United States Patent 11,446,398 (REGULATED BIOCIRCUIT SYSTEMS) - sequence listing, part 91

SEQ ID NO: 199200 - DNA, 2650 bp, Homo sapiens
  Payload ID: 19297
  Gene Name: vitrin
  ENST ID: ENST00000497382
  CDS Start-End: 1181-2224
gttcgattagctcctctgagaagaagagaaaaggttcttggacctctccctgtttcttccttagaataatttggatgggatttgtgatgcaggaaagcctaagggaaaaagaatattcattctgtgtggtgaaaattttttgaaaaaaaaattgccttcttcaaacaagggtgtcattctgatatttatgaggactgttgttctcactatgaaggcatctgttattgaaatgttccttgttttgctggtgactggagtacattcaaacaaagaaacggcaaagaagattaaaaggcccaagttcactgtgcctcagatcaactgcgatgtcaaagccggaaagatcatcgatcctgagttcattgtgaaatgtccagcaggatgccaagaccccaaataccatgtttatggcactgacgtgtatgcatcctactccagtgtgtgtggcgctgccgtacacagtggtgtgcttgataattcaggagggaaaatacttgttcggaaggttgctggacagtctggttacaaagggagttattccaacggtgtccaatcgttatccctaccacgatggagagaatcctttatcgtcttagaaagtaaacccaaaaagggtgtaacctacccatcagctcttacatactcatcatcgaaaagtccagctgcccaagcaggtgagaccacaaaagcctatcagaggccacctattccagggacaactgcacagccggtcactctgatgcagcttctggctgtcactgtagctgtggccacccccaccaccttgccaaggccatccccttctgctgcttctaccaccagcatccccagaccacaatcagtgggccacaggagccaggagatggatctctggtccactgccacctacacaagcagccaaaacaggcccagagctgatccaggtatccaaaggcaagatccttcaggagctgccttccagaaacctgttggagcggatgtcagcctgggacttgttccaaaagaagaattgagcacacagtctttggagccagtatccctgggagatccaaactgcaaaattgacttgtcgtttttaattgatgggagcaccagcattggcaaacggcgattccgaatccagaagcagctcctggctgatgttgcccaagctcttgacattggccctgccggtccactgatgggtgttgtccagtatggagacaaccctgctactcactttaacctcaagacacacacgaattctcgagatctgaagacagccatagagaaaattactcagagaggaggactttctaatgtaggtcgggccatctcctttgtgaccaagaacttcttttccaaagccaatggaaacagaagcggggctcccaatgtggtggtggtgatggtggatggctggcccacggacaaagtggaggaggcttcaagacttgcgagagagtcaggaatcaacattttcttcatcaccattgaaggtgctgctgaaaatgagaagcagtatgtggtggagcccaactttgcaaacaaggccgtgtgcagaacaaacggcttctactcgctccacgtgcagagctggtttggcctccacaagaccctgcagcctctggtgaagcgggtctgcgacactgaccgcctggcctgcagcaagacctgcttgaactcggctgacattggcttcgtcatcgacggctccagcagtgtggggacgggcaacttccgcaccgtcctccagtttgtgaccaacctcaccaaagagtttgagatttccgacacggacacgcgcatcggggccgtgcagtacacctacgaacagcggctggagtttgggttcgacaagtacagcagcaagcctgacatcctcaacgccatcaagagggtgggctactggagtggtggcaccagcacgggggctgccatcaacttcgccctggagcagctcttcaagaagtccaagcccaacaagaggaagttaatgatcctcatcaccgacgggaggtcctacgacgacgtccggatcccagccatggctgcccatctgaagggagtgatcacctatgcgataggcgttgcctgggctgcccaagaggagctagaagtcattgccactcaccccgccagagaccactccttctttgtggacgagtttgacaacctccatcagtatgtccccaggatcatccagaacatttgtacagagttcaactcacagcctcggaactgaattcagagcaggcagagcaccagcaagtgctgctttactaactgacgtgttggaccaccccaccgcttaatggggcacgcacggtgcatcaagtcttgggcagggcatggagaaacaaatgtcttgttattattctttgccatcatgctttttcatattccaaaacttggagttacaaagatgatcacaaacgtatagaatgagccaaaaggctacatcatgttgagggtgctggagattttacattttgacaattgttttcaaaataaatgttcggaatacagtgcagcccttacgacaggcttacgtagagcttttgtgagatttttaagttgttatttctgattagaactctgtaaccctcagcaagtttcatttttgtcatgacaatgtaggaattgctgaattaaatgtttagaaggatga

SEQ ID NO: 199201 - DNA, 579 bp, Homo sapiens
  Payload ID: 19297
  Gene Name: vitrin
  ENST ID: ENST00000464309
  CDS Start-End: 1-404
acacaagcagccaaaacaggcccagagctgatccaggtatccaaaggcaagatccttcaggagctgccttccagaaacctgttggagcggatgtcagcctgggacttgttccaaaagaagaattgagcacacagtctttggagccagtatccctgggagatccaaactgcaaaattgacttgtcgtttttaattgatgggagcaccagcattggcaaacggcgattccgaatccagaagcagctcctggctgatgttgcccaagctcttgacattggccctgccggtccactgatgggtgttgtccagtatgggcccctgcactggtactggaaaaactcaccaggcaatggagaagaatgggtgggaagagagacggcccccatcagtcagctgagcacctagatgactttcgccaacctgctctattattatacttaggatagaaatggagggctcgtgttgacatccagtctcaatctttcatttggcggtaataaatcactcttatttcagatatgaataggtttctcactgaaacagatacatagatattgataataaacaatcaaaagaacaa

SEQ ID NO: 199202 - DNA, 2149 bp, Homo sapiens
  Payload ID: 19298
  Gene Name: vitronectin
  Uniprot ID: P04004
  ENST ID: ENST00000226218
  CDS Start-End: 620-2056
ctttgttcttttatgctaaaaaataaaattccccagagtgcttacaatctctcctcccactccctttttcctgccctaaataaataatggcgaatgagcacccagccagggatgtgtctgatcaaacaatcatggatcaatagctatgtttggagaaggaatttgtggctgctccagctactgggcattttgtctggtccagttcatgtaatctcccaacaccccatgaagcaaggctttgttaatcctattttactgaaaatgaactaagactcagagagataaagctgttgcccaatgagccttctttctgccctccagatccacggtgctaattccccttccgatgacctaatgattctgagcttggcaaaggtcttatctcccagctcgcccaggcccagtgttccaggaatgtgacctttgctgcagcagccgctggagggggcagaggggatgggctggaggttgagcaaacagagcagcagaaaaggcagttcctcttctccagtgccctccttccctgtctctgcctctccctcccttcctcaggcatcagagcggagacttcagggagaccagagcccagcttgccaggcactgagctagaagccctgccatggcacccctgagaccccttctcatactggccctgctggcatgggttgctctggctgaccaagagtcatgcaagggccgctgcactgagggcttcaacgtggacaagaagtgccagtgtgacgagctctgctcttactaccagagctgctgcacagactatacggctgagtgcaagccccaagtgactcgcggggatgtgttcactatgccggaggatgagtacacggtctatgacgatggcgaggagaaaaacaatgccactgtccatgaacaggtggggggcccctccctgacctctgacctccaggcccagtccaaagggaatcctgagcagacacctgttctgaaacctgaggaagaggcccctgcgcctgaggtgggcgcctctaagcctgaggggatagactcaaggcctgagacccttcatccagggagacctcagcccccagcagaggaggagctgtgcagtgggaagcccttcgacgccttcaccgacctcaagaacggttccctctttgccttccgagggcagtactgctatgaactggacgaaaaggcagtgaggcctgggtaccccaagctcatccgagatgtctggggcatcgagggccccatcgatgccgccttcacccgcatcaactgtcaggggaagacctacctcttcaagggtagtcagtactggcgctttgaggatggtgtcctggaccctgattacccccgaaatatctctgacggcttcgatggcatcccggacaacgtggatgcagccttggccctccctgcccatagctacagtggccgggagcgggtctacttcttcaaggggaaacagtactgggagtaccagttccagcaccagcccagtcaggaggagtgtgaaggcagctccctgtcggctgtgtttgaacactttgccatgatgcagcgggacagctgggaggacatcttcgagcttctcttctggggcagaacctctgctggtaccagacagccccagttcattagccgggactggcacggtgtgccagggcaagtggacgcagccatggctggccgcatctacatctcaggcatggcaccccgcccctccttggccaagaaacaaaggtttaggcatcgcaaccgcaaaggctaccgttcacaacgaggccacagccgtggccgcaaccagaactcccgccggccatcccgcgccacgtggctgtccttgttctccagtgaggagagcaacttgggagccaacaactatgatgactacaggatggactggcttgtgcctgccacctgtgaacccatccagagtgtcttcttcttctctggagacaagtactaccgagtcaatcttcgcacacggcgagtggacactgtggaccctccctacccacgctccatcgctcagtactggctgggctgcccagctcctggccatctgtaggagtcagagcccacatggccgggccctctgtagctccctcctcccatctccttcccccagcccaataaaggtcccttagccccgagtttaaaa

SEQ ID NO: 199203 - DNA, 501 bp, Homo sapiens
  Payload ID: 19298
  Gene Name: vitronectin
  ENST ID: ENST00000542029
  CDS Start-End: 148-501
agaatgagatcatgtctggcctgttgcaagaaccagaatgaaggatggagcagaagttggattggggcggcaagaagggagcatcagagcggagacttcagggagaccagagcccagcttgccaggcactgagctagaagccctgccatggcacccctgagaccccttctcatactggccctgctggcatgggttgctctggctgaccaagagtcatgcaagggccgctgcactgagggcttcaacgtggacaagaagtgccagtgtgacgagctctgctcttactaccagagctgctgcacagactatacggctgagtgcaagccccaagtgactcgcggggatgtgttcactatgccggaggatgagtacacggtctatgacgatggcgaggagaaaaacaatgccactgtccatgaacaggtggggggcccctccctgacctctgacctccaggcccagtccaaagggaatcctgagcagacacctgttctgaaacct

SEQ ID NO: 199204 - DNA, 5186 bp, Homo sapiens
  Payload ID: 19299
  Gene Name: v-kit Hardy-Zuckerman 4 feline sarcoma viral oncogene homolog
  Uniprot ID: P10721
  ENST ID: ENST00000288135
  CDS Start-End: 98-3028
cgctcgcggctctgggggctcggctttgccgcgctcgctgcacttgggcgagagctggaacgtggaccagagctcggatcccatcgcagctaccgcgatgagaggcgctcgcggcgcctgggattttctctgcgttctgctcctactgcttcgcgtccagacaggctcttctcaaccatctgtgagtccaggggaaccgtctccaccatccatccatccaggaaaatcagacttaatagtccgcgtgggcgacgagattaggctgttatgcactgatccgggctttgtcaaatggacttttgagatcctggatgaaacgaatgagaataagcagaatgaatggatcacggaaaaggcagaagccaccaacaccggcaaatacacgtgcaccaacaaacacggcttaagcaattccatttatgtgtttgttagagatcctgccaagcttttccttgttgaccgctccttgtatgggaaagaagacaacgacacgctggtccgctgtcctctcacagacccagaagtgaccaattattccctcaaggggtgccaggggaagcctcttcccaaggacttgaggtttattcctgaccccaaggcgggcatcatgatcaaaagtgtgaaacgcgcctaccatcggctctgtctgcattgttctgtggaccaggagggcaagtcagtgctgtcggaaaaattcatcctgaaagtgaggccagccttcaaagctgtgcctgttgtgtctgtgtccaaagcaagctatcttcttagggaaggggaagaattcacagtgacgtgcacaataaaagatgtgtctagttctgtgtactcaacgtggaaaagagaaaacagtcagactaaactacaggagaaatataatagctggcatcacggtgacttcaattatgaacgtcaggcaacgttgactatcagttcagcgagagttaatgattctggagtgttcatgtgttatgccaataatacttttggatcagcaaatgtcacaacaaccttggaagtagtagataaaggattcattaatatcttccccatgataaacactacagtatttgtaaacgatggagaaaatgtagatttgattgttgaatatgaagcattccccaaacctgaacaccagcagtggatctatatgaacagaaccttcactgataaatgggaagattatcccaagtctgagaatgaaagtaatatcagatacgtaagtgaacttcatctaacgagattaaaaggcaccgaaggaggcacttacacattcctagtgtccaattctgacgtcaatgctgccatagcatttaatgtttatgtgaatacaaaaccagaaatcctgacttacgacaggctcgtgaatggcatgctccaatgtgtggcagcaggattcccagagcccacaatagattggtatttttgtccaggaactgagcagagatgctctgcttctgtactgccagtggatgtgcagacactaaactcatctgggccaccgtttggaaagctagtggttcagagttctatagattctagtgcattcaagcacaatggcacggttgaatgtaaggcttacaacgatgtgggcaagacttctgcctattttaactttgcatttaaaggtaacaacaaagagcaaatccatccccacaccctgttcactcctttgctgattggtttcgtaatcgtagctggcatgatgtgcattattgtgatgattctgacctacaaatatttacagaaacccatgtatgaagtacagtggaaggttgttgaggagataaatggaaacaattatgtttacatagacccaacacaacttccttatgatcacaaatgggagtttcccagaaacaggctgagttttgggaaaaccctgggtgctggagctttcgggaaggttgttgaggcaactgcttatggcttaattaagtcagatgcggccatgactgtcgctgtaaagatgctcaagccgagtgcccatttgacagaacgggaagccctcatgtctgaactcaaagtcctgagttaccttggtaatcacatgaatattgtgaatctacttggagcctgcaccattggagggcccaccctggtcattacagaatattgttgctatggtgatcttttgaattttttgagaagaaaacgtgattcatttatttgttcaaagcaggaagatcatgcagaagctgcactttataagaatcttctgcattcaaaggagtcttcctgcagcgatagtactaatgagtacatggacatgaaacctggagtttcttatgttgtcccaaccaaggccgacaaaaggagatctgtgagaataggctcatacatagaaagagatgtgactcccgccatcatggaggatgacgagttggccctagacttagaagacttgctgagcttttcttaccaggtggcaaagggcatggctttcctcgcctccaagaattgtattcacagagacttggcagccagaaatatcctccttactcatggtcggatcacaaagatttgtgattttggtctagccagagacatcaagaatgattctaattatgtggttaaaggaaacgctcgactacctgtgaagtggatggcacctgaaagcattttcaactgtgtatacacgtttgaaagtgacgtctggtcctatgggatttttctttgggagctgttctctttaggaagcagcccctatcctggaatgccggtcgattctaagttctacaagatgatcaaggaaggcttccggatgctcagccctgaacacgcacctgctgaaatgtatgacataatgaagacttgctgggatgcagatcccctaaaaagaccaacattcaagcaaattgttcagctaattgagaagcagatttcagagagcaccaatcatatttactccaacttagcaaactgcagccccaaccgacagaagcccgtggtagaccattctgtgcggatcaattctgtcggcagcaccgcttcctcctcccagcctctgcttgtgcacgacgatgtctgagcagaatcagtgtttgggtcacccctccaggaatgatctcttcttttggcttccatgatggttattttcttttctttcaacttgcatccaactccaggatagtgggcaccccactgcaatcctgtctttctgagcacactttagtggccgatgatttttgtcatcagccaccatcctattgcaaaggttccaactgtatatattcccaatagcaacgtagcttctaccatgaacagaaaacattctgatttggaaaaagagagggaggtatggactgggggccagagtcctttccaaggcttctccaattctgcccaaaaatatggttgatagtttacctgaataaatggtagtaatcacagttggccttcagaaccatccatagtagtatgatgatacaagattagaagctgaaaacctaagtcctttatgtggaaaacagaacatcattagaacaaaggacagagtatgaacacctgggcttaagaaatctagtatttcatgctgggaatgagacataggccatgaaaaaaatgatccccaagtgtgaacaaaagatgctcttctgtggaccactgcatgagcttttatactaccgacctggtttttaaatagagtttgctattagagcattgaattggagagaaggcctccctagccagcacttgtatatacgcatctataaattgtccgtgttcatacatttgaggggaaaacaccataaggtttcgtttctgtatacaaccctggcattatgtccactgtgtatagaagtagattaagagccatataagtttgaaggaaacagttaataccattttttaaggaaacaatataaccacaaagcacagtttgaacaaaatctcctcttttagctgatgaacttattctgtagattctgtggaacaagcctatcagcttcagaatggcattgtactcaatggatttgatgctgtttgacaaagttactgattcactgcatggctcccacaggagtgggaaaacactgccatcttagtttggattcttatgtagcaggaaataaagtataggtttagcctccttcgcaggcatgtcctggacaccgggccagtatctatatatgtgtatgtacgtttgtatgtgtgtagacaaatatttggaggggtatttttgccctgagtccaagagggtcctttagtacctgaaaagtaacttggctttcattattagtactgctcttgtttcttttcacatagctgtctagagtagcttaccagaagcttccatagtggtgcagaggaagtggaaggcatcagtccctatgtatttgcagttcacctgcacttaaggcactctgttatttagactcatcttactgtacctgttccttagaccttccataatgctactgtctcactgaaacatttaaattttaccctttagactgtagcctggatattattcttgtagtttacctctttaaaaacaaaacaaaacaaaacaaaaaactccccttcctcactgcccaatataaaaggcaaatgtgtacatggcagagtttgtgtgttgtcttgaaagattcaggtatgttgcctttatggtttcccccttctacatttcttagactacatttagagaactgtggccgttatctggaagtaaccatttgcactggagttctatgctctcgcacctttccaaagttaacagattttggggttgtgttgtcacccaagagattgttgtttgccatactttgtctgaaaaattcctttgtgtttctattgacttcaatgatagtaagaaaagtggttgttagttatagatgtctaggtacttcaggggcacttcattgagagttttgtcttggatattcttgaaagtttatatttttataattttttcttacatcagatgtttctttgcagtggcttaatgtttgaaattattttgtggctttttttgtaaatattgaaatgtagcaataatgtcttttgaatattcccaagcccatgagtccttgaaaatattttttatatatacagtaactttatgtgtaaatacataagcggcgtaagtttaaaggatgttggtgttccacgtgttttattcctgtatgttgtccaattgttgacagttctgaagaattctaataaaatgtacatatataaatcaa

SEQ ID NO: 199205 - DNA, 3470 bp, Homo sapiens
  Payload ID: 19299
  Gene Name: v-kit Hardy-Zuckerman 4 feline sarcoma viral oncogene homolog
  Uniprot ID: P10721
  ENST ID: ENST00000412167
  CDS Start-End: 98-3016
cgctcgcggctctgggggctcggctttgccgcgctcgctgcacttgggcgagagctggaacgtggaccagagctcggatcccatcgcagctaccgcgatgagaggcgctcgcggcgcctgggattttctctgcgttctgctcctactgcttcgcgtccagacaggctcttctcaaccatctgtgagtccaggggaaccgtctccaccatccatccatccaggaaaatcagacttaatagtccgcgtgggcgacgagattaggctgttatgcactgatccgggctttgtcaaatggacttttgagatcctggatgaaacgaatgagaataagcagaatgaatggatcacggaaaaggcagaagccaccaacaccggcaaatacacgtgcaccaacaaacacggcttaagcaattccatttatgtgtttgttagagatcctgccaagcttttccttgttgaccgctccttgtatgggaaagaagacaacgacacgctggtccgctgtcctctcacagacccagaagtgaccaattattccctcaaggggtgccaggggaagcctcttcccaaggacttgaggtttattcctgaccccaaggcgggcatcatgatcaaaagtgtgaaacgcgcctaccatcggctctgtctgcattgttctgtggaccaggagggcaagtcagtgctgtcggaaaaattcatcctgaaagtgaggccagccttcaaagctgtgcctgttgtgtctgtgtccaaagcaagctatcttcttagggaaggggaagaattcacagtgacgtgcacaataaaagatgtgtctagttctgtgtactcaacgtggaaaagagaaaacagtcagactaaactacaggagaaatataatagctggcatcacggtgacttcaattatgaacgtcaggcaacgttgactatcagttcagcgagagttaatgattctggagtgttcatgtgttatgccaataatacttttggatcagcaaatgtcacaacaaccttggaagtagtagataaaggattcattaatatcttccccatgataaacactacagtatttgtaaacgatggagaaaatgtagatttgattgttgaatatgaagcattccccaaacctgaacaccagcagtggatctatatgaacagaaccttcactgataaatgggaagattatcccaagtctgagaatgaaagtaatatcagatacgtaagtgaacttcatctaacgagattaaaaggcaccgaaggaggcacttacacattcctagtgtccaattctgacgtcaatgctgccatagcatttaatgtttatgtgaatacaaaaccagaaatcctgacttacgacaggctcgtgaatggcatgctccaatgtgtggcagcaggattcccagagcccacaatagattggtatttttgtccaggaactgagcagagatgctctgcttctgtactgccagtggatgtgcagacactaaactcatctgggccaccgtttggaaagctagtggttcagagttctatagattctagtgcattcaagcacaatggcacggttgaatgtaaggcttacaacgatgtgggcaagacttctgcctattttaactttgcatttaaagagcaaatccatccccacaccctgttcactcctttgctgattggtttcgtaatcgtagctggcatgatgtgcattattgtgatgattctgacctacaaatatttacagaaacccatgtatgaagtacagtggaaggttgttgaggagataaatggaaacaattatgtttacatagacccaacacaacttccttatgatcacaaatgggagtttcccagaaacaggctgagttttgggaaaaccctgggtgctggagctttcgggaaggttgttgaggcaactgcttatggcttaattaagtcagatgcggccatgactgtcgctgtaaagatgctcaagccgagtgcccatttgacagaacgggaagccctcatgtctgaactcaaagtcctgagttaccttggtaatcacatgaatattgtgaatctacttggagcctgcaccattggagggcccaccctggtcattacagaatattgttgctatggtgatcttttgaattttttgagaagaaaacgtgattcatttatttgttcaaagcaggaagatcatgcagaagctgcactttataagaatcttctgcattcaaaggagtcttcctgcagcgatagtactaatgagtacatggacatgaaacctggagtttcttatgttgtcccaaccaaggccgacaaaaggagatctgtgagaataggctcatacatagaaagagatgtgactcccgccatcatggaggatgacgagttggccctagacttagaagacttgctgagcttttcttaccaggtggcaaagggcatggctttcctcgcctccaagaattgtattcacagagacttggcagccagaaatatcctccttactcatggtcggatcacaaagatttgtgattttggtctagccagagacatcaagaatgattctaattatgtggttaaaggaaacgctcgactacctgtgaagtggatggcacctgaaagcattttcaactgtgtatacacgtttgaaagtgacgtctggtcctatgggatttttctttgggagctgttctctttaggaagcagcccctatcctggaatgccggtcgattctaagttctacaagatgatcaaggaaggcttccggatgctcagccctgaacacgcacctgctgaaatgtatgacataatgaagacttgctgggatgcagatcccctaaaaagaccaacattcaagcaaattgttcagctaattgagaagcagatttcagagagcaccaatcatatttactccaacttagcaaactgcagccccaaccgacagaagcccgtggtagaccattctgtgcggatcaattctgtcggcagcaccgcttcctcctcccagcctctgcttgtgcacgacgatgtctgagcagaatcagtgtttgggtcacccctccaggaatgatctcttcttttggcttccatgatggttattttcttttctttcaacttgcatccaactccaggatagtgggcaccccactgcaatcctgtctttctgagcacactttagtggccgatgatttttgtcatcagccaccatcctattgcaaaggttccaactgtatatattcccaatagcaacgtagcttctaccatgaacagaaaacattctgatttggaaaaagagagggaggtatggactgggggccagagtcctttccaaggcttctccaattctgcccaaaaatatggttgatagtttacctgaataaatggtagtaatcacagttggccttcagaaccatccatagtagtatgatgatacaagattagaagctgaaaacctaagtcctttatgtggaaaacagaacatcattaga

SEQ ID NO: 199206 - DNA, 4717 bp, Homo sapiens
  Payload ID: 19300
  Gene Name: VMA21 vacuolar H+-ATPase homolog (S. cerevisiae)
  Uniprot ID: Q3ZAQ7
  ENST ID: ENST00000330374
  CDS Start-End: 106-411
ctacttccggtgcgaaccgcctcggccgttccctcgcggagcttactgagcgcggccgccgagcccagctccgccgccgagcgcctgtgccggcacggctacaccatggagcgcccggataaggcggcgctgaacgcactgcagcctcctgagttcagaaatgaaagctcattagcatctacactgaagacgctcctgttcttcacagctttaatgatcactgttcctattgggttatatttcacaactaaatcttacatatttgaaggcgcccttgggatgtccaatagggacagctatttttacgctgctattgttgcagtggtcgccgtccatgtggtgctggccctctttgtgtatgtggcctggaatgaaggctcacgacagtggcgtgaaggcaaacaggattaaagtgaacatcacctttttatagcattaaattcattttttaaaatgataaatgctggagggggccatctgatttgaataaagttgaaagaacatgttaaagtcagtcttaaggagtcacgtttgagtatgtaaattttgatctttctaatatgttggtttgtatattcagttttaactgtatgaatctgatttgcaaatgagaatttggaaaagttagttacaaagaaatatgttaatttaattagacaatactctggaaggaattttatcttctttcaacaaaacatgttttatagtattctgacttacggttgcttttgagttttactcatttggatatattaagatgcacacagtgaagcaaattaaactccactttacgctggaatgctttctttagcatgaaaataccaggtccttggatttgggattttaatttcctatggaaagttgcttaaattgtggacactggaattaatctgaatgtcactgaggaatttcacatgaagtgtaatccctagtcaataagaattatccattacattattttatgggaaaactaggctaaattacatccattcaggtaaaaggaccttagcttactgaaggatctaaagagcaaagcaaagatctcactactcaaacactcagcctgcttccttcaagtccccttgcaggccagctttgtgctttgcagaccaactttttaatgagatactttgcttcctcattcaacattgaagctaggcttcaattaaaaggttcgaggaagctccatttaaaattgttttttttactattttttaaaattgtagtgtatatgataggaatttgcatttaaatatgttcatttttgcatatgttaggagtggaaacaatctggaaaacatttttttttcatccaaaaagtattctccttgggcatatctgatggaaaaaaaccttgattttattttcgtatctttagtctgtgttctttctagttatttggtactaattatgtgcaatctaaaaacactcccacaagtatttgttttttaattataaaatcatagtatatgttctttgtagaaaactggaaaaatacatattcaaacaggaaaaaaaatcaaaattccccataatgttgccatctaaaaataacctctattttagttgatatcccgtattcatttttgaaagccattccttaatgctagtttgatacacactaaaagtttagcttacaagttcaaattctgccagcttttcctgacagctatttgcatttttttcagatgagtgattattggccattttctttttctttttctttattttatttatttatttttttgagacagagttttgctctgttgcccaggctggagtgcagtggtgcaatctcggctcactgcaacctctgcctcctgggttcaagtgattctccacctcagcctcccaagtagctgggactacggatgcctgccaccacgcctggctaatttttttttgtatttttttgtagagacggggtttcaccatgttgtccaggctaatcttgaacttgtgacctcaggtgatccacccgcctcggcctccgaaagtgctgggattacaggcgtgagctaccacgcccggccttattgaccattttctaaataagcacattctatctttattctcttaaaattcaaattttctgttactgataatcctaatactaggattcttgcttaagtatgtgaaaccattaccgatttgttgttcacatttattttttatgttgtgaaactggactaaaggaatagagggatgattagtcataaaagtcaaatagcatttgtgtttaactgttgagaaaagtgaaagatcagtatgattattatggaactgtttttaattcttgcttaaagactacaattttagtataatgacatttgagtctagggtagtatgtggtagatttctagatggtccctaattaagaagtattgttgtatttagaattgtccacctaatttctttttatataatgccaaggtatttcttgtgcttttgggatcttatgctgtttgtaaaatgttactgtccaatgttggattattgttttggtttcaggcatttgctgaataggtgatgatacatgggtatttttctgcaagtatttaaaccaggggcatatgcaaaggcagttgtaatttcctcttggaaaaagcgccaaatgtttgaaggttaaaatcaaatgctagggttgatatttaggcttataacaaaataggcttgttttcaaagcagttttttcctagagttttaactgttaactcactagtttgctgctgtttttaactatgttaaataacatatggtatttggcaaatagatttatttttcaaaatgtctcactagtttccttttacacaatgtatatacttcaagatgtatagaaaggaaagctacagttgagcccttatacatgttttaaggtagaaatatgttccctattgtttgaaaactgattgtaagaataacctcagttaggagatataacttgaagtgtcagtccaaactactgatttaaccctatttacggtaacacattaccttcctcacctcctgtttggccctggagaatgtagtcctttttctcatttgtgttgagaaatgaaaagtctgctgtagaatgtatctgatgtcattagttcttcaaatggataccattgtacatataacagtagaatttggtttggggttgttagtgaaaaaaaatttaaacctgccattaaaaatccccatgtttcatggaaatctaacagaaatacattgtaataattagaacattttgttttcttttttctttttttttttttcgagacggagttttgcccttcttgcccaggctggagtgcaagggcgcaatctcggctcgctgcaacctccgcctcccgggttcaagcagttctcctgcctcagccccctgagtacctcagatgacaggtgcgtgccaccacacccggctaatttttgtatttttagtagagacggggtttcaccatgttagccaggctagtctcgaactcctgacctcaggtgatccacccgcctccgcctcccaaagtgctgggattacaggtatcagccaccgtgcctggcctaataattggaacattttcatcatgaaaatgtcatcagctttgccaaaagaaacaaccaattgacttgtttggcgtttgttttccattttcatgtcaattttatgtatacagttagaatacccaaggagaccactaaaatcagttaaacaagtagggtatatacaaagaaagatgaaacccgaaagtacataaaaaggatttaaatccgattttagatgtacctagtgtgtatttcttatctctagacaagttcatgtttattgtttaatttatgcccaagtgaagttgtaaacttatggttcaactctgacacagaatttgtcacttgtctgaggtcagtggcaggtttctctgctgtcaagcactctgtgtcacccaccagattagtataactattaattcagactgtactcctatgtttaagataatttttacaagagctggctgaagcagcacattagtaacctgacaagatttctttttcccttttcagggggaaagggtcaccttaaaaataaattattttcagggactttgggaatctaatgataaatattacacataatctatgaatagcttaatcctttatatattccttaaaataggaattcctcgacatcactcctggccacactttccttgcctgtgttgttgctatgtgtatttgaaagtaatatctgcattccttttaagatgttctgtaagtcatatttgtcagttatacagagtagtcttccttttccccacgttcagtgtaatctcactgaacagtaataatagcaatagctaacaacatctgcacagcaccttacagtttgcaaagaacgttcacacattctcatttgagttttgcatagtgaacctgttacgagatgtctcttgacgtcgatgctaaaagtgttagaatctttacatcactagagtcattgaatatgctgtagtattgaatagtgccctgactagggggaggatttggatgtgctgcatttcaagccgtgtataatcatcaaaatggggggcttgagttctttagctacttgaatccgatttacttctgttaagtgatgcttttctaaccgttttctggatggattttgtattcactatattgtagcttgtaatttgtataaatgtaccatctgatgtcattaaaaaaagtgtttgtagtgcta

SEQ ID NO: 199207 - DNA, 693 bp, Homo sapiens
  Payload ID: 19300
  Gene Name: VMA21 vacuolar H+-ATPase homolog (S. cerevisiae)
  Uniprot ID: Q3ZAQ7
  ENST ID: ENST00000370361
  CDS Start-End: 124-594
gggtcactggcatcgagtctggaacagtcattctcagcaagagctctttgaactctgacattctctagttttacggactcggcaccacagccctctggctggtagtccctcttcgcggctcatatgctcgggtctccttgcggcccccagctcagcgaccgagacgcagacgaggaccagtgttcacgcgagttcagggggcggcgtagccgccgcccgcccaggaggaccatgttgcgcggcaagtcccggctcaacgtggagtggctgggctactcgccaggcctgctcctcgagcacaggcccctcctggcagggcgcacgccgcggagccaccgccgaaatgaaagctcattagcatctacactgaagacgctcctgttcttcacagctttaatgatcactgttcctattgggttatatttcacaactaaatcttacatatttgaaggcgcccttgggatgtccaatagggacagctatttttacgctgctattgttgcagtggtcgccgtccatgtggtgctggccctctttgtgtatgtggcctggaatgaaggctcacgacagtggcgtgaaggcaaacaggattaaagtgaacatcacctttttatagcattaaattcattttttaaaatgataaatgctggagggggccatctgatttgaataaagttgaaagaacatgttaaa

SEQ ID NO: 199208 - DNA, 2646 bp, Homo sapiens
  Payload ID: 19301
  Gene Name: v-maf avian musculoaponeurotic fibrosarcoma oncogene homolog
  Uniprot ID: O75444
  ENST ID: ENST00000326043
  CDS Start-End: 813-2024
atcttttttcatcttctagctgtagctcgggctgcttgtcggcttggcctccccctcccccctttgctctctgcctcgtctttccccaggacttcgctattttgcttttttaaaaaaaggcaagaaagaactaaactcccccctccctctcctccagtcgggctgcacctctgccttgcactttgcacagaggtagagagcgcgcgagggagagagaggaaagaaaaaaaataataaagagagccaagcagaagaggaggcgagaagcatgaagtgttaactcccccgtgccaaggcccgcgccgcccggacagacgcccgccgcgcctccagccccgagcggacgccgcgcgcgccctgcctgcagcccgggccggcgaggcgagcccttccttatgcaaagcgcgcagcggagcggcgagcgggggacgccgcgcaccgggccgggctcctccagcttcgccgccgcagccaccaccgccgccaccgcagctcgcggaggatcttcccgagcctgaagccgccggctcggcgcgcaaggaggcgagcgagcaaggaggggccggggcgagcgagggagcacattggcgtgagcaggggggagggagggcgggcgcggggggcgcgggcagggcgggggggtgtgtgtgtgagcgcgctcggaggtttcgggccagccaccgccgcgcaagctagaagcgccccagcccggcaagctggctcacccgctggccacccagcacagcccgctggcccctctcctgcagcccatctggcggagcggcggcggcggcggcggcggcggcaggagaatggcatcagaactggcaatgagcaactccgacctgcccaccagtcccctggccatggaatatgttaatgacttcgatctgatgaagtttgaagtgaaaaaggaaccggtggagaccgaccgcatcatcagccagtgcggccgtctcatcgccgggggctcgctgtcctccacccccatgagcacgccgtgcagctcggtgcccccttcccccagcttctcggcgcccagcccgggctcgggcagcgagcagaaggcgcacctggaagactactactggatgaccggctacccgcagcagctgaaccccgaggcgctgggcttcagccccgaggacgcggtcgaggcgctcatcagcaacagccaccagctccagggcggcttcgatggctacgcgcgcggggcgcagcagctggccgcggcggccggggccggtgccggcgcctccttgggcggcagcggcgaggagatgggccccgccgccgccgtggtgtccgccgtgatcgccgcggccgccgcgcagagcggcgcgggcccgcactaccaccaccaccaccaccacgccgccggccaccaccaccacccgacggccggcgcgcccggcgccgcgggcagcgcggccgcctcggccggtggcgctgggggcgcgggcggcggtggcccggccagcgctgggggcggcggcggcggcggcggcggcggaggcggcgggggcgcggcgggggcggggggcgccctgcacccgcaccacgccgccggcggcctgcacttcgacgaccgcttctccgacgagcagctggtgaccatgtctgtgcgcgagctgaaccggcagctgcgcggggtcagcaaggaggaggtgatccggctgaagcagaagaggcggaccctgaaaaaccgcggctatgcccagtcctgccgcttcaagagggtgcagcagagacacgtcctggagtcggagaagaaccagctgctgcagcaagtcgaccacctcaagcaggagatctccaggctggtgcgcgagagggacgcgtacaaggagaaatacgagaagttggtgagcagcggcttccgagaaaacggctcgagcagcgacaacccgtcctctcccgagtttttcataactgagcccactcgcaagttggagccatcagtgggatacgccacattttggaagccccagcatcgtgtacttaccagtgtgttcacaaaatgaaatttgtgtgagagctgtacattaaaaaaaatcatcattattattattatttgcagtcatggagaaccacctacccctgacttctgtttagtctcctttttaaataaaaattactgtgttagagaagaaggctattaaatgtagtagttaactatgcctcttgtctgggggtttcatagagaccggtaggaaagcgcactcctgcttttcgatttatggtgtgtgcaagtaaacaggtgcattgctttcaacctgccatactagttttaaaaattcactgaaattacaaagatacatatatatgcatatatataatggaaagtttcccggaatgcaacaattagcattttaaaatcatatataggcatgcacattctaaatagtactttttcatgcttcattgtttctctggcagataattttactaagaagaaaaatagatattcgactccccttccctaaacaaatccacgggcagaggctccagcggagccgagccccctggttttctcgtaggccctagacggtgttgcatttatcagtgatgtcaaacgtgctcatttgtcagacatagctgtaaatgaaaacaatgtgtggcaaaatacaaagttagttaaataca

SEQ ID NO: 199209 - DNA, 6384 bp, Homo sapiens
  Payload ID: 19301
  Gene Name: v-maf avian musculoaponeurotic fibrosarcoma oncogene homolog
  Uniprot ID: O75444
  ENST ID: ENST00000393350
  CDS Start-End: 813-1934
atcttttttcatcttctagctgtagctcgggctgcttgtcggcttggcctccccctcccccctttgctctctgcctcgtctttccccaggacttcgctattttgcttttttaaaaaaaggcaagaaagaactaaactcccccctccctctcctccagtcgggctgcacctctgccttgcactttgcacagaggtagagagcgcgcgagggagagagaggaaagaaaaaaaataataaagagagccaagcagaagaggaggcgagaagcatgaagtgttaactcccccgtgccaaggcccgcgccgcccggacagacgcccgccgcgcctccagccccgagcggacgccgcgcgcgccctgcctgcagcccgggccggcgaggcgagcccttccttatgcaaagcgcgcagcggagcggcgagcgggggacgccgcgcaccgggccgggctcctccagcttcgccgccgcagccaccaccgccgccaccgcagctcgcggaggatcttcccgagcctgaagccgccggctcggcgcgcaaggaggcgagcgagcaaggaggggccggggcgagcgagggagcacattggcgtgagcaggggggagggagggcgggcgcggggggcgcgggcagggcgggggggtgtgtgtgtgagcgcgctcggaggtttcgggccagccaccgccgcgcaagctagaagcgccccagcccggcaagctggctcacccgctggccacccagcacagcccgctggcccctctcctgcagcccatctggcggagcggcggcggcggcggcggcggcggcaggagaatggcatcagaactggcaatgagcaactccgacctgcccaccagtcccctggccatggaatatgttaatgacttcgatctgatgaagtttgaagtgaaaaaggaaccggtggagaccgaccgcatcatcagccagtgcggccgtctcatcgccgggggctcgctgtcctccacccccatgagcacgccgtgcagctcggtgcccccttcccccagcttctcggcgcccagcccgggctcgggcagcgagcagaaggcgcacctggaagactactactggatgaccggctacccgcagcagctgaaccccgaggcgctgggcttcagccccgaggacgcggtcgaggcgctcatcagcaacagccaccagctccagggcggcttcgatggctacgcgcgcggggcgcagcagctggccgcggcggccggggccggtgccggcgcctccttgggcggcagcggcgaggagatgggccccgccgccgccgtggtgtccgccgtgatcgccgcggccgccgcgcagagcggcgcgggcccgcactaccaccaccaccaccaccacgccgccggccaccaccaccacccgacggccggcgcgcccggcgccgcgggcagcgcggccgcctcggccggtggcgctgggggcgcgggcggcggtggcccggccagcgctgggggcggcggcggcggcggcggcggcggaggcggcgggggcgcggcgggggcggggggcgccctgcacccgcaccacgccgccggcggcctgcacttcgacgaccgcttctccgacgagcagctggtgaccatgtctgtgcgcgagctgaaccggcagctgcgcggggtcagcaaggaggaggtgatccggctgaagcagaagaggcggaccctgaaaaaccgcggctatgcccagtcctgccgcttcaagagggtgcagcagagacacgtcctggagtcggagaagaaccagctgctgcagcaagtcgaccacctcaagcaggagatctccaggctggtgcgcgagagggacgcgtacaaggagaaatacgagaagttggtgagcagcggcttccgagaaaacggctcgagcagcgacaacccgtcctctcccgagtttttcatgtgagtctgacacgcgattccagctagccaccctgataagtgctccgcgggggtccggctcgggtgtgggcttgctagttctagagccatgctcgccaccacctcaccacccccacccccaccgagtttggcccccttggccccctacacacacacaaacccgcacgcacacaccacacacacacacacacacacacacacaccccacaccctgctcgagtttgtggtggtggtggctgttttaaactggggagggaatgggtgtctggctcatggattgccaatctgaaattctccataacttgctagcttgttttttttttttttttacacccccccgccccacccccggacttgcacaatgttcaatgatctcagcagagttcttcatgtgaaacgttgatcacctttgaagcctgcatcattcacatattttttcttcttcttccccttcagttcatgaactggtgttcattttctgtgtgtgtgtgtgttttattttgtttggatttttttttttaattttacttttagagcttgctgtgttgcccaccttttttccaacctccaccctcactccttctcaacccatctcttccgagatgaaagaaaaaaaaaagcaaagtttttttttcttctcctgagttcttcatgtgagattgagcttgcaaaggaaaaaaaaatgtgaaatgttatagacttgcagcgtgccgagttccatcgggttttttttttagcattgttatgctaaaatagagaaaaaaatcctcatgaaccttccacaatcaagcctgcatcaaccttctgggtgtgacttgtgagttttggccttgtgatgccaaatctgagagtttagtctgccattaaaaaaactcattctcatctcatgcattattatgcttgctactttgtcttagcaacaatgaactataactgtttcaaagactttatggaaaagagacattatattaataaaaaaaaaaagcctgcatgctggacatgtatggtataattattttttcctttttttttccttttggcttggaaatggacgttcgaagacttatagcatggcattcatacttttgttttattgcctcatgacttttttgagtttagaacaaaacagtgcaaccgtagagccttcttcccatgaaattttgcatctgctccaaaactgctttgagttactcagaacttcaacctcccaatgcactgaaggcattccttgtcaaagataccagaatgggttacacatttaacctggcaaacattgaagaactcttaatgttttctttttaataagaatgacgccccactttggggactaaaattgtgctattgccgagaagcagtctaaaatttattttttaaaaagagaaactgccccattatttttggtttgttttatttttattttatattttttggcttttggtcattgtcaaatgtggaatgctctgggtttctagtatataatttaattctagtttttataatctgttagcccagttaaaatgtatgctacagataaaggaatgttatagataaatttgaaagagttaggtctgtttagctgtagattttttaaacgattgatgcactaaattgtttactattgtgatgttaaggggggtagagtttgcaaggggactgtttaaaaaaagtagcttatacagcatgtgcttgcaacttaaatataagttgggtatgtgtagtctttgctataccactgactgtattgaaaaccaaagtattaagaggggaaacgcccctgtttatatctgtaggggtattttacattcaaaaatgtatgtttttttttcttttcaaaattaaagtatttgggactgaattgcactaagatataacctgcaagcatataatacaaaaaaaaattgcaaaactgtttagaacgctaataaaatttatgcagttataaaaatggcattactgcacagttttaagatgatgcagatttttttacagttgtattgtggtgcagaactggattttctgtaacttaaaaaaaaatccacagttttaaaggcaataatcagtaaatgttattttcagggactgacatcctgtctttaaaaagaaatgaaaagtaaatcttaccacaataaatataaaaaaatcttgtcagttacttttcttttacatattttgctgtgcaaaattgttttatatcttgagttactaactaaccacgcgtgttgttcctatgtgcttttctttcattttcaattctggttatatcaagaaaagaataatctacaataataaacggcatttttttttgattctgtactcagtttcttagtgtacagtttaactgggcccaacaacctcgttaaaagtgtaaaatgcatccttttctccagtggaaggattcctggaggaatagggagacagtaattcagggtgaaattataggctgttttttgaagtgaggaggctggccccatatactgattagcaatatttaatatagatgtaaattatgacctcatttttttctccccaaagttttcagttttcaaatgagttgagccataattgcccttggtaggaaaaacaaaacaaaacagtggaactaggcttcctgagcatggccctacacttctgatcaggagcaaagccatccatagacagaggagccggacaaatatggcgcatcagaggtggcttgcgcacatatgcattgaacggtaaagagaaacagcgcttgccttttcactaaagttgactatttttccttcttctcttacacaccgagattttcttgttagcaaggcctgacaagatttaacataaacatgacaaatcatagttgtttgttttgttttgcttttctctttaacactgaagatcatttgtcttaaataggaaaaagaaaatccactccttacttccatatttccaagtacatatctggtttaaactatgttatcaaatcatatttcaccgtgaatattcagtggagaacttctctacctggatgagctagtaatgatttcagatcatgctatccccagaaataaaagcaaaaaataatacctgtgtggaatataggctgtgctttgatttactggtatttaccccaaaataggctgtgtatgggggctgacttaaagatcccttggaaagactcaaaactaccttcactagtaggactcctaagcgctgacctatttttaaatgacacaaattcatgaaactaatgttacaaattcatgcagtttgcactcttagtcatcttcccctagcacaccaatagaatgttagacaaagccagcactgttttgaaaatacagccaaacacgatgacttttgttttgttttctgccgttcttaaaagaaaaaaagataatattgcaactctgactgaaagacttatttttaagaaaacaggttgtgtttggtgctgctaagttctggccagtttatcatctggccttcctgcctattttttacaaaacacgaagacagtgtgtaacctcgacattttgaccttcctttatgtgctagtttagacaggctcctgaatccacacttaattttgcttaacaaaagtcttaatagtaaacctcccctcatgagcttgaagtcaagtgttcttgacttcagatatttctttcctttttttttttttttcctcatcacaactaagagatacacaaactctgaagaagcagaaatggagagaatgcttttaacaaaaaagcatctgatgaaagattttaggcaaacattctcaaaataagagtgatattctggatgtagttattgcagttatctcatgacaaatgaggcctggattggaaggaaaatatagttgtgtagaattaagcattttgataggaatctacaaggtagttgaatataataagcaggtttgggcccccaaactttagaaaatcaaatgcaaaggtgctggcaaaaatgaggtttgagtggctggctgtaagagaaggttaactcctagtaaaaggcatttttagaaataacaattactgaaaactttgaagtatagtgggagtagcaaacaaatacatgttttttttttcttacaaagaactcctaaatcctgagtaagtgccattcattacaataagtctctaaatttaaaaaaaaaaaaatcatatgaggaaatctagctttcccctttacgctgcgtttgatctttgtctaaatagtgttaaaattcctttcattccaattacagaactgagcccactcgcaagttggagccatcagtgggatacgccacattttggaagccccagcatcgtgtacttaccagtgtgttcacaaaatgaaatttgtgtgagagctgtacattaaaaaaaatcatcattattattattatttgcagtcatggagaaccacctacccctgacttctgtttagtctcctttttaaataaaaattactgtgttagagaagaa

SEQ ID NO: 199210 - DNA, 1217 bp, Homo sapiens
  Payload ID: 19301
  Gene Name: v-maf avian musculoaponeurotic fibrosarcoma oncogene homolog
  ENST ID: ENST00000569649
  CDS Start-End: 1-1152
atggcatcagaactggcaatgagcaactccgacctgcccaccagtcccctggccatggaatatgttaatgacttcgatctgatgaagtttgaagtgaaaaaggaaccggtggagaccgaccgcatcatcagccagtgcggccgtctcatcgccgggggctcgctgtcctccacccccatgagcacgccgtgcagctcggtgcccccttcccccagcttctcggcgcccagcccgggctcgggcagcgagcagaaggcgcacctggaagactactactggatgaccggctacccgcagcagctgaaccccgaggcgctgggcttcagccccgaggacgcggtcgaggcgctcatcagcaacagccaccagctccagggcggcttcgatggctacgcgcgcggggcgcagcagctggccgcggcggccggggccggtgccggcgcctccttgggcggcagcggcgaggagatgggccccgccgccgccgtggtgtccgccgtgatcgccgcggccgccgcgcagagcggcgcgggcccgcactaccaccaccaccaccaccacgccgccggccaccaccaccacccgacggccggcgcgcccggcgccgcgggcagcgcggccgcctcggccggtggcgctgggggcgcgggcggcggtggcccggccagcgctgggggcggcggcggcggcggcggcggcggaggcggcgggggcgcggcgggggcggggggcgccctgcacccgcaccacgccgccggcggcctgcacttcgacgaccgcttctccgacgagcagctggtgaccatgtctgtgcgcgagctgaaccggcagctgcgcggggtcagcaaggaggaggtgatccggctgaagcagaagaggcggaccctgaaaaaccgcggctatgcccagtcctgccgcttcaagagggtgcagcagagacacgtcctggagtcggagaagaaccagctgctgcagcaagtcgaccacctcaagcaggagatctccaggctggtgcgcgagagggacgcgtacaaggagaaatacgagaagttggtgagcagcggcttccgagaaaacggctcgagcagcgacaacccgtcctctcccgagtttttcatgtacccaagggaatcctctacatcagtgatgtgaaaaaatccagttgcctgaagtcaaagaggtacatcttgatttttgatttgcatgtgcttgagttt

SEQ ID NO: 199211 - DNA, 2347 bp, Homo sapiens
  Payload ID: 19302
  Gene Name: v-maf avian musculoaponeurotic fibrosarcoma oncogene homolog A
  Uniprot ID: Q8NHW3
  ENST ID: ENST00000333480
  CDS Start-End: 1-1062
atggccgcggagctggcgatgggcgccgagctgcccagcagcccgctggccatcgagtacgtcaacgacttcgacctgatgaagttcgaggtgaagaaggagcctcccgaggccgagcgcttctgccaccgcctgccgccaggctcgctgtcctcgacgccgctcagcacgccctgctcctccgtgccctcctcgcccagcttctgcgcgcccagcccgggcaccggcggcggcggcggcgcggggggcggcggcggctcgtctcaggccgggggcgcccccgggccgccgagcgggggccccggcgccgtcgggggcacctcggggaagccggcgctggaggatctgtactggatgagcggctaccagcatcacctcaaccccgaggcgctcaacctgacgcccgaggacgcggtggaggcgctcatcggcagcggccaccacggcgcgcaccacggcgcgcaccacccggcggccgccgcagcctacgaggctttccgcggcccgggcttcgcgggcggcggcggagcggacgacatgggcgccggccaccaccacggcgcgcaccacgccgcccaccatcaccacgccgcccaccaccaccaccaccaccaccaccaccatggcggcgcgggacacggcggtggcgcgggccaccacgtgcgcctggaggagcgcttctccgacgaccagctggtgtccatgtcggtgcgcgagctgaaccggcagctccgcggcttcagcaaggaggaggtcatccggctcaagcagaagcggcgcacgctcaagaaccgcggctacgcgcagtcctgccgcttcaagcgggtgcagcagcggcacattctggagagcgagaagtgccaactccagagccaggtggagcagctgaagctggaggtggggcgcctggccaaagagcgggacctgtacaaggagaaatacgagaagctggcgggccggggcggccccgggagcgcgggcggggccggtttcccgcgggagccttcgccgccgcaggccggtcccggcggggccaagggcacggccgacttcttcctgtaggcgccggaccccgagcccgcgccgccgtcgccggggacaagttcgcgcaggcctctcggggcctcggctcggactccgcggtacaggacgtggacaccaggcccggcccggccgtgctggccccggtgccaagtctgcgggcgcggggctggaggccccttcgctcccggtccccgttcgcgcgcgtcggcccgggtcgccgtcctgaggttgagcggagaacggtgatttctaaggaaacttgagccaggtctaacttctttccaagcgtccgcttgtacatacgttgaacgtggttctccgttcccaccttcgccctgccagcctagagggaccgcgctgccgtcccttcccgggtggcccctgcctgcccccgccctccttcgttctcttctcagcctccctttccttgccttttttaacttcccctccccgttttaaaatcggtcttattttcgaagtatttataattattatgcttggtgattagaaaagaaaaccttggaggaagccccttctttccccagccggggtccgccctcagtcgcgagtcacagcatgagtcgctcgccaggaggggcccggcccctgcctgccccctccccgcttgcccccgaccctgctaccggcgttccttggaggtcgaagccagggacgtcacccgtgctgtgtccaggcctgctgtcctactatgctcaaccgggggtggggggaggggggtgagtcctgtgctcagtcgggtgggggctggcccggatcccgagctgctgtctctctatgcaccagaacatatctgtaactcctggggaaatacatcttgttttaaccttcaagagaagtgaaagaaaaaagtaatgcacagtatttctagcagaaaatttttttttttaagaggaggcttgggccagagccttctggcatggggcgggtggagaaagtgtttttattttaatttaaattgtgtttcgttttgtttgtggaatctttctttaatgcttcgtcgctctttggactagccgggagagagggcgaggaggcgggtgctccaggccctgtaggctgggccaggcgcctgggggatctgcccgttttcggaggccctcaggggccatcagtgggattccagccgctccacacccctcccctgagcactcggagtggaaggcgcgccgactcgttgaaagttttgttgtgtagttggttttcgttgagttcttttttcatttgctacgaaactgagaaaaagaaaaaaatacacaaaataaatctgttcagatccaagtca

SEQ ID NO: 199212 - DNA, 3393 bp, Homo sapiens
  Payload ID: 19303
  Gene Name: v-maf avian musculoaponeurotic fibrosarcoma oncogene homolog B
  Uniprot ID: Q9Y5Q3
  ENST ID: ENST00000373313
  CDS Start-End: 391-1362
cagcacagctgcaccgccgagctgcgagcggctgcgagcgagagagcgtaagagcaagagagctagagagcgagcaacgggcactcgccccacgcctcccctcagccccaccgcgcgctccgcttgcctctccaccccgcccgactctacccggcccggtccctgcgcgggcacagcccagagctctggggcggtgcaggcagcctcgggactctccggcgcgccgccgcgtccccagacaaaggcttggccggcggccccggcccgctgcgccctcgctccccgcctccccagctcttctccgctcttcccccccgcgcttggctcggcgcgctccggccggccgcaaagtttcccgggcggcagcggcggctgcgcctcgcttcagcgatggccgcggagctgagcatggggccagagctgcccaccagcccgctggccatggagtatgtcaacgacttcgacctgctcaagttcgacgtgaagaaggagccactggggcgcgcggagcgtccgggcaggccctgcacacgcctgcagccagccggctcggtgtcctccacaccgctcagcactccgtgtagctccgtgccctcgtcgcccagcttcagcccgaccgaacagaagacacacctcgaggatctgtactggatggcgagcaactaccagcagatgaaccccgaggcgctcaacctgacgcccgaggacgcggtggaagcgctcatcggctcgcacccagtgccacagccgctgcaaagcttcgacagctttcgcggcgctcaccaccaccaccatcaccaccaccctcacccgcaccacgcgtacccgggcgccggcgtggcccacgacgagctgggcccgcacgctcacccgcaccatcaccatcatcaccaagcgtcgccgccgccgtccagcgccgctagcccggcgcaacagctgcccactagccaccccgggcccgggccgcacgcgacggcctcggcgacggcggcgggcggcaacggcagcgtggaggaccgcttctccgacgaccagctcgtgtccatgtccgtgcgcgagctgaaccgccacctgcggggcttcaccaaggacgaggtgatccgcctgaagcagaagcggcggaccctgaagaaccggggctacgcccagtcttgcaggtataaacgcgtccagcagaagcaccacctggagaatgagaagacgcagctcattcagcaggtggagcagcttaagcaggaggtgtcccggctggcccgcgagagagacgcctacaaggtcaagtgcgagaaactcgccaactccggcttcagggaggcgggctccaccagcgacagcccctcctctcccgagttctttctgtgagtcgtggccggtcctggcccccgcccttgccccggcccggactccctgtcccacgtccctagtcccagactaccccggaccctgtccctgccgcggccccagccttgacctgtttgacttgagcgagagggaggaagggcgcgcgggccgcgggcgacgggcgggtgcgcgggcgggcaggggaccttggctaaggcgagagtagcgcacgccagcgccgcctcctagactcgagcagagccggagagagagacgagagggtgggaggtcccggagtaacttctctccaggctgaagggcggcgaggcatagtcccgagaagtcaccaaggccatctggagactcctggctttctgaactttgcgcgttaagccgggacagctgctttgctgcccggagagtagtccgcgccaggaagagagcaacgaggaaaggagagggactctggcgtcccggcaggcgagaggcgaggctgagcgaaagaaggaaggacagacggacctgtctgtcagagttcggagaacactggctctcagccctgagacacaggcctcagttaggacgctcggcgcccaaatctcatcagttttattgcctgctcgattatatagaaaaatacaaaaaatctgcattaaaaatattaatcctgcatgctggacatgtatggtaataatttctattttgtaccattttcttgtttaactttagcatgttgttgatcatggatcatactccccttgtttctttgggtgagaagggatcgcagtttggaaactccggcggctgcgtgcggggtttcagtcccagctgtaggcttgtaaatacccgccccgccaaaccgcatagagaacgtggcagcaagctgagggtctttgtttgggtttattattacggtatttttgtttgtaagttaaaaagaaaaaaaaaaagaaaaagttccgggcattttgcatcagaaaacaactttgtcttggggcacacttggaagttgcatgttttctttccttcccttatccccattcggtcctctttttcctctctcgctttagttttcaaccttgttggtgctgagagagagaaccgagaggtcccagtacaagggcagggcagggcagggaagctgccaagctccgcaccccagaggagtgttctggactacagccttgtcttatggtcaaattgatacccttaataagaaaggaaaggaaaggaaaacagatcctcccctctgctttttattgtaaccagaatcaccctgaggtcccttctgaaccctctgggcctgcgctaattgtaggagccacagcgctcctagggtgagaggcttagccatccctgaccctggcagtgcactggtaagcagacactgcactgaaccaactgctatgctcagaatgtaccagaaacccaaacattggcaagtaattttgcaactttcaagtgcgttctttagaccaatgcattgcgtttctttccctgcttttgagatagtaggaagagttcttggtggtgtccccccccttcaattcttcagttgtatagtagttatagggaagatatgggtgtttttctttattattacttttttttttctgcaggtcagtaaaaggatttaagttgcactgacaaaaataccaaaataaaagtgtatttttaagttcccatttgaaattgctggcgctgctggccggatgcatttttgagtttgtattagttgataaattaacagtaataacaagattgtatgaaccgcatggtgcttgcagttttaaatattgtggatatttgtcctgcatcagaaacgagctttggtttttacagattcaactgtgttgaaatcaaacctgccgcaacagaaattgtttttatttcatgtaaaataagggatcaatttcaaaccctgcttatgatatgaaaatattaaaacctagtctattgtagttttattcagactggtttctgttttttggttattaaaatggtttcctattttgcttattaaaaccatggaaatggtgtttatttagagga

SEQ ID NO: 199213 - DNA, 2490 bp, Homo sapiens
  Payload ID: 19304
  Gene Name: v-maf avian musculoaponeurotic fibrosarcoma oncogene homolog F
  Uniprot ID: Q9ULX9
  ENST ID: ENST00000338483
  CDS Start-End: 363-857
acgggggcggggccgagggaccaagcggccgctcctggccggagggcggccgggtcggtgacgtcaccgcatgactgggtttttatgaatgaaaggaatcctgtgagtgagtaattccgggaagctcgccttacaactccgcgcggcctcggccccctgcgccgcccgccccacaacaaaactcagcgcagcgctcccgggcgcccggttcagagcgacctgcggctcagagcggaggggagactgaccggagcgcggatcgggacagcggccgggacagcggcgagacgcgcgtgtgtgagcgcgccggaccaagcgggcccagaagcgggtctgcagcccagagggcaccttctgcaaacatgtctgtggatcccctatccagcaaagctctaaagatcaagcgagagctgagcgagaacacgccgcacctgtcggacgaggcgctgatggggctgtcggtgcgcgagctgaaccggcatctgcgcgggctctccgccgaggaggtgacacggctcaagcagcggcgccgcacactcaaaaaccgtggctacgccgccagctgccgcgtgaagcgcgtgtgccagaaggaggagctgcagaagcagaagtcggagctggagcgcgaggtggacaagctggcgcgcgagaacgccgccatgcgcctggagctcgacgcgctgcgcggcaagtgcgaggcgctgcagggcttcgcgcgctccgtggccgccgcccgcgggcccgccacgctcgtggcgccggccagcgtcatcaccatcgtcaagtccaccccgggctcggggtctggccccgcccacggcccggaccccgcccacggcccggcctcctgctcctagtgcccgcccccgccatgcctcagccacgcccctccggcctcagctccctccccaaagtgcctgagcgccgcctctgtgcccaggtcccatttctctgcagcactggccccttggtgcacacacattcccttcgtgggccctgtcttcctcttgcagccccccaaactgggaccgaatgaccctgggaaggggaacttgggtaggttggggatggggcagaggtctggatctgggatcgcccttggctgaaagtttagcctttttagattgagagatacagagccggcttagagaacagctgttgggggagaagagggcacccctcatcttggaaactgctcttattgtgccaatatgccctccaaaccctcccaggattcaaagctaggtttggctgtctgtgacttacgggaccgtcctgctgagaaattgcactgaagagatgcccccacctctggttgggcctgggggtgcctggccttccgaaactaaaagagtgggtgggaagactagtgaaacccagttcacggatggggaaacaggcctgaggtcacatttcacttagtggttgtgttgggaccaaaacctgggtgtcctcactgctgccctgagtccagccatggttttcagggggacagtggacagggactcagaaatgtggtgggagggcctccctggcttgggagaccgctctctgcaagggagggggagagaagcagagggagagagaaggtgacacggatggaagagtgggaaggagctggcctggctcagccctaggctgtccctgcagccagggtgtccgggggctggccagtcagagaaagggggccatggactgctgtggcaaatagggagacaaggagacagaccctgcagtcctactacagtctggagtggggtcctaagaagaagggtcccacctcaacccctgtcagtgtccactgtggggtgggggctgacccctgcctttgattgtcattctcctgggaagcccagtctcagtccctcccccaacactgtccacactgcccctccccactgtttatttattgcacggatctaagttattctccccagccagagcccgagctcctgctccctgggaaaagtggcgtatggccctgagctgggctttatattttatatctgcaaataaatcacattttatcttatatttagggaaagccggagagcaacaacaaaaaatgtttaagccgggcgcggtggctcacatctgtaatcccagcactttgggagtccaaggagggggatcgcttgagtccaggagtttgagaccagcctggacaacatggtgaaaccccatctctacaaaaaatacaaaaattagccatgcatggtggctcatgcctgtagtcccagctacttgggaggctgaggcaggaggatcacttaagcccagaaggcagaggttgtagtgagctgagatcgcaccactgcactccagcctgggcaacatagcaaaatcctgtctcaaaaaaaaagttaaaaaatattgcccggctcctagaatttatttatttcctgacttacagcaagcgagttatcgtcttctgtattttgtagactttctaaataaagtcaaattctttctttttccacagagaataaa

SEQ ID NO: 199214 - DNA, 2325 bp, Homo sapiens
  Payload ID: 19304
  Gene Name: v-maf avian musculoaponeurotic fibrosarcoma oncogene homolog F
  Uniprot ID: Q9ULX9
  ENST ID: ENST00000407965
  CDS Start-End: 204-698
cagaatggtcaaagaggacctcctgaggaggtgacattgggcaaagacctaaatgatgaggagtcaccatggggctagaacagtaaagagcacagcctgtgcacagctcccgcggctggaaggagccattcaaggaggcctgtggaccaatgtggagagaggaaggtggcaggtctgcagcccagagggcaccttctgcaaacatgtctgtggatcccctatccagcaaagctctaaagatcaagcgagagctgagcgagaacacgccgcacctgtcggacgaggcgctgatggggctgtcggtgcgcgagctgaaccggcatctgcgcgggctctccgccgaggaggtgacacggctcaagcagcggcgccgcacactcaaaaaccgtggctacgccgccagctgccgcgtgaagcgcgtgtgccagaaggaggagctgcagaagcagaagtcggagctggagcgcgaggtggacaagctggcgcgcgagaacgccgccatgcgcctggagctcgacgcgctgcgcggcaagtgcgaggcgctgcagggcttcgcgcgctccgtggccgccgcccgcgggcccgccacgctcgtggcgccggccagcgtcatcaccatcgtcaagtccaccccgggctcggggtctggccccgcccacggcccggaccccgcccacggcccggcctcctgctcctagtgcccgcccccgccatgcctcagccacgcccctccggcctcagctccctccccaaagtgcctgagcgccgcctctgtgcccaggtcccatttctctgcagcactggccccttggtgcacacacattcccttcgtgggccctgtcttcctcttgcagccccccaaactgggaccgaatgaccctgggaaggggaacttgggtaggttggggatggggcagaggtctggatctgggatcgcccttggctgaaagtttagcctttttagattgagagatacagagccggcttagagaacagctgttgggggagaagagggcacccctcatcttggaaactgctcttattgtgccaatatgccctccaaaccctcccaggattcaaagctaggtttggctgtctgtgacttacgggaccgtcctgctgagaaattgcactgaagagatgcccccacctctggttgggcctgggggtgcctggccttccgaaactaaaagagtgggtgggaagactagtgaaacccagttcacggatggggaaacaggcctgaggtcacatttcacttagtggttgtgttgggaccaaaacctgggtgtcctcactgctgccctgagtccagccatggttttcagggggacagtggacagggactcagaaatgtggtgggagggcctccctggcttgggagaccgctctctgcaagggagggggagagaagcagagggagagagaaggtgacacggatggaagagtgggaaggagctggcctggctcagccctaggctgtccctgcagccagggtgtccgggggctggccagtcagagaaagggggccatggactgctgtggcaaatagggagacaaggagacagaccctgcagtcctactacagtctggagtggggtcctaagaagaagggtcccacctcaacccctgtcagtgtccactgtggggtgggggctgacccctgcctttgattgtcattctcctgggaagcccagtctcagtccctcccccaacactgtccacactgcccctccccactgtttatttattgcacggatctaagttattctccccagccagagcccgagctcctgctccctgggaaaagtggcgtatggccctgagctgggctttatattttatatctgcaaataaatcacattttatcttatatttagggaaagccggagagcaacaacaaaaaatgtttaagccgggcgcggtggctcacatctgtaatcccagcactttgggagtccaaggagggggatcgcttgagtccaggagtttgagaccagcctggacaacatggtgaaaccccatctctacaaaaaatacaaaaattagccatgcatggtggctcatgcctgtagtcccagctacttgggaggctgaggcaggaggatcacttaagcccagaaggcagaggttgtagtgagctgagatcgcaccactgcactccagcctgggcaacatagcaaaatcctgtctcaaaaaaaaagttaaaaaatattgcccggctcctagaatttatttatttcctgacttacagcaagcgagttatcgtcttctgtattttgtagactttctaaataaagtcaaattctttctttttccacagag

SEQ ID NO: 199215 - DNA, 2216 bp, Homo sapiens
  Payload ID: 19304
  Gene Name: v-maf avian musculoaponeurotic fibrosarcoma oncogene homolog F
  Uniprot ID: Q9ULX9
  ENST ID: ENST00000426621
  CDS Start-End: 97-591
agctgagctaggagtgagggatgtgagccacccccgcttggcaccccggtggatctggtaacaaagtctgcagcccagagggcaccttctgcaaacatgtctgtggatcccctatccagcaaagctctaaagatcaagcgagagctgagcgagaacacgccgcacctgtcggacgaggcgctgatggggctgtcggtgcgcgagctgaaccggcatctgcgcgggctctccgccgaggaggtgacacggctcaagcagcggcgccgcacactcaaaaaccgtggctacgccgccagctgccgcgtgaagcgcgtgtgccagaaggaggagctgcagaagcagaagtcggagctggagcgcgaggtggacaagctggcgcgcgagaacgccgccatgcgcctggagctcgacgcgctgcgcggcaagtgcgaggcgctgcagggcttcgcgcgctccgtggccgccgcccgcgggcccgccacgctcgtggcgccggccagcgtcatcaccatcgtcaagtccaccccgggctcggggtctggccccgcccacggcccggaccccgcccacggcccggcctcctgctcctagtgcccgcccccgccatgcctcagccacgcccctccggcctcagctccctccccaaagtgcctgagcgccgcctctgtgcccaggtcccatttctctgcagcactggccccttggtgcacacacattcccttcgtgggccctgtcttcctcttgcagccccccaaactgggaccgaatgaccctgggaaggggaacttgggtaggttggggatggggcagaggtctggatctgggatcgcccttggctgaaagtttagcctttttagattgagagatacagagccggcttagagaacagctgttgggggagaagagggcacccctcatcttggaaactgctcttattgtgccaatatgccctccaaaccctcccaggattcaaagctaggtttggctgtctgtgacttacgggaccgtcctgctgagaaattgcactgaagagatgcccccacctctggttgggcctgggggtgcctggccttccgaaactaaaagagtgggtgggaagactagtgaaacccagttcacggatggggaaacaggcctgaggtcacatttcacttagtggttgtgttgggaccaaaacctgggtgtcctcactgctgccctgagtccagccatggttttcagggggacagtggacagggactcagaaatgtggtgggagggcctccctggcttgggagaccgctctctgcaagggagggggagagaagcagagggagagagaaggtgacacggatggaagagtgggaaggagctggcctggctcagccctaggctgtccctgcagccagggtgtccgggggctggccagtcagagaaagggggccatggactgctgtggcaaatagggagacaaggagacagaccctgcagtcctactacagtctggagtggggtcctaagaagaagggtcccacctcaacccctgtcagtgtccactgtggggtgggggctgacccctgcctttgattgtcattctcctgggaagcccagtctcagtccctcccccaacactgtccacactgcccctccccactgtttatttattgcacggatctaagttattctccccagccagagcccgagctcctgctccctgggaaaagtggcgtatggccctgagctgggctttatattttatatctgcaaataaatcacattttatcttatatttagggaaagccggagagcaacaacaaaaaatgtttaagccgggcgcggtggctcacatctgtaatcccagcactttgggagtccaaggagggggatcgcttgagtccaggagtttgagaccagcctggacaacatggtgaaaccccatctctacaaaaaatacaaaaattagccatgcatggtggctcatgcctgtagtcccagctacttgggaggctgaggcaggaggatcacttaagcccagaaggcagaggttgtagtgagctgagatcgcaccactgcactccagcctgggcaacatagcaaaatcctgtctcaaaaaaaaagttaaaaaatattgcccggctcctagaatttatttatttcctgacttacagcaagcgagttatcgtcttctgtattttgtagactttctaaataaagtcaaattctttctttttccacag

SEQ ID NO: 199216 - DNA, 548 bp, Homo sapiens
  Payload ID: 19304
  Gene Name: v-maf avian musculoaponeurotic fibrosarcoma oncogene homolog F
  ENST ID: ENST00000441709
  CDS Start-End: 269-548
ttccgggaagctcgccttacaactccgcgcggcctcggccccctgcgccgcccgccccacaacaaaactcagcgcagcgctcccgggcgcccggttcagagcgacctgcggctcagagcggaggggagactgaccggagcgcggatcgggacagcggccgggacagcggcgagacgcgcgtgtgtgagcgcgccggaccaagcgggcccagaagcggatcaagcgagagctgagcgagaacacgccgcacctgtcggacgaggcgctgatggggctgtcggtgcgcgagctgaaccggcatctgcgcgggctctccgccgaggaggtgacacggctcaagcagcggcgccgcacactcaaaaaccgtggctacgccgccagctgccgcgtgaagcgcgtgtgccagaaggaggagctgcagaagcagaagtcggagctggagcgcgaggtggacaagctggcgcgcgagaacgccgccatgcgcctggagctcgacgcgctgcgcggcaagtgcgaggcgctgcagggcttcgcgcgctccgtggccg

SEQ ID NO: 199217 - DNA, 697 bp, Homo sapiens
  Payload ID: 19304
  Gene Name: v-maf avian musculoaponeurotic fibrosarcoma oncogene homolog F
  ENST ID: ENST00000417948
  CDS Start-End: 321-697
aaacgcggaacaaggacccgagcgaaggaagcggacccgtgcgtcttcgcacggggtctgggaattctggcccgggccgccccagtcctactacccggggctgtccgtccccggctctccccggagtttcccagggcctccgccacgtgaccccagtgtttgtctcccgcccagagcccgcgcccgcagccacagggtggggcaaggtatcaaagaccccacccagctgagctaggagtgagggatgtgagccacccccgcttggcaccccggtggatctggtaacaaagtctgcagcccagagggcaccttctgcaaacatgtctgtggatcccctatccagcaaagctctaaagatcaagcgagagctgagcgagaacacgccgcacctgtcggacgaggcgctgatggggctgtcggtgcgcgagctgaaccggcatctgcgcgggctctccgccgaggaggtgacacggctcaagcagcggcgccgcacactcaaaaaccgtggctacgccgccagctgccgcgtgaagcgcgtgtgccagaaggaggagctgcagaagcagaagtcggagctggagcgcgaggtggacaagctggcgcgcgagaacgccgccatgcgcctggagctcgacgcgctgcgcggcaagtgcgaggcgctgcagggcttcgcgcgctccgtggccgccgcccgcgg

SEQ ID NO: 199218 - DNA, 2365 bp, Homo sapiens
  Payload ID: 19304
  Gene Name: v-maf avian musculoaponeurotic fibrosarcoma oncogene homolog F
  Uniprot ID: Q9ULX9
  ENST ID: ENST00000538999
  CDS Start-End: 333-740
cgggtcggtgacgtcaccgcatgactgggtttttatgaatgaaaggaatcctgtgagtgagtaattccgggaagctcgccttacaactccgcgcggcctcggccccctgcgccgcccgccccacaacaaaactcagcgcagcgctcccgggcgcccggttcagagcgacctgcggctcagagcggaggggagactgaccggagcgcggatcgggacagcggccgggacagcggcgagacgcgcgtgtgtgagcgcgccggaccaagcgggcccagaagcggatcaagcgagagctgagcgagaacacgccgcacctgtcggacgaggcgctgatggggctgtcggtgcgcgagctgaaccggcatctgcgcgggctctccgccgaggaggtgacacggctcaagcagcggcgccgcacactcaaaaaccgtggctacgccgccagctgccgcgtgaagcgcgtgtgccagaaggaggagctgcagaagcagaagtcggagctggagcgcgaggtggacaagctggcgcgcgagaacgccgccatgcgcctggagctcgacgcgctgcgcggcaagtgcgaggcgctgcagggcttcgcgcgctccgtggccgccgcccgcgggcccgccacgctcgtggcgccggccagcgtcatcaccatcgtcaagtccaccccgggctcggggtctggccccgcccacggcccggaccccgcccacggcccggcctcctgctcctagtgcccgcccccgccatgcctcagccacgcccctccggcctcagctccctccccaaagtgcctgagcgccgcctctgtgcccaggtcccatttctctgcagcactggccccttggtgcacacacattcccttcgtgggccctgtcttcctcttgcagccccccaaactgggaccgaatgaccctgggaaggggaacttgggtaggttggggatggggcagaggtctggatctgggatcgcccttggctgaaagtttagcctttttagattgagagatacagagccggcttagagaacagctgttgggggagaagagggcacccctcatcttggaaactgctcttattgtgccaatatgccctccaaaccctcccaggattcaaagctaggtttggctgtctgtgacttacgggaccgtcctgctgagaaattgcactgaagagatgcccccacctctggttgggcctgggggtgcctggccttccgaaactaaaagagtgggtgggaagactagtgaaacccagttcacggatggggaaacaggcctgaggtcacatttcacttagtggttgtgttgggaccaaaacctgggtgtcctcactgctgccctgagtccagccatggttttcagggggacagtggacagggactcagaaatgtggtgggagggcctccctggcttgggagaccgctctctgcaagggagggggagagaagcagagggagagagaaggtgacacggatggaagagtgggaaggagctggcctggctcagccctaggctgtccctgcagccagggtgtccgggggctggccagtcagagaaagggggccatggactgctgtggcaaatagggagacaaggagacagaccctgcagtcctactacagtctggagtggggtcctaagaagaagggtcccacctcaacccctgtcagtgtccactgtggggtgggggctgacccctgcctttgattgtcattctcctgggaagcccagtctcagtccctcccccaacactgtccacactgcccctccccactgtttatttattgcacggatctaagttattctccccagccagagcccgagctcctgctccctgggaaaagtggcgtatggccctgagctgggctttatattttatatctgcaaataaatcacattttatcttatatttagggaaagccggagagcaacaacaaaaaatgtttaagccgggcgcggtggctcacatctgtaatcccagcactttgggagtccaaggagggggatcgcttgagtccaggagtttgagaccagcctggacaacatggtgaaaccccatctctacaaaaaatacaaaaattagccatgcatggtggctcatgcctgtagtcccagctacttgggaggctgaggcaggaggatcacttaagcccagaaggcagaggttgtagtgagctgagatcgcaccactgcactccagcctgggcaacatagcaaaatcctgtctcaaaaaaaaagttaaaaaatattgcccggctcctagaatttatttatttcctgacttacagcaagcgagttatcgtcttctgtattttgtagactttctaaataaagtcaaattctttctttttccacag

SEQ ID NO: 199219 - DNA, 2458 bp, Homo sapiens
  Payload ID: 19304
  Gene Name: v-maf avian musculoaponeurotic fibrosarcoma oncogene homolog F
  Uniprot ID: Q9ULX9
  ENST ID: ENST00000538320
  CDS Start-End: 339-833
cgggtcggtgacgtcaccgcatgactgggtttttatgaatgaaaggaatcctgtgagtgagtaattccgggaagctcgccttacaactccgcgcggcctcggccccctgcgccgcccgccccacaacaaaactcagcgcagcgctcccgggcgcccggttcagagcgacctgcggctcagagcggaggggagactgaccggagcgcggatcgggacagcggccgggacagcggcgagacgcgcgtgtgtgagcgcgccggaccaagcgggcccagaagcgggtgaggaacgcgggaccaggaggacggtctgcagcccagagggcaccttctgcaaacatgtctgtggatcccctatccagcaaagctctaaagatcaagcgagagctgagcgagaacacgccgcacctgtcggacgaggcgctgatggggctgtcggtgcgcgagctgaaccggcatctgcgcgggctctccgccgaggaggtgacacggctcaagcagcggcgccgcacactcaaaaaccgtggctacgccgccagctgccgcgtgaagcgcgtgtgccagaaggaggagctgcagaagcagaagtcggagctggagcgcgaggtggacaagctggcgcgcgagaacgccgccatgcgcctggagctcgacgcgctgcgcggcaagtgcgaggcgctgcagggcttcgcgcgctccgtggccgccgcccgcgggcccgccacgctcgtggcgccggccagcgtcatcaccatcgtcaagtccaccccgggctcggggtctggccccgcccacggcccggaccccgcccacggcccggcctcctgctcctagtgcccgcccccgccatgcctcagccacgcccctccggcctcagctccctccccaaagtgcctgagcgccgcctctgtgcccaggtcccatttctctgcagcactggccccttggtgcacacacattcccttcgtgggccctgtcttcctcttgcagccccccaaactgggaccgaatgaccctgggaaggggaacttgggtaggttggggatggggcagaggtctggatctgggatcgcccttggctgaaagtttagcctttttagattgagagatacagagccggcttagagaacagctgttgggggagaagagggcacccctcatcttggaaactgctcttattgtgccaatatgccctccaaaccctcccaggattcaaagctaggtttggctgtctgtgacttacgggaccgtcctgctgagaaattgcactgaagagatgcccccacctctggttgggcctgggggtgcctggccttccgaaactaaaagagtgggtgggaagactagtgaaacccagttcacggatggggaaacaggcctgaggtcacatttcacttagtggttgtgttgggaccaaaacctgggtgtcctcactgctgccctgagtccagccatggttttcagggggacagtggacagggactcagaaatgtggtgggagggcctccctggcttgggagaccgctctctgcaagggagggggagagaagcagagggagagagaaggtgacacggatggaagagtgggaaggagctggcctggctcagccctaggctgtccctgcagccagggtgtccgggggctggccagtcagagaaagggggccatggactgctgtggcaaatagggagacaaggagacagaccctgcagtcctactacagtctggagtggggtcctaagaagaagggtcccacctcaacccctgtcagtgtccactgtggggtgggggctgacccctgcctttgattgtcattctcctgggaagcccagtctcagtccctcccccaacactgtccacactgcccctccccactgtttatttattgcacggatctaagttattctccccagccagagcccgagctcctgctccctgggaaaagtggcgtatggccctgagctgggctttatattttatatctgcaaataaatcacattttatcttatatttagggaaagccggagagcaacaacaaaaaatgtttaagccgggcgcggtggctcacatctgtaatcccagcactttgggagtccaaggagggggatcgcttgagtccaggagtttgagaccagcctggacaacatggtgaaaccccatctctacaaaaaatacaaaaattagccatgcatggtggctcatgcctgtagtcccagctacttgggaggctgaggcaggaggatcacttaagcccagaaggcagaggttgtagtgagctgagatcgcaccactgcactccagcctgggcaacatagcaaaatcctgtctcaaaaaaaaagttaaaaaatattgcccggctcctagaatttatttatttcctgacttacagcaagcgagttatcgtcttctgtattttgtagactttctaaataaagtcaaattctttctttttccacag

SEQ ID NO: 199220 - DNA, 5040 bp, Homo sapiens
  Payload ID: 19305
  Gene Name: v-maf avian musculoaponeurotic fibrosarcoma oncogene homolog G
  Uniprot ID: O15525
  ENST ID: ENST00000357736
  CDS Start-End: 217-705
ggcggcggcggcggatcccgagcctggtccggcccggccttcccagtgcgctcggcccggcccgcgcaggcggcgagtcctccgagccccgggcccggacccctcgcgccggtccctgccccgcgcggcctcggagcgcgcgcggccccgccccgccccggcctcggcccgccgggcccgcagtgtgagagcgcctgctcgctgtgcccccgggttatgacgacccccaataaaggaaacaaggccttgaaggtgaagcgggagccgggtgagaatggcaccagcctgacggatgaggagctggtgaccatgtcggtgcgggagctgaaccagcacctgcggggcctgtccaaggaggagatcgtccagctgaagcagcgccggcgcacgctcaagaaccgcggctacgctgccagctgccgcgtgaagcgggtgacgcagaaggaggagctggagaagcagaaggcggagctgcagcaggaggtggagaagctggcctcagagaacgccagcatgaagctggagctcgacgcgctgcgctccaagtacgaggcgctgcagaccttcgcccggacggtggcccgcagccccgtggcgccagcccggggcccccttgccgccggcctggggcccctcgtcccaggcaaggtggccgccaccagcgtcatcacaatagtaaagtccaagacggatgcccgatcgtagggacgcgcgtctgcccaggcgggtctttgcggggccactaggcacatggcgaatttggctgccctgtccctctgtttccttctcttctctttcctccctctcttccccacccttctctcttccctgcaaagcacaacctgtaccccaggggcgccgggctgagcccctttgatctcgtcattgtcgtcgtgtgttttgtatgttgggattggtcagttcggcggtgacgtggggtcgccccaaccccttttgtaccagggccatgcaggcttggagtccagagttggtgctgtgggaacggactagagagagttgcgggagagagaaggagcaggcacgctgggcctcgcgtgtccccgagcagtgagggtcccagtgttccctccactcccgagtggccacaggctcgcgggctgggaaggattcactctctttagccccaggggagcagctcagcttagcccagcatgaagagatgggctctgctctgagagtagggcgggcttgaaggccctgatgggtggaccaccagcctgggcgcagtggtgctgggggcgtgcagctgggcccaggggctgtgcactcaggcctgacccgttgcactgaacaagaccaaatctctggttgtgcgcttaacgtgagggtgggtccagtgtgccctgcgatgggtcccgtgtcactgtttacatgacctatttgtgtggttatatagccctttatttaaaagagagaagttccttttacaaagttattaaattaattatatgtttaaaagttaaagaaaaaagagctgcagagtatttataaaactgtcttttagaaaaaaaacaagcaagaagaccatttgaccatatgaatggaaaagggaagaaagtataatagaaactttgctagttaaaaaaaaaagaaaaaaaaagaaaaaaaatccctttcttgtaaacttacggacacctctttgtggctgttggagtttagtttttatatacacagagttatcagacattatttataaaacttagtttaaaaaaaagacaaaaaaaaaaaagccaagccgtgagccgaccagaaggccgtcctctttgatatcttttgcaattgtaccgaaagtgacttactcctctgcccttcctgcttccgtctcttgccggtgccgtggtgtcgtccgtgcctggtgaggttttgtgcagcggtaaagtgctggtgcttctggtgacctttgacctgtgggtgtcacttcttgtgtctgttttcccgtgttcgttttttgggtttagttgtgcttttgcttctgctggcttgctggacctgggctggggtgccaagtggcgcctgctgcgtcagagctcaaggaatctgtgcccaccaccagctcctggtccgtaggaggtgagacatggggttctgtcatgcccccctccactgagccttggctacatctgtgtctagggcttgggctgatctagtggcggggtaggtgaaactggggtcccttggggcgccccacgctgcttccacacccaccacctctggccttgggtggtggcattacagggatgagggagtcactgtgggtggccacagggctatggccaagcgttccctggccgtcttcctctggcctcagctttgttcctataggctgcccgcgccgtgggctgcaggtctcgccgcccgcttgatccctgaggtgtttccatgctgcgggtggtgcttccaggcagagtgggtgggggcccaccgggcaccgccctttcttccttgtccctgcctcactctgagagccttgggggtctccaccagtgcagacaagggctacagtctccagggccgggtcttgtccctcttctccgctggtccacgctggcagctcttggcttcgggcctgccttctgcctccctttgggatctgtgtcttccagggatcagctgcttggcttctgctggaggtgcctccctgtgggggcgcagcctgcctcctgctctcagttcctcgccagaggctgctgcccttcctggctgggctcaggaggctccttgtaggcatatgatggggagggggtgcccctacccacctccaagaggctacagccctgtgtctggccatgtgagccctggcctttcaccgggttgctggtttcttttctgtggggcccagacttctgtaaagcacacagatgtgggtaagatgaaaaactgtggcccaacagggcttaaccctatggatggtgggatttttatccaatagtttggcctggtgtgcccacaggatgggaacagggaggcaccatcaacacttgtcatgttaatgagcttttctttgctcgaggtgttcagagacaagtcctgtgtctacctgcgtcagcctgaaaatggaaatattggctgttgactcttgtcatttagtgacttcatccccctcccctcagtctgatcttgtctaagtagaatccaggcgttagttggaatcatatcataagtatccatgaagaaaacgtcatgatctgcctcggagtggggagaaacaggccctccttgtccttgtgcagcccccacttttgtcctggctgtgggtggccatccattttgagcacctctgccaggctgcagacctggaggcgaagggagtgtggaagaggagggtgtaagggtcgacgcgtgctgaatgggaggtgcaggtcctcggtgcgttggcagaagaggcttctggagtttcgaggccatacctcctttcaagagctttggatttggggcgacttccctgggtctaggggagtgttcctgtcccctgtcaggtcagccctgcggagccactccacccctcttccccttcccctggatttcctgacatagatggtgtgttcatgtgcaggtgtgagtgtgctgtccttctgatctctgttgatcccgctttcctactgagagggtggtggagagggtggtggtctcttctcacctcagtttttctgacacagcgaatcgagggctttggccaaggccaggtctctcaaacttgtccgccaagtaaaccatgatatatgtcttcccttccaccttaactttgccccaactcctcttttatcctaacatggacgctcagatttcagaggaatacccagcagggacaggtcagctctcaccaggagagtgaggcccctggctgctgctcggggtggcactggtgttgctggctcagctcttggtgcatgtttcagatatgtgtgtacacttctgactggtgatcagggcccggcccacggccctgagcggctgcagcctgctttgggacgatggtcaggtcccatgttgtccctgctgcctccctctggagtggccacttggccaaagcgcccatccacatctggaaagtcggagccgcagcctgctgcaccgtttccgctctgggatcttgtgagttacttttttaggctgtggtttggtgaaaggaaccaacacattaacgatttttcccccagaagccactgaataattctttttggtgtatttttgccttcctgttggctgtctggccttggagcaggtcgggagagtagagtacataatcagtgccacacagaggcagggcgtgtctgagagactaatgcctgtcctgcctctggcctgtgtcctgggtgtgtaccatacctgctgggccagtcccacacatttccaccctgcccctggagcagcagctttgataccatgggtgtcccttgagtctgagctagagtgtgtccccgataaactgtgagacctccctgttcttggtgaccccagttgggctttggcccctccagcaaccttgtgtcccagccctgcccttcttcccaccccctcaatctgctagtccctgaagcctttaaccaaacgggagtgggcacagaaagccttctcctggcaacaggacaagggctgcccgcgtgtccagccctgttgctctcctggcgctgagaggtgggtccaagcagagttgatcagtccctgcctgccctgcctaggtctagccaggggaggttgtgtgtgtgggagaagaccccgggatctgctggggtgggatggaggttattaaagatctaagtgaggaggggctggggtttggatgcggggtgaggcccgagcgctcacacttcgtgtagggcgggcaggggcctgacctcttgcagggcagtggccttggtgccctacccctgccctgcgcagtatttattgctaaattattgtccaggaggggcagcactgggcctggccccccgggtatttattgctgtacatagtgtatgtttgtgatatataaggttttctttattttgtatatgatcaataaaccttttaaagaga

SEQ ID NO: 199221 - DNA, 1743 bp, Homo sapiens
  Payload ID: 19305
  Gene Name: v-maf avian musculoaponeurotic fibrosarcoma oncogene homolog G
  Uniprot ID: O15525
  ENST ID: ENST00000392366
  CDS Start-End: 210-698
ccgcgtcttattccttctaatctctcccctgccccttgtcttgcgcctgccttcctaacagccttcagttccccttctcccgtcagaccttcctgacctcccacctggttctctaggggcagggtggacaggaagcagctcagcccagcctgggagaggccaagggctgcctcctatcagagagcgcctgctcgctgtgcccccgggttatgacgacccccaataaaggaaacaaggccttgaaggtgaagcgggagccgggtgagaatggcaccagcctgacggatgaggagctggtgaccatgtcggtgcgggagctgaaccagcacctgcggggcctgtccaaggaggagatcgtccagctgaagcagcgccggcgcacgctcaagaaccgcggctacgctgccagctgccgcgtgaagcgggtgacgcagaaggaggagctggagaagcagaaggcggagctgcagcaggaggtggagaagctggcctcagagaacgccagcatgaagctggagctcgacgcgctgcgctccaagtacgaggcgctgcagaccttcgcccggacggtggcccgcagccccgtggcgccagcccggggcccccttgccgccggcctggggcccctcgtcccaggcaaggtggccgccaccagcgtcatcacaatagtaaagtccaagacggatgcccgatcgtagggacgcgcgtctgcccaggcgggtctttgcggggccactaggcacatggcgaatttggctgccctgtccctctgtttccttctcttctctttcctccctctcttccccacccttctctcttccctgcaaagcacaacctgtaccccaggggcgccgggctgagcccctttgatctcgtcattgtcgtcgtgtgttttgtatgttgggattggtcagttcggcggtgacgtggggtcgccccaaccccttttgtaccagggccatgcaggcttggagtccagagttggtgctgtgggaacggactagagagagttgcgggagagagaaggagcaggcacgctgggcctcgcgtgtccccgagcagtgagggtcccagtgttccctccactcccgagtggccacaggctcgcgggctgggaaggattcactctctttagccccaggggagcagctcagcttagcccagcatgaagagatgggctctgctctgagagtagggcgggcttgaaggccctgatgggtggaccaccagcctgggcgcagtggtgctgggggcgtgcagctgggcccaggggctgtgcactcaggcctgacccgttgcactgaacaagaccaaatctctggttgtgcgcttaacgtgagggtgggtccagtgtgccctgcgatgggtcccgtgtcactgtttacatgacctatttgtgtggttatatagccctttatttaaaagagagaagttccttttacaaagttattaaattaattatatgtttaaaagttaaagaaaaaagagctgcagagtatttataaaactgtcttttagaaaaaaaacaagcaagaagaccatttgaccatatgaatggaaaagggaagaaagtataatagaaactttgctagttaaaaaaaaaagaaaaaaaaagaaaaaaaatccctttcttgtaaacttacggacacctctttgtggctgttggagtttagtttttatatacacagagttatcagacattatttataaaacttagtttaaaaaaaagacaaaaaaaaaaaa

SEQ ID NO: 199222 - DNA, 570 bp, Homo sapiens
  Payload ID: 19305
  Gene Name: v-maf avian musculoaponeurotic fibrosarcoma oncogene homolog G
  ENST ID: ENST00000574686
  CDS Start-End: 275-570
ggcggcggatcccgagcctggtccggcccggccttcccagtgcgctcggcccggcccgcgcaggcggcgagtcctccgagccccgggcccggacccctcgcgccggtccctgccccgcgcggcctcggagcgcgcgcggccccgccccgccccggcctcggcccgccgggcccgcagtgtggggcagggtggacaggaagcagctcagcccagcctgggagaggccaagggctgcctcctatcagagagcgcctgctcgctgtgcccccgggttatgacgacccccaataaaggaaacaaggccttgaaggtgaagcgggagccgggtgagaatggcaccagcctgacggatgaggagctggtgaccatgtcggtgcgggagctgaaccagcacctgcggggcctgtccaaggaggagatcgtccagctgaagcagcgccggcgcacgctcaagaaccgcggctacgctgccagctgccgcgtgaagcgggtgacgcagaaggaggagctggagaagcagaaggcggagctgcagcaggaggtggagaagctggcctcagagaacgccag

SEQ ID NO: 199223 - DNA, 3368 bp, Homo sapiens
  Payload ID: 19306
  Gene Name: v-maf avian musculoaponeurotic fibrosarcoma oncogene homolog K
  Uniprot ID: O60675
  ENST ID: ENST00000343242
  CDS Start-End: 230-700
ggagccgggcgggcgggtgcggtggcggcgggcggcgcgggggcacttgttgttcttcgcgaagtcggagcccgagcgccaggcggcggcggcggccgaggggagcgcgacagtgagcgccggcgcgaggacagcgcgtgcccgcgaggagccgccgcgcgcccgcgccctccgcgcgacgccagctacgagttccagggagctctgtcctggtgaccgtgcccgggttatgacgactaatcccaaaccgaataaggcattaaaggtcaagaaggaggcgggcgagaacgccccggtgctcagcgatgatgagctggtgtccatgtcggtgcgggagctgaaccagcacctgcggggtctcaccaaggaggaggtgacccgcctgaagcagcgtcggcgcacactcaagaaccgcggctacgcggccagctgccgcatcaagcgggtgacgcagaaggaggagctggagcggcagcgcgtggagctgcagcaggaggtggagaagctggcgcgtgagaacagcagcatgcggctggagctggacgccctgcgctccaagtacgaggcgctgcagaccttcgcgcgcaccgtggcccggggacctgtggcgccctccaaggtggccaccaccagcgtcatcaccatcgtcaagtccaccgagctctcctccacctccgtgcccttctcggctgcatcctagtgccggccgggggcggggggtggcgggcggcgggcggcgggcaggcgggtgggggcacacccctcgtacctgtcactgggatgcagactctcgacatccgagtccaagcgcaggcccctcgggcgcaggcagctcacaccaggaagagactgtattgcagggtgaagagtgggctcccgtgggcccagagctgcacgccggtccacagacacactcacgcccgccacctgctccccgcaggatgtgtctgtgtgtgggaattggtatcttgcacccgtgggagtcgggacatataatggaaaggccctcgggaagttccgcgtcctctgtgggggctgccggaagacacggccccaggagtcaggcccctgtggtcaggtctagcatggggcttgttttccactcctgctgtaagcagccttcgacacctgtcctgccacggcctcccagccggtgcgggagcccctcactgccctgaccgactccgcagtccccggggaggagcatggatggtgtgtcggcagctccgtccttccagctgtcccgttgcagtgcccgtgatccgcgtctgccttagcaggggcctgcgtgagtgggcacggtgtgggaggtcgcctgcgtggggtggtgtctgtgtgtgtgcacgcacgcctgccatcaaagcagcagggctgagggggtgcagcttgctggtgttcactgggggagggcctgtgggcacacatggcagagagagtggctcacacgtcgtgaggtctcccctgtgctctggtgacccgaggaggtcgtgcagcacagcgcagaagcccctgcccacgggatccggccccccagacaccgaccccacaggccgtcccggatctcagcggacacaggcaggagcgccccatcatttgacggtgagcaggactcaggctgtgtgtcctggagctacttctcaccaactgtggtcagtgcagggggaacgaggaggtcttttgggggcctggcgaggggaagggctgctgcagtctagggagagggggtgcagcctgggggatgttggtggacatggatgtggaggtggaaggaggaggacgttgcgtggagtggtgggaggaggcgggagccgtgtgcgagagcaggtggaaagccttgaggggcaggaccaggatgcagctggcttgtagaagagctcaggagtgagcctggcactccagagggcgcggcgggtggggaggcagcaggcaccagtccaggagagcttcgtggacgtggctcctgcgcgcacacccccaggagcacagccacgggctgcaggtgtggctggcctcagcactcagtcctcacccggagcctttgcctgctcctccttccaagagcactgaggcaccagtgggcttggcactccaccttgggcttccttttcctggagagccgccttgagggtccctcctgtgactggggtctctgcagcgagagccgcgggggttgcggagcccctgcctgggggagctggcggaatgtgagccgccggccgggggccgccacataagacctgcaaggtggtgcctggggccctggctccttctcggctgcccctgcccacccagtaacagcccccaccagctacagagcccaggcgggtgccagccacgctgggagggcagaggacagacagccccggggctgcgacttggttctgtgtctactgttagaagttgagtgggaagctgcaggcccgccaggaccactgggtccctacagagcaaaggcctgcgtgttcccaaacagccgttgcccccgtggccgtggtaggtaatccatattggatgtcataaggaccagggggatatttaaagagagaaacagaaaatatatagagatataaaattatattcacagtttatctacagatttttcgtaacaatctttcttttccagtttgatactgtaaatctatcagagcagagccgggggcacgggcacaggtgggagttgggagcaaagcggaggcccgggctgcccgccgtcccccttcatctccccacggactgtaccaggcagctgggccccgcaggacaggccgcagcgggtggccggttctgtcccgtcttggggttcttggtgtccacgtcttgtgggccgtgggcttctacctgcccttggcctgcagtgctttgctggagaagggactccctggtccccagggtggacggagccgctgtcaccgcccagagctgggccggggaagcacggtgtgttctgcttttcttttcagattgttgaaatttcattgtcatgatttaatatatggatttttttatttaagaaaaagacgagggactctttgtcacgtgggtttgttttctgtctccgtgcctccggcttcccaaagagatccaggtctttgcgtttccagggcgtggggaccccggccccctatgccgccacgccgccacaccgcctcaccctggcttctgtgctacttggcagttccatttcattatttattttttgtgctgctttttatcatgatataaattattgaaaacagatcacatgtgggcccgtgtctggccgccgccgccctgccccgtccctgcggccaccacctaatttattgccgtgcgtcctgctgctgtgactgcttttgtacctttgcaataaagaattttctggtttcaga

SEQ ID NO: 199224 - DNA, 632 bp, Homo sapiens
  Payload ID: 19306
  Gene Name: v-maf avian musculoaponeurotic fibrosarcoma oncogene homolog K
  Uniprot ID: O60675
  ENST ID: ENST00000406174
  CDS Start-End: 164-632
ggggcaccttgtgctgtgcaggtgcagacgtcttctctgacctcagggagagtcagaacaggaagcagccactgccggcgcctgctggtcaccccacagtgccggcggctgcagcccagctacgagttccagggagctctgtcctggtgaccgtgcccgggttatgacgactaatcccaaaccgaataaggcattaaaggtcaagaaggaggcgggcgagaacgccccggtgctcagcgatgatgagctggtgtccatgtcggtgcgggagctgaaccagcacctgcggggtctcaccaaggaggaggtgacccgcctgaagcagcgtcggcgcacactcaagaaccgcggctacgcggccagctgccgcatcaagcgggtgacgcagaaggaggagctggagcggcagcgcgtggagctgcagcaggaggtggagaagctggcgcgtgagaacagcagcatgcggctggagctggacgccctgcgctccaagtacgaggcgctgcagaccttcgcgcgcaccgtggcccggggacctgtggcgccctccaaggtggccaccaccagcgtcatcaccatcgtcaagtccaccgagctctcctccacctccgtgcccttctcggctgcatcct

SEQ ID NO: 199225 - DNA, 2773 bp, Homo sapiens
  Payload ID: 19306
  Gene Name: v-maf avian musculoaponeurotic fibrosarcoma oncogene homolog K
  Uniprot ID: O60675
  ENST ID: ENST00000403150
  CDS Start-End: 1016-1486
tttgcaggtccccacggtggcggaggcagctgggccccagcctctccactgtcaccctcaccccaggacgtggtgcgaaggagcctggagcccacctggccgtccccgggaccggctggtgccatcctgtgccatctacgtcagcgccctgagatcagctggccttggcaggggcagcggactcggcagcctggcgcaggaccctgtctcacctgtgcggccctcttgttgtgggggtttgtgggttgcgggggtggggcccccatcggaggcagggctggagggtggagggatttgggcccgagggctccctggcccagggtgtggggagggtcctgggctggcagggaggacgggatgcggtcacccgcccccatgatgcccatgtccagtggaggtgctgaccaaggacaccccccaccgccgtgtgctgctctgatgttcctgtgggaacctgtgtctggtatttggggtatgggagtgggtgctgtgaacccctgtcccgcgagctgcccggcgccttctgcccgcccgtcccggccgccgggtgcaaatgggtttgttgactgcctgccggcctcgtgatgtctgtgcaacctgacctgaagtcaggatcgcgtttgggcttctcggtttccatgacaaccgtgggggctggctcggtcccaaggtcgccatggcaactatcggagggctcatgccggggatgctttggctgggtttttcatgaatgattagaatgtgtgacacaatgcagacgtgaggacggcgggggcggcggcggggacgactcccgccagacggtcaaatgctcggcagggcggcggctcccccacctccctggtctctggctgcggcccccggacctgccgcccctcaggaaccccacacccccttgggccgcagggtcctcgctcgggggcagcttaggtggaggtggtgatgtcacagccgcagcggccagggccgtgctacgagttccagggagctctgtcctggtgaccgtgcccgggttatgacgactaatcccaaaccgaataaggcattaaaggtcaagaaggaggcgggcgagaacgccccggtgctcagcgatgatgagctggtgtccatgtcggtgcgggagctgaaccagcacctgcggggtctcaccaaggaggaggtgacccgcctgaagcagcgtcggcgcacactcaagaaccgcggctacgcggccagctgccgcatcaagcgggtgacgcagaaggaggagctggagcggcagcgcgtggagctgcagcaggaggtggagaagctggcgcgtgagaacagcagcatgcggctggagctggacgccctgcgctccaagtacgaggcgctgcagaccttcgcgcgcaccgtggcccggggacctgtggcgccctccaaggtggccaccaccagcgtcatcaccatcgtcaagtccaccgagctctcctccacctccgtgcccttctcggctgcatcctagtgccggccgggggcggggggtggcgggcggcgggcggcgggcaggcgggtgggggcacacccctcgtacctgtcactgggatgcagactctcgacatccgagtccaagcgcaggcccctcgggcgcaggcagctcacaccaggaagagactgtattgcagggtgaagagtgggctcccgtgggcccagagctgcacgccggtccacagacacactcacgcccgccacctgctccccgcaggatgtgtctgtgtgtgggaattggtatcttgcacccgtgggagtcgggacatataatggaaaggccctcgggaagttccgcgtcctctgtgggggctgccggaagacacggccccaggagtcaggcccctgtggtcaggtctagcatggggcttgttttccactcctgctgtaagcagccttcgacacctgtcctgccacggcctcccagccggtgcgggagcccctcactgccctgaccgactccgcagtccccggggaggagcatggatggtgtgtcggcagctccgtccttccagctgtcccgttgcagtgcccgtgatccgcgtctgccttagcaggggcctgcgtgagtgggcacggtgtgggaggtcgcctgcgtggggtggtgtctgtgtgtgtgcacgcacgcctgccatcaaagcagcagggctgagggggtgcagcttgctggtgttcactgggggagggcctgtgggcacacatggcagagagagtggctcacacgtcgtgaggtctcccctgtgctctggtgacccgaggaggtcgtgcagcacagcgcagaagcccctgcccacgggatccggccccccagacaccgaccccacaggccgtcccggatctcagcggacacaggcaggagcgccccatcatttgacgtttgatactgtaaatctatcagagcagagccgggggcacgggcacaggtgggagttgggagcaaagcggaggcccgggctgcccgccgtcccccttcatctccccacggactgtaccaggcagctgggccccgcaggacaggccgcagcgggtggccggttctgtcccgtcttggggttcttggtgtccacgtcttgtgggccgtgggcttctacctgcccttggcctgcagtgctttgctggagaagggactccctggtccccagggtggacggagccgctgtcaccgcccagagctgggccggggaagcacggtgtgttctgcttttcttttcagattgttgaaatttcattgtcatgatttaatatatggatttttttatttaag

SEQ ID NO: 199226 - DNA, 1041 bp, Homo sapiens
  Payload ID: 19307
  Gene Name: v-mos Moloney murine sarcoma viral oncogene homolog
  Uniprot ID: P00540
  ENST ID: ENST00000311923
  CDS Start-End: 1-1041
atgccctcgcccctggccctacgcccctacctccggagcgagttttccccatcggtggacgcgcggccctgcagcagtccctcagagctacctgcgaagctgcttctgggggccactcttcctcgggccccgcggctgccgcgccggctggcctggtgctccattgactgggagcaggtgtgcttgctgcagaggctgggagctggagggtttggctcggtgtacaaggcgacttaccgcggtgttcctgtggccataaagcaagtgaacaagtgcaccaagaaccgactagcatctcggcggagtttctgggctgagctcaacgtagcaaggctgcgccacgataacatcgtgcgcgtggtggctgccagcacgcgcacgcccgcagggtccaatagcctagggaccatcatcatggagttcggtggcaacgtcactttacaccaagtcatctatggcgccgccggccaccctgagggggacgcaggggagcctcactgccgcactggaggacagttaagtttgggaaagtgtctcaagtactcactagatgttgtgaacggcctgctcttcctccactcgcaaagcattgtgcacttggacctgaagcccgcgaacatcttgatcagtgagcaggatgtctgtaaaattagtgacttcggttgctctgagaagttggaagatctgctgtgcttccagacaccctcttaccctctaggaggcacatacacccaccgcgccccggagctcctgaaaggagagggcgtgacgcctaaagccgacatttattcctttgccatcactctctggcaaatgactaccaagcaggcgccgtattcgggggagcggcagcacatactgtacgcggtggtggcctacgacctgcgcccgtccctctccgctgccgtcttcgaggactcgctccccgggcagcgccttggggacgtcatccagcgctgctggagacccagcgcggcgcagaggccgagcgcgcggctgcttttggtggatctcacctctttgaaagctgaactcggctga

SEQ ID NO: 199227 - DNA, 3571 bp, Homo sapiens
  Payload ID: 19308
  Gene Name: v-myb avian myeloblastosis viral oncogene homolog
  ENST ID: ENST00000316528
  CDS Start-End: 200-2380
aatatcaacctgtttcctcctcctccttctcctcctcctccgtgacctcctcctcctctttctcctgagaaacttcgccccagcggtgcggagcgccgctgcgcagccggggagggacgcaggcaggcggcgggcagcgggaggcggcagcccggtgcggtccccgcggctctcggcggagccccgcgcccgccgcgccatggcccgaagaccccggcacagcatatatagcagtgacgaggatgatgaggactttgagatgtgtgaccatgactatgatgggctgcttcccaagtctggaaagcgtcacttggggaaaacaaggtggacccgggaagaggatgaaaaactgaagaagctggtggaacagaatggaacagatgactggaaagttattgccaattatctcccgaatcgaacagatgtgcagtgccagcaccgatggcagaaagtactaaaccctgagctcatcaagggtccttggaccaaagaagaagatcagagagtgatagagcttgtacagaaatacggtccgaaacgttggtctgttattgccaagcacttaaaggggagaattggaaaacaatgtagggagaggtggcataaccacttgaatccagaagttaagaaaacctcctggacagaagaggaagacagaattatttaccaggcacacaagagactggggaacagatgggcagaaatcgcaaagctactgcctggacgaactgataatgctatcaagaaccactggaattctacaatgcgtcggaaggtcgaacaggaaggttatctgcaggagtcttcaaaagccagccagccagcagtggccacaagcttccagaagaacagtcatttgatgggttttgctcaggctccgcctacagctcaactccctgccactggccagcccactgttaacaacgactattcctattaccacatttctgaagcacaaaatgtctccagtcatgttccataccctgtagcgttacatgtaaatatagtcaatgtccctcagccagctgccgcagccattcagagacactataatgatgaagaccctgagaaggaaaagcgaataaaggaattagaattgctcctaatgtcaaccgagaatgagctaaaaggacagcaggtgctaccaacacagaaccacacatgcagctaccccgggtggcacagcaccaccattgccgaccacaccagacctcatggagacagtgcacctgtttcctgtttgggagaacaccactccactccatctctgccagcggatcctggctccctacctgaagaaagcgcctcgccagcaaggtgcatgatcgtccaccagggcaccattctggataatgttaagaacctcttagaatttgcagaaacactccaatttatagattctttcttaaacacttccagtaaccatgaaaactcagacttggaaatgccttctttaacttccacccccctcattggtcacaaattgactgttacaacaccatttcatagagaccagactgtgaaaactcaaaaggaaaatactgtttttagaaccccagctatcaaaaggtcaatcttagaaagctctccaagaactcctacaccattcaaacatgcacttgcagctcaagaaattaaatacggtcccctgaagatgctacctcagacaccctctcatctagtagaagatctgcaggatgtgatcaaacaggaatctgatgaatctggaattgttgctgagtttcaagaaaatggaccacccttactgaagaaaatcaaacaagaggtggaatctccaactgataaatcaggaaacttcttctgctcacaccactgggaaggggacagtctgaatacccaactgttcacgcagacctcgcctgtggcagatgcaccgactggagtgcaatggcacgatttcggctcactgcaacctctgcctcccgggttcaagcgattctcctgcctcagtctcccgagaagctgggattacaggcacccgccaccacgcccagctaattttgaatttttagtagagacggggtttctccatgttggtcaggctggtcttgaactcctgacctcaggtgatctacccgcctcggcctcccaaagtgctaggattacaggcgtgagccaccgcgcccggccagataatattcttacaagctccgttttaatggcaccagcatcagaagatgaagacaatgttctcaaagcatttacagtacctaaaaacaggtccctggcgagccccttgcagccttgtagcagtacctgggaacctgcatcctgtggaaagatggaggagcagatgacatcttccagtcaagctcgtaaatacgtgaatgcattctcagcccggacgctggtcatgtgagacatttccagaaaagcattatggttttcagaacacttcaagttgacttgggatatatcattcctcaacatgaaacttttcatgaatgggagaagaacctatttttgttgtggtacaacagttgagagcagcaccaagtgcatttagttgaatgaagtcttcttggatttcacccaactaaaaggatttttaaaaataaataacagtcttacctaaattattaggtaatgaattgtagccagttgttaatatcttaatgcagatttttttaaaaaaaacataaaatgatttatctgtattttaaaggatccaacagatcagtattttttcctgtgatgggttttttgaaatttgacacattaaaaggtactccagtatttcacttttctcgatcactaaacatatgcatatatttttaaaaatcagtaaaagcattactctaagtgtagacttaataccatgtgacatttaatccagattgtaaatgctcatttatggttaatgacattgaaggtacatttattgtaccaaaccattttatgagttttctgttagcttgctttaaaaattattactgtaagaaatagttttataaaaaattatatttttattcagtaatttaattttgtaaatgccaaatgaaaaacgttttttgctgctatggtcttagcctgtagacatgctgctagtatcagaggggcagtagagcttggacagaaagaaaagaaacttggtgttaggtaattgactatgcactagtatttcagactttttaattttatatatatatacattttttttccttctgcaatacatttgaaaacttgtttgggagactctgcattttttattgtggtttttttgttattgttggtttatacaagcatgcgttgcacttcttttttgggagatgtgtgttgttgatgttctatgttttgttttgagtgtagcctgactgttttataatttgggagttctgcatttgatccgcatcccctgtggtttctaagtgtatggtctcagaactgttgcatggatcctgtgtttgcaactggggagacagaaactgtggttgatagccagtcactgccttaagaacatttgatgcaagatggccagcactgaacttttgagatatgacggtgtacttactgccttgtagcaaaataaagatgtgcccttattttacct

SEQ ID NO: 199228 - DNA, 3672 bp, Homo sapiens
  Payload ID: 19308
  Gene Name: v-myb avian myeloblastosis viral oncogene homolog
  Uniprot ID: P10242
  ENST ID: ENST00000341911
  CDS Start-End: 200-2485
aatatcaacctgtttcctcctcctccttctcctcctcctccgtgacctcctcctcctctttctcctgagaaacttcgccccagcggtgcggagcgccgctgcgcagccggggagggacgcaggcaggcggcgggcagcgggaggcggcagcccggtgcggtccccgcggctctcggcggagccccgcgcccgccgcgccatggcccgaagaccccggcacagcatatatagcagtgacgaggatgatgaggactttgagatgtgtgaccatgactatgatgggctgcttcccaagtctggaaagcgtcacttggggaaaacaaggtggacccgggaagaggatgaaaaactgaagaagctggtggaacagaatggaacagatgactggaaagttattgccaattatctcccgaatcgaacagatgtgcagtgccagcaccgatggcagaaagtactaaaccctgagctcatcaagggtccttggaccaaagaagaagatcagagagtgatagagcttgtacagaaatacggtccgaaacgttggtctgttattgccaagcacttaaaggggagaattggaaaacaatgtagggagaggtggcataaccacttgaatccagaagttaagaaaacctcctggacagaagaggaagacagaattatttaccaggcacacaagagactggggaacagatgggcagaaatcgcaaagctactgcctggacgaactgataatgctatcaagaaccactggaattctacaatgcgtcggaaggtcgaacaggaaggttatctgcaggagtcttcaaaagccagccagccagcagtggccacaagcttccagaagaacagtcatttgatgggttttgctcaggctccgcctacagctcaactccctgccactggccagcccactgttaacaacgactattcctattaccacatttctgaagcacaaaatgtctccagtcatgttccataccctgtagcgttacatgtaaatatagtcaatgtccctcagccagctgccgcagccattcagagacactataatgatgaagaccctgagaaggaaaagcgaataaaggaattagaattgctcctaatgtcaaccgagaatgagctaaaaggacagcaggtgctaccaacacagaaccacacatgcagctaccccgggtggcacagcaccaccattgccgaccacaccagacctcatggagacagtgcacctgtttcctgtttgggagaacaccactccactccatctctgccagcggatcctggctccctacctgaagaaagcgcctcgccagcaaggtgcatgatcgtccaccagggcaccattctggataatgttaagaacctcttagaatttgcagaaacactccaatttatagattctgattcttcatcatggtgtgatctcagcagttttgaattctttgaagaagcagatttttcacctagccaacatcacacaggcaaagccctacagcttcagcaaagagagggcaatgggactaaacctgcaggagaacctagcccaagggtgaacaaacgtatgttgagtgagagttcacttgacccacccaaggtcttacctcctgcaaggcacagcacaattccactggtcatccttcgaaaaaaacggggccaggccagccccttagccactggagactgtagctccttcatatttgctgacgtcagcagttcaactcccaagcgttcccctgtcaaaagcctacccttctctccctcgcagttcttaaacacttccagtaaccatgaaaactcagacttggaaatgccttctttaacttccacccccctcattggtcacaaattgactgttacaacaccatttcatagagaccagactgtgaaaactcaaaaggaaaatactgtttttagaaccccagctatcaaaaggtcaatcttagaaagctctccaagaactcctacaccattcaaacatgcacttgcagctcaagaaattaaatacggtcccctgaagatgctacctcagacaccctctcatctagtagaagatctgcaggatgtgatcaaacaggaatctgatgaatctggaattgttgctgagtttcaagaaaatggaccacccttactgaagaaaatcaaacaagaggtggaatctccaactgataaatcaggaaacttcttctgctcacaccactgggaaggggacagtctgaatacccaactgttcacgcagacctcgcctgtggcagatgcaccgaatattcttacaagctccgttttaatggcaccagcatcagaagatgaagacaatgttctcaaagcatttacagtacctaaaaacaggtccctggcgagccccttgcagccttgtagcagtacctgggaacctgcatcctgtggaaagatggaggagcagatgacatcttccagtcaagctcgtaaatacgtgaatgcattctcagcccggacgctggtcatgtgagacatttccagaaaagcattatggttttcagaacacttcaagttgacttgggatatatcattcctcaacatgaaacttttcatgaatgggagaagaacctatttttgttgtggtacaacagttgagagcagcaccaagtgcatttagttgaatgaagtcttcttggatttcacccaactaaaaggatttttaaaaataaataacagtcttacctaaattattaggtaatgaattgtagccagttgttaatatcttaatgcagatttttttaaaaaaaacataaaatgatttatctgtattttaaaggatccaacagatcagtattttttcctgtgatgggttttttgaaatttgacacattaaaaggtactccagtatttcacttttctcgatcactaaacatatgcatatatttttaaaaatcagtaaaagcattactctaagtgtagacttaataccatgtgacatttaatccagattgtaaatgctcatttatggttaatgacattgaaggtacatttattgtaccaaaccattttatgagttttctgttagcttgctttaaaaattattactgtaagaaatagttttataaaaaattatatttttattcagtaatttaattttgtaaatgccaaatgaaaaacgttttttgctgctatggtcttagcctgtagacatgctgctagtatcagaggggcagtagagcttggacagaaagaaaagaaacttggtgttaggtaattgactatgcactagtatttcagactttttaattttatatatatatacattttttttccttctgcaatacatttgaaaacttgtttgggagactctgcattttttattgtggtttttttgttattgttggtttatacaagcatgcgttgcacttcttttttgggagatgtgtgttgttgatgttctatgttttgttttgagtgtagcctgactgttttataatttgggagttctgcatttgatccgcatcccctgtggtttctaagtgtatggtctcagaactgttgcatggatcctgtgtttgcaactggggagacagaaactgtggttgatagccagtcactgccttaagaacatttgatgcaagatggccagcactgaacttttgagatatgacggtgtacttactgccttgtagcaaaataaagatgtgcccttatttt

SEQ ID NO: 199229 - DNA, 3365 bp, Homo sapiens
  Payload ID: 19308
  Gene Name: v-myb avian myeloblastosis viral oncogene homolog
  ENST ID: ENST00000339290
  CDS Start-End: 200-1549
aatatcaacctgtttcctcctcctccttctcctcctcctccgtgacctcctcctcctctttctcctgagaaacttcgccccagcggtgcggagcgccgctgcgcagccggggagggacgcaggcaggcggcgggcagcgggaggcggcagcccggtgcggtccccgcggctctcggcggagccccgcgcccgccgcgccatggcccgaagaccccggcacagcatatatagcagtgacgaggatgatgaggactttgagatgtgtgaccatgactatgatgggctgcttcccaagtctggaaagcgtcacttggggaaaacaaggtggacccgggaagaggatgaaaaactgaagaagctggtggaacagaatggaacagatgactggaaagttattgccaattatctcccgaatcgaacagatgtgcagtgccagcaccgatggcagaaagtactaaaccctgagctcatcaagggtccttggaccaaagaagaagatcagagagtgatagagcttgtacagaaatacggtccgaaacgttggtctgttattgccaagcacttaaaggggagaattggaaaacaatgtagggagaggtggcataaccacttgaatccagaagttaagaaaacctcctggacagaagaggaagacagaattatttaccaggcacacaagagactggggaacagatgggcagaaatcgcaaagctactgcctggacgaactgataatgctatcaagaaccactggaattctacaatgcgtcggaaggtcgaacaggaaggttatctgcaggagtcttcaaaagccagccagccagcagtggccacaagcttccagaagaacagtcatttgatgggttttgctcaggctccgcctacagctcaactccctgccactggccagcccactgttaacaacgactattcctattaccacatttctgaagcacaaaatgtctccagtcatgttccataccctgtagcgttacatgtaaatatagtcaatgtccctcagccagctgccgcagccattcagagacactataatgatgaagaccctgagaaggaaaagcgaataaaggaattagaattgctcctaatgtcaaccgagaatgagctaaaaggacagcaggtgctaccaacacagaaccacacatgcagctaccccgggtggcacagcaccaccattgccgaccacaccagacctcatggagacagtgcacctgtttcctgtttgggagaacaccactccactccatctctgccagcggatcctggctccctacctgaagaaagcgcctcgccagcaaggtgcatgatcgtccaccagggcaccattctggataatgttaagaacctcttagaatttgcagaaacactccaatttatagattctttcttaaacacttccagtaaccatgaaaactcagacttggaaatgccttctttaacttccacccccctcattggtcacaaattgactgttacaacaccatttcatagagaccagactgtgaaaactcaaaaggaaaatactgtataggacctcttctgacatccccaggaatattatatgattagaagccaagggatgattttagaaccccagctatcaaaaggtcaatcttagaaagctctccaagaactcctacaccattcaaacatgcacttgcagctcaagaaattaaatacggtcccctgaagatgctacctcagacaccctctcatctagtagaagatctgcaggatgtgatcaaacaggaatctgatgaatctggaattgttgctgagtttcaagaaaatggaccacccttactgaagaaaatcaaacaagaggtggaatctccaactgataaatcaggaaacttcttctgctcacaccactgggaaggggacagtctgaatacccaactgttcacgcagacctcgcctgtggcagatgcaccgaatattcttacaagctccgttttaatggcaccagcatcagaagatgaagacaatgttctcaaagcatttacagtacctaaaaacaggtccctggcgagccccttgcagccttgtagcagtacctgggaacctgcatcctgtggaaagatggaggagcagatgacatcttccagtcaagctcgtaaatacgtgaatgcattctcagcccggacgctggtcatgtgagacatttccagaaaagcattatggttttcagaacacttcaagttgacttgggatatatcattcctcaacatgaaacttttcatgaatgggagaagaacctatttttgttgtggtacaacagttgagagcagcaccaagtgcatttagttgaatgaagtcttcttggatttcacccaactaaaaggatttttaaaaataaataacagtcttacctaaattattaggtaatgaattgtagccagttgttaatatcttaatgcagatttttttaaaaaaaacataaaatgatttatctgtattttaaaggatccaacagatcagtattttttcctgtgatgggttttttgaaatttgacacattaaaaggtactccagtatttcacttttctcgatcactaaacatatgcatatatttttaaaaatcagtaaaagcattactctaagtgtagacttaataccatgtgacatttaatccagattgtaaatgctcatttatggttaatgacattgaaggtacatttattgtaccaaaccattttatgagttttctgttagcttgctttaaaaattattactgtaagaaatagttttataaaaaattatatttttattcagtaatttaattttgtaaatgccaaatgaaaaacgttttttgctgctatggtcttagcctgtagacatgctgctagtatcagaggggcagtagagcttggacagaaagaaaagaaacttggtgttaggtaattgactatgcactagtatttcagactttttaattttatatatatatacattttttttccttctgcaatacatttgaaaacttgtttgggagactctgcattttttattgtggtttttttgttattgttggtttatacaagcatgcgttgcacttcttttttgggagatgtgtgttgttgatgttctatgttttgttttgagtgtagcctgactgttttataatttgggagttctgcatttgatccgcatcccctgtggtttctaagtgtatggtctcagaactgttgcatggatcctgtgtttgcaactggggagacagaaactgtggttgatagccagtcactgccttaagaacatttgatgcaagatggccagcactgaacttttgagatatgacggtgtacttactgccttgtagcaaaataaagatgtgcccttatttt

SEQ ID NO: 199230 - DNA, 3565 bp, Homo sapiens
  Payload ID: 19308
  Gene Name: v-myb avian myeloblastosis viral oncogene homolog
  Uniprot ID: P10242
  ENST ID: ENST00000367812
  CDS Start-End: 200-2200
aatatcaacctgtttcctcctcctccttctcctcctcctccgtgacctcctcctcctctttctcctgagaaacttcgccccagcggtgcggagcgccgctgcgcagccggggagggacgcaggcaggcggcgggcagcgggaggcggcagcccggtgcggtccccgcggctctcggcggagccccgcgcccgccgcgccatggcccgaagaccccggcacagcatatatagcagtgacgaggatgatgaggactttgagatgtgtgaccatgactatgatgggctgcttcccaagtctggaaagcgtcacttggggaaaacaaggtggacccgggaagaggatgaaaaactgaagaagctggtggaacagaatggaacagatgactggaaagttattgccaattatctcccgaatcgaacagatgtgcagtgccagcaccgatggcagaaagtactaaaccctgagctcatcaagggtccttggaccaaagaagaagatcagagagtgatagagcttgtacagaaatacggtccgaaacgttggtctgttattgccaagcacttaaaggggagaattggaaaacaatgtagggagaggtggcataaccacttgaatccagaagttaagaaaacctcctggacagaagaggaagacagaattatttaccaggcacacaagagactggggaacagatgggcagaaatcgcaaagctactgcctggacgaactgataatgctatcaagaaccactggaattctacaatgcgtcggaaggtcgaacaggaaggttatctgcaggagtcttcaaaagccagccagccagcagtggccacaagcttccagaagaacagtcatttgatgggttttgctcaggctccgcctacagctcaactccctgccactggccagcccactgttaacaacgactattcctattaccacatttctgaagcacaaaatgtctccagtcatgttccataccctgtagcgttacatgtaaatatagtcaatgtccctcagccagctgccgcagccattcagagacactataatgatgaagaccctgagaaggaaaagcgaataaaggaattagaattgctcctaatgtcaaccgagaatgagctaaaaggacagcaggtgctaccaacacagaaccacacatgcagctaccccgggtggcacagcaccaccattgccgaccacaccagacctcatggagacagtgcacctgtttcctgtttgggagaacaccactccactccatctctgccagcggatcctggctccctacctgaagaaagcgcctcgccagcaaggtgcatgatcgtccaccagggcaccattctggataatgttaagaacctcttagaatttgcagaaacactccaatttatagattctttcttaaacacttccagtaaccatgaaaactcagacttggaaatgccttctttaacttccacccccctcattggtcacaaattgactgttacaacaccatttcatagagaccagactgtgaaaactcaaaaggaaaatactgtttttagaaccccagctatcaaaaggtcaatcttagaaagctctccaagaactcctacaccattcaaacatgcacttgcagctcaagaaattaaatacggtcccctgaagatgctacctcagacaccctctcatctagtagaagatctgcaggatgtgatcaaacaggaatctgatgaatctggaattgttgctgagtttcaagaaaatggaccacccttactgaagaaaatcaaacaagaggtggaatctccaactgataaatcaggaaacttcttctgctcacaccactgggaaggggacagtctgaatacccaactgttcacgcagacctcgcctgtggcagatgcaccgactggagtgcaatggcacgatttcggctcactgcaacctctgcctcccgggttcaagcgattctcctgcctcagtctcccgagaagctgggattacaggcacccgccaccacgcccagctaattttgaatttttagtagagacggggtttctccatgttggtcaggctggtcttgaactcctgacctcaggtgatctacccgcctcggcctcccaaagtgctaggattacaggcgtgagccaccgcgcccggccagaatattcttacaagctccgttttaatggcaccagcatcagaagatgaagacaatgttctcaaagcatttacagtacctaaaaacaggtccctggcgagccccttgcagccttgtagcagtacctgggaacctgcatcctgtggaaagatggaggagcagatgacatcttccagtcaagctcgtaaatacgtgaatgcattctcagcccggacgctggtcatgtgagacatttccagaaaagcattatggttttcagaacacttcaagttgacttgggatatatcattcctcaacatgaaacttttcatgaatgggagaagaacctatttttgttgtggtacaacagttgagagcagcaccaagtgcatttagttgaatgaagtcttcttggatttcacccaactaaaaggatttttaaaaataaataacagtcttacctaaattattaggtaatgaattgtagccagttgttaatatcttaatgcagatttttttaaaaaaaacataaaatgatttatctgtattttaaaggatccaacagatcagtattttttcctgtgatgggttttttgaaatttgacacattaaaaggtactccagtatttcacttttctcgatcactaaacatatgcatatatttttaaaaatcagtaaaagcattactctaagtgtagacttaataccatgtgacatttaatccagattgtaaatgctcatttatggttaatgacattgaaggtacatttattgtaccaaaccattttatgagttttctgttagcttgctttaaaaattattactgtaagaaatagttttataaaaaattatatttttattcagtaatttaattttgtaaatgccaaatgaaaaacgttttttgctgctatggtcttagcctgtagacatgctgctagtatcagaggggcagtagagcttggacagaaagaaaagaaacttggtgttaggtaattgactatgcactagtatttcagactttttaattttatatatatatacattttttttccttctgcaatacatttgaaaacttgtttgggagactctgcattttttattgtggtttttttgttattgttggtttatacaagcatgcgttgcacttcttttttgggagatgtgtgttgttgatgttctatgttttgttttgagtgtagcctgactgttttataatttgggagttctgcatttgatccgcatcccctgtggtttctaagtgtatggtctcagaactgttgcatggatcctgtgtttgcaactggggagacagaaactgtggttgatagccagtcactgccttaagaacatttgatgcaagatggccagcactgaacttttgagatatgacggtgtacttactgccttgtagcaaaataaagatgtgcccttatttt

SEQ ID NO: 199231 - DNA, 3302 bp, Homo sapiens
  Payload ID: 19308
  Gene Name: v-myb avian myeloblastosis viral oncogene homolog
  Uniprot ID: P10242
  ENST ID: ENST00000367814
  CDS Start-End: 187-2109
ttcctcctcctccttctcctcctcctccgtgacctcctcctcctctttctcctgagaaacttcgccccagcggtgcggagcgccgctgcgcagccggggagggacgcaggcaggcggcgggcagcgggaggcggcagcccggtgcggtccccgcggctctcggcggagccccgcgcccgccgcgccatggcccgaagaccccggcacagcatatatagcagtgacgaggatgatgaggactttgagatgtgtgaccatgactatgatgggctgcttcccaagtctggaaagcgtcacttggggaaaacaaggtggacccgggaagaggatgaaaaactgaagaagctggtggaacagaatggaacagatgactggaaagttattgccaattatctcccgaatcgaacagatgtgcagtgccagcaccgatggcagaaagtactaaaccctgagctcatcaagggtccttggaccaaagaagaagatcagagagtgatagagcttgtacagaaatacggtccgaaacgttggtctgttattgccaagcacttaaaggggagaattggaaaacaatgtagggagaggtggcataaccacttgaatccagaagttaagaaaacctcctggacagaagaggaagacagaattatttaccaggcacacaagagactggggaacagatgggcagaaatcgcaaagctactgcctggacgaactgataatgctatcaagaaccactggaattctacaatgcgtcggaaggtcgaacaggaaggttatctgcaggagtcttcaaaagccagccagccagcagtggccacaagcttccagaagaacagtcatttgatgggttttgctcaggctccgcctacagctcaactccctgccactggccagcccactgttaacaacgactattcctattaccacatttctgaagcacaaaatgtctccagtcatgttccataccctgtagcgttacatgtaaatatagtcaatgtccctcagccagctgccgcagccattcagagacactataatgatgaagaccctgagaaggaaaagcgaataaaggaattagaattgctcctaatgtcaaccgagaatgagctaaaaggacagcaggtgctaccaacacagaaccacacatgcagctaccccgggtggcacagcaccaccattgccgaccacaccagacctcatggagacagtgcacctgtttcctgtttgggagaacaccactccactccatctctgccagcggatcctggctccctacctgaagaaagcgcctcgccagcaaggtgcatgatcgtccaccagggcaccattctggataatgttaagaacctcttagaatttgcagaaacactccaatttatagattctttcttaaacacttccagtaaccatgaaaactcagacttggaaatgccttctttaacttccacccccctcattggtcacaaattgactgttacaacaccatttcatagagaccagactgtgaaaactcaaaaggaaaatactgtttttagaaccccagctatcaaaaggtcaatcttagaaagctctccaagaactcctacaccattcaaacatgcacttgcagctcaagaaattaaatacggtcccctgaagatgctacctcagacaccctctcatctagtagaagatctgcaggatgtgatcaaacaggaatctgatgaatctggaattgttgctgagtttcaagaaaatggaccacccttactgaagaaaatcaaacaagaggtggaatctccaactgataaatcaggaaacttcttctgctcacaccactgggaaggggacagtctgaatacccaactgttcacgcagacctcgcctgtggcagatgcaccgaatattcttacaagctccgttttaatggcaccagcatcagaagatgaagacaatgttctcaaagcatttacagtacctaaaaacaggtccctggcgagccccttgcagccttgtagcagtacctgggaacctgcatcctgtggaaagatggaggagcagatgacatcttccagtcaagctcgtaaatacgtgaatgcattctcagcccggacgctggtcatgtgagacatttccagaaaagcattatggttttcagaacacttcaagttgacttgggatatatcattcctcaacatgaaacttttcatgaatgggagaagaacctatttttgttgtggtacaacagttgagagcagcaccaagtgcatttagttgaatgaagtcttcttggatttcacccaactaaaaggatttttaaaaataaataacagtcttacctaaattattaggtaatgaattgtagccagttgttaatatcttaatgcagatttttttaaaaaaaacataaaatgatttatctgtattttaaaggatccaacagatcagtattttttcctgtgatgggttttttgaaatttgacacattaaaaggtactccagtatttcacttttctcgatcactaaacatatgcatatatttttaaaaatcagtaaaagcattactctaagtgtagacttaataccatgtgacatttaatccagattgtaaatgctcatttatggttaatgacattgaaggtacatttattgtaccaaaccattttatgagttttctgttagcttgctttaaaaattattactgtaagaaatagttttataaaaaattatatttttattcagtaatttaattttgtaaatgccaaatgaaaaacgttttttgctgctatggtcttagcctgtagacatgctgctagtatcagaggggcagtagagcttggacagaaagaaaagaaacttggtgttaggtaattgactatgcactagtatttcagactttttaattttatatatatatacattttttttccttctgcaatacatttgaaaacttgtttgggagactctgcattttttattgtggtttttttgttattgttggtttatacaagcatgcgttgcacttcttttttgggagatgtgtgttgttgatgttctatgttttgttttgagtgtagcctgactgttttataatttgggagttctgcatttgatccgcatcccctgtggtttctaagtgtatggtctcagaactgttgcatggatcctgtgtttgcaactggggagacagaaactgtggttgatagccagtcactgccttaagaacatttgatgcaagatggccagcactgaacttttgagatatgacggtgtacttactgccttgtagcaaaataaagatgtgcccttattttacctac

SEQ ID NO: 199232 - DNA, 1036 bp, Homo sapiens
  Payload ID: 19308
  Gene Name: v-myb avian myeloblastosis viral oncogene homolog
  ENST ID: ENST00000430686
  CDS Start-End: 1-834
gaggatgaaaaactgaagaagctggtggaacagaatggaacagatgactggaaagttattgccaattatctcccgaatcgaacagatgtgcagtgccagcaccgatggcagaaagtactaaaccctgagctcatcaagggtccttggaccaaagaagaagatcagagagtgatagagcttgtacagaaatacggtccgaaacgttggtctgttattgccaagcacttaaaggggagaattggaaaacaatgtagggagaggtggcataaccacttgaatccagaagttaagaaaacctcctggacagaagaggaagacagaattatttaccaggcacacaagagactggggaacagatgggcagaaatcgcaaagctactgcctggacgaactgataatgctatcaagaaccactggaattctacaatgcgtcggaaggtcgaacaggaaggttatctgcaggagtcttcaaaagccagccagccagcagtggccacaagcttccagaagaacagtcatttgatgggttttgctcaggctccgcctacagctcaactccctgccactggccagcccactgttaacaacgactattcctattaccacatttctgaagcacaaaatgtctccagtcatgttccataccctgtagcgttacatgtaaatatagtcaatgtccctcagccagctgccgcagccattcagagacactataatgatgaagaccctgagaaggaaaagcgaataaaggaattagaattgctcctaatgtcaaccgagaatgagctaaaaggacagcaggtgctaccagtaagactgtcatcatgtgcttgaatgaggggatagcagctttgcctcagtttacctaagcgctcttctcttctaaatattacacttagcaaggctccatatatccattcagaatgtctcaacacaagaagttgcttgtagtaaaatgtagttggtatcagattatatgctgattaaattggaagcagtctttttgtaattgcaataaaaatgcaatatccactta

SEQ ID NO: 199233 - DNA, 1051 bp, Homo sapiens
  Payload ID: 19308
  Gene Name: v-myb avian myeloblastosis viral oncogene homolog
  ENST ID: ENST00000420123
  CDS Start-End: 94-993
ccggggagggacgcaggcaggcggcgggcagcgggaggcggcagcccggtgcggtccccgcggctctcggcggagccccgcgcccgccgcgccatggcccgaagaccccggcacagcatatatagcagtgacgaggatgatgaggactttgagatgtgtgaccatgactatgatgggctgcttcccaagtctggaaagcgtcacttggggaaaacaaggtggacccgggaagagaatcgaacagatgtgcagtgccagcaccgatggcagaaagtactaaaccctgagctcatcaagggtccttggaccaaagaagaagatcagagagtgatagagcttgtacagaaatacggtccgaaacgttggtctgttattgccaagcacttaaaggggagaattggaaaacaatgtagggagaggtggcataaccacttgaatccagaagttaagaaaacctcctggacagaagaggaagacagaattatttaccaggcacacaagagactggggaacagatgggcagaaatcgcaaagctactgcctggacgaactgataatgctatcaagaaccactggaattctacaatgcgtcggaaggtcgaacaggaaggttatctgcaggagtcttcaaaagccagccagccagcagtggccacaagcttccagaagaacagtcatttgatgggttttgctcaggctccgcctacagctcaactccctgccactggccagcccactgttaacaacgactattcctattaccacatttctgaagcacaaaatgtctccagtcatgttccataccctgtagcgttacatgtaaatatagtcaatgtccctcagccagctgccgcagccattcagagacactataatgatgaagaccctgagaaggaaaagcgaataaaggaattagaattgctcctaatgtcaaccgagaatgagctaaaaggacagcaggtgctaccagtaagactgtcatcatgtgcttgaatgaggggatagcagctttgcctcagtttacctaagcgctcttctcttctaaatatta

SEQ ID NO: 199234 - DNA, 3304 bp, Homo sapiens
  Payload ID: 19308
  Gene Name: v-myb avian myeloblastosis viral oncogene homolog
  Uniprot ID: P10242
  ENST ID: ENST00000442647
  CDS Start-End: 200-2113
aatatcaacctgtttcctcctcctccttctcctcctcctccgtgacctcctcctcctctttctcctgagaaacttcgccccagcggtgcggagcgccgctgcgcagccggggagggacgcaggcaggcggcgggcagcgggaggcggcagcccggtgcggtccccgcggctctcggcggagccccgcgcccgccgcgccatggcccgaagaccccggcacagcatatatagcagtgacgaggatgatgaggactttgagatgtgtgaccatgactatgatgggctgcttcccaagtctggaaagcgtcacttggggaaaacaaggtggacccgggaagaggatgaaaaactgaagaagctggtggaacagaatggaacagatgactggaaagttattgccaattatctcccgaatcgaacagatgtgcagtgccagcaccgatggcagaaagtactaaaccctgagctcatcaagggtccttggaccaaagaagaagatcagagagtgatagagcttgtacagaaatacggtccgaaacgttggtctgttattgccaagcacttaaaggggagaattggaaaacaatgtagggagaggtggcataaccacttgaatccagaagttaagaaaacctcctggacagaagaggaagacagaattatttaccaggcacacaagagactggggaacagatgggcagaaatcgcaaagctactgcctggacgaactgataatgctatcaagaaccactggaattctacaatgcgtcggaaggtcgaacaggaaggttatctgcaggagtcttcaaaagccagccagccagcagtggccacaagcttccagaagaacagtcatttgatgggttttgctcaggctccgcctacagctcaactccctgccactggccagcccactgttaacaacgactattcctattaccacatttctgaagcacaaaatgtctccagtcatgttccataccctgtagcgttacatgtaaatatagtcaatgtccctcagccagctgccgcagccattcagagacactataatgatgaagaccctgagaaggaaaagcgaataaaggaattagaattgctcctaatgtcaaccgagaatgagctaaaaggacagcagacacagaaccacacatgcagctaccccgggtggcacagcaccaccattgccgaccacaccagacctcatggagacagtgcacctgtttcctgtttgggagaacaccactccactccatctctgccagcggatcctggctccctacctgaagaaagcgcctcgccagcaaggtgcatgatcgtccaccagggcaccattctggataatgttaagaacctcttagaatttgcagaaacactccaatttatagattctttcttaaacacttccagtaaccatgaaaactcagacttggaaatgccttctttaacttccacccccctcattggtcacaaattgactgttacaacaccatttcatagagaccagactgtgaaaactcaaaaggaaaatactgtttttagaaccccagctatcaaaaggtcaatcttagaaagctctccaagaactcctacaccattcaaacatgcacttgcagctcaagaaattaaatacggtcccctgaagatgctacctcagacaccctctcatctagtagaagatctgcaggatgtgatcaaacaggaatctgatgaatctggaattgttgctgagtttcaagaaaatggaccacccttactgaagaaaatcaaacaagaggtggaatctccaactgataaatcaggaaacttcttctgctcacaccactgggaaggggacagtctgaatacccaactgttcacgcagacctcgcctgtggcagatgcaccgaatattcttacaagctccgttttaatggcaccagcatcagaagatgaagacaatgttctcaaagcatttacagtacctaaaaacaggtccctggcgagccccttgcagccttgtagcagtacctgggaacctgcatcctgtggaaagatggaggagcagatgacatcttccagtcaagctcgtaaatacgtgaatgcattctcagcccggacgctggtcatgtgagacatttccagaaaagcattatggttttcagaacacttcaagttgacttgggatatatcattcctcaacatgaaacttttcatgaatgggagaagaacctatttttgttgtggtacaacagttgagagcagcaccaagtgcatttagttgaatgaagtcttcttggatttcacccaactaaaaggatttttaaaaataaataacagtcttacctaaattattaggtaatgaattgtagccagttgttaatatcttaatgcagatttttttaaaaaaaacataaaatgatttatctgtattttaaaggatccaacagatcagtattttttcctgtgatgggttttttgaaatttgacacattaaaaggtactccagtatttcacttttctcgatcactaaacatatgcatatatttttaaaaatcagtaaaagcattactctaagtgtagacttaataccatgtgacatttaatccagattgtaaatgctcatttatggttaatgacattgaaggtacatttattgtaccaaaccattttatgagttttctgttagcttgctttaaaaattattactgtaagaaatagttttataaaaaattatatttttattcagtaatttaattttgtaaatgccaaatgaaaaacgttttttgctgctatggtcttagcctgtagacatgctgctagtatcagaggggcagtagagcttggacagaaagaaaagaaacttggtgttaggtaattgactatgcactagtatttcagactttttaattttatatatatatacattttttttccttctgcaatacatttgaaaacttgtttgggagactctgcattttttattgtggtttttttgttattgttggtttatacaagcatgcgttgcacttcttttttgggagatgtgtgttgttgatgttctatgttttgttttgagtgtagcctgactgttttataatttgggagttctgcatttgatccgcatcccctgtggtttctaagtgtatggtctcagaactgttgcatggatcctgtgtttgcaactggggagacagaaactgtggttgatagccagtcactgccttaagaacatttgatgcaagatggccagcactgaacttttgagatatgacggtgtacttactgccttgtagcaaaataaagatgtgcccttattttacct

SEQ ID NO: 199235 - DNA, 3481 bp, Homo sapiens
  Payload ID: 19308
  Gene Name: v-myb avian myeloblastosis viral oncogene homolog
  ENST ID: ENST00000438901
  CDS Start-End: 1-1665
atggcccgaagaccccggcacagcatatatagcagtgacgaggatgatgaggactttgagatgtgtgaccatgactatgatgggctgcttcccaagtctggaaagcgtcacttggggaaaacaaggtggacccgggaagaggatgaaaaactgaagaagctggtggaacagaatggaacagatgactggaaagttattgccaattatctcccgaatcgaacagatgtgcagtgccagcaccgatggcagaaagtactaaaccctgagctcatcaagggtccttggaccaaagaagaagatcagagagtgatagagcttgtacagaaatacggtccgaaacgttggtctgttattgccaagcacttaaaggggagaattggaaaacaatgtagggagaggtggcataaccacttgaatccagaagttaagaaaacctcctggacagaagaggaagacagaattatttaccaggcacacaagagactggggaacagatgggcagaaatcgcaaagctactgcctggacgaactgataatgctatcaagaaccactggaattctacaatgcgtcggaaggtcgaacaggaaggttatctgcaggagtcttcaaaagccagccagccagcagtggccacaagcttccagaagaacagtcatttgatgggttttgctcaggctccgcctacagctcaactccctgccactggccagcccactgttaacaacgactattcctattaccacatttctgaagcacaaaatgtctccagtcatgttccataccctgtagcgttacatgtaaatatagtcaatgtccctcagccagctgccgcagccattcagagacactataatgatgaagaccctgagaaggaaaagcgaataaaggaattagaattgctcctaatgtcaaccgagaatgagctaaaaggacagcaggtgctaccaacacagaaccacacatgcagctaccccgggtggcacagcaccaccattgccgaccacaccagacctcatggagacagtgcacctgtttcctgtttgggagaacaccactccactccatctctgccagcggatcctggctccctacctgaagaaagcgcctcgccagcaaggtgcatgatcgtccaccagggcaccattctggataatgattcttcatcatggtgtgatctcagcagttttgaattctttgaagaagcagatttttcacctagccaacatcacacaggcaaagccctacagcttcagcaaagagagggcaatgggactaaacctgcaggagaacctagcccaagggtgaacaaacgtatgttgagtgagagttcacttgacccacccaaggtcttacctcctgcaaggcacagcacaattccactggtcatccttcgaaaaaaacggggccaggccagccccttagccactggagactgtagctccttcatatttgctgacgtcagcagttcaactcccaagcgttcccctgtcaaaagcctacccttctctccctcgcagttcttaaacacttccagtaaccatgaaaactcagacttggaaatgccttctttaacttccacccccctcattggtcacaaattgactgttacaacaccatttcatagagaccagactgtgaaaactcaaaaggaaaatactgtataggacctcttctgacatccccaggaatattatatgattagaagccaagggatgattttagaaccccagctatcaaaaggtcaatcttagaaagctctccaagaactcctacaccattcaaacatgcacttgcagctcaagaaattaaatacggtcccctgaagatgctacctcagacaccctctcatctagtagaagatctgcaggatgtgatcaaacaggaatctgatgaatctggaattgttgctgagtttcaagaaaatggaccacccttactgaagaaaatcaaacaagaggtggaatctccaactgataaatcaggaaacttcttctgctcacaccactgggaaggggacagtctgaatacccaactgttcacgcagacctcgcctgtggcagatgcaccgaatattcttacaagctccgttttaatggcaccagcatcagaagatgaagacaatgttctcaaagcatttacagtacctaaaaacaggtccctggcgagccccttgcagccttgtagcagtacctgggaacctgcatcctgtggaaagatggaggagcagatgacatcttccagtcaagctcgtaaatacgtgaatgcattctcagcccggacgctggtcatgtgagacatttccagaaaagcattatggttttcagaacacttcaagttgacttgggatatatcattcctcaacatgaaacttttcatgaatgggagaagaacctatttttgttgtggtacaacagttgagagcagcaccaagtgcatttagttgaatgaagtcttcttggatttcacccaactaaaaggatttttaaaaataaataacagtcttacctaaattattaggtaatgaattgtagccagttgttaatatcttaatgcagatttttttaaaaaaaacataaaatgatttatctgtattttaaaggatccaacagatcagtattttttcctgtgatgggttttttgaaatttgacacattaaaaggtactccagtatttcacttttctcgatcactaaacatatgcatatatttttaaaaatcagtaaaagcattactctaagtgtagacttaataccatgtgacatttaatccagattgtaaatgctcatttatggttaatgacattgaaggtacatttattgtaccaaaccattttatgagttttctgttagcttgctttaaaaattattactgtaagaaatagttttataaaaaattatatttttattcagtaatttaattttgtaaatgccaaatgaaaaacgttttttgctgctatggtcttagcctgtagacatgctgctagtatcagaggggcagtagagcttggacagaaagaaaagaaacttggtgttaggtaattgactatgcactagtatttcagactttttaattttatatatatatacattttttttccttctgcaatacatttgaaaacttgtttgggagactctgcattttttattgtggtttttttgttattgttggtttatacaagcatgcgttgcacttcttttttgggagatgtgtgttgttgatgttctatgttttgttttgagtgtagcctgactgttttataatttgggagttctgcatttgatccgcatcccctgtggtttctaagtgtatggtctcagaactgttgcatggatcctgtgtttgcaactggggagacagaaactgtggttgatagccagtcactgccttaagaacatttgatgcaagatggccagcactgaacttttgagatatgacggtgtacttactgccttgtagcaaaataaagatgtgcccttatttt

SEQ ID NO: 199236 - DNA, 801 bp, Homo sapiens
  Payload ID: 19308
  Gene Name: v-myb avian myeloblastosis viral oncogene homolog
  ENST ID: ENST00000534736
  CDS Start-End: 1-261
acacagaaccacacatgcagctaccccgggtggcacagcaccaccattgccgaccacaccagacctcatggagacagtgcacctgtttcctgtttgggagaacaccactccactccatctctgccagcggatcctggctccctacctgaagaaagcgcctcgccagcaaggtgcatgatcgtccaccagggcaccattctggataatgttaagaacctcttagaatttgcagaaacactccaatttatagattctatgtagagtgtcgggaggtccctgcagcacatcagagggccagccttgaggcagcccactagaccctgctctactgcagtataatagagcaactgctcatcttgaagctgttgctcaagaagccaaaccaacgggcctagtgtttgctttgcgttgagcatctctctctcagtgctgtttcaggattcttcatcatggtgtgatctcagcagttttgaattctttgaagaagcagatttttcacctagccaacatcacacaggcaaagccctacagcttcagcaaagagagggcaatgggactaaacctgcaggagaacctagcccaagggtgaacaaacgtatgttgagtgagagttcacttgacccacccaaggtcttacctcctgcaaggcacagcacaattccactggtcatccttcgaaaaaaacggggccaggccagccccttagccactggagactgtagctccttcatatttgctgacgtcagcagttcaactcccaagcgttcccctgtcaaaagcctacccttctctccctcgcag

SEQ ID NO: 199237 - DNA, 2436 bp, Homo sapiens
  Payload ID: 19308
  Gene Name: v-myb avian myeloblastosis viral oncogene homolog
  ENST ID: ENST00000531737
  CDS Start-End: 1-1167
atggcccgaagaccccggcacagcatatatagcagtgacgaggatgatgaggactttgagatgtgtgaccatgactatgatgggctgcttcccaagtctggaaagcgtcacttggggaaaacaaggtggacccgggaagaggatgaaaaactgaagaagctggtggaacagaatggaacagatgactggaaagttattgccaattatctcccgaatcgaacagatgtgcagtgccagcaccgatggcagaaagtactaaaccctgagctcatcaagggtccttggaccaaagaagaagatcagagagtgatagagcttgtacagaaatacggtccgaaacgttggtctgttattgccaagcacttaaaggggagaattggaaaacaatgtagggagaggtggcataaccacttgaatccagaagttaagaaaacctcctggacagaagaggaagacagaattatttaccaggcacacaagagactggggaacagatgggcagaaatcgcaaagctactgcctggacgaactgataatgctatcaagaaccactggaattctacaatgcgtcggaaggtcgaacaggaaggttatctgcaggagtcttcaaaagccagccagccagcagtggccacaagcttccagaagaacagtcatttgatgggttttgctcaggctccgcctacagctcaactccctgccactggccagcccactgttaacaacgactattcctattaccacatttctgaagcacaaaatgtctccagtcatgttccataccctgtagcgttacatgtaaatatagtcaatgtccctcagccagctgccgcagccattcagagacactataatgatgaagaccctgagaaggaaaagcgaataaaggaattagaattgctcctaatgtcaaccgagaatgagctaaaaggacagcaggtgctaccaacacagaaccacacatgcagctaccccgggtggcacagcaccaccattgccgaccacaccagacctcatggagacagtgcacctgtttcctgtttgggagaacaccactccactccatctctgccagcggatcctggctccctacctgaagaaagcgcctcgccagcaagatgtagagtgtcgggaggtccctgcagcacatcagagggccagccttgaggcagcccactagaccctgctctactgcagtataatagagcaactgctcatcttgaagctgttgctcaagaagccaaaccaacgggcctagtgtttgctttgcgttgagcatctctctctcagtgctgtttcaggtgatgatggcacacactatctcaaagttctgtgcctcccacattgtttcaggattcttcatcatggtgtgatctcagcagttttgaattctttgaagaagcagatttttcacctagccaacatcacacaggcaaagccctacagcttcagcaaagagagggcaatgggactaaacctgcaggagaacctagcccaagggtgaacaaacgtatgttgagtgagagttcacttgacccacccaaggtcttacctcctgcaaggcacagcacaattccactggtcatccttcgaaaaaaacggggccaggccagccccttagccactggagactgtagctccttcatatttgctgacgtcagcagttcaactcccaagcgttcccctgtcaaaagcctacccttctctccctcgcagttcttaaacacttccagtaaccatgaaaactcagacttggaaatgccttctttaacttccacccccctcattggtcacaaattgactgttacaacaccatttcatagagaccagactgtgaaaactcaaaaggaaaatactgtttttagaaccccagctatcaaaaggtcaatcttagaaagctctccaagaactcctacaccattcaaacatgcacttgcagctcaagaaattaaatacggtcccctgaagatgctacctcagacaccctctcatctagtagaagatctgcaggatgtgatcaaacaggaatctgatgaatctggaattgttgctgagtttcaagaaaatggaccacccttactgaagaaaatcaaacaagaggtggaatctccaactgataaatcaggaaacttcttctgctcacaccactgggaaggggacagtctgaatacccaactgttcacgcagacctcgcctgtggcagatgcaccgaatattcttacaagctccgttttaatggcaccagcatcagaagatgaagacaatgttctcaaagcatttacagtacctaaaaacaggtccctggcgagccccttgcagccttgtagcagtacctgggaacctgcatcctgtggaaagatggaggagcagatgacatcttccagtcaagctcgtaaatacgtgaatgcattctcagcccggacgctggtcatgtga

SEQ ID NO: 199238 - DNA, 2521 bp, Homo sapiens
  Payload ID: 19308
  Gene Name: v-myb avian myeloblastosis viral oncogene homolog
  Uniprot ID: P10242
  ENST ID: ENST00000533384
  CDS Start-End: 1-1209
atggcccgaagaccccggcacagcatatatagcagtgacgaggatgatgaggactttgagatgtgtgaccatgactatgatgggctgcttcccaagtctggaaagcgtcacttggggaaaacaaggtggacccgggaagaggatgaaaaactgaagaagctggtggaacagaatggaacagatgactggaaagttattgccaattatctcccgaatcgaacagatgtgcagtgccagcaccgatggcagaaagtactaaaccctgagctcatcaagggtccttggaccaaagaagaagatcagagagtgatagagcttgtacagaaatacggtccgaaacgttggtctgttattgccaagcacttaaaggggagaattggaaaacaatgtagggagaggtggcataaccacttgaatccagaagttaagaaaacctcctggacagaagaggaagacagaattatttaccaggcacacaagagactggggaacagatgggcagaaatcgcaaagctactgcctggacgaactgataatgctatcaagaaccactggaattctacaatgcgtcggaaggtcgaacaggaaggttatctgcaggagtcttcaaaagccagccagccagcagtggccacaagcttccagaagaacagtcatttgatgggttttgctcaggctccgcctacagctcaactccctgccactggccagcccactgttaacaacgactattcctattaccacatttctgaagcacaaaatgtctccagtcatgttccataccctgtagcgttacatgtaaatatagtcaatgtccctcagccagctgccgcagccattcagagacactataatgatgaagaccctgagaaggaaaagcgaataaaggaattagaattgctcctaatgtcaaccgagaatgagctaaaaggacagcaggtgctaccaacacagaaccacacatgcagctaccccgggtggcacagcaccaccattgccgaccacaccagacctcatggagacagtgcacctgtttcctgtttgggagaacaccactccactccatctctgccagcggatcctggctccctacctgaagaaagcgcctcgccagcaaggtgcatgatcgtccaccagggcaccattctggataatgttaagaacctcttagaatttgcagaaacactccaatttatagattctatgtagagtgtcgggaggtccctgcagcacatcagagggccagccttgaggcagcccactagaccctgctctactgcagtataatagagcaactgctcatcttgaagctgttgctcaagaagccaaaccaacgggcctagtgtttgctttgcgttgagcatctctctctcagtgctgtttcaggtgatgatggcacacactatctcaaagttctgtgcctcccacattgtttcaggattcttcatcatggtgtgatctcagcagttttgaattctttgaagaagcagatttttcacctagccaacatcacacaggcaaagccctacagcttcagcaaagagagggcaatgggactaaacctgcaggagaacctagcccaagggtgaacaaacgtatgttgagtgagagttcacttgacccacccaaggtcttacctcctgcaaggcacagcacaattccactggtcatccttcgaaaaaaacggggccaggccagccccttagccactggagactgtagctccttcatatttgctgacgtcagcagttcaactcccaagcgttcccctgtcaaaagcctacccttctctccctcgcagttcttaaacacttccagtaaccatgaaaactcagacttggaaatgccttctttaacttccacccccctcattggtcacaaattgactgttacaacaccatttcatagagaccagactgtgaaaactcaaaaggaaaatactgtttttagaaccccagctatcaaaaggtcaatcttagaaagctctccaagaactcctacaccattcaaacatgcacttgcagctcaagaaattaaatacggtcccctgaagatgctacctcagacaccctctcatctagtagaagatctgcaggatgtgatcaaacaggaatctgatgaatctggaattgttgctgagtttcaagaaaatggaccacccttactgaagaaaatcaaacaagaggtggaatctccaactgataaatcaggaaacttcttctgctcacaccactgggaaggggacagtctgaatacccaactgttcacgcagacctcgcctgtggcagatgcaccgaatattcttacaagctccgttttaatggcaccagcatcagaagatgaagacaatgttctcaaagcatttacagtacctaaaaacaggtccctggcgagccccttgcagccttgtagcagtacctgggaacctgcatcctgtggaaagatggaggagcagatgacatcttccagtcaagctcgtaaatacgtgaatgcattctcagcccggacgctggtcatgtga

SEQ ID NO: 199239 - DNA, 2238 bp, Homo sapiens
  Payload ID: 19308
  Gene Name: v-myb avian myeloblastosis viral oncogene homolog
  Uniprot ID: P10242
  ENST ID: ENST00000534121
  CDS Start-End: 1-2238
atggcccgaagaccccggcacagcatatatagcagtgacgaggatgatgaggactttgagatgtgtgaccatgactatgatgggctgcttcccaagtctggaaagcgtcacttggggaaaacaaggtggacccgggaagaggatgaaaaactgaagaagctggtggaacagaatggaacagatgactggaaagttattgccaattatctcccgaatcgaacagatgtgcagtgccagcaccgatggcagaaagtactaaaccctgagctcatcaagggtccttggaccaaagaagaagatcagagagtgatagagcttgtacagaaatacggtccgaaacgttggtctgttattgccaagcacttaaaggggagaattggaaaacaatgtagggagaggtggcataaccacttgaatccagaagttaagaaaacctcctggacagaagaggaagacagaattatttaccaggcacacaagagactggggaacagatgggcagaaatcgcaaagctactgcctggacgaactgataatgctatcaagaaccactggaattctacaatgcgtcggaaggtcgaacaggaaggttatctgcaggagtcttcaaaagccagccagccagcagtggccacaagcttccagaagaacagtcatttgatgggttttgctcaggctccgcctacagctcaactccctgccactggccagcccactgttaacaacgactattcctattaccacatttctgaagcacaaaatgtctccagtcatgttccataccctgtagcgttacatgtaaatatagtcaatgtccctcagccagctgccgcagccattcagagacactataatgatgaagaccctgagaaggaaaagcgaataaaggaattagaattgctcctaatgtcaaccgagaatgagctaaaaggacagcaggtgctaccaacacagaaccacacatgcagctaccccgggtggcacagcaccaccattgccgaccacaccagacctcatggagacagtgcacctgtttcctgtttgggagaacaccactccactccatctctgccagcggatcctggctccctacctgaagaaagcgcctcgccagcaaggtgcatgatcgtccaccagggcaccattctggataatgattcttcatcatggtgtgatctcagcagttttgaattctttgaagaagcagatttttcacctagccaacatcacacaggcaaagccctacagcttcagcaaagagagggcaatgggactaaacctgcaggagaacctagcccaagggtgaacaaacgtatgttgagtgagagttcacttgacccacccaaggtcttacctcctgcaaggcacagcacaattccactggtcatccttcgaaaaaaacggggccaggccagccccttagccactggagactgtagctccttcatatttgctgacgtcagcagttcaactcccaagcgttcccctgtcaaaagcctacccttctctccctcgcagttcttaaacacttccagtaaccatgaaaactcagacttggaaatgccttctttaacttccacccccctcattggtcacaaattgactgttacaacaccatttcatagagaccagactgtgaaaactcaaaaggaaaatactgtttttagaaccccagctatcaaaaggtcaatcttagaaagctctccaagaactcctacaccattcaaacatgcacttgcagctcaagaaattaaatacggtcccctgaagatgctacctcagacaccctctcatctagtagaagatctgcaggatgtgatcaaacaggaatctgatgaatctggaattgttgctgagtttcaagaaaatggaccacccttactgaagaaaatcaaacaagaggtggaatctccaactgataaatcaggaaacttcttctgctcacaccactgggaaggggacagtctgaatacccaactgttcacgcagacctcgcctgtggcagatgcaccgaatattcttacaagctccgttttaatggcaccagcatcagaagatgaagacaatgttctcaaagcatttacagtacctaaaaacaggtccctggcgagccccttgcagccttgtagcagtacctgggaacctgcatcctgtggaaagatggaggagcagatgacatcttccagtcaagctcgtaaatacgtgaatgcattctcagcccggacgctggtcatgtga

SEQ ID NO: 199240 - DNA, 2021 bp, Homo sapiens
  Payload ID: 19308
  Gene Name: v-myb avian myeloblastosis viral oncogene homolog
  ENST ID: ENST00000528140
  CDS Start-End: 1-1167
atggcccgaagaccccggcacagcatatatagcagtgacgaggatgatgaggactttgagatgtgtgaccatgactatgatgggctgcttcccaagtctggaaagcgtcacttggggaaaacaaggtggacccgggaagaggatgaaaaactgaagaagctggtggaacagaatggaacagatgactggaaagttattgccaattatctcccgaatcgaacagatgtgcagtgccagcaccgatggcagaaagtactaaaccctgagctcatcaagggtccttggaccaaagaagaagatcagagagtgatagagcttgtacagaaatacggtccgaaacgttggtctgttattgccaagcacttaaaggggagaattggaaaacaatgtagggagaggtggcataaccacttgaatccagaagttaagaaaacctcctggacagaagaggaagacagaattatttaccaggcacacaagagactggggaacagatgggcagaaatcgcaaagctactgcctggacgaactgataatgctatcaagaaccactggaattctacaatgcgtcggaaggtcgaacaggaaggttatctgcaggagtcttcaaaagccagccagccagcagtggccacaagcttccagaagaacagtcatttgatgggttttgctcaggctccgcctacagctcaactccctgccactggccagcccactgttaacaacgactattcctattaccacatttctgaagcacaaaatgtctccagtcatgttccataccctgtagcgttacatgtaaatatagtcaatgtccctcagccagctgccgcagccattcagagacactataatgatgaagaccctgagaaggaaaagcgaataaaggaattagaattgctcctaatgtcaaccgagaatgagctaaaaggacagcaggtgctaccaacacagaaccacacatgcagctaccccgggtggcacagcaccaccattgccgaccacaccagacctcatggagacagtgcacctgtttcctgtttgggagaacaccactccactccatctctgccagcggatcctggctccctacctgaagaaagcgcctcgccagcaagatgtagagtgtcgggaggtccctgcagcacatcagagggccagccttgaggcagcccactagaccctgctctactgcagtataatagagcaactgctcatcttgaagctgttgctcaagaagccaaaccaacgggcctagtgtttgctttgcgttgagcatctctctctcagtgctgtttcagttcttaaacacttccagtaaccatgaaaactcagacttggaaatgccttctttaacttccacccccctcattggtcacaaattgactgttacaacaccatttcatagagaccagactgtgaaaactcaaaaggaaaatactgtttttagaaccccagctatcaaaaggtcaatcttagaaagctctccaagaactcctacaccattcaaacatgcacttgcagctcaagaaattaaatacggtcccctgaagatgctacctcagacaccctctcatctagtagaagatctgcaggatgtgatcaaacaggaatctgatgaatctggaattgttgctgagtttcaagaaaatggaccacccttactgaagaaaatcaaacaagaggtggaatctccaactgataaatcaggaaacttcttctgctcacaccactgggaaggggacagtctgaatacccaactgttcacgcagacctcgcctgtggcagatgcaccgaatattcttacaagctccgttttaatggcaccagcatcagaagatgaagacaatgttctcaaagcatttacagtacctaaaaacaggtccctggcgagccccttgcagccttgtagcagtacctgggaacctgcatcctgtggaaagatggaggagcagatgacatcttccagtcaagctcgtaaatacgtgaatgcattctcagcccggacgctggtcatgtga

SEQ ID NO: 199241 - DNA, 1838 bp, Homo sapiens
  Payload ID: 19308
  Gene Name: v-myb avian myeloblastosis viral oncogene homolog
  ENST ID: ENST00000525940
  CDS Start-End: 1-1125
atggcccgaagaccccggcacagcatatatagcagtgacgaggatgatgaggactttgagatgtgtgaccatgactatgatgggctgcttcccaagtctggaaagcgtcacttggggaaaacaaggtggacccgggaagaggatgaaaaactgaagaagctggtggaacagaatggaacagatgactggaaagttattgccaattatctcccgaatcgaacagatgtgcagtgccagcaccgatggcagaaagtactaaaccctgagctcatcaagggtccttggaccaaagaagaagatcagagagtgatagagcttgtacagaaatacggtccgaaacgttggtctgttattgccaagcacttaaaggggagaattggaaaacaatgtagggagaggtggcataaccacttgaatccagaagttaagaaaacctcctggacagaagaggaagacagaattatttaccaggcacacaagagactggggaacagatgggcagaaatcgcaaagctactgcctggacgaactgataatgctatcaagaaccactggaattctacaatgcgtcggaaggtcgaacaggaaggttatctgcaggagtcttcaaaagccagccagccagcagtggccacaagcttccagaagaacagtcatttgatgggttttgctcaggctccgcctacagctcaactccctgccactggccagcccactgttaacaacgactattcctattaccacatttctgaagcacaaaatgtctccagtcatgttccataccctgtagcgttacatgtaaatatagtcaatgtccctcagccagctgccgcagccattcagagacactataatgatgaagaccctgagaaggaaaagcgaataaaggaattagaattgctcctaatgtcaaccgagaatgagctaaaaggacagcaggtgctaccaacacagaaccacacatgcagctaccccgggtggcacagcaccaccattgccgaccacaccagacctcatggagacagtgcacctgtttcctgtttgggagaacaccactccactccatctctgccagcggatcctggctccctacctgaagaaagcgcctcgccagcaagttcttaaacacttccagtaaccatgaaaactcagacttggaaatgccttctttaacttccacccccctcattggtcacaaattgactgttacaacaccatttcatagagaccagactgtgaaaactcaaaaggaaaatactgtttttagaaccccagctatcaaaaggtcaatcttagaaagctctccaagaactcctacaccattcaaacatgcacttgcagctcaagaaattaaatacggtcccctgaagatgctacctcagacaccctctcatctagtagaagatctgcaggatgtgatcaaacaggaatctgatgaatctggaattgttgctgagtttcaagaaaatggaccacccttactgaagaaaatcaaacaagaggtggaatctccaactgataaatcaggaaacttcttctgctcacaccactgggaaggggacagtctgaatacccaactgttcacgcagacctcgcctgtggcagatgcaccgaatattcttacaagctccgttttaatggcaccagcatcagaagatgaagacaatgttctcaaagcatttacagtacctaaaaacaggtccctggcgagccccttgcagccttgtagcagtacctgggaacctgcatcctgtggaaagatggaggagcagatgacatcttccagtcaagctcgtaaatacgtgaatgcattctcagcccggacgctggtcatgtga

SEQ ID NO: 199242 - DNA, 2381 bp, Homo sapiens
  Payload ID: 19308
  Gene Name: v-myb avian myeloblastosis viral oncogene homolog
  ENST ID: ENST00000527615
  CDS Start-End: 134-1969
gagaaacttcgccccagcggtgcggagcgccgctgcgcagccggggagggacgcaggcaggcggcgggcagcgggaggcggcagcccggtgcggtccccgcggctctcggcggagccccgcgcccgccgcgccatggcccgaagaccccggcacagcatatatagcagtgacgaggatgatgaggactttgagatgtgtgaccatgactatgatgggctgcttcccaagtctggaaagcgtcacttggggaaaacaaggtggacccgggaagaggatgaaaaactgaagaagctggtggaacagaatggaacagatgactggaaagttattgccaattatctcccgaatcgaacagatgtgcagtgccagcaccgatggcagaaagtactaaaccctgagctcatcaagggtccttggaccaaagaagaagatcagagagtgatagagcttgtacagaaatacggtccgaaacgttggtctgttattgccaagcacttaaaggggagaattggaaaacaatgtagggagaggtggcataaccacttgaatccagaagttaagaaaacctcctggacagaagaggaagacagaattatttaccaggcacacaagagactggggaacagatgggcagaaatcgcaaagctactgcctggacgaactgataatgctatcaagaaccactggaattctacaatgcgtcggaaggtcgaacaggaaggttatctgcaggagtcttcaaaagccagccagccagcagtggccacaagcttccagaagaacagtcatttgatgggttttgctcaggctccgcctacagctcaactccctgccactggccagcccactgttaacaacgactattcctattaccacatttctgaagcacaaaatgtctccagtcatgttccataccctgtagcgttacatgtaaatatagtcaatgtccctcagccagctgccgcagccattcagagacactataatgatgaagaccctgagaaggaaaagcgaataaaggaattagaattgctcctaatgtcaaccgagaatgagctaaaaggacagcaggtgctaccaacacagaaccacacatgcagctaccccgggtggcacagcaccaccattgccgaccacaccagacctcatggagacagtgcacctgtttcctgtttgggagaacaccactccactccatctctgccagcggatcctggctccctacctgaagaaagcgcctcgccagcaaggtgcatgatcgtccaccagggcaccattctggataatgttaagaacctcttagaatttgcagaaacactccaatttatagattctttcttaaacacttccagtaaccatgaaaactcagacttggaaatgccttctttaacttccacccccctcattggtcacaaattgactgttacaacaccatttcatagagaccagactgtgaaaactcaaaaggaaaatactgtttttagaaccccagctatcaaaaggtcaatcttagaaagctctccaagaactcctacaccattcaaacatgcacttgcagctcaagaaattaaatacggtcccctgaagatgctacctcagacaccctctcatctagtagaagatctgcaggatgtgatcaaacaggaatctgatgaatctggaattgttgctgagtttcaagaaaatggaccacccttactgaagaaaatcaaacaagaggtggaatctccaactgataaatcaggaaacttcttctgctcacaccactgggaaggggacagtctgaatacccaactgttcacgcagacctcgcctgtggcagatgcaccgaatattcttacaagctccgttttaatggcaccagcatcagaagatgaagacaatgttctcaaagcatttacagtacctaaaaacaggtccctggcgagccccttgcaggtaattactattccaacattggtattttaaaattcattcactgaaaaactgtcatctttggtggtggtggtggtggtggtgatggtagtgctggtggtctgtttttcgttttcaacattttagacataggggagtaatgcttttatacaattcttgatgtctagaaaaatccaataattcctttttgctactcatatgagacatgctagaaatttttatcagtgcagattccccaaagcatgatgaaatgaaacatttcttactgtgactgagactaagatgtattacacgtgtgtcactatcttcttctgccctcaaatgttttataaaaatatatcaatatagtttactttatgttccaaattttttattttttatgctgtatccctaggcaaccaaagctcagagactgttccaattttaaatgaagtctgaaattagt

SEQ ID NO: 199243 - DNA, 3157 bp, Homo sapiens
  Payload ID: 19308
  Gene Name: v-myb avian myeloblastosis viral oncogene homolog
  ENST ID: ENST00000526889
  CDS Start-End: 1-1341
atggcccgaagaccccggcacagcatatatagcagtgacgaggatgatgaggactttgagatgtgtgaccatgactatgatgggctgcttcccaagtctggaaagcgtcacttggggaaaacaaggtggacccgggaagaggatgaaaaactgaagaagctggtggaacagaatggaacagatgactggaaagttattgccaattatctcccgaatcgaacagatgtgcagtgccagcaccgatggcagaaagtactaaaccctgagctcatcaagggtccttggaccaaagaagaagatcagagagtgatagagcttgtacagaaatacggtccgaaacgttggtctgttattgccaagcacttaaaggggagaattggaaaacaatgtagggagaggtggcataaccacttgaatccagaagttaagaaaacctcctggacagaagaggaagacagaattatttaccaggcacacaagagactggggaacagatgggcagaaatcgcaaagctactgcctggacgaactgataatgctatcaagaaccactggaattctacaatgcgtcggaaggtcgaacaggaaggttatctgcaggagtcttcaaaagccagccagccagcagtggccacaagcttccagaagaacagtcatttgatgggttttgctcaggctccgcctacagctcaactccctgccactggccagcccactgttaacaacgactattcctattaccacatttctgaagcacaaaatgtctccagtcatgttccataccctgtagcgttacatgtaaatatagtcaatgtccctcagccagctgccgcagccattcagagacactataatgatgaagaccctgagaaggaaaagcgaataaaggaattagaattgctcctaatgtcaaccgagaatgagctaaaaggacagcagacacagaaccacacatgcagctaccccgggtggcacagcaccaccattgccgaccacaccagacctcatggagacagtgcacctgtttcctgtttgggagaacaccactccactccatctctgccagcggatcctggctccctacctgaagaaagcgcctcgccagcaaggtgcatgatcgtccaccagggcaccattctggataatgttaagaacctcttagaatttgcagaaacactccaatttatagattctttcttaaacacttccagtaaccatgaaaactcagacttggaaatgccttctttaacttccacccccctcattggtcacaaattgactgttacaacaccatttcatagagaccagactgtgaaaactcaaaaggaaaatactgtataggacctcttctgacatccccaggaatattatatgattagaagccaagggatgattttagaaccccagctatcaaaaggtcaatcttagaaagctctccaagaactcctacaccattcaaacatgcacttgcagctcaagaaattaaatacggtcccctgaagatgctacctcagacaccctctcatctagtagaagatctgcaggatgtgatcaaacaggaatctgatgaatctggaattgttgctgagtttcaagaaaatggaccacccttactgaagaaaatcaaacaagaggtggaatctccaactgataaatcaggaaacttcttctgctcacaccactgggaaggggacagtctgaatacccaactgttcacgcagacctcgcctgtggcagatgcaccgaatattcttacaagctccgttttaatggcaccagcatcagaagatgaagacaatgttctcaaagcatttacagtacctaaaaacaggtccctggcgagccccttgcagccttgtagcagtacctgggaacctgcatcctgtggaaagatggaggagcagatgacatcttccagtcaagctcgtaaatacgtgaatgcattctcagcccggacgctggtcatgtgagacatttccagaaaagcattatggttttcagaacacttcaagttgacttgggatatatcattcctcaacatgaaacttttcatgaatgggagaagaacctatttttgttgtggtacaacagttgagagcagcaccaagtgcatttagttgaatgaagtcttcttggatttcacccaactaaaaggatttttaaaaataaataacagtcttacctaaattattaggtaatgaattgtagccagttgttaatatcttaatgcagatttttttaaaaaaaacataaaatgatttatctgtattttaaaggatccaacagatcagtattttttcctgtgatgggttttttgaaatttgacacattaaaaggtactccagtatttcacttttctcgatcactaaacatatgcatatatttttaaaaatcagtaaaagcattactctaagtgtagacttaataccatgtgacatttaatccagattgtaaatgctcatttatggttaatgacattgaaggtacatttattgtaccaaaccattttatgagttttctgttagcttgctttaaaaattattactgtaagaaatagttttataaaaaattatatttttattcagtaatttaattttgtaaatgccaaatgaaaaacgttttttgctgctatggtcttagcctgtagacatgctgctagtatcagaggggcagtagagcttggacagaaagaaaagaaacttggtgttaggtaattgactatgcactagtatttcagactttttaattttatatatatatacattttttttccttctgcaatacatttgaaaacttgtttgggagactctgcattttttattgtggtttttttgttattgttggtttatacaagcatgcgttgcacttcttttttgggagatgtgtgttgttgatgttctatgttttgttttgagtgtagcctgactgttttataatttgggagttctgcatttgatccgcatcccctgtggtttctaagtgtatggtctcagaactgttgcatggatcctgtgtttgcaactggggagacagaaactgtggttgatagccagtcactgccttaagaacatttgatgcaagatggccagcactgaacttttgagatatgacggtgtacttactgccttgtagcaaaataaagatgtgcccttatttt

SEQ ID NO: 199244 - DNA, 2182 bp, Homo sapiens
  Payload ID: 19308
  Gene Name: v-myb avian myeloblastosis viral oncogene homolog
  ENST ID: ENST00000525002
  CDS Start-End: 1-1746
atggcccgaagaccccggcacagcatatatagcagtgacgaggatgatgaggactttgagatgtgtgaccatgactatgatgggctgcttcccaagtctggaaagcgtcacttggggaaaacaaggtggacccgggaagaggatgaaaaactgaagaagctggtggaacagaatggaacagatgactggaaagttattgccaattatctcccgaatcgaacagatgtgcagtgccagcaccgatggcagaaagtactaaaccctgagctcatcaagggtccttggaccaaagaagaagatcagagagtgatagagcttgtacagaaatacggtccgaaacgttggtctgttattgccaagcacttaaaggggagaattggaaaacaatgtagggagaggtggcataaccacttgaatccagaagttaagaaaacctcctggacagaagaggaagacagaattatttaccaggcacacaagagactggggaacagatgggcagaaatcgcaaagctactgcctggacgaactgataatgctatcaagaaccactggaattctacaatgcgtcggaaggtcgaacaggaaggttatctgcaggagtcttcaaaagccagccagccagcagtggccacaagcttccagaagaacagtcatttgatgggttttgctcaggctccgcctacagctcaactccctgccactggccagcccactgttaacaacgactattcctattaccacatttctgaagcacaaaatgtctccagtcatgttccataccctgtagcgttacatgtaaatatagtcaatgtccctcagccagctgccgcagccattcagagacactataatgatgaagaccctgagaaggaaaagcgaataaaggaattagaattgctcctaatgtcaaccgagaatgagctaaaaggacagcaggtgctaccaacacagaaccacacatgcagctaccccgggtggcacagcaccaccattgccgaccacaccagacctcatggagacagtgcacctgtttcctgtttgggagaacaccactccactccatctctgccagcggatcctggctccctacctgaagaaagcgcctcgccagcaaggtgcatgatcgtccaccagggcaccattctggataatgttaagaacctcttagaatttgcagaaacactccaatttatagattctttcttaaacacttccagtaaccatgaaaactcagacttggaaatgccttctttaacttccacccccctcattggtcacaaattgactgttacaacaccatttcatagagaccagactgtgaaaactcaaaaggaaaatactgtttttagaaccccagctatcaaaaggtcaatcttagaaagctctccaagaactcctacaccattcaaacatgcacttgcagctcaagaaattaaatacggtcccctgaagatgctacctcagacaccctctcatctagtagaagatctgcaggatgtgatcaaacaggaatctgatgaatctggaattgttgctgagtttcaagaaaatggaccacccttactgaagaaaatcaaacaagaggtaaacacgcaaccctttggaagcaacaagctgagaatcctgccccctttattccttgtgtgcagcttgatgtgtctgccattggcactgtgcaacaccacgacttttcgtgcaagattttcatacaaggtgcagcgaaaaggtactgccagactgtaggcatcatcaacctttcctttgggaagccaagccatctctatctacttcatgtttggacagaaaacatactagagagtatcaagaaaagggagggaaagaggtggaatctccaactgataaatcaggaaacttcttctgctcacaccactgggaaggggacagtctgaatacccaactgttcacgcagacctcgcctgtggcagatgcaccgaatattcttacaagctccgttttaatggcaccagcatcagaagatgaagacaatgttctcaaagcatttacagtacctaaaaacaggtccctggcgagccccttgcagccttgtagcagtacctgggaacctgcatcctgtggaaagatggaggagcagatgacatcttccagtcaagctcgtaaatacgtgaatgcattctcagcccggacgctggtcatgtga

SEQ ID NO: 199245 - DNA, 2427 bp, Homo sapiens
  Payload ID: 19308
  Gene Name: v-myb avian myeloblastosis viral oncogene homolog
  ENST ID: ENST00000529262
  CDS Start-End: 1-1158
atggcccgaagaccccggcacagcatatatagcagtgacgaggatgatgaggactttgagatgtgtgaccatgactatgatgggctgcttcccaagtctggaaagcgtcacttggggaaaacaaggtggacccgggaagaggatgaaaaactgaagaagctggtggaacagaatggaacagatgactggaaagttattgccaattatctcccgaatcgaacagatgtgcagtgccagcaccgatggcagaaagtactaaaccctgagctcatcaagggtccttggaccaaagaagaagatcagagagtgatagagcttgtacagaaatacggtccgaaacgttggtctgttattgccaagcacttaaaggggagaattggaaaacaatgtagggagaggtggcataaccacttgaatccagaagttaagaaaacctcctggacagaagaggaagacagaattatttaccaggcacacaagagactggggaacagatgggcagaaatcgcaaagctactgcctggacgaactgataatgctatcaagaaccactggaattctacaatgcgtcggaaggtcgaacaggaaggttatctgcaggagtcttcaaaagccagccagccagcagtggccacaagcttccagaagaacagtcatttgatgggttttgctcaggctccgcctacagctcaactccctgccactggccagcccactgttaacaacgactattcctattaccacatttctgaagcacaaaatgtctccagtcatgttccataccctgtagcgttacatgtaaatatagtcaatgtccctcagccagctgccgcagccattcagagacactataatgatgaagaccctgagaaggaaaagcgaataaaggaattagaattgctcctaatgtcaaccgagaatgagctaaaaggacagcagacacagaaccacacatgcagctaccccgggtggcacagcaccaccattgccgaccacaccagacctcatggagacagtgcacctgtttcctgtttgggagaacaccactccactccatctctgccagcggatcctggctccctacctgaagaaagcgcctcgccagcaagatgtagagtgtcgggaggtccctgcagcacatcagagggccagccttgaggcagcccactagaccctgctctactgcagtataatagagcaactgctcatcttgaagctgttgctcaagaagccaaaccaacgggcctagtgtttgctttgcgttgagcatctctctctcagtgctgtttcaggtgatgatggcacacactatctcaaagttctgtgcctcccacattgtttcaggattcttcatcatggtgtgatctcagcagttttgaattctttgaagaagcagatttttcacctagccaacatcacacaggcaaagccctacagcttcagcaaagagagggcaatgggactaaacctgcaggagaacctagcccaagggtgaacaaacgtatgttgagtgagagttcacttgacccacccaaggtcttacctcctgcaaggcacagcacaattccactggtcatccttcgaaaaaaacggggccaggccagccccttagccactggagactgtagctccttcatatttgctgacgtcagcagttcaactcccaagcgttcccctgtcaaaagcctacccttctctccctcgcagttcttaaacacttccagtaaccatgaaaactcagacttggaaatgccttctttaacttccacccccctcattggtcacaaattgactgttacaacaccatttcatagagaccagactgtgaaaactcaaaaggaaaatactgtttttagaaccccagctatcaaaaggtcaatcttagaaagctctccaagaactcctacaccattcaaacatgcacttgcagctcaagaaattaaatacggtcccctgaagatgctacctcagacaccctctcatctagtagaagatctgcaggatgtgatcaaacaggaatctgatgaatctggaattgttgctgagtttcaagaaaatggaccacccttactgaagaaaatcaaacaagaggtggaatctccaactgataaatcaggaaacttcttctgctcacaccactgggaaggggacagtctgaatacccaactgttcacgcagacctcgcctgtggcagatgcaccgaatattcttacaagctccgttttaatggcaccagcatcagaagatgaagacaatgttctcaaagcatttacagtacctaaaaacaggtccctggcgagccccttgcagccttgtagcagtacctgggaacctgcatcctgtggaaagatggaggagcagatgacatcttccagtcaagctcgtaaatacgtgaatgcattctcagcccggacgctggtcatgtga

SEQ ID NO: 199246 - DNA, 2091 bp, Homo sapiens
  Payload ID: 19308
  Gene Name: v-myb avian myeloblastosis viral oncogene homolog
  ENST ID: ENST00000528343
  CDS Start-End: 1-1746
atggcccgaagaccccggcacagcatatatagcagtgacgaggatgatgaggactttgagatgtgtgaccatgactatgatgggctgcttcccaagtctggaaagcgtcacttggggaaaacaaggtggacccgggaagaggatgaaaaactgaagaagctggtggaacagaatggaacagatgactggaaagttattgccaattatctcccgaatcgaacagatgtgcagtgccagcaccgatggcagaaagtactaaaccctgagctcatcaagggtccttggaccaaagaagaagatcagagagtgatagagcttgtacagaaatacggtccgaaacgttggtctgttattgccaagcacttaaaggggagaattggaaaacaatgtagggagaggtggcataaccacttgaatccagaagttaagaaaacctcctggacagaagaggaagacagaattatttaccaggcacacaagagactggggaacagatgggcagaaatcgcaaagctactgcctggacgaactgataatgctatcaagaaccactggaattctacaatgcgtcggaaggtcgaacaggaaggttatctgcaggagtcttcaaaagccagccagccagcagtggccacaagcttccagaagaacagtcatttgatgggttttgctcaggctccgcctacagctcaactccctgccactggccagcccactgttaacaacgactattcctattaccacatttctgaagcacaaaatgtctccagtcatgttccataccctgtagcgttacatgtaaatatagtcaatgtccctcagccagctgccgcagccattcagagacactataatgatgaagaccctgagaaggaaaagcgaataaaggaattagaattgctcctaatgtcaaccgagaatgagctaaaaggacagcaggtgctaccaacacagaaccacacatgcagctaccccgggtggcacagcaccaccattgccgaccacaccagacctcatggagacagtgcacctgtttcctgtttgggagaacaccactccactccatctctgccagcggatcctggctccctacctgaagaaagcgcctcgccagcaaggtgcatgatcgtccaccagggcaccattctggataatgttaagaacctcttagaatttgcagaaacactccaatttatagattctttcttaaacacttccagtaaccatgaaaactcagacttggaaatgccttctttaacttccacccccctcattggtcacaaattgactgttacaacaccatttcatagagaccagactgtgaaaactcaaaaggaaaatactgtttttagaaccccagctatcaaaaggtcaatcttagaaagctctccaagaactcctacaccattcaaacatgcacttgcagctcaagaaattaaatacggtcccctgaagatgctacctcagacaccctctcatctagtagaagatctgcaggatgtgatcaaacaggaatctgatgaatctggaattgttgctgagtttcaagaaaatggaccacccttactgaagaaaatcaaacaagaggtaaacacgcaaccctttggaagcaacaagctgagaatcctgccccctttattccttgtgtgcagcttgatgtgtctgccattggcactgtgcaacaccacgacttttcgtgcaagattttcatacaaggtgcagcgaaaaggtggaatctccaactgataaatcaggaaacttcttctgctcacaccactgggaaggggacagtctgaatacccaactgttcacgcagacctcgcctgtggcagatgcaccgaatattcttacaagctccgttttaatggcaccagcatcagaagatgaagacaatgttctcaaagcatttacagtacctaaaaacaggtccctggcgagccccttgcagccttgtagcagtacctgggaacctgcatcctgtggaaagatggaggagcagatgacatcttccagtcaagctcgtaaatacgtgaatgcattctcagcccggacgctggtcatgtgagacatttccagaaaagcattatggtt

SEQ ID NO: 199247 - DNA, 3492 bp, Homo sapiens
  Payload ID: 19308
  Gene Name: v-myb avian myeloblastosis viral oncogene homolog
  Uniprot ID: P10242
  ENST ID: ENST00000533837
  CDS Start-End: 200-1408
aatatcaacctgtttcctcctcctccttctcctcctcctccgtgacctcctcctcctctttctcctgagaaacttcgccccagcggtgcggagcgccgctgcgcagccggggagggacgcaggcaggcggcgggcagcgggaggcggcagcccggtgcggtccccgcggctctcggcggagccccgcgcccgccgcgccatggcccgaagaccccggcacagcatatatagcagtgacgaggatgatgaggactttgagatgtgtgaccatgactatgatgggctgcttcccaagtctggaaagcgtcacttggggaaaacaaggtggacccgggaagaggatgaaaaactgaagaagctggtggaacagaatggaacagatgactggaaagttattgccaattatctcccgaatcgaacagatgtgcagtgccagcaccgatggcagaaagtactaaaccctgagctcatcaagggtccttggaccaaagaagaagatcagagagtgatagagcttgtacagaaatacggtccgaaacgttggtctgttattgccaagcacttaaaggggagaattggaaaacaatgtagggagaggtggcataaccacttgaatccagaagttaagaaaacctcctggacagaagaggaagacagaattatttaccaggcacacaagagactggggaacagatgggcagaaatcgcaaagctactgcctggacgaactgataatgctatcaagaaccactggaattctacaatgcgtcggaaggtcgaacaggaaggttatctgcaggagtcttcaaaagccagccagccagcagtggccacaagcttccagaagaacagtcatttgatgggttttgctcaggctccgcctacagctcaactccctgccactggccagcccactgttaacaacgactattcctattaccacatttctgaagcacaaaatgtctccagtcatgttccataccctgtagcgttacatgtaaatatagtcaatgtccctcagccagctgccgcagccattcagagacactataatgatgaagaccctgagaaggaaaagcgaataaaggaattagaattgctcctaatgtcaaccgagaatgagctaaaaggacagcaggtgctaccaacacagaaccacacatgcagctaccccgggtggcacagcaccaccattgccgaccacaccagacctcatggagacagtgcacctgtttcctgtttgggagaacaccactccactccatctctgccagcggatcctggctccctacctgaagaaagcgcctcgccagcaaggtgcatgatcgtccaccagggcaccattctggataatgttaagaacctcttagaatttgcagaaacactccaatttatagattctatgtagagtgtcgggaggtccctgcagcacatcagagggccagccttgaggcagcccactagaccctgctctactgcagtataatagagcaactgctcatcttgaagctgttgctcaagaagccaaaccaacgggcctagtgtttgctttgcgttgagcatctctctctcagtgctgtttcagttcttaaacacttccagtaaccatgaaaactcagacttggaaatgccttctttaacttccacccccctcattggtcacaaattgactgttacaacaccatttcatagagaccagactgtgaaaactcaaaaggaaaatactgtttttagaaccccagctatcaaaaggtcaatcttagaaagctctccaagaactcctacaccattcaaacatgcacttgcagctcaagaaattaaatacggtcccctgaagatgctacctcagacaccctctcatctagtagaagatctgcaggatgtgatcaaacaggaatctgatgaatctggaattgttgctgagtttcaagaaaatggaccacccttactgaagaaaatcaaacaagaggtggaatctccaactgataaatcaggaaacttcttctgctcacaccactgggaaggggacagtctgaatacccaactgttcacgcagacctcgcctgtggcagatgcaccgaatattcttacaagctccgttttaatggcaccagcatcagaagatgaagacaatgttctcaaagcatttacagtacctaaaaacaggtccctggcgagccccttgcagccttgtagcagtacctgggaacctgcatcctgtggaaagatggaggagcagatgacatcttccagtcaagctcgtaaatacgtgaatgcattctcagcccggacgctggtcatgtgagacatttccagaaaagcattatggttttcagaacacttcaagttgacttgggatatatcattcctcaacatgaaacttttcatgaatgggagaagaacctatttttgttgtggtacaacagttgagagcagcaccaagtgcatttagttgaatgaagtcttcttggatttcacccaactaaaaggatttttaaaaataaataacagtcttacctaaattattaggtaatgaattgtagccagttgttaatatcttaatgcagatttttttaaaaaaaacataaaatgatttatctgtattttaaaggatccaacagatcagtattttttcctgtgatgggttttttgaaatttgacacattaaaaggtactccagtatttcacttttctcgatcactaaacatatgcatatatttttaaaaatcagtaaaagcattactctaagtgtagacttaataccatgtgacatttaatccagattgtaaatgctcatttatggttaatgacattgaaggtacatttattgtaccaaaccattttatgagttttctgttagcttgctttaaaaattattactgtaagaaatagttttataaaaaattatatttttattcagtaatttaattttgtaaatgccaaatgaaaaacgttttttgctgctatggtcttagcctgtagacatgctgctagtatcagaggggcagtagagcttggacagaaagaaaagaaacttggtgttaggtaattgactatgcactagtatttcagactttttaattttatatatatatacattttttttccttctgcaatacatttgaaaacttgtttgggagactctgcattttttattgtggtttttttgttattgttggtttatacaagcatgcgttgcacttcttttttgggagatgtgtgttgttgatgttctatgttttgttttgagtgtagcctgactgttttataatttgggagttctgcatttgatccgcatcccctgtggtttctaagtgtatggtctcagaactgttgcatggatcctgtgtttgcaactggggagacagaaactgtggttgatagccagtcactgccttaagaacatttgatgcaagatggccagcactgaacttttgagatatgacggtgtacttactgccttgtagcaaaataaagatgtgcccttatttt

SEQ ID NO: 199248 - DNA, 1630 bp, Homo sapiens
  Payload ID: 19308
  Gene Name: v-myb avian myeloblastosis viral oncogene homolog
  ENST ID: ENST00000524588
  CDS Start-End: 1-240
atggcccgaagaccccggcacagcatatatagcagtgacgaggatgatgaggactttgagatgtgtgaccatgactatgatgggctgcttcccaagtctggaaagcgtcacttggggaaaacaaggtggacccgggaagagaatcgaacagatgtgcagtgccagcaccgatggcagaaagtactaaaccctgagctcatcaagggtccttggaccaaagaagaagatcagagaaactgataatgctatcaagaaccactggaattctacaatgcgtcggaaggtcgaacaggaaggttatctgcaggagtcttcaaaagccagccagccagcagtggccacaagcttccagaagaacagtcatttgatgggttttgctcaggctccgcctacagctcaactccctgccactggccagcccactgttaacaacgactattcctattaccacatttctgaagcacaaaatgtctccagtcatgttccataccctgtagcgttacatgtaaatatagtcaatgtccctcagccagctgccgcagccattcagagacactataatgatgaagaccctgagaaggaaaagcgaataaaggaattagaattgctcctaatgtcaaccgagaatgagctaaaaggacagcaggtgctaccaacacagaaccacacatgcagctaccccgggtggcacagcaccaccattgccgaccacaccagacctcatggagacagtgcacctgtttcctgtttgggagaacaccactccactccatctctgccagcggatcctggctccctacctgaagaaagcgcctcgccagcaaggtgcatgatcgtccaccagggcaccattctggataatgttaagaacctcttagaatttgcagaaacactccaatttatagattctttcttaaacacttccagtaaccatgaaaactcagacttggaaatgccttctttaacttccacccccctcattggtcacaaattgactgttacaacaccatttcatagagaccagactgtgaaaactcaaaaggaaaatactgtttttagaaccccagctatcaaaaggtcaatcttagaaagctctccaagaactcctacaccattcaaacatgcacttgcagctcaagaaattaaatacggtcccctgaagatgctacctcagacaccctctcatctagtagaagatctgcaggatgtgatcaaacaggaatctgatgaatctggaattgttgctgagtttcaagaaaatggaccacccttactgaagaaaatcaaacaagaggtggaatctccaactgataaatcaggaaacttcttctgctcacaccactgggaaggggacagtctgaatacccaactgttcacgcagacctcgcctgtggcagatgcaccgaatattcttacaagctccgttttaatggcaccagcatcagaagatgaagacaatgttctcaaagcatttacagtacctaaaaacaggtccctggcgagccccttgcagccttgtagcagtacctgggaacctgcatcctgtggaaagatggaggagcagatgacatcttccagtcaagctcgtaaatacgtgaatgcattctcagcccggacgctggtcatgtga

SEQ ID NO: 199249 - DNA, 2277 bp, Homo sapiens
  Payload ID: 19308
  Gene Name: v-myb avian myeloblastosis viral oncogene homolog
  Uniprot ID: P10242
  ENST ID: ENST00000528774
  CDS Start-End: 1-2277
atggcccgaagaccccggcacagcatatatagcagtgacgaggatgatgaggactttgagatgtgtgaccatgactatgatgggctgcttcccaagtctggaaagcgtcacttggggaaaacaaggtggacccgggaagaggatgaaaaactgaagaagctggtggaacagaatggaacagatgactggaaagttattgccaattatctcccgaatcgaacagatgtgcagtgccagcaccgatggcagaaagtactaaaccctgagctcatcaagggtccttggaccaaagaagaagatcagagagtgatagagcttgtacagaaatacggtccgaaacgttggtctgttattgccaagcacttaaaggggagaattggaaaacaatgtagggagaggtggcataaccacttgaatccagaagttaagaaaacctcctggacagaagaggaagacagaattatttaccaggcacacaagagactggggaacagatgggcagaaatcgcaaagctactgcctggacgaactgataatgctatcaagaaccactggaattctacaatgcgtcggaaggtcgaacaggaaggttatctgcaggagtcttcaaaagccagccagccagcagtggccacaagcttccagaagaacagtcatttgatgggttttgctcaggctccgcctacagctcaactccctgccactggccagcccactgttaacaacgactattcctattaccacatttctgaagcacaaaatgtctccagtcatgttccataccctgtagcgttacatgtaaatatagtcaatgtccctcagccagctgccgcagccattcagagacactataatgatgaagaccctgagaaggaaaagcgaataaaggaattagaattgctcctaatgtcaaccgagaatgagctaaaaggacagcagacacagaaccacacatgcagctaccccgggtggcacagcaccaccattgccgaccacaccagacctcatggagacagtgcacctgtttcctgtttgggagaacaccactccactccatctctgccagcggatcctggctccctacctgaagaaagcgcctcgccagcaaggtgcatgatcgtccaccagggcaccattctggataatgttaagaacctcttagaatttgcagaaacactccaatttatagattctgattcttcatcatggtgtgatctcagcagttttgaattctttgaagaagcagatttttcacctagccaacatcacacaggcaaagccctacagcttcagcaaagagagggcaatgggactaaacctgcaggagaacctagcccaagggtgaacaaacgtatgttgagtgagagttcacttgacccacccaaggtcttacctcctgcaaggcacagcacaattccactggtcatccttcgaaaaaaacggggccaggccagccccttagccactggagactgtagctccttcatatttgctgacgtcagcagttcaactcccaagcgttcccctgtcaaaagcctacccttctctccctcgcagttcttaaacacttccagtaaccatgaaaactcagacttggaaatgccttctttaacttccacccccctcattggtcacaaattgactgttacaacaccatttcatagagaccagactgtgaaaactcaaaaggaaaatactgtttttagaaccccagctatcaaaaggtcaatcttagaaagctctccaagaactcctacaccattcaaacatgcacttgcagctcaagaaattaaatacggtcccctgaagatgctacctcagacaccctctcatctagtagaagatctgcaggatgtgatcaaacaggaatctgatgaatctggaattgttgctgagtttcaagaaaatggaccacccttactgaagaaaatcaaacaagaggtggaatctccaactgataaatcaggaaacttcttctgctcacaccactgggaaggggacagtctgaatacccaactgttcacgcagacctcgcctgtggcagatgcaccgaatattcttacaagctccgttttaatggcaccagcatcagaagatgaagacaatgttctcaaagcatttacagtacctaaaaacaggtccctggcgagccccttgcagccttgtagcagtacctgggaacctgcatcctgtggaaagatggaggagcagatgacatcttccagtcaagctcgtaaatacgtgaatgcattctcagcccggacgctggtcatgtga

SEQ ID NO: 199250 - DNA, 2192 bp, Homo sapiens
  Payload ID: 19308
  Gene Name: v-myb avian myeloblastosis viral oncogene homolog
  ENST ID: ENST00000526187
  CDS Start-End: 1-1260
atggcccgaagaccccggcacagcatatatagcagtgacgaggatgatgaggactttgagatgtgtgaccatgactatgatgggctgcttcccaagtctggaaagcgtcacttggggaaaacaaggtggacccgggaagaggatgaaaaactgaagaagctggtggaacagaatggaacagatgactggaaagttattgccaattatctcccgaatcgaacagatgtgcagtgccagcaccgatggcagaaagtactaaaccctgagctcatcaagggtccttggaccaaagaagaagatcagagagtgatagagcttgtacagaaatacggtccgaaacgttggtctgttattgccaagcacttaaaggggagaattggaaaacaatgtagggagaggtggcataaccacttgaatccagaagttaagaaaacctcctggacagaagaggaagacagaattatttaccaggcacacaagagactggggaacagatgggcagaaatcgcaaagctactgcctggacgaactgataatgctatcaagaaccactggaattctacaatgcgtcggaaggtcgaacaggaaggttatctgcaggagtcttcaaaagccagccagccagcagtggccacaagcttccagaagaacagtcatttgatgggttttgctcaggctccgcctacagctcaactccctgccactggccagcccactgttaacaacgactattcctattaccacatttctgaagcacaaaatgtctccagtcatgttccataccctgtagcgttacatgtaaatatagtcaatgtccctcagccagctgccgcagccattcagagacactataatgatgaagaccctgagaaggaaaagcgaataaaggaattagaattgctcctaatgtcaaccgagaatgagctaaaaggacagcagacacagaaccacacatgcagctaccccgggtggcacagcaccaccattgccgaccacaccagacctcatggagacagtgcacctgtttcctgtttgggagaacaccactccactccatctctgccagcggatcctggctccctacctgaagaaagcgcctcgccagcaaggattcttcatcatggtgtgatctcagcagttttgaattctttgaagaagcagatttttcacctagccaacatcacacaggcaaagccctacagcttcagcaaagagagggcaatgggactaaacctgcaggagaacctagcccaagggtgaacaaacgtatgttgagtgagagttcacttgacccacccaaggtcttacctcctgcaaggcacagcacaattccactggtcatccttcgaaaaaaacggggccaggccagccccttagccactggagactgtagctccttcatatttgctgacgtcagcagttcaactcccaagcgttcccctgtcaaaagcctacccttctctccctcgcagttcttaaacacttccagtaaccatgaaaactcagacttggaaatgccttctttaacttccacccccctcattggtcacaaattgactgttacaacaccatttcatagagaccagactgtgaaaactcaaaaggaaaatactgtttttagaaccccagctatcaaaaggtcaatcttagaaagctctccaagaactcctacaccattcaaacatgcacttgcagctcaagaaattaaatacggtcccctgaagatgctacctcagacaccctctcatctagtagaagatctgcaggatgtgatcaaacaggaatctgatgaatctggaattgttgctgagtttcaagaaaatggaccacccttactgaagaaaatcaaacaagaggtggaatctccaactgataaatcaggaaacttcttctgctcacaccactgggaaggggacagtctgaatacccaactgttcacgcagacctcgcctgtggcagatgcaccgaatattcttacaagctccgttttaatggcaccagcatcagaagatgaagacaatgttctcaaagcatttacagtacctaaaaacaggtccctggcgagccccttgcagccttgtagcagtacctgggaacctgcatcctgtggaaagatggaggagcagatgacatcttccagtcaagctcgtaaatacgtgaatgcattctcagcccggacgctggtcatgtga

SEQ ID NO: 199251 - DNA, 2201 bp, Homo sapiens
  Payload ID: 19308
  Gene Name: v-myb avian myeloblastosis viral oncogene homolog
  ENST ID: ENST00000528015
  CDS Start-End: 1-1269
atggcccgaagaccccggcacagcatatatagcagtgacgaggatgatgaggactttgagatgtgtgaccatgactatgatgggctgcttcccaagtctggaaagcgtcacttggggaaaacaaggtggacccgggaagaggatgaaaaactgaagaagctggtggaacagaatggaacagatgactggaaagttattgccaattatctcccgaatcgaacagatgtgcagtgccagcaccgatggcagaaagtactaaaccctgagctcatcaagggtccttggaccaaagaagaagatcagagagtgatagagcttgtacagaaatacggtccgaaacgttggtctgttattgccaagcacttaaaggggagaattggaaaacaatgtagggagaggtggcataaccacttgaatccagaagttaagaaaacctcctggacagaagaggaagacagaattatttaccaggcacacaagagactggggaacagatgggcagaaatcgcaaagctactgcctggacgaactgataatgctatcaagaaccactggaattctacaatgcgtcggaaggtcgaacaggaaggttatctgcaggagtcttcaaaagccagccagccagcagtggccacaagcttccagaagaacagtcatttgatgggttttgctcaggctccgcctacagctcaactccctgccactggccagcccactgttaacaacgactattcctattaccacatttctgaagcacaaaatgtctccagtcatgttccataccctgtagcgttacatgtaaatatagtcaatgtccctcagccagctgccgcagccattcagagacactataatgatgaagaccctgagaaggaaaagcgaataaaggaattagaattgctcctaatgtcaaccgagaatgagctaaaaggacagcaggtgctaccaacacagaaccacacatgcagctaccccgggtggcacagcaccaccattgccgaccacaccagacctcatggagacagtgcacctgtttcctgtttgggagaacaccactccactccatctctgccagcggatcctggctccctacctgaagaaagcgcctcgccagcaaggattcttcatcatggtgtgatctcagcagttttgaattctttgaagaagcagatttttcacctagccaacatcacacaggcaaagccctacagcttcagcaaagagagggcaatgggactaaacctgcaggagaacctagcccaagggtgaacaaacgtatgttgagtgagagttcacttgacccacccaaggtcttacctcctgcaaggcacagcacaattccactggtcatccttcgaaaaaaacggggccaggccagccccttagccactggagactgtagctccttcatatttgctgacgtcagcagttcaactcccaagcgttcccctgtcaaaagcctacccttctctccctcgcagttcttaaacacttccagtaaccatgaaaactcagacttggaaatgccttctttaacttccacccccctcattggtcacaaattgactgttacaacaccatttcatagagaccagactgtgaaaactcaaaaggaaaatactgtttttagaaccccagctatcaaaaggtcaatcttagaaagctctccaagaactcctacaccattcaaacatgcacttgcagctcaagaaattaaatacggtcccctgaagatgctacctcagacaccctctcatctagtagaagatctgcaggatgtgatcaaacaggaatctgatgaatctggaattgttgctgagtttcaagaaaatggaccacccttactgaagaaaatcaaacaagaggtggaatctccaactgataaatcaggaaacttcttctgctcacaccactgggaaggggacagtctgaatacccaactgttcacgcagacctcgcctgtggcagatgcaccgaatattcttacaagctccgttttaatggcaccagcatcagaagatgaagacaatgttctcaaagcatttacagtacctaaaaacaggtccctggcgagccccttgcagccttgtagcagtacctgggaacctgcatcctgtggaaagatggaggagcagatgacatcttccagtcaagctcgtaaatacgtgaatgcattctcagcccggacgctggtcatgtga

SEQ ID NO: 199252 - DNA, 3081 bp, Homo sapiens
  Payload ID: 19308
  Gene Name: v-myb avian myeloblastosis viral oncogene homolog
  ENST ID: ENST00000526320
  CDS Start-End: 1-1125
atggcccgaagaccccggcacagcatatatagcagtgacgaggatgatgaggactttgagatgtgtgaccatgactatgatgggctgcttcccaagtctggaaagcgtcacttggggaaaacaaggtggacccgggaagaggatgaaaaactgaagaagctggtggaacagaatggaacagatgactggaaagttattgccaattatctcccgaatcgaacagatgtgcagtgccagcaccgatggcagaaagtactaaaccctgagctcatcaagggtccttggaccaaagaagaagatcagagagtgatagagcttgtacagaaatacggtccgaaacgttggtctgttattgccaagcacttaaaggggagaattggaaaacaatgtagggagaggtggcataaccacttgaatccagaagttaagaaaacctcctggacagaagaggaagacagaattatttaccaggcacacaagagactggggaacagatgggcagaaatcgcaaagctactgcctggacgaactgataatgctatcaagaaccactggaattctacaatgcgtcggaaggtcgaacaggaaggttatctgcaggagtcttcaaaagccagccagccagcagtggccacaagcttccagaagaacagtcatttgatgggttttgctcaggctccgcctacagctcaactccctgccactggccagcccactgttaacaacgactattcctattaccacatttctgaagcacaaaatgtctccagtcatgttccataccctgtagcgttacatgtaaatatagtcaatgtccctcagccagctgccgcagccattcagagacactataatgatgaagaccctgagaaggaaaagcgaataaaggaattagaattgctcctaatgtcaaccgagaatgagctaaaaggacagcaggtgctaccaacacagaaccacacatgcagctaccccgggtggcacagcaccaccattgccgaccacaccagacctcatggagacagtgcacctgtttcctgtttgggagaacaccactccactccatctctgccagcggatcctggctccctacctgaagaaagcgcctcgccagcaagttcttaaacacttccagtaaccatgaaaactcagacttggaaatgccttctttaacttccacccccctcattggtcacaaattgactgttacaacaccatttcatagagaccagactgtgaaaactcaaaaggaaaatactgtataggacctcttctgacatccccaggaatattatatgattagaagccaagggatgattttagaaccccagctatcaaaaggtcaatcttagaaagctctccaagaactcctacaccattcaaacatgcacttgcagctcaagaaattaaatacggtcccctgaagatgctacctcagacaccctctcatctagtagaagatctgcaggatgtgatcaaacaggaatctgatgaatctggaattgttgctgagtttcaagaaaatggaccacccttactgaagaaaatcaaacaagaggtggaatctccaactgataaatcaggaaacttcttctgctcacaccactgggaaggggacagtctgaatacccaactgttcacgcagacctcgcctgtggcagatgcaccgaatattcttacaagctccgttttaatggcaccagcatcagaagatgaagacaatgttctcaaagcatttacagtacctaaaaacaggtccctggcgagccccttgcagccttgtagcagtacctgggaacctgcatcctgtggaaagatggaggagcagatgacatcttccagtcaagctcgtaaatacgtgaatgcattctcagcccggacgctggtcatgtgagacatttccagaaaagcattatggttttcagaacacttcaagttgacttgggatatatcattcctcaacatgaaacttttcatgaatgggagaagaacctatttttgttgtggtacaacagttgagagcagcaccaagtgcatttagttgaatgaagtcttcttggatttcacccaactaaaaggatttttaaaaataaataacagtcttacctaaattattaggtaatgaattgtagccagttgttaatatcttaatgcagatttttttaaaaaaaacataaaatgatttatctgtattttaaaggatccaacagatcagtattttttcctgtgatgggttttttgaaatttgacacattaaaaggtactccagtatttcacttttctcgatcactaaacatatgcatatatttttaaaaatcagtaaaagcattactctaagtgtagacttaataccatgtgacatttaatccagattgtaaatgctcatttatggttaatgacattgaaggtacatttattgtaccaaaccattttatgagttttctgttagcttgctttaaaaattattactgtaagaaatagttttataaaaaattatatttttattcagtaatttaattttgtaaatgccaaatgaaaaacgttttttgctgctatggtcttagcctgtagacatgctgctagtatcagaggggcagtagagcttggacagaaagaaaagaaacttggtgttaggtaattgactatgcactagtatttcagactttttaattttatatatatatacattttttttccttctgcaatacatttgaaaacttgtttgggagactctgcattttttattgtggtttttttgttattgttggtttatacaagcatgcgttgcacttcttttttgggagatgtgtgttgttgatgttctatgttttgttttgagtgtagcctgactgttttataatttgggagttctgcatttgatccgcatcccctgtggtttctaagtgtatggtctcagaactgttgcatggatcctgtgtttgcaactggggagacagaaactgtggttgatagccagtcactgccttaagaacatttgatgcaagatggccagcactgaacttttgagatatgacggtgtacttactgccttgtagcaaaataaagatgtgcccttatttt

SEQ ID NO: 199253 - DNA, 1812 bp, Homo sapiens
  Payload ID: 19308
  Gene Name: v-myb avian myeloblastosis viral oncogene homolog
  Uniprot ID: P10242
  ENST ID: ENST00000534044
  CDS Start-End: 1-1812
atggcccgaagaccccggcacagcatatatagcagtgacgaggatgatgaggactttgagatgtgtgaccatgactatgatgggctgcttcccaagtctggaaagcgtcacttggggaaaacaaggtggacccgggaagaggatgaaaaactgaagaagctggtggaacagaatggaacagatgactggaaagttattgccaattatctcccgaatcgaacagatgtgcagtgccagcaccgatggcagaaagtactaaaccctgagctcatcaagggtccttggaccaaagaagaagatcagagagtgatagagcttgtacagaaatacggtccgaaacgttggtctgttattgccaagcacttaaaggggagaattggaaaacaatgtagggagaggtggcataaccacttgaatccagaagttaagaaaacctcctggacagaagaggaagacagaattatttaccaggcacacaagagactggggaacagatgggcagaaatcgcaaagctactgcctggacgaactgataatgctatcaagaaccactggaattctacaatgcgtcggaaggtcgaacaggaaggttatctgcaggagtcttcaaaagccagccagccagcagtggccacaagcttccagaagaacagtcatttgatgggttttgctcaggctccgcctacagctcaactccctgccactggccagcccactgttaacaacgactattcctattaccacatttctgaagcacaaaatgtctccagtcatgttccataccctgtagcgttacatgtaaatatagtcaatgtccctcagccagctgccgcagccattcagagacactataatgatgaagaccctgagaaggaaaagcgaataaaggaattagaattgctcctaatgtcaaccgagaatgagctaaaaggacagcaggtgctaccaacacagaaccacacatgcagctaccccgggtggcacagcaccaccattgccgaccacaccagacctcatggagacagtgcacctgtttcctgtttgggagaacaccactccactccatctctgccagcggatcctggctccctacctgaagaaagcgcctcgccagcaaggtgcatgatcgtccaccagggcaccattctggataatgttaagaacctcttagaatttgcagaaacactccaatttatagattctttcttaaacacttccagtaaccatgaaaactcagacttggaaatgccttctttaacttccacccccctcattggtcacaaattgactgttacaacaccatttcatagagaccagactgtgaaaactcaaaaggaaaatactgtttttagaaccccagctatcaaaaggtcaatcttagaaagctctccaagaactcctacaccattcaaacatgcacttgcagctcaagaaattaaatacggtcccctgaagatgctacctcagacaccctctcatctagtagaagatctgcaggatgtgatcaaacaggaatctgatgaatctggaattgttgctgagtttcaagaaaatggaccacccttactgaagaaaatcaaacaagagaatattcttacaagctccgttttaatggcaccagcatcagaagatgaagacaatgttctcaaagcatttacagtacctaaaaacaggtccctggcgagccccttgcagccttgtagcagtacctgggaacctgcatcctgtggaaagatggaggagcagatgacatcttccagtcaagctcgtaaatacgtgaatgcattctcagcccggacgctggtcatgtga

SEQ ID NO: 199254 - DNA, 3349 bp, Homo sapiens
  Payload ID: 19308
  Gene Name: v-myb avian myeloblastosis viral oncogene homolog
  Uniprot ID: P10242
  ENST ID: ENST00000533808
  CDS Start-End: 1-1209
atggcccgaagaccccggcacagcatatatagcagtgacgaggatgatgaggactttgagatgtgtgaccatgactatgatgggctgcttcccaagtctggaaagcgtcacttggggaaaacaaggtggacccgggaagaggatgaaaaactgaagaagctggtggaacagaatggaacagatgactggaaagttattgccaattatctcccgaatcgaacagatgtgcagtgccagcaccgatggcagaaagtactaaaccctgagctcatcaagggtccttggaccaaagaagaagatcagagagtgatagagcttgtacagaaatacggtccgaaacgttggtctgttattgccaagcacttaaaggggagaattggaaaacaatgtagggagaggtggcataaccacttgaatccagaagttaagaaaacctcctggacagaagaggaagacagaattatttaccaggcacacaagagactggggaacagatgggcagaaatcgcaaagctactgcctggacgaactgataatgctatcaagaaccactggaattctacaatgcgtcggaaggtcgaacaggaaggttatctgcaggagtcttcaaaagccagccagccagcagtggccacaagcttccagaagaacagtcatttgatgggttttgctcaggctccgcctacagctcaactccctgccactggccagcccactgttaacaacgactattcctattaccacatttctgaagcacaaaatgtctccagtcatgttccataccctgtagcgttacatgtaaatatagtcaatgtccctcagccagctgccgcagccattcagagacactataatgatgaagaccctgagaaggaaaagcgaataaaggaattagaattgctcctaatgtcaaccgagaatgagctaaaaggacagcaggtgctaccaacacagaaccacacatgcagctaccccgggtggcacagcaccaccattgccgaccacaccagacctcatggagacagtgcacctgtttcctgtttgggagaacaccactccactccatctctgccagcggatcctggctccctacctgaagaaagcgcctcgccagcaaggtgcatgatcgtccaccagggcaccattctggataatgttaagaacctcttagaatttgcagaaacactccaatttatagattctatgtagagtgtcgggaggtccctgcagcacatcagagggccagccttgaggcagcccactagaccctgctctactgcagtataatagagcaactgctcatcttgaagctgttgctcaagaagccaaaccaacgggcctagtgtttgctttgcgttgagcatctctctctcagtgctgtttcagttcttaaacacttccagtaaccatgaaaactcagacttggaaatgccttctttaacttccacccccctcattggtcacaaattgactgttacaacaccatttcatagagaccagactgtgaaaactcaaaaggaaaatactgtataggacctcttctgacatccccaggaatattatatgattagaagccaagggatgattttagaaccccagctatcaaaaggtcaatcttagaaagctctccaagaactcctacaccattcaaacatgcacttgcagctcaagaaattaaatacggtcccctgaagatgctacctcagacaccctctcatctagtagaagatctgcaggatgtgatcaaacaggaatctgatgaatctggaattgttgctgagtttcaagaaaatggaccacccttactgaagaaaatcaaacaagaggtggaatctccaactgataaatcaggaaacttcttctgctcacaccactgggaaggggacagtctgaatacccaactgttcacgcagacctcgcctgtggcagatgcaccgaatattcttacaagctccgttttaatggcaccagcatcagaagatgaagacaatgttctcaaagcatttacagtacctaaaaacaggtccctggcgagccccttgcagccttgtagcagtacctgggaacctgcatcctgtggaaagatggaggagcagatgacatcttccagtcaagctcgtaaatacgtgaatgcattctcagcccggacgctggtcatgtgagacatttccagaaaagcattatggttttcagaacacttcaagttgacttgggatatatcattcctcaacatgaaacttttcatgaatgggagaagaacctatttttgttgtggtacaacagttgagagcagcaccaagtgcatttagttgaatgaagtcttcttggatttcacccaactaaaaggatttttaaaaataaataacagtcttacctaaattattaggtaatgaattgtagccagttgttaatatcttaatgcagatttttttaaaaaaaacataaaatgatttatctgtattttaaaggatccaacagatcagtattttttcctgtgatgggttttttgaaatttgacacattaaaaggtactccagtatttcacttttctcgatcactaaacatatgcatatatttttaaaaatcagtaaaagcattactctaagtgtagacttaataccatgtgacatttaatccagattgtaaatgctcatttatggttaatgacattgaaggtacatttattgtaccaaaccattttatgagttttctgttagcttgctttaaaaattattactgtaagaaatagttttataaaaaattatatttttattcagtaatttaattttgtaaatgccaaatgaaaaacgttttttgctgctatggtcttagcctgtagacatgctgctagtatcagaggggcagtagagcttggacagaaagaaaagaaacttggtgttaggtaattgactatgcactagtatttcagactttttaattttatatatatatacattttttttccttctgcaatacatttgaaaacttgtttgggagactctgcattttttattgtggtttttttgttattgttggtttatacaagcatgcgttgcacttcttttttgggagatgtgtgttgttgatgttctatgttttgttttgagtgtagcctgactgttttataatttgggagttctgcatttgatccgcatcccctgtggtttctaagtgtatggtctcagaactgttgcatggatcctgtgtttgcaactggggagacagaaactgtggttgatagccagtcactgccttaagaacatttgatgcaagatggccagcactgaacttttgagatatgacggtgtacttactgccttgtagcaaaataaagatgtgcccttatttt

SEQ ID NO: 199255 - DNA, 1973 bp, Homo sapiens
  Payload ID: 19308
  Gene Name: v-myb avian myeloblastosis viral oncogene homolog
  ENST ID: ENST00000528345
  CDS Start-End: 1-981
atggcccgaagaccccggcacagcatatatagcagtgacgaggatgatgaggactttgagatgtgtgaccatgactatgatgggctgcttcccaagtctggaaagcgtcacttggggaaaacaaggtggacccgggaagagaatcgaacagatgtgcagtgccagcaccgatggcagaaagtactaaaccctgagctcatcaagggtccttggaccaaagaagaagatcagagagtgatagagcttgtacagaaatacggtccgaaacgttggtctgttattgccaagcacttaaaggggagaattggaaaacaatgtagggagaggtggcataaccacttgaatccagaagttaagaaaacctcctggacagaagaggaagacagaattatttaccaggcacacaagagactggggaacagatgggcagaaatcgcaaagctactgcctggacgaactgataatgctatcaagaaccactggaattctacaatgcgtcggaaggtcgaacaggaaggttatctgcaggagtcttcaaaagccagccagccagcagtggccacaagcttccagaagaacagtcatttgatgggttttgctcaggctccgcctacagctcaactccctgccactggccagcccactgttaacaacgactattcctattaccacatttctgaagcacaaaatgtctccagtcatgttccataccctgtagcgttacatgtaaatatagtcaatgtccctcagccagctgccgcagccattcagagacactataatgatgaagaccctgagaaggaaaagcgaataaaggaattagaattgctcctaatgtcaaccgagaatgagctaaaaggacagcaggtgctaccattatgtgggccattactgaattctgacatctttagcgactgggcagccaactgggatggctccttgtgctttgcaacatacatagttaaccaacaaagacaataaaagagaagtgatgcccaacacagaaccacacatgcagctaccccgggtggcacagcaccaccattgccgaccacaccagacctcatggagacagtgcacctgtttcctgtttgggagaacaccactccactccatctctgccagcggatcctggctccctacctgaagaaagcgcctcgccagcaaggtgcatgatcgtccaccagggcaccattctggataatgttaagaacctcttagaatttgcagaaacactccaatttatagattctttcttaaacacttccagtaaccatgaaaactcagacttggaaatgccttctttaacttccacccccctcattggtcacaaattgactgttacaacaccatttcatagagaccagactgtgaaaactcaaaaggaaaatactgtttttagaaccccagctatcaaaaggtcaatcttagaaagctctccaagaactcctacaccattcaaacatgcacttgcagctcaagaaattaaatacggtcccctgaagatgctacctcagacaccctctcatctagtagaagatctgcaggatgtgatcaaacaggaatctgatgaatctggaattgttgctgagtttcaagaaaatggaccacccttactgaagaaaatcaaacaagaggtggaatctccaactgataaatcaggaaacttcttctgctcacaccactgggaaggggacagtctgaatacccaactgttcacgcagacctcgcctgtggcagatgcaccgaatattcttacaagctccgttttaatggcaccagcatcagaagatgaagacaatgttctcaaagcatttacagtacctaaaaacaggtccctggcgagccccttgcagccttgtagcagtacctgggaacctgcatcctgtggaaagatggaggagcagatgacatcttccagtcaagctcgtaaatacgtgaatgcattctcagcccggacgctggtcatgtga

SEQ ID NO: 199256 - DNA, 3288 bp, Homo sapiens
  Payload ID: 19308
  Gene Name: v-myb avian myeloblastosis viral oncogene homolog
  Uniprot ID: P10242
  ENST ID: ENST00000525514
  CDS Start-End: 1-1053
atggcccgaagaccccggcacagcatatatagcagtgacgaggatgatgaggactttgagatgtgtgaccatgactatgatgggctgcttcccaagtctggaaagcgtcacttggggaaaacaaggtggacccgggaagaggatgaaaaactgaagaagctggtggaacagaatggaacagatgactggaaagttattgccaattatctcccgaatcgaacagatgtgcagtgccagcaccgatggcagaaagtactaaaccctgagctcatcaagggtccttggaccaaagaagaagatcagagagtgatagagcttgtacagaaatacggtccgaaacgttggtctgttattgccaagcacttaaaggggagaattggaaaacaatgtagggagaggtggcataaccacttgaatccagaagttaagaaaacctcctggacagaagaggaagacagaattatttaccaggcacacaagagactggggaacagatgggcagaaatcgcaaagctactgcctggacgaactgataatgctatcaagaaccactggaattctacaatgcgtcggaaggtcgaacaggaaggttatctgcaggagtcttcaaaagccagccagccagcagtggccacaagcttccagaagaacagtcatttgatgggttttgctcaggctccgcctacagctcaactccctgccactggccagcccactgttaacaacgactattcctattaccacatttctgaagcacaaaatgtctccagtcatgttccataccctgtagcgttacatgtaaatatagtcaatgtccctcagccagctgccgcagccattcagagacactataatgatgaagaccctgagaaggaaaagcgaataaaggaattagaattgctcctaatgtcaaccgagaatgagctaaaaggacagcaggtgctaccattatgtgggccattactgaattctgacatctttagcgactgggcagccaactgggatggctccttgtgctttgcaacatacatagttaaccaacaaagacaataaaagagaagtgatgcccaacacagaaccacacatgcagctaccccgggtggcacagcaccaccattgccgaccacaccagacctcatggagacagtgcacctgtttcctgtttgggagaacaccactccactccatctctgccagcggatcctggctccctacctgaagaaagcgcctcgccagcaaggtgcatgatcgtccaccagggcaccattctggataatgttaagaacctcttagaatttgcagaaacactccaatttatagattctttcttaaacacttccagtaaccatgaaaactcagacttggaaatgccttctttaacttccacccccctcattggtcacaaattgactgttacaacaccatttcatagagaccagactgtgaaaactcaaaaggaaaatactgtataggacctcttctgacatccccaggaatattatatgattagaagccaagggatgattttagaaccccagctatcaaaaggtcaatcttagaaagctctccaagaactcctacaccattcaaacatgcacttgcagctcaagaaattaaatacggtcccctgaagatgctacctcagacaccctctcatctagtagaagatctgcaggatgtgatcaaacaggaatctgatgaatctggaattgttgctgagtttcaagaaaatggaccacccttactgaagaaaatcaaacaagaggtggaatctccaactgataaatcaggaaacttcttctgctcacaccactgggaaggggacagtctgaatacccaactgttcacgcagacctcgcctgtggcagatgcaccgaatattcttacaagctccgttttaatggcaccagcatcagaagatgaagacaatgttctcaaagcatttacagtacctaaaaacaggtccctggcgagccccttgcagccttgtagcagtacctgggaacctgcatcctgtggaaagatggaggagcagatgacatcttccagtcaagctcgtaaatacgtgaatgcattctcagcccggacgctggtcatgtgagacatttccagaaaagcattatggttttcagaacacttcaagttgacttgggatatatcattcctcaacatgaaacttttcatgaatgggagaagaacctatttttgttgtggtacaacagttgagagcagcaccaagtgcatttagttgaatgaagtcttcttggatttcacccaactaaaaggatttttaaaaataaataacagtcttacctaaattattaggtaatgaattgtagccagttgttaatatcttaatgcagatttttttaaaaaaaacataaaatgatttatctgtattttaaaggatccaacagatcagtattttttcctgtgatgggttttttgaaatttgacacattaaaaggtactccagtatttcacttttctcgatcactaaacatatgcatatatttttaaaaatcagtaaaagcattactctaagtgtagacttaataccatgtgacatttaatccagattgtaaatgctcatttatggttaatgacattgaaggtacatttattgtaccaaaccattttatgagttttctgttagcttgctttaaaaattattactgtaagaaatagttttataaaaaattatatttttattcagtaatttaattttgtaaatgccaaatgaaaaacgttttttgctgctatggtcttagcctgtagacatgctgctagtatcagaggggcagtagagcttggacagaaagaaaagaaacttggtgttaggtaattgactatgcactagtatttcagactttttaattttatatatatatacattttttttccttctgcaatacatttgaaaacttgtttgggagactctgcattttttattgtggtttttttgttattgttggtttatacaagcatgcgttgcacttcttttttgggagatgtgtgttgttgatgttctatgttttgttttgagtgtagcctgactgttttataatttgggagttctgcatttgatccgcatcccctgtggtttctaagtgtatggtctcagaactgttgcatggatcctgtgtttgcaactggggagacagaaactgtggttgatagccagtcactgccttaagaacatttgatgcaagatggccagcactgaacttttgagatatgacggtgtacttactgccttgtagcaaaataaagatgtgcccttatttt

SEQ ID NO: 199257 - DNA, 2911 bp, Homo sapiens
  Payload ID: 19308
  Gene Name: v-myb avian myeloblastosis viral oncogene homolog
  ENST ID: ENST00000531519
  CDS Start-End: 1-1095
atggcccgaagaccccggcacagcatatatagcagtgacgaggatgatgaggactttgagatgtgtgaccatgactatgatgggctgcttcccaagtctggaaagcgtcacttggggaaaacaaggtggacccgggaagaggatgaaaaactgaagaagctggtggaacagaatggaacagatgactggaaagttattgccaattatctcccgaatcgaacagatgtgcagtgccagcaccgatggcagaaagtactaaaccctgagctcatcaagggtccttggaccaaagaagaagatcagagagtgatagagcttgtacagaaatacggtccgaaacgttggtctgttattgccaagcacttaaaggggagaattggaaaacaatgtagggagaggtggcataaccacttgaatccagaagttaagaaaacctcctggacagaagaggaagacagaattatttaccaggcacacaagagactggggaacagatgggcagaaatcgcaaagctactgcctggacgaactgataatgctatcaagaaccactggaattctacaatgcgtcggaaggtcgaacaggaaggttatctgcaggagtcttcaaaagccagccagccagcagtggccacaagcttccagaagaacagtcatttgatgggttttgctcaggctccgcctacagctcaactccctgccactggccagcccactgttaacaacgactattcctattaccacatttctgaagcacaaaatgtctccagtcatgttccataccctgtagcgttacatgtaaatatagtcaatgtccctcagccagctgccgcagccattcagagacactataatgatgaagaccctgagaaggaaaagcgaataaaggaattagaattgctcctaatgtcaaccgagaatgagctaaaaggacagcaggtgctaccattcttaaacacttccagtaaccatgaaaactcagacttggaaatgccttctttaacttccacccccctcattggtcacaaattgactgttacaacaccatttcatagagaccagactgtgaaaactcaaaaggaaaatactgtataggacctcttctgacatccccaggaatattatatgattagaagccaagggatgattttagaaccccagctatcaaaaggtcaatcttagaaagctctccaagaactcctacaccattcaaacatgcacttgcagctcaagaaattaaatacggtcccctgaagatgctacctcagacaccctctcatctagtagaagatctgcaggatgtgatcaaacaggaatctgatgaatctggaattgttgctgagtttcaagaaaatggaccacccttactgaagaaaatcaaacaagaggtggaatctccaactgataaatcaggaaacttcttctgctcacaccactgggaaggggacagtctgaatacccaactgttcacgcagacctcgcctgtggcagatgcaccgaatattcttacaagctccgttttaatggcaccagcatcagaagatgaagacaatgttctcaaagcatttacagtacctaaaaacaggtccctggcgagccccttgcagccttgtagcagtacctgggaacctgcatcctgtggaaagatggaggagcagatgacatcttccagtcaagctcgtaaatacgtgaatgcattctcagcccggacgctggtcatgtgagacatttccagaaaagcattatggttttcagaacacttcaagttgacttgggatatatcattcctcaacatgaaacttttcatgaatgggagaagaacctatttttgttgtggtacaacagttgagagcagcaccaagtgcatttagttgaatgaagtcttcttggatttcacccaactaaaaggatttttaaaaataaataacagtcttacctaaattattaggtaatgaattgtagccagttgttaatatcttaatgcagatttttttaaaaaaaacataaaatgatttatctgtattttaaaggatccaacagatcagtattttttcctgtgatgggttttttgaaatttgacacattaaaaggtactccagtatttcacttttctcgatcactaaacatatgcatatatttttaaaaatcagtaaaagcattactctaagtgtagacttaataccatgtgacatttaatccagattgtaaatgctcatttatggttaatgacattgaaggtacatttattgtaccaaaccattttatgagttttctgttagcttgctttaaaaattattactgtaagaaatagttttataaaaaattatatttttattcagtaatttaattttgtaaatgccaaatgaaaaacgttttttgctgctatggtcttagcctgtagacatgctgctagtatcagaggggcagtagagcttggacagaaagaaaagaaacttggtgttaggtaattgactatgcactagtatttcagactttttaattttatatatatatacattttttttccttctgcaatacatttgaaaacttgtttgggagactctgcattttttattgtggtttttttgttattgttggtttatacaagcatgcgttgcacttcttttttgggagatgtgtgttgttgatgttctatgttttgttttgagtgtagcctgactgttttataatttgggagttctgcatttgatccgcatcccctgtggtttctaagtgtatggtctcagaactgttgcatggatcctgtgtttgcaactggggagacagaaactgtggttgatagccagtcactgccttaagaacatttgatgcaagatggccagcactgaacttttgagatatgacggtgtacttactgccttgtagcaaaataaagatgtgcccttatttt

SEQ ID NO: 199258 - DNA, 2866 bp, Homo sapiens
  Payload ID: 19308
  Gene Name: v-myb avian myeloblastosis viral oncogene homolog
  Uniprot ID: P10242
  ENST ID: ENST00000525369
  CDS Start-End: 7-1674
cgcgccatggcccgaagaccccggcacagcatatatagcagtgacgaggatgatgaggactttgagatgtgtgaccatgactatgatgggctgcttcccaagtctggaaagcgtcacttggggaaaacaaggtggacccgggaagaggatgaaaaactgaagaagctggtggaacagaatggaacagatgactggaaagttattgccaattatctcccgaatcgaacagatgtgcagtgccagcaccgatggcagaaagtactaaaccctgagctcatcaagggtccttggaccaaagaagaagatcagagagtgatagagcttgtacagaaatacggtccgaaacgttggtctgttattgccaagcacttaaaggggagaattggaaaacaatgtagggagaggtggcataaccacttgaatccagaagttaagaaaacctcctggacagaagaggaagacagaattatttaccaggcacacaagagactggggaacagatgggcagaaatcgcaaagctactgcctggacgaactgataatgctatcaagaaccactggaattctacaatgcgtcggaaggtcgaacaggaaggttatctgcaggagtcttcaaaagccagccagccagcagtggccacaagcttccagaagaacagtcatttgatgggttttgctcaggctccgcctacagctcaactccctgccactggccagcccactgttaacaacgactattcctattaccacatttctgaagcacaaaatgtctccagtcatgttccataccctgtagcgttacatgtaaatatagtcaatgtccctcagccagctgccgcagccattcagagacactataatgatgaagaccctgagaaggaaaagcgaataaaggaattagaattgctcctaatgtcaaccgagaatgagctaaaaggacagcaggtgctaccattcttaaacacttccagtaaccatgaaaactcagacttggaaatgccttctttaacttccacccccctcattggtcacaaattgactgttacaacaccatttcatagagaccagactgtgaaaactcaaaaggaaaatactgtttttagaaccccagctatcaaaaggtcaatcttagaaagctctccaagaactcctacaccattcaaacatgcacttgcagctcaagaaattaaatacggtcccctgaagatgctacctcagacaccctctcatctagtagaagatctgcaggatgtgatcaaacaggaatctgatgaatctggaattgttgctgagtttcaagaaaatggaccacccttactgaagaaaatcaaacaagaggtggaatctccaactgataaatcaggaaacttcttctgctcacaccactgggaaggggacagtctgaatacccaactgttcacgcagacctcgcctgtggcagatgcaccgaatattcttacaagctccgttttaatggcaccagcatcagaagatgaagacaatgttctcaaagcatttacagtacctaaaaacaggtccctggcgagccccttgcagccttgtagcagtacctgggaacctgcatcctgtggaaagatggaggagcagatgacatcttccagtcaagctcgtaaatacgtgaatgcattctcagcccggacgctggtcatgtgagacatttccagaaaagcattatggttttcagaacacttcaagttgacttgggatatatcattcctcaacatgaaacttttcatgaatgggagaagaacctatttttgttgtggtacaacagttgagagcagcaccaagtgcatttagttgaatgaagtcttcttggatttcacccaactaaaaggatttttaaaaataaataacagtcttacctaaattattaggtaatgaattgtagccagttgttaatatcttaatgcagatttttttaaaaaaaacataaaatgatttatctgtattttaaaggatccaacagatcagtattttttcctgtgatgggttttttgaaatttgacacattaaaaggtactccagtatttcacttttctcgatcactaaacatatgcatatatttttaaaaatcagtaaaagcattactctaagtgtagacttaataccatgtgacatttaatccagattgtaaatgctcatttatggttaatgacattgaaggtacatttattgtaccaaaccattttatgagttttctgttagcttgctttaaaaattattactgtaagaaatagttttataaaaaattatatttttattcagtaatttaattttgtaaatgccaaatgaaaaacgttttttgctgctatggtcttagcctgtagacatgctgctagtatcagaggggcagtagagcttggacagaaagaaaagaaacttggtgttaggtaattgactatgcactagtatttcagactttttaattttatatatatatacattttttttccttctgcaatacatttgaaaacttgtttgggagactctgcattttttattgtggtttttttgttattgttggtttatacaagcatgcgttgcacttcttttttgggagatgtgtgttgttgatgttctatgttttgttttgagtgtagcctgactgttttataatttgggagttctgcatttgatccgcatcccctgtggtttctaagtgtatggtctcagaactgttgcatggatcctgtgtttgcaactggggagacagaaactgtggttgatagccagtcactgccttaagaacatttgatgcaagatggccagcactgaacttttgagatatgacggtgtacttactgccttgtagcaaaataaagatgtgcccttattttaccta

SEQ ID NO: 199259 - DNA, 2399 bp, Homo sapiens
  Payload ID: 19308
  Gene Name: v-myb avian myeloblastosis viral oncogene homolog
  ENST ID: ENST00000526565
  CDS Start-End: 1-1044
atggcccgaagaccccggcacagcatatatagcagtgacgaggatgatgaggactttgagatgtgtgaccatgactatgatgggctgcttcccaagtctggaaagcgtcacttggggaaaacaaggtggacccgggaagaggatgaaaaactgaagaagctggtggaacagaatggaacagatgactggaaagttattgccaattatctcccgaatcgaacagatgtgcagtgccagcaccgatggcagaaagtactaaaccctgagctcatcaagggtccttggaccaaagaagaagatcagagagtgatagagcttgtacagaaatacggtccgaaacgttggtctgttattgccaagcacttaaaggggagaattggaaaacaatgtagggagaggtggcataaccacttgaatccagaagttaagaaaacctcctggacagaagaggaagacagaattatttaccaggcacacaagagactggggaacagatgggcagaaatcgcaaagctactgcctggacgaactgataatgctatcaagaaccactggaattctacaatgcgtcggaaggtcgaacaggaaggttatctgcaggagtcttcaaaagccagccagccagcagtggccacaagcttccagaagaacagtcatttgatgggttttgctcaggctccgcctacagctcaactccctgccactggccagcccactgttaacaacgactattcctattaccacatttctgaagcacaaaatgtctccagtcatgttccataccctgtagcgttacatgtaaatatagtcaatgtccctcagccagctgccgcagccattcagagacactataatgatgaagaccctgagaaggaaaagcgaataaaggaattagaattgctcctaatgtcaaccgagaatgagctaaaaggacagcagttatgtgggccattactgaattctgacatctttagcgactgggcagccaactgggatggctccttgtgctttgcaacatacatagttaaccaacaaagacaataaaagagaagtgatgcccaacacagaaccacacatgcagctaccccgggtggcacagcaccaccattgccgaccacaccagacctcatggagacagtgcacctgtttcctgtttgggagaacaccactccactccatctctgccagcggatcctggctccctacctgaagaaagcgcctcgccagcaaggtgcatgatcgtccaccagggcaccattctggataatgttaagaacctcttagaatttgcagaaacactccaatttatagattctgattcttcatcatggtgtgatctcagcagttttgaattctttgaagaagcagatttttcacctagccaacatcacacaggcaaagccctacagcttcagcaaagagagggcaatgggactaaacctgcaggagaacctagcccaagggtgaacaaacgtatgttgagtgagagttcacttgacccacccaaggtcttacctcctgcaaggcacagcacaattccactggtcatccttcgaaaaaaacggggccaggccagccccttagccactggagactgtagctccttcatatttgctgacgtcagcagttcaactcccaagcgttcccctgtcaaaagcctacccttctctccctcgcagttcttaaacacttccagtaaccatgaaaactcagacttggaaatgccttctttaacttccacccccctcattggtcacaaattgactgttacaacaccatttcatagagaccagactgtgaaaactcaaaaggaaaatactgtttttagaaccccagctatcaaaaggtcaatcttagaaagctctccaagaactcctacaccattcaaacatgcacttgcagctcaagaaattaaatacggtcccctgaagatgctacctcagacaccctctcatctagtagaagatctgcaggatgtgatcaaacaggaatctgatgaatctggaattgttgctgagtttcaagaaaatggaccacccttactgaagaaaatcaaacaagaggtggaatctccaactgataaatcaggaaacttcttctgctcacaccactgggaaggggacagtctgaatacccaactgttcacgcagacctcgcctgtggcagatgcaccgaatattcttacaagctccgttttaatggcaccagcatcagaagatgaagacaatgttctcaaagcatttacagtacctaaaaacaggtccctggcgagccccttgcagccttgtagcagtacctgggaacctgcatcctgtggaaagatggaggagcagatgacatcttccagtcaagctcgtaaatacgtgaatgcattctcagcccggacgctggtcatgtga

SEQ ID NO: 199260 - DNA, 3422 bp, Homo sapiens
  Payload ID: 19308
  Gene Name: v-myb avian myeloblastosis viral oncogene homolog
  ENST ID: ENST00000463282
  CDS Start-End: 200-1243
aatatcaacctgtttcctcctcctccttctcctcctcctccgtgacctcctcctcctctttctcctgagaaacttcgccccagcggtgcggagcgccgctgcgcagccggggagggacgcaggcaggcggcgggcagcgggaggcggcagcccggtgcggtccccgcggctctcggcggagccccgcgcccgccgcgccatggcccgaagaccccggcacagcatatatagcagtgacgaggatgatgaggactttgagatgtgtgaccatgactatgatgggctgcttcccaagtctggaaagcgtcacttggggaaaacaaggtggacccgggaagaggatgaaaaactgaagaagctggtggaacagaatggaacagatgactggaaagttattgccaattatctcccgaatcgaacagatgtgcagtgccagcaccgatggcagaaagtactaaaccctgagctcatcaagggtccttggaccaaagaagaagatcagagagtgatagagcttgtacagaaatacggtccgaaacgttggtctgttattgccaagcacttaaaggggagaattggaaaacaatgtagggagaggtggcataaccacttgaatccagaagttaagaaaacctcctggacagaagaggaagacagaattatttaccaggcacacaagagactggggaacagatgggcagaaatcgcaaagctactgcctggacgaactgataatgctatcaagaaccactggaattctacaatgcgtcggaaggtcgaacaggaaggttatctgcaggagtcttcaaaagccagccagccagcagtggccacaagcttccagaagaacagtcatttgatgggttttgctcaggctccgcctacagctcaactccctgccactggccagcccactgttaacaacgactattcctattaccacatttctgaagcacaaaatgtctccagtcatgttccataccctgtagcgttacatgtaaatatagtcaatgtccctcagccagctgccgcagccattcagagacactataatgatgaagaccctgagaaggaaaagcgaataaaggaattagaattgctcctaatgtcaaccgagaatgagctaaaaggacagcagttatgtgggccattactgaattctgacatctttagcgactgggcagccaactgggatggctccttgtgctttgcaacatacatagttaaccaacaaagacaataaaagagaagtgatgcccaacacagaaccacacatgcagctaccccgggtggcacagcaccaccattgccgaccacaccagacctcatggagacagtgcacctgtttcctgtttgggagaacaccactccactccatctctgccagcggatcctggctccctacctgaagaaagcgcctcgccagcaaggtgcatgatcgtccaccagggcaccattctggataatgttaagaacctcttagaatttgcagaaacactccaatttatagattctttcttaaacacttccagtaaccatgaaaactcagacttggaaatgccttctttaacttccacccccctcattggtcacaaattgactgttacaacaccatttcatagagaccagactgtgaaaactcaaaaggaaaatactgtttttagaaccccagctatcaaaaggtcaatcttagaaagctctccaagaactcctacaccattcaaacatgcacttgcagctcaagaaattaaatacggtcccctgaagatgctacctcagacaccctctcatctagtagaagatctgcaggatgtgatcaaacaggaatctgatgaatctggaattgttgctgagtttcaagaaaatggaccacccttactgaagaaaatcaaacaagaggtggaatctccaactgataaatcaggaaacttcttctgctcacaccactgggaaggggacagtctgaatacccaactgttcacgcagacctcgcctgtggcagatgcaccgaatattcttacaagctccgttttaatggcaccagcatcagaagatgaagacaatgttctcaaagcatttacagtacctaaaaacaggtccctggcgagccccttgcagccttgtagcagtacctgggaacctgcatcctgtggaaagatggaggagcagatgacatcttccagtcaagctcgtaaatacgtgaatgcattctcagcccggacgctggtcatgtgagacatttccagaaaagcattatggttttcagaacacttcaagttgacttgggatatatcattcctcaacatgaaacttttcatgaatgggagaagaacctatttttgttgtggtacaacagttgagagcagcaccaagtgcatttagttgaatgaagtcttcttggatttcacccaactaaaaggatttttaaaaataaataacagtcttacctaaattattaggtaatgaattgtagccagttgttaatatcttaatgcagatttttttaaaaaaaacataaaatgatttatctgtattttaaaggatccaacagatcagtattttttcctgtgatgggttttttgaaatttgacacattaaaaggtactccagtatttcacttttctcgatcactaaacatatgcatatatttttaaaaatcagtaaaagcattactctaagtgtagacttaataccatgtgacatttaatccagattgtaaatgctcatttatggttaatgacattgaaggtacatttattgtaccaaaccattttatgagttttctgttagcttgctttaaaaattattactgtaagaaatagttttataaaaaattatatttttattcagtaatttaattttgtaaatgccaaatgaaaaacgttttttgctgctatggtcttagcctgtagacatgctgctagtatcagaggggcagtagagcttggacagaaagaaaagaaacttggtgttaggtaattgactatgcactagtatttcagactttttaattttatatatatatacattttttttccttctgcaatacatttgaaaacttgtttgggagactctgcattttttattgtggtttttttgttattgttggtttatacaagcatgcgttgcacttcttttttgggagatgtgtgttgttgatgttctatgttttgttttgagtgtagcctgactgttttataatttgggagttctgcatttgatccgcatcccctgtggtttctaagtgtatggtctcagaactgttgcatggatcctgtgtttgcaactggggagacagaaactgtggttgatagccagtcactgccttaagaacatttgatgcaagatggccagcactgaacttttgagatatgacggtgtacttactgccttgtagcaaaataaagatgtgcccttatttt

SEQ ID NO: 199261 - DNA, 1818 bp, Homo sapiens
  Payload ID: 19308
  Gene Name: v-myb avian myeloblastosis viral oncogene homolog
  Uniprot ID: P10242
  ENST ID: ENST00000533624
  CDS Start-End: 1-1818
atggcccgaagaccccggcacagcatatatagcagtgacgaggatgatgaggactttgagatgtgtgaccatgactatgatgggctgcttcccaagtctggaaagcgtcacttggggaaaacaaggtggacccgggaagaggatgaaaaactgaagaagctggtggaacagaatggaacagatgactggaaagttattgccaattatctcccgaatcgaacagatgtgcagtgccagcaccgatggcagaaagtactaaaccctgagctcatcaagggtccttggaccaaagaagaagatcagagagtgatagagcttgtacagaaatacggtccgaaacgttggtctgttattgccaagcacttaaaggggagaattggaaaacaatgtagggagaggtggcataaccacttgaatccagaagttaagaaaacctcctggacagaagaggaagacagaattatttaccaggcacacaagagactggggaacagatgggcagaaatcgcaaagctactgcctggacgaactgataatgctatcaagaaccactggaattctacaatgcgtcggaaggtcgaacaggaaggttatctgcaggagtcttcaaaagccagccagccagcagtggccacaagcttccagaagaacagtcatttgatgggttttgctcaggctccgcctacagctcaactccctgccactggccagcccactgttaacaacgactattcctattaccacatttctgaagcacaaaatgtctccagtcatgttccataccctgtagcgttacatgtaaatatagtcaatgtccctcagccagctgccgcagccattcagacacagaaccacacatgcagctaccccgggtggcacagcaccaccattgccgaccacaccagacctcatggagacagtgcacctgtttcctgtttgggagaacaccactccactccatctctgccagcggatcctggctccctacctgaagaaagcgcctcgccagcaaggtgcatgatcgtccaccagggcaccattctggataatgttaagaacctcttagaatttgcagaaacactccaatttatagattctttcttaaacacttccagtaaccatgaaaactcagacttggaaatgccttctttaacttccacccccctcattggtcacaaattgactgttacaacaccatttcatagagaccagactgtgaaaactcaaaaggaaaatactgtttttagaaccccagctatcaaaaggtcaatcttagaaagctctccaagaactcctacaccattcaaacatgcacttgcagctcaagaaattaaatacggtcccctgaagatgctacctcagacaccctctcatctagtagaagatctgcaggatgtgatcaaacaggaatctgatgaatctggaattgttgctgagtttcaagaaaatggaccacccttactgaagaaaatcaaacaagaggtggaatctccaactgataaatcaggaaacttcttctgctcacaccactgggaaggggacagtctgaatacccaactgttcacgcagacctcgcctgtggcagatgcaccgaatattcttacaagctccgttttaatggcaccagcatcagaagatgaagacaatgttctcaaagcatttacagtacctaaaaacaggtccctggcgagccccttgcagccttgtagcagtacctgggaacctgcatcctgtggaaagatggaggagcagatgacatcttccagtcaagctcgtaaatacgtgaatgcattctcagcccggacgctggtcatgtga

SEQ ID NO: 199262 - DNA, 1824 bp, Homo sapiens
  Payload ID: 19308
  Gene Name: v-myb avian myeloblastosis viral oncogene homolog
  ENST ID: ENST00000531634
  CDS Start-End: 1-312
atggcccgaagaccccggcacagcatatatagcagtgacgaggatgatgaggactttgagatgtgtgaccatgactatgatgggctgcttcccaagtctggaaagcgtcacttggggaaaacaaggtggacccgggaagaggatgaaaaactgaagaagctggtggaacagaatggaacagatgactggaaagttattgccaattatctcccgaatcgaacagatgtgcagtgccagcaccgatggcagaaagtactaaaccctgagctcatcaagggtccttggaccaaagaagaagatcagagaaactgataatgctatcaagaaccactggaattctacaatgcgtcggaaggtcgaacaggaaggttatctgcaggagtcttcaaaagccagccagccagcagtggccacaagcttccagaagaacagtcatttgatgggttttgctcaggctccgcctacagctcaactccctgccactggccagcccactgttaacaacgactattcctattaccacatttctgaagcacaaaatgtctccagtcatgttccataccctgtagcgttacatgtaaatatagtcaatgtccctcagccagctgccgcagccattcagagacactataatgatgaagaccctgagaaggaaaagcgaataaaggaattagaattgctcctaatgtcaaccgagaatgagctaaaaggacagcaggtgctaccattatgtgggccattactgaattctgacatctttagcgactgggcagccaactgggatggctccttgtgctttgcaacatacatagttaaccaacaaagacaataaaagagaagtgatgcccaacacagaaccacacatgcagctaccccgggtggcacagcaccaccattgccgaccacaccagacctcatggagacagtgcacctgtttcctgtttgggagaacaccactccactccatctctgccagcggatcctggctccctacctgaagaaagcgcctcgccagcaaggtgcatgatcgtccaccagggcaccattctggataatgttaagaacctcttagaatttgcagaaacactccaatttatagattctttcttaaacacttccagtaaccatgaaaactcagacttggaaatgccttctttaacttccacccccctcattggtcacaaattgactgttacaacaccatttcatagagaccagactgtgaaaactcaaaaggaaaatactgtttttagaaccccagctatcaaaaggtcaatcttagaaagctctccaagaactcctacaccattcaaacatgcacttgcagctcaagaaattaaatacggtcccctgaagatgctacctcagacaccctctcatctagtagaagatctgcaggatgtgatcaaacaggaatctgatgaatctggaattgttgctgagtttcaagaaaatggaccacccttactgaagaaaatcaaacaagaggtggaatctccaactgataaatcaggaaacttcttctgctcacaccactgggaaggggacagtctgaatacccaactgttcacgcagacctcgcctgtggcagatgcaccgaatattcttacaagctccgttttaatggcaccagcatcagaagatgaagacaatgttctcaaagcatttacagtacctaaaaacaggtccctggcgagccccttgcagccttgtagcagtacctgggaacctgcatcctgtggaaagatggaggagcagatgacatcttccagtcaagctcgtaaatacgtgaatgcattctcagcccggacgctggtcatgtga

SEQ ID NO: 199263 - DNA, 3431 bp, Homo sapiens
  Payload ID: 19308
  Gene Name: v-myb avian myeloblastosis viral oncogene homolog
  Uniprot ID: P10242
  ENST ID: ENST00000525477
  CDS Start-End: 200-1252
aatatcaacctgtttcctcctcctccttctcctcctcctccgtgacctcctcctcctctttctcctgagaaacttcgccccagcggtgcggagcgccgctgcgcagccggggagggacgcaggcaggcggcgggcagcgggaggcggcagcccggtgcggtccccgcggctctcggcggagccccgcgcccgccgcgccatggcccgaagaccccggcacagcatatatagcagtgacgaggatgatgaggactttgagatgtgtgaccatgactatgatgggctgcttcccaagtctggaaagcgtcacttggggaaaacaaggtggacccgggaagaggatgaaaaactgaagaagctggtggaacagaatggaacagatgactggaaagttattgccaattatctcccgaatcgaacagatgtgcagtgccagcaccgatggcagaaagtactaaaccctgagctcatcaagggtccttggaccaaagaagaagatcagagagtgatagagcttgtacagaaatacggtccgaaacgttggtctgttattgccaagcacttaaaggggagaattggaaaacaatgtagggagaggtggcataaccacttgaatccagaagttaagaaaacctcctggacagaagaggaagacagaattatttaccaggcacacaagagactggggaacagatgggcagaaatcgcaaagctactgcctggacgaactgataatgctatcaagaaccactggaattctacaatgcgtcggaaggtcgaacaggaaggttatctgcaggagtcttcaaaagccagccagccagcagtggccacaagcttccagaagaacagtcatttgatgggttttgctcaggctccgcctacagctcaactccctgccactggccagcccactgttaacaacgactattcctattaccacatttctgaagcacaaaatgtctccagtcatgttccataccctgtagcgttacatgtaaatatagtcaatgtccctcagccagctgccgcagccattcagagacactataatgatgaagaccctgagaaggaaaagcgaataaaggaattagaattgctcctaatgtcaaccgagaatgagctaaaaggacagcaggtgctaccattatgtgggccattactgaattctgacatctttagcgactgggcagccaactgggatggctccttgtgctttgcaacatacatagttaaccaacaaagacaataaaagagaagtgatgcccaacacagaaccacacatgcagctaccccgggtggcacagcaccaccattgccgaccacaccagacctcatggagacagtgcacctgtttcctgtttgggagaacaccactccactccatctctgccagcggatcctggctccctacctgaagaaagcgcctcgccagcaaggtgcatgatcgtccaccagggcaccattctggataatgttaagaacctcttagaatttgcagaaacactccaatttatagattctttcttaaacacttccagtaaccatgaaaactcagacttggaaatgccttctttaacttccacccccctcattggtcacaaattgactgttacaacaccatttcatagagaccagactgtgaaaactcaaaaggaaaatactgtttttagaaccccagctatcaaaaggtcaatcttagaaagctctccaagaactcctacaccattcaaacatgcacttgcagctcaagaaattaaatacggtcccctgaagatgctacctcagacaccctctcatctagtagaagatctgcaggatgtgatcaaacaggaatctgatgaatctggaattgttgctgagtttcaagaaaatggaccacccttactgaagaaaatcaaacaagaggtggaatctccaactgataaatcaggaaacttcttctgctcacaccactgggaaggggacagtctgaatacccaactgttcacgcagacctcgcctgtggcagatgcaccgaatattcttacaagctccgttttaatggcaccagcatcagaagatgaagacaatgttctcaaagcatttacagtacctaaaaacaggtccctggcgagccccttgcagccttgtagcagtacctgggaacctgcatcctgtggaaagatggaggagcagatgacatcttccagtcaagctcgtaaatacgtgaatgcattctcagcccggacgctggtcatgtgagacatttccagaaaagcattatggttttcagaacacttcaagttgacttgggatatatcattcctcaacatgaaacttttcatgaatgggagaagaacctatttttgttgtggtacaacagttgagagcagcaccaagtgcatttagttgaatgaagtcttcttggatttcacccaactaaaaggatttttaaaaataaataacagtcttacctaaattattaggtaatgaattgtagccagttgttaatatcttaatgcagatttttttaaaaaaaacataaaatgatttatctgtattttaaaggatccaacagatcagtattttttcctgtgatgggttttttgaaatttgacacattaaaaggtactccagtatttcacttttctcgatcactaaacatatgcatatatttttaaaaatcagtaaaagcattactctaagtgtagacttaataccatgtgacatttaatccagattgtaaatgctcatttatggttaatgacattgaaggtacatttattgtaccaaaccattttatgagttttctgttagcttgctttaaaaattattactgtaagaaatagttttataaaaaattatatttttattcagtaatttaattttgtaaatgccaaatgaaaaacgttttttgctgctatggtcttagcctgtagacatgctgctagtatcagaggggcagtagagcttggacagaaagaaaagaaacttggtgttaggtaattgactatgcactagtatttcagactttttaattttatatatatatacattttttttccttctgcaatacatttgaaaacttgtttgggagactctgcattttttattgtggtttttttgttattgttggtttatacaagcatgcgttgcacttcttttttgggagatgtgtgttgttgatgttctatgttttgttttgagtgtagcctgactgttttataatttgggagttctgcatttgatccgcatcccctgtggtttctaagtgtatggtctcagaactgttgcatggatcctgtgtttgcaactggggagacagaaactgtggttgatagccagtcactgccttaagaacatttgatgcaagatggccagcactgaacttttgagatatgacggtgtacttactgccttgtagcaaaataaagatgtgcccttatttt

SEQ ID NO: 199264 - DNA, 3203 bp, Homo sapiens
  Payload ID: 19308
  Gene Name: v-myb avian myeloblastosis viral oncogene homolog
  Uniprot ID: P10242
  ENST ID: ENST00000529586
  CDS Start-End: 1-1053
atggcccgaagaccccggcacagcatatatagcagtgacgaggatgatgaggactttgagatgtgtgaccatgactatgatgggctgcttcccaagtctggaaagcgtcacttggggaaaacaaggtggacccgggaagaggatgaaaaactgaagaagctggtggaacagaatggaacagatgactggaaagttattgccaattatctcccgaatcgaacagatgtgcagtgccagcaccgatggcagaaagtactaaaccctgagctcatcaagggtccttggaccaaagaagaagatcagagagtgatagagcttgtacagaaatacggtccgaaacgttggtctgttattgccaagcacttaaaggggagaattggaaaacaatgtagggagaggtggcataaccacttgaatccagaagttaagaaaacctcctggacagaagaggaagacagaattatttaccaggcacacaagagactggggaacagatgggcagaaatcgcaaagctactgcctggacgaactgataatgctatcaagaaccactggaattctacaatgcgtcggaaggtcgaacaggaaggttatctgcaggagtcttcaaaagccagccagccagcagtggccacaagcttccagaagaacagtcatttgatgggttttgctcaggctccgcctacagctcaactccctgccactggccagcccactgttaacaacgactattcctattaccacatttctgaagcacaaaatgtctccagtcatgttccataccctgtagcgttacatgtaaatatagtcaatgtccctcagccagctgccgcagccattcagagacactataatgatgaagaccctgagaaggaaaagcgaataaaggaattagaattgctcctaatgtcaaccgagaatgagctaaaaggacagcaggtgctaccattatgtgggccattactgaattctgacatctttagcgactgggcagccaactgggatggctccttgtgctttgcaacatacatagttaaccaacaaagacaataaaagagaagtgatgcccaacacagaaccacacatgcagctaccccgggtggcacagcaccaccattgccgaccacaccagacctcatggagacagtgcacctgtttcctgtttgggagaacaccactccactccatctctgccagcggatcctggctccctacctgaagaaagcgcctcgccagcaagttcttaaacacttccagtaaccatgaaaactcagacttggaaatgccttctttaacttccacccccctcattggtcacaaattgactgttacaacaccatttcatagagaccagactgtgaaaactcaaaaggaaaatactgtataggacctcttctgacatccccaggaatattatatgattagaagccaagggatgattttagaaccccagctatcaaaaggtcaatcttagaaagctctccaagaactcctacaccattcaaacatgcacttgcagctcaagaaattaaatacggtcccctgaagatgctacctcagacaccctctcatctagtagaagatctgcaggatgtgatcaaacaggaatctgatgaatctggaattgttgctgagtttcaagaaaatggaccacccttactgaagaaaatcaaacaagaggtggaatctccaactgataaatcaggaaacttcttctgctcacaccactgggaaggggacagtctgaatacccaactgttcacgcagacctcgcctgtggcagatgcaccgaatattcttacaagctccgttttaatggcaccagcatcagaagatgaagacaatgttctcaaagcatttacagtacctaaaaacaggtccctggcgagccccttgcagccttgtagcagtacctgggaacctgcatcctgtggaaagatggaggagcagatgacatcttccagtcaagctcgtaaatacgtgaatgcattctcagcccggacgctggtcatgtgagacatttccagaaaagcattatggttttcagaacacttcaagttgacttgggatatatcattcctcaacatgaaacttttcatgaatgggagaagaacctatttttgttgtggtacaacagttgagagcagcaccaagtgcatttagttgaatgaagtcttcttggatttcacccaactaaaaggatttttaaaaataaataacagtcttacctaaattattaggtaatgaattgtagccagttgttaatatcttaatgcagatttttttaaaaaaaacataaaatgatttatctgtattttaaaggatccaacagatcagtattttttcctgtgatgggttttttgaaatttgacacattaaaaggtactccagtatttcacttttctcgatcactaaacatatgcatatatttttaaaaatcagtaaaagcattactctaagtgtagacttaataccatgtgacatttaatccagattgtaaatgctcatttatggttaatgacattgaaggtacatttattgtaccaaaccattttatgagttttctgttagcttgctttaaaaattattactgtaagaaatagttttataaaaaattatatttttattcagtaatttaattttgtaaatgccaaatgaaaaacgttttttgctgctatggtcttagcctgtagacatgctgctagtatcagaggggcagtagagcttggacagaaagaaaagaaacttggtgttaggtaattgactatgcactagtatttcagactttttaattttatatatatatacattttttttccttctgcaatacatttgaaaacttgtttgggagactctgcattttttattgtggtttttttgttattgttggtttatacaagcatgcgttgcacttcttttttgggagatgtgtgttgttgatgttctatgttttgttttgagtgtagcctgactgttttataatttgggagttctgcatttgatccgcatcccctgtggtttctaagtgtatggtctcagaactgttgcatggatcctgtgtttgcaactggggagacagaaactgtggttgatagccagtcactgccttaagaacatttgatgcaagatggccagcactgaacttttgagatatgacggtgtacttactgccttgtagcaaaataaagatgtgcccttatttt

SEQ ID NO: 199265 - DNA, 3573 bp, Homo sapiens
  Payload ID: 19308
  Gene Name: v-myb avian myeloblastosis viral oncogene homolog
  ENST ID: ENST00000616088
  CDS Start-End: 200-2182
aatatcaacctgtttcctcctcctccttctcctcctcctccgtgacctcctcctcctctttctcctgagaaacttcgccccagcggtgcggagcgccgctgcgcagccggggagggacgcaggcaggcggcgggcagcgggaggcggcagcccggtgcggtccccgcggctctcggcggagccccgcgcccgccgcgccatggcccgaagaccccggcacagcatatatagcagtgacgaggatgatgaggactttgagatgtgtgaccatgactatgatgggctgcttcccaagtctggaaagcgtcacttggggaaaacaaggtggacccgggaagaggatgaaaaactgaagaagctggtggaacagaatggaacagatgactggaaagttattgccaattatctcccgaatcgaacagatgtgcagtgccagcaccgatggcagaaagtactaaaccctgagctcatcaagggtccttggaccaaagaagaagatcagagagtgatagagcttgtacagaaatacggtccgaaacgttggtctgttattgccaagcacttaaaggggagaattggaaaacaatgtagggagaggtggcataaccacttgaatccagaagttaagaaaacctcctggacagaagaggaagacagaattatttaccaggcacacaagagactggggaacagatgggcagaaatcgcaaagctactgcctggacgaactgataatgctatcaagaaccactggaattctacaatgcgtcggaaggtcgaacaggaaggttatctgcaggagtcttcaaaagccagccagccagcagtggccacaagcttccagaagaacagtcatttgatgggttttgctcaggctccgcctacagctcaactccctgccactggccagcccactgttaacaacgactattcctattaccacatttctgaagcacaaaatgtctccagtcatgttccataccctgtagcgttacatgtaaatatagtcaatgtccctcagccagctgccgcagccattcagagacactataatgatgaagaccctgagaaggaaaagcgaataaaggaattagaattgctcctaatgtcaaccgagaatgagctaaaaggacagcaggtgctaccaacacagaaccacacatgcagctaccccgggtggcacagcaccaccattgccgaccacaccagacctcatggagacagtgcacctgtttcctgtttgggagaacaccactccactccatctctgccagcggatcctggctccctacctgaagaaagcgcctcgccagcaaggtgcatgatcgtccaccagggcaccattctggataatgttaagaacctcttagaatttgcagaaacactccaatttatagattctttcttaaacacttccagtaaccatgaaaactcagacttggaaatgccttctttaacttccacccccctcattggtcacaaattgactgttacaacaccatttcatagagaccagactgtgaaaactcaaaaggaaaatactgtttttagaaccccagctatcaaaaggtcaatcttagaaagctctccaagaactcctacaccattcaaacatgcacttgcagctcaagaaattaaatacggtcccctgaagatgctacctcagacaccctctcatctagtagaagatctgcaggatgtgatcaaacaggaatctgatgaatctggaattgttgctgagtttcaagaaaatggaccacccttactgaagaaaatcaaacaagaggtggaatctccaactgataaatcaggaaacttcttctgctcacaccactgggaaggggacagtctgaatacccaactgttcacgcagacctcgcctgtggcagatgcaccgactggagtgcaatggcacgatttcggctcactgcaacctctgcctcccgggttcaagcgattctcctgcctcagtctcccgagaagctgggattacaggcacccgccaccacgcccagctaattttgaatttttagtagagacggggtttctccatgttggtcaggctggtcttgaactcctgacctcaggtgatctacccgcctcggcctcccaaagtgctaggattacaggcgtgagccaccgcgcccggccaggtggaatattcttacaagctccgttttaatggcaccagcatcagaagatgaagacaatgttctcaaagcatttacagtacctaaaaacaggtccctggcgagccccttgcagccttgtagcagtacctgggaacctgcatcctgtggaaagatggaggagcagatgacatcttccagtcaagctcgtaaatacgtgaatgcattctcagcccggacgctggtcatgtgagacatttccagaaaagcattatggttttcagaacacttcaagttgacttgggatatatcattcctcaacatgaaacttttcatgaatgggagaagaacctatttttgttgtggtacaacagttgagagcagcaccaagtgcatttagttgaatgaagtcttcttggatttcacccaactaaaaggatttttaaaaataaataacagtcttacctaaattattaggtaatgaattgtagccagttgttaatatcttaatgcagatttttttaaaaaaaacataaaatgatttatctgtattttaaaggatccaacagatcagtattttttcctgtgatgggttttttgaaatttgacacattaaaaggtactccagtatttcacttttctcgatcactaaacatatgcatatatttttaaaaatcagtaaaagcattactctaagtgtagacttaataccatgtgacatttaatccagattgtaaatgctcatttatggttaatgacattgaaggtacatttattgtaccaaaccattttatgagttttctgttagcttgctttaaaaattattactgtaagaaatagttttataaaaaattatatttttattcagtaatttaattttgtaaatgccaaatgaaaaacgttttttgctgctatggtcttagcctgtagacatgctgctagtatcagaggggcagtagagcttggacagaaagaaaagaaacttggtgttaggtaattgactatgcactagtatttcagactttttaattttatatatatatacattttttttccttctgcaatacatttgaaaacttgtttgggagactctgcattttttattgtggtttttttgttattgttggtttatacaagcatgcgttgcacttcttttttgggagatgtgtgttgttgatgttctatgttttgttttgagtgtagcctgactgttttataatttgggagttctgcatttgatccgcatcccctgtggtttctaagtgtatggtctcagaactgttgcatggatcctgtgtttgcaactggggagacagaaactgtggttgatagccagtcactgccttaagaacatttgatgcaagatggccagcactgaacttttgagatatgacggtgtacttactgccttgtagcaaaataaagatgtgcccttattttacct

SEQ ID NO: 199266 - DNA, 3545 bp, Homo sapiens
  Payload ID: 19308
  Gene Name: v-myb avian myeloblastosis viral oncogene homolog
  ENST ID: ENST00000618728
  CDS Start-End: 200-2038
aatatcaacctgtttcctcctcctccttctcctcctcctccgtgacctcctcctcctctttctcctgagaaacttcgccccagcggtgcggagcgccgctgcgcagccggggagggacgcaggcaggcggcgggcagcgggaggcggcagcccggtgcggtccccgcggctctcggcggagccccgcgcccgccgcgccatggcccgaagaccccggcacagcatatatagcagtgacgaggatgatgaggactttgagatgtgtgaccatgactatgatgggctgcttcccaagtctggaaagcgtcacttggggaaaacaaggtggacccgggaagaggatgaaaaactgaagaagctggtggaacagaatggaacagatgactggaaagttattgccaattatctcccgaatcgaacagatgtgcagtgccagcaccgatggcagaaagtactaaaccctgagctcatcaagggtccttggaccaaagaagaagatcagagagtgatagagcttgtacagaaatacggtccgaaacgttggtctgttattgccaagcacttaaaggggagaattggaaaacaatgtagggagaggtggcataaccacttgaatccagaagttaagaaaacctcctggacagaagaggaagacagaattatttaccaggcacacaagagactggggaacagatgggcagaaatcgcaaagctactgcctggacgaactgataatgctatcaagaaccactggaattctacaatgcgtcggaaggtcgaacaggaaggttatctgcaggagtcttcaaaagccagccagccagcagtggccacaagcttccagaagaacagtcatttgatgggttttgctcaggctccgcctacagctcaactccctgccactggccagcccactgttaacaacgactattcctattaccacatttctgaagcacaaaatgtctccagtcatgttccataccctgtagcgttacatgtaaatatagtcaatgtccctcagccagctgccgcagccattcagagacactataatgatgaagaccctgagaaggaaaagcgaataaaggaattagaattgctcctaatgtcaaccgagaatgagctaaaaggacagcaggtgctaccaacacagaaccacacatgcagctaccccgggtggcacagcaccaccattgccgaccacaccagacctcatggagacagtgcacctgtttcctgtttgggagaacaccactccactccatctctgccagcggatcctggctccctacctgaagaaagcgcctcgccagcaaggtgcatgatcgtccaccagggcaccattctggataatgttaagaacctcttagaatttgcagaaacactccaatttatagattctttcttaaacacttccagtaaccatgaaaactcagacttggaaatgccttctttaacttccacccccctcattggtcacaaattgactgttacaacaccatttcatagagaccagactgtgaaaactcaaaaggaaaatactgtttttagaaccccagctatcaaaaggtcaatcttagaaagctctccaagaactcctacaccattcaaacatgcacttgcagctcaagaaattaaatacggtcccctgaagatgctacctcagacaccctctcatctagtagaagatctgcaggatgtgatcaaacaggaatctgatgaatctggaattgttgctgagtttcaagaaaatggaccacccttactgaagaaaatcaaacaagaggtggaatctccaactgataaatcaggaaacttcttctgctcacaccactgggaaggggacagtctgaatacccaactgttcacgcagacctcgcctgtggcagatgcaccgaatattcttacaagctccgttttaatggcaccagcatcagaagatgaagacaatgttctcaaagcatttacagtacctaaaaacaggtccctggcgagccccttgcaggcaaccaaagctcagagactgttccaattttaaatgaagtctgaaattagtcagacagaaaataattgcaatgtatttgactgtcagaataagaaagtcaactgtcaatgttgtgaggccgatctgaagttgaccatctgctgtcaggttttaatatcaaaagagatttcccttgtaaccctaaagtgggtgtgtgttgatgaaatataaccaattccaaattaatcctgagccagccttgtagcagtacctgggaacctgcatcctgtggaaagatggaggagcagatgacatcttccagtcaagctcgtaaatacgtgaatgcattctcagcccggacgctggtcatgtgagacatttccagaaaagcattatggttttcagaacacttcaagttgacttgggatatatcattcctcaacatgaaacttttcatgaatgggagaagaacctatttttgttgtggtacaacagttgagagcagcaccaagtgcatttagttgaatgaagtcttcttggatttcacccaactaaaaggatttttaaaaataaataacagtcttacctaaattattaggtaatgaattgtagccagttgttaatatcttaatgcagatttttttaaaaaaaacataaaatgatttatctgtattttaaaggatccaacagatcagtattttttcctgtgatgggttttttgaaatttgacacattaaaaggtactccagtatttcacttttctcgatcactaaacatatgcatatatttttaaaaatcagtaaaagcattactctaagtgtagacttaataccatgtgacatttaatccagattgtaaatgctcatttatggttaatgacattgaaggtacatttattgtaccaaaccattttatgagttttctgttagcttgctttaaaaattattactgtaagaaatagttttataaaaaattatatttttattcagtaatttaattttgtaaatgccaaatgaaaaacgttttttgctgctatggtcttagcctgtagacatgctgctagtatcagaggggcagtagagcttggacagaaagaaaagaaacttggtgttaggtaattgactatgcactagtatttcagactttttaattttatatatatatacattttttttccttctgcaatacatttgaaaacttgtttgggagactctgcattttttattgtggtttttttgttattgttggtttatacaagcatgcgttgcacttcttttttgggagatgtgtgttgttgatgttctatgttttgttttgagtgtagcctgactgttttataatttgggagttctgcatttgatccgcatcccctgtggtttctaagtgtatggtctcagaactgttgcatggatcctgtgtttgcaactggggagacagaaactgtggttgatagccagtcactgccttaagaacatttgatgcaagatggccagcactgaacttttgagatatgacggtgtacttactgccttgtagcaaaataaagatgtgcccttatttt

SEQ ID NO: 199267 - DNA, 2148 bp, Homo sapiens
  Payload ID: 19309
  Gene Name: v-myb avian myeloblastosis viral oncogene homolog-like 1
  Uniprot ID: P10243
  ENST ID: ENST00000524176
  CDS Start-End: 70-2148
cattcgccggaggctggaggaggctgacccgcgtccccgcccagcctgctcctatgcggtacttgaaggatggcgaagaggtcgcgcagtgaggatgaggatgatgaccttcagtatgccgatcatgattatgaagtaccacaacaaaaaggactgaagaaactctggaacagagtaaaatggacaagggacgaggatgataaattaaagaagttggttgaacaacatggaactgatgattggactctaattgctagtcatcttcaaaatcgctctgattttcagtgccagcatcgatggcagaaagttttaaatcctgaattgataaagggtccttggactaaagaagaagatcagagggttattgaattagttcagaaatatgggccaaaaagatggtctttaattgcaaaacatttaaaaggaagaataggcaagcagtgtagagaaagatggcataatcatctgaatcctgaggtaaagaaatcttcctggacagaagaggaggacaggatcatctatgaagcacataagcggttgggaaatcgttgggcagaaattgccaaactacttccaggaaggactgataattctatcaaaaatcattggaattctactatgcgaagaaaagtggaacaggagggctatttacaagatggaataaaatcagaacgatcttcatctaaacttcaacacaaaccttgtgcagctatggatcatatgcaaacccagaatcagttttacatacctgttcagatccctgggtatcagtatgtgtcacctgaaggcaattgtatagaacatgttcagcctacttctgcctttattcagcaacccttcattgatgaagatcctgataaggaaaagaaaataaaggaacttgagatgcttcttatgtcagctgagaatgaagttagaagaaagcgaattccatcacagcctggaagtttttctagctggtctggtagtttcctcatggatgataacatgtctaatactctaaatagccttgacgagcacactagtgagttttacagtatggatgaaaatcagcctgtgtctgctcagcagaattcacccacaaagttcctggccgtggaggcaaacgctgtgttatcctctttgcagaccatcccagaatttgcagagactctagaacttattgaatctgatcctgtagcatggagtgacgttaccagttttgatatttctgatgctgctgcttctcctatcaaatccaccccagttaaattaatgagaattcagcacaatgaaggagccatggaatgccaatttaacgtcagtcttgtacttgaagggaaaaaaaacacttgtaatggtggcaacagtgaagctgttcctttaacatccccaaatatagccaagtttagcactccaccagccatcctcagaaagaagagaaaaatgcgagtgggtcattccccaggcagcgaacttagggatggctcattgaacgatggtggtaatatggcgctaaaacatacaccactgaaaacactaccattttctccttcacagtttttcaacacatgtcctggtaatgaacaacttaatatagaaaatccttcatttacatcaacccctatttgtgggcagaaagctctcattacaactcctcttcataaggaaacaactcccaaagatcaaaaggaaaatgtagggtttagaacacctactattagaagatctatactgggtaccacaccaagaactcctactccttttaagaatgcgcttgctgctcaggagaaaaaatatggacctcttaaaattgtgtcccagccacttgctttcttggaagaagatattcgggaagttttaaaagaagaaactggaacagacctattcctcaaagaggaagatgaacctgcttacaaaagctgcaaacaagagaataccgcttctgggaagaaagtcagaaaatcactagtcttagataattgggaaaaagaagaatcaggcactcaactgttgactgaagacatttcagacatgcagtcaaattgtgaatgggaaacagtggtttatgggaagacagaagaccaacttattatgactgaacaagcaagaagatatctgagtacttacacagctaccagtagtacttcaagagctctcatactgtaa

SEQ ID NO: 199268 - DNA, 1714 bp, Homo sapiens
  Payload ID: 19309
  Gene Name: v-myb avian myeloblastosis viral oncogene homolog-like 1
  ENST ID: ENST00000517885
  CDS Start-End: 457-1689
aaacggcggctcttgagggaggctgggcgcgagattcggcggtgcggacaaaaccctgcaggagactgcgagccctgcagaactgctagctgcgggggagagggcaggggtcgggcgcctgtggcggagccgggctggggccagggcagggaggctgacaagcggcgggagaagccggcggagggcgggatcgcgcctcctgacatgttgggggtatccctggccgggccgggccggggctaagagcggcgctgcgggccggggtcggggtcgggtcgcggtccgcccccgctgtccctccgtcctgccctgtcgaggacgtgcgttccgcactcggccgcctccagagggagcgagggaagcggctagaggatcggggagaaggagcattcgccggaggctggaggaggctgacccgcgtccccgcccagcctgctcctatgcggtacttgaaggatggcgaagaggtcgcgcagtgaggatgaggatgatgaccttcagtatgccgatcatgattatgaagtaccacaacaaaaaggactgaagaaactctggaacagagtaaaatggacaagggacgaggatgataaattaaagaagttggttgaacaacatggaactgatgattggactctaattgctagtcatcttcaaaatcgctctgattttcagtgccagcatcgatggcagaaagttttaaatcctgaattgataaagggtccttggactaaagaagaagatcagagggttattgaattagttcagaaatatggaaagaagagaaaaatgcgagtgggtcattccccaggcagcgaacttagggatggctcattgaacgatggtggtaatatggcgctaaaacatacaccactgaaaacactaccattttctccttcacagtttttcaacacatgtcctggtaatgaacaacttaatatagaaaatccttcatttacatcaacccctatttgtgggcagaaagctctcattacaactcctcttcataaggaaacaactcccaaagatcaaaaggaaaatgtagggtttagaacacctactattagaagatctatactgggtaccacaccaagaactcctactccttttaagaatgcgcttgctgctcaggagaaaaaatatggacctcttaaaattgtgtcccagccacttgctttcttggaagaagatattcgggaagttttaaaagaagaaactggaacagacctattcctcaaagaggaagatgaacctgcttacaaaagctgcaaacaagagaataccgcttctgggaagaaagtcagaaaatcactagtcttagataattgggaaaaagaagaatcaggcactcaactgttgactgaagacatttcagacatgcagtcagaaaatagatttactacatccttattaatgataccattattggaaatacatgacaataggtgcaacttgattcctgaaaaacaagatataaattcaaccaacaaaacatatacacttactaaaaagaaaccaaaccctaacacttccaaagttgtcaaattggaaaagaatcttcagtcaaattgtgaatgggaaacagtggtttatgggaagacagaagaccaacttattatgactgaacaagcaagaagatatctgagtacttacacagctaccagtagtacttcaagagctctcatactgtaattgttattaaaattgatgaaatgcc

SEQ ID NO: 199269 - DNA, 5192 bp, Homo sapiens
  Payload ID: 19309
  Gene Name: v-myb avian myeloblastosis viral oncogene homolog-like 1
  Uniprot ID: P10243
  ENST ID: ENST00000522677
  CDS Start-End: 412-2670
ggacaaaaccctgcaggagactgcgagccctgcagaactgctagctgcgggggagagggcaggggtcgggcgcctgtggcggagccgggctggggccagggcagggaggctgacaagcggcgggagaagccggcggagggcgggatcgcgcctcctgacatgttgggggtatccctggccgggccgggccggggctaagagcggcgctgcgggccggggtcggggtcgggtcgcggtccgcccccgctgtccctccgtcctgccctgtcgaggacgtgcgttccgcactcggccgcctccagagggagcgagggaagcggctagaggatcggggagaaggagcattcgccggaggctggaggaggctgacccgcgtccccgcccagcctgctcctatgcggtacttgaaggatggcgaagaggtcgcgcagtgaggatgaggatgatgaccttcagtatgccgatcatgattatgaagtaccacaacaaaaaggactgaagaaactctggaacagagtaaaatggacaagggacgaggatgataaattaaagaagttggttgaacaacatggaactgatgattggactctaattgctagtcatcttcaaaatcgctctgattttcagtgccagcatcgatggcagaaagttttaaatcctgaattgataaagggtccttggactaaagaagaagatcagagggttattgaattagttcagaaatatgggccaaaaagatggtctttaattgcaaaacatttaaaaggaagaataggcaagcagtgtagagaaagatggcataatcatctgaatcctgaggtaaagaaatcttcctggacagaagaggaggacaggatcatctatgaagcacataagcggttgggaaatcgttgggcagaaattgccaaactacttccaggaaggactgataattctatcaaaaatcattggaattctactatgcgaagaaaagtggaacaggagggctatttacaagatggaataaaatcagaacgatcttcatctaaacttcaacacaaaccttgtgcagctatggatcatatgcaaacccagaatcagttttacatacctgttcagatccctgggtatcagtatgtgtcacctgaaggcaattgtatagaacatgttcagcctacttctgcctttattcagcaacccttcattgatgaagatcctgataaggaaaagaaaataaaggaacttgagatgcttcttatgtcagctgagaatgaagttagaagaaagcgaattccatcacagcctggaagtttttctagctggtctggtagtttcctcatggatgataacatgtctaatactctaaatagccttgacgagcacactagtgagttttacagtatggatgaaaatcagcctgtgtctgctcagcagaattcacccacaaagttcctggccgtggaggcaaacgctgtgttatcctctttgcagaccatcccagaatttgcagagactctagaacttattgaatctgatcctgtagcatggagtgacgttaccagttttgatatttctgatgctgctgcttctcctatcaaatccaccccagttaaattaatgagaattcagcacaatgaaggagccatggaatgccaatttaacgtcagtcttgtacttgaagggaaaaaaaacacttgtaatggtggcaacagtgaagctgttcctttaacatccccaaatatagccaagtttagcactccaccagccatcctcagaaagaagagaaaaatgcgagtgggtcattccccaggcagcgaacttagggatggctcattgaacgatggtggtaatatggcgctaaaacatacaccactgaaaacactaccattttctccttcacagtttttcaacacatgtcctggtaatgaacaacttaatatagaaaatccttcatttacatcaacccctatttgtgggcagaaagctctcattacaactcctcttcataaggaaacaactcccaaagatcaaaaggaaaatgtagggtttagaacacctactattagaagatctatactgggtaccacaccaagaactcctactccttttaagaatgcgcttgctgctcaggagaaaaaatatggacctcttaaaattgtgtcccagccacttgctttcttggaagaagatattcgggaagttttaaaagaagaaactggaacagacctattcctcaaagaggaagatgaacctgcttacaaaagctgcaaacaagagaataccgcttctgggaagaaagtcagaaaatcactagtcttagataattgggaaaaagaagaatcaggcactcaactgttgactgaagacatttcagacatgcagtcagaaaatagatttactacatccttattaatgataccattattggaaatacatgacaataggtgcaacttgattcctgaaaaacaagatataaattcaaccaacaaaacatatacacttactaaaaagaaaccaaaccctaacacttccaaagttgtcaaattggaaaagaatcttcagtcaaattgtgaatgggaaacagtggtttatgggaagacagaagaccaacttattatgactgaacaagcaagaagatatctgagtacttacacagctaccagtagtacttcaagagctctcatactgtaattgttattaaaattgatgaaatgccccactcccttactgcagtctctactaaattaggttgcagtgaaatttttctcaattagttgtttttaaagttgtaagatagcccttttaatacagcatcttttttctattctatatagtaggcagaaagctagtaagtcacttaaggggtagatagtttcatagtttattttttaagagatgagatttttaaaaattgtttttaaagaacaagatgggaaaataatagaatgttcatggatttctaaaagtaaattctcatatattttcttcacaagatatatgttgctactctcttgatgctgcagttttgttatagataggtgtatgagtatatatgatttctgaaattagtctatgtatggaaagcacacatgattttatgaagtacttttgcccatgtgctgatttacttaggctaccatttacaaagaaacacattgaaaaggaatttaaaggaaggatagaaagttgcactactaattttttgttttttttttcagaagcagtaaaattaactacagtgttaaatgtatttatttgagcatagtactgaaaacaaaaagcattcaaaaaagagttttttctttattagtaaatagtattttcttaatctcagaggagctgagagttttgttgaatgtattgtacagtatgtaggagcaggagaactttgtaaattggaaagaagtctgtttttataatttatttttatttttaaagcttaaatgtagatatttatacgtatacagggtgcctagaagccaatgttgtttcctgttattacagctaacacagtaaagaataattttgactttaagtatgaaacagtagtaagttatagctgcaaagaatacaatatctatactgtatgtcacatctacctaaatgttgcactatgccctttaaatcatgctggttataaagtagttctaaaaatgtactaaataataatttaatattttctttttaaattatatcgggggtggtcatatacattaatctggtgatttgtatatgtgtttgaaatttttgcattttgtttaaaaaataatatggtaccttggtccctaaaaacagtctgcacttagaagtttatatttactcagtgtttcagaagtggagaacattatcttttatttataaaaatattttgtccttttttaaatgttttgtgtttctctacaggttacaacagttgcttcagttgcctgttttaggtgtttgcacttattttatttcttcttgaaagaatttttatttgcttttgtggtagagattatatgtaattttttttcagtcatataatggtgtgctgtcaacttaaacactgacaggtaaatagaattgtacactgtagtttgaattatttataattgacacactctctccctctccactcctgaagtatgctgctatagaaaatagcagaatcggcttgctgctacgagagaaggaaagagcgaccaccacttgcactgtgtgaaaagataaaaaacaaatgatggcaagttctcaagttaactaaatggaatcaaccattaccaggcaaattcttgcaaataccaaaatactactatgccttataaaacaaaatgaaagcaggttaagattttctgctctgtttgtatgttaatagaaatggaaatactaagtattttaatgcttagctcttgaacagtagacctaaaagggttttaagctatttaaatctacttgctagtttttgcatattttatatatatatatatttatatatatatatagtgagaagtgaagaaaatgtatggtactaagattatgccttattgataaatagataaaccaatttgaatcctcttagcatgtttaagtatgttgattgctttctaattaatgaacttctcacagaaatttcacttagtgaaaccaatgattgtagcaaactcatactggatcatttcagttaccttgaactaatagcacataatggttttttgttgttgttgtttttaatgtagcccttacctggatatacatagtctgcaatcaccaaagtataatatcttgtaaggctatattttttaaagcatattttttcttgagcattaaattatcctaaatggtaatatattgtggataagtctgggcttattggacataatacatatttgggttggtactggttgaatccttcagttaactgctttgttgctttttgcaagattttttatcttaaacatgtcaggcatcttaagtcacctttatactgttttgttcctctgagtttctttcagtatgttatacaaatgccagacataacatgtagcagccatacttgcatggaaactgactacacatacataatactgcattttattgtaaggttttcacattaatacagcaattaccctgactaaattgagttttgtgatatatggaaaacttcattgtaagagaatcttgcatacaatgttgacatattaacatccaaaataaagcatctgtgtacaagctga

SEQ ID NO: 199270 - DNA, 2639 bp, Homo sapiens
  Payload ID: 19310
  Gene Name: v-myb avian myeloblastosis viral oncogene homolog-like 2
  Uniprot ID: P10244
  ENST ID: ENST00000217026
  CDS Start-End: 128-2230
gctgacgccttcgagcgcggcccggggcccggagcggccggagcagcccgggtcctgaccccggcccggctcccgctccgggctctgccggcgggcgggcgagcgcggcgcggtccgggccggggggatgtctcggcggacgcgctgcgaggatctggatgagctgcactaccaggacacagattcagatgtgccggagcagagggatagcaagtgcaaggtcaaatggacccatgaggaggacgagcagctgagggccctggtgaggcagtttggacagcaggactggaagttcctggccagccacttccctaaccgcactgaccagcaatgccagtacaggtggctgagagttttgaatccagaccttgtcaaggggccatggaccaaagaggaagaccaaaaagtcatcgagctggttaagaagtatggcacaaagcagtggacactgattgccaagcacctgaagggccggctggggaagcagtgccgtgaacgctggcacaaccacctcaaccctgaggtgaagaagtcttgctggaccgaggaggaggaccgcatcatctgcgaggcccacaaggtgctgggcaaccgctgggccgagatcgccaagatgttgccagggaggacagacaatgctgtgaagaatcactggaactctaccatcaaaaggaaggtggacacaggaggcttcttgagcgagtccaaagactgcaagcccccagtgtacttgctgctggagctcgaggacaaggacggcctccagagtgcccagcccacggaaggccagggaagtcttctgaccaactggccctccgtccctcctaccataaaggaggaggaaaacagtgaggaggaacttgcagcagccaccacatcgaaggaacaggagcccatcggtacagatctggacgcagtgcgaacaccagagcccttggaggaattcccgaagcgtgaggaccaggaaggctccccaccagaaacgagcctgccttacaagtgggtggtggaggcagctaacctcctcatccctgctgtgggttctagcctctctgaagccctggacttgatcgagtcggaccctgatgcttggtgtgacctgagtaaatttgacctccctgaggaaccatctgcagaggacagtatcaacaacagcctagtgcagctgcaagcgtcacatcagcagcaagtcctgccaccccgccagccttccgccctggtgcccagtgtgaccgagtaccgcctggatggccacaccatctcagacctgagccggagcagccggggcgagctgatccccatctcccccagcactgaagtcgggggctctggcattggcacaccgccctctgtgctcaagcggcagaggaagaggcgtgtggctctgtcccctgtcactgagaatagcaccagtctgtccttcctggattcctgtaacagcctcacgcccaagagcacacctgttaagaccctgcccttctcgccctcccagtttctgaacttctggaacaaacaggacacattggagctggagagcccctcgctgacatccaccccagtgtgcagccagaaggtggtggtcaccacaccactgcaccgggacaagacacccctgcaccagaaacatgctgcgtttgtaaccccagatcagaagtactccatggacaacactccccacacgccaaccccgttcaagaacgccctggagaagtacggacccctgaagcccctgccacagaccccgcacctggaggaggacttgaaggaggtgctgcgttctgaggctggcatcgaactcatcatcgaggacgacatcaggcccgagaagcagaagaggaagcctgggctgcggcggagccccatcaagaaagtccggaagtctctggctcttgacattgtggatgaggatgtgaagctgatgatgtccacactgcccaagtctctatccttgccgacaactgccccttcaaactcttccagcctcaccctgtcaggtatcaaagaagacaacagcttgctcaaccagggcttcttgcaggccaagcccgagaaggcagcagtggcccagaagccccgaagccacttcacgacacctgcccctatgtccagtgcctggaagacggtggcctgcggggggaccagggaccagcttttcatgcaggagaaagcccggcagctcctgggccgcctgaagcccagccacacatctcggaccctcatcttgtcctgaggtgttgagggtgtcacgagcccattctcatgtttacaggggttgtgggggcagagggggtctgtgaatctgagagtcattcaggtgacctcctgcagggagccttctgccaccagcccctccccagactctcaggtggaggcaacagggccatgtgctgccctgttgccgagcccagctgtgggcggctcctggtgctaacaacaaagttccacttccaggtctgcctggttccctccccaaggccacagggagctccgtcagcttctcccaagcccacgtcaggcctggcctcatctcagaccctgcttaggatgggggatgtggccaggggtgctcctgtgctcaccctctcttggtgcatttttttggaagaataaaattgcctctctctttgtgctggtctgga

SEQ ID NO: 199271 - DNA, 2704 bp, Homo sapiens
  Payload ID: 19310
  Gene Name: v-myb avian myeloblastosis viral oncogene homolog-like 2
  Uniprot ID: P10244
  ENST ID: ENST00000396863
  CDS Start-End: 266-2296
actcaggcccctcccccggcgcccgcgcgccaggactgggcggcgccgacgcgcttggcgggagatagaaaagtgcttcaacccgcgccggcggcgactgcagttcctgcgagcgaggagcgcgggacctgctgacacgctgacgccttcgagcgcggcccggggcccggagcggccggagcagcccgggtcctgaccccggcccggctcccgctccgggctctgccggcgggcgggcgagcgcggcgcggtccgggccggggggatgtctcggcggacgcgctgcgaggatctggatgagctgcactaccaggacacagattcagatgtgccggagcagagggatagcaagtgcaaggtcaaatggacccatgaggagaaccgcactgaccagcaatgccagtacaggtggctgagagttttgaatccagaccttgtcaaggggccatggaccaaagaggaagaccaaaaagtcatcgagctggttaagaagtatggcacaaagcagtggacactgattgccaagcacctgaagggccggctggggaagcagtgccgtgaacgctggcacaaccacctcaaccctgaggtgaagaagtcttgctggaccgaggaggaggaccgcatcatctgcgaggcccacaaggtgctgggcaaccgctgggccgagatcgccaagatgttgccagggaggacagacaatgctgtgaagaatcactggaactctaccatcaaaaggaaggtggacacaggaggcttcttgagcgagtccaaagactgcaagcccccagtgtacttgctgctggagctcgaggacaaggacggcctccagagtgcccagcccacggaaggccagggaagtcttctgaccaactggccctccgtccctcctaccataaaggaggaggaaaacagtgaggaggaacttgcagcagccaccacatcgaaggaacaggagcccatcggtacagatctggacgcagtgcgaacaccagagcccttggaggaattcccgaagcgtgaggaccaggaaggctccccaccagaaacgagcctgccttacaagtgggtggtggaggcagctaacctcctcatccctgctgtgggttctagcctctctgaagccctggacttgatcgagtcggaccctgatgcttggtgtgacctgagtaaatttgacctccctgaggaaccatctgcagaggacagtatcaacaacagcctagtgcagctgcaagcgtcacatcagcagcaagtcctgccaccccgccagccttccgccctggtgcccagtgtgaccgagtaccgcctggatggccacaccatctcagacctgagccggagcagccggggcgagctgatccccatctcccccagcactgaagtcgggggctctggcattggcacaccgccctctgtgctcaagcggcagaggaagaggcgtgtggctctgtcccctgtcactgagaatagcaccagtctgtccttcctggattcctgtaacagcctcacgcccaagagcacacctgttaagaccctgcccttctcgccctcccagtttctgaacttctggaacaaacaggacacattggagctggagagcccctcgctgacatccaccccagtgtgcagccagaaggtggtggtcaccacaccactgcaccgggacaagacacccctgcaccagaaacatgctgcgtttgtaaccccagatcagaagtactccatggacaacactccccacacgccaaccccgttcaagaacgccctggagaagtacggacccctgaagcccctgccacagaccccgcacctggaggaggacttgaaggaggtgctgcgttctgaggctggcatcgaactcatcatcgaggacgacatcaggcccgagaagcagaagaggaagcctgggctgcggcggagccccatcaagaaagtccggaagtctctggctcttgacattgtggatgaggatgtgaagctgatgatgtccacactgcccaagtctctatccttgccgacaactgccccttcaaactcttccagcctcaccctgtcaggtatcaaagaagacaacagcttgctcaaccagggcttcttgcaggccaagcccgagaaggcagcagtggcccagaagccccgaagccacttcacgacacctgcccctatgtccagtgcctggaagacggtggcctgcggggggaccagggaccagcttttcatgcaggagaaagcccggcagctcctgggccgcctgaagcccagccacacatctcggaccctcatcttgtcctgaggtgttgagggtgtcacgagcccattctcatgtttacaggggttgtgggggcagagggggtctgtgaatctgagagtcattcaggtgacctcctgcagggagccttctgccaccagcccctccccagactctcaggtggaggcaacagggccatgtgctgccctgttgccgagcccagctgtgggcggctcctggtgctaacaacaaagttccacttccaggtctgcctggttccctccccaaggccacagggagctccgtcagcttctcccaagcccacgtcaggcctggcctcatctcagaccctgcttaggatgggggatgtggccaggggtgctcctgtgctcaccctctcttggtgcatttttttggaagaataaaattgcctctctctttgtgctggtctgg

SEQ ID NO: 199272 - DNA, 2042 bp, Homo sapiens
  Payload ID: 19311
  Gene Name: v-myc avian myelocytomatosis viral oncogene homolog
  ENST ID: ENST00000259523
  CDS Start-End: 1206-1979
ggagtttattcataacgcgctctccaagtatacgtggcaatgcgttgctgggttattttaatcattctaggcatcgttttcctccttatgcctctatcattcctccctatctacactaacatcccacgctctgaacgcgcgcccattaatacccttctttcctccactctccctgggactcttgatcaaagcgcggccctttccccagccttagcgaggcgccctgcagcctggtacgcgcgtggcgtggcggtgggcgcgcagtgcgttctcggtgtggagggcagctgttccgcctgcgatgatttatactcacaggacaaggatgcggtttgtcaaacagtactgctacggaggagcagcagagaaagggagagggtttgagagggagcaaaagaaaatggtaggcgcgcgtagttaattcatgcggctctcttactctgtttacatcctagagctagagtgctcggctgcccggctgagtctcctccccaccttccccaccctccccaccctccccataagcgcccctcccgggttcccaaagcagagggcgtgggggaaaagaaaaaagatcctctctcgctaatctccgcccaccggccctttataatgcgagggtctggacggctgaggacccccgagctgtgctgctcgcggccgccaccgccgggccccggccgtccctggctcccctcctgcctcgagaagggcagggcttctcagaggcttggcgggaaaaagaacggagggagggatcgcgctgagtataaaagccggttttcggggctttatctaactcgctgtagtaattccagcgagaggcagagggagcgagcgggcggccggctagggtggaagagccgggcgagcagagctgcgctgcgggcgtcctgggaagggagatccggagcgaatagggggcttcgcctctggcccagccctcccgctgatcccccagccagcggtccgcaacccttgccgcatccacgaaactttgcccatagcagcgggcgggcactttgcactggaacttacaacacccgagcaaggacgcgactctcccgacgcggggaggctattctgcccatttggggacacttccccgccgctgccaggacccgcttctctgaaaggctctccttgcagctgcttagacgctggatttttttcgggtagtggaaaaccagcagcctcccgcgacgatgcccctcaacgttagcttcaccaacaggaactatgacctcgactacgactcggtgcagccgtatttctactgcgacgaggaggagaacttctaccagcagcagcagcagagcgagctgcagcccccggcgcccagcgaggatatctggaagaaattcgagctgctgcccaccccgcccctgtcccctagccgccgctccgggctctgctcgccctcctacgttgcggtcacacccttctcccttcggggagacaacgacggcggtggcgggagcttctccacggccgaccagctggagatggtgaccgagctgctgggaggagacatggtgaaccagagtttcatctgcgacccggacgacgagaccttcatcaaaaacatcatcatccaggactgtatgtggagcggcttctcggccgccgccaagctcgtctcagagaagctggcctcctaccaggctgcgcgcaaagacagcggcagcccgaaccccgcccgcggccacagcgtctgctccacctccagcttgtacctgcaggatctgagcgccgccgcctcagagtgcatcgacccctcggtggtcttcccctaccctctcaacgacagcagctcgcccaagtcctgcgcctcgcaagactccagcgccttctctccgtcctcggattctctgctctcctcgacggagtcctccccgcagggcagccccgagcccctggtgctccatgaggagacaccgcccaccaccagcagcgactctggaggaacaagaagatgaggaagaaatcgatgttgtttctgtggaaaagaggcaggctcctggcaaaaggtcagagtctgg

SEQ ID NO: 199273 - DNA, 2351 bp, Homo sapiens
  Payload ID: 19311
  Gene Name: v-myc avian myelocytomatosis viral oncogene homolog
  Uniprot ID: P01106
  ENST ID: ENST00000377970
  CDS Start-End: 556-1875
ctgctcgcggccgccaccgccgggccccggccgtccctggctcccctcctgcctcgagaagggcagggcttctcagaggcttggcgggaaaaagaacggagggagggatcgcgctgagtataaaagccggttttcggggctttatctaactcgctgtagtaattccagcgagaggcagagggagcgagcgggcggccggctagggtggaagagccgggcgagcagagctgcgctgcgggcgtcctgggaagggagatccggagcgaatagggggcttcgcctctggcccagccctcccgctgatcccccagccagcggtccgcaacccttgccgcatccacgaaactttgcccatagcagcgggcgggcactttgcactggaacttacaacacccgagcaaggacgcgactctcccgacgcggggaggctattctgcccatttggggacacttccccgccgctgccaggacccgcttctctgaaaggctctccttgcagctgcttagacgctggatttttttcgggtagtggaaaaccagcagcctcccgcgacgatgcccctcaacgttagcttcaccaacaggaactatgacctcgactacgactcggtgcagccgtatttctactgcgacgaggaggagaacttctaccagcagcagcagcagagcgagctgcagcccccggcgcccagcgaggatatctggaagaaattcgagctgctgcccaccccgcccctgtcccctagccgccgctccgggctctgctcgccctcctacgttgcggtcacacccttctcccttcggggagacaacgacggcggtggcgggagcttctccacggccgaccagctggagatggtgaccgagctgctgggaggagacatggtgaaccagagtttcatctgcgacccggacgacgagaccttcatcaaaaacatcatcatccaggactgtatgtggagcggcttctcggccgccgccaagctcgtctcagagaagctggcctcctaccaggctgcgcgcaaagacagcggcagcccgaaccccgcccgcggccacagcgtctgctccacctccagcttgtacctgcaggatctgagcgccgccgcctcagagtgcatcgacccctcggtggtcttcccctaccctctcaacgacagcagctcgcccaagtcctgcgcctcgcaagactccagcgccttctctccgtcctcggattctctgctctcctcgacggagtcctccccgcagggcagccccgagcccctggtgctccatgaggagacaccgcccaccaccagcagcgactctgaggaggaacaagaagatgaggaagaaatcgatgttgtttctgtggaaaagaggcaggctcctggcaaaaggtcagagtctggatcaccttctgctggaggccacagcaaacctcctcacagcccactggtcctcaagaggtgccacgtctccacacatcagcacaactacgcagcgcctccctccactcggaaggactatcctgctgccaagagggtcaagttggacagtgtcagagtcctgagacagatcagcaacaaccgaaaatgcaccagccccaggtcctcggacaccgaggagaatgtcaagaggcgaacacacaacgtcttggagcgccagaggaggaacgagctaaaacggagcttttttgccctgcgtgaccagatcccggagttggaaaacaatgaaaaggcccccaaggtagttatccttaaaaaagccacagcatacatcctgtccgtccaagcagaggagcaaaagctcatttctgaagaggacttgttgcggaaacgacgagaacagttgaaacacaaacttgaacagctacggaactcttgtgcgtaaggaaaagtaaggaaaacgattccttctaacagaaatgtcctgagcaatcacctatgaacttgtttcaaatgcatgatcaaatgcaacctcacaaccttggctgagtcttgagactgaaagatttagccataatgtaaactgcctcaaattggactttgggcataaaagaacttttttatgcttaccatcttttttttttctttaacagatttgtatttaagaattgtttttaaaaaattttaagatttacacaatgtttctctgtaaatattgccattaaatgtaaataactttaataaaacgtttatagcagttacacagaatttcaatcctagtatatagtacctagtattataggtactataaaccctaattttttttatttaagtacattttgctttttaaagttgatttttttctattgtttttagaaaaaataaaataactggcaaatatatcattgagccaaatcttaa

SEQ ID NO: 199274 - DNA, 1023 bp, Homo sapiens
  Payload ID: 19311
  Gene Name: v-myc avian myelocytomatosis viral oncogene homolog
  ENST ID: ENST00000517291
  CDS Start-End: 472-1023
ttatgcctctatcattcctccctatctacactaacatcccacgctctgaacgcgcgcccattaatacccttctttcctccactctccctgggactcttgatcaaagcgcggccctttccccagccttagcgaggcgccctgcagcctggtacgcgcgtggcgtggcggtgggcgcgcagtgcgttctcggtgtggagggcagctgttccgcctgcgatgatttatactcacaggacaaggatgcggtttgtcaaacagtactgctacggaggagcagcagagaaagggagagggtttgagagggagcaaaagaaaatgcagcgggcgggcactttgcactggaacttacaacacccgagcaaggacgcgactctcccgacgcggggaggctattctgcccatttggggacacttccccgccgctgccaggacccgcttctctgaaaggctctccttgcagctgcttagacgctggatttttttcgggtagtggaaaaccagcctcccgcgacgatgcccctcaacgttagcttcaccaacaggaactatgacctcgactacgactcggtgcagccgtatttctactgcgacgaggaggagaacttctaccagcagcagcagcagagcgagctgcagcccccggcgcccagcgaggatatctggaagaaattcgagctgctgcccaccccgcccctgtcccctagccgccgctccgggctctgctcgccctcctacgttgcggtcacacccttctcccttcggggagacaacgacggcggtggcgggagcttctccacggccgaccagctggagatggtgaccgagctgctgggaggagacatggtgaaccagagtttcatctgcgacccggacgacgagaccttcatcaaaaacatcatcatccaggactgtatgtggagcggcttctcggccgccgccaagctcgtctcagagaagctggcctcctaccaggctgcgcgcaaagacagcggcagcccgaaccccgcccgcggccacagcgtc

SEQ ID NO: 199275 - DNA, 577 bp, Homo sapiens
  Payload ID: 19311
  Gene Name: v-myc avian myelocytomatosis viral oncogene homolog
  ENST ID: ENST00000520751
  CDS Start-End: 399-577
aactcgctgtagtaattccagcgagaggcagagggagcgagcgggcggccggctagggtggaagagccgggcgagcagagctgcgctgcgggcgtcctgggaagggagatccggagcgaatagggggcttcgcctctggcccagccctcccgctgatcccccagccagcggtccgcaacccttgccgcatccacgaaactttgcccatagcagcgggcgggcactttgcactggaacttacaacacccgagcaaggacgcgactctcccgacgcggggaggctattctgcccatttggggacacttccccgccgctgccaggacccgcttctctgaaaggctctccttgcagctgcttagacgctggatttttttcgggtagtggaaaaccaggaactatgacctcgactacgactcggtgcagccgtatttctactgcgacgaggaggagaacttctaccagcagcagcagcagagcgagctgcagcccccggcgcccagcgaggatatctggaagaaattcgagctgctgcccaccccgcccctgtcccctagccgccgctccgggctctgctcg

SEQ ID NO: 199276 - DNA, 2150 bp, Homo sapiens
  Payload ID: 19311
  Gene Name: v-myc avian myelocytomatosis viral oncogene homolog
  ENST ID: ENST00000524013
  CDS Start-End: 375-1736
gggctttatctaactcgctgtagtaattccagcgagaggcagagggagcgagcgggcggccggctagggtggaagagccgggcgagcagagctgcgctgcgggcgtcctgggaagggagatccggagcgaatagggggcttcgcctctggcccagccctcccgctgatcccccagccagcggtccgcaacccttgccgcatccacgaaactttgcccatagcagcgggcgggcactttgcactggaacttacaacacccgagcaaggacgcgactctcccgacgcggggaggctattctgcccatttggggacacttccccgccgctgccaggacccgcttctctgaaaggctctccttgcagctgcttagacgctggatttttttcgggtagtggaaaaccagcctcccgcgacgatgcccctcaacgttagcttcaccaacaggaactatgacctcgactacgactcggtgcagccgtatttctactgcgacgaggaggagaacttctaccagcagcagcagcagagcgagctgcagcccccggcgcccagcgaggatatctggaagaaattcgagctgctgcccaccccgcccctgtcccctagccgccgctccgggctctgctcgccctcctacgttgcggtcacacccttctcccttcggggagacaacgacggcggtggcgggagcttctccacggccgaccagctggagatggtgaccgagctgctgggaggagacatggtgaaccagagtttcatctgcgacccggacgacgagaccttcatcaaaaacatcatcatccaggactgtatgtggagcggcttctcggccgccgccaagctcgtctcagagaagctggcctcctaccaggctgcgcgcaaagacagcggcagcccgaaccccgcccgcggccacagcgtctgctccacctccagcttgtacctgcaggatctgagcgccgccgcctcagagtgcatcgacccctcggtggtcttcccctaccctctcaacgacagcagctcgcccaagtcctgcgcctcgcaagactccagcgccttctctccgtcctcggattctctgctctcctcgacggagtcctccccgcagggcagccccgagcccctggtgctccatgaggagacaccgcccaccaccagcagcgactctgaggaggaacaagaagatgaggaagaaatcgatgttgtttctgtggaaaagaggcaggctcctggcaaaaggtcagagtctggatcaccttctgctggaggccacagcaaacctcctcacagcccactggtcctcaagaggtgccacgtctccacacatcagcacaactacgcagcgcctccctccactcggaaggactatcctgctgccaagagggtcaagttggacagtgtcagagtcctgagacagatcagcaacaaccgaaaatgcaccagccccaggtcctcggacaccgaggagaatgtcaagaggcgaacacacaacgtcttggagcgccagaggaggaacgagctaaaacggagcttttttgccctgcgtgaccagatcccggagttggaaaacaatgaaaaggcccccaaggtagttatccttaaaaaagccacagcatacatcctgtccgtccaagcagaggagcaaaagctcatttctgaagaggacttgttgcggaaacgacgagaacagttgaaacacaaacttgaacagctacggaactcttgtgcgtaaggaaaagtaaggaaaacgattccttctaacagaaatgtcctgagcaatcacctatgaacttgtttcaaatgcatgatcaaatgcaacctcacaaccttggctgagtcttgagactgaaagatttagccataatgtaaactgcctcaaattggactttgggcataaaagaacttttttatgcttaccatcttttttttttctttaacagatttgtatttaagaattgtttttaaaaaattttaagatttacacaatgtttctctgtaaatattgccattaaatgtaaataactttaataaaacgtttatagcagttacacagaatttcaatcctagtatatagtacctagtattataggtactataaaccctaattttttttatttaagtacattttgctttttaaagttgattt

SEQ ID NO: 199277 - DNA, 2366 bp, Homo sapiens
  Payload ID: 19311
  Gene Name: v-myc avian myelocytomatosis viral oncogene homolog
  ENST ID: ENST00000621592
  CDS Start-End: 526-1890
gacccccgagctgtgctgctcgcggccgccaccgccgggccccggccgtccctggctcccctcctgcctcgagaagggcagggcttctcagaggcttggcgggaaaaagaacggagggagggatcgcgctgagtataaaagccggttttcggggctttatctaactcgctgtagtaattccagcgagaggcagagggagcgagcgggcggccggctagggtggaagagccgggcgagcagagctgcgctgcgggcgtcctgggaagggagatccggagcgaatagggggcttcgcctctggcccagccctcccgctgatcccccagccagcggtccgcaacccttgccgcatccacgaaactttgcccatagcagcgggcgggcactttgcactggaacttacaacacccgagcaaggacgcgactctcccgacgcggggaggctattctgcccatttggggacacttccccgccgctgccaggacccgcttctctgaaaggctctccttgcagctgcttagacgctggatttttttcgggtagtggaaaaccagcagcctcccgcgacgatgcccctcaacgttagcttcaccaacaggaactatgacctcgactacgactcggtgcagccgtatttctactgcgacgaggaggagaacttctaccagcagcagcagcagagcgagctgcagcccccggcgcccagcgaggatatctggaagaaattcgagctgctgcccaccccgcccctgtcccctagccgccgctccgggctctgctcgccctcctacgttgcggtcacacccttctcccttcggggagacaacgacggcggtggcgggagcttctccacggccgaccagctggagatggtgaccgagctgctgggaggagacatggtgaaccagagtttcatctgcgacccggacgacgagaccttcatcaaaaacatcatcatccaggactgtatgtggagcggcttctcggccgccgccaagctcgtctcagagaagctggcctcctaccaggctgcgcgcaaagacagcggcagcccgaaccccgcccgcggccacagcgtctgctccacctccagcttgtacctgcaggatctgagcgccgccgcctcagagtgcatcgacccctcggtggtcttcccctaccctctcaacgacagcagctcgcccaagtcctgcgcctcgcaagactccagcgccttctctccgtcctcggattctctgctctcctcgacggagtcctccccgcagggcagccccgagcccctggtgctccatgaggagacaccgcccaccaccagcagcgactctgaggaggaacaagaagatgaggaagaaatcgatgttgtttctgtggaaaagaggcaggctcctggcaaaaggtcagagtctggatcaccttctgctggaggccacagcaaacctcctcacagcccactggtcctcaagaggtgccacgtctccacacatcagcacaactacgcagcgcctccctccactcggaaggactatcctgctgccaagagggtcaagttggacagtgtcagagtcctgagacagatcagcaacaaccgaaaatgcaccagccccaggtcctcggacaccgaggagaatgtcaagaggcgaacacacaacgtcttggagcgccagaggaggaacgagctaaaacggagcttttttgccctgcgtgaccagatcccggagttggaaaacaatgaaaaggcccccaaggtagttatccttaaaaaagccacagcatacatcctgtccgtccaagcagaggagcaaaagctcatttctgaagaggacttgttgcggaaacgacgagaacagttgaaacacaaacttgaacagctacggaactcttgtgcgtaaggaaaagtaaggaaaacgattccttctaacagaaatgtcctgagcaatcacctatgaacttgtttcaaatgcatgatcaaatgcaacctcacaaccttggctgagtcttgagactgaaagatttagccataatgtaaactgcctcaaattggactttgggcataaaagaacttttttatgcttaccatcttttttttttctttaacagatttgtatttaagaattgtttttaaaaaattttaagatttacacaatgtttctctgtaaatattgccattaaatgtaaataactttaataaaacgtttatagcagttacacagaatttcaatcctagtatatagtacctagtattataggtactataaaccctaattttttttatttaagtacattttgctttttaaagttgatttttttctattgtttttagaaaaaataaaataactggcaaatatatcattgagccaaatcttaa

SEQ ID NO: 199278 - DNA, 2364 bp, Homo sapiens
  Payload ID: 19311
  Gene Name: v-myc avian myelocytomatosis viral oncogene homolog
  ENST ID: ENST00000613283
  CDS Start-End: 526-1890
gacccccgagctgtgctgctcgcggccgccaccgccgggccccggccgtccctggctcccctcctgcctcgagaagggcagggcttctcagaggcttggcgggaaaaagaacggagggagggatcgcgctgagtataaaagccggttttcggggctttatctaactcgctgtagtaattccagcgagaggcagagggagcgagcgggcggccggctagggtggaagagccgggcgagcagagctgcgctgcgggcgtcctgggaagggagatccggagcgaatagggggcttcgcctctggcccagccctcccgctgatcccccagccagcggtccgcaacccttgccgcatccacgaaactttgcccatagcagcgggcgggcactttgcactggaacttacaacacccgagcaaggacgcgactctcccgacgcggggaggctattctgcccatttggggacacttccccgccgctgccaggacccgcttctctgaaaggctctccttgcagctgcttagacgctggatttttttcgggtagtggaaaaccagcagcctcccgcgacgatgcccctcaacgttagcttcaccaacaggaactatgacctcgactacgactcggtgcagccgtatttctactgcgacgaggaggagaacttctaccagcagcagcagcagagcgagctgcagcccccggcgcccagcgaggatatctggaagaaattcgagctgctgcccaccccgcccctgtcccctagccgccgctccgggctctgctcgccctcctacgttgcggtcacacccttctcccttcggggagacaacgacggcggtggcgggagcttctccacggccgaccagctggagatggtgaccgagctgctgggaggagacatggtgaaccagagtttcatctgcgacccggacgacgagaccttcatcaaaaacatcatcatccaggactgtatgtggagcggcttctcggccgccgccaagctcgtctcagagaagctggcctcctaccaggctgcgcgcaaagacagcggcagcccgaaccccgcccgcggccacagcgtctgctccacctccagcttgtacctgcaggatctgagcgccgccgcctcagagtgcatcgacccctcggtggtcttcccctaccctctcaacgacagcagctcgcccaagtcctgcgcctcgcaagactccagcgccttctctccgtcctcggattctctgctctcctcgacggagtcctccccgcagggcagccccgagcccctggtgctccatgaggagacaccgcccaccaccagcagcgactctgaggaggaacaagaagatgaggaagaaatcgatgttgtttctgtggaaaagaggcaggctcctggcaaaaggtcagagtctggatcaccttctgctggaggccacagcaaacctcctcacagcccactggtcctcaagaggtgccacgtctccacacatcagcacaactacgcagcgcctccctccactcggaaggactatcctgctgccaagagggtcaagttggacagtgtcagagtcctgagacagatcagcaacaaccgaaaatgcaccagccccaggtcctcggacaccgaggagaatgtcaagaggcgaacacacaacgtcttggagcgccagaggaggaacgagctaaaacggagcttttttgccctgcgtgaccagatcccggagttggaaaacaatgaaaaggcccccaaggtagttatccttaaaaaagccacagcatacatcctgtccgtccaagcagaggagcaaaagctcatttctgaagaggacttgttgcggaaacgacgagaacagttgaaacacaaacttgaacagctacggaactcttgtgcgtaaggaaaagtaaggaaaacgattccttctaacagaaatgtcctgagcaatcacctatgaacttgtttcaaatgcatgatcaaatgcaacctcacaaccttggctgagtcttgagactgaaagatttagccataatgtaaactgcctcaaattggactttgggcataaaagaacttttttatgcttaccatcttttttttttctttaacagatttgtatttaagaattgtttttaaaaaattttaagatttacacaatgtttctctgtaaatattgccattaaatgtaaataactttaataaaacgtttatagcagttacacagaatttcaatcctagtatatagtacctagtattataggtactataaaccctaattttttttatttaagtacattttgctttttaaagttgatttttttctattgtttttagaaaaaataaaataactggcaaatatatcattgagccaaatctt

SEQ ID NO: 199279 - DNA, 1944 bp, Homo sapiens
  Payload ID: 19312
  Gene Name: v-myc avian myelocytomatosis viral oncogene lung carcinoma derived homolog
  Uniprot ID: P12524
  ENST ID: ENST00000372815
  CDS Start-End: 32-742
gtgagtgcgggccgcgctctcggcggcgcgcatgtgcgtgtgtgctggctgccgggctgccccgagccggcggggagccggtccgctccaggtggcgggcggctggagcgagggagcggacatggactacgactcgtaccagcactatttctacgactatgactgcggggaggatttctaccgctccacggcgcccagcgaggacatctggaagaaattcgagctggtgccatcgccccccacgtcgccgccctggggcttgggtcccggcgcaggggacccggcccccgggattggtcccccggagccgtggcccggagggtgcaccggagacgaagcggaatcccggggccactcgaaaggctggggcaggaactacgcctccatcatacgccgtgactgcatgtggagcggcttctcggcccgggaacggctggagagagctgtgagcgaccggctcgctcctggcgcgccccgggggaacccgcccaaggcgtccgccgccccggactgcactcccagcctcgaagccggcaacccggcgcccgccgccccctgtccgctgggcgaacccaagacccaggcctgctccgggtccgagagcccaagcgactcgggtaaggacctccccgagccatccaagagggggccaccccatgggtggccaaagctctgcccctgcctgaggtcaggcattggctcttctcaagctcttgggccatctccgcctctctttggctgaagctgcccgtgtagtccccaaccgtgtctgtctggcacgtgggtgtgttggtaaacagtttggaaaagtggcgtgggagccagcctccctttgatgattattggagccccaggggacaagggatttgaggtgagggttggcgcttagagaggacaatactggggttggactgtaagggattgaagggggtaccttaagagacactccaaacctgaagtttttttgctgctgcctctttccctaggaaactcacactcccctagggggagaagaagccgagagccttttgtgcaaagccaaaaccttcgtccttttaaaaacctaggtctccagttggctttactttaaaatgccaataataaatgccctcttctcgtgcctccccaccaccacttaccactcgtgcatccctgagacagggagggaagaatgaacactccccattaacagatggaaaaactgaggcttagagatagacaatcactacaagtcagctccagctttctgccatctagccagcccctcttccccaatgctccatcccaaccaggcacctcttccttgatgtttggggtctttgtggtagcttatcttagaagcactacaccttgccttgctgtttgtcctgagatggaaaagtgtccttcttgctccccctcaatagatctccagcgtcagctgctccctggcattcaacaaatattcactggcccctactttgtggcaatctgtgggctacatgctggggtcaaggcagtagaactccaggccctcctctcccatccttgatgcaagtgcaacctcgctgagggcagactggggcatcctgtgccactaaactacattgttcttattctggcatcttagacctccacacccgtgagaaatcctggagagggtatttttgtagagtgtagactgtggctagtgacaaataaattaggaccaagaaagctcactgtagcttttaggaataacttttacacgaccatttgatagggaactggggaatggggtatggaagttttcctacacttgagagaaaaaataggataacaaaaattaaaagtcttttttttcctggtccactgtgttaaggtcatttttaaccagcttgctttctacaccaagagtttatgtttgtttaatggctggaaagagaatcttgagatcaaaaaaccaataaagatgtatctctacaa

SEQ ID NO: 199280 - DNA, 1688 bp, Homo sapiens
  Payload ID: 19312
  Gene Name: v-myc avian myelocytomatosis viral oncogene lung carcinoma derived homolog
  Uniprot ID: P12524
  ENST ID: ENST00000372816
  CDS Start-End: 449-1543
gtgtgtgctggctgccgggctgccccgagccggcggggagccggtccgctccaggtggcgggcggctggagcgaggtgaggctgcgggtggccagggcacgggcgcgggtcccgcggtgcgggctggctgcaggctgccttctgggcacggcgcgcccccgcccggccccgccgggccctgggagctgcgctccgggcggcgctggcaaagtttgctttgaactcgctgcccacagtcgggtccgcgcgctgcgattggcttcccctaccactctgacccggggcccggcttcccgggacgcgaggactgggcgcaggctgcaagctggtggggttggggaggaacgagagcccggcagccgactgtgccgagggacccggggacacctccttcgcccggccggcacccggtcagcacgtccccccttccctcccgcagggagcggacatggactacgactcgtaccagcactatttctacgactatgactgcggggaggatttctaccgctccacggcgcccagcgaggacatctggaagaaattcgagctggtgccatcgccccccacgtcgccgccctggggcttgggtcccggcgcaggggacccggcccccgggattggtcccccggagccgtggcccggagggtgcaccggagacgaagcggaatcccggggccactcgaaaggctggggcaggaactacgcctccatcatacgccgtgactgcatgtggagcggcttctcggcccgggaacggctggagagagctgtgagcgaccggctcgctcctggcgcgccccgggggaacccgcccaaggcgtccgccgccccggactgcactcccagcctcgaagccggcaacccggcgcccgccgccccctgtccgctgggcgaacccaagacccaggcctgctccgggtccgagagcccaagcgactcggagaatgaagaaattgatgttgtgacagtagagaagaggcagtctctgggtattcggaagccggtcaccatcacggtgcgagcagaccccctggatccctgcatgaagcatttccacatctccatccatcagcaacagcacaactatgctgcccgttttcctccagaaagctgctcccaagaagaggcttcagagaggggtccccaagaagaggttctggagagagatgctgcaggggaaaaggaagatgaggaggatgaagagattgtgagtcccccacctgtagaaagtgaggctgcccagtcctgccaccccaaacctgtcagttctgatactgaggatgtgaccaagaggaagaatcacaacttcctggagcgcaagaggcggaatgacctgcgttcgcgattcttggcgctgagggaccaggtgcccaccctggccagctgctccaaggcccccaaagtagtgatcctaagcaaggccttggaatacttgcaagccctggtgggggctgagaagaggatggctacagagaaaagacagctccgatgccggcagcagcagttgcagaaaagaattgcatacctcactggctactaactgaccaaaaagcctgacagttctgtcttacgaagacacaagtttattttttaacctccctctcccctttagtaatttgcacattttggttatggtgggacagtctggacagtagatcccagaatgcattgcagccggtgcacac

SEQ ID NO: 199281 - DNA, 3256 bp, Homo sapiens
  Payload ID: 19312
  Gene Name: v-myc avian myelocytomatosis viral oncogene lung carcinoma derived homolog
  Uniprot ID: P12524
  ENST ID: ENST00000397332
  CDS Start-End: 126-1310
tgcgcctgcagctcgcgctcccgcgccgatcccgagagcgtccgggccgccgtgcgcgagcgagggagggcgcgcgcgcggggggggcgcgcttgtgagtgcgggccgcgctctcggcggcgcgcatgtgcgtgtgtgctggctgccgggctgccccgagccggcggggagccggtccgctccaggtggcgggcggctggagcgagggagcggacatggactacgactcgtaccagcactatttctacgactatgactgcggggaggatttctaccgctccacggcgcccagcgaggacatctggaagaaattcgagctggtgccatcgccccccacgtcgccgccctggggcttgggtcccggcgcaggggacccggcccccgggattggtcccccggagccgtggcccggagggtgcaccggagacgaagcggaatcccggggccactcgaaaggctggggcaggaactacgcctccatcatacgccgtgactgcatgtggagcggcttctcggcccgggaacggctggagagagctgtgagcgaccggctcgctcctggcgcgccccgggggaacccgcccaaggcgtccgccgccccggactgcactcccagcctcgaagccggcaacccggcgcccgccgccccctgtccgctgggcgaacccaagacccaggcctgctccgggtccgagagcccaagcgactcggagaatgaagaaattgatgttgtgacagtagagaagaggcagtctctgggtattcggaagccggtcaccatcacggtgcgagcagaccccctggatccctgcatgaagcatttccacatctccatccatcagcaacagcacaactatgctgcccgttttcctccagaaagctgctcccaagaagaggcttcagagaggggtccccaagaagaggttctggagagagatgctgcaggggaaaaggaagatgaggaggatgaagagattgtgagtcccccacctgtagaaagtgaggctgcccagtcctgccaccccaaacctgtcagttctgatactgaggatgtgaccaagaggaagaatcacaacttcctggagcgcaagaggcggaatgacctgcgttcgcgattcttggcgctgagggaccaggtgcccaccctggccagctgctccaaggcccccaaagtagtgatcctaagcaaggccttggaatacttgcaagccctggtgggggctgagaagaggatggctacagagaaaagacagctccgatgccggcagcagcagttgcagaaaagaattgcatacctcactggctactaactgaccaaaaagcctgacagttctgtcttacgaagacacaagtttattttttaacctccctctcccctttagtaatttgcacattttggttatggtgggacagtctggacagtagatcccagaatgcattgcagccggtgcacacacaataaaggcttgcattcttggaaaccttgaaacccagctctccctcttccctgactcatgggagtgctgtatgttctctggcgcctttggcttcccagcaggcagctgactgaggagccttggggtctgcctagctcactagctctgaagaaaaggctgacagatgctatgcaacaggtggtggatgttgtcaggggctccagcctgcatgaaatctcacactctgcatgagctttaggctaggaaaggatgctcccaactggtgtctctggggtgatgcaaggacagctgggcctggatgctctccctgaggctcctttttccagaagacacacgagctgtcttgggtgaagacaagcttgcagacttgatcaacattgaccattacctcactgtcagacactttacagtagccaaggagttggaaacctttatatattatgatgttagctgacccccttcctcccactcccaatgctgcgaccctgggaacacttaaaaagcttggcctctagattctttgtctcagagccctctgggctctctcctctgagggagggacctttctttcctcacaagggacttttttgttccattatgccttgttatgcaatgggctctacagcaccctttcccacaggtcagaaatatttccccaagacacagggaaatcggtcctagcctggggcctggggatagcttggagtcctggcccatgaacttgatccctgcccaggtgttttccgaggggcacttgaggcccagtcttttctcaaggcaggtgtaagacacctcagagggagaactgtactgctgcctctttcccacctgcctcatctcaatccttgagcggcaagtttgaagttcttctggaaccatgcaaatctgtcctcctcatgcaattccaaggagcttgctggctctgcagccacccttgggccccttccagcctgccatgaatcagatatctttcccagaatctgggcgtttctgaagttttggggagagctgttgggactcatccagtgctccagaaggtggacttgcttctggtgggttttaaaggagcctccaggagatatgcttagccaaccatgatggattttaccccagctggactcggcagctccaagtggaatccacgtgcagcttctagtctgggaaagtcacccaacctagcagttgtcatgtgggtaacctcaggcacctctaagcctgtcctggaagaaggaccagcagcccctccagaactctgcccaggacagcaggtgcctgctggctctgggtttggaagttggggtgggtagggggtggtaagtactatatatggctctggaaaaccagctgctacttccaaatctattgtccataatggtttctttctgaggttgcttcttggcctcagaggaccccaggggatgtttggaaatagcctctctacccttctggagcatggtttacaaaagccagctgacttctggaattgtctatggaggacagtttgggtgtaggttactgatgtctcaactgaatagcttgtgttttataagctgctgttggctattatgctgggggagtcttttttttttatattgtatttttgtatgccttttgcaaagtggtgttaactgtttttgtacaaggaaaaaaactcttggggcaatttcctgttgcaagggtctgatttattttgaaaggcaagttcacctgaaattttgtatttagttgtgattactgattgcctgattttaaaatgttgccttctgggacatcttctaataaaagatttctcaaacatg

SEQ ID NO: 199282 - DNA, 426 bp, Homo sapiens
  Payload ID: 19312
  Gene Name: v-myc avian myelocytomatosis viral oncogene lung carcinoma derived homolog
  ENST ID: ENST00000450953
  CDS Start-End: 126-426
gcaccgccaagcggccgccgggccgcatcagccctcctcctgtttgcgctccccagcgtgcaatttatttggggggctaccggggattgaacggagcgggcgagcgctgccaggagggagcggacatggactacgactcgtaccagcactatttctacgactatgactgcggggaggatttctaccgctccacggcgcccagcgaggacatctggaagaaattcgagctggtgccatcgccccccacgtcgccgccctggggcttgggtcccggcgcaggggacccggcccccgggattggtcccccggagccgtggcccggagggtgcaccggagacgaagcggaatcccggggccactcgaaaggctggggcaggaactacgcctccatcatacgccgtgactgcatgtggagcggcttctcgg

SEQ ID NO: 199283 - DNA, 2602 bp, Homo sapiens
  Payload ID: 19313
  Gene Name: v-myc avian myelocytomatosis viral oncogene neuroblastoma derived homolog
  Uniprot ID: P04198
  ENST ID: ENST00000281043
  CDS Start-End: 298-1692
atctgtctggacgcgctgggtggatgcggggggctcctgggaactgtgttggagccgagcaagcgctagccaggcgcaagcgcgcacagactgtagccatccgaggacacccccgcccccccggcccacccggagacacccgcgcagaatcgcctccggatcccctgcagtcggcgggagtgttggaggtcggcgccggcccccgccttccgcgccccccacgggaaggaagcacccccggtattaaaacgaacggggcggaaagaagccctcagtcgccggccgggaggcgagccgatgccgagctgctccacgtccaccatgccgggcatgatctgcaagaacccagacctcgagtttgactcgctacagccctgcttctacccggacgaagatgacttctacttcggcggccccgactcgacccccccgggggaggacatctggaagaagtttgagctgctgcccacgcccccgctgtcgcccagccgtggcttcgcggagcacagctccgagcccccgagctgggtcacggagatgctgcttgagaacgagctgtggggcagcccggccgaggaggacgcgttcggcctggggggactgggtggcctcacccccaacccggtcatcctccaggactgcatgtggagcggcttctccgcccgcgagaagctggagcgcgccgtgagcgagaagctgcagcacggccgcgggccgccaaccgccggttccaccgcccagtccccgggagccggcgccgccagccctgcgggtcgcgggcacggcggggctgcgggagccggccgcgccggggccgccctgcccgccgagctcgcccacccggccgccgagtgcgtggatcccgccgtggtcttcccctttcccgtgaacaagcgcgagccagcgcccgtgcccgcagccccggccagtgccccggcggcgggccctgcggtcgcctcgggggcgggtattgccgccccagccggggccccgggggtcgcccctccgcgcccaggcggccgccagaccagcggcggcgaccacaaggccctcagtacctccggagaggacaccctgagcgattcagatgatgaagatgatgaagaggaagatgaagaggaagaaatcgacgtggtcactgtggagaagcggcgttcctcctccaacaccaaggctgtcaccacattcaccatcactgtgcgtcccaagaacgcagccctgggtcccgggagggctcagtccagcgagctgatcctcaaacgatgccttcccatccaccagcagcacaactatgccgccccctctccctacgtggagagtgaggatgcacccccacagaagaagataaagagcgaggcgtccccacgtccgctcaagagtgtcatccccccaaaggctaagagcttgagcccccgaaactctgactcggaggacagtgagcgtcgcagaaaccacaacatcctggagcgccagcgccgcaacgaccttcggtccagctttctcacgctcagggaccacgtgccggagttggtaaagaatgagaaggccgccaaggtggtcattttgaaaaaggccactgagtatgtccactccctccaggccgaggagcaccagcttttgctggaaaaggaaaaattgcaggcaagacagcagcagttgctaaagaaaattgaacacgctcggacttgctagacgcttctcaaaactggacagtcactgccactttgcacattttgattttttttttaaacaaacattgtgttgacattaagaatgttggtttactttcaaatcggtcccctgtcgagttcggctctgggtgggcagtaggaccaccagtgtggggttctgctgggaccttggagagcctgcatcccaggatgctgggtggccctgcagcctcctccacctcacctccatgacagcgctaaacgttggtgacggttgggagcctctggggctgttgaagtcaccttgtgtgttccaagtttccaaacaacagaaagtcattccttctttttaaaatggtgcttaagttccagcagatgccacataaggggtttgccatttgatacccctggggaacatttctgtaaataccattgacacatccgccttttgtatacatcctgggtaatgagaggtggcttttgcggccagtattagactggaagttcatacctaagtactgtaataatacctcaatgtttgaggagcatgttttgtatacaaatatattgttaatctctgttatgtactgtactaattcttacactgcctgtatactttagtatgacgctgatacataactaaatttgatacttatattttcgtatgaaaatgagttgtgaaagttttgagtagatattactttatcactttttgaactaagaaacttttgtaaagaaatttactatatatatatgcctttttcctagcctgtttcttcctgttaatgtatttgttcatgtttggtgcatagaactgggtaaatgcaaagttctgtgtttaatttcttcaaaatgtatatatttagtgctgcatcttatagcactttgaaatacctcatgtttatgaaaataaatagcttaaaattaaatga

SEQ ID NO: 199284 - DNA, 1953 bp, Homo sapiens
  Payload ID: 19314
  Gene Name: voltage-dependent anion channel 1
  Uniprot ID: P21796
  ENST ID: ENST00000265333
  CDS Start-End: 246-1097
attagcgcagggacctccgggccacagctcagagaatcggaaggcctcctcccccttcccgagcgctgccactggggccgaggtttccagcaagaacccgcgtgtccctgcgcacgcacacacggtgcacacgtcagtccggcgcctccccgtgccccgactcacgcaggtcctcccgcgcgcccgcaacacgcccgcaggctcctgtgtctgctgccggggcagcggggcccggaaggcagaagatggctgtgccacccacgtatgccgatcttggcaaatctgccagggatgtcttcaccaagggctatggatttggcttaataaagcttgatttgaaaacaaaatctgagaatggattggaatttacaagctcaggctcagccaacactgagaccaccaaagtgacgggcagtctggaaaccaagtacagatggactgagtacggcctgacgtttacagagaaatggaataccgacaatacactaggcaccgagattactgtggaagatcagcttgcacgtggactgaagctgaccttcgattcatccttctcacctaacactgggaaaaaaaatgctaaaatcaagacagggtacaagcgggagcacattaacctgggctgcgacatggatttcgacattgctgggccttccatccggggtgctctggtgctaggttacgagggctggctggccggctaccagatgaattttgagactgcaaaatcccgagtgacccagagcaactttgcagttggctacaagactgatgaattccagcttcacactaatgtgaatgacgggacagagtttggcggctccatttaccagaaagtgaacaagaagttggagaccgctgtcaatcttgcctggacagcaggaaacagtaacacgcgcttcggaatagcagccaagtatcagattgaccctgacgcctgcttctcggctaaagtgaacaactccagcctgataggtttaggatacactcagactctaaagccaggtattaaactgacactgtcagctcttctggatggcaagaacgtcaatgctggtggccacaagcttggtctaggactggaatttcaagcataaatgaatactgtacaattgtttaattttaaactattttgcagcatagctaccttcagaatttagtgtatcttttaatgttgtatgtctgggatgcaagtattgctaaatatgttagccctccaggttaaagttgattcagctttaagatgttacccttccagaggtacagaagaaacctatttccaaaaaaggtcctttcagtggtagactcggggagaacttggtggcccctttgagatgccaggtttcttttttatctagaaatggctgcaagtggaagcggataatatgtaggcactttgtaaattcatattgagtaaatgaatgaaattgtgatttcctgagaatcgaaccttggttccctaaccctaattgatgagaggctcgctgcttgatggtgtgtacaaactcacctgaatgggacttttttagacagatcttcatgacctgttcccaccccagttcatcatcatctcttttacaccaaaaggtctgcagggtgtggtaactgtttcttttgtgccattttggggtggagaaggtggatgtgatgaagccaataattcaggacttattccttcttgtgttgtgtttttttttggcccttgcaccagagtatgaaatagcttccaggagctccagctataagcttggaagtgtctgtgtgattgtaatcacatggtgacaacactcagaatctaaattggacttctgttgtattctcaccactcaatttgttttttagcagtttaatgggtacattttagagtcttccattttgttggaattagatcctccccttcaaatgctgtaattaacaacacttaaaaaacttgaataaaatattgaaacctca

SEQ ID NO: 199285 - DNA, 1807 bp, Homo sapiens
  Payload ID: 19314
  Gene Name: voltage-dependent anion channel 1
  Uniprot ID: P21796
  ENST ID: ENST00000395044
  CDS Start-End: 100-951
gccgctcgctcggctccgctccctggctcggctccctgcctccgcgtcgcagcccccgccgtagccgcctccgagcccgccgccacatcctctgagaagatggctgtgccacccacgtatgccgatcttggcaaatctgccagggatgtcttcaccaagggctatggatttggcttaataaagcttgatttgaaaacaaaatctgagaatggattggaatttacaagctcaggctcagccaacactgagaccaccaaagtgacgggcagtctggaaaccaagtacagatggactgagtacggcctgacgtttacagagaaatggaataccgacaatacactaggcaccgagattactgtggaagatcagcttgcacgtggactgaagctgaccttcgattcatccttctcacctaacactgggaaaaaaaatgctaaaatcaagacagggtacaagcgggagcacattaacctgggctgcgacatggatttcgacattgctgggccttccatccggggtgctctggtgctaggttacgagggctggctggccggctaccagatgaattttgagactgcaaaatcccgagtgacccagagcaactttgcagttggctacaagactgatgaattccagcttcacactaatgtgaatgacgggacagagtttggcggctccatttaccagaaagtgaacaagaagttggagaccgctgtcaatcttgcctggacagcaggaaacagtaacacgcgcttcggaatagcagccaagtatcagattgaccctgacgcctgcttctcggctaaagtgaacaactccagcctgataggtttaggatacactcagactctaaagccaggtattaaactgacactgtcagctcttctggatggcaagaacgtcaatgctggtggccacaagcttggtctaggactggaatttcaagcataaatgaatactgtacaattgtttaattttaaactattttgcagcatagctaccttcagaatttagtgtatcttttaatgttgtatgtctgggatgcaagtattgctaaatatgttagccctccaggttaaagttgattcagctttaagatgttacccttccagaggtacagaagaaacctatttccaaaaaaggtcctttcagtggtagactcggggagaacttggtggcccctttgagatgccaggtttcttttttatctagaaatggctgcaagtggaagcggataatatgtaggcactttgtaaattcatattgagtaaatgaatgaaattgtgatttcctgagaatcgaaccttggttccctaaccctaattgatgagaggctcgctgcttgatggtgtgtacaaactcacctgaatgggacttttttagacagatcttcatgacctgttcccaccccagttcatcatcatctcttttacaccaaaaggtctgcagggtgtggtaactgtttcttttgtgccattttggggtggagaaggtggatgtgatgaagccaataattcaggacttattccttcttgtgttgtgtttttttttggcccttgcaccagagtatgaaatagcttccaggagctccagctataagcttggaagtgtctgtgtgattgtaatcacatggtgacaacactcagaatctaaattggacttctgttgtattctcaccactcaatttgttttttagcagtttaatgggtacattttagagtcttccattttgttggaattagatcctccccttcaaatgctgtaattaacaacacttaaaaaacttgaataaaatattgaaacctca

SEQ ID NO: 199286 - DNA, 1873 bp, Homo sapiens
  Payload ID: 19314
  Gene Name: voltage-dependent anion channel 1
  Uniprot ID: P21796
  ENST ID: ENST00000395047
  CDS Start-End: 203-1054
gtcccgggcggggcctgggggcggagcgcgccgggccgggcgcgcaggaggggaggcgggtccgcgccgccgccgtccgcgccgccccgcccttggcccagccgctcgctcggctccgctccctggctcggctccctgcctccgcgtcgcagcccccgccgtagccgcctccgagcccgccgccacatcctctgagcagaagatggctgtgccacccacgtatgccgatcttggcaaatctgccagggatgtcttcaccaagggctatggatttggcttaataaagcttgatttgaaaacaaaatctgagaatggattggaatttacaagctcaggctcagccaacactgagaccaccaaagtgacgggcagtctggaaaccaagtacagatggactgagtacggcctgacgtttacagagaaatggaataccgacaatacactaggcaccgagattactgtggaagatcagcttgcacgtggactgaagctgaccttcgattcatccttctcacctaacactgggaaaaaaaatgctaaaatcaagacagggtacaagcgggagcacattaacctgggctgcgacatggatttcgacattgctgggccttccatccggggtgctctggtgctaggttacgagggctggctggccggctaccagatgaattttgagactgcaaaatcccgagtgacccagagcaactttgcagttggctacaagactgatgaattccagcttcacactaatgtgaatgacgggacagagtttggcggctccatttaccagaaagtgaacaagaagttggagaccgctgtcaatcttgcctggacagcaggaaacagtaacacgcgcttcggaatagcagccaagtatcagattgaccctgacgcctgcttctcggctaaagtgaacaactccagcctgataggtttaggatacactcagactctaaagccaggtattaaactgacactgtcagctcttctggatggcaagaacgtcaatgctggtggccacaagcttggtctaggactggaatttcaagcataaatgaatactgtacaattgtttaattttaaactattttgcagcatagctaccttcagaatttagtgtatcttttaatgttgtatgtctgggatgcaagtattgctaaatatgttagccctccaggttaaagttgattcagctttaagatgttacccttccagaggtacagaagaaacctatttccaaaaaaggtcctttcagtggtagactcggggagaacttggtggcccctttgagatgccaggtttcttttttatctagaaatggctgcaagtggaagcggataatatgtaggcactttgtaaattcatattgagtaaatgaatgaaattgtgatttcctgagaatcgaaccttggttccctaaccctaattgatgagaggctcgctgcttgatggtgtgtacaaactcacctgaatgggacttttttagacagatcttcatgacctgttcccaccccagttcatcatcatctcttttacaccaaaaggtctgcagggtgtggtaactgtttcttttgtgccattttggggtggagaaggtggatgtgatgaagccaataattcaggacttattccttcttgtgttgtgtttttttttggcccttgcaccagagtatgaaatagcttccaggagctccagctataagcttggaagtgtctgtgtgattgtaatcacatggtgacaacactcagaatctaaattggacttctgttgtattctcaccactcaatttgttttttagcagtttaatgggtacattttagagtcttccattttgttggaattagatcctccccttcaaatgctgtaattaac

SEQ ID NO: 199287 - DNA, 703 bp, Homo sapiens
  Payload ID: 19314
  Gene Name: voltage-dependent anion channel 1
  ENST ID: ENST00000425992
  CDS Start-End: 153-703
ggaaaaggaccccggcttccttgcgccctggacggcgggggccaggcccctggggagctgagagggaggcgctgagggaggagcgggcgaggggccccggcagcccggccgcggggagggatcgcgagcggccggcgcgggcctggctgaagatggctgtgccacccacgtatgccgatcttggcaaatctgccagggatgtcttcaccaagggctatggatttggcttaataaagcttgatttgaaaacaaaatctgagaatggattggaatttacaagctcaggctcagccaacactgagaccaccaaagtgacgggcagtctggaaaccaagtacagatggactgagtacggcctgacgtttacagagaaatggaataccgacaatacactaggcaccgagattactgtggaagatcagcttgcacgtggactgaagctgaccttcgattcatccttctcacctaacactgggaaaaaaaatgctaaaatcaagacagggtacaagcgggagcacattaacctgggctgcgacatggatttcgacattgctgggccttccatccggggtgctctggtgctaggttacgagggctggctggccggctaccagatgaattttgagactgcaaaatcccgagtgacccagagcaactttgcagttggctacaagactgatgaattccagcttcacactaatgt

SEQ ID NO: 199288 - DNA, 931 bp, Homo sapiens
  Payload ID: 19315
  Gene Name: voltage-dependent anion channel 2
  ENST ID: ENST00000298468
  CDS Start-End: 85-931
ggcagtcccaaaaagcctctcaggcacacaacccagcacagcaaggcagtcacaccaagattcccctcttcccgcggcctcgccatggcgacccacggacagacttgcgcgcgtccaatgtgtattcctccatcatatgctgaccttggcaaagctgccagagatattttcaacaaaggatttggttttgggttggtgaaactggatgtgaaaacaaagtcttgcagtggcgtggaattttcaacgtccggttcatctaatacagacactggtaaagttactgggaccttggagaccaaatacaagtggtgtgagtatggtctgactttcacagaaaagtggaacactgataacactctgggaacagaaatcgcaattgaagaccagatttgtcaaggtttgaaactgacatttgatactaccttctcaccaaacacaggaaagaaaagtggtaaaatcaagtcttcttacaagagggagtgtataaaccttggttgtgatgttgactttgattttgctggacctgcaatccatggttcagctgtctttggttatgagggctggcttgctggctaccagatgacctttgacagtgccaaatcaaagctgacaaggaataactttgcagtgggctacaggactggggacttccagctacacactaatgtcaatgatgggacagaatttggaggatcaatttatcagaaagtttgtgaagatcttgacacttcagtaaaccttgcttggacatcaggtaccaactgcactcgttttggcattgcagctaaatatcagttggatcccactgcttccatttctgcaaaagtcaacaactctagcttaattggagtaggctatactcagactctgaggcctggtgtgaagcttacactctctgctctggtagatgggaagagcattaatgctggag

SEQ ID NO: 199289 - DNA, 681 bp, Homo sapiens
  Payload ID: 19315
  Gene Name: voltage-dependent anion channel 2
  ENST ID: ENST00000344036
  CDS Start-End: 98-681
cccaccgacggacggaggcagcccacctgcaggaccggggcgctgtcggtccacgtggccgctctggagcagattcccctcttcccgcggcctcgccatggcgacccacggacagacttgcgcgcgtccaatgtgtattcctccatcatatgctgaccttggcaaagctgccagagatattttcaacaaaggatttggttttgggttggtgaaactggatgtgaaaacaaagtcttgcagtggcgtggaattttcaacgtccggttcatctaatacagacactggtaaagttactgggaccttggagaccaaatacaagtggtgtgagtatggtctgactttcacagaaaagtggaacactgataacactctgggaacagaaatcgcaattgaagaccagatttgtcaaggtttgaaactgacatttgatactaccttctcaccaaacacaggaaagaaaagtggtaaaatcaagtcttcttacaagagggagtgtataaaccttggttgtgatgttgactttgattttgctggacctgcaatccatggttcagctgtctttggttatgagggctggcttgctggctaccagatgacctttgacagtgccaaatcaaagctgacaaggaataactttgcagtgggctacaggactggggacttccagctacacactaatgt

SEQ ID NO: 199290 - DNA, 1467 bp, Homo sapiens
  Payload ID: 19315
  Gene Name: voltage-dependent anion channel 2
  Uniprot ID: P45880
  ENST ID: ENST00000313132
  CDS Start-End: 250-1179
gctgctggagctgcagcccgaccgcgagcgtgccaagcggcttcagcagctagcggagcggtggcggcggcccccctcaggacaccaccagattcccctcttcccgcggcctcgccatggcgacccacggacagacttgcgcgcgtcgatcggatcaatcacttttctagaggaagtagcagtccctcttgtgagagcgcaaggtcattacttgtgctcctaagggcgtggacgtgctttgtggaatgaatgagctggtgtaatgagctcagattgcctgcccttaagcagcacagcattggccgaggacttgagagtcacattacaatgtgtattcctccatcatatgctgaccttggcaaagctgccagagatattttcaacaaaggatttggttttgggttggtgaaactggatgtgaaaacaaagtcttgcagtggcgtggaattttcaacgtccggttcatctaatacagacactggtaaagttactgggaccttggagaccaaatacaagtggtgtgagtatggtctgactttcacagaaaagtggaacactgataacactctgggaacagaaatcgcaattgaagaccagatttgtcaaggtttgaaactgacatttgatactaccttctcaccaaacacaggaaagaaaagtggtaaaatcaagtcttcttacaagagggagtgtataaaccttggttgtgatgttgactttgattttgctggacctgcaatccatggttcagctgtctttggttatgagggctggcttgctggctaccagatgacctttgacagtgccaaatcaaagctgacaaggaataactttgcagtgggctacaggactggggacttccagctacacactaatgtcaatgatgggacagaatttggaggatcaatttatcagaaagtttgtgaagatcttgacacttcagtaaaccttgcttggacatcaggtaccaactgcactcgttttggcattgcagctaaatatcagttggatcccactgcttccatttctgcaaaagtcaacaactctagcttaattggagtaggctatactcagactctgaggcctggtgtgaagcttacactctctgctctggtagatgggaagagcattaatgctggaggccacaaggttgggctcgccctggagttggaggcttaatccagctgaaagaaacctttgggaatggatatcagaagatttggccttaatatatttccattgtgaccagcagcaggcttttttcccccaagaagatgatcaaaacaaaggatgatctcaacaagagctgtattttaagtatttagacagttctttgttagctggtttctagttggttatctagttaccaatgctgcagtcctgcagtcacctatacattatttaaatgtatttaactgttaaatgcgctacccaccaataatgaaatagacctttatgaaaactgtg

SEQ ID NO: 199291 - DNA, 1557 bp, Homo sapiens
  Payload ID: 19315
  Gene Name: voltage-dependent anion channel 2
  Uniprot ID: P45880
  ENST ID: ENST00000332211
  CDS Start-End: 214-1098
ggcgcggcggacagccccgggggcagcggcggggtcctgtctgggagaggacagggttgcggcgggcggaacggtgtctccttcacttcgccctccagctgctggagctgcagcccgaccgcgagcgtgccaagcggcttcagcagctagcggagcggtggcggcggcccccctcaggacaccaccagattcccctcttcccgcggcctcgccatggcgacccacggacagacttgcgcgcgtccaatgtgtattcctccatcatatgctgaccttggcaaagctgccagagatattttcaacaaaggatttggttttgggttggtgaaactggatgtgaaaacaaagtcttgcagtggcgtggaattttcaacgtccggttcatctaatacagacactggtaaagttactgggaccttggagaccaaatacaagtggtgtgagtatggtctgactttcacagaaaagtggaacactgataacactctgggaacagaaatcgcaattgaagaccagatttgtcaaggtttgaaactgacatttgatactaccttctcaccaaacacaggaaagaaaagtggtaaaatcaagtcttcttacaagagggagtgtataaaccttggttgtgatgttgactttgattttgctggacctgcaatccatggttcagctgtctttggttatgagggctggcttgctggctaccagatgacctttgacagtgccaaatcaaagctgacaaggaataactttgcagtgggctacaggactggggacttccagctacacactaatgtcaatgatgggacagaatttggaggatcaatttatcagaaagtttgtgaagatcttgacacttcagtaaaccttgcttggacatcaggtaccaactgcactcgttttggcattgcagctaaatatcagttggatcccactgcttccatttctgcaaaagtcaacaactctagcttaattggagtaggctatactcagactctgaggcctggtgtgaagcttacactctctgctctggtagatgggaagagcattaatgctggaggccacaaggttgggctcgccctggagttggaggcttaatccagctgaaagaaacctttgggaatggatatcagaagatttggccttaatatatttccattgtgaccagcagcaggcttttttcccccaagaagatgatcaaaacaaaggatgatctcaacaagagctgtattttaagtatttagacagttctttgttagctggtttctagttggttatctagttaccaatgctgcagtcctgcagtcacctatacattatttaaatgtatttaactgttaaatgcgctacccaccaataatgaaatagacctttatgaaaactgtgcaattgtgtgcatgtttgtttttatgttcctttagaaaacattgactgttaccattgaatgagatggatcagtggatattaagatgaggttacaaattttgttaagttcagccattattacttttggtatcccagaacatgacaaattatgaataaaacaagtatacataa

SEQ ID NO: 199292 - DNA, 457 bp, Homo sapiens
  Payload ID: 19315
  Gene Name: voltage-dependent anion channel 2
  ENST ID: ENST00000413289
  CDS Start-End: 129-457
gttaattggggattctgcctttggaggatcggatcaatcacttttctagaggaagtagcagtccctcttgtgagagcgcaaggtcattacttgtgctcctaagggcgtggacgtgctttgtggaatgaatgagctggtgtaatgagctcagattgcctgcccttaagcagcacagcattggccgaggacttgagagtcacattacaatgtgtattcctccatcatatgctgaccttggcaaagctgccagagatattttcaacaaaggatttggttttgggttggtgaaactggatgtgaaaacaaagtcttgcagtggcgtggaattttcaacgtccggttcatctaatacagacactggtaaagttactgggaccttggagaccaaatacaagtggtgtgagtatggtctgactttcacagaaaagtggaacactgataacactctgggaacaga

SEQ ID NO: 199293 - DNA, 738 bp, Homo sapiens
  Payload ID: 19315
  Gene Name: voltage-dependent anion channel 2
  ENST ID: ENST00000447677
  CDS Start-End: 126-738
aagatggccgcgctgccccgcggcccctcgcccctctctgcccgggatctccctttggccctttgaccccagcttaccgcacttcttgtccctcccgcagattcccctcttcccgcggcctcgccatggcgacccacggacagacttgcgcgcgtccaatgtgtattcctccatcatatgctgaccttggcaaagctgccagagatattttcaacaaaggatttggttttgggttggtgaaactggatgtgaaaacaaagtcttgcagtggcgtggaattttcaacgtccggttcatctaatacagacactggtaaagttactgggaccttggagaccaaatacaagtggtgtgagtatggtctgactttcacagaaaagtggaacactgataacactctgggaacagaaatcgcaattgaagaccagatttgtcaaggtttgaaactgacatttgatactaccttctcaccaaacacaggaaagaaaagtggtaaaatcaagtcttcttacaagagggagtgtataaaccttggttgtgatgttgactttgattttgctggacctgcaatccatggttcagctgtctttggttatgagggctggcttgctggctaccagatgacctttgacagtgccaaatcaaagctgacaaggaataactttgcagtgggctacaggactggggacttccagctacacactaatgtcaatgatgggacagaatttggaggatcaa

SEQ ID NO: 199294 - DNA, 1424 bp, Homo sapiens
  Payload ID: 19315
  Gene Name: voltage-dependent anion channel 2
  Uniprot ID: P45880
  ENST ID: ENST00000543351
  CDS Start-End: 85-969
ggcagtcccaaaaagcctctcaggcacacaacccagcacagcaaggcagtcacaccaagattcccctcttcccgcggcctcgccatggcgacccacggacagacttgcgcgcgtccaatgtgtattcctccatcatatgctgaccttggcaaagctgccagagatattttcaacaaaggatttggttttgggttggtgaaactggatgtgaaaacaaagtcttgcagtggcgtggaattttcaacgtccggttcatctaatacagacactggtaaagttactgggaccttggagaccaaatacaagtggtgtgagtatggtctgactttcacagaaaagtggaacactgataacactctgggaacagaaatcgcaattgaagaccagatttgtcaaggtttgaaactgacatttgatactaccttctcaccaaacacaggaaagaaaagtggtaaaatcaagtcttcttacaagagggagtgtataaaccttggttgtgatgttgactttgattttgctggacctgcaatccatggttcagctgtctttggttatgagggctggcttgctggctaccagatgacctttgacagtgccaaatcaaagctgacaaggaataactttgcagtgggctacaggactggggacttccagctacacactaatgtcaatgatgggacagaatttggaggatcaatttatcagaaagtttgtgaagatcttgacacttcagtaaaccttgcttggacatcaggtaccaactgcactcgttttggcattgcagctaaatatcagttggatcccactgcttccatttctgcaaaagtcaacaactctagcttaattggagtaggctatactcagactctgaggcctggtgtgaagcttacactctctgctctggtagatgggaagagcattaatgctggaggccacaaggttgggctcgccctggagttggaggcttaatccagctgaaagaaacctttgggaatggatatcagaagatttggccttaatatatttccattgtgaccagcagcaggcttttttcccccaagaagatgatcaaaacaaaggatgatctcaacaagagctgtattttaagtatttagacagttctttgttagctggtttctagttggttatctagttaccaatgctgcagtcctgcagtcacctatacattatttaaatgtatttaactgttaaatgcgctacccaccaataatgaaatagacctttatgaaaactgtgcaattgtgtgcatgtttgtttttatgttcctttagaaaacattgactgttaccattgaatgagatggatcagtggatattaagatgaggttacaaattttgttaagttcagccattattacttttggtatcccagaacatgacaaattatgaataaaacaagtatac

SEQ ID NO: 199295 - DNA, 1355 bp, Homo sapiens
  Payload ID: 19316
  Gene Name: voltage-dependent anion channel 3
  Uniprot ID: Q9Y277
  ENST ID: ENST00000022615
  CDS Start-End: 69-920
agcagagacaggccctcggggtggaggtctttggtttcataagagcctgagagagatttttctaagatatgtgtaacacaccaacgtactgtgacctaggaaaggctgctaaggatgtcttcaacaaaggatatggctttggcatggtcaagatagacctgaaaaccaagtcttgtagtggagtggaattttctacttctggtcatgcttacactgatacagggaaagcatcaggcaacctagaaaccaaatataaggtctgtaactatggacttaccttcacccagaaatggaacacagacaatactctagggacagaaatctcttgggagaataagttggctgaagggttgaaactgactcttgataccatatttgtaccgaacacaggaaagaagagtgggaaattgaaggcctcctataaacgggattgttttagtgttggcagtaatgttgatatagatttttctggaccaaccatctatggctgggctgtgttggccttcgaagggtggcttgctggctatcagatgagttttgacacagccaaatccaaactgtcacagaataatttcgccctgggttacaaggctgcggacttccagctgcacacacatgtgaacgatggcactgaatttggaggttctatctaccagaaggtgaatgagaagattgaaacatccataaaccttgcttggacagctgggagtaacaacacccgttttggcattgctgctaagtacatgctggattgtagaacttctctctctgctaaagtaaataatgccagcctgattggactgggttatactcagacccttcgaccaggagtcaaattgactttatcagctttaatcgatgggaagaacttcagtgcaggaggtcacaaggttggcttgggatttgaactggaagcttaatgtggtttgaggaaagcatcagatttgtccctggaagtgaagagaaatgaacccactatgttttggccttaaaattcttctgtgaaatttcaaaagtgtgaactttttattcttccaaagaattgtaatcctccccacactgaagtctaggggttgcgaatccctcctgagggagatgcttgaaggcatgcctggaagttgtcatgtttgtgccacgtttcagttcagttctgaagtgttattaaatgtgttcctcagcgacagtgtagcgtcatgttagaggagacgatctgacccaccagtttgtacatcacgtcctgcatgtcccacaccattttttcatgaccttgtaatatactggtctctgtgctatagtggaatctttggttttgcatcatagtaaaataaaataaacccatcacatttggaacataa

SEQ ID NO: 199296 - DNA, 799 bp, Homo sapiens
  Payload ID: 19316
  Gene Name: voltage-dependent anion channel 3
  ENST ID: ENST00000522572
  CDS Start-End: 108-512
acggcgttggtttgaagaccttcagcgttgccctggcggagcagagacaggccctcggggtggaggtctttggtttcataagagcctgagagagatttttctaagatatgtgtaacacaccaacgtactgtgacctaggaaaggctgctaaggatgtcttcaacaaaggatatggctttggcatggtcaagatagacctgaaaaccaagtcttgtagtggagtgatggaattttctacttctggtcatgcttacactgatacagggaaagcatcaggcaacctagaaaccaaatataaggtctgtaactatggacttaccttcacccagaaatggaacacagacaatactctagggacagaaatctcttgggagaataagttggctgaagggttgaaactgactcttgataccatatttgtaccgaacacaggaaagaagagtgggaaattgaaggcctcctataaacgggattgttttagtgttggcttgggatttgaactggaagcttaatgtggtttgaggaaagcatcagatttgtccctggaagtgaagagaaatgaacccactatgttttggccttaaaattcttctgtgaaatttcaaaagtgtgaactttttattcttccaaagaattgtaatcctccccacactgaagtctaggggttgcgaatccctcctgagggagatgcttgaaggcatgcctggaagttgtcatgtttgtgccacgtttcagttcagttctgaagtgttattaaatgtgttcctcagcgacagtgtagcgtcatgttagaggagac

SEQ ID NO: 199297 - DNA, 580 bp, Homo sapiens
  Payload ID: 19316
  Gene Name: voltage-dependent anion channel 3
  ENST ID: ENST00000520115
  CDS Start-End: 86-580
gaggctgcgcaggcgcggacggcgttggtttgaagaccttcagcgttgccctggcggagcagagacaggccctcggggtggagatatgtgtaacacaccaacgtactgtgacctaggaaaggctgctaaggatgtcttcaacaaaggatatggctttggcatggtcaagatagacctgaaaaccaagtcttgtagtggagtggaattttctacttctggtcatgcttacactgatacagggaaagcatcaggcaacctagaaaccaaatataaggtctgtaactatggacttaccttcacccagaaatggaacacagacaatactctagggacagaaatctcttgggagaataagttggctgaagggttgaaactgactcttgataccatatttgtaccgaacacaggaaagaagagtgggaaattgaaggcctcctataaacgggattgttttagtgttggcagtaatgttgatatagatttttctggaccaaccatctatggctgggctgtgttggccttcgaagggtggcttgctggctatcagatgagttttgacacagccaaatccaaactgtca

SEQ ID NO: 199298 - DNA, 949 bp, Homo sapiens
  Payload ID: 19316
  Gene Name: voltage-dependent anion channel 3
  Uniprot ID: Q9Y277
  ENST ID: ENST00000521158
  CDS Start-End: 69-923
agcagagacaggccctcggggtggaggtctttggtttcataagagcctgagagagatttttctaagatatgtgtaacacaccaacgtactgtgacctaggaaaggctgctaaggatgtcttcaacaaaggatatggctttggcatggtcaagatagacctgaaaaccaagtcttgtagtggagtgatggaattttctacttctggtcatgcttacactgatacagggaaagcatcaggcaacctagaaaccaaatataaggtctgtaactatggacttaccttcacccagaaatggaacacagacaatactctagggacagaaatctcttgggagaataagttggctgaagggttgaaactgactcttgataccatatttgtaccgaacacaggaaagaagagtgggaaattgaaggcctcctataaacgggattgttttagtgttggcagtaatgttgatatagatttttctggaccaaccatctatggctgggctgtgttggccttcgaagggtggcttgctggctatcagatgagttttgacacagccaaatccaaactgtcacagaataatttcgccctgggttacaaggctgcggacttccagctgcacacacatgtgaacgatggcactgaatttggaggttctatctaccagaaggtgaatgagaagattgaaacatccataaaccttgcttggacagctgggagtaacaacacccgttttggcattgctgctaagtacatgctggattgtagaacttctctctctgctaaagtaaataatgccagcctgattggactgggttatactcagacccttcgaccaggagtcaaattgactttatcagctttaatcgatgggaagaacttcagtgcaggaggtcacaaggttggcttgggatttgaactggaagcttaatgtggtttgaggaaagcatcagattt

SEQ ID NO: 199299 - DNA, 719 bp, Homo sapiens
  Payload ID: 19316
  Gene Name: voltage-dependent anion channel 3
  ENST ID: ENST00000518563
  CDS Start-End: 394-719
agggcacaggtgcggtccccagcctcttgggcccccagtcaacctcactgtccacaccgagccctcctgcgcacgcgcgctgcggagccggacagttggtggtgctggcttggcccggctgttcgtctccgcgccttgctccgaagcgcgcgaccgtggcgcgacacgccggcgcacaggcgctctcggggaggggcggcgcgcaggcgcggctgggggtgcgaggctgcgcaggcgcggacggcgttggtttgaagaccttcagcgttgccctggcggagcagagacaggccctcggggtggaggtctttggtttcataagagcctgagagagatttttctaagatatgtgtaacacaccaacgtactgtgacctaggaaaggctgctaaggatgtcttcaacaaaggatatggaattttctacttctggtcatgcttacactgatacagggaaagcatcaggcaacctagaaaccaaatataaggtctgtaactatggacttaccttcacccagaaatggaacacagacaatactctagggacagaaatctcttgggagaataagttggctgaagggttgaaactgactcttgataccatatttgtaccgaacacaggaaagaagagtgggaaattgaaggcctcctataaacgggattgttttagtgttggcagtaatgttgatatagatttttctggaccaaccatctatggctg

SEQ ID NO: 199300 - DNA, 625 bp, Homo sapiens
  Payload ID: 19316
  Gene Name: voltage-dependent anion channel 3
  ENST ID: ENST00000522069
  CDS Start-End: 150-625
aggcgcggacggcgttggtttgaagaccttcagcgttgccctggcggagcagagacaggccctcggggtggagtttctttaaaaatttccattgttgtcttatacaggtctttggtttcataagagcctgagagagatttttctaagatatgtgtaacacaccaacgtactgtgacctaggaaaggctgctaaggatgtcttcaacaaaggatatggctttggcatggtcaagatagacctgaaaaccaagtcttgtagtggagtggaattttctacttctggtcatgcttacactgatacagggaaagcatcaggcaacctagaaaccaaatataaggtctgtaactatggacttaccttcacccagaaatggaacacagacaatactctagggacagaaatctcttgggagaataagttggctgaagggttgaaactgactcttgataccatatttgtaccgaacacaggaaagaagagtgggaaattgaaggcctcctataaacgggattgttttagtgttggcagtaatgttgatatagatttttctggaccaaccatctatggctgggctgtgttggccttcgaagggtggcttgctggctatcagatgagttttgacac

SEQ ID NO: 199301 - DNA, 531 bp, Homo sapiens
  Payload ID: 19316
  Gene Name: voltage-dependent anion channel 3
  ENST ID: ENST00000518495
  CDS Start-End: 70-243
gagcagagacaggccctcggggtggaggtctttggtttcataagagcctgagagagatttttctaagatatgtgtaacacaccaacgtactgtgacctaggaaaggctgctaaggatgtcttcaacaaaggatatggctttggcatggtcaagatagacctgaaaaccaagtcttgtagtggagtgttgtgtggtaatattcattcagatggaattttctacttctggtcatgcttacactgatacagggaaagcatcaggcaacctagaaaccaaatataaggtctgtaactatggacttaccttcacccagaaatggaacacagacaatactctagggacagaaatctcttgggagaataagttggctgaagggttgaaactgactcttgataccatatttgtaccgaacacaggaaagaagagtgggaaattgaaggcctcctataaacgggattgttttagtgttggcagtaatgttgatatagatttttctggaccaaccatctatggctgggctgtgttggcctt

SEQ ID NO: 199302 - DNA, 631 bp, Homo sapiens
  Payload ID: 19316
  Gene Name: voltage-dependent anion channel 3
  ENST ID: ENST00000522010
  CDS Start-End: 3-305
atatgtgtaacacaccaacgtactgtgacctaggaaaggctgctaaggatgtcttcaacaaaggatatggctttggcatggtcaagatagacctgaaaaccaagtcttgtagtggagtggaattttctacttctggtcatgcttacactgatacagggaaagcatcaggcaacctagaaaccaaatataaggtctgtaactatggacttaccttcacccagaaatggaacacagacaatactctagggacagaaatctcttgggagaataagaaagaagagtgggaaattgaaggcctcctataaacgggattgttttagtgttggcagtaatgttgatatagatttttctggaccaaccatctatggctgggctgtgttggccttcgaagggtggcttgctggctatcagatgagttttgacacagccaaatccaaactgtcacagaataatttcgccctgggttacaaggctgcggacttccagctgcacacacatgtgaacgatggcactgaatttggaggttctatctaccagaaggtgaatgagaagattgaaacatccataaaccttgcttggacagctgggagtaacaacacccgttttggcattgctgctaagtacatgctgg

SEQ ID NO: 199303 - DNA, 2353 bp, Homo sapiens
  Payload ID: 19317
  Gene Name: vomeronasal 1 receptor 1
  Uniprot ID: Q9GZP7
  ENST ID: ENST00000321039
  CDS Start-End: 657-1718
tcccaggttcaagcgattctcctgcctcagcctcccgagtagctgggactagcacgcgccgccatgcccggctaatttttgtattattagtattttgtattattagtagagacagggtttcaccatgttggccaggatggtctccatcttggcctcccgaagtgctggaattacaggtgtgagccactgcacccggcctaaaatttgtttcaatgcatcaataacaatggtgtttactaaaatattagtgtggaaaaggttttatggtgtattatttttgcttttcatatctccaggctacttaattgaaggttttattgaaataagtgtagactcacaagcagtcataagaaataatacagaaaaagccctgtccatattacccagggttccgtcatgattacattttgcaaactatagtataatatcactctaatgatattgactcttctgtgttctgtttttatatatttccctagttttgcttgtatttacttgttgcatgtgtgtaagccctgagttttataggtttgatttgtggatctgttgtgcggttgagccctcattcattcacctgcttctctgcagttggacacacaagcaattgcctttgcacgaacagggacaatcttaatttctgtttaagatgagaaaatatggttggagacacattaaaacttctgtctccactgatgacaagatacttctttctgcttttttattctactgattcttcagacctcaatgaaaatcaacatcccctagattttgatgaaatggcttttggaaaagtaaaatcagggattagcttcctcattcagactggagttgggatcctgggaaattcctttctcctttgtttttataacttaattttgttcactggacacaagctgagacccacggacttgattctcagccaactggccttggctaactccatggtccttttctttaaagggatacctcagacaatggcagcttttggattgaaatatttgctgaatgacactggatgtaagtttgtcttttattatcacagggtgggcacaagagtttccctcagcaccatctgccttctcaatggattccaagccattaagctcaaccccagtatatgcaggtggatggagatcaagattagatccccaaggtttattgacttctgttgtctcctctgctgggccccccatgtcttgatgaatgcatctgttcttctattagtgaatggcccactgaatagcaaaaacagtagtgcaaaaaacaattatggatactgttcttacaaagcatcaaagagatttagctcattacatgcagtcttatatttttcccctgattttatgagtttgggcttcatggtctgggccagtggctccatggtcttcttcctctacagacacaagcagcaagtccaacacaatcacagcaacagactctcctgcagaccttcccaggaagccagagccacacacaccatcatggtcctggtgagctccttttttgttttctattcagtccatagttttctgacaatttggacaactgtagttgcaaacccaggccagtggatagtgaccaactctgtgttggtcgcctcatgtttcccagcacgcagcccttttgtcctcatcatgagtgatactcatatctctcagttctgttttgcctgcaggacaaggaaaacactctttcctaatctggttgtcatgccatgagtcttttctcttcatggaattcagctatttatcataactcttgctaagatttaggaaatattaactactagttatttgtgatagcaacatacacatggccagtaatgctcttgtccaggaagatctaataccagagctaaaaatgaaagtcatggatactgttacacaaagaacactctatataactgtgttaagtccttcagacaagttcaggaaatcaaaaagtttaaaaagggaattctttagagatttaggggagatttctcatttttgtactatgaagaatcatggaatgttttaaaaatatttttaaagcacagtttgattcaggtgcttcttgaacagcataaatcccctggagagtccacatgtaagaaagacatgtgcaggccgggcacagtggctcacgcctgtaatcccaccgttttgggaggctgaggcactcccaaatgcctcaagtgatccactcaagatgacttgaggccaggagttcgagaccagcctggccaacatggcaaaaaccctgtctcaaatacaaaaattagccaaccatgtggcacacacctgtagtcccagctactccagagggtgaagcacgagaattacttaccagcttgggtgacggagggagactc

SEQ ID NO: 199304 - DNA, 1311 bp, Homo sapiens
  Payload ID: 19318
  Gene Name: vomeronasal 1 receptor 2
  Uniprot ID: Q8NFZ6
  ENST ID: ENST00000341702
  CDS Start-End: 85-1272
tctctctctgccttggctgccaggcagggaagggccccctgtccagtggacacgtgacccacgtgaccttacctatcattggagatgactcacactctttaccctaccccttttgctttgtatccaataaatatcagcgcagcctggcatttggggccactaccagtctcctgctttgtatccaataaatatcagtgcagcctggcattcggggccactaccggtctccgcgtcttggtggtagtggtcccccagacacagctgtcttttctttcatctctttgtcttgtgtctttatttctacactctcttgtctctgcacacggagagaaacccaccaaacctgtggggctggaccctacactattccaggtagttgttggaatcctggggaatttttcactcttatattattatatgttcctttactttaggggatacaagccaagatccacagatttgattctcaggcacctgactgtagctgactccttggttatcctatctaaaagaatcccagagaccatggcaacttttgggttgaaacattttgacaattattttggatgcaaatttcttttgtatgcacacagggtaggcaggggtgtgtccattggaagcacctgcctcttgagtgtcttccaggtgatcaccatcaaccctaggaactccaggtgggcagagatgaaagtaaaagccccgacatacattggtctctccaatatcctgtgctgggccttccacatgctggtaaatgccatttttcctatttatacaactggcaaatggagcaacaacaacatcacaaagaaaggagatttgggatattgttctgccccacttagtgatgaagtcacaaagtcagtatatgcagcattgacatccttccatgatgttttgtgtctggggctcatgctctgggccagcagctccatcgttttggtcttgtacaggcacaaacagcaggtacaacacatctgtaggaacaatctctaccccaactcttctcctgggaacagagccatccaaagcatccttgcattggtgagcacctttgcattatgttacgccctttccttcatcacctacgtttatttagctctcttcgataattccagttggtggctagtgaacactgctgcactaatcattgcctgttttccaactattagcccttttgttctcatgtgccgtgaccccagcagatccaggctctgcagtatctgctgcagaagaaatagacgattctttcatgatttcaggaaaatgtgaattggctgtcttggtttatgttcggccactgatgcactc

SEQ ID NO: 199305 - DNA, 1048 bp, Homo sapiens
  Payload ID: 19319
  Gene Name: vomeronasal 1 receptor 4
  Uniprot ID: Q7Z5H5
  ENST ID: ENST00000311170
  CDS Start-End: 59-964
tccatgcaggacctcccagccctgaagacaaacatcagtgacagacatcagtggcagaatggcctcccggtatgtggcagtgggaatgatcttatcacagaccgtggtgggagtcctggggagcttctctgttcttctccattatctctccttttactgcactgggtgcaggttaaggtccacagatttgattgttaagcacctgattgtagccaacttcttagctctccgctgtaaaggagtcccccagacaatggcagcttttggggttagatattttctcaatgctcttgggtgcaaacttgttttctatctccatagagtgggcaggggagtgtccattggcaccacctgcctcttgagtgtcttccaggtgatcacggtcagctccaggaaatccaggtgggcaaaacttaaagagaaagcccccaagcatgttggcttttctgttctcctgtgctggatcgtgtgcatgttggtaaacatcatctttcccatgtatgtgactggcaaatggaactacacaaacatcacagtgaacgaggatttgggatactgttctgggggaggcaacaacaaaatcgcacagacactgcgtgcaatgttgttatcattccctgatgtgttgtgtctggggctcatgctctgggtcagcagctccatggtttgcatactgcacaggcacaagcagcgggtccagcacattgataggagcaatctctcccccagagcctccccagagaacagagctacgcagagcatcctcatcctggtgagcacctttgtgtcttcttacactctctcctgccttttccaagtttgtatggctcttttggataatcccaatagtttactggtgaacacttcagccttaatgagtgtatgtttcccaactctcagcccctttgttctcatgagctgtgaccccagtgtatacaggttttgttttgcctggaaaagatgacaagatctcctaacctcatcataaacatgtacattgtatatatttgctcatggttcaattgatgacttactcttctgtgccgca

SEQ ID NO: 199306 - DNA, 1686 bp, Homo sapiens
  Payload ID: 19320
  Gene Name: von Hippel-Lindau binding protein 1
  Uniprot ID: P61758
  ENST ID: ENST00000286428
  CDS Start-End: 118-711
tgcgcaccaatgaatgtgcatggagatggagaggcgggcctgcaagtgcgaacaagccaatcacggaatcccggcggccggcggcccgggaggcagtcgcgcgctcgcatccccaagatggcggccgttaaggacagttgtggcaaaggagaaatggccacagggaatgggcggcggctccacctggggattcctgaggccgtgtttgtggaagatgtagattccttcatgaaacagcctgggaatgagactgcagatacagtattaaagaagctggatgaacagtaccagaagtataagtttatggaactcaaccttgctcaaaagaaaagaaggctaaaaggtcagattcctgaaattaaacagactttggaaattctaaaatacatgcagaagaaaaaagagtccaccaactcaatggagaccagattcttgctggcagataacctgtattgcaaagcttcagttcctcctaccgataaagtgtgtctgtggttgggggctaatgtaatgcttgaatatgatattgatgaagctcaggcattgttggaaaagaatttatcgactgccacaaagaatcttgattccctggaggaagaccttgactttcttcgagatcaatttactaccacagaagtcaatatggccagggtttataattgggatgtaaaaagaagaaacaaggatgactctaccaagaacaaagcataatgctggcaattaaaaatgtggtttagttttccaaacatgttatcttaaatacccctttatccttacaggttgacataactttgaatgttttaacagcaagaattttaagaaaagataaacaccattttatttatttataaaaacaaaattagtttcaaatatttttgacattgtgatttttttttccacatttctcagcaaagctaatggtattttaatcattatttttgcctgtcataagaaaactcttagctgaaatggccgaaaactgtgagacatgctatggaagctgaatgccggacgctagcacagtttactttttccctttctaattggctgatgttactctcacttgatgtggttaaaccattttagaggtagagaagacagacagtttgaatatttgtaaacttgtttttctttggtatatttaggacttagtggtcctctgttgctattgtcttctataagtggagtttcatgacttactgcttaacgaataactaactactatgatattctggacattttaggaaatggtaatttgccttgctacacattaagagggctattaagactacattttttctaacctcagataagtgcagtgtctttgcaatgccaacataagggagatcttggccaacgtgaaataaaattactcattcaaaactctgcctaaggtgattttgtagttcttaacagttctccagagcatcttgaacaggaatattaagataaatgtgaatctgcaatggctgaaaagagttgtgagcttttttattcatgataaaaccttataggaatagtataaaaaatccctgtggaaagctactagtacattgaccagcgctgggtgatacagattctgataaaaacataaatgtattagttcatctccatgtagtaaaaagtatacttatacaatgttttgtacttgtatttcatgaaattaaaacagtgatgctaaaacta

SEQ ID NO: 199307 - DNA, 944 bp, Homo sapiens
  Payload ID: 19320
  Gene Name: von Hippel-Lindau binding protein 1
  ENST ID: ENST00000535916
  CDS Start-End: 164-742
attactcagcttttcatctgctgtgttgaaagccaacttatcatttttcacattattgtatacatctaaaagacatcataaacgaagactggaagtgaaaactgaaaaactgagaaagttttatttgttggaggttccaactccattgggagctccttctctaatggcacctcaacccatgattcatacccagcaaggcctaaggaccagtagtccttccactccatccccagagcatcaggaagatgtagattccttcatgaaacagcctgggaatgagactgcagatacagtattaaagaagctggatgaacagtaccagaagtataagtttatggaactcaaccttgctcaaaagaaaagaaggctaaaaggtcagattcctgaaattaaacagactttggaaattctaaaatacatgcagaagaaaaaagagtccaccaactcaatggagaccagattcttgctggcagataacctgtattgcaaagcttcagttcctcctaccgataaagtgtgtctgtggttgggggctaatgtaatgcttgaatatgatattgatgaagctcaggcattgttggaaaagaatttatcgactgccacaaagaatcttgattccctggaggaagaccttgactttcttcgagatcaatttactaccacagaagtcaatatggccagggtttataattgggatgtaaaaagaagaaacaaggatgactctaccaagaacaaagcataatgctggcaattaaaaatgtggtttagttttccaaacatgttatcttaaatacccctttatccttacaggttgacataactttgaatgttttaacagcaagaattttaagaaaagataaacaccattttatttatttataaaaacaaaattagtttcaaatatttttgacattgtgatttttttttccacatttctcagcaaa

SEQ ID NO: 199308 - DNA, 1547 bp, Homo sapiens
  Payload ID: 19320
  Gene Name: von Hippel-Lindau binding protein 1
  ENST ID: ENST00000625964
  CDS Start-End: 1-579
atggcacctcaacccatgattcatacccagcaaggcctaaggaccagtagtccttccactccatccccagagcatcaggaagatgtagattccttcatgaaacagcctgggaatgagactgcagatacagtattaaagaagctggatgaacagtaccagaagtataagtttatggaactcaaccttgctcaaaagaaaagaaggctaaaaggtcagattcctgaaattaaacagactttggaaattctaaaatacatgcagaagaaaaaagagtccaccaactcaatggagaccagattcttgctggcagataacctgtattgcaaagcttcagttcctcctaccgataaagtgtgtctgtggttgggggctaatgtaatgcttgaatatgatattgatgaagctcaggcattgttggaaaagaatttatcgactgccacaaagaatcttgattccctggaggaagaccttgactttcttcgagatcaatttactaccacagaagtcaatatggccagggtttataattgggatgtaaaaagaagaaacaaggatgactctaccaagaacaaagcataatgctggcaattaaaaatgtggtttagttttccaaacatgttatcttaaatacccctttatccttacaggttgacataactttgaatgttttaacagcaagaattttaagaaaagataaacaccattttatttatttataaaaacaaaattagtttcaaatatttttgacattgtgatttttttttccacatttctcagcaaagctaatggtattttaatcattatttttgcctgtcataagaaaactcttagctgaaatggccgaaaactgtgagacatgctatggaagctgaatgccggacgctagcacagtttactttttccctttctaattggctgatgttactctcacttgatgtggttaaaccattttagaggtagagaagacagacagtttgaatatttgtaaacttgtttttctttggtatatttaggacttagtggtcctctgttgctattgtcttctataagtggagtttcatgacttactgcttaacgaataactaactactatgatattctggacattttaggaaatggtaatttgccttgctacacattaagagggctattaagactacattttttctaacctcagataagtgcagtgtctttgcaatgccaacataagggagatcttggccaacgtgaaataaaattactcattcaaaactctgcctaaggtgattttgtagttcttaacagttctccagagcatcttgaacaggaatattaagataaatgtgaatctgcaatggctgaaaagagttgtgagcttttttattcatgataaaaccttataggaatagtataaaaaatccctgtggaaagctactagtacattgaccagcgctgggtgatacagattctgataaaaacataaatgtattagttcatctccatgtagtaaaaagtatacttatacaatgttttgtacttgtatttcatgaaattaaaacagtgatgct

SEQ ID NO: 199309 - DNA, 3737 bp, Homo sapiens
  Payload ID: 19321
  Gene Name: von Hippel-Lindau tumor suppressor, E3 ubiquitin protein ligase
  Uniprot ID: P40337
  ENST ID: ENST00000256474
  CDS Start-End: 841-1482
tgagtgtttatgtttgtagttttaattgctctgaagtaaatatctgattttccaatttccaccagagtgctctgcacatagtaggtctaattatttttccctctttactaatcacccatgccttgtaagaattcagttagttgactttttgtactttataagcgtgatgattgggtgttcccgtgtgagatgcgccaccctcgaaccttgttacgacgtcggcacattgcgcgtctgacatgaagaaaaaaaaaattcagttagtccaccaggcacagtggctaaggcctgtaatccctgcactttgagaggccaaggcaggaggatcacttgaacccaggagttcgagaccagcctaggcaacatagcgagactccgtttcaaacaacaaataaaaataattagtcgggcatggtggtgcgcgcctacagtaccaactactcgggaggctgaggcgagacgatcgcttgagccagggaggtcaaggctgcagtgagccaagctcgcgccactgcactccagcccgggcgacagagtgagaccctgtctcaaaaaaaaaaaaaacaccaaaccttagaggggcgaaaaaaaattttatagtggaaatacagtaacgagttggcctagcctcgcctccgttacaacggcctacggtgctggaggatccttctgcgcacgcgcacagcctccggccggctatttccgcgagcgcgttccatcctctaccgagcgcgcgcgaagactacggaggtcgactcgggagcgcgcacgcagctccgccccgcgtccgacccgcggatcccgcggcgtccggcccgggtggtctggatcgcggagggaatgccccggagggcggagaactgggacgaggccgaggtaggcgcggaggaggcaggcgtcgaagagtacggccctgaagaagacggcggggaggagtcgggcgccgaggagtccggcccggaagagtccggcccggaggaactgggcgccgaggaggagatggaggccgggcggccgcggcccgtgctgcgctcggtgaactcgcgcgagccctcccaggtcatcttctgcaatcgcagtccgcgcgtcgtgctgcccgtatggctcaacttcgacggcgagccgcagccctacccaacgctgccgcctggcacgggccgccgcatccacagctaccgaggtcacctttggctcttcagagatgcagggacacacgatgggcttctggttaaccaaactgaattatttgtgccatctctcaatgttgacggacagcctatttttgccaatatcacactgccagtgtatactctgaaagagcgatgcctccaggttgtccggagcctagtcaagcctgagaattacaggagactggacatcgtcaggtcgctctacgaagatctggaagaccacccaaatgtgcagaaagacctggagcggctgacacaggagcgcattgcacatcaacggatgggagattgaagatttctgttgaaacttacactgtttcatctcagcttttgatggtactgatgagtcttgatctagatacaggactggttccttccttagtttcaaagtgtctcattctcagagtaaaataggcaccattgcttaaaagaaagttaactgacttcactaggcattgtgatgtttaggggcaaacatcacaaaatgtaatttaatgcctgcccattagagaagtatttatcaggagaaggtggtggcatttttgcttcctagtaagtcaggacagcttgtatgtaaggaggtttgtataagtaattcagtgggaattgcagcatatcgtttaattttaagaaggcattggcatctgcttttaatggatgtataatacatccattctacatccgtagcggttggtgacttgtctgcctcctgctttgggaagactgaggcatccgtgaggcagggacaagtctttctcctctttgagaccccagtgcctgcacatcatgagccttcagtcagggtttgtcagaggaacaaaccaggggacactttgttagaaagtgcttagaggttctgcctctatttttgttggggggtgggagaggggaccttaaaatgtgtacagtgaacaaatgtcttaaagggaatcatttttgtaggaagcattttttataattttctaagtcgtgcactttctcggtccactcttgttgaagtgctgttttattactgtttctaaactaggattgacattctacagttgtgataatagcatttttgtaacttgccatccgcacagaaaatacgagaaaatctgcatgtttgattatagtattaatggacaaataagtttttgctaaatgtgagtatttctgttcctttttgtaaatatgtgacattcctgattgatttgggtttttttgttgttgttgttttgttttgttttgtttttttgagatggagtctcactcttgtcacccaggctggagtgcagtggcgccatctcggctcactgcaacctctgcctcctgggttcacgtaatcctcctgagtagctgggattacaggcgcctgccaccacgctggccaatttttgtacttttagtagagacagtgtttcgtcatgttggccaggctggtttcaaactcctgacctcaggtgatccgcccacctcagcctcccaaaatggtgggattacaggtgtgtgggccaccgtgcctggctgattcagcattttttatcaggcaggaccaggtggcacttccacctccagcctctggtcctaccaatggattcatggagtagcctggactgtttcatagttttctaaatgtacaaattcttataggctagacttagattcattaactcaaattcaatgcttctatcagactcagttttttgtaactaatagatttttttttccacttttgttctactccttccctaatagctttttaaaaaaatctccccagtagagaaacatttggaaaagacagaaaactaaaaaggaagaaaaaagatccctattagatacacttcttaaatacaatcacattaacattttgagctatttccttccagcctttttagggcagattttggttggtttttacatagttgagattgtactgttcatacagttttataccctttttcatttaactttataacttaaatattgctctatgttagtataagcttttcacaaacattagtatagtctcccttttataattaatgtttgtgggtatttcttggcatgcatctttaattccttatcctagcctttgggcacaattcctgtgctcaaaaatgagagtgacggctggcatggtggctcccgcctgtaatcccagtactttggaaagccaaggtaagaggattgcttgagcccagaacttcaagatgagcctgggctcatagtgagaacccatctatacaaaaaatttttaaaaattagcatggcggcacacatctgtaatcctagctacttggcaggctgaggtgagaagatcattggagtttaggaattggaggctgcagtgagccatgagtatgccactgcactccagcctgggggacagagcaagaccctgcctcaaaaaaaaaaaaaaaaaaaaaatcaggccgggcatggtggctcacgcctgtaatcccagcactttgggaggtcgaggtgggcagatcacctgaggtcaggagttcgagaccagcctggccaacatggtaaaaccccatttctactaaaaaatacaagaat

SEQ ID NO: 199310 - DNA, 2696 bp, Homo sapiens
  Payload ID: 19321
  Gene Name: von Hippel-Lindau tumor suppressor, E3 ubiquitin protein ligase
  Uniprot ID: P40337
  ENST ID: ENST00000345392
  CDS Start-End: 61-579
cccgcgtccgacccgcggatcccgcggcgtccggcccgggtggtctggatcgcggagggaatgccccggagggcggagaactgggacgaggccgaggtaggcgcggaggaggcaggcgtcgaagagtacggccctgaagaagacggcggggaggagtcgggcgccgaggagtccggcccggaagagtccggcccggaggaactgggcgccgaggaggagatggaggccgggcggccgcggcccgtgctgcgctcggtgaactcgcgcgagccctcccaggtcatcttctgcaatcgcagtccgcgcgtcgtgctgcccgtatggctcaacttcgacggcgagccgcagccctacccaacgctgccgcctggcacgggccgccgcatccacagctaccgagtgtatactctgaaagagcgatgcctccaggttgtccggagcctagtcaagcctgagaattacaggagactggacatcgtcaggtcgctctacgaagatctggaagaccacccaaatgtgcagaaagacctggagcggctgacacaggagcgcattgcacatcaacggatgggagattgaagatttctgttgaaacttacactgtttcatctcagcttttgatggtactgatgagtcttgatctagatacaggactggttccttccttagtttcaaagtgtctcattctcagagtaaaataggcaccattgcttaaaagaaagttaactgacttcactaggcattgtgatgtttaggggcaaacatcacaaaatgtaatttaatgcctgcccattagagaagtatttatcaggagaaggtggtggcatttttgcttcctagtaagtcaggacagcttgtatgtaaggaggtttgtataagtaattcagtgggaattgcagcatatcgtttaattttaagaaggcattggcatctgcttttaatggatgtataatacatccattctacatccgtagcggttggtgacttgtctgcctcctgctttgggaagactgaggcatccgtgaggcagggacaagtctttctcctctttgagaccccagtgcctgcacatcatgagccttcagtcagggtttgtcagaggaacaaaccaggggacactttgttagaaagtgcttagaggttctgcctctatttttgttggggggtgggagaggggaccttaaaatgtgtacagtgaacaaatgtcttaaagggaatcatttttgtaggaagcattttttataattttctaagtcgtgcactttctcggtccactcttgttgaagtgctgttttattactgtttctaaactaggattgacattctacagttgtgataatagcatttttgtaacttgccatccgcacagaaaatacgagaaaatctgcatgtttgattatagtattaatggacaaataagtttttgctaaatgtgagtatttctgttcctttttgtaaatatgtgacattcctgattgatttgggtttttttgttgttgttgttttgttttgttttgtttttttgagatggagtctcactcttgtcacccaggctggagtgcagtggcgccatctcggctcactgcaacctctgcctcctgggttcacgtaatcctcctgagtagctgggattacaggcgcctgccaccacgctggccaatttttgtacttttagtagagacagtgtttcgtcatgttggccaggctggtttcaaactcctgacctcaggtgatccgcccacctcagcctcccaaaatggtgggattacaggtgtgtgggccaccgtgcctggctgattcagcattttttatcaggcaggaccaggtggcacttccacctccagcctctggtcctaccaatggattcatggagtagcctggactgtttcatagttttctaaatgtacaaattcttataggctagacttagattcattaactcaaattcaatgcttctatcagactcagttttttgtaactaatagatttttttttccacttttgttctactccttccctaatagctttttaaaaaaatctccccagtagagaaacatttggaaaagacagaaaactaaaaaggaagaaaaaagatccctattagatacacttcttaaatacaatcacattaacattttgagctatttccttccagcctttttagggcagattttggttggtttttacatagttgagattgtactgttcatacagttttataccctttttcatttaactttataacttaaatattgctctatgttagtataagcttttcacaaacattagtatagtctcccttttataattaatgtttgtgggtatttcttggcatgcatctttaattccttatcctagcctttgggcacaattcctgtgctcaaaaatgagagtgacggctggcatggtggctcccgcctgtaatcccagtactttggaaagccaaggtaagaggattgcttgagcccagaacttcaagatgagcctgggctcatagtgagaacccatctatacaaaaaatttttaaaaattagcatggcggcacacatctgtaatcctagctacttggcaggctgaggtgagaagatcattggagtttaggaattggaggctgcagtgagccatgagtatgccactgcactccagcctgggggacagagcaagaccctgcctcaaaaaaaaaaaaaaaaaaaaaa

SEQ ID NO: 199311 - DNA, 676 bp, Homo sapiens
  Payload ID: 19322
  Gene Name: von Hippel-Lindau tumor suppressor-like
  Uniprot ID: Q6RSH7
  ENST ID: ENST00000339922
  CDS Start-End: 111-530
ctcccagcctttctgattccattgtaactcttgccgaaatccgggtgaacggaagtagtctctttaagaactggtatgggcaggcccaagttgtcaaggcttcggaggtaatgccctggagagcggggaacggggtgggtttagaggcccaggcgggcacccaggaggcaggcccagaagagtactgccaggaagagttgggcgccgaggaggagatggcagccagagcagcatggcctgtgctgcgctctgtgaactcacgcgagctctcccggatcatcatctgcaatcacagcccacgaatcgtgctgcctgtgtggctcaactactatggcaagctgctgccctacctgacgctgctgcccggcagggacttccgcatccacaacttccgaagccacccttggctcttcagagatgcaaggacacatgataagcttctggttaaccaaactgaattgtttgtgccatcttccaatgttaatggacagcctgtttttgccaacatcacactgcagtgtataccctgaaagagcaatgcctccaggttgtcggaagcctagtcaagcccaagaattacaggagactggacatcgtcagatcactctatgacgatctggaagatcatccaaatgtgattgaaagacctggagcggctgacgcaggagcacagtga

SEQ ID NO: 199312 - DNA, 8838 bp, Homo sapiens
  Payload ID: 19323
  Gene Name: von Willebrand factor
  Uniprot ID: P04275
  ENST ID: ENST00000261405
  CDS Start-End: 256-8697
gtggcagctcacagctattgtggtgggaaagggagggtggttggtggatgtcacagcttgggctttatctcccccagcagtggggactccacagcccctgggctacataacagcaagacagtccggagctgtagcagacctgattgagcctttgcagcagctgagagcatggcctagggtgggcggcaccattgtccagcagctgagtttcccagggaccttggagatagccgcagccctcatttgcaggggaagatgattcctgccagatttgccggggtgctgcttgctctggccctcattttgccagggaccctttgtgcagaaggaactcgcggcaggtcatccacggcccgatgcagccttttcggaagtgacttcgtcaacacctttgatgggagcatgtacagctttgcgggatactgcagttacctcctggcagggggctgccagaaacgctccttctcgattattggggacttccagaatggcaagagagtgagcctctccgtgtatcttggggaattttttgacatccatttgtttgtcaatggtaccgtgacacagggggaccaaagagtctccatgccctatgcctccaaagggctgtatctagaaactgaggctgggtactacaagctgtccggtgaggcctatggctttgtggccaggatcgatggcagcggcaactttcaagtcctgctgtcagacagatacttcaacaagacctgcgggctgtgtggcaactttaacatctttgctgaagatgactttatgacccaagaagggaccttgacctcggacccttatgactttgccaactcatgggctctgagcagtggagaacagtggtgtgaacgggcatctcctcccagcagctcatgcaacatctcctctggggaaatgcagaagggcctgtgggagcagtgccagcttctgaagagcacctcggtgtttgcccgctgccaccctctggtggaccccgagccttttgtggccctgtgtgagaagactttgtgtgagtgtgctggggggctggagtgcgcctgccctgccctcctggagtacgcccggacctgtgcccaggagggaatggtgctgtacggctggaccgaccacagcgcgtgcagcccagtgtgccctgctggtatggagtataggcagtgtgtgtccccttgcgccaggacctgccagagcctgcacatcaatgaaatgtgtcaggagcgatgcgtggatggctgcagctgccctgagggacagctcctggatgaaggcctctgcgtggagagcaccgagtgtccctgcgtgcattccggaaagcgctaccctcccggcacctccctctctcgagactgcaacacctgcatttgccgaaacagccagtggatctgcagcaatgaagaatgtccaggggagtgccttgtcacaggtcaatcacacttcaagagctttgacaacagatacttcaccttcagtgggatctgccagtacctgctggcccgggattgccaggaccactccttctccattgtcattgagactgtccagtgtgctgatgaccgcgacgctgtgtgcacccgctccgtcaccgtccggctgcctggcctgcacaacagccttgtgaaactgaagcatggggcaggagttgccatggatggccaggacgtccagctccccctcctgaaaggtgacctccgcatccagcatacagtgacggcctccgtgcgcctcagctacggggaggacctgcagatggactgggatggccgcgggaggctgctggtgaagctgtcccccgtctatgccgggaagacctgcggcctgtgtgggaattacaatggcaaccagggcgacgacttccttaccccctctgggctggcggagccccgggtggaggacttcgggaacgcctggaagctgcacggggactgccaggacctgcagaagcagcacagcgatccctgcgccctcaacccgcgcatgaccaggttctccgaggaggcgtgcgcggtcctgacgtcccccacattcgaggcctgccatcgtgccgtcagcccgctgccctacctgcggaactgccgctacgacgtgtgctcctgctcggacggccgcgagtgcctgtgcggcgccctggccagctatgccgcggcctgcgcggggagaggcgtgcgcgtcgcgtggcgcgagccaggccgctgtgagctgaactgcccgaaaggccaggtgtacctgcagtgcgggaccccctgcaacctgacctgccgctctctctcttacccggatgaggaatgcaatgaggcctgcctggagggctgcttctgccccccagggctctacatggatgagaggggggactgcgtgcccaaggcccagtgcccctgttactatgacggtgagatcttccagccagaagacatcttctcagaccatcacaccatgtgctactgtgaggatggcttcatgcactgtaccatgagtggagtccccggaagcttgctgcctgacgctgtcctcagcagtcccctgtctcatcgcagcaaaaggagcctatcctgtcggccccccatggtcaagctggtgtgtcccgctgacaacctgcgggctgaagggctcgagtgtaccaaaacgtgccagaactatgacctggagtgcatgagcatgggctgtgtctctggctgcctctgccccccgggcatggtccggcatgagaacagatgtgtggccctggaaaggtgtccctgcttccatcagggcaaggagtatgcccctggagaaacagtgaagattggctgcaacacttgtgtctgtcaggaccggaagtggaactgcacagaccatgtgtgtgatgccacgtgctccacgatcggcatggcccactacctcaccttcgacgggctcaaatacctgttccccggggagtgccagtacgttctggtgcaggattactgcggcagtaaccctgggacctttcggatcctagtggggaataagggatgcagccacccctcagtgaaatgcaagaaacgggtcaccatcctggtggagggaggagagattgagctgtttgacggggaggtgaatgtgaagaggcccatgaaggatgagactcactttgaggtggtggagtctggccggtacatcattctgctgctgggcaaagccctctccgtggtctgggaccgccacctgagcatctccgtggtcctgaagcagacataccaggagaaagtgtgtggcctgtgtgggaattttgatggcatccagaacaatgacctcaccagcagcaacctccaagtggaggaagaccctgtggactttgggaactcctggaaagtgagctcgcagtgtgctgacaccagaaaagtgcctctggactcatcccctgccacctgccataacaacatcatgaagcagacgatggtggattcctcctgtagaatccttaccagtgacgtcttccaggactgcaacaagctggtggaccccgagccatatctggatgtctgcatttacgacacctgctcctgtgagtccattggggactgcgcctgcttctgcgacaccattgctgcctatgcccacgtgtgtgcccagcatggcaaggtggtgacctggaggacggccacattgtgcccccagagctgcgaggagaggaatctccgggagaacgggtatgagtgtgagtggcgctataacagctgtgcacctgcctgtcaagtcacgtgtcagcaccctgagccactggcctgccctgtgcagtgtgtggagggctgccatgcccactgccctccagggaaaatcctggatgagcttttgcagacctgcgttgaccctgaagactgtccagtgtgtgaggtggctggccggcgttttgcctcaggaaagaaagtcaccttgaatcccagtgaccctgagcactgccagatttgccactgtgatgttgtcaacctcacctgtgaagcctgccaggagccgggaggcctggtggtgcctcccacagatgccccggtgagccccaccactctgtatgtggaggacatctcggaaccgccgttgcacgatttctactgcagcaggctactggacctggtcttcctgctggatggctcctccaggctgtccgaggctgagtttgaagtgctgaaggcctttgtggtggacatgatggagcggctgcgcatctcccagaagtgggtccgcgtggccgtggtggagtaccacgacggctcccacgcctacatcgggctcaaggaccggaagcgaccgtcagagctgcggcgcattgccagccaggtgaagtatgcgggcagccaggtggcctccaccagcgaggtcttgaaatacacactgttccaaatcttcagcaagatcgaccgccctgaagcctcccgcatcaccctgctcctgatggccagccaggagccccaacggatgtcccggaactttgtccgctacgtccagggcctgaagaagaagaaggtcattgtgatcccggtgggcattgggccccatgccaacctcaagcagatccgcctcatcgagaagcaggcccctgagaacaaggccttcgtgctgagcagtgtggatgagctggagcagcaaagggacgagatcgttagctacctctgtgaccttgcccctgaagcccctcctcctactctgccccccgacatggcacaagtcactgtgggcccggggctcttgggggtttcgaccctggggcccaagaggaactccatggttctggatgtggcgttcgtcctggaaggatcggacaaaattggtgaagccgacttcaacaggagcaaggagttcatggaggaggtgattcagcggatggatgtgggccaggacagcatccacgtcacggtgctgcagtactcctacatggtgactgtggagtaccccttcagcgaggcacagtccaaaggggacatcctgcagcgggtgcgagagatccgctaccagggcggcaacaggaccaacactgggctggccctgcggtacctctctgaccacagcttcttggtcagccagggtgaccgggagcaggcgcccaacctggtctacatggtcaccggaaatcctgcctctgatgagatcaagaggctgcctggagacatccaggtggtgcccattggagtgggccctaatgccaacgtgcaggagctggagaggattggctggcccaatgcccctatcctcatccaggactttgagacgctcccccgagaggctcctgacctggtgctgcagaggtgctgctccggagaggggctgcagatccccaccctctcccctgcacctgactgcagccagcccctggacgtgatccttctcctggatggctcctccagtttcccagcttcttattttgatgaaatgaagagtttcgccaaggctttcatttcaaaagccaatatagggcctcgtctcactcaggtgtcagtgctgcagtatggaagcatcaccaccattgacgtgccatggaacgtggtcccggagaaagcccatttgctgagccttgtggacgtcatgcagcgggagggaggccccagccaaatcggggatgccttgggctttgctgtgcgatacttgacttcagaaatgcatggtgccaggccgggagcctcaaaggcggtggtcatcctggtcacggacgtctctgtggattcagtggatgcagcagctgatgccgccaggtccaacagagtgacagtgttccctattggaattggagatcgctacgatgcagcccagctacggatcttggcaggcccagcaggcgactccaacgtggtgaagctccagcgaatcgaagacctccctaccatggtcaccttgggcaattccttcctccacaaactgtgctctggatttgttaggatttgcatggatgaggatgggaatgagaagaggcccggggacgtctggaccttgccagaccagtgccacaccgtgacttgccagccagatggccagaccttgctgaagagtcatcgggtcaactgtgaccgggggctgaggccttcgtgccctaacagccagtcccctgttaaagtggaagagacctgtggctgccgctggacctgcccctgcgtgtgcacaggcagctccactcggcacatcgtgacctttgatgggcagaatttcaagctgactggcagctgttcttatgtcctatttcaaaacaaggagcaggacctggaggtgattctccataatggtgcctgcagccctggagcaaggcagggctgcatgaaatccatcgaggtgaagcacagtgccctctccgtcgagctgcacagtgacatggaggtgacggtgaatgggagactggtctctgttccttacgtgggtgggaacatggaagtcaacgtttatggtgccatcatgcatgaggtcagattcaatcaccttggtcacatcttcacattcactccacaaaacaatgagttccaactgcagctcagccccaagacttttgcttcaaagacgtatggtctgtgtgggatctgtgatgagaacggagccaatgacttcatgctgagggatggcacagtcaccacagactggaaaacacttgttcaggaatggactgtgcagcggccagggcagacgtgccagcccatcctggaggagcagtgtcttgtccccgacagctcccactgccaggtcctcctcttaccactgtttgctgaatgccacaaggtcctggctccagccacattctatgccatctgccagcaggacagttgccaccaggagcaagtgtgtgaggtgatcgcctcttatgcccacctctgtcggaccaacggggtctgcgttgactggaggacacctgatttctgtgctatgtcatgcccaccatctctggtctacaaccactgtgagcatggctgtccccggcactgtgatggcaacgtgagctcctgtggggaccatccctccgaaggctgtttctgccctccagataaagtcatgttggaaggcagctgtgtccctgaagaggcctgcactcagtgcattggtgaggatggagtccagcaccagttcctggaagcctgggtcccggaccaccagccctgtcagatctgcacatgcctcagcgggcggaaggtcaactgcacaacgcagccctgccccacggccaaagctcccacgtgtggcctgtgtgaagtagcccgcctccgccagaatgcagaccagtgctgccccgagtatgagtgtgtgtgtgacccagtgagctgtgacctgcccccagtgcctcactgtgaacgtggcctccagcccacactgaccaaccctggcgagtgcagacccaacttcacctgcgcctgcaggaaggaggagtgcaaaagagtgtccccaccctcctgccccccgcaccgtttgcccacccttcggaagacccagtgctgtgatgagtatgagtgtgcctgcaactgtgtcaactccacagtgagctgtccccttgggtacttggcctcaactgccaccaatgactgtggctgtaccacaaccacctgccttcccgacaaggtgtgtgtccaccgaagcaccatctaccctgtgggccagttctgggaggagggctgcgatgtgtgcacctgcaccgacatggaggatgccgtgatgggcctccgcgtggcccagtgctcccagaagccctgtgaggacagctgtcggtcgggcttcacttacgttctgcatgaaggcgagtgctgtggaaggtgcctgccatctgcctgtgaggtggtgactggctcaccgcggggggactcccagtcttcctggaagagtgtcggctcccagtgggcctccccggagaacccctgcctcatcaatgagtgtgtccgagtgaaggaggaggtctttatacaacaaaggaacgtctcctgcccccagctggaggtccctgtctgcccctcgggctttcagctgagctgtaagacctcagcgtgctgcccaagctgtcgctgtgagcgcatggaggcctgcatgctcaatggcactgtcattgggcccgggaagactgtgatgatcgatgtgtgcacgacctgccgctgcatggtgcaggtgggggtcatctctggattcaagctggagtgcaggaagaccacctgcaacccctgccccctgggttacaaggaagaaaataacacaggtgaatgttgtgggagatgtttgcctacggcttgcaccattcagctaagaggaggacagatcatgacactgaagcgtgatgagacgctccaggatggctgtgatactcacttctgcaaggtcaatgagagaggagagtacttctgggagaagagggtcacaggctgcccaccctttgatgaacacaagtgtctggctgagggaggtaaaattatgaaaattccaggcacctgctgtgacacatgtgaggagcctgagtgcaacgacatcactgccaggctgcagtatgtcaaggtgggaagctgtaagtctgaagtagaggtggatatccactactgccagggcaaatgtgccagcaaagccatgtactccattgacatcaacgatgtgcaggaccagtgctcctgctgctctccgacacggacggagcccatgcaggtggccctgcactgcaccaatggctctgttgtgtaccatgaggttctcaatgccatggagtgcaaatgctcccccaggaagtgcagcaagtgaggctgctgcagctgcatgggtgcctgctgctgcctgccttggcctgatggccaggccagagtgctgccagtcctctgcatgttctgctcttgtgcccttctgagcccacaataaaggctgagctcttatcttgcaaaaggc

SEQ ID NO: 199313 - DNA, 709 bp, Homo sapiens
  Payload ID: 19323
  Gene Name: von Willebrand factor
  ENST ID: ENST00000538563
  CDS Start-End: 251-433
agctcacagctattgtggtgggaaagggagggtggttggtggatgtcacagcttgggctttatctcccccagcagtggggactccacagcccctgggctacataacagcaagacagtccggagctgtagcagacctgattgagcctttgcagcagctgagagcatggcctagggtgggcggcaccattgtccagcagctgagtttcccagggaccttggagatagccgcagccctcatttgcaggggaagatgattcctgccagatttgccggggtgctgcttgctctggccctcattttgccagagaccaggtgcctgcaaatgccatctcctgttggggaattaagaagcataaaggtggcacagaactgtcctatattatgggggcacaggatgaggaggaaggaatccaagacttggatggattattagttttcgataagattgtggaggtcaccttgttgaacctcccatggtacaatgaagagactgagggtcagagaggagaaatgactgctccaaagtctcctagagccaaaatcagagggaccctttgtgcagaaggaactcgcggcaggtcatccacggcccgatgcagccttttcggaagtgacttcgtcaacacctttgatgggagcatgtacagctttgcgggatactgcagttacctcctggcagggggctgccagaaacgctccttctcgatta

SEQ ID NO: 199314 - DNA, 1326 bp, Homo sapiens
  Payload ID: 19323
  Gene Name: von Willebrand factor
  ENST ID: ENST00000321023
  CDS Start-End: 251-433
agctcacagctattgtggtgggaaagggagggtggttggtggatgtcacagcttgggctttatctcccccagcagtggggactccacagcccctgggctacataacagcaagacagtccggagctgtagcagacctgattgagcctttgcagcagctgagagcatggcctagggtgggcggcaccattgtccagcagctgagtttcccagggaccttggagatagccgcagccctcatttgcaggggaagatgattcctgccagatttgccggggtgctgcttgctctggccctcattttgccagagaccaggtgcctgcaaatgccatctcctgttggggaattaagaagcataaaggtggcacagaactgtcctatattatgggggcacaggatgaggaggaaggaatccaagacttggatggattattagttttcgataagattgtggaggtcaccttgttgaacctcccatggtacaatgaagagactgagggtcagagaggagaaatgactgctccaaagtctcctagagccaaaatcagagggaccctttgtgcagaaggaactcgcggcaggtcatccacggcccgatgcagccttttcggaagtgacttcgtcaacacctttgatgggagcatgtacagctttgcgggatactgcagttacctcctggcagggggctgccagaaacgctccttctcgattattggggacttccagaatggcaagagagtgagcctctccgtgtatcttggggaattttttgacatccatttgtttgtcaatggtaccgtgacacagggggaccaaagagtctccatgccctatgcctccaaagggctgtatctagaaactgaggctgggtactacaagctgtccggtgaggcctatggctttgtggccaggatcgatggcagcggcaactttcaagtcctgctgtcagacagatacttcaacaagacctgcgggctgtgtggcaactttaacatctttgctgaagatgactttatgacccaagaagggaccttgacctcggacccttatgactttgccaactcatgggctctgagcagtggagaacagtggtgtgaacgggcatctcctcccagcagctcatgcaacatctcctctggggaaatgcagaaggtgggtgtggactggcctgggtgcacctggatggtgtgtgatttctggatctaaaagacagaaggactcagtctcatatccttccatctgggggaggaatggacttacgcagggccatttcctccaaaactaactgtggctagagtctaattctaatacatctcgagcctgaagctc

SEQ ID NO: 199315 - DNA, 4511 bp, Homo sapiens
  Payload ID: 19324
  Gene Name: von Willebrand factor A domain containing 1
  Uniprot ID: Q6PCB0
  ENST ID: ENST00000476993
  CDS Start-End: 79-1416
gcgcggtgacgcgccctgcagccccgagcgagcgagcgagcgagcgagttgccgagcgcgccccgtccctcgcgcgcgatgctcccctggacggcgctcggcctggccctgagcttgcggctggcgctggcgcggagcggcgcggagcgcggtccaccagcatcagccccccgaggggacctgatgttcctgctggacagctcagccagcgtctctcactacgagttctcccgggttcgggagtttgtggggcagctggtggctccactgcccctgggcaccggggccctgcgtgccagtctggtgcacgtgggcagtcggccatacaccgagttccccttcggccagcacagctcgggtgaggctgcccaggatgcggtgcgtgcttctgcccagcgcatgggtgacacccacactggcctggcgctggtctatgccaaggaacagctgtttgctgaagcatcaggtgcccggccaggggtgcccaaagtgctggtgtgggtgacagatggcggctccagcgaccctgtgggcccccccatgcaggagctcaaggacctgggcgtcaccgtgttcattgtcagcaccggccgaggcaacttcctggagctgtcagccgctgcctcagcccctgccgagaagcacctgcactttgtggacgtggatgacctgcacatcattgtccaagagctgaggggctccattctcgacgcgatgcggccgcagcagctccatgccacggagatcacgtccagcggcttccgcctggcctggccacccctgctgaccgcagactcgggctactatgtgctggagctggtgcccagcgcccagccgggggctgcaagacgccagcagctgccagggaacgccacggactggatctgggccggcctcgacccggacacggactacgacgtggcgctagtgcctgagtccaacgtgcgcctcctgaggccccagatcctgcgggtgcgcacgcggcccggtgaggcagggccgggggcttcgggcccggagtcgggggctgggccggcccccacgcagctcgccgccctccccgccccagaggaggccgggccagagcgcatcgtcatctcccacgcccggccgcgcagcctccgcgtgagttgggccccagcgctgggctcagccgcggcgctcggctaccacgtgcagttcgggccgctgcggggcggggaggcgcagcgggtggaggtgcccgcgggccgcaactgcaccacgctgcagggcctggcgccgggcaccgcctacctggtgaccgtgaccgccgccttccgctcgggccgcgagagcgcgctgtccgccaaggcctgcacgcccgacggcccgcgcccgcgcccacgccccgtgccccgcgccccgaccccggggaccgccagccgtgagccgtaagccggcgtccccgcccagccgagagggccggcgcctacctgagggcccctgtgtcccgaacccggagcggaggcgcccaacccggcagacgggtgcaggcccggcctttccccacgcggactccgcgcgaccccggccctctccctgcggccgcagggcttccccgcctggcgcctgccctccagggctggggcctcgcctggcgggaccccgcagcagccccggccccatccccgcccagagccgggcgtcgtgtgggtccgtgggtgataattgagagcgtcagacccaggactgttcagggaggagccccggtcagactcccacgtgtgaagaccgggccccaagtggcaagggctggcctggggcgggcagcttgggtcctggacgttgataggaagcggaaggggaatcgcgggaagctggcccaggtcaggtccgcaaaggcttctgaagaagaggaagggcgagtaggggcacctggacgctgatggtggccaggatgctcagctggccaggagggcagcacctgctggggacggtggccctgccttcatgcccaggacaccagctgggtccagctagcagccactgggaatcagaggaatggggcagagctgggcattcaggaccttgaggacacgtgaccccacccgcccaccgccactatcaggccccgggaccgcactgacaggaaaccttccgtcgtgagggagcacttcccaggggccgcagggacgacactctccagggaggccccagcaaccacaccatcttcttgctgtgagaggtctcaccccgggctacctcctgtcactactcactgccctggggtccgtgggcaagttgcccagggtgggggtgcctagccaggtgcagtccccgccccgcctagtcctcggcgtcacgcaatgctcacctcgcctcttccccactaacatcccagactttaaaattcagtaaatcagatgtacaccgagcctgcagtctcgctaggatgctttactcctccacaaacagcagccgccgacaggacagcttgtgaacgtctccgccttttggggtgtccggggagaggaggtggagctgtcccctcccagtgtcaggcctccttggtcctcatgtgcaccttttattcagagagcttgggcccccttcctttggagctgggcccagggcaggtggctggaatgcagaggacaagggggctggggcctctgcagggccattcccaccgcagtctctgccacggcccggagccctgggcccagggccacgcgggctccctctgctggcaaagccacaccctgcaccgcatggggtccactgcccctttccccacgtggactctgcgtgaccccaggaactgcagcattgaggtggtctcagtccctccctcaggtctggtgggcattgtgccaggggccaccttcgggacagctggccttggcaccgtctcccaagaacccagctctgtgcatcccgtggccccaccagaaacccaaggccacaccgcccaccagctgggtgtggtcaccattcatggagggccggctggggccaggctcaccacgcagagtttgccctccggtgtgatgatgcatgagacacagtaggcccccctgcctgtgtgtgcagggggtgtctgtgggggggccctgctggctggactttgggtttctcctgagctccccttagcccccaagtcaggccacggaggcctgagtaggacccatgggctgtgtgtgtcactgcaggtggcgtgctcacaactgcactgctggtcggcaggtggccagggttgcaggcccgggcctcgggccccacctcctctggaggggtaggatctccttcgtgcagcccctgccccctaccctgttctccggagtgttggcagatctgagcccacggtcacgtgagaggagatgcctcttgcacactgagcccaggcccagctcacggagcaccctgcaggtggcagcggggcaccaggggctcattcctggtggcctcagtggcttctgtggacgactcagactcacatgagaagctgggaggagctccagctctgcaatcccgagagggcagagcgggggccctggccacaaccctgctccccacatacccgtctggcagaggctctgcctcccctctgcccatctctgcacaccaaggctgagcacagcacaaggcctcacggagagggtgaaaaggcactgccgtctccatctcagtgccaaggaatgcccctttcagaagccctcgtctgagaagtgctgccccttatgtagccccaggcattttaaaatctttgaatctgcaccaagtctcagaacagctctggccccggagtgctccgtccaggccgctgtgaaccggctgtccccgcgtctcctccacctcccctgacacaatcctggccccgactcagtccacccagggtgcagtgcagaggctgatacccgccaggacttccttgccaagggcccggccacgtcacaaggccactgcacgcttttcgacatgcacctggaaatcgggaagggccatgctgcagttgcttctagttgagacgagaagagcgacaaggttgtgatccacgtggcaggtgttcagaaggctgggggcgggcagcgctggggagagccctgggtacttcgaggagaccccgaagggaggctgctcccacacctgcgccagtttccaccctctctgtgagcagggctgcggtcacctcccacatctgaagagaaccaacctgaggatttcacgctggctgcgtgccagaccagtccctgacaggttgtgcgaggcccttcgctggacagcccattgctggccactggacggagaggcagagggggctgaaattcgggcccatgcctctgtgagcgatgacggagcaacagctctccagcacgtgaagctctccagacagctgttcgtgagaagccagacagaggcctggggtctcagtccagatttctggggagtggggtgtccaagcgtgggccacgctgctgggagccacctagggaagcaggtcgcctgtttctatagtgacggtaataaaccaagtcaattttctatagtga

SEQ ID NO: 199316 - DNA, 2147 bp, Homo sapiens
  Payload ID: 19324
  Gene Name: von Willebrand factor A domain containing 1
  Uniprot ID: Q6PCB0
  ENST ID: ENST00000338660
  CDS Start-End: 227-421
tgtccctgcgtgtcggggtccgctcgtgcgcgcctctccggggtctgtgcgcgtggccctccgctcgcgccggagggcgtgggcgtggcctcggcgtgggtgtggccgctcggggaggggcctcccgggggcggggccggcctggtccgcgcggtgacgcgccctgcagccccgagcgagcgagcgagcgagcgagttgccgagcgcgccccgtccctcgcgcgcgatgctcccctggacggcgctcggcctggccctgagcttgcggctggcgctggcgcggagcggcgcggagcgcggagctcaaggacctgggcgtcaccgtgttcattgtcagcaccggccgaggcaacttcctggagctgtcagccgctgcctcagcccctgccgagaagcacctgcactttgtggacgtggatgacctgcacatcattgtccaagagctgaggggctccattctcgacgcgatgcggccgcagcagctccatgccacggagatcacgtccagcggcttccgcctggcctggccacccctgctgaccgcagactcgggctactatgtgctggagctggtgcccagcgcccagccgggggctgcaagacgccagcagctgccagggaacgccacggactggatctgggccggcctcgacccggacacggactacgacgtggcgctagtgcctgagtccaacgtgcgcctcctgaggccccagatcctgcgggtgcgcacgcggcccggtgaggcagggccgggggcttcgggcccggagtcgggggctgggccggcccccacgcagctcgccgccctccccgccccagaggaggccgggccagagcgcatcgtcatctcccacgcccggccgcgcagcctccgcgtgagttgggccccagcgctgggctcagccgcggcgctcggctaccacgtgcagttcgggccgctgcggggcggggaggcgcagcgggtggaggtgcccgcgggccgcaactgcaccacgctgcagggcctggcgccgggcaccgcctacctggtgaccgtgaccgccgccttccgctcgggccgcgagagcgcgctgtccgccaaggcctgcacgcccgacggcccgcgcccgcgcccacgccccgtgccccgcgccccgaccccggggaccgccagccgtgagccgtaagccggcgtccccgcccagccgagagggccggcgcctacctgagggcccctgtgtcccgaacccggagcggaggcgcccaacccggcagacgggtgcaggcccggcctttccccacgcggactccgcgcgaccccggccctctccctgcggccgcagggcttccccgcctggcgcctgccctccagggctggggcctcgcctggcgggaccccgcagcagccccggccccatccccgcccagagccgggcgtcgtgtgggtccgtgggtgataattgagagcgtcagacccaggactgttcagggaggagccccggtcagactcccacgtgtgaagaccgggccccaagtggcaagggctggcctggggcgggcagcttgggtcctggacgttgataggaagcggaaggggaatcgcgggaagctggcccaggtcaggtccgcaaaggcttctgaagaagaggaagggcgagtaggggcacctggacgctgatggtggccaggatgctcagctggccaggagggcagcacctgctggggacggtggccctgccttcatgcccaggacaccagctgggtccagctagcagccactgggaatcagaggaatggggcagagctgggcattcaggaccttgaggacacgtgaccccacccgcccaccgccactatcaggccccgggaccgcactgacaggaaaccttccgtcgtgagggagcacttcccaggggccgcagggacgacactctccagggaggccccagcaaccacaccatcttcttgctgtgagaggtctcaccccgggctacctcctgtcactactcactgccctggggtccgtgggcaagttgcccagggtgggggtgcctagccaggtgcagtccccgccccgcctagtcctcggcgtcacgcaatgctcacctcgcctcttccccactaacatcccagactttaaaattcagtaaatcagatgtacaccg

SEQ ID NO: 199317 - DNA, 819 bp, Homo sapiens
  Payload ID: 19324
  Gene Name: von Willebrand factor A domain containing 1
  ENST ID: ENST00000495558
  CDS Start-End: 319-819
cagccacctctcgtctgggcctcaccaagaccccaagactcaagagctcctgtctcaccagtgggaccctccagtcctgctgggggtgtgtcctgggtcctggagtctgggcccctcactgggtagggtatatgggtaacaggcccagtgtggtcccactggacagggcctcaaccaaccatctcccactcccatgcctcttcctccaagaagcccaggtggcgtgggtgcttcgagtctctctcgaattcctgtcttctgtcccctttcaagccactgtgtccttgtccaccagcatcagccccccgaggggacctgatgttcctgctggacagctcagccagcgtctctcactacgagttctcccgggttcgggagtttgtggggcagctggtggctccactgcccctgggcaccggggccctgcgtgccagtctggtgcacgtgggcagtcggccatacaccgagttccccttcggccagcacagctcgggtgaggctgcccaggatgcggtgcgtgcttctgcccagcgcatgggtgacacccacactggcctggcgctggtctatgccaaggaacagctgtttgctgaagcatcaggtgcccggccaggggtgcccaaagtgctggtgtgggtgacagatggcggctccagcgaccctgtgggcccccccatgcaggagctcaaggacctgggcgtcaccgtgttcattgtcagcaccggccgaggcaacttcctggagctgtcagccgctgcctcagcccctgccgagaagcacctgcactttgtggacgtggatgacctgcacatcattgtc

SEQ ID NO: 199318 - DNA, 458 bp, Homo sapiens
  Payload ID: 19324
  Gene Name: von Willebrand factor A domain containing 1
  ENST ID: ENST00000471398
  CDS Start-End: 15-458
gtccctcgcgcgcgatgctcccctggacggcgctcggcctggccctgagcttgcggctggcgctggcgcggagcggcgcggagcgcggacctttgggagaaggcaagcatccacttaaggaaagctggggccctgggggaccctgccttgctgtggggctgtctggggggcccacacctgaggctgagcattcctcctttcccccaggtccaccagcatcagccccccgaggggacctgatgttcctgctggacagctcagccagcgtctctcactacgagttctcccgggttcgggagtttgtggggcagctggtggctccactgcccctgggcaccggggccctgcgtgccagtctggtgcacgtgggcagtcggccatacaccgagttccccttcggccagcacagctcgggtgaggctgcccaggatgcggtgcgtgcttctgcccagcgcatg

SEQ ID NO: 199319 - DNA, 2794 bp, Homo sapiens
  Payload ID: 19325
  Gene Name: von Willebrand factor A domain containing 2
  Uniprot ID: Q5GFL6
  ENST ID: ENST00000392982
  CDS Start-End: 251-2518
ggccgatgccgctttaaaaaacgcgaggggctctatgcacctccctggcggtagttcctccgacctcagccgggtcgggtcgtgccgccctctcccaggagagacaaacaggtgtcccacgtggcagccgcgccccgggcgcccctcctgtgatcccgtagcgccccctggcccgagccgcgcccgggtctgtgagtagagccgcccgggcaccgagcgctggtcgccgctctccttccgttatatcaacatgccccctttcctgttgctggaagccgtctgtgttttcctgttttccagagtgcccccatctctccctctccaggaagtccatgtaagcaaagaaaccatcgggaagatttcagctgccagcaaaatgatgtggtgctcggctgcagtggacatcatgtttctgttagatgggtctaacagcgtcgggaaagggagctttgaaaggtccaagcactttgccatcacagtctgtgacggtctggacatcagccccgagagggtcagagtgggagcattccagttcagttccactcctcatctggaattccccttggattcattttcaacccaacaggaagtgaaggcaagaatcaagaggatggttttcaaaggagggcgcacggagacggaacttgctctgaaataccttctgcacagagggttgcctggaggcagaaatgcttctgtgccccagatcctcatcatcgtcactgatgggaagtcccagggggatgtggcactgccatccaagcagctgaaggaaaggggtgtcactgtgtttgctgtgggggtcaggtttcccaggtgggaggagctgcatgcactggccagcgagcctagagggcagcacgtgctgttggctgagcaggtggaggatgccaccaacggcctcttcagcaccctcagcagctcggccatctgctccagcgccacgccagactgcagggtcgaggctcacccctgtgagcacaggacgctggagatggtccgggagttcgctggcaatgccccatgctggagaggatcgcggcggacccttgcggtgctggctgcacactgtcccttctacagctggaagagagtgttcctaacccaccctgccacctgctacaggaccacctgcccaggcccctgtgactcgcagccctgccagaatggaggcacatgtgttccagaaggactggacggctaccagtgcctctgcccgctggcctttggaggggaggctaactgtgccctgaagctgagcctggaatgcagggtcgacctcctcttcctgctggacagctctgcgggcaccactctggacggcttcctgcgggccaaagtcttcgtgaagcggtttgtgcgggccgtgctgagcgaggactctcgggcccgagtgggtgtggccacatacagcagggagctgctggtggcggtgcctgtgggggagtaccaggatgtgcctgacctggtctggagcctcgatggcattcccttccgtggtggccccaccctgacgggcagtgccttgcggcaggcggcagagcgtggcttcgggagcgccaccaggacaggccaggaccggccacgtagagtggtggttttgctcactgagtcacactccgaggatgaggttgcgggcccagcgcgtcacgcaagggcgcgagagctgctcctgctgggtgtaggcagtgaggccgtgcgggcagagctggaggagatcacaggcagcccaaagcatgtgatggtctactcggatcctcaggatctgttcaaccaaatccctgagctgcaggggaagctgtgcagccggcagcggccagggtgccggacacaagccctggacctcgtcttcatgttggacacctctgcctcagtagggcccgagaattttgctcagatgcagagctttgtgagaagctgtgccctccagtttgaggtgaaccctgacgtgacacaggtcggcctggtggtgtatggcagccaggtgcagactgccttcgggctggacaccaaacccacccgggctgcgatgctgcgggccattagccaggccccctacctaggtggggtgggctcagccggcaccgccctgctgcacatctatgacaaagtgatgaccgtccagaggggtgcccggcctggtgtccccaaagctgtggtggtgctcacaggcgggagaggcgcagaggatgcagccgttcctgcccagaagctgaggaacaatggcatctctgtcttggtcgtgggcgtggggcctgtcctaagtgagggtctgcggaggcttgcaggtccccgggattccctgatccacgtggcagcttacgccgacctgcggtaccaccaggacgtgctcattgagtggctgtgtggagaagccaagcagccagtcaacctctgcaaacccagcccgtgcatgaatgagggcagctgcgtcctgcagaatgggagctaccgctgcaagtgtcgggatggctgggagggcccccactgcgagaaccgattcttgagacgcccctgaggcacatggctcccgtgcaggagggcagcagccgtacccctcccagcaactacagagaaggcctgggcactgaaatggtgcctaccttctggaatgtctgtgccccaggtccttagaatgtctgcttcccgccgtggccaggaccactattctcactgagggaggaggatgtcccaactgcagccatgctgcttagagacaagaaagcagctgatgtcacccacaaacgatgttgttgaaaagttttgatgtgtaagtaaatacccactttctgta

SEQ ID NO: 199320 - DNA, 2600 bp, Homo sapiens
  Payload ID: 19325
  Gene Name: von Willebrand factor A domain containing 2
  Uniprot ID: Q5GFL6
  ENST ID: ENST00000603594
  CDS Start-End: 1007-2272
ggggctctatgcacctccctggcggtagttcctccgacctcagccgggtcgggtcgtgccgccctctcccaggagagacaaacaggtgtcccacgtggcagccgcgccccgggcgcccctcctgtgatcccgtagcgccccctggcccgagccgcgcccgggtctgtgagtagagccgcccgggcaccgagcgctggtcgccgctctccttccgttatatcaacatgccccctttcctgttgctggaagccgtctgtgttttcctgttttccagagtgcccccatctctccctctccaggaagtccatgtaagcaaagaaaccatcgggaagatttcagctgccagcaaaagtcagagtgggagcattccagttcagttccactcctcatctggaattccccttggattcattttcaacccaacaggaagtgaaggcaagaatcaagaggatggttttcaaaggagggcgcacggagacggaacttgctctgaaataccttctgcacagagggttgcctggaggcagaaatgcttctgtgccccagatcctcatcatcgtcactgatgggaagtcccagggggatgtggcactgccatccaagcagctgaaggaaaggggtgtcactgtgtttgctgtgggggtcaggtttcccaggtgggaggagctgcatgcactggccagcgagcctagagggcagcacgtgctgttggctgagcaggtggaggatgccaccaacggcctcttcagcaccctcagcagctcggccatctgctccagcgccacgccagactgcagggtcgaggctcacccctgtgagcacaggacgctggagatggtccgggagttcgctggcaatgccccatgctggagaggatcgcggcggacccttgcggtgctggctgcacactgtcccttctacagctggaagagagtgttcctaacccaccctgccacctgctacaggaccacctgcccaggcccctgtgactcgcagccctgccagaatggaggcacatgtgttccagaaggactggacggctaccagtgcctctgcccgctggcctttggaggggaggctaactgtggtagccctgaagctgagcctggaatgcagggtcgacctcctcttcctgctggacagctctgcgggcaccactctggacggcttcctgcgggccaaagtcttcgtgaagcggtttgtgcgggccgtgctgagcgaggactctcgggcccgagtgggtgtggccacatacagcagggagctgctggtggcggtgcctgtgggggagtaccaggatgtgcctgacctggtctggagcctcgatggcattcccttccgtggtggccccaccctgacgggcagtgccttgcggcaggcggcagagcgtggcttcgggagcgccaccaggacaggccaggaccggccacgtagagtggtggttttgctcactgagtcacactccgaggatgaggttgcgggcccagcgcgtcacgcaagggcgcgagagctgctcctgctgggtgtaggcagtgaggccgtgcgggcagagctggaggagatcacaggcagcccaaagcatgtgatggtctactcggatcctcaggatctgttcaaccaaatccctgagctgcaggggaagctgtgcagccggcagcggccagggtgccggacacaagccctggacctcgtcttcatgttggacacctctgcctcagtagggcccgagaattttgctcagatgcagagctttgtgagaagctgtgccctccagtttgaggtgaaccctgacgtgacacaggtcggcctggtggtgtatggcagccaggtgcagactgccttcgggctggacaccaaacccacccgggctgcgatgctgcgggccattagccaggccccctacctaggtggggtgggctcagccggcaccgccctgctgcacatctatgacaaagtgatgaccgtccagaggggtgcccggcctggtgtccccaaagctgtggtggtgctcacaggcgggagaggcgcagaggatgcagccgttcctgcccagaagctgaggaacaatggcatctctgtcttggtcgtgggcgtggggcctgtcctaagtgagggtctgcggaggcttgcaggtccccgggattccctgatccacgtggcagcttacgccgacctgcggtaccaccaggacgtgctcattgagtggctgtgtggaggtgagtgggggaatccacaccctcagggctgcccccatggcaggccctcagcctgagccttcacatacatcatgacgaggatggcagctcttcccagctactgagcacttgcttcccaagtgccaggttctgtgctaaaccccatgctcacataaaatcctacagtaggcataaccatcctatttgacatttaaggtacagaaagtttaactaacatagataactccccccaaacttgagaatttatgcattccctttaaacagaacacacttttagaatatccacaagcttcctaagggtctaaagatcccacattcacactgacttgggcagtgacagagcccagagcaaacagggccaggccagcccaaatccagtgacct

SEQ ID NO: 199321 - DNA, 2513 bp, Homo sapiens
  Payload ID: 19326
  Gene Name: von Willebrand factor A domain containing 3A
  ENST ID: ENST00000299840
  CDS Start-End: 1-1288
gcatgacgctcctctcaccattgagtttccaaacttggacaagacttctgcagagtggcttaaggtcaatggtctgaaagccaagaaattaagtctatatcaggtcctggcacccaatgcattctctcctgtggaggaatttgtacctattctccagaaaacagtatcatcgaccatccatgagaaggcaatgatacaatttgaatggcacgacgggacagtgaagaacattcatgtggacccacccttcctctataagtaccagcaacagctcagcagagctatgcggatgtatgagaggcggattgagtggctctccctggccagcagaagaatctggggcacagtctgtgaaaaaagggtggttgtactgctcgatatctctgcgaccaattccatgtacattattcatatccagcactccctgcggctgctgctggaggagcagttatccaacaaggactgtttcaacctcatcgcgtttggaagcacaattgaaagctggaggcctgagatggttcccgtgagtcacaacaatttacaaagtgcctggcggtgggccctgaacctgcggtgtcggggcagcaggaacgttctcagcgccctgcggaaggctgtggaagtagacttcaaggacaaagacaaacaccaatcgcagggaatctacctcttcactgggggcatccccgaccaggacatgcctacactcagtgcctacatggctgaggcctgtggcggctgcgacctccagctgaacgtgtgtctcttctacgtgggcgagccaaagatggacaccacaccccctgcccgctatgccagtcacactgacacagccgccgcctacaaggaggtcacccgggctgcaggtggccgcttccactggtttggagacacaggcatttatgagagcgatgacatcaactccatcatgtctgagatggaaaaggctctcaactactcccaaaagtgtgccttcctcatggcctccctgaagaaccattcaggaaaagtactgggaagttcagccctcccgaaagaaaaaccaaagacacttcagctaagaagtcagcccaagaagctctgccctcccaggcccaccgtccccctgggggccagaatgagcattaaagatgaccctgacagagagaagagccccccgctgaaatctctgaaatggcgtccactcagtagcagagttggcatctcaccaggtatggcagagtggctcagagcagagttctggagtcagcaggaccagctgcggcccagccaacgaaagaagggatgatggaactgaggaggaagaccaagtcaagggaagcagagacatctcttttactgttctacacagagaaagggaatgacgtgggctcagtgtacaagaagtaccctcaaggaaggggcttgagaaggactagctcttctattgacttacccagaaaggatacagtttgctcaagccaagagtgggtggcaaaatatgggctcaaaaaattgaagctggagatttccagatgcatgggtcccaactgcactcatcaaaagtcaggacagaggtcagcatccgccaaacactgcagcatcttccccagcgttgagatccatggagtggtgagacacatccagtggacgcccagggagatggaggtgtacatcaggcacttggagaaggtgttaaggcgctatgtccagaggctgcagtggctgctgtccgggagccgccgactgtttggcaccgttttggagagcaaagtatgcatattgctggacacgtcagggtccatgggcccctacctgcagcaggtgaagacagagctggttttgctgatttgggaacagctgcggaagtgctgtgacagttttaacctgctcagctttgcagagagctttcagtcatggcaggacacgctggtggagaccacagatgcagcgtgtcatgaggctatgcaatgggtgacccacctgcaagctcagggcagcacctccatcttgcaagcattgctgaaagctttcagtttccatgatctggaaggattgtacctcctgaccgacggaaagccagacacaagctgcagccttgtcctaaatgaagtccaaaaactcagggagaaaagagatgtgaaagtgcacaccatttccttgaactgctcagacagagcggcggttgagttcctgagaaagctggcttccttcaccggcggacgctatcactgccctgtgggtgaggacacactctccaaaattcacagcctgctgaccaaaggcttcatcaatgaaaaggatcccacattgccaccatttgaaggagatgatttaaggatcctggcccaggagatcaccaaggccagaagcttcctctggcaggcccaatccttcagatcccaactccagaagaaaaatgatgcagaaccaaaggtcactctttcctagagaagtgttctcagaaaagtcatcctgcaaaggaccactcactgagcaaatctcagccccgagggcaggatgggatgaaatgc

SEQ ID NO: 199322 - DNA, 4600 bp, Homo sapiens
  Payload ID: 19326
  Gene Name: von Willebrand factor A domain containing 3A
  Uniprot ID: A6NCI4
  ENST ID: ENST00000389398
  CDS Start-End: 97-3651
agttgcttggaggagcttggagaaaccagaagtgagatccaggagaagtaaggccctggagtgccaggagcccttctcccaaagatggagaaataaatgaagaaatacaggaaaataagcattgggtgttttgcaatggctacacaaactagtcatgtcttccatggtcaagaaaatatgtttctggaaaaccattgcattaggagaaacactggcagagattcaaagaagccactaaagcagaagaatatgaatggacttgggcaaaattcggacaatggattattggttacacatgttaaccagacacaggacttactgaggctgcaggggagtgagacccagtcttcagattgggaggactctgaagactggctttcggctcacagtttaaaatgtcagaaactcaccttggctgacctgataagccagggcacagaagtgctggaggagggcaccaatgtcgtgcagaaaatatgtttctccacccagatcatccgccattttgagtcaaagctttctgacactattgaagtctatcaagagagaattcagtggctcacagaaaacagcaagaaggcatttggcctcatcaaaggggccagagtcagcatcctcatagatgtgtcagccatcagcagtggccctcagaaagaagagttccaaaaggacctcatgagcctcatcgatgagcagctgagccacaaggagaagctgtttgtcctgtcctttggcaccaatgccgggtccctctggccagaccccatggaagtcagcgcctccaccctccaggaacttaagctctgggtaaagacgctgcagcctgatggaggcagcaacctgctacaagctctgaagaagatcttcactctcaagggactggattccctggtggccatcatgagaagctgcccagatcagccttctgaaatcctgtctgactacatccagcagtccaccatgggaagagacctcatcatccacttcatcacctacagatgcgatgatcagatgccccctgctgtcctgaagaaccttgcagaagctgttaggggctactaccactgctacagcccaaagatggagcactacaccagccgggacatggatgagctcctggcagaaattcagaaggcccagagcctcctcagccacgtgcaagccctgcagcacagcagcccctgtgaggcgctcacctgcaccatggaggagatttccacagagattacaaatgggccactcataagcctcttgcctaaacccccaaagcatgacgctcctctcaccattgagtttccaaacttggacaagacttctgcagagtggcttaaggtcaatggtctgaaagccaagaaattaagtctatatcaggtcctggcacccaatgcattctctcctgtggaggaatttgtacctattctccagaaaacagtatcatcgaccatccatgagaaggcaatgatacaatttgaatggcacgacgggacagtgaagaacattcatgtggacccacccttcctctataagtaccagcaacagctcagcagagctatgcggatgtatgagaggcggattgagtggctctccctggccagcagaagaatctggggcacagtctgtgaaaaaagggtggttgtactgctcgatatctctgcgaccaattccatgtacattattcatatccagcactccctgcggctgctgctggaggagcagttatccaacaaggactgtttcaacctcatcgcgtttggaagcacaattgaaagctggaggcctgagatggttcccgtgagtcacaacaatttacaaagtgcctggcggtgggccctgaacctgcggtgtcggggcagcaggaacgttctcagcgccctgcggaaggctgtggaagtagacttcaaggacaaagacaaacaccaatcgcagggaatctacctcttcactgggggcatccccgaccaggacatgcctacactcagtgcctacatggctgaggcctgtggcggctgcgacctccagctgaacgtgtgtctcttctacgtgggcgagccaaagatggacaccacaccccctgcccgctatgccagtcacactgacacagccgccgcctacaaggaggtcacccgggctgcaggtggccgcttccactggtttggagacacaggcatttatgagagcgatgacatcaactccatcatgtctgagatggaaaaggctctcaactactcccaaaagtgtgccttcctcatggcctccctgaagaaccattcaggaaaagtactgggaagttcagccctcccgaaagaaaaaccaaagacacttcagctaagaagtcagcccaagaagctctgccctcccaggcccaccgtccccctgggggccagaatgagcattaaagatgaccctgacagagagaagagccccccgctgaaatctctgaaatggcgtccactcagtagcagagttggcatctcaccagctgcggcccagccaacgaaagaagggatgatggaactgaggaggaagaccaagtcaagggaagcagagacatctcttttactgttctacacagagaaagggaatgacgtgggctcagtgtacaagaagtaccctcaaggaaggggcttgagaaggactagctcttctattgacttacccagaaaggatacagtttgctcaagccaagagtgggtggcaaaatatgggctcaaaaaattgaagctggagatttccagatgcatgggtcccaactgcactcatcaaaagtcaggacagaggtcagcatccgccaaacactgcagcatcttccccagcgttgagatccatggagtggtgagacacatccagtggacgcccagggagatggaggtgtacatcaggcacttggagaaggtgttaaggcgctatgtccagaggctgcagtggctgctgtccgggagccgccgactgtttggcaccgttttggagagcaaagtatgcatattgctggacacgtcagggtccatgggcccctacctgcagcaggtgaagacagagctggttttgctgatttgggaacagctgcggaagtgctgtgacagttttaacctgctcagctttgcagagagctttcagtcatggcaggacacgctggtggagaccacagatgcagcgtgtcatgaggctatgcaatgggtgacccacctgcaagctcagggcagcacctccatcttgcaagcattgctgaaagctttcagtttccatgatctggaaggattgtacctcctgaccgacggaaagccagacacaagctgcagccttgtcctaaatgaagtccaaaaactcagggagaaaagagatgtgaaagtgcacaccatttccttgaactgctcagacagagcggcggttgagttcctgagaaagctggcttccttcaccggcggacgctatcactgccctgtgggtgaggacacactctccaaaattcacagcctgctgaccaaaggcttcatcaatgaaaaggatcccacattgccaccatttgaaggagatgatttaaggatcctggcccaggagatcaccaaggccagaagcttcctctggcaggcccaatccttcagatcccaactccagaagaaaaatgatgcagaaccaaaggtcactctttcctagagaagtgttctcagaaaagtcatcctgcaaaggaccactcactgagcaaatctcagccccgagggcaggatgggatgaaatgctgtgacctgcaggaaacatgattcctggtaccaggactctctggaagctgaggaaggaaagactttgtcttttgtgtgaggggccattcccgggtcttaatctaactctccagccctgtcccgcagcgcactctactctccagccactagattgtccctctctgggaagccctaaaccaaccccctgcctaaatggtggtgcttcttgcaaaccaaccccctgcctgaacggtgcttcttgccccctctgcctggagactcctgctcatccatcaaggcacagctcaaatgacatcagctccctgggacctatctagagcgaggggcctccagtctttctcttgcagcatcctgaccacgcagacctctcgcactcagcactctatgtcacgccaccttgctcgctgatctaactcttctccttgatggtgagctccttcgggatgagactggtgtcccaggatctgcaggtccccagaagctgccacataggagacacatggtgaacagtgagcaggcggctgagctgtgagagcctagctctggaaagcagctgatggggtggtctccaccctggttcataagaggctaatgcagagtcacagtcagcccatcctgggggaagaagaaacaagtgagcctcagcaccaccctccatccctgcccaaccaaactgaagtgaaggctgctcatctgggttcattttctaaaattaaaaacaattaattttattctactaataggatcaacatgactttaactgtttgaagtgatcattggcgtgtgtgtgtgtgcataaatttttagtgacataaaactttattaaaagactcataccataataaagaatttcaataagaaaaaga

SEQ ID NO: 199323 - DNA, 861 bp, Homo sapiens
  Payload ID: 19326
  Gene Name: von Willebrand factor A domain containing 3A
  Uniprot ID: A6NCI4
  ENST ID: ENST00000563755
  CDS Start-End: 1-861
atggaggtgtacatcaggcacttggagaaggtgttaaggcgctatgtccagaggctgcagtggctgctgtccggtccagtcctctgcagtaggacctggtatagacagtccatggacaggggcgtcatgatgactgctgcttcagggagccgccgactgtttggcaccgttttggagagcaaagtatgcatattgctggacacgtcagggtccatgggcccctacctgcagcaggtgaagacagagctggttttgctgatttgggaacagctgcggaagtgctgtgacagttttaacctgctcagctttgcagagagctttcagtcatggcaggacacgctggtggagaccacagatgcagcgtgtcatgaggctatgcaatgggtgacccacctgcaagctcagggcagcacctccatcttgcaagcattgctgaaagctttcagtttccatgatctggaaggattgtacctcctgaccgacggaaagccagacacaagctgcagccttgtcctaaatgaagtccaaaaactcagggagaaaagagatgtgaaagtgcacaccatttccttgaactgctcagacagagcggcggttgagttcctgagaaagctggcttccttcaccggcggacgctatcactgccctgtgggtgaggacacactctccaaaattcacagcctgctgaccaaaggcttcatcaatgaaaaggatcccacattgccaccatttgaaggagatgatttaaggatcctggcccaggagatcaccaaggccagaagcttcctctggcaggcccaatccttcagatcccaactccagaagaaaaatgatgcagaaccaaaggtcactctttcctag

SEQ ID NO: 199324 - DNA, 478 bp, Homo sapiens
  Payload ID: 19326
  Gene Name: von Willebrand factor A domain containing 3A
  ENST ID: ENST00000563389
  CDS Start-End: 1-444
atccccgaccaggacatgcctacactcagtgcctacatggctgaggcctgtggcggctgcgacctccagctgaacgtgtgtctcttctacgtgggcgagccaaagatggacaccacaccccctgcccgctatgccagtcacactgacacagccgccgcctacaaggaggtcacccgggctgcaggtggccgcttccactggtttggagacacaggcatttatgagagcgatgacatcaactccatcatgtctgagatggaaaaggctctcaactactcccaaaagtgtgccttcctcatggcctccctgaagaaccattcaggaaaagtactgggaagttcagccctcccgaaagaaaaaccaaagacacttcagctaagaagtcagcccaagaagctctgccctcccaggcccaccgtccccctgggggccagaatggtttgactcccctcctaataacacgcagaagatttggttt

SEQ ID NO: 199325 - DNA, 593 bp, Homo sapiens
  Payload ID: 19326
  Gene Name: von Willebrand factor A domain containing 3A
  ENST ID: ENST00000567131
  CDS Start-End: 499-593
tgagttgcttggaggagcttggagaaaccagaagtgagatccaggagaagtaaggccctggagtgccaggagcccttctcccaaagatggagaaataaatgaagaaatacaggaaaataagcattgggtgttttgcaatggctacacaaactagtcatgtcttccatggtcaagaaaatatgtttctggaaaaccattgaggctgcaggggagtgagacccagtcttcagattgggaggactctgaagactggctttcggctcacagtttaaaatgtcagaaactcaccttggctgacctgataagccagggcacagaagtgctggaggagggcaccaatgtcgtgcagaaaatatgtttctccacccagatcatccgccattttgagtcaaagctttctgagcatttggcctcatcaaaggggccagagtcagcatcctcatagatgtgtcagccatcagcagtggccctcagaaagaagagttccaaaaggacctcatgagcctcatcgatgagcagctgagccacaaggagaagctgtttgtcctgtcctttggcaccaatgccgggtccctctggccagaccccatgga

SEQ ID NO: 199326 - DNA, 2336 bp, Homo sapiens
  Payload ID: 19326
  Gene Name: von Willebrand factor A domain containing 3A
  ENST ID: ENST00000568328
  CDS Start-End: 97-2336
agttgcttggaggagcttggagaaaccagaagtgagatccaggagaagtaaggccctggagtgccaggagcccttctcccaaagatggagaaataaatgaagaaatacaggaaaataagcattgggtgttttgcaatggctacacaaactagtcatgtcttccatggtcaagaaaatatgtttctggaaaaccattgcattaggagaaacactggcagagattcaaagaagccactaaagcagaagaatatgaatggacttgggcaaaattcggacaatggattattggttacacatgttaaccagacacaggacttactgaggctgcaggggagtgagacccagtcttcagattgggaggactctgaagactggctttcggctcacagtttaaaatgtcagaaactcaccttggctgacctgataagccagggcacagaagtgctggaggagggcaccaatgtcgtgcagaaaatatgtttctccacccagatcatccgccattttgagtcaaagctttctgacactattgaagtctatcaagagagaattcagtggctcacagaaaacagcaagaaggcatttggcctcatcaaaggggccagagtcagcatcctcatagatgtgtcagccatcagcagtggccctcagaaagaagagttccaaaaggacctcatgagcctcatcgatgagcagctgagccacaaggagaagctgtttgtcctgtcctttggcaccaatgccgggtccctctggccagaccccatggaagtcagcgcctccaccctccaggaacttaagctctgggtaaagacgctgcagcctgatggaggcagcaacctgctacaagctctgaagaagatcttcactctcaagggactggattccctggtggccatcatgagaagctgcccagatcagccttctgaaatcctgtctgactacatccagcagtccaccatgggaagagacctcatcatccacttcatcacctacagatgcgatgatcagatgccccctgctgtcctgaagaaccttgcagaagctgttaggggctactaccactgctacagcccaaagatggagcactacaccagccgggacatggatgagctcctggcagaaattcagaaggcccagagcctcctcagccacgtgcaagccctgcagcacagcagcccctgtgaggcgctcacctgcaccatggaggagatttccacagagattacaaatgggccactcataagcctcttgcctaaacccccaaagcatgacgctcctctcaccattgagtttccaaacttggacaagacttctgcagagtggcttaaggtcaatggtctgaaagccaagaaattaagtctatatcaggtcctggcacccaatgcattctctcctgtggaggaatttgtacctattctccagaaaacagtatcatcgaccatccatgagaaggcaatgatacaatttgaatggcacgacgggacagtgaagaacattcatgtggacccacccttcctctataagtaccagtggaatgattatactgcctggattcccagggacttgacacaccattccctgaagcccacccagcaacagctcagcagagctatgcggatgtatgagaggcggattgagtggctctccctggccagcagaagaatctggggcacagtctgtgaaaaaagggtggttgtactgctcgatatctctgcgaccaattccatgtacattattcatatccagcactccctgcggctgctgctggaggagcagttatccaacaaggactgtttcaacctcatcgcgtttggaagcacaattgaaagctggaggcctgagatggttcccgtgagtcacaacaatttacaaagtgcctggcggtgggccctgaacctgcggtgtcggggcagcaggaacgttctcagcgccctgcggaaggctgtggaagtagacttcaaggacaaagacaaacaccaatcgcagggaatctacctcttcactgggggcatccccgaccaggacatgcctacactcagtgcctacatggctgaggcctgtggcggctgcgacctccagctgaacgtgtgtctcttctacgtgggcgagccaaagatggacaccacaccccctgcccgctatgccagtcacactgacacagccgccgcctacaaggaggtcacccgggctgcaggtggccgcttccactggtttggagacacaggcatttatgagagcgatgacatcaactccatcatgtctgagatggaaaaggctctcaactactcccaaaagtgtgccttcctcatggcctccctgaagaaccattcagg

SEQ ID NO: 199327 - DNA, 2642 bp, Homo sapiens
  Payload ID: 19327
  Gene Name: von Willebrand factor A domain containing 3B
  Uniprot ID: Q502W6
  ENST ID: ENST00000433678
  CDS Start-End: 220-2094
gtcacagagacctagaacagctggaatccttcgcccccggcgcgcagccttcgcccgccggaatcgctgccttatccaccagcgggatgcttacctcgcccgccctctcgggtcaggcgggcccgggaggatgggagggtggctgctgagcgggagccgccacgtcttccacccgacatattgcctagagtttgctgtgacttagatcttgattcagagatggagaaatcaggcccatcttctaccatctctgagcagcagctgcagaggcaagagggatggattaacaccaaaacagacttggctgagcagagtctcatttcatctgagaaatggcttcaactgcatgggcttaagagcaacaaattgaccttgaaacagattttgtcacagatcggattcccacattgtgaagattatgtggcgtctctggggagacctgtggcttctcggtatgctgatggtctgtttccacagctctacagagcagaagatggcagagtatacaatctgacagctaaatcagaactgatttatcagtttgtggaacatttaacacaagctgtggagagctacaagcagcgaatggactggctcaccagcaagagccggcagatttttggtgtcatcttggaacagtgcgtcaccatagtgctggattttggcggcattctggagggggagcttgatctgtgccgagaggctctaacaatggttctccaggagcaggtggctcacataaccgagttcaatatcatacgggtttctcaagagcctgtgaagtggcaggaaaatgctactcctgtgaccgaacagtccatagctactgccatcagttgggttgagaaactgacggttgagctgactgtgagcgaggctggccgcctggatgctctgctggaagccgggagagacaagactattgaatccatttactactttgtggtgggggatgttcctgaagaatccaaggagcttctcctccagagggccttggagatcccgtgtccagtctacacagtgtccttcaacgccagaggagaaggcactatagcttttctaaaggatctgagtgccaagacccacagcagattccacgcatttgccgagagaacagagtgtgtagaatttcctgcattctccacaaaggatggtgacaatgtgatgacttggaattcaaggaaactgaaaggaaaactccctccaggagctggagtcagagaggacgtgtttctcgtttggcaagagatggaggaagcctgcagcacgctggcccagatccagaggctggtggccgagcctcccaagcccgacgtggccactgtggactgcgagtcagaaacaacctctgttgagattgcatcgaatccagaagacacctgggactctaagacatggctgcagaaatatggcttgaaggcccagaagctatccttgtatgatgtgcttgccgactgctctttccgccacgctgatggggttgtggatataaaagccaaaccggagaatgagtccgtgcagaccagtgcggagacgaacaagaagacagtccatgcaaaatattgcagcaggtttgtccatgctccctggaaggatgggagcttggtccacgtcaacattaccaaagagaagtgcaagtggtacagtgagagaatccacacagccctggcccggatccgaaggaggattaaatggctacaggatgggagtcaaagcctctttggaagattgcataatgattgcatctacattctcattgacacgtctcactcaatgaagagcaaactggacttggtgaaggacaagatcattcagttcatacaggaacagctgaaatataaaagtaagtttaactttgtgaagtttgatggtcaagcagttgcttggcgggaacaacttgctgaagtcaatgaagataatttggaacaggctcagtcctggattagagacataaagattggaagctccacaaacaccctgagtgccctgaaaactgcttttgctgataaagaaacacaggcaatctaccttctgaccgatgggagacctgatcagggaacatcatctcatttactcctcacagcagccgtttaaggagggagtatcagttctgagccacagatgaggaaactcacattagacaggacatgccctaggccattcagatgggcagtgctggatgagcttcaagcccaagtctctcgctctggagctgtttccttcattccatacagctgaagacagcatgagtgggagagactgtcatgtgtatcattccacctgaaacagttatagaccaggtcaaacgttttcaggaaattcctatttataccatctccttcaattacaatgatgagattgcaaacaggtttttgaaagaggttgctgctttgactggaggagagttccatttttataattttggttgcaaggatcccactcccccagaggctgttcagaatgaagatctgactcttttagttaaggaaatggaacagggtcacagtgatctggagaagatgcaagacctttattctgagtccttgatcatggactggtggtacaatgcagaaaaggatggagacagcaaatattcaagtatcacagcctaccctgccaggagatgtcttttttatttcaaa

SEQ ID NO: 199328 - DNA, 1927 bp, Homo sapiens
  Payload ID: 19327
  Gene Name: von Willebrand factor A domain containing 3B
  ENST ID: ENST00000422503
  CDS Start-End: 161-535
ggaatcgctgccttatccaccagcgggatgcttacctcgcccgccctctcgggtcaggcgggcccgggaggatgggagggtggctgctgagcgggagccgccacgtcttccacccgacatattgcctagagtttgctgtgacttagatcttgattcagagatggagaaatcaggcccatcttctaccatctctgagcagcagctgcagaggcaagagggatggattaacaccaaaacagacttggctgagcagagtctcatttcatctgagaaatggcttcaactgcatgggcttaagagcaacaaattgaccttgaaacagattttgtcacagatcggattcccacattgtgaagattatgtggcgtctctggggagacctgtggcttctcggtatgctgatggtctgtttccacagctctacagagcagaagatggcagagtatacaatggtttctcaagagcctgtgaagtggcaggaaaatgctactcctgtgaccgaacagtccatagctactgccatcagttgggttgagaaactgacggttgagctgactgtgagcgaggctggccgcctggatgctctgctggaagccgggagagacaagactattgaatccatttactactttgtggtgggggatgttcctgaagaatccaaggagcttctcctccagagggccttggagatcccgtgtccagtctacacagtgtccttcaacgccagaggagaaggcactatagcttttctaaaggatctgagtgccaagacccacagcagattccacgcatttgccgagagaacagagtgtgtagaatttcctgcattctccacaaaggatggtgacaatgtgatgacttggaattcaaggaaactgaaaggaaaactccctccaggagctggagtcagagaggacgtgtttctcgtttggcaagagatggaggaagcctgcagcacgctggcccagatccagaggctggtggccgagcctcccaagcccgacgtggccactgtggactgcgagtcagaaacaacctctgttgagattgcatcgaatccagaagacacctgggactctaagacatggctgcagaaatatggcttgaaggcccagaagctatccttgtatgatgtgcttgccgactgctctttccgccacgctgatggggttgtggatataaaagccaaaccggagaatgagtccgtgcagaccagtgcggagacgaacaagaagacagtccatgcaaaatattgcagcaggtttgtccatgctccctggaaggatgggagcttggtccacgtcaacattaccaaagagaagtgcaagtggtacagtgagagaatccacacagccctggcccggatccgaaggaggattaaatggctacaggatgggagtcaaagcctctttggaagattgcataatgattgcatctacattctcattgacacgtctcactcaatgaagagcaaactggacttggtgaaggacaagatcattcagttcatacaggaacagctgaaatataaaagtaagtttaactttgtgaagtttgatggtcaagcagttgcttggcgggaacaacttgctgaagtcaatgaagataatttggaacaggctcagtcctggattagagacataaagattggaagctccacaaacaccctgagtgccctgaaaactgcttttgctgataaagaaacacaggcaatctaccttctgaccgatgggagacctgatcagcagccgtttaaggagggagtatcagttctgagccacagatgaggaaactcacattagacaggacatgccctaggccattcagatgggcagtgctggatgagcttcaagcccaagtctctcgctctggagctgtttccttcattccatacagctgaagacagcatgagtgggagagactgtca

SEQ ID NO: 199329 - DNA, 5324 bp, Homo sapiens
  Payload ID: 19327
  Gene Name: von Willebrand factor A domain containing 3B
  ENST ID: ENST00000432242
  CDS Start-End: 281-586
gtgtccaggcaaccgcggagacgccgtcgtcaacagaccgcgctcggaaccagaggcgcgggtcacagagacctagaacagctggaatccttcgcccccggcgcgcagccttcgcccgccggaatcgctgccttatccaccagcgggatgcttacctcgcccgccctctcgggtcaggcgggcccgggaggatgggagggtggctgctgagcgggagccgccacgtcttccacccgacatattgcctagagtttgctgtgacttagatcttgattcagagatggagaaatcaggcccatcttctaccatctctgagcagcagctgcagaggcaagagggatggattaacaccaaaacagacttggctgagcagagtctcatttcatctgagaaatggcttcaactgcatgggcttaagagcaacaaattgaccttgaaacagattttgtcacagatcggattcccacattgtgaagattatgtggcgtctctggggagacctgtggcttctcggtatgctgatggtctgtttccacagctctacagagcagaagatggcagagtatacaatctaaatcagaactgatttatcagtttgtggaacatttaacacaagctgtggagagctacaagcagcgaatggactggctcaccagcaagagccggcagatttttggtgtcatcttggaacagtgcgtcaccatagtgctggattttggcggcattctggagggggagcttgatctgtgccgagaggctctaacaatggttctccaggagcaggtggctcacataaccgagttcaatatcatacgggtttctcaagagcctgtgaagtggcaggaaaatgctactcctgtgaccgaacagtccatagctactgccatcagttgggttgagaaactgacggttgagctgactgtgagcgaggctggccgcctggatgctctgctggaagccgggagagacaagactattgaatccatttactactttgtggtgggggatgttcctgaagaatccaaggagcttctcctccagagggccttggagatcccgtgtccagtctacacagtgtccttcaacgccagaggagaaggcactatagcttttctaaaggatctgagtgccaagacccacagcagattccacgcatttgccgagagaacagagtgtgtagaatttcctgcattctccacaaaggatggtgacaatgtgatgacttggaattcaaggaaactgaaaggaaaactccctccaggagctggagtcagagaggacgtgtttctcgtttggcaagagatggaggaagcctgcagcacgctggcccagatccagaggctggtggccgagcctcccaagcccgacgtggccactgtggactgcgagtcagaaacaacctctgttgagattgcatcgaatccagaagacacctgggactctaagacatggctgcagaaatatggcttgaaggcccagaagctatccttgtatgatgtgcttgccgactgctctttccgccacgctgatggggttgtggatataaaagccaaaccggagaatgagtccgtgcagaccagtgcggattaaatggctacaggatgggagtcaaagcctctttggaagattgcataatgattgcatctacattctcattgacacgtctcactcaatgaagagcaaactggacttggtgaaggacaagatcattcagttcatacaggaacagctgaaatataaaagtaagtttaactttgtgaagtttgatggtcaagcagttgcttggcgggaacaacttgctgaagtcaatgaagataatttggaacaggctcagtcctggattagagacataaagattggaagctccacaaacaccctgagtgccctgaaaactgcttttgctgataaagaaacacaggcaatctaccttctgaccgatgggagacctgatcagggaacatcatctcatttactcctcacagcagccgtttaaggagggagtatcagttctgagccacagatgaggaaactcacattagacaggacatgccctaggccattcagatgggcagtgctggatgagcttcaagcccaagtctctcgctctggagctgtttccttcattccatacagctgaagacagcatgagtgggagagactgtcatgtgtatcattccacctgaaacagttatagaccaggtcaaacgttttcaggaaattcctatttataccatctccttcaattacaatgatgagattgcaaacaggtttttgaaagaggttgctgctttgactggaggagagttccatttttataattttggttgcaaggatcccactcccccagaggctgttcagaatgaagatctgactcttttagttaaggaaatggaacagggtcacagtgatctggagaagatgcaagacctttattctgagtccttgatcatggactggtggtacaatgcagaaaaggatggagacagcaagcatcaaaaggaaatctgttctatgatttcaaccccagaaaagtgtgcaaagcctcaatctgatgtcgattcaacacaaacttcatctctgaatatgttgaagggaccatggggcctttcagatcaaaaggttcagaaaaagaaagtccttcacgcagaatcaaccaaaaccagcctgctcagaagccagatgtcctccctcaggagctcagcttgcagtgaaaggaaggatggcctctccaatgccagcagccggaggactgctctaagtgacaaagaaatgagcatcttgctggctgaggagtggctggatgacaaatcgtcagaaaaggtgacgcgagaaggaagccaggtttatgaccacgattcttcagatgtgtcttcagaaaactggctgaagacctatggcttggtcgccaagaaactcaccctcatggatgccttgtcagtggcagcagtcccgcacagctccacctatgttcccgtcctggacaagcatgtcgtgtctaaggtctttgatgaggtgttccctctggcacatgtgtgcaacgacacaaataagatgacattaattaacccccaaggagccaaactcaatatctacaagcgaaaagtggaacaggcaattcaatcctatgaaaagcgcttgaataaaattgtttggcgagcattatctcaagaggaaaaagaaaagagcctgtaatatcttgttccccctggtgtctctctgaagtactgcagtatctccaatgctgtaacaagctgtgacactcatttctgttctcagaggtcccaacctgacctgcaaaatatgccactgttctcatcagcattctgaatcaggttagatgcaaacaaaccaatacagtacttggaaaacaaaacagttttaaaccaggctttagaacggttgaattggcccatttcactgaaagagctgtcgatgctggaaagtgaaatcctagctgggaaaatgtacatccagcaggccatggaactccaggaggctgccaagaagaattatgcaaacaaggccccgggagagcaacagaaattgcaaggaaatccaacaaagaaaaccaaatcaaaaagaccagatcccctcaaaggacagaaggttattgcaagatgtgatgaaaatggcttttattttccaggggttgtgaagaagtgtgtgagccgcacccaagcactggtgggcttcagttacggagacaccaaggtcgtgtccacctccttcatcacgcctgtggggggcgccatgccctgcccgctgctccaggttggagattatgtgtttgccaaaattgtgatacccaaaggatttgacttctatgtccctgccattgtcatagcacttcccaataagcatgtggccacagaaaaattctacacagttttgaagtgtaacaaccggagagaattttgccctcggagtgcacttattaagatcagccaaaacaagtatgcgctctcttgctctcatataaagtcacccccaattcctgaggatccagaagtagaggatgtggaggcgaggaactctgctttcctcttctggccactgaaagaagcggacacgcaggattccagagagccaagacgagagaagcccaggaggaaaaagaggcccgccaagcagccactccagcaggcggcgccctcggactcggacggctcctcccacggcatcagctcccatgggtcctgccaggggacacaccccgagcccaggacagcccacctccacttccccgcggccgggcgtctaggactcagcagccacgccatcattgccacacctccacctcgagcagccctgccctgtactctccaagccacccacagcagcaaagggctgaggagcgtccctgagacactttaaggccgtctggtggcagctatgtttaagagaccagcgtccttccaggctgttcagacctcagcgttgacactgaaactggcccctccgcggaggtaaggccgccctccgcgccgcctatgcctgccctgtctgtagcaaagactcctctcccctccatccctgctgcctcccctacccgtttgacgacttggttctggctttttctgactgttctttatcctgttttccccctgcactcacaaaattgtattccatcttctggtagacgccccacccccagaagttttaacctgaaggatgactgtcacaggactttcaaattgtttagcagtcagcatagtcaggatccaagcccgcaatcttgttttaaattaattatcacatctaaattagagaatttgtcacccaatattaggactgaaattcagactcggtaacttgtctgagatctgcaagactgaacatcccctactgtatagtttcctgacattttcatttagcctttcctaattatttttgtctatagtctgttgtaggtaactctaattgagcccgaaaccagaataaaaactcttacattggaaacatttcaaaaccattggattgttggattatttgttaccatttttctctgaacacattttagcaatgacatatgaaagtattcagttgtgtttactaacttcaaaaatgaaatcgctccatcaaatttcgtttttctagtcggtaagatccctgaggctagatgaaaatagagcacaggtcatcactagggaaaatattggatgctttttgcaaacagaacagatagggctgagttctgatactctaaaaatttacaatctaattaaaagtggcattcacattcctgaaagctaggagtagccagggttatggtgaagaaattaaagaactaatccacttctaaaaatatgaaaaaaaaaaaataa

SEQ ID NO: 199330 - DNA, 2516 bp, Homo sapiens
  Payload ID: 19327
  Gene Name: von Willebrand factor A domain containing 3B
  ENST ID: ENST00000448638
  CDS Start-End: 207-1118
agaacagctggaatccttcgcccccggcgcgcagccttcgcccgccggaatcgctgccttatccaccagcgggatgcttacctcgcccgccctctcgggtcaggcgggcccgggaggatgggagggtggctgctgagcgggagccgccacgtcttccacccgacatattgcctagagtttgctgtgacttagatcttgattcagagatggagaaatcaggcccatcttctaccatctctgagcagcagctgcagaggcaagagggatggattaacaccaaaacagacttggctgagcagagtctcatttcatctgagaaatggcttcaactgcatgggcttaagagcaacaaattgaccttgaaacagattttgtcacagatcggattcccacattgtgaagattatgtggcgtctctggggagacctgtggcttctcggtatgctgatggtctgtttccacagctctacagagcagaagatggcagagtatacaatctgacagctaaatcagaactgatttatcagtttgtggaacatttaacacaagctgtggagagctacaagcagcgaatggactggctcaccagcaagagccggcagatttttggtgtcatcttggaacagtgcgtcaccatagtgctggattttggcggcattctggagggggagcttgatctgtgccgagaggctctaacaatggttctccaggagcaggtggctcacataaccgagttcaatatcatacgggtttctcaagagcctgtgaagtggcaggaaaatgctactcctgtgaccgaacagtccatagctactgccatcagttgggttgagaaactgacggttgagctgactgtgagcgaggctggccgcctggatgctctgctggaagccgggagagacaagactgagctggagtcagagaggacgtgtttctcgtttggcaagagatggaggaagcctgcagcacgctggcccagatccagaggctggtggccgagcctcccaagcccgacgtggccactgtggactgcgagtcagaaacaacctctgttgagattgcatcgaatccagaagacacctgggactctaagacatggctgcagaaatatggcttgaaggcccagaagctatccttgtatgatgtgcttgccgactgctctttccgccacgctgatggggttgtggatataaaagccaaaccggagaatgagtccgtgcagaccagtgcggattaaatggctacaggatgggagtcaaagcctctttggaagattgcataatgattgcatctacattctcattgacacgtctcactcaatgaagagcaaactggacttggtgaaggacaagatcattcagttcatacaggaacagctgaaatataaaagtaagtttaactttgtgaagtttgatggtcaagcagttgcttggcgggaacaacttgctgaagtcaatgaagataatttggaacaggctcagtcctggattagagacataaagattggaagctccacaaacaccctgagtgccctgaaaactgcttttgctgataaagaaacacaggcaatctaccttctgaccgatgggagacctgatcagccacctgaaacagttatagaccaggtcaaacgttttcaggaaattcctatttataccatctccttcaattacaatgatgagattgcaaacaggtttttgaaagaggttgctgctttgactggaggagagttccatttttataattttggttgcaaggatcccactcccccagaggctgttcagaatgaagatctgactcttttagttaaggaaatggaacagggtcacagtgatctggagaagatgcaagacctttattctgagtccttgatcatggactggtggtacaatgcagaaaaggatggagacagcaagcatcaaaaggaaatctgttctatgatttcaaccccagaaaagtgtgcaaagcctcaatctgatgtcgattcaacacaaacttcatctctgaatatgttgaagggaccatggggcctttcagatcaaaaggttcagaaaaagaaagtccttcacgcagaatcaaccaaaaccagcctgctcagaagccagatgtcctccctcaggagctcagcttgcagtgaaaggaaggatggcctctccaatgccagcagccggaggactgctctaagtgacaaagaaatgagcatcttgctggctgaggagtggctggatgacaaatcgtcagaaaaggtgacgcgagaaggaagccaggtttatgaccacgattcttcagatgtgtcttcagaaaactggctgaagacctatggcttggtcgccaagaaactcaccctcatggatgccttgtcagtggcagcagtcccgcacagctccacctatgttcccgtcctggacaagcatgtcgtgtctaaggtctttgatgaggtaaactgattgtctatacgtccctacttgaggccattttcattttctgctcaaataaaaagtagtccaatttcttgt

SEQ ID NO: 199331 - DNA, 2827 bp, Homo sapiens
  Payload ID: 19327
  Gene Name: von Willebrand factor A domain containing 3B
  ENST ID: ENST00000416277
  CDS Start-End: 161-1432
ggaatcgctgccttatccaccagcgggatgcttacctcgcccgccctctcgggtcaggcgggcccgggaggatgggagggtggctgctgagcgggagccgccacgtcttccacccgacatattgcctagagtttgctgtgacttagatcttgattcagagatggagaaatcaggcccatcttctaccatctctgagcagcagctgcagaggcaagagggatggattaacaccaaaacagacttggctgagcagagtctcatttcatctgagaaatggcttcaactgcatgggcttaagagcaacaaattgaccttgaaacagattttgtcacagatcggattcccacattgtgaagattatgtggcgtctctggggagacctgtggcttctcggtatgctgatggtctgtttccacagctctacagagcagaagatggcagagtatacaatctgacagctaaatcagaactgatttatcagtttgtggaacatttaacacaagctgtggagagctacaagcagcgaatggactggctcaccagcaagagccggcagatttttggtgtcatcttggaacagtgcgtcaccatagtgctggattttggcggcattctggagggggagcttgatctgtgccgagaggctctaacaatggttctccaggagcaggtggctcacataaccgagttcaatatcatacgggtttctcaagagcctgtgaagtggcaggaaaatgctactcctgtgaccgaacagtccatagctactgccatcagttgggttgagaaactgacggttgagctgactgtgagcgaggctggccgcctggatgctctgctggaagccgggagagacaagactattgaatccatttactactttgtggtgggggatgttcctgaagaatccaaggagcttctcctccagagggccttggagatcccgtgtccagtctacacagtgtccttcaacgccagaggagaaggcactatagcttttctaaaggatctgagtgccaagacccacagcagattccacgcatttgccgagagaacagagtgtgtagaatttcctgcattctccacaaaggatggtgacaatgtgatgacttggaattcaaggaaactgaaaggaaaactccctccaggagctggagtcagagaggacgtgtttctcgtttggcaagagatggaggaagcctgcagcacgctggcccagatccagaggctggtggccgagcctcccaagcccgacgtggccactgtggactgcggtgctgttccaagtttcgagtcatctggaaaaatagttttctgcttgtgtgatatgctggcttgtcccgctcagagtcagaaacaacctctgttgagattgcatcgaatccagaagacacctgggactctaagacatggctgcagaaatatggcttgaaggcccagaagctatccttgtatgatgtgcttgccgactgctctttccgccacgctgatggggttgtggatataaaagccaaaccggagaatgagtccgtgcagaccagtgcggattaaatggctacaggatgggagtcaaagcctctttggaagattgcataatgattgcatctacattctcattgacacgtctcactcaatgaagagcaaactggacttggtgaaggacaagatcattcagttcatacaggaacagctgaaatataaaagtaagtttaactttgtgaagtttgatggtcaagcagttgcttggcgggaacaacttgctgaagtcaatgaagataatttggaacaggctcagtcctggattagagacataaagattggaagctccacaaacaccctgagtgccctgaaaactgcttttgctgataaagaaacacaggcaatctaccttctgaccgatgggagacctgatcagccacctgaaacagttatagaccaggtcaaacgttttcaggaaattcctatttataccatctccttcaattacaatgatgagattgcaaacaggtttttgaaagaggttgctgctttgactggaggagagttccatttttataattttggttgcaaggatcccactcccccagaggctgttcagaatgaagatctgactcttttagttaaggaaatggaacagggtcacagtgatctggagaagatgcaagacctttattctgagtccttgatcatggactggtggtacaatgcagaaaaggatggagacagcaagcatcaaaaggaaatctgttctatgatttcaaccccagaaaagtgtgcaaagcctcaatctgatgtcgattcaacacaaacttcatctctgaatatgttgaagggaccatggggcctttcagatcaaaaggttcagaaaaagaaagtccttcacgcagaatcaaccaaaaccagcctgctcagaagccagatgtcctccctcaggagctcagcttgcagtgaaaggaaggatggcctctccaatgccagcagccggaggactgctctaagtgacaaagaaatgagcatcttgctggctgaggagtggctggatgacaaatcgtcagaaaaggtgacgcgagaaggaagccaggtttatgaccacgattcttcagatgtgtcttcagaaaactggctgaagacctatggcttggtcgccaagaaactcaccctcatggatgccttgtcagtggcagcagtcccgcacagctccacctatgttcccgtcctggacaagcatgtcgtgtctaaggtctttgatgaggtaaactgattgtctatacgtccctacttgaggccattttcattttctgctcaaataaaaagtagtccaatttct

SEQ ID NO: 199332 - DNA, 4454 bp, Homo sapiens
  Payload ID: 19327
  Gene Name: von Willebrand factor A domain containing 3B
  Uniprot ID: Q502W6
  ENST ID: ENST00000477737
  CDS Start-End: 205-4089
aacagctggaatccttcgcccccggcgcgcagccttcgcccgccggaatcgctgccttatccaccagcgggatgcttacctcgcccgccctctcgggtcaggcgggcccgggaggatgggagggtggctgctgagcgggagccgccacgtcttccacccgacatattgcctagagtttgctgtgacttagatcttgattcagagatggagaaatcaggcccatcttctaccatctctgagcagcagctgcagaggcaagagggatggattaacaccaaaacagacttggctgagcagagtctcatttcatctgagaaatggcttcaactgcatgggcttaagagcaacaaattgaccttgaaacagattttgtcacagatcggattcccacattgtgaagattatgtggcgtctctggggagacctgtggcttctcggtatgctgatggtctgtttccacagctctacagagcagaagatggcagagtatacaatctgacagctaaatcagaactgatttatcagtttgtggaacatttaacacaagctgtggagagctacaagcagcgaatggactggctcaccagcaagagccggcagatttttggtgtcatcttggaacagtgcgtcaccatagtgctggattttggcggcattctggagggggagcttgatctgtgccgagaggctctaacaatggttctccaggagcaggtggctcacataaccgagttcaatatcatacgggtttctcaagagcctgtgaagtggcaggaaaatgctactcctgtgaccgaacagtccatagctactgccatcagttgggttgagaaactgacggttgagctgactgtgagcgaggctggccgcctggatgctctgctggaagccgggagagacaagactattgaatccatttactactttgtggtgggggatgttcctgaagaatccaaggagcttctcctccagagggccttggagatcccgtgtccagtctacacagtgtccttcaacgccagaggagaaggcactatagcttttctaaaggatctgagtgccaagacccacagcagattccacgcatttgccgagagaacagagtgtgtagaatttcctgcattctccacaaaggatggtgacaatgtgatgacttggaattcaaggaaactgaaaggaaaactccctccaggagctggagtcagagaggacgtgtttctcgtttggcaagagatggaggaagcctgcagcacgctggcccagatccagaggctggtggccgagcctcccaagcccgacgtggccactgtggactgcgagtcagaaacaacctctgttgagattgcatcgaatccagaagacacctgggactctaagacatggctgcagaaatatggcttgaaggcccagaagctatccttgtatgatgtgcttgccgactgctctttccgccacgctgatggggttgtggatataaaagccaaaccggagaatgagtccgtgcagaccagtgcggagacgaacaagaagacagtccatgcaaaatattgcagcaggtttgtccatgctccctggaaggatgggagcttggtccacgtcaacattaccaaagagaagtgcaagtggtacagtgagagaatccacacagccctggcccggatccgaaggaggattaaatggctacaggatgggagtcaaagcctctttggaagattgcataatgattgcatctacattctcattgacacgtctcactcaatgaagagcaaactggacttggtgaaggacaagatcattcagttcatacaggaacagctgaaatataaaagtaagtttaactttgtgaagtttgatggtcaagcagttgcttggcgggaacaacttgctgaagtcaatgaagataatttggaacaggctcagtcctggattagagacataaagattggaagctccacaaacaccctgagtgccctgaaaactgcttttgctgataaagaaacacaggcaatctaccttctgaccgatgggagacctgatcagccacctgaaacagttatagaccaggtcaaacgttttcaggaaattcctatttataccatctccttcaattacaatgatgagattgcaaacaggtttttgaaagaggttgctgctttgactggaggagagttccatttttataattttggttgcaaggatcccactcccccagaggctgttcagaatgaagatctgactcttttagttaaggaaatggaacagggtcacagtgatctggagaagatgcaagacctttattctgagtccttgatcatggactggtggtacaatgcagaaaaggatggagacagcaagcatcaaaaggaaatctgttctatgatttcaaccccagaaaagtgtgcaaagcctcaatctgatgtcgattcaacacaaacttcatctctgaatatgttgaagggaccatggggcctttcagatcaaaaggttcagaaaaagaaagtccttcacgcagaatcaaccaaaaccagcctgctcagaagccagatgtcctccctcaggagctcagcttgcagtgaaaggaaggatggcctctccaatgccagcagccggaggactgctctaagtgacaaagaaatgagcatcttgctggctgaggagtggctggatgacaaatcgtcagaaaaggtgacgcgagaaggaagccaggtttatgaccacgattcttcagatgtgtcttcagaaaactggctgaagacctatggcttggtcgccaagaaactcaccctcatggatgccttgtcagtggcagcagtcccgcacagctccacctatgttcccgtcctggacaagcatgtcgtgtctaaggtctttgatgaggtgttccctctggcacatgtgtgcaacgacacaaataagatgacattaattaacccccaaggagccaaactcaatatctacaagcgaaaagtggaacaggcaattcaatcctatgaaaagcgcttgaataaaattgtttggcgagcattatctcaagaggaaaaagaaaagttagatgcaaacaaaccaatacagtacttggaaaacaaaacagttttaaaccaggctttagaacggttgaattggcccatttcactgaaagagctgtcgatgctggaaagtgaaatcctagctgggaaaatgtacatccagcaggccatggaactccaggaggctgccaagaagaattatgcaaacaaggccccgggagagcaacagaaattgcaaggaaatccaacaaagaaaaccaaatcaaaaagaccagatcccctcaaaggacagaaggttattgcaagatgtgatgaaaatggcttttattttccaggggttgtgaagaagtgtgtgagccgcacccaagcactggtgggcttcagttacggagacaccaaggtcgtgtccacctccttcatcacgcctgtggggggcgccatgccctgcccgctgctccaggttggagattatgtgtttgccaaaattgtgatacccaaaggatttgacttctatgtccctgccattgtcatagcacttcccaataagcatgtggccacagaaaaattctacacagttttgaagtgtaacaaccggagagaattttgccctcggagtgcacttattaagatcagccaaaacaagtatgcgctctcttgctctcatataaagtcacccccaattcctgaggatccagaagtagaggatgtggaggcgaggaactctgctttcctcttctggccactgaaagaagcggacacgcaggattccagagagccaagacgagagaagcccaggaggaaaaagaggcccgccaagcagccactccagcaggcggcgccctcggactcggacggctcctcccacggcatcagctcccatgggtcctgccaggggacacaccccgagcccaggacagcccacctccacttccccgcggccgggcgtctaggactcagcagccacgccatcattgccacacctccacctcgagcagccctgccctgtactctccaagccacccacagcagcaaagggctgaggagcgtccctgagacactttaaggccgtctggtggcagctatgtttaagagaccagcgtccttccaggctgttcagacctcagcgttgacactgaaactggcccctccgcggaggtaaggccgccctccgcgccgcctatgcctgccctgtctgtagcaaagactcctctcccctccatccctgctgcctcccctacccgtttgacgacttggttctggctttttctgactgttctttatcctgttttccccctgcactcacaaaattgtattccatcttctggtagacgccccacccccagaagttttaacctgaaggatgactgtcacaggactttcaaattgtttagcagtcagcatagtcaggatccaagcccgcaatcttgt

SEQ ID NO: 199333 - DNA, 2575 bp, Homo sapiens
  Payload ID: 19327
  Gene Name: von Willebrand factor A domain containing 3B
  ENST ID: ENST00000489630
  CDS Start-End: 1-313
gaaaactgcttttgctgataaagaaacacaggcaatctaccttctgaccgatgggagacctgatcagccacctgaaacagttatagaccaggtcaaacgttttcaggaaattcctatttataccatctccttcaattacaatgatgagattgcaaacaggtttttgaaagaggttgctgctttgactggaggagagttccatttttataattttggttgcaaggatcccactcccccagaggctgttcaggcatcaaaaggaaatctgttctatgatttcaaccccagaaaagtgtgcaaagcctcaatctgatgtcgattcaacacaaacttcatctctgaatatgttgaagggaccatggggcctttcagatcaaaaggttcagaaaaagaaagtccttcacgcagaatcaaccaaaaccagcctgctcagaagccagatgtcctccctcaggagctcagcttgcagtgaaaggaaggatggcctctccaatgccagcagccggaggactgctctaagtgacaaagaaatgagcatcttgctggctgaggagtggctggatgacaaatcgtcagaaaaggtgacgcgagaaggaagccaggtttatgaccacgattcttcagatgtgtcttcagaaaactggctgaagacctatggcttggtcgccaagaaactcaccctcatggatgccttgtcagtggcagcagtcccgcacagctccacctatgttcccgtcctggacaagcatgtcgtgtctaaggtctttgatgaggtgttccctctggcacatgtgtgcaacgacacaaataagatgacattaattaacccccaaggagccaaactcaatatctacaagcgaaaagtggaacaggcaattcaatcctatgaaaagcgcttgaataaaattgtttggcgagcattatctcaagaggaaaaagaaaagttagatgcaaacaaaccaatacagtacttggaaaacaaaacagttttaaaccaggctttagaacggttgaattggcccatttcactgaaagagctgtcgatgctggaaagtgaaatcctagctgggaaaatgtacatccagcaggccatggaactccaggaggctgccaagaagaattatgcaaacaaggccccgggagagcaacagaaattgcaaggaaatccaacaaagaaaaccaaatcaaaaagaccagatcccctcaaaggacagaaggttattgcaagatgtgatgaaaatggcttttattttccaggggttgtgaagaagtgtgtgagccgcacccaagcactggtgggcttcagttacggagacaccaaggtcgtgtccacctccttcatcacgcctgtggggggcgccatgccctgcccgctgctccaggttggagattatgtgtttgccaaaattgtgatacccaaaggatttgacttctatgtccctgccattgtcatagcacttcccaataagcatgtggccacagaaaaattctacacagttttgaagtgtaacaaccggagagaattttgccctcggagtgcacttattaagatcagccaaaacaagtatgcgctctcttgctctcatataaagtcacccccaattcctgaggatccagaagtagaggatgtggaggcgaggaactctgctttcctcttctggccactgaaagaagcggacacgcaggattccagagagccaagacgagagaagcccaggaggaaaaagaggcccgccaagcagccactccagcaggcggcgccctcggactcggacggctcctcccacggcatcagctcccatgggtcctgccaggggacacaccccgagcccaggacagcccacctccacttccccgcggccgggcgtctaggactcagcagccacgccatcattgccacacctccacctcgagcagccctgccctgtactctccaagccacccacagcagcaaagggctgaggagcgtccctgagacactttaaggccgtctggtggcagctatgtttaagagaccagcgtccttccaggctgttcagacctcagcgttgacactgaaactggcccctccgcggaggtaaggccgccctccgcgccgcctatgcctgccctgtctgtagcaaagactcctctcccctccatccctgctgcctcccctacccgtttgacgacttggttctggctttttctgactgttctttatcctgttttccccctgcactcacaaaattgtattccatcttctggtagacgccccacccccagaagttttaacctgaaggatgactgtcacaggactttcaaattgtttagcagtcagcatagtcaggatccaagcccgcaatcttgttttaaattaattatcacatctaaattagagaatttgtcacccaatattaggactgaaattcagactcggtaacttgtctgagatctgcaagactgaacatcccctactgtatagtttcctgacattttcatttagcctttcctaattatttttgtctatagtctgttgtaggtaactctaattgagcccgaaaccagaataaaaactcttacattggaaacattt

SEQ ID NO: 199334 - DNA, 246 bp, Homo sapiens
  Payload ID: 19327
  Gene Name: von Willebrand factor A domain containing 3B
  ENST ID: ENST00000465555
  CDS Start-End: 1-246
tcaccctcatggatgccttgtcagtggcagcagtcccgcacagctccacctatgttcccgtcctggacaagcatgtcgtgtctaaggtctttgatgagtgtttcccggaccagcctcaaatcggtcaccttggaaatgaggtgttccctctggcacatgtgtgcaacgacacaaataagatgacattaattaacccccaaggagccaaactcaatatctacaagcgaaaagtggaacaggcaattc

SEQ ID NO: 199335 - DNA, 2874 bp, Homo sapiens
  Payload ID: 19327
  Gene Name: von Willebrand factor A domain containing 3B
  ENST ID: ENST00000473149
  CDS Start-End: 1-2170
gaaaactgcttttgctgataaagaaacacaggcaatctaccttctgaccgatgggagacctgatcagccacctgaaacagttatagaccaggtcaaacgttttcaggaaattcctatttataccatctccttcaattacaatgatgagattgcaaacaggtttttgaaagaggttgctgctttgactggaggagagttccatttttataattttggttgcaaggatcccactcccccagaggctgttcagaatgaagatctgactcttttagttaaggaaatggaacagggtcacagtgatctggagaagatgcaagacctttattctgagtccttgatcatggactggtggtacaatgcagaaaaggatggagacagcaagcatcaaaaggaaatctgttctatgatttcaaccccagaaaagtgtgcaaagcctcaatctgatgtcgattcaacacaaacttcatctctgaatatgttgaagggaccatggggcctttcagatcaaaaggttcagaaaaagaaagtccttcacgcagaatcaaccaaaaccagcctgctcagaagccagatgtcctccctcaggagctcagcttgcagtgaaaggaaggatggcctctccaatgccagcagccggaggactgctctaagtgacaaagaaatgagcatcttgctggctgaggagtggctggatgacaaatcgtcagaaaaggtgacgcgagaaggaagccaggtttatgaccacgattcttcagatgtgtcttcagaaaactggctgaagacctatggcttggtcgccaagaaactcaccctcatggatgccttgtcagtggcagcagtcccgcacagctccacctatgttcccgtcctggacaagcatgtcgtgtctaaggtctttgatgaggtgttccctctggcacatgtgtgcaacgacacaaataagatgacattaattaacccccaaggagccaaactcaatatctacaagcgaaaagtggaacaggcaattcaatcctatgaaaagcgcttgaataaaattgtttggcgagcattatctcaagaggaaaaagaaaagttagatgcaaacaaaccaatacagtacttggaaaacaaaacagttttaaaccaggctttagaacggttgaattggcccatttcactgaaagagctgtcgatgctggaaagtgaaatcctagctgggaaaatgtacatccagcaggccatggaactccaggaggctgccaagaagaattatgcaaacaaggccccgggagagcaacagaaattgcaaggaaatccaacaaagaaaaccaaatcaaaaagaccagatcccctcaaaggacagaaggttattgcaagatgtgatgaaaatggcttttattttccaggggttgtgaagaagtgtgtgagccgcacccaagcactggtgggcttcagttacggagacaccaaggtcgtgtccacctccttcatcacgcctgtggggggcgccatgccctgcccgctgctccaggttggagattatgtgtttgccaaaattgtgatacccaaaggatttgacttctatgtccctgccattgtcatagcacttcccaataagcatgtggccacagaaaaattctacacagttttgaagtgtaacaaccggagagaattttgccctcggagtgcacttattaagatcagccaaaacaagtatgcgctctcttgctctcatataaagtcacccccaattcctgaggatccagaagtagaggatgtggaggcgaggaactctgctttcctcttctggccactgaaagaagcggacacgcaggattccagagagccaagacgagagaagcccaggaggaaaaagaggcccgccaagcagccactccagcaggcggcgccctcggactcggacggctcctcccacggcatcagctcccatgggtcctgccaggggacacaccccgagcccagggtttgggtgatggggggggaacacaacatcgcttatctcaggaacaccctgaaatccctttcaagaatagtacacctaacatcgtccttcagattctgggcctgtttaggctccagtgcagcaaagaccctaacatccttaagtaatgctgaactctgcttccccagacagcccacctccacttccccgcggccgggcgtctaggactcagcagccacgccatcattgccacacctccacctcgagcagccctgccctgtactctccaagccacccacagcagcaaagggctgaggagcgtccctgagacactttaaggccgtctggtggcagctatgtttaagagaccagcgtccttccaggctgttcagacctcagcgttgacactgaaactggcccctccgcggaggtaaggccgccctccgcgccgcctatgcctgccctgtctgtagcaaagactcctctcccctccatccctgctgcctcccctacccgtttgacgacttggttctggctttttctgactgttctttatcctgttttccccctgcactcacaaaattgtattccatcttctggtagacgccccacccccagaagttttaacctgaaggatgactgtcacaggactttcaaattgtttagcagtcagcatagtcaggatccaagcccgcaatcttgttttaaattaattatcacatctaaattagagaatttgtcacccaatattaggactgaaattcagactcggtaacttgtctgagatctgcaagactgaacatcccctactgtatagtttcctgacattttcatttagcctttcctaattatttttgtctatagtctgttgtaggtaactctaattgagcccgaaaccagaataaaaactcttacattggaaacatttc

SEQ ID NO: 199336 - DNA, 2711 bp, Homo sapiens
  Payload ID: 19327
  Gene Name: von Willebrand factor A domain containing 3B
  ENST ID: ENST00000495571
  CDS Start-End: 1-316
gagcaaactggacttggtgaaggacaagatcattcagttcatacaggaacagctgaaatataaaagtaagtttaactttgtgaagtttgatggtcaagcagttgcttggcgggaacaacttgctgaagtcaatgaagataatttggaacaggctcagtcctggattagagacataaagattggaagctccacaaacaccctgagtgccctgaaaactgcttttgctgataaagaaacacaggcaatctaccttctgaccgatgggagacctgatcagggaacatcatctcatttactcctcacagcagccgtttaaggagggagtatcagttctgagccacagatgaggaaactcacattagacaggacatgccctaggccattcagatgggcagtgctggatgagcttcaagcccaagtctctcgctctggagctgtttccttcattccatacagctgaagacagcatgagtgggagagactgtcatgtgtatcattccacctgaaacagttatagaccaggtcaaacgttttcaggaaattcctatttataccatctccttcaattacaatgatgagattgcaaacaggtttttgaaagaggttgctgctttgactggaggagagttccatttttataattttggttgcaaggatcccactcccccagaggctgttcagaatgaagatctgactcttttagttaaggaaatggaacagggtcacagtgatctggagaagatgcaagacctttattctgagtccttgatcatggactggtggtacaatgcagaaaaggatggagacagcaagcatcaaaaggaaatctgttctatgatttcaaccccagaaaagtgtgcaaagcctcaatctgatgtcgattcaacacaaacttcatctctgaatatgttgaagggaccatggggcctttcagatcaaaaggttcagaaaaagaaagtccttcacgcagaatcaaccaaaaccagcctgctcagaagccagatgtcctccctcaggagctcagcttgcagtgaaaggaaggatggcctctccaatgccagcagccggaggactgctctaagtgacaaagaaatgagcatcttgctggctgaggagtggctggatgacaaatcgtcagaaaaggtgacgcgagaaggaagccaggtttatgaccacgattcttcagatgtgtcttcagaaaactggctgaagacctatggcttggtcgccaagaaactcaccctcatggatgccttgtcagtggcagcagtcccgcacagctccacctatgttcccgtcctggacaagcatgtcgtgtctaaggtctttgatgaggtgttccctctggcacatgtgtgcaacgacacaaataagatgacattaattaacccccaaggagccaaactcaatatctacaagcgaaaagtggaacaggcaattcaatcctatgaaaagcgcttgaataaaattgtttggcgagcattatctcaagaggaaaaagaaaagttagatgcaaacaaaccaatacagtacttggaaaacaaaacagttttaaaccaggctttagaacggttgaattggcccatttcactgaaagagctgtcgatgctggaaagtgaaatcctagctgggaaaatgtacatccagcaggccatggaactccaggaggctgccaagaagaattatgcaaacaaggccccgggagagcaacagaaattgcaaggaaatccaacaaagaaaaccaaatcaaaaagaccagatcccctcaaaggacagaaggttattgcaagatgtgatgaaaatggcttttattttccaggggttgtgaagaagtgtgtgagccgcacccaagcactggtgggcttcagttacggagacaccaaggtcgtgtccacctccttcatcacgcctgtggggggcgccatgccctgcccgctgctccaggttggagattatgtgtttgccaaaattgtgatacccaaaggatttgacttctatgtccctgccattgtcatagcacttcccaataagcatgtggccacagaaaaattctacacagttttgaagtgtaacaaccggagagaattttgccctcggagtgcacttattaagatcagccaaaacaagtatgcgctctcttgctctcatataaagtcacccccaattcctgaggatccagaagtagaggatgtggaggcgaggaactctgctttcctcttctggccactgaaagaagcggacacgcaggattccagagagccaagacgagagaagcccaggaggaaaaagaggcccgccaagcagccactccagcaggcggcgccctcggactcggacggctcctcccacggcatcagctcccatgggtcctgccaggggacacaccccgagcccaggacagcccacctccacttccccgcggccgggcgtctaggactcagcagccacgccatcattgccacacctccacctcgagcagccctgccctgtactctccaagccacccacagcagcaaagggctgaggagcgtccctgagacactttaaggccgtctggtggcagctatgtttaagagaccagcgtccttccaggctgttcagacctcagcgttgacactgaaactggcccctccgcggagtctgttgtaggtaactctaattgagcccgaaaccagaataaaaactcttacattggaaacatttcaaaacca

SEQ ID NO: 199337 - DNA, 1542 bp, Homo sapiens
  Payload ID: 19327
  Gene Name: von Willebrand factor A domain containing 3B
  Uniprot ID: Q502W6
  ENST ID: ENST00000614454
  CDS Start-End: 129-1379
gtaaaaactaagatgtcagactcgaagtgtggggtatgactttatctttccctggatctgcatgtggagaggacggagagtgggtgcacacaagccaaatctgagctactatcacactgaagcacacaatggccacgaaaggcatgaggttgaaatccacaaaagaggtgttccctctggcacatgtgtgcaacgacacaaataagatgacattaattaacccccaaggagccaaactcaatatctacaagcgaaaagtggaacaggcaattcaatcctatgaaaagcgcttgaataaaattgtttggcgagcattatctcaagaggaaaaagaaaagttagatgcaaacaaaccaatacagtacttggaaaacaaaacagttttaaaccaggctttagaacggttgaattggcccatttcactgaaagagctgtcgatgctggaaagtgaaatcctagctgggaaaatgtacatccagcaggccatggaactccaggaggctgccaagaagaattatgcaaacaaggccccgggagagcaacagaaattgcaaggaaatccaacaaagaaaaccaaatcaaaaagaccagatcccctcaaaggacagaaggttattgcaagatgtgatgaaaatggcttttattttccaggggttgtgaagaagtgtgtgagccgcacccaagcactggtgggcttcagttacggagacaccaaggtcgtgtccacctccttcatcacgcctgtggggggcgccatgccctgcccgctgctccaggttggagattatgtgtttgccaaaattgtgatacccaaaggatttgacttctatgtccctgccattgtcatagcacttcccaataagcatgtggccacagaaaaattctacacagttttgaagtgtaacaaccggagagaattttgccctcggagtgcacttattaagatcagccaaaacaagtatgcgctctcttgctctcatataaagtcacccccaattcctgaggatccagaagtagaggatgtggaggcgaggaactctgctttcctcttctggccactgaaagaagcggacacgcaggattccagagagccaagacgagagaagcccaggaggaaaaagaggcccgccaagcagccactccagcaggcggcgccctcggactcggacggctcctcccacggcatcagctcccatgggtcctgccaggggacacaccccgagcccaggacagcccacctccacttccccgcggccgggcgtctaggactcagcagccacgccatcattgccacacctccacctcgagcagccctgccctgtactctccaagccacccacagcagcaaagggctgaggagcgtccctgagacactttaaggccgtctggtggcagctatgtttaagagaccagcgtccttccaggctgttcagacctcagcgttgacactgaaactggcccctccgcggagtctgttgtaggtaactctaattgagcccgaaaccagaataaaaactcttacattggaaacatttcaaaacc

SEQ ID NO: 199338 - DNA, 1863 bp, Homo sapiens
  Payload ID: 19328
  Gene Name: von Willebrand factor A domain containing 5A
  Uniprot ID: O00534
  ENST ID: ENST00000361352
  CDS Start-End: 95-1342
cggttctttccggaaattatgactgcagctgttttcactccgctgtgactcagagcgctccgggctgcaggagaggaagaaatcttgcatcaccatggtgcacttctgtggcctactcaccctccaccgggagccagtgccgctgaagagtatctctgtgagcgtgaacatttacgagtttgtggctggtgtgtctgcaactttgaactacgagaatgaggagaaagttcctttggaggccttctttgtgttccccatggatgaagactctgctgtttacagctttgaggccttggtggatgggaagaaaattgtagcagaattacaagacaagatgaaggcccgcaccaactatgagaaagccatctcccagggccaccaggccttcttattggagggggacagcagctccagggatgtcttctcttgcaatgtgggtaacctccaacctgggtcgaaggcggcagtcaccctgaagtatgtgcaggagctgcctctggaagcagatggggctctgcgctttgtgctcccagctgtcctgaatcctagataccagttctctgggtcgtctaaggacagttgccttaatgtgaagactcctatagtccctgtggaggacctgccctacacactcagcatggtcgccaccatagattcccagcatggcattgagaaggtccaatccaactgccccttgagtcctaccgagtacctaggagaggacaagacttctgctcaggtttccctggctgctggacacaagtttgatcgggacgtggaactcctgatttactacaatgaggtgcatacccccagcgtggttttggagatggggatgcctaacatgaagccaggtcatttgatgggagatccatctgcaatggtgagtttctatccaaatatcccagaagatcaaccatcaaatacctgtggagagtttatctttctcatggaccgctcgggaagtatgcagagccccatgagtagccaggatacatctcagctgcgaatacaggcagccaaggaaacactgattttgctgctgaagagtttacctataggctgttatttcaacatctatggatttggctcttcctatgaggcatgctttccggagagtgtgaagtacactcagcaaacaatggaggaggctctggggagagtgaagcttatgcaggccgacctagggggcactgaaatcttggcaccactccagaacatttacaggggaccctccatcccaggccaccccctacagctttttgtctttacagatggagaagttacagacacgtttagtgtaattaaagaagttaggatcaacagacagaaacacaggtaggaagaaaatgtgatttccgggtgattggtgctgagtagtgacacacagactctagtgctacatgatgccggtgttgaccttccttcaagaggaccaaatgatttcagaatttagttttagcagctgaaaatttatttctccctgtaaacgttaaaaacagttttccaaataacatcaacaacacagcaaaaccattgtttcttattctttctaaactacaacgaacacaagaattgaatagtaagatgttaattttttttactataaacatttttagagaagtaaaacatgctgaaaactacacaaattataagcatacaactggactcattatcacagtgaatgcactgtgtgatcgccacataggtaaaaactggaatggtcgtaggcctctccatctgtacccttttccatcatgtcctattccctgtcactacacactaaaactttcctgacttacaataccatgggttatttatgcttgtttttgaatgaaaataaataagttatacagtatgctt

SEQ ID NO: 199339 - DNA, 2691 bp, Homo sapiens
  Payload ID: 19328
  Gene Name: von Willebrand factor A domain containing 5A
  ENST ID: ENST00000392744
  CDS Start-End: 1329-2624
gactcagagcgctccgggctgcaggagaggaaggtaggggaccaagctaccggtgcagggcctggatccaacccctgctctggaagactgagagctccacattctagctccctttccccagtccccaaatttgtaggggctccttgaattgcacgccccatgggtggaggatttcatcctgatgtatgatccccaggaaggttcctgcaagtttggcagtttaggggaatcttttggaggttgaaggagggatttagccatctcctaatctcaaggcccttcttcctactttccttctcttttactttactttttttcccgctttctttctttgatatagacaattgatgttttctcagtttcaggatagtgtaagctgaggaaatgaggctgtaagcctcatctactccaatcagttgcagcccctaagcccttctctatagaaatgtaagagaccgacgcagtctcttctgtaaatacgtggacattggaaatctaggactgaatggaaaggttaaatcaatctctgattttatccaagccccacttcttaccccaaatctcctccttgtctggttccgagttctccacttcacccctgccacaggccgcaggggtgtgtgtggccggtggtgccacccagctcccctcccaccctcctagctgctgagcggctggtgctgggactctgcattcctgaagcagctacctggctaggccggaagccttgtattctcccagctgcctcagattcatggctttcagcttggtggccagtctctacctaagccttgcaagttgcctttctgaagtgccatcctgagagacagaactaattctgacccaaactaattttgtttgtactgggaagagtgggggcaagggtgcagaatagcaagttttcctcaacggaggatttgttctgagcttagaatcaggaagcgaaggctatttccttgtaggggtgccctttgcgtctctctctcttttactctagccaccttggtgagtattgcccagcctgagagcttctctttcagctgttttactcctgtgtgagtctcctgctttaggctctctgcttaatgtgttattagaaattcttccctcccccagcccagcctgttctaccagagaacttgcccaggtcagaggtctgcgtagaagcccttttctgagcatcctctcctctcctcacacctgccactgtcctctgcgttgctgtcgaattgttccaacttcctaactccaacattaaccctttgaatgtattcttatgccagagaaaggcacataaagtactggtgtttgaacagataacttccaacatgtcctctgtttgtgatatgtcttttctgcagaaatcttgcatcaccatggtgcacttctgtggcctactcaccctccaccgggagccagtgccgctgaagagtatctctgtgagcgtgaacatttacgagtttgtggctggtgtgtctgcaactttgaactacgagaatgaggagaaagttcctttggaggccttctttgtgttccccatggatgaagactctgctgtttacagctttgaggccttggtggatgggaagaaaattgtagcagaattacaagacaagatgaaggcccgcaccaactatgagaaagccatctcccagggccaccaggccttcttattggagggggacagcagctccagggatgtcttctcttgcaatgtgggtaacctccaacctgggtcgaaggcggcagtcaccctgaagtatgtgcaggagctgcctctggaagcagatggggctctgcgctttgtgctcccagctgtcctgaatcctagataccagttctctgggtcgtctaaggacagttgccttaatgtgaagactcctatagtccctgtggaggacctgccctacacactcagcatggtcgccaccatagattcccagcatggcattgagaaggtccaatccaactgccccttgagtcctaccgagtacctaggagaggacaagacttctgctcaggtttccctggctgctggacacaagtttgatcgggacgtggaactcctgatttactacaatgaggtgcatacccccagcgtggttttggagatggggatgcctaacatgaagccaggtcatttgatgggagatccatctgcaatggtgagtttctatccaaatatcccagaagatcaaccatcaaatacctgtggagagtttatctttctcatggaccgctcgggaagtatgcagagccccatgagtagccaggatacatctcagctgcgaatacaggcagccaaggaaacactgattttgctgctgaagagtttacctataggctgttatttcaacatctatggatttggctcttcctatgaggcatgctttccggagagtgtgaagtacactcagcaaacaatggaggaggctctggggagagtgaagcttatgcaggccgacctagggggcactgaaatcttggcaccactccagaacatttacaggggaccctccatcccaggccaccccctacagctttttgtctttacagatggagaagttacagacacgtttagtgtaattaaagaagttaggatcaacagacagaaacacaggtaggaagaaaatgtgatttccgggtgattggtgctgagtagtgacacacagactctagtgctacatgatg

SEQ ID NO: 199340 - DNA, 3419 bp, Homo sapiens
  Payload ID: 19328
  Gene Name: von Willebrand factor A domain containing 5A
  Uniprot ID: O00534
  ENST ID: ENST00000392748
  CDS Start-End: 95-2455
cggttctttccggaaattatgactgcagctgttttcactccgctgtgactcagagcgctccgggctgcaggagaggaagaaatcttgcatcaccatggtgcacttctgtggcctactcaccctccaccgggagccagtgccgctgaagagtatctctgtgagcgtgaacatttacgagtttgtggctggtgtgtctgcaactttgaactacgagaatgaggagaaagttcctttggaggccttctttgtgttccccatggatgaagactctgctgtttacagctttgaggccttggtggatgggaagaaaattgtagcagaattacaagacaagatgaaggcccgcaccaactatgagaaagccatctcccagggccaccaggccttcttattggagggggacagcagctccagggatgtcttctcttgcaatgtgggtaacctccaacctgggtcgaaggcggcagtcaccctgaagtatgtgcaggagctgcctctggaagcagatggggctctgcgctttgtgctcccagctgtcctgaatcctagataccagttctctgggtcgtctaaggacagttgccttaatgtgaagactcctatagtccctgtggaggacctgccctacacactcagcatggtcgccaccatagattcccagcatggcattgagaaggtccaatccaactgccccttgagtcctaccgagtacctaggagaggacaagacttctgctcaggtttccctggctgctggacacaagtttgatcgggacgtggaactcctgatttactacaatgaggtgcatacccccagcgtggttttggagatggggatgcctaacatgaagccaggtcatttgatgggagatccatctgcaatggtgagtttctatccaaatatcccagaagatcaaccatcaaatacctgtggagagtttatctttctcatggaccgctcgggaagtatgcagagccccatgagtagccaggatacatctcagctgcgaatacaggcagccaaggaaacactgattttgctgctgaagagtttacctataggctgttatttcaacatctatggatttggctcttcctatgaggcatgctttccggagagtgtgaagtacactcagcaaacaatggaggaggctctggggagagtgaagcttatgcaggccgacctagggggcactgaaatcttggcaccactccagaacatttacaggggaccctccatcccaggccaccccctacagctttttgtctttacagatggagaagttacagacacgtttagtgtaattaaagaagttaggatcaacagacagaaacacaggtgtttctcatttggtattggagaaggcacctccaccagcctaataaaaggtattgcccgggcatcagggggcacctcagaatttatcacaggcaaagacaggatgcagtccaaggctctcaggactctgaaacgctctctgcagcctgtggtagaggatgtctctctgagctggcatttgcctcctggtctgtctgctaaaatgctttccccagaacagactgtcatctttaggggtcagagattaatcagctatgcccagctgaccgggaggatgccagcagcagagacaacaggagaagtatgcctcaaatatacactccagggcaagacttttgaggataaggtgacatttcctctacaacccaagcctgatgtcaacctcaccattcaccgccttgctgccaagtccttgctccagaccaaggacatgggcctcagggagactccagcaagtgataaaaaagatgcattgaaccttagccttgagtctggtgtcataagctccttcacagctttcattgctatcaataaggagctcaacaagccggttcaggggcctctggctcatagggacgtcccaaggccaattctgttgggtgcttctgccccattgaagataaaatgccaatcaggttttcgaaaggccttacactctgaccgtcctccttctgcatctcagcccagaggggaacttatgtgttataaggccaagacattccagatggacgattacagtctctgtgggttgataagtcacaaggaccagcacagtccaggctttggagagaatcaccttgtgcagctgatttaccaccaaaatgcaaatggttcctgggatctgaatgaagatctagccaagatcctaggtatgagtttggaagaaataatggctgcacagcctgccgagcttgtggattcctcaggctgggccaccatcctggccgtgatctggctgcacagcaatggtaaggacttgaagtgtgaatgggagcttctggaaaggaaggccgtggcctggatgcgtgcccatgcaggctccaccatgccttcggttgtgaaagctgctattactttcctgaagtcatctgtggatcctgctatctttgccttttgaagataccatccagaaaaagaagtgcctttaatttgctactgtcatttcctctagtatcacttttgctgtgatgatgtgttcttgtgtattataactctttattttttgccataaaagtaaaggatgcttactccacttcgcttctctgctccaggttcactttggatatgatctttcttttcccaacatatgccctcagaaaagtgacagtggtcccagaacctattccctttcttgagggagttcaaaacattcataggcagtaatgttcctcccagggtttccagggaaacaacatgaaaaacaggtgacatgaactacagactaaagattgcagcatttatgttagagaatgcttgaattagagaattttctgcattatctttgtctgttcactttctatcttatatacttatcagggccatactggtaagcttgcgtaggaggagttagagggaagttgaaagccaacatctggatcaatgtaatgtcaagatcacaaagacagagactgcaggggtccactgtgagaggtgacactgttggggaccttcctgattcattcttcttgggctttgctagcctgtacaacctacatgtcttttcttccactgcctgaaagacttgggttgaactataactgttggagagagatgttcctctttaatcatgaaacaccttaagaagtctataatgcaatccttagtcctaccctgaacctatgtgtcctctaagtcaggccctgatctagtgcagtaaagggaagggtgggcttaatgggagctttgcctgggacctgaacctggagcacttaccgcattaggaagaaaggagctccccgtaatcgttcctgacccttgtgtctcatataccctatcctggtggaaatgaccctatttgatatgctgtcccttaaaataacttgtatcaatattaaaatgactatttctaccctttgatgagt

SEQ ID NO: 199341 - DNA, 1978 bp, Homo sapiens
  Payload ID: 19328
  Gene Name: von Willebrand factor A domain containing 5A
  Uniprot ID: O00534
  ENST ID: ENST00000449321
  CDS Start-End: 210-1457
cggttctttccggaaattatgactgcagctgttttcactccgctgtgactcagagcgctccgggctgcaggagaggaagcccagcctgttctaccagagaacttgcccaggtcagaggtctgcgtagaagcccttttctgagcatcctctcctctcctcacacctgccactgtcctctgcgttgctgtcgaattaaatcttgcatcaccatggtgcacttctgtggcctactcaccctccaccgggagccagtgccgctgaagagtatctctgtgagcgtgaacatttacgagtttgtggctggtgtgtctgcaactttgaactacgagaatgaggagaaagttcctttggaggccttctttgtgttccccatggatgaagactctgctgtttacagctttgaggccttggtggatgggaagaaaattgtagcagaattacaagacaagatgaaggcccgcaccaactatgagaaagccatctcccagggccaccaggccttcttattggagggggacagcagctccagggatgtcttctcttgcaatgtgggtaacctccaacctgggtcgaaggcggcagtcaccctgaagtatgtgcaggagctgcctctggaagcagatggggctctgcgctttgtgctcccagctgtcctgaatcctagataccagttctctgggtcgtctaaggacagttgccttaatgtgaagactcctatagtccctgtggaggacctgccctacacactcagcatggtcgccaccatagattcccagcatggcattgagaaggtccaatccaactgccccttgagtcctaccgagtacctaggagaggacaagacttctgctcaggtttccctggctgctggacacaagtttgatcgggacgtggaactcctgatttactacaatgaggtgcatacccccagcgtggttttggagatggggatgcctaacatgaagccaggtcatttgatgggagatccatctgcaatggtgagtttctatccaaatatcccagaagatcaaccatcaaatacctgtggagagtttatctttctcatggaccgctcgggaagtatgcagagccccatgagtagccaggatacatctcagctgcgaatacaggcagccaaggaaacactgattttgctgctgaagagtttacctataggctgttatttcaacatctatggatttggctcttcctatgaggcatgctttccggagagtgtgaagtacactcagcaaacaatggaggaggctctggggagagtgaagcttatgcaggccgacctagggggcactgaaatcttggcaccactccagaacatttacaggggaccctccatcccaggccaccccctacagctttttgtctttacagatggagaagttacagacacgtttagtgtaattaaagaagttaggatcaacagacagaaacacaggtaggaagaaaatgtgatttccgggtgattggtgctgagtagtgacacacagactctagtgctacatgatgccggtgttgaccttccttcaagaggaccaaatgatttcagaatttagttttagcagctgaaaatttatttctccctgtaaacgttaaaaacagttttccaaataacatcaacaacacagcaaaaccattgtttcttattctttctaaactacaacgaacacaagaattgaatagtaagatgttaattttttttactataaacatttttagagaagtaaaacatgctgaaaactacacaaattataagcatacaactggactcattatcacagtgaatgcactgtgtgatcgccacataggtaaaaactggaatggtcgtaggcctctccatctgtacccttttccatcatgtcctattccctgtcactacacactaaaactttcctgacttacaataccatgggttatttatgcttgtttttgaatgaaaataaataagttatacagtatgctt

SEQ ID NO: 199342 - DNA, 4388 bp, Homo sapiens
  Payload ID: 19328
  Gene Name: von Willebrand factor A domain containing 5A
  Uniprot ID: O00534
  ENST ID: ENST00000456829
  CDS Start-End: 252-2612
agtcttgtagtcgctactttataaccggtccctagaagggggcggttctttccggaaattatgactgcagctgttttcactccgctgtgactcagagcgctccgggctgcaggagaggaagcccagcctgttctaccagagaacttgcccaggtcagaggtctgcgtagaagcccttttctgagcatcctctcctctcctcacacctgccactgtcctctgcgttgctgtcgaattaaatcttgcatcaccatggtgcacttctgtggcctactcaccctccaccgggagccagtgccgctgaagagtatctctgtgagcgtgaacatttacgagtttgtggctggtgtgtctgcaactttgaactacgagaatgaggagaaagttcctttggaggccttctttgtgttccccatggatgaagactctgctgtttacagctttgaggccttggtggatgggaagaaaattgtagcagaattacaagacaagatgaaggcccgcaccaactatgagaaagccatctcccagggccaccaggccttcttattggagggggacagcagctccagggatgtcttctcttgcaatgtgggtaacctccaacctgggtcgaaggcggcagtcaccctgaagtatgtgcaggagctgcctctggaagcagatggggctctgcgctttgtgctcccagctgtcctgaatcctagataccagttctctgggtcgtctaaggacagttgccttaatgtgaagactcctatagtccctgtggaggacctgccctacacactcagcatggtcgccaccatagattcccagcatggcattgagaaggtccaatccaactgccccttgagtcctaccgagtacctaggagaggacaagacttctgctcaggtttccctggctgctggacacaagtttgatcgggacgtggaactcctgatttactacaatgaggtgcatacccccagcgtggttttggagatggggatgcctaacatgaagccaggtcatttgatgggagatccatctgcaatggtgagtttctatccaaatatcccagaagatcaaccatcaaatacctgtggagagtttatctttctcatggaccgctcgggaagtatgcagagccccatgagtagccaggatacatctcagctgcgaatacaggcagccaaggaaacactgattttgctgctgaagagtttacctataggctgttatttcaacatctatggatttggctcttcctatgaggcatgctttccggagagtgtgaagtacactcagcaaacaatggaggaggctctggggagagtgaagcttatgcaggccgacctagggggcactgaaatcttggcaccactccagaacatttacaggggaccctccatcccaggccaccccctacagctttttgtctttacagatggagaagttacagacacgtttagtgtaattaaagaagttaggatcaacagacagaaacacaggtgtttctcatttggtattggagaaggcacctccaccagcctaataaaaggtattgcccgggcatcagggggcacctcagaatttatcacaggcaaagacaggatgcagtccaaggctctcaggactctgaaacgctctctgcagcctgtggtagaggatgtctctctgagctggcatttgcctcctggtctgtctgctaaaatgctttccccagaacagactgtcatctttaggggtcagagattaatcagctatgcccagctgaccgggaggatgccagcagcagagacaacaggagaagtatgcctcaaatatacactccagggcaagacttttgaggataaggtgacatttcctctacaacccaagcctgatgtcaacctcaccattcaccgccttgctgccaagtccttgctccagaccaaggacatgggcctcagggagactccagcaagtgataaaaaagatgcattgaaccttagccttgagtctggtgtcataagctccttcacagctttcattgctatcaataaggagctcaacaagccggttcaggggcctctggctcatagggacgtcccaaggccaattctgttgggtgcttctgccccattgaagataaaatgccaatcaggttttcgaaaggccttacactctgaccgtcctccttctgcatctcagcccagaggggaacttatgtgttataaggccaagacattccagatggacgattacagtctctgtgggttgataagtcacaaggaccagcacagtccaggctttggagagaatcaccttgtgcagctgatttaccaccaaaatgcaaatggttcctgggatctgaatgaagatctagccaagatcctaggtatgagtttggaagaaataatggctgcacagcctgccgagcttgtggattcctcaggctgggccaccatcctggccgtgatctggctgcacagcaatggtaaggacttgaagtgtgaatgggagcttctggaaaggaaggccgtggcctggatgcgtgcccatgcaggctccaccatgccttcggttgtgaaagctgctattactttcctgaagtcatctgtggatcctgctatctttgccttttgaagataccatccagaaaaagaagtgcctttaatttgctactgtcatttcctctagtatcacttttgctgtgatgatgtgttcttgtgtattataactctttattttttgccataaaagtaaaggatgcttactccacttcgcttctctgctccaggttcactttggatatgatctttcttttcccaacatatgccctcagaaaagtgacagtggtcccagaacctattccctttcttgagggagttcaaaacattcataggcagtaatgttcctcccagggtttccagggaaacaacatgaaaaacaggtgacatgaactacagactaaagattgcagcatttatgttagagaatgcttgaattagagaattttctgcattatctttgtctgttcactttctatcttatatacttatcagggccatactggtaagcttgcgtaggaggagttagagggaagttgaaagccaacatctggatcaatgtaatgtcaagatcacaaagacagagactgcaggggtccactgtgagaggtgacactgttggggaccttcctgattcattcttcttgggctttgctagcctgtacaacctacatgtcttttcttccactgcctgaaagacttgggttgaactataactgttggagagagatgttcctctttaatcatgaaacaccttaagaagtctataatgcaatccttagtcctaccctgaacctatgtgtcctctaagtcaggccctgatctagtgcagtaaagggaagggtgggcttaatgggagctttgcctgggacctgaacctggagcacttaccgcattaggaagaaaggagctccccgtaatcgttcctgacccttgtgtctcatataccctatcctggtggaaatgaccctatttgatatgctgtcccttaaaataacttgtatcaatattaaaatgactatttctaccctttgatgagtaaatgcagtggttcttaaagtggtctcgtctccctaccccacaatattttggtactgccactttgggaagccaaactaggatagtaaattgaccggaacacagttgtggaaatttgacctgaagttagtgaaataaaacttagtagggaaaaaaagcttagcaagaggtctactcctccatagattcatttattgaacttacattggttttattgtcccttgttttctgttccagcttttctgatgcctccactgttcccatggtatcctgaccctctatcttctgttgtaggctgacttcttttatatgaagcaagtaaaggatactaataagaataccactgtagaatcctgaccatacccttaaatagttatgtgatgatgggcaaatgatttcaccctcaggcacttaatatcctcatctgtaaaactaagggattaaactagaactttattaacactttcgagttccactcagaattcctagaggaacatcggtgacttttcactcagaaagtgggtggactaggcctgagtttctttaagttgttgagttacctggtattaggaagacttgtgtgacttgcatagtggactctaatctctcagtctttcttccaagtttgtttatgctgaatgtgatctgcggaacagggttgttagaaatgcagctttttagaaatgcagaattttaatcgataccaggaactactttatttaacaaggctcccaggtatcatgcatgcacattgaagtttgaaaagtaaaggcttaatattttcatgaaataggcttatatccaagcctgccat

SEQ ID NO: 199343 - DNA, 4475 bp, Homo sapiens
  Payload ID: 19329
  Gene Name: von Willebrand factor A domain containing 5B1
  Uniprot ID: Q5TIE3
  ENST ID: ENST00000289815
  CDS Start-End: 197-3844
atcgcaatgtgggcattgatcaagccagctgccagggcagcgggcgcagggcttgggcactggagcccagccccggaccgcacctccagcagtgctgggtgcagaaggcagtcactgtggcagtggagagacagagtgtgtacccagacacgtgttgcttctggggtaaggttctgaaggctgagtagccagcgggatgcccggcttgctgaattggatcacgggggcagccctgcccctcaccgcgtctgatgttacctcctgtgtcagcggttatgccctgggcctaactgcctccctcacctatggcaacctggaagcccagcccttccagggcctcttcgtgtaccccctggatgagtgcaccacggtgatcggctttgaggcagtcattgccgaccgtgtcgtgacagtacagatcaaggacaaagccaagctggagagcggccacttcgatgcctcccatgttcgatccccaacagtcacagggaacattctgcaagacggggtttccatagcccctcattcctgcacaccgggaaaggtgaccttggacgaggatttggagcggatcctgttcgtggccaacctggggaccattgcccccatggagaatgtcaccatcttcatcagcacctcctcggagctcccaacgctgcccagcggggctgtgagggtccttctgcctgctgtctgtgccccaaccgtgccccagttctgcaccaagagcactggcacctccaaccaacaggcccagggcaaagacaggcactgcttcggtgcctgggccccgggctcctggaataagttgtgcctggcgactctcctgaacaccgaagtgtccaaccccatggagtatgagttcaacttccagctggagatccgtgggccatgtctgctcgcaggggtggagagtcccactcatgagattcgtgccgacgccgccccatctgcccgctcggccaagagcatcatcatcaccttggccaacaagcacacctttgaccggcctgtggagatcctcatccaccccagcgagccccatatgccccatgtcctgatagagaaaggggacatgaccctgggagagtttgaccagcacttgaagggaagaacagatttcattaaagggatgaagaagaagagcagagcagagcggaagacagaaatcattcgaaaacgcctccacaaagacattccccaccactccgtcatcatgctcaacttctgtcccgacctccagtcagtccagccgtgcctgagaaaggcccacggggagttcatcttcctcattgacaggagcagcagcatgagcgggatcagcatgcaccgagtcaaggatgccatgttggtggcccttaagagcctcatgccagcctgcctcttcaatatcattgggtttggatccacatttaagagcctttttccttccagccagacctacagtgaggacagcttggccatggcttgtgatgacatccagagaatgaaggccgacatgggtgggaccaacatcctttcccctctcaagtgggtcatcaggcagccagtgcaccgaggccacccgcggctcctcttcgtgatcacagatggcgctgtcaacaacacagggaaggtgctggagctggtgcgaaatcacgccttctccaccaggtgctatagctttggaattggacccaacgtctgccacagactggtgaaaggactggcatctgtgtccgagggcagtgctgagctcctgatggagggggagcggctgcaacccaagatggtcaaatccttgaagaaggccatggccccagtcctgagcgatgtgactgtggagtggatcttccctgagaccactgaggtcctggtctcacccgtcagcgccagctccctcttccctggagaacggctggtggggtatggcattgtatgtgatgcttctttgcacatctccaatcccagatctgacaagaggcgccggtacagcatgctgcactctcaggagtctggcagctctgtcttctaccactctcaggatgacggacccgggctggaaggtggagactgtgccaagaactcgggggcacccttcatcctagggcaggccaaaaatgcccggctagccagcggagactctaccaccaagcacgatctgaacctctctcagcgacggagggcatacagcaccaaccagatcaccaatcacaagcccctcccaagagccaccatggcaagtgaccccatgccagctgccaagagatacccactgcggaaagccaggctgcaggacctcaccaaccagaccagcctggatgtccagcggtggcagattgatttgcagcccttgctgaacagtggtcaggacctgaaccagggccccaaactccgtggcccaggggcccgaaggccctctctgctgccccaaggctgccagcccttcctgccctggggccaggagacccaggcctggagccctgtgagagagcggacttctgacagccgaagccctggagatctggagccgtcccaccatccctctgccttcgagacagagacgtcctcggactgggaccccccagccgagtcccaggagcgagccagtcccagcaggcccgccaccccggccccggtgctgggcaaggccctggtcaaaggcctgcacgacagccaacgcctgcagtgggaggtgagcttcgagctggggacccctggaccggagcggggcggcgcgcaggatgccgacctatggagcgagaccttccaccacctggcggcccgcgccatcatccgcgacttcgagcagctggcggagcgcgagggcgagatcgagcaggggtccaaccgccgctaccaagtgagcgccttgcacaccagcaaggcctgcaacatcattagcaaatacacagccttcgtgcctgtggacgtgagcaagagccggtacctgcccaccgtggtggagtaccccaactctggagctgccctgcgtatgcttggctctcgggccctggcccaacagtggaggggcacctcttctggctttggaaggccgcagacgatgcttggagaagattcggcaccaggaaatgacatggaggcaagtcccactgctctcttcagcgaggccaggtcccccggccgcgagaagcacggtgcttctgaaggtccccagcgcagcctggctacaaatactctttcttccatgaaggcctcagagaatctctttggatcctggctaaatctcaacaagtccaggctactgacgcgagcagccaagggcttcctgagcaagccactgatcaaagctgtggagtcgacctccgggaaccagagcttcgactacatacctctggtgtctctgcagctggcctccggagccttcctgctcaacgaagccttctgtgaggccacgcacatccccatggagaagctcaagtggacgtcccccttcacctgccatcgagtgtccctcaccacccgcccgtctgagtccaagaccccgagtccccagctgtgcaccagctccccgcctaggcacccgtcctgtgacagcttctccctggagcctctggccaagggcaagctgggcctggagccgagggcagtggtggagcacactgggaagctgtgggccacggtggtggggctggcatggctggagcacagttcggcctcctacttcactgagtgggagttggtggctgccaaggccaactcatggctggagcagcaggaagtacccgagggccgcacgcagggcacactcaaggccgctgcccgccagctgtttgtgcttctgcggcactgggatgagaatctcgagttcaatatgctctgctataacccgaattatgtgtagttgagtgacggggaggctgggtggagggaagggtggggaggagagggatgggcagggccatgtcggcctggtttcggggagcttttggagctgtaactaatatttcagttactagaaagagccctggactggcagccaggaggcctgagttcaatcccaactttgctaccatccagccatgcaactttaggccagtgcctgcccccgtctgggcctcagtttcctcatctataaaataagagggcgagatgaaggaggtggagtggatctcaaatggttcagtggttcctttctgcccattcaggcagtcccgggctgactgctgctggggctggcgagggaagatgcagtggaagcctgagccctgtctggaggtagaccacgtgggcacggagtggacacagcaatgcccactcaaataaaagggcagatgagagaacccagtgacctcaagtaaccaggcctacaggcttgcataggcacatagagactagcaagtctggtgcctgtaggacaggctcttgtctccatggtaacagccaaggaccccccctaaatcccacttaaaagccaattggagaagcatccttctcaacgctttacaaaagagtagtttgggggccttttgttt

SEQ ID NO: 199344 - DNA, 3859 bp, Homo sapiens
  Payload ID: 19329
  Gene Name: von Willebrand factor A domain containing 5B1
  Uniprot ID: Q5TIE3
  ENST ID: ENST00000375079
  CDS Start-End: 197-3859
atcgcaatgtgggcattgatcaagccagctgccagggcagcgggcgcagggcttgggcactggagcccagccccggaccgcacctccagcagtgctgggtgcagaaggcagtcactgtggcagtggagagacagagtgtgtacccagacacgtgttgcttctggggtaaggttctgaaggctgagtagccagcgggatgcccggcttgctgaattggatcacgggggcagccctgcccctcaccgcgtctgatgttacctcctgtgtcagcggttatgccctgggcctaactgcctccctcacctatggcaacctggaagcccagcccttccagggcctcttcgtgtaccccctggatgagtgcaccacggtgatcggctttgaggcagtcattgccgaccgtgtcgtgacagtacagatcaaggacaaagccaagctggagagcggccacttcgatgcctcccatgttcgatccccaacagtcacagggaacattctgcaagacggggtttccatagcccctcattcctgcacaccgggaaaggtgaccttggacgaggatttggagcggatcctgttcgtggccaacctggggaccattgcccccatggagaatgtcaccatcttcatcagcacctcctcggagctcccaacgctgcccagcggggctgtgagggtccttctgcctgctgtctgtgccccaaccgtgccccagttctgcaccaagagcactggcacctccaaccaacaggcccagggcaaagacaggcactgcttcggtgcctgggccccgggctcctggaataagttgtgcctggcgactctcctgaacaccgaagtgtccaaccccatggagtatgagttcaacttccagctggagatccgtgggccatgtctgctcgcaggggtggagagtcccactcatgagattcgtgccgacgccgccccatctgcccgctcggccaagagcatcatcatcaccttggccaacaagcacacctttgaccggcctgtggagatcctcatccaccccagcgagccccatatgccccatgtcctgatagagaaaggggacatgaccctgggagagtttgaccagcacttgaagggaagaacagatttcattaaagggatgaagaagaagagcagagcagagcggaagacagaaatcattcgaaaacgcctccacaaagacattccccaccactccgtcatcatgctcaacttctgtcccgacctccagtcagtccagccgtgcctgagaaaggcccacggggagttcatcttcctcattgacaggagcagcagcatgagcgggatcagcatgcaccgagtcaaggatgccatgttggtggcccttaagagcctcatgccagcctgcctcttcaatatcattgggtttggatccacatttaagagcctttttccttccagccagacctacagtgaggacagcttggccatggcttgtgatgacatccagagaatgaaggccgacatgggtgggaccaacatcctttcccctctcaagtgggtcatcaggcagccagtgcaccgaggccacccgcggctcctcttcgtgatcacagatggcgctgtcaacaacacagggaaggtgctggagctggtgcgaaatcacgccttctccaccaggtgctatagctttggaattggacccaacgtctgccacagactggtgaaaggactggcatctgtgtccgagggcagtgctgagctcctgatggagggggagcggctgcaacccaagatggtcaaatccttgaagaaggccatggccccagtcctgagcgatgtgactgtggagtggatcttccctgagaccactgaggtcctggtctcacccgtcagcgccagctccctcttccctggagaacggctggtggggtatggcattgtatgtgatgcttctttgcacatctccaatcccagatctgacaagaggcgccggtacagcatgctgcactctcaggagtctggcagctctgtcttctaccactctcaggatgacggacccgggctggaaggtggagactgtgccaagaactcgggggcacccttcatcctagggcaggccaaaaatgcccggctagccagcggagactctaccaccaagcacgatctgaacctctctcagcgacggagggcatacagcaccaaccagatcaccaatcacaagcccctcccaagagccaccatggcaagtgaccccatgccagctgccaagagatacccactgcggaaagccaggctgcaggacctcaccaaccagaccagcctggatgtccagcggtggcagattgatttgcagcccttgctgaacagtggtcaggacctgaaccagggccccaaactccgtggcccaggggcccgaaggccctctctgctgccccaaggctgccagcccttcctgccctggggccaggagacccaggcctggagccctgtgagagagcggacttctgacagccgaagccctggagatctggagccgtcccaccatccctctgccttcgagacagagacgtcctcggactgggaccccccagccgagtcccaggagcgagccagtcccagcaggcccgccaccccggccccggtgctgggcaaggccctggtcaaaggcctgcacgacagccaacgcctgcagtgggaggtgagcttcgagctggggacccctggaccggagcggggcggcgcgcaggatgccgacctatggagcgagaccttccaccacctggcggcccgcgccatcatccgcgacttcgagcagctggcggagcgcgagggcgagatcgagcaggggtccaaccgccgctaccaagtgagcgccttgcacaccagcaaggcctgcaacatcattagcaaatacacagccttcgtgcctgtggacgtgagcaagagccggtacctgcccaccgtggtggagtaccccaactctgctgccctgcgtatgcttggctctcgggccctggcccaacagtggaggggcacctcttctggctttggaaggccgcagacgatgcttggagaagattcggcaccaggaaatggtaaatttcaggccctaaacatggaggcaagtcccactgctctcttcagcgaggccaggtcccccggccgcgagaagcacggtgcttctgaaggtccccagcgcagcctggctacaaatactctttcttccatgaaggcctcagagaatctctttggatcctggctaaatctcaacaagtccaggctactgacgcgagcagccaagggcttcctgagcaagccactgatcaaagctgtggagtcgacctccgggaaccagagcttcgactacatacctctggtgtctctgcagctggcctccggagccttcctgctcaacgaagccttctgtgaggccacgcacatccccatggagaagctcaagtggacgtcccccttcacctgccatcgagtgtccctcaccacccgcccgtctgagtccaagaccccgagtccccagctgtgcaccagctccccgcctaggcacccgtcctgtgacagcttctccctggagcctctggccaagggcaagctgggcctggagccgagggcagtggtggagcacactgggaagctgtgggccacggtggtggggctggcatggctggagcacagttcggcctcctacttcactgagtgggagttggtggctgccaaggccaactcatggctggagcagcaggaagtacccgagggccgcacgcagggcacactcaaggccgctgcccgccagctgtttgtgcttctgcggcactgggatgagaatctcgagttcaatatgctctgctataacccgaattatgtgtag

SEQ ID NO: 199345 - DNA, 3776 bp, Homo sapiens
  Payload ID: 19329
  Gene Name: von Willebrand factor A domain containing 5B1
  ENST ID: ENST00000485375
  CDS Start-End: 197-751
atcgcaatgtgggcattgatcaagccagctgccagggcagcgggcgcagggcttgggcactggagcccagccccggaccgcacctccagcagtgctgggtgcagaaggcagtcactgtggcagtggagagacagagtgtgtacccagacacgtgttgcttctggggtaaggttctgaaggctgagtagccagcgggatgcccggcttgctgaattggatcacgggggcagccctgcccctcaccgcgtctgatgttacctcctgtgtcagcggttatgccctgggcctaactgcctccctcacctatggcaacctggaagcccagcccttccagggcctcttcgtgtaccccctggatgagtgcaccacggtgatcggctttgaggcagtcattgccgaccgtgtcgtgacagtacagatcaaggacaaagccaagctggagagcggccacttcgatgcctcccatgttcgatccccaacagtcacaggtgaccttggacgaggatttggagcggatcctgttcgtggccaacctggggaccattgcccccatggagaatgtcaccatcttcatcagcacctcctcggagctcccaacgctgcccagcggggctgtgagggtccttctgcctgctgtctgtgccccaaccgtgccccagttctgcaccaagagcactggcacctccaaccaacaggcccagggcaaagacaggcactgcttcggtgcctgggccccgggctcctggaataagttgtgcctggcgactctcctgaacaccgaagtgtccaaccccatggagtatgagttcaacttccagctggagatccgtgggccatgtctgctcgcaggggtggagagtcccactcatgagattcgtgccgacgccgccccatctgcccgctcggccaagagcatcatcatcaccttggccaacaagcacacctttgaccggcctgtggagatcctcatccaccccagcgagccccatatgccccatgtcctgatagagaaaggggacatgaccctgggagagtttgaccagcacttgaagggaagaacagatttcattaaagggatgaagaagaagagcagagcagagcggaagacagaaatcattcgaaaacgcctccacaaagacattccccaccactccgtcatcatgctcaacttctgtcccgacctccagtcagtccagccgtgcctgagaaaggcccacggggagttcatcttcctcattgacaggagcagcagcatgagcgggatcagcatgcaccgagtcaaggatgccatgttggtggcccttaagagcctcatgccagcctgcctcttcaatatcattgggtttggatccacatttaagagcctttttccttccagccagacctacagtgaggacagcttggccatggcttgtgatgacatccagagaatgaaggccgacatgggtgggaccaacatcctttcccctctcaagtgggtcatcaggcagccagtgcaccgaggccacccgcggctcctcttcgtgatcacagatggcgctgtcaacaacacagggaaggtgctggagctggtgcgaaatcacgccttctccaccaggtgctatagctttggaattggacccaacgtctgccacagactggtgaaaggactggcatctgtgtccgagggcagtgctgagctcctgatggagggggagcggctgcaacccaagatggtcaaatccttgaagaaggccatggccccagtcctgagcgatgtgactgtggagtggatcttccctgagaccactgaggtcctggtctcacccgtcagcgccagctccctcttccctggagaacggctggtggggtatggcattgtatgtgatgcttctttgcacatctccaatcccagatctgacaagaggcgccggtacagcatgctgcactctcaggagtctggcagctctgtcttctaccactctcaggatgacggacccgggctggaaggtggagactgtgccaagaactcgggggcacccttcatcctagggcaggccaaaaatgcccggctagccagcggagactctaccaccaagcacgatctgaacctctctcagcgacggagggcatacagcaccaaccagatcaccaatcacaagcccctcccaagagccaccatggcaagtgaccccatgccagctgccaagagatacccactgcggaaagccaggctgcaggacctcaccaaccagaccagcctggatgtccagcggtggcagattgatttgcagcccttgctgaacagtggtcaggacctgaaccagggccccaaactccgtggcccaggggcccgaaggccctctctgctgccccaaggctgccagcccttcctgccctggggccaggagacccaggcctggagccctgtgagagagcggacttctgacagccgaagccctggagatctggagccgtcccaccatccctctgccttcgagacagagacgtcctcggactgggaccccccagccgagtcccaggagcgagccagtcccagcaggcccgccaccccggccccggtgctgggcaaggccctggtcaaaggcctgcacgacagccaacgcctgcagtgggaggtgagcttcgagctggggacccctggaccggagcggggcggcgcgcaggatgccgacctatggagcgagaccttccaccacctggcggcccgcgccatcatccgcgacttcgagcagctggcggagcgcgagggcgagatcgagcaggggtccaaccgccgctaccaagtgagcgccttgcacaccagcaaggcctgcaacatcattagcaaatacacagccttcgtgcctgtggacgtgagcaagagccggtacctgcccaccgtggtggagtaccccaactctggagctgccctgcgtatgcttggctctcgggccctggcccaacagtggaggggcacctcttctggctttggaaggccgcagacgatgcttggagaagattcggcaccaggaaatgacatggaggcaagtcccactgctctcttcagcgaggccaggtcccccggccgcgagaagcacggtgcttctgaaggtccccagcgcagcctggctacaaatactctttcttccatgaaggcctcagagaatctctttggatcctggctaaatctcaacaagtccaggctactgacgcgagcagccaagggcttcctgagcaagccactgatcaaagctgtggagtcgacctccgggaaccagagcttcgactacatacctctggtgtctctgcagctggcctccggagccttcctgctcaacgaagccttctgtgaggccacgcacatccccatggagaagctcaagtggacgtcccccttcacctgccatcgagtgtccctcaccacccgcccgtctgagtccaagaccccgagtccccagctgtgcaccagctccccgcctaggcacccgtcctgtgacagcttctccctggagcctctggccaagggcaagctgggcctggagccgagggcagtggtggagcacactgggaagctgtgggccacggtggtggggctggcatggctggagcacagttcggcctcctacttcactgagtgggagttggtggctgccaaggccaactcatggctggagcagcaggaagtacccgagggccgcacgcagggcacactcaaggccgctgcccgccagctgtttgtgcttctgcggcactgggatgagaatctcgagttcaatatgctctgctataacccg

SEQ ID NO: 199346 - DNA, 541 bp, Homo sapiens
  Payload ID: 19329
  Gene Name: von Willebrand factor A domain containing 5B1
  ENST ID: ENST00000534075
  CDS Start-End: 159-541
actttgataagagtgttggtgctattggtgattgggtggcccttagagcacgggcttctaaaggggacatgaaagcaggacttcctagagggggctggagataagaaaagaagcaaaggcccctagccccaggttctgaaggctgagtagccagcgggatgcccggcttgctgaattggatcacgggggcagccctgcccctcaccgcgtctgatgttacctcctgtgtcagcggttatgccctgggcctaactgcctccctcacctatggcaacctggaagcccagcccttccagggcctcttcgtgtaccccctggatgagtgcaccacggtgatcggctttgaggcagtcattgccgaccgtgtcgtgacagtacagatcaaggacaaagccaagctggagagcggccacttcgatgcctcccatgttcgatccccaacagtcacagggaacattctgcaagacggggtttccatagcccctcattcctgcacaccgggaaaggtgaccttggacgaggatttggagcggatcctgtt

SEQ ID NO: 199347 - DNA, 2116 bp, Homo sapiens
  Payload ID: 19329
  Gene Name: von Willebrand factor A domain containing 5B1
  ENST ID: ENST00000467486
  CDS Start-End: 1-1333
atgtgatgcttctttgcacatctccaatcccagatctgacaagaggcgccggtacagcatgctgcactctcaggagtctggcagctctgtcttctaccactctcaggatgacggacccgggctggaaggtggagactgtgccaagaactcgggggcacccttcatcctagggcaggccaaaaatgcccggctagccagcggagactctaccaccaagcacgatctgaacctctctcagcgacggagggcatacagcaccaaccagatcaccaatcacaagcccctcccaagagccaccatggcaagtgaccccatgccagctgccaagagatacccactgcggaaagccaggctgcaggacctcaccaaccagaccagcctggatgtccagcggtggcagattgatttgcagcccttgctgaacagtggtcaggacctgaaccagggccccaaactccgtggcccaggggcccgaaggccctctctgctgccccaaggctgccagcccttcctgccctggggccaggagacccaggcctggagccctgtgagagagcggacttctgacagccgaagccctggagatctggagccgtcccaccatccctctgccttcgagacagagacgtcctcggactgggaccccccagccgagtcccaggagcgagccagtcccagcaggcccgccaccccggccccggtgctgggcaaggccctggtcaaaggcctgcacgacagccaacgcctgcagtgggaggtgagcttcgagctggggacccctggaccggagcggggcggcgcgcaggatgccgacctatggagcgagaccttccaccacctggcggcccgcgccatcatccgcgacttcgagcagctggcggagcgcgagggcgagatcgagcaggggtccaaccgccgctaccaagtgagcgccttgcacaccagcaaggcctgcaacatcattagcaaatacacagccttcgtgcctgtggacgtgagcaagagccggtacctgcccaccgtggtggagtaccccaactctggagctgccctgcgtatgcttggctctcgggccctggcccaacagtggaggggcacctcttctggctttggaaggccgcagacgatgcttggagaagattcggcaccaggaaatggtcctagaaagtgctcacagacattgatgggttttaaaacaaaaacagaaacagaacacagtgtgagggggtggaaacccagaggagctcttcagaatcaaagtgttctctcaacttcttggtcccattggcctccaaaacccaggagaaccagctccacccctgagccaagctgaacttccagtcttcaggaaattgctgacatggaggcaagtcccactgctctcttcagcgaggccaggtcccccggccgcgagaagcacggtgcttctgaaggtccccagcgcagcctggctacaaatactctttcttccatgaaggcctcagagaatctctttggatcctggctaaatctcaacaagtccaggctactgacgcgagcagccaagggcttcctgagcaagccactgatcaaagctgtggagtcgacctccgggaaccagagcttcgactacatacctctggtgtctctgcagctggcctccggagccttcctgctcaacgaagccttctgtgaggccacgcacatccccatggagaagctcaagtggacgtcccccttcacctgccatcgagtgtccctcaccacccgcccgtctgagtccaagaccccgagtccccagctgtgcaccagctccccgcctaggcacccgtcctgtgacagcttctccctggagcctctggccaagggcaagctgggcctggagccgagggcagtggtggagcacactgggaagctgtgggccacggtggtggggctggcatggctggagcacagttcggcctcctacttcactgagtgggagttggtggctgccaaggccaactcatggctggagcagcaggaagtacccgagggccgcacgcagggcacactcaaggccgctgcccgccagctgtttgtgcttctgcggcactgggatgagaatctcgagttcaatatgctctgctataacccg

SEQ ID NO: 199348 - DNA, 541 bp, Homo sapiens
  Payload ID: 19329
  Gene Name: von Willebrand factor A domain containing 5B1
  ENST ID: ENST00000530722
  CDS Start-End: 296-541
actttgataagagtgttggtgctattggtgattgggtggcccttagagcacgggcttctaaaggggacatgaaagcaggacttcctagagggggctggagataagaaaagaagcaaaggcccctagccccaggtaagagggcaggtggcaagcccagaattgcttgtgggctcacagtcttcatctagcccaggcctggctgagcccacacaggtaggggaccccaactctatggagaagcatctaggagggatcaggccaggatgagggttctgaaggctgagtagccagcgggatgcccggcttgctgaattggatcacgggggcagccctgcccctcaccgcgtctgatgttacctcctgtgtcagcggttatgccctgggcctaactgcctccctcacctatggcaacctggaagcccagcccttccagggcctcttcgtgtaccccctggatgagtgcaccacggtgatcggctttgaggcagtcattgccgaccgtgtcgtgacagtacagatcaaggacaaagccaagctggag

SEQ ID NO: 199349 - DNA, 3725 bp, Homo sapiens
  Payload ID: 19329
  Gene Name: von Willebrand factor A domain containing 5B1
  ENST ID: ENST00000473325
  CDS Start-End: 179-1075
atcaagccagctgccagggcagcgggcgcagggcttgggcactggagcccagccccggaccgcacctccagcagtgctgggtgcagaaggcagtcactgtggcagtggagagacagagtgtgtacccagacacgtgttgcttctggggtaaggttctgaaggctgagtagccagcgggatgcccggcttgctgaattggatcacgggggcagccctgcccctcaccgcgtctgatgttacctcctgtgtcagcggttatgccctgggcctaactgcctccctcacctatggcaacctggaagcccagcccttccagggcctcttcgtgtaccccctggatgagtgcaccacggtgatcggctttgaggcagtcattgccgaccgtgtcgtgacagtacagatcaaggacaaagccaagctggagagcggccacttcgatgcctcccatgttcgatccccaacagtcacagggaacattctgcaagacggggtttccatagcccctcattcctgcacaccgggaaaggtgaccttggacgaggatttggagcggatcctgttcgtggccaacctggggaccattgcccccatggagaatgtcaccatcttcatcagcacctcctcggagctcccaacgctgcccagcggggctgtgagggtccttctgcctgctgtctgtgccccaaccgtgccccagttctgcaccaagagcactggcacctccaaccaacaggcccagggcaaagacaggcactgcttcggtgcctgggccccgggctcctggaataagttgtgcctggcgactctcctgaacaccgaagtgtccaaccccatggagtatgagttcaacttccagctggagatccgtgggccatgtctgctcgcaggtggggaaattgaggcagcctggccatggtcacactgcaggtcaggagcccctaacggggctggcatgtcactcatctctggcctggatctcggtgtgccccagcgaactcctctctctcctgacctcatgagcctatatcccccttgcctttctatgccactcaggggtggagagtcccactcatgagattcgtgccgacgccgccccatctgcccgctcggccaagagcatcatcatcaccttggccaacaagcacacctttgaccggcctgtggagatcctcatccaccccagcgagccccatatgccccatgtcctgatagagaaaggggacatgaccctgggagagtttgaccagcacttgaagggaagaacagatttcattaaagggatgaagaagaagagcagagcagagcggaagacagaaatcattcgaaaacgcctccacaaagacattccccaccactccgtcatcatgctcaacttctgtcccgacctccagtcagtccagccgtgcctgagaaaggcccacggggagttcatcttcctcattgacaggagcagcagcatgagcgggatcagcatgcaccgagtcaaggatgccatgttggtggcccttaagagcctcatgccagcctgcctcttcaatatcattgggtttggatccacatttaagagcctttttccttccagccagacctacagtgaggacagcttggccatggcttgtgatgacatccagagaatgaaggccgacatgggtgggaccaacatcctttcccctctcaagtgggtcatcaggcagccagtgcaccgaggccacccgcggctcctcttcgtgatcacagatggcgctgtcaacaacacagggaaggtgctggagctggtgcgaaatcacgccttctccaccaggtgctatagctttggaattggacccaacgtctgccacagactggtgaaaggactggcatctgtgtccgagggcagtgctgagctcctgatggagggggagcggctgcaacccaagatggtcaaatccttgaagaaggccatggccccagtcctgagcgatgtgactgtggagtggatcttccctgagaccactgaggtcctggtctcacccgtcagcgccagctccctcttccctggagaacggctggtggggtatggcattgtatgtgatgcttctttgcacatctccaatcccagatctgacaagaggcgccggtacagcatgctgcactctcaggagtctggcagctctgtcttctaccactctcaggatgacggacccgggctggaaggtggagactgtgccaagaactcgggggcacccttcatcctagggcaggccaaaaatgcccggctagccagcggagactctaccaccaagcacgatctgaacctctctcagcgacggagggcatacagcaccaaccagatcaccaatcacaagcccctcccaagagccaccatggcaagtgaccccatgccagctgccaagagatacccactgcggaaagccaggctgcaggacctcaccaaccagaccagcctggatgtccagcggtggcagattgatttgcaggccttcatctgccttacctccgaggacaccttccaaatcaggacacccaccggtcaataagctcgctcattccctgcacacacactgcccagttggcaaggaacatttgcatgtgctctttcatttgactttatagcagacctgggggaggagagagtttaggggcccaccttggctcagtacagatgtggaaattgagagccagagaggtagggcacttatccaaggtcacacagccagtcagaggattgtaacctgtctgacctttgaaggaccccctgccttcaaagccttttattccccctcattagattgcacctcctacaaattccaggggatatacatttacccagggcagagaggattttttgtttatttgtttgtttgtttgttgagacagagtctcgctctgttgcccaggctggagtgcagtggtgccatctcagctcactgcaacctctacctcctaggttcaagcaattctcatgcctcagccttccaagtagctgggattacaggcacgtgccaccatacctggctaacttttgtattttatttatttatttatttttgagatggagttttgctcgtgttgcccaggctggagtgcaatggcgcaatctcagctcactgcaacctctgcctcctgggttcaagcgattctcctgcctcagcctcctgagtagctgagattacaggcatgtaccgctatgcccggctaatttttgtatttttggtagagacagggtttcaccatgttggccaggctagtctcgaactcctggcctcaggtgatccacctgcctcgaactcccaaagcactgggattacaggtgtgggccaccacgcctggcctgatttttgtatttttagtagagacagggttttgccatattgcccgggctggtcttgaactcctgggctcaagcgatctgcctgcctcggcctcccaaaggtctgggattacagaagtgagcaaccatgcctggcagcagagagaatttgagagttagagagccacagctaggccagggtttctcagcctcagcaccatggacacgataattttatatttgggggcaattctgtgcactgtagaatgttcggcagcatcccttggcctctgctcgctagaggcctcctgggaataacaccatccccaatcatgacaaccaaaaatgtctgcagacactgccaaatgttccctggggagctaaatcacctggttgagcaccattgtcctaaacc

SEQ ID NO: 199350 - DNA, 3486 bp, Homo sapiens
  Payload ID: 19330
  Gene Name: von Willebrand factor A domain containing 5B2
  ENST ID: ENST00000273794
  CDS Start-End: 167-3241
ctcttcgtccctccctcggcttctctgggtctagtgcggccccaccagctgcttcggggtgggcagccttcaggaggaagggctggcctgggaggagctggctgcccctcgggacgtgttctcaggccctgcccgctgccctgccccatataccttctccttcgagatgctggtgactgggccatgcctgcttgcaggcctggagagcccctctcatgctctgcgggcagatgccccccctcatgccagctctgcagccaccatctgtgtcacactggcagagggccaccactgtgaccgggccttggagatcctgctgcaccccagtgagccccatcagccacacctgatgctggagggcggcagcctgagctcagcagaatatgaggcccgggtgagggcccgccgagattttcagaggctacagcgaagggacagtgatggggaccggcaggtgtggttcctgcagcgacgcttccacaaggacatcctgctgaaccccgtgctggcgctgagcttctgcccagacctgagctccaagcccggacacctggggacagctactcgggagctactcttccttttggatagcagcagcgtggcacacaaggatgccattgttttggctgtgaagtccctcccgccccagacgcttatcaacctggccgtgtttgggacgttggtgcagccactcttcccagagagccggccttgcagtgatgatgctgtgcagctgatctgcgagagcattgagaccctgcaggttccgagtgggcccccagacgtgctggctgctctggactgggccgtggggcagccccagcacagggcctaccctcggcagctgttcctgctcactgctgcctcacccatggccgccactacccaccgaaccctggagctcatgaggtggcacagggggacagccagatgcttctcctttgggctggggcccacctgccaccagctgctccagggtttatctgccctcagcagaggccaggcctacttcctgaggcctgggcagaggctgcagcccatgctggtacaggctctgcggaaggcactggagcctgctttgagtgacatctctgtggactggtttgtgcccgacactgtggaggcactgctgaccccccgggagatcccagcactctaccctggggaccagctgctcggttactgctcactcttcagggtggatggcttccggtcccgcccaccagggggccaagagcctggctggcagagctcgggtgggtccgtgtttccatccccagaagaggccccgtctgctgccagccctggcactgagcccactggcacctcagagccactgggaacaggcactgtctcagcagaactgtccagcccatgggctgccagggactcggagcagacaggtactgatgctctgacagacccagtcacggatcctggacccaacccctctgacacagccatatggcgccgcatctttcagtcctcgtacattcgggagcagtatgtgctcacccactgctctgccagccccgagccaggcccaggctccacaggcagcagtgagtccccaggctcacagggccctggctcccccgaaggtagtgctcccttggagcccccttctcagcagggctgccgcagtctggcctggggagaacctgcaggctcccgctcctgtcccctgcctgcacccacaccagctccattcaaggtgggggccttgagtactgaggtgctgggccgtcagcacagagcggctctggctggccgaagcctctcatcccctccaggccgggcaaaccaagtccccggccgaccccggaaaccctctttgggtgcaatactagatggcccaagtcctgagccaggccaacagttgggacaaggcctggatgactcaggaaacctgctctccccagcccctatggactgggacatgctgatggaaccacccttcttattcacggctgtgcctcctagtggggagttggcccctccagcagtgcctccccaggctccacgctgccatgtggtgatccggggcctgtgtggggagcagcccatgtgctgggaggtgggtgttgggctggagacactgtggggacctggagatggctcacagcctccctcacctcctgtaagagaagctgcttgggaccaagcactccatcggctgacagcagcctctgtggtccgggacaatgagcagctggccctccgaggaggggcagagaccacagctgaccggggccatgcccggaggtgctggcttcgagcccttcagacaagtaaggtcagctctgccccctcctgcttcacttgccctgtagctgtggatgctactactagggaggtcctgcctggggccctgcaggtgtgcagctcagagcccgctgagcccccaggaacccctcctgcctctcacagccatctagatgcagctcctctgcccactgttgtctactctaaaggacttcagagaggctctccagcaggcgcctgggactcggaccaaaatggcaactccaagcgtgctttgggggaccctgccactcccacggaaggtcctcgccgcccacctccccgtcctccctgtcggctcagcatgggccgccgtcacaaactctgtagccctgacccgggccaggccaacaacagtgaaggcagcgaccatgactacctgcccttggtgcggctgcaggaggcaccaggctccttccgcctggacgcgcccttctgcgccgctgtgcgcatctcgcaggagcgcctctgccgtgcctcgccctttgccgtgcaccgcgccagcctcagccccacctcggcctcattgccctgggcacttctgggccctggtgttggccagggtgacagtgccacggcctcctgcagcccgtcccccagctcgggctctgaggggccaggccaggtggacagtgggcggggctcagacaccgaggcctccgagggggcggaagggctgggcggcaccgacctgcggggccggacctgggccactgccgtagcactcgcctggctggagcaccgatgcgccgctgccttcgacgagtgggaactgacagcggccaaggctgattgctggctgcgggcccagcacttgcctgacggccttgacctggccgccctcaaggccgcagcccgagggctcttcctgctactgcgccactgggaccaaaacctgcagctacacctgctgtgctacagcccagcgaacgtgtgaaggctgccccctgctgcttgggctggcgccccacccaacacactcaagtcactgccgcccagggctggcctcttggtgctgggaaagtgtaggctggtgccagcctgtcccccactgcttcttactccctccctagagccctcttgcccccacaaaaagtgcctgcctgtgctctctccctctcctcccaccccactcacactcccctccatcctctgagctccctgcaacacagtggaagggta

SEQ ID NO: 199351 - DNA, 4120 bp, Homo sapiens
  Payload ID: 19330
  Gene Name: von Willebrand factor A domain containing 5B2
  Uniprot ID: Q8N398
  ENST ID: ENST00000426955
  CDS Start-End: 101-3829
gtgagactctcgcgctggcctctggagcgcggggtgggcgtcccgtcaccctgcgcccagcttccccggcccgttcccgcagggccggcctcccggcgccatgcccggcctgtactgcccctccagctggacgccgctgccgctcacggactcctgggtccgggcctgcgccaacggcccctgcctcagcgtgcgggcccggctcacctaccgcaacccgcagccgcagccggtggacggcgtgttcgtgtacccgctggccgaggccgaggtggtgtccggcttcgaggccgaggccgccggacggcgcgtctccttccagctgcagagccggcgccgctcgcaggccgcctgctgccgcgctctgggcccggggctggggaccccgacgccccgccgctgcgcgcagggtcatcttgtcttggatctggcccaggcccggtccacgttggtgctgcccacaggcattatcgccgcggctggcaccatgacggtgaccctgcacagcagccgggagctgccctcaaggcctgacggggtgctgcatgtggccctgcccactgtgctcaccccgctggccccgccaggcccgccggggccccccaggcctccggggctctgtgacgacagccccaccagctgcttcggggtgggcagccttcaggaggaagggctggcctgggaggagctggctgcccctcgggacgtgttctcaggccctgcccgctgccctgccccatataccttctccttcgagatgctggtgactgggccatgcctgcttgcaggcctggagagcccctctcatgctctgcgggcagatgccccccctcatgccagctctgcagccaccatctgtgtcacactggcagagggccaccactgtgaccgggccttggagatcctgctgcaccccagtgagccccatcagccacacctgatgctggagggcggcagcctgagctcagcagaatatgaggcccgggtgagggcccgccgagattttcagaggctacagcgaagggacagtgatggggaccggcaggtgtggttcctgcagcgacgcttccacaaggacatcctgctgaaccccgtgctggcgctgagcttctgcccagacctgagctccaagcccggacacctggggacagctactcgggagctactcttccttttggatagcagcagcgtggcacacaaggatgccattgttttggctgtgaagtccctcccgccccagacgcttatcaacctggccgtgtttgggacgttggtgcagccactcttcccagagagccggccttgcagtgatgatgctgtgcagctgatctgcgagagcattgagaccctgcaggttccgagtgggcccccagacgtgctggctgctctggactgggccgtggggcagccccagcacagggcctaccctcggcagctgttcctgctcactgctgcctcacccatggccgccactacccaccgaaccctggagctcatgaggtggcacagggggacagccagatgcttctcctttgggctggggcccacctgccaccagctgctccagggtttatctgccctcagcagaggccaggcctacttcctgaggcctgggcagaggctgcagcccatgctggtacaggctctgcggaaggcactggagcctgctttgagtgacatctctgtggactggtttgtgcccgacactgtggaggcactgctgaccccccgggagatcccagcactctaccctggggaccagctgctcggttactgctcactcttcagggtggatggcttccggtcccgcccaccagggggccaagagcctggctggcagagctcgggtgggtccgtgtttccatccccagaagaggccccgtctgctgccagccctggcactgagcccactggcacctcagagccactgggaacaggcactgtctcagcagaactgtccagcccatgggctgccagggactcggagcagagtactgatgctctgacagacccagtcacggatcctggacccaacccctctgacacagccatatggcgccgcatctttcagtcctcgtacattcgggagcagtatgtgctcacccactgctctgccagccccgagccaggcccaggctccacaggcagcagtgagtccccaggctcacagggccctggctcccccgaaggtagtgctcccttggagcccccttctcagcagggctgccgcagtctggcctggggagaacctgcaggctcccgctcctgtcccctgcctgcacccacaccagctccattcaaggtgggggccttgagtactgaggtgctgggccgtcagcacagagcggctctggctggccgaagcctctcatcccctccaggccgggcaaaccaagtccccggccgaccccggaaaccctctttgggtgcaatactagatggcccaagtcctgagccaggccaacagttgggacaaggcctggatgactcaggaaacctgctctccccagcccctatggactgggacatgctgatggaaccacccttcttattcacggctgtgcctcctagtggggagttggcccctccagcagtgcctccccaggctccacgctgccatgtggtgatccggggcctgtgtggggagcagcccatgtgctgggaggtgggtgttgggctggagacactgtggggacctggagatggctcacagcctccctcacctcctgtaagagaagctgcttgggaccaagcactccatcggctgacagcagcctctgtggtccgggacaatgagcagctggccctccgaggaggggcagagaccacagctgaccggggccatgcccggaggtgctggcttcgagcccttcagacaagtaaggtcagctctgccccctcctgcttcacttgccctgtagctgtggatgctactactagggaggtcctgcctggggccctgcaggtgtgcagctcagagcccgctgagcccccaggaacccctcctgcctctcacagccatctagatgcagctcctctgcccactgttgtctactctaaaggacttcagagaggctctccagcaggcgcctgggactcggaccaaaatggcaactccaagcgtgctttgggggaccctgccactcccacggaaggtcctcgccgcccacctccccgtcctccctgtcggctcagcatgggccgccgtcacaaactctgtagccctgacccgggccaggccaacaacagtgaaggcagcgaccatgactacctgcccttggtgcggctgcaggaggcaccaggctccttccgcctggacgcgcccttctgcgccgctgtgcgcatctcgcaggagcgcctctgccgtgcctcgccctttgccgtgcaccgcgccagcctcagccccacctcggcctcattgccctgggcacttctgggccctggtgttggccagggtgacagtgccacggcctcctgcagcccgtcccccagctcgggctctgaggggccaggccaggtggacagtgggcggggctcagacaccgaggcctccgagggggcggaagggctgggcggcaccgacctgcggggccggacctgggccactgccgtagcactcgcctggctggagcaccgatgcgccgctgccttcgacgagtgggaactgacagcggccaaggctgattgctggctgcgggcccagcacttgcctgacggccttgacctggccgccctcaaggccgcagcccgagggctcttcctgctactgcgccactgggaccaaaacctgcagctacacctgctgtgctacagcccagcgaacgtgtgaaggctgccccctgctgcttgggctggcgccccacccaacacactcaagtcactgccgcccagggctggcctcttggtgctgggaaagtgtaggctggtgccagcctgtcccccactgcttcttactccctccctagagccctcttgcccccacaaaaagtgcctgcctgtgctctctccctctcctcccaccccactcacactcccctccatcctctgagctccctgcaacacagtggaagggtagagagccacagtccccaaatcctatgcaataaagtgcctcttagga

SEQ ID NO: 199352 - DNA, 2881 bp, Homo sapiens
  Payload ID: 19331
  Gene Name: von Willebrand factor A domain containing 7
  Uniprot ID: Q9Y334
  ENST ID: ENST00000375688
  CDS Start-End: 202-2877
cctggcgtgggctgctgcctgtggctttgggcaggcaggagcgaaagggccaggggttgcctgtcctcccccaccctgttgaggccttcctccccctctgctgagcctcggttaattataactctgacctaagtgccctgtgacgtcaagcccgggccagccctgcccaggagacccagcaaccaggtccatgtctcagccatgctccccacggaggtcccccaatcccacccgggcccctcagcgttgcttctgctgcagctgttgctgccccccacatctgccttcttccccaacatctggagcctgctggctgcccctggctccatcacccaccaagacctaactgaggaggcagcgctcaacgtcaccctgcagctcttcctggagcagccacccccaggccgcccccctcttcgtcttgaggacttcctgggtcgaacactccttgctgatgacctctttgccgcctactttggacctggttcttctcggcggttccgagcagccttaggtgaggtgtctcgtgccaatgcagcccaggacttcctgccaacttccaggaatgaccccgacctgcactttgatgctgagcgactgggtcagggacgcgcgcgcctggtaggggctctgcgggagaccgtggtggcagccagggcccttgaccacaccctggctcgccagcgcctcggggctgcacttcatgccctgcaggatttctacagtcatagcaactgggtggagctgggcgagcagcagccacaccctcacctcctctggccaaggcaggagctccagaacctggcacaagtggccgatcctacctgctccgattgcgaggagttgagctgccccaggaattggctgggcttcacactcctcacctctggctactttggaactcatcccccgaaacctccagggaaatgtagccacgggggccattttgaccggagcagctcccagccaccgaggggaggcatcaacaaggacagcacatccccaggcttctcccctcaccacatgctgcacctccaggctgcaaaactggcccttctagcctccatccaggccttcagccttctgcgaagccgcctgggagacagggatttctccaggctgctggacatcaccccagcctccagcctgagctttgtcctggacaccacgggcagcatgggtgaggagatcaacgctgccaaaatccaggctcgccaccttgtggagcagcggagaggcagccccatggagcctgtccactatgtcctggtgccttttcatgacccagggttcggccctgtctttacaaccagtgaccctgacagcttctggcaacagcttaatgagatccatgccttggggggtggagacgagcctgagatgtgcctgtcagccctgcagctggccctgctgcacacacctccactctcagatatctttgtcttcacggatgcctcccccaaggatgcctttctcaccaaccaggtggaatccctgactcaggagcggcgctgccgggtaacattcctggtgactgaagatacatcaagggttcagggtcgagctcggcgtgagatcttgtcccctctgcgttttgagccatacaaagcagtggccctggcctcaggaggagaggtgatcttcaccaaagaccagcacattcgagacgtggcagccattgttggggagagcatggctgccctggtgactcttcccctggaccctcctgttgtggtgcctgggcagccacttgtgttcagcgtggatgggctgctccagaagatcacagtccggatccacggagacatcagcagcttctggatcaagaaccctgcaggggtctcccagggccaggaggaaggcgggggtcctctaggtcacactcgccgctttgggcagttctggatggtgaccatggatgaccctccacagacaggaacctgggagatccaggtcacagctgaggacacccctggggtgagagtgcaagcccagacctccctggacttcctcttccactttgggatccccatggaggatggaccccaccctggcctctaccccctgactcagccagttgcaggtcttcagacccagctgctggtagaagtgacagggttgggttccagagccaatcctggggatcctcagccgcatttctcccacgtcatccttcgaggggtcccagagggtgccgaactaggccaggtgcccttggagcccgtgggacctccggagcgaggtctcctcgcagcctcgctgtcgcccacgctgctgtccacccctagacccttctccctggagctgattggccaggacgcagcggggcggcgcctgcacagggctgcccctcagcctagcactgtagtccctgtccttctggagcttagtggcccctcgggtttcttggccccgggcagcaaagtcccgctcagtctccgcatcgccagcttctcgggccctcaggatcttgaccttaggactttcgtcaaccccagcttctccctcacctccaacctctccagggctcacctggaactgaatgagtcggcctggggccgcctgtggctggaggtcccagattcagcggccccggattccgtggtgatggtgactgtgactgcagggggacgagaagccaacccagtacccccgactcatgctttcctccggctcctggtatcggccccagccccgcaggaccggcacaccacccctaccggctcatctgacccgatcctcaccacggccacccctgccttttcccccttcacattggtgactcaaggcagggctggggcagggctggctgcgggcagcccctggtggggcacagttggaggggtgctgcttctgctaggcctggcctcctggtgacaca

SEQ ID NO: 199353 - DNA, 2881 bp, Homo sapiens; identical to SEQ ID NO: 199352
  Payload ID: 19331
  Gene Name: von Willebrand factor A domain containing 7
  Uniprot ID: Q9Y334
  ENST ID: ENST00000438415
  CDS Start-End: 202-2877

SEQ ID NO: 199354 - DNA, 2881 bp, Homo sapiens; identical to SEQ ID NO: 199352
  Payload ID: 19331
  Gene Name: von Willebrand factor A domain containing 7
  Uniprot ID: Q9Y334
  ENST ID: ENST00000452329
  CDS Start-End: 202-2877

SEQ ID NO: 199355 - DNA, 2881 bp, Homo sapiens
  Payload ID: 19331
  Gene Name: von Willebrand factor A domain containing 7
  ENST ID: ENST00000452630
  CDS Start-End: 202-2877
cctggcgtgggctgctgcctgtggctttgggcaggcaggagcgaaagggccaggggttgcctgtcctcccccaccctgttgaggccttcctccccctctgctgagcctcggttaattataactctgacctaagtgccctgtgacgtcaagcccgggccagccctgcccaggagacccagcaaccaggtccatgtctcagccatgctccccacggaggtcccccaatcccacccgggcccctcagcgttgcttctgctgcagctgttgctgccccccacatctgccttcttccccaacatctggagcctgctggctgcccctggctccatcacccaccaagacctaactgaggaggcagcgctcaacgtcaccctgcagctcttcctggagcagccacccccaggccgcccccctcttcgtcttgaggacttcctgggtcgaacactccttgctgatgacctctttgccgcctactttggacctggttcttctcggcggttccgagcagccttaggtgaggtgtctcgtgccaatgcagcccaggacttcctgccaacttccaggaatgaccccgacctgcactttgatgctgagcgactgggtcagggacgcgcgcgcctggtaggggctctgcgggagaccgtggtggcagccagggcccttgaccacaccctggctcgccagcgcctcggggctgcacttcatgccctgcaggatttctacagtcatagcaactgggtggagctgggcgagcagcagccacaccctcacctcctctggccaaggcaggagctccagaacctggcacaagtggccgatcctacctgctccgattgcgaggagttgagctgccccaggaattggctgggcttcacactcctcacctctggctactttggaactcatcccccgaaacctccagggaaatgtagccacgggggccattttgaccggagcagctcccagccaccgaggggaggcatcaacaaggacagcacatccccaggcttctcccctcaccacatgctgcacctccaggctgcaaaactggcccttctagcctccatccaggccttcagccttctgcgaagccgcctgggagacagggatttctccaggctgctggacatcaccccagcctccagcctgagctttgtcctggacaccacgggcagcatgggtgaggagatcaacgctgccaaaatccaggctcgccaccttgtggagcagcggagaggcagccccatggagcctgtccactatgtcctggtgccttttcatgacccagggttcggccctgtctttacaaccagtgaccctgacagcttctggcaacagcttaatgagatccatgccttggggggtggagacgagcctgagatgtgcctgtcagccctgcagctggccctgctgcacacacctccactctcagatatctttgtcttcacggatgcctcccccaaggatgcctttctcaccaaccaggtggaatccctgactcaggagcggcgctgccgggtaacattcctggtgactgaagatacatcaagggttcagggtcgagctcggcgtgagatcttgtcccctctgcgttttgagccatacaaagcagtggccctggcctcaggaggagaggtgatcttcaccaaagaccagcacattcgagacgtggcagccattgttggggagagcatggctgccctggtgactcttcccctggaccctcctgttgtggtgcctgggcagccacttgtgttcagcgtggatgggctgctccagaagatcacagtccggatccacggagacatcagcagcttctggatcaagaaccctgcaggggtctcccagggccaggaggaaggcgggggtcctctaggtcacactcgccgctttgggcagttctggatggtgaccatggatgaccctccacagacaggaacctgggagatccaggtcacagctgaggacacccctggggtgagagtgcaagcccagacctccctggacttcctcttccactttgggatccccatggaggatggaccccaccctggcctctaccccctgactcagccagttgcaggtcttcagacccagctgctggtagaagtgacagggttgggttccagagccaatcctggggatcctcagccgcatttctcccacgtcatccttcgaggggtcccagagggtgccgaactaggccaggtgcccttggagcccgtgggacctccggagcgaggtctcctcgcagcctcgctgtcgcccacgctgctgtcaacccctagacccttctccctggagctgattggccaggacgcagcggggcggcgcctgcacagggctgcccctcagcctagcactgtagtccctgtccttctggagcttagtggcccctcgggtttcttggccccgggcagcaaagtcccgctcagtctccgcatcgccagcttctcgggccctcaggatcttgaccttaggactttcgtcaaccccagcttctccctcacctccaacctctccagggctcacctggaactgaatgagtcggcctggggccgcctgtggctggaggtcccagattcagcggccccggattccgtggtgatggtgactgtgactgcagggggacgagaagccaacccagtacccccgactcatgctttcctccggctcctggtatcggccccagccccgcaggaccggcacaccacccctaccggctcatctgacccgatcctcaccacggccacccctgccttttcccccttcacattggtggctcaaggcagggctggggcagggctggctgcgggcagcccctggtggggcacagttggaggggtgctgcttctgctaggcctggcctcctggtgacaca

SEQ ID NO: 199356 - DNA, 2881 bp, Homo sapiens; identical to SEQ ID NO: 199352
  Payload ID: 19331
  Gene Name: von Willebrand factor A domain containing 7
  Uniprot ID: Q9Y334
  ENST ID: ENST00000430726
  CDS Start-End: 202-2877

SEQ ID NO: 199357 - DNA, 2881 bp, Homo sapiens; identical to SEQ ID NO: 199352
  Payload ID: 19331
  Gene Name: von Willebrand factor A domain containing 7
  Uniprot ID: Q9Y334
  ENST ID: ENST00000438725
  CDS Start-End: 202-2877

SEQ ID NO: 199358 - DNA, 3475 bp, Homo sapiens
  Payload ID: 19332
  Gene Name: von Willebrand factor A domain containing 8
  Uniprot ID: A3KMH1
  ENST ID: ENST00000281496
  CDS Start-End: 106-3225
aggtgccgcttcctgtccccttctccgcgctgcctcacggtgcctgcacgggacgccgctcgatccccgagccccctcgccgtccccgacagcccccccggcgccatgcaatcccggcttctactcctcggggcacccggaggccacggcggcccggcctcgcggcgcatgcggctgctcctgcggcaggtggtgcagcgcaggccgggtggcgacaggcagcggccggaggtcagactgttgcacgccggctcgggggccgacacaggtgatacagttaatattggagatgtatcctacaagttgaaaattcctaagaatccagaacttgtgccacagaactacatttcagactctctggctcaatctgtagttcagcatctaagatggataatgcagaaggatcttttggggcaagatgtttttctaataggacctcctgggcctcttcgacgctctattgctatgcagtacttggagctgaccaaacgggaggtcgaatacattgccctgtcaagggacaccactgaaactgatctcaaacagcgacgagagatccgtgcaggcacagccttttacattgatcagtgtgcagttcgtgcagccacagaaggcagaactctcattttggaaggtttggaaaaggcagagaggaatgttttgcctgttttgaacaacttgctggaaaacagagagatgcagcttgaagatggacgcttcctgatgtctgctgagcgttacgacaaacttctccgagatcataccaaaaaagagttggattcttggaaaattgtccgagttagtgaaaatttccgagtgattgccttgggcttgccagtgccaaggtattctgggaatccattagacccccctcttcgttctcgatttcaagccagggatatttattatttacccttcaaggaccaacttaagttgttatattcaattggagccaatgtttctgctgagaaagtttctcagctcttgtcctttgccacaactctgtgttcccaagaatcttctactcttggacttccagactttcctttagatagtttagcagctgcggttcaaatcttggattcctttcctatgatgccaatcaaacatgcaatccagtggctttatccatatagtattttactaggtcatgaagggaagatggctgtggaaggtgttttaaagcgctttgaacttcaagattcaggaagctctctacttcctaaagagattgtaaaagtagagaagatgatggaaaaccatgtgtcccaagcttctgtgaccatccggattgcagataaagaggtgaccattaaggtgccagccgggaccaggctattaagtcaaccttgtgcgtcagaccgtttcatacagactttgagccataagcagctacaggctgaaatgatgcagtctcacatggttaaagatatatgtttaattggaggaaagggttgtggaaaaacagtgatcgctaagaactttgccgataccttaggatacaacatagaacctattatgctctatcaggatatgacagcgcgtgatctgctacagcagagatacacccttccaaatggagacactgcctggcggtcctcaccccttgtgaatgctgctctggaaggcaagctggtcctgctggatggcattcaccgggtgaatgcgggcacgcttgctgtattgcaaaggttaatccatgatcgagagctaagcctctatgatggttctaggctgctgagagaagacaggtatatgcgtttaaaggaggagctgcaactgtctgatgaacagctacagaagagatccatttttcctatccatccctccttcagaatcattgccttggcagaaccccctgttattggaagcacagcacaccagtggctgggaccagaattcttaaccatgttctttttccattacatgaaaccacttgtgaaaagtgaagaaatccaagtgattaaggaaaaggtcccaaatgtacctcaggaagctctggataagttattatcatttacacacaaactcagagaaacacaggatccaacggcacaatcattagcggcatcactttctaccagacaactgttgcgaatttctcgtcggctgtcacagtatcctaatgaaaatcttcacagtgctgttactaaagcctgcctttccaggtttttacccagtcttgctaggtcagcattagaaaaaaatctggcagatgctacaatagaaataaatactgatgacaatttggagccagaactgaaggattacaaatgtgaagtaacatctggaactctgaggattggtgctgttagtgcaccgatctataatgcacatgagaaaatgaaagtgcctgatgttcttttctatgacaacattcagcatgtgatagtgatggaagatatgctgaaagactttctccttggagaacacttattattggttggcaaccagggtgtaggaaaaaacaagattgttgacagattccttcacctgctcaacagaccccgagaatatattcagctacacagggataccacagtacaaactcttacgcttcagccttcggttaaagacggacttattgtatatgaagactcacctttggttaaagcagtaaagttgggtcatattctggtagtagatgaggctgacaaagctccaacaaatgtcacgtgtattttaaaaactctagtagaaaatggagaaatgattctagcagatggaagacgcattgttgcaaattctgctaatgtgaatggaagagaaaatgttgtagtgattcatcctgattttaggatgattgttctggcaaatagacctggatttcctttcctaggcaatgatttcttcggtaccttaggtgatatttttagctgccatgcagttgataaccccaaaccccactcggagctcgagatgctcagacagtatggaccaaatgtgcctgagcccatccttcagaagcttgtggctgcctttggagagctgaggagtttggctgaccaagggattattaactatccttattctaccagagaagttgtcaacatagtcaaacatttacagaaatttccgactgaaggtctctccagtgtagttcgaaatgtgtttgactttgattcctacaacaatgacatgagggagatattgattaacactttacacaaatacgggatacctatcggagcaaagcctaccagtgtgcagctggcaaaggagtaaggcaaattcagtactcttctgattcttaaatgctgatagttcttgatttatcattccattctacaaaactgagttgctatggaaattactttccatgagtaagcttttcaaatacatgtatatgttgctgtttgctggctgcttttcagttaaatagcattatttataggcctgtaaattgaaaattttgattattatgtatgtcccatgagtagatgtaataaataaagggaaatatttgtttctttaa

SEQ ID NO: 199359 - DNA, 7147 bp, Homo sapiens
  Payload ID: 19332
  Gene Name: von Willebrand factor A domain containing 8
  Uniprot ID: A3KMH1
  ENST ID: ENST00000379310
  CDS Start-End: 70-5787
acggtgcctgcacgggacgccgctcgatccccgagccccctcgccgtccccgacagcccccccggcgccatgcaatcccggcttctactcctcggggcacccggaggccacggcggcccggcctcgcggcgcatgcggctgctcctgcggcaggtggtgcagcgcaggccgggtggcgacaggcagcggccggaggtcagactgttgcacgccggctcgggggccgacacaggtgatacagttaatattggagatgtatcctacaagttgaaaattcctaagaatccagaacttgtgccacagaactacatttcagactctctggctcaatctgtagttcagcatctaagatggataatgcagaaggatcttttggggcaagatgtttttctaataggacctcctgggcctcttcgacgctctattgctatgcagtacttggagctgaccaaacgggaggtcgaatacattgccctgtcaagggacaccactgaaactgatctcaaacagcgacgagagatccgtgcaggcacagccttttacattgatcagtgtgcagttcgtgcagccacagaaggcagaactctcattttggaaggtttggaaaaggcagagaggaatgttttgcctgttttgaacaacttgctggaaaacagagagatgcagcttgaagatggacgcttcctgatgtctgctgagcgttacgacaaacttctccgagatcataccaaaaaagagttggattcttggaaaattgtccgagttagtgaaaatttccgagtgattgccttgggcttgccagtgccaaggtattctgggaatccattagacccccctcttcgttctcgatttcaagccagggatatttattatttacccttcaaggaccaacttaagttgttatattcaattggagccaatgtttctgctgagaaagtttctcagctcttgtcctttgccacaactctgtgttcccaagaatcttctactcttggacttccagactttcctttagatagtttagcagctgcggttcaaatcttggattcctttcctatgatgccaatcaaacatgcaatccagtggctttatccatatagtattttactaggtcatgaagggaagatggctgtggaaggtgttttaaagcgctttgaacttcaagattcaggaagctctctacttcctaaagagattgtaaaagtagagaagatgatggaaaaccatgtgtcccaagcttctgtgaccatccggattgcagataaagaggtgaccattaaggtgccagccgggaccaggctattaagtcaaccttgtgcgtcagaccgtttcatacagactttgagccataagcagctacaggctgaaatgatgcagtctcacatggttaaagatatatgtttaattggaggaaagggttgtggaaaaacagtgatcgctaagaactttgccgataccttaggatacaacatagaacctattatgctctatcaggatatgacagcgcgtgatctgctacagcagagatacacccttccaaatggagacactgcctggcggtcctcaccccttgtgaatgctgctctggaaggcaagctggtcctgctggatggcattcaccgggtgaatgcgggcacgcttgctgtattgcaaaggttaatccatgatcgagagctaagcctctatgatggttctaggctgctgagagaagacaggtatatgcgtttaaaggaggagctgcaactgtctgatgaacagctacagaagagatccatttttcctatccatccctccttcagaatcattgccttggcagaaccccctgttattggaagcacagcacaccagtggctgggaccagaattcttaaccatgttctttttccattacatgaaaccacttgtgaaaagtgaagaaatccaagtgattaaggaaaaggtcccaaatgtacctcaggaagctctggataagttattatcatttacacacaaactcagagaaacacaggatccaacggcacaatcattagcggcatcactttctaccagacaactgttgcgaatttctcgtcggctgtcacagtatcctaatgaaaatcttcacagtgctgttactaaagcctgcctttccaggtttttacccagtcttgctaggtcagcattagaaaaaaatctggcagatgctacaatagaaataaatactgatgacaatttggagccagaactgaaggattacaaatgtgaagtaacatctggaactctgaggattggtgctgttagtgcaccgatctataatgcacatgagaaaatgaaagtgcctgatgttcttttctatgacaacattcagcatgtgatagtgatggaagatatgctgaaagactttctccttggagaacacttattattggttggcaaccagggtgtaggaaaaaacaagattgttgacagattccttcacctgctcaacagaccccgagaatatattcagctacacagggataccacagtacaaactcttacgcttcagccttcggttaaagacggacttattgtatatgaagactcacctttggttaaagcagtaaagttgggtcatattctggtagtagatgaggctgacaaagctccaacaaatgtcacgtgtattttaaaaactctagtagaaaatggagaaatgattctagcagatggaagacgcattgttgcaaattctgctaatgtgaatggaagagaaaatgttgtagtgattcatcctgattttaggatgattgttctggcaaatagacctggatttcctttcctaggcaatgatttcttcggtaccttaggtgatatttttagctgccatgcagttgataaccccaaaccccactcggagctcgagatgctcagacagtatggaccaaatgtgcctgagcccatccttcagaagcttgtggctgcctttggagagctgaggagtttggctgaccaagggattattaactatccttattctaccagagaagttgtcaacatagtcaaacatttacagaaatttccgactgaaggtctctccagtgtagttcgaaatgtgtttgactttgattcctacaacaatgacatgagggagatattgattaacactttacacaaatacgggatacctatcggagcaaagcctaccagtgtgcagctggcaaaggagttgactctgccagaacaaacgttcatgggctactggacaattggtcaggcaagaagtgggatgcaaaaactcttgtgtccagtggaaactcatcatatagacataaagggtccagcacttataaatatacaggagtatccaatagaaagacatgaagaaagatccctaaactttactgaagaatgtgcctcatggagaataccattggatgaaattaatataatctgtgacattgctacatcacatgaaaatgagcaaaatactctctatgtagttacatgcaatcccgcttccctgtactttatgaatatgactgggaaaagtggcttctttgtggacttttttgatatcttcccaagaacagccaatggcgtttggcacccttttgtgacagtggcaccgctgggaagtcctctcaaaggtcaagtggttctccatgagcagcagagtaatgttatcctgttgttagatactactggccgggcccttcatcgtctcatcctcccttccgagaagtttacatctaagaaacctttctggtggaacaaagaagaagctgaaacttataaaatgtgtaaagaattttcacacaaaaactggctggtgttctacaaagaaaaagggaacagcctgactgtgctggatgttctagaagggcgaactcacaccatctcacttcccatcaacctcaagacagttttccttgtagcagaggacaaatggcttctggtggagagcaaaacaaatcagaaatatcttttaactaagcctgcacacatcgaatctgagggtagtggggtttgccagttgtatgtgctgaaagaggagccgcccagcacagggtttggagttacacaagaaacagagttcagcatacctcataaaatttccagtgatcaactatcatctgaacatctaagttcagctgtggaacaaaagattgcctctcccaacagaattctctcagatgagaaaaattatgctacaatagttgttggttttccagatctcatgtcacccagtgaagtttattcttggaagagaccatcatctttgcataaacgaagtggcactgatacatcattctatagaggaaagaagaaaagggggactccaaaacaaagcaattgtgtgactcttttagatacgaatcaggtagtgaggattttacccccaggagaagtccctctaaaagatatctacccaaaagatgttactcctccacaaacatctggttatatagaagtcactgatcttcaatcaaagaaactccgatatatccctattcccagatcagaatctctctcgccgtataccacatggctgtcgaccatttcagacacagatgcactgctggctgagtgggacaaaagcggtgttgttactgttgatatgggaggtcacatcaggctttgggaaactggacttgaacgtctgcagcgatcactcatggaatggagaaacatgattggacaagatgacagaaatatgcagataacaatcaacagagacagtggtgaagatgtaagctcccccaaacacgggaaggaggacccagacaacatgcctcacgtgggcggcaacacttgggctggcggaacagggggaagagacacggcaggcctgggtggcaaaggaggcccttaccggctggatgcaggccatacggtgtaccaggtctctcaggctgagaaagatgcagttcccgaagaggtcaagagagctgctagagagatgggccagagagcattccagcagaggctaaaggagatccaaatgagtgaatacgatgctgcaacctatgaaaggttttcaggtgctgttcggcgacaggtgcactccctccgaatcatcctggataatttacaggctaaaggtaaagaaagacaatggctaagacatcaagctactggagaattagatgatgccaagatcattgatgggctgactggagaaaaagccatctacaaacgtcggggtgagctggagccacaacttggcagcccacaacagaaacccaagcgtctgcgcctggtggtagatgtgtctggtagcatgtaccgtttcaacaggatggatggccggcttgagcgcacaatggaggctgtgtgtatggtcatggaagccttcgagaactatgaggagaagttccagtatgacatcgttggacactctggagatggctacaacattggtctggttccaatgaacaaaatccccaaggacaataagcaaagactagaaattctgaagacaatgcatgcccactctcagttctgcatgagtggggaccacacgttagaagggacagaacatgccatcaaggaaattgtcaaagaagaagctgatgagtactttgtcatagtcttgagtgatgcaaatctgtcacgatatggaatacatcctgctaagtttgctcaaatcctcacaagagaccctcaagtaaatgcttttgccatttttattggctctttaggtgatcaagcaaccaggcttcagagaactttaccagctggtcggtctttcgttgccatggataccaaggatatccctcagattttacaacagatcttcacctccaccatgttgtcgagtgtctaagaagtgcccttcatcaccctgatgacaccaggatttgaaataagacaggaataaagagtattctgaaaaaaagaagatatggatgaagtgaacccatgcagtgactggatgattccggcattcctgggtcttcctacacttgctccgtaatgagaattcagagaagcagccagaaggagacttaaacatggaaagatactccactgatgagtttagaagtgattagggcaagctagttgacctgcactttatcaaaggttggggttaaaggaaggtggttttgagaactatgtgtttggtctatttccaaaaacctgagggggagaaaatactttgcttttgccttaacacatcatctggtcacgttagaaaagtgaccccatcaaactgagcctttgatgtcacattctgacacaagatgcaagtctgtgcaaaacccaccaaaatgctcctatccaacaattatttttattttctccctgctctgtattgaccagaaaacaatgattttataatatttaacccaccaaaaagtccctccaacagcaatatcttatgaaagtctggctgttctcaataatttcattttcttggccaaagccaaaaggaatcaaaaaatccttggagtgcttgcctttccacgtgacttttaaaaggctcttaaagagcaaatgtcctcttctccttgctgctagagtgggaggagaaagatgtcttgccttaaaagtttactgtttcttctgttcttctagcatctctcaaaaaattcacagtactccattttggggtccaaactgtaatgctcaaaataataaatgcttacacgaaaattatttattgagaatattcatataaaaattacctaaagcaaagtaaaaaaagtaaaatcaaggtggtatatttgaagtgaatggtgattggaaatttttagctgtaacaaaaagaaagaaaacaactttttttaaagcctcattctcttttctttcaaaatgtaccttattcccacacactcttgggctgacctttattttatcaataagctcaatattactttgtttaaaataagatgcttcagcaaaagtcattctctctttaaccatataatttaaaaactcctcttcacgattgatagcaaaatcagaaacgttagggcaccagtgagttgaaaaaactggtcttaagttggaaaaactattattaataatattatcctatccatccatatctattgaaattgtacaggtccataatttcattttaattaattataggaaagaagaaaagataatacccatttgttctatcacccctctccctatcattaactatcaaataaataaataaaagcaatctgatttcc

SEQ ID NO: 199360 - DNA, 2393 bp, Homo sapiens
  Payload ID: 19333
  Gene Name: von Willebrand factor A domain containing 9
  Uniprot ID: Q96SY0
  ENST ID: ENST00000313182
  CDS Start-End: 211-1767
tccaaggaccgccccgcccagcgcggagtgcaggcgccggattcccttctgtcgcgcggccttatagttccggctgtggcgcgcggacggaaagtttatgccgacggaaagtttatgccgacggactgtgtccggcgatgggcacgggcatttcttcgtttatagctgtctgtttgcattctgattgggaacactgggatcattttcatcatgccgacagtggtggtaatggatgtatccctttccatgacccgacctgtgtctattgaggggtccgaggaataccagcgtaagcacctagcagcccatggtttaacgatgctgtttgagcacatggccacaaattacaagcttgaatttacagcacttgtggttttttcatcactttgggagttgatggtccccttcacgagagattataataccctacaggaagcactaagtaatatggatgattatgacaaaacctgcttggagtctgcattagttggtgtttgcaatatcgttcagcaagaatggggtggtgcaattccttgccaggttgtcctggtgacagacggctgtcttggcattggtagagggtcactgcgacattccctagccactcaaaatcaacgaagtgagagcaacaggtttccactaccttttcctttcccatctaagttatatatcatgtgcatggcgaatttggaggagctccagagcaccgattccttggaatgccttgaacgtctcatagatttaaacaatggtgaagggcagatttttactattgatggccccctgtgcttgaagaatgtacagtctatgtttggaaaactgatagatttggcatatacgcctttccatgctgttctcaagtgtggccacctaactgctgatgtacaagtcttccccaggccagaaccttttgttgtagatgaagaaattgatcctatccctaaagtcattaacacagatttggaaatagtgggatttattgatatagctgatatttcaagtcccccagttctgtccagacatctggtcttacctatagcacttaacaaagaaggtgatgaggtgggtactggcatcactgatgacaatgaagatgaaaattcagccaatcagattgcaggcaaaatacccaacttttgtgtcctgctccatggtagcctaaaagtggaaggaatggtagcgattgttcaattaggtcctgaatggcatggaatgctctactcccaagctgacagcaagaagaaatcaaacctcatgatgtctctctttgagcctggcccagaacctctcccatggctagggaaaatggcacagttgggtcctatttcagatgctaaagaaaacccttatggcgaggatgacaataagagtccattccccctgcagcccaaaaacaaacgcagttatgcccagaatgtgactgtctggatcaaacccagcggcctgcagacagatgtacagaagattttaagaaatgcaaggaaactacctgaaaaaacacagacattctataaggagctgaaccgtttgcgaaaggccgctctagcctttggtttcctggacctgctgaaaggggtggctgacatgctggaaagggaatgcacactgctgcctgagacagcccaccctgatgctgcattccagctgacccatgctgcccagcagctcaagctggccagtaccggcacctctgagtatgccgcttatgaccagaacatcacacctttgcacacggacttctctgggagcagcactgaaagaatttgaaactgacttttggagctttccttcttttttcatttcaactgaaaatgctttaggtaaaaacctttccagtatgttcacctctagaatagccacccaaagaccttcctgaggctgcctcagaagcaccacttgctgttttgaatgactctactagtatgagaaggatgtgaaggtggttggctggttgggctttaacttcctgggattcataatttttaagcttggaagatagctgctgttcccatgatgggcacatttcctgagaagcttgaatgactgatgagcatagagcacccctgccttcctcaggaaacctgaccggcaggggctctctggcttcctgaaagcttcacctcttccctcgtttatatctcaactgtaagggcattttcaagcttctgttcatggaatgagcaactcagactgtctggagcttgctgagtacaaacacaccaccactaagtttcagaactttccttagaacttgggcaaaatgtggtggtaactcttaagtgcttttggtatctcttgagattctaacttttaaagagcaaccattaatgtgtaaaatgattcctattattcaaggtttttttttaatgaaaataaaatatttgattttctag

SEQ ID NO: 199361 - DNA, 1863 bp, Homo sapiens
  Payload ID: 19333
  Gene Name: von Willebrand factor A domain containing 9
  ENST ID: ENST00000442903
  CDS Start-End: 255-1703
cctccgggatgagccagaaccctgcccgggcgaccctgaagctctccaaggaccgccccgcccagcgcggagtgcaggcgccggattcccttctgtcgcgcggccttatagttccggctgtggcgcgcggacggaaagtttatgccgacggaaagtttatgccgacggactgtgtccggcgatgggcacgggcatttcttcgtttatagctgtctgtttgcattctgattgggaacactgggatcattttcatcatgccgacagtggtggtaatggatgtatccctttccatgacccgacctgtgtctattgaggggtccgaggaataccagcgtaagcacctagcagcccatggtttaacgatgctgtttgagcacatggccacaaattacaagcttgaatttacagcacttgtggttttttcatcactttgggagttgatggtccccttcacgagagattataataccctacaggttgtcctggtgacagacggctgtcttggcattggtagagggtcactgcgacattccctagccactcaaaatcaacgaagtgagagcaacaggtttccactaccttttcctttcccatctaagttatatatcatgtgcatggcgaatttggaggagctccagagcaccgattccttggaatgccttgaacgtctcatagatttaaacaatggtgaagggcagatttttactattgatggccccctgtgcttgaagaatgtacagtctatgtttggaaaactgatagatttggcatatacgcctttccatgctgttctcaagtgtggccacctaactgctgatgtacaagtcttccccaggccagaaccttttgttgtagatgaagaaattgatcctatccctaaagtcattaacacagatttggaaatagtgggatttattgatatagctgatatttcaagtcccccagttctgtccagacatctggtcttacctatagcacttaacaaagaaggtgatgaggtgggtactggcatcactgatgacaatgaagatgaaaattcagccaatcagattgcaggcaaaatacccaacttttgtgtcctgctccatggtagcctaaaagtggaaggaatggtagcgattgttcaattaggtcctgaatggcatggaatgctctactcccaagctgacagcaagaagaaatcaaacctcatgatgtctctctttgagcctggcccagaacctctcccatggctagggaaaatggcacagttgggtcctatttcagatgctaaagaaaacccttatggcgaggatgacaataagagtccattccccctgcagcccaaaaacaaacgcagttatgcccagaatgtgactgtctggatcaaacccagcggcctgcagacagatgtacagaagattttaagaaatgcaaggaaactacctgaaaaaacacagacattctataaggagctgaaccgtttgcgaaaggccgctctagcctttggtttcctggacctgctgaaaggggtggctgacatgctggaaagggaatgcacactgctgcctgagacagcccaccctgatgctgcattccagctgacccatgctgcccagcagctcaagctggccagtaccggcacctctgagtatgccgcttatgaccagaacatcacacctttgcacacggacttctctgggagcagcactgaaagaatttgaaactgacttttggagctttccttcttttttcatttcaactgaaaatgctttaggtaaaaacctttccagtatgttcacctctagaatagccacccaaagaccttcctgaggctgcctcagaagcaccacttgctgttttgaatgactctactagtatgag

SEQ ID NO: 199362 - DNA, 1980 bp, Homo sapiens
  Payload ID: 19333
  Gene Name: von Willebrand factor A domain containing 9
  Uniprot ID: Q96SY0
  ENST ID: ENST00000431261
  CDS Start-End: 318-1637
gaccctgaagctctccaaggaccgccccgcccagcgcggagtgcaggcgccggattcccttctgtcgcgcggccttatagttccggctgtggcgcgcggacggaaagtttatgccgacggaaagtttatgccgacggactgtgtccggcgatgggcacgggcatttcttcgtttatagctgtctgtttgcattctgattgggaacactgggatcattttcatcatgccgacagtggtggtaatggatgtatccctttccatgacccgacctgtgtctattgaggggtccgaggaataccagcgaagcactaagtaatatggatgattatgacaaaacctgcttggagtctgcattagttggtgtttgcaatatcgttcagcaagaatggggtggtgcaattccttgccaggttgtcctggtgacagacggctgtcttggcattggtagagggtcactgcgacattccctagccactcaaaatcaacgaagtgagagcaacaggtttccactaccttttcctttcccatctaagttatatatcatgtgcatggcgaatttggaggagctccagagcaccgattccttggaatgccttgaacgtctcatagatttaaacaatggtgaagggcagatttttactattgatggccccctgtgcttgaagaatgtacagtctatgtttggaaaactgatagatttggcatatacgcctttccatgctgttctcaagtgtggccacctaactgctgatgtacaagtcttccccaggccagaaccttttgttgtagatgaagaaattgatcctatccctaaagtcattaacacagatttggaaatagtgggatttattgatatagctgatatttcaagtcccccagttctgtccagacatctggtcttacctatagcacttaacaaagaaggtgatgaggtgggtactggcatcactgatgacaatgaagatgaaaattcagccaatcagattgcaggcaaaatacccaacttttgtgtcctgctccatggtagcctaaaagtggaaggaatggtagcgattgttcaattaggtcctgaatggcatggaatgctctactcccaagctgacagcaagaagaaatcaaacctcatgatgtctctctttgagcctggcccagaacctctcccatggctagggaaaatggcacagttgggtcctatttcagatgctaaagaaaacccttatggcgaggatgacaataagagtccattccccctgcagcccaaaaacaaacgcagttatgcccagaatgtgactgtctggatcaaacccagcggcctgcagacagatgtacagaagattttaagaaatgcaaggaaactacctgaaaaaacacagacattctataaggagctgaaccgtttgcgaaaggccgctctagcctttggtttcctggacctgctgaaaggggtggctgacatgctggaaagggaatgcacactgctgcctgagacagcccaccctgatgctgcattccagctgacccatgctgcccagcagctcaagctggccagtaccggcacctctgagtatgccgcttatgaccagaacatcacacctttgcacacggacttctctgggagcagcactgaaagaatttgaaactgacttttggagctttccttcttttttcatttcaactgaaaatgctttaggtaaaaacctttccagtatgttcacctctagaatagccacccaaagaccttcctgaggctgcctcagaagcaccacttgctgttttgaatgactctactagtatgagaaggatgtgaaggtggttggctggttgggctttaacttcctgggattcataatttttaagcttggaagatagctgctgttcccatgatgggcacatttcctgagaagcttgaatgactgatgagcatagagcacccctgccttcctcaggaaacctgaccggcaggggctctctggcttcctg

SEQ ID NO: 199363 - DNA, 1741 bp, Homo sapiens
  Payload ID: 19333
  Gene Name: von Willebrand factor A domain containing 9
  Uniprot ID: Q96SY0
  ENST ID: ENST00000420799
  CDS Start-End: 95-1480
aaggaccgccccgcccagcgcggagtgcaggcgccggattcccttctgtcgcgcggccttatagttccggctgtggcgcgcggacggaaagtttatgccgacggaaagtttatgccgacggactgtgtccggcgatgggcacggggaagcactaagtaatatggatgattatgacaaaacctgcttggagtctgcattagttggtgtttgcaatatcgttcagcaagaatggggtggtgcaattccttgccaggttgtcctggtgacagacggctgtcttggcattggtagagggtcactgcgacattccctagccactcaaaatcaacgaagtgagagcaacaggtttccactaccttttcctttcccatctaagttatatatcatgtgcatggcgaatttggaggagctccagagcaccgattccttggaatgccttgaacgtctcatagatttaaacaatggtgaagggcagatttttactattgatggccccctgtgcttgaagaatgtacagtctatgtttggaaaactgatagatttggcatatacgcctttccatgctgttctcaagtgtggccacctaactgctgatgtacaagtcttccccaggccagaaccttttgttgtagatgaagaaattgatcctatccctaaagtcattaacacagatttggaaatagtgggatttattgatatagctgatatttcaagtcccccagttctgtccagacatctggtcttacctatagcacttaacaaagaaggtgatgaggtgggtactggcatcactgatgacaatgaagatgaaaattcagccaatcagattgcaggcaaaatacccaacttttgtgtcctgctccatggtagcctaaaagtggaaggaatggtagcgattgttcaattaggtcctgaatggcatggaatgctctactcccaagctgacagcaagaagaaatcaaacctcatgatgtctctctttgagcctggcccagaacctctcccatggctagggaaaatggcacagttgggtcctatttcagatgctaaagaaaacccttatggcgaggatgacaataagagtccattccccctgcagcccaaaaacaaacgcagttatgcccagaatgtgactgtctggatcaaacccagcggcctgcagacagatgtacagaagattttaagaaatgcaaggaaactacctgaaaaaacacagacattctataaggagctgaaccgtttgcgaaaggccgctctagcctttggtttcctggacctgctgaaaggggtggctgacatgctggaaagggaatgcacactgctgcctgagacagcccaccctgatgctgcattccagctgacccatgctgcccagcagctcaagctggccagtaccggcacctctgagtatgccgcttatgaccagaacatcacacctttgcacacggacttctctgggagcagcactgaaagaatttgaaactgacttttggagctttccttcttttttcatttcaactgaaaatgctttaggtaaaaacctttccagtatgttcacctctagaatagccacccaaagaccttcctgaggctgcctcagaagcaccacttgctgttttgaatgactctactagtatgagaaggatgtgaaggtggttggctggttgggctttaacttcctgggattcataatttttaagcttggaagatagctgctgttcccatgatgggcacatttcct

SEQ ID NO: 199364 - DNA, 584 bp, Homo sapiens
  Payload ID: 19333
  Gene Name: von Willebrand factor A domain containing 9
  ENST ID: ENST00000567923
  CDS Start-End: 76-584
gcggagtgcaggcgccggattcccttctgtcgcgcggccttatagttccggctgtggcgcgcggacggaaagtttatgccgacggaaagtttatgccgacggactgtgtccggcgatgggcacgggctgtctgtttgcattctgattgggaacactgggatcattttcatcatgccgacagtggtggtaatggatgtatccctttccatgacccgacctgtgtctattgaggggtccgaggaataccagcgtaagcacctagcagcccatggtttaacgatgctgtttgagcacatggccacaaattacaagcttgaatttacagcacttgtggttttttcatcactttgggagttgatggtccccttcacgagagattataataccctacaggaagcactaagtaatatggatgattatgacaaaacctgcttggagtctgcattagttggtgtttgcaatatcgttcagcaagaatggggtggtgcaattccttgccaggttgtcctggtgacagacggctgtcttggcattggtagagggtcactgcgacattccctagccactcaaaatcaacgaagtga

SEQ ID NO: 199365 - DNA, 564 bp, Homo sapiens
  Payload ID: 19333
  Gene Name: von Willebrand factor A domain containing 9
  ENST ID: ENST00000561769
  CDS Start-End: 352-564
atgccgacggactgtgtccggcgatgggcacggggtgagtggggaggccgagggcccgggactgcctttcgctgcttgttggggttacaggtgaaggggttatgggtgaagaacaacccagggccagcgcttggccttcccgccaccgtggcggccgccccgcgctgtctgtgaggcgccagttccggggcgctgctcccggcctcccctcgctctgaggctcggggtccccagctccgcgtaaactgcacgatttcgccctctgctcagctcccctctgccccctctttccaagagagacttccagatcccacattttcttgactgatttttaaggaagcactaagtaatatggatgattatgacaaaacctgcttggagtctgcattagttggtgtttgcaatatcgttcagcaagaatggggtggtgcaattccttgccaggttgtcctggtgacagacggctgtcttggcattggtagagggtcactgcgacattccctagccactcaaaatcaacgaagtgagagcaacaggtttccactaccttttcctttcccatct

SEQ ID NO: 199366 - DNA, 772 bp, Homo sapiens
  Payload ID: 19333
  Gene Name: von Willebrand factor A domain containing 9
  ENST ID: ENST00000569565
  CDS Start-End: 9-182
gaaagtttatgccgacggactgtgtccggcgatgggcacggggtgagtggggaggccgagggcccgggactgcctttcgctgcttgttggggttacaggtgaaggggttatgggtgaagaacaacccagggccagcgcttggccttcccgccaccgtggcggccgccccgcgctgtctgtgaggcgccagttccggggcgctgctcccggcctcccctcgctctgaggctcggggtccccagctccgcgtaaactgcacgatttcgccctctgctcagctcccctctgccccctctttccaagagagacttccagatcccacattttcttgactgatttttaaggtaaaaatacatctcccagatgtgattttcagtctggacttttagagatgaaattatatctgagaactggggagggactcccggaggctgacgggaaagccaaagagcagcatttcttcgtttatagctgtctgtttgcattctgattgggaacactgggatcattttcatcatgccgacagtggtggtaatggatgtatccctttccatgacccgacctgtgtctattgaggggtccgaggaataccagcgtaagcacctagcagcccatggtttaacgatgctgtttgagcacatggccacaaattacaagcttgaatttacagcacttgtggttttttcatcactttgggagttgatggtccccttcacgagagattataataccctacaggaagcactaagtaatatggatgattatgacaaaa

SEQ ID NO: 199367 - DNA, 806 bp, Homo sapiens
  Payload ID: 19333
  Gene Name: von Willebrand factor A domain containing 9
  ENST ID: ENST00000569004
  CDS Start-End: 30-494
tgattgggaacactgggatcattttcatcatgccgacagtggtggtaatggatgtatccctttccatgacccgacctgtgtctattgaggggtccgaggaataccagcgtaagcacctagcagcccatggtttaacgatgctgtttgagcacatggccacaaattacaagcttgaatttacagcacttgtggttttttcatcactttgggagttgatggtccccttcacgagagattataataccctacaggaagcactaagtaatatggatgattatgacaaaacctgcttggagtctgcattagttggtgtttgcaatatcgttcagcaagaatggggtggtgcaattccttgccaggttgtcctggtgacagacggctgtcttggcattggtagagggtcactgcgacattccctagccactcaaaatcaacgaagtgagagcaacagctccagagcaccgattccttggaatgccttgaacgtctcatagatttaaacaatggtgaagggcagatttttactattgatggccccctgtgcttgaagaatgtacagtctatgtttggaaaactgatagatttggcatatacgcctttccatgctgttctcaagtgtggccacctaactgctgatgtacaagtcttccccaggccagaaccttttgttgtagatgaagaaattgatcctatccctaaagtcattaacacagatttggaaatagtgggatttattgatatagctgatatttcaagtcccccagttctgtccagacatctggtcttacctatagcacttaacaaag

SEQ ID NO: 199368 - DNA, 1797 bp, Homo sapiens
  Payload ID: 19333
  Gene Name: von Willebrand factor A domain containing 9
  ENST ID: ENST00000569491
  CDS Start-End: 80-1486
atgccgacggactgtgtccggcgatgggcacgggctgtctgtttgcattctgattgggaacactgggatcattttcatcatgccgacagtggtggtaatggatgtatccctttccatgacccgacctgtgtctattgaggggtccgaggaataccagccactaagtaatatggatgattatgacaaaacctgcttggagtctgcattagttggtgtttgcaatatcgttcagcaagaatggggtggtgcaattccttgccaggttgtcctggtgacagacggctgtcttggcattggtagagggtcactgcgacattccctagccactcaaaatcaacgaagtgagagcaacaggtttccactaccttttcctttcccatctaagttatatatcatgtgcatggcgaatttggaggagctccagagcaccgattccttggaatgccttgaacgtctcatagatttaaacaatggtgaagggcagatttttactattgatggccccctgtgcttgaagaatgtacagtctatgtttggaaaactgatagatttggcatatacgcctttccatgctgttctcaagtgtggccacctaactgctgatgtacaagtcttccccaggccagaaccttttgttgtagatgaagaaattgatcctatccctaaagtcattaacacagatttggaaatagtgggatttattgatatagctgatatttcaagtcccccagttctgtccagacatctggtcttacctatagcacttaacaaaggtgatgaggtgggtactggcatcactgatgacaatgaagatgaaaattcagccaatcagattgcaggcaaaatacccaacttttgtgtcctgctccatggtagcctaaaagtggaaggaatggtagcgattgttcaattaggtcctgaatggcatggaatgctctactcccaagctgacagcaagaagaaatcaaacctcatgatgtctctctttgagcctggcccagaacctctcccatggctagggaaaatggcacagttgggtcctatttcagatgctaaagaaaacccttatggcgaggatgacaataagagtccattccccctgcagcccaaaaacaaacgcagttatgcccagaatgtgactgtctggatcaaacccagcggcctgcagacagatgtacagaagattttaagaaatgcaaggaaactacctgaaaaaacacagacattctataaggagctgaaccgtttgcgaaaggccgctctagcctttggtttcctggacctgctgaaaggggtggctgacatgctggaaagggaatgcacactgctgcctgagacagcccaccctgatgctgcattccagctgacccatgctgcccagcagctcaagctggccagtaccggcacctctgagtatgccgcttatgaccagaacatcacacctttgcacacggacttctctgggagcagcactgaaagaatttgaaactgacttttggagctttccttcttttttcatttcaactgaaaatgctttaggtaaaaacctttccagtatgttcacctctagaatagccacccaaagaccttcctgaggctgcctcagaagcaccacttgctgttttgaatgactctactagtatgagaaggatgtgaaggtggttggctggttgggctttaacttcctgggattcataatttttaagcttggaagatagctgctgttcccatgatgggcacatttcctgagaagcttgaatgactgatgagcatagagcacccctgccttcctcagga

SEQ ID NO: 199369 - DNA, 492 bp, Homo sapiens
  Payload ID: 19333
  Gene Name: von Willebrand factor A domain containing 9
  ENST ID: ENST00000562830
  CDS Start-End: 376-492
ggactgtgtccggcgatgggcacggggtgagtggggaggccgagggcccgggactgcctttcgctgcttgttggggttacaggtgaaggggttatgggtgaagaacaacccagggccagcgcttggccttcccgccaccgtggcggccgccccgcgctgtctgtgaggcgccagttccggggcgctgctcccggcctcccctcgctctgaggctcggggtccccagctccgcgtaaactgcacgatttcgccctctgctcagctcccctctgccccctctttccaagagagacttccagatcccacattttcttgactgatttttaaggtaaaaatacatctcccagatgtgattttcagtctggacttttagagatgaaattatatctgagaactggggagggactcccggaggctgacgggaaagccaaagagcaggaagcactaagtaatatggatgattatgacaaaacctgcttggagtctgcatta

SEQ ID NO: 199370 - DNA, 2419 bp, Homo sapiens
  Payload ID: 19333
  Gene Name: von Willebrand factor A domain containing 9
  ENST ID: ENST00000567744
  CDS Start-End: 374-2038
actgtgtccggcgatgggcacggggtgagtggggaggccgagggcccgggactgcctttcgctgcttgttggggttacaggtgaaggggttatgggtgaagaacaacccagggccagcgcttggccttcccgccaccgtggcggccgccccgcgctgtctgtgaggcgccagttccggggcgctgctcccggcctcccctcgctctgaggctcggggtccccagctccgcgtaaactgcacgatttcgccctctgctcagctcccctctgccccctctttccaagagagacttccagatcccacattttcttgactgatttttaaggtaaaaatacatctcccagatgtgattttcagtctggacttttagagatgaaattatatctgagaactggggagggactcccggaggctgacgggaaagccaaagagcagctgtctgtttgcattctgattgggaacactgggatcattttcatcatgccgacagtggtggtaatggatgtatccctttccatgacccgacctgtgtctattgaggggtccgaggaataccagcgtaagcacctagcagcccatggtttaacgatgctgtttgagcacatggccacaaattacaagcttgaatttacagcacttgtggttttttcatcactttgggagttgatggtccccttcacgagagattataataccctacaggaagcactaagtaatatggatgattatgacaaaacctgcttggagtctgcattagttggtgtttgcaatatcgttcagcaagaatggggtggtgcaattccttgccaggttgtcctggtgacagacggctgtcttggcattggtagagggtcactgcgacattccctagccactcaaaatcaacgaagtgagagcaacaggtttccactaccttttcctttcccatctaagttatatatcatgtgcatggcgaatttggaggagctccagagcaccgattccttggaatgccttgaacgtctcatagatttaaacaatggtgaagggcagatttttactattgatggccccctgtgcttgaagaatgtacagtctatgtttggaaaactgatagatttggcatatacgcctttccatgctgttctcaagtgtggccacctaactgctgatgtacaagtcttccccaggccagaaccttttgttgtagatgaagaaattgatcctatccctaaagtcattaacacagatttggaaatagtgggatttattgatatagctgatatttcaagtcccccagttctgtccagacatctggtcttacctatagcacttaacaaagaaggtgatgaggtgggtactggcatcactgatgacaatgaagatgaaaattcagccaatcagattgcaggcaaaatacccaacttttgtgtcctgctccatggtagcctaaaagtggaaggaatggtagcgattgttcaattaggtcctgaatggcatggaatgctctactcccaagctgacagcaagaagaaatcaaacctcatgatgtctctctttgagcctggcccagaacctctcccatggctagggaaaatggcacagttgggtcctatttcagatgctaaagaaaacccttatggcgaggatgacaataagagtccattccccctgcagcccaaaaacaaacgcagttatgcccagaatgtgactgtctggatcaaacccagcggcctgcagacagatgtacagaagattttaagaaatgcaaggaaactacctgaaaaaacacagacattctataaggagctgaaccgtttgcgaaaggccgctctagcctttggtttcctggacctgctgaaaggggtggctgacatgctggaaagggaatgcacactgctgcctgagacagcccaccctgatgctgcattccagctgacccatgctgcccagcagctcaagctggccagtaccggcacctctgagtatgccgcttatgaccagaacatcacacctttgcacacggacttctctgggagcagcactgaaagaatttgaaactgacttttggagctttccttcttttttcatttcaactgaaaatgctttaggtaaaaacctttccagtatgttcacctctagaatagccacccaaagaccttcctgaggctgcctcagaagcaccacttgctgttttgaatgactctactagtatgagaaggatgtgaaggtggttggctggttgggctttaacttcctgggattcataatttttaagcttggaagatagctgctgttcccatgatgggcacatttcctgagaagcttgaatgactgatgagcatagagcacccctgccttcctcaggaaacctgaccggcaggggctctctggcttcctgaaagcttcacctcttccctcgtttatatctcaactgta

SEQ ID NO: 199371 - DNA, 618 bp, Homo sapiens
  Payload ID: 19333
  Gene Name: von Willebrand factor A domain containing 9
  ENST ID: ENST00000568573
  CDS Start-End: 389-618
actgtgtccggcgatgggcacggggtgagtggggaggccgagggcccgggactgcctttcgctgcttgttggggttacaggtgaaggggttatgggtgaagaacaacccagggccagcgcttggccttcccgccaccgtggcggccgccccgcgctgtctgtgaggcgccagttccggggcgctgctcccggcctcccctcgctctgaggctcggggtccccagctccgcgtaaactgcacgatttcgccctctgctcagctcccctctgccccctctttccaagagagacttccagatcccacattttcttgactgatttttaagcatttcttcgtttatagctgtctgtttgcattctgattgggaacactgggatcattttcatcatgccgacagtggtggtaatggatgtatccctttccatgacccgacctgtgtctattgaggggtccgaggaataccagccactaagtaatatggatgattatgacaaaacctgcttggagtctgcattagttggtgtttgcaatatcgttcagcaagaatggggtggtgcaattccttgccaggttgtcctggtgacagacggctgtcttggcattggtagagggtcact

SEQ ID NO: 199372 - DNA, 761 bp, Homo sapiens
  Payload ID: 19333
  Gene Name: von Willebrand factor A domain containing 9
  ENST ID: ENST00000567940
  CDS Start-End: 18-191
atgccgacggaaagtttatgccgacggactgtgtccggcgatgggcacggggtgagtggggaggccgagggcccgggactgcctttcgctgcttgttggggttacaggtgaaggggttatgggtgaagaacaacccagggccagcgcttggccttcccgccaccgtggcggccgccccgcgctgtctgtgaggcgccagttccggggcgctgctcccggcctcccctcgctctgaggctcggggtccccagctccgcgtaaactgcacgatttcgccctctgctcagctcccctctgccccctctttccaagagagacttccagatcccacattttcttgactgatttttaagctgtctgtttgcattctgattgggaacactgggatcattttcatcatgccgacagtggtggtaatggatgtatccctttccatgacccgacctgtgtctattgaggggtccgaggaataccagcgtaagcacctagcagcccatggtttaacgatgctgtttgagcacatggccacaaattacaagcttgaatttacagcacttgtggttttttcatcactttgggagttgatggtccccttcacgagagattataataccctacaggaagcactaagtaatatggatgattatgacaaaacctgcttggagtctgcattagttggtgtttgcaatatcgttcagcaagaatggggtggtgcaattccttgccaggttgtcctggtgacagacggctgtcttggcatt

SEQ ID NO: 199373 - DNA, 2615 bp, Homo sapiens
  Payload ID: 19333
  Gene Name: von Willebrand factor A domain containing 9
  ENST ID: ENST00000573314
  CDS Start-End: 6-179
agtttatgccgacggactgtgtccggcgatgggcacggggtgagtggggaggccgagggcccgggactgcctttcgctgcttgttggggttacaggtgaaggggttatgggtgaagaacaacccagggccagcgcttggccttcccgccaccgtggcggccgccccgcgctgtctgtgaggcgccagttccggggcgctgctcccggcctcccctcgctctgaggctcggggtccccagctccgcgtaaactgcacgatttcgccctctgctcagctcccctctgccccctctttccaagagagacttccagatcccacattttcttgactgatttttaagcatttcttcgtttatagctgtctgtttgcattctgattgggaacactgggatcattttcatcatgccgacagtggtggtaatggatgtatccctttccatgacccgacctgtgtctattgaggggtccgaggaataccagcgtaagcacctagcagcccatggtttaacgatgctgtttgagcacatggccacaaattacaagcttgaatttacagcacttgtggttttttcatcactttgggagttgatggtccccttcacgagagattataataccctacaggaagcactaagtaatatggatgattatgacaaaacctgcttggagtctgcattagttggtgtttgcaatatcgttcagcaagaatggggtggtgcaattccttgccaggttgtcctggtgacagacggctgtcttggcattggtagagggtcactgcgacattccctagccactcaaaatcaacgaagtgagagcaacaggtttccactaccttttcctttcccatctaagttatatatcatgtgcatggcgaatttggaggagctccagagcaccgattccttggaatgccttgaacgtctcatagatttaaacaatggtgaagggcagatttttactattgatggccccctgtgcttgaagaatgtacagtctatgtttggaaaactgatagatttggcatatacgcctttccatgctgttctcaagtgtggccacctaactgctgatgtacaagtcttccccaggccagaaccttttgttgtagatgaagaaattgatcctatccctaaagtcattaacacagatttggaaatagtgggatttattgatatagctgatatttcaagtcccccagttctgtccagacatctggtcttacctatagcacttaacaaagaaggtgatgaggtgggtactggcatcactgatgacaatgaagatgaaaattcagccaatcagattgcaggcaaaatacccaacttttgtgtcctgctccatggtagcctaaaagtggaaggaatggtagcgattgttcaattaggtcctgaatggcatggaatgctctactcccaagctgacagcaagaagaaatcaaacctcatgatgtctctctttgagcctggcccagaacctctcccatggctagggaaaatggcacagttgggtcctatttcagatgctaaagaaaacccttatggcgaggatgacaataagagtccattccccctgcagcccaaaaacaaacgcagttatgcccagaatgtgactgtctggatcaaacccagcggcctgcagacagatgtacagaagattttaagaaatgcaaggaaactacctgaaaaaacacagacattctataaggagctgaaccgtttgcgaaaggccgctctagcctttggtttcctggacctgctgaaaggggtggctgacatgctggaaagggaatgcacactgctgcctgagacagcccaccctgatgctgcattccagctgacccatgctgcccagcagctcaagctggccagtaccggcacctctgagtatgccgcttatgaccagaacatcacacctttgcacacggacttctctgggagcagcactgaaagaatttgaaactgacttttggagctttccttcttttttcatttcaactgaaaatgctttaggtaaaaacctttccagtatgttcacctctagaatagccacccaaagaccttcctgaggctgcctcagaagcaccacttgctgttttgaatgactctactagtatgagaaggatgtgaaggtggttggctggttgggctttaacttcctgggattcataatttttaagcttggaagatagctgctgttcccatgatgggcacatttcctgagaagcttgaatgactgatgagcatagagcacccctgccttcctcaggaaacctgaccggcaggggctctctggcttcctgaaagcttcacctcttccctcgtttatatctcaactgtaagggcattttcaagcttctgttcatggaatgagcaactcagactgtctggagcttgctgagtacaaacacaccaccactaagtttcagaactttccttagaacttgggcaaaatgtggtggtaactcttaagtgcttttggtatctcttgagattctaacttttaaagagcaaccattaatgtgtaaaatgattcctattattcaaggtttttttttaatgaaaataaaatatttgattttctagaaaatggtttcactatgaaactaaaggtc

SEQ ID NO: 199374 - DNA, 3368 bp, Homo sapiens
  Payload ID: 19334
  Gene Name: von Willebrand factor C and EGF domains
  Uniprot ID: Q96DN2
  ENST ID: ENST00000301770
  CDS Start-End: 55-714
cccgcgcgcggcgcaggagccgagcccagcccgggggacccgccgccgccggtcatgtgggccggactgctccttcgggccgcctgtgtcgcgctcctgctgccgggggcaccagcccgaggctacaccgggaggaagccgcccgggcacttcgcggccgagagacgccgactgggcccccacgtctgcctctctgggtttgggagtggctgctgccctggctgggcgccctctatgggtggtgggcactgcaccctgcccctctgctccttcggctgtgggagtggcatctgcatcgctcccaatgtctgctcctgccaggatggagagcaaggggccacctgcccagaaacccatggaccatgtggggagtacggctgtgaccttacctgcaaccatggaggctgtcaggaggtggcccgagtgtgccccgtgggcttctcgatgacggagacagctgttggcatcaggtgtacagacattgacgaatgtgtaacctcctcctgcgagggccactgtgtgaacacagaaggtgggtttgtgtgcgagtgtgggccgggcatgcagctgtctgccgaccgccacagctgccaagacactgacgaatgcctagggactccctgtcagcagagatgtaaaaacagcattggcagctacaagtgttcctgtcgaactggcttccaccttcatggcaaccggcactcctgtatgtaaacgagtgtcggaggccattggagaggcgagtctgtcaccattcctgccacaacaccgtgggcagcttcctatgcacatgccgacctggcttcaggctccgagctgaccgcgtgtcctgtgaagctttcccgaaagccgtgctggccccatctgccatcctgcaaccccggcaacacccgtccaagatgcttctgttgcttcctgaggccggccggcctgccctgtccccaggacatagccctccttctggggctccagggcccccagccggagtcaggaccacccgcctgccatctcccaccccacgactacccacatcctccccttctgcccctgtgtggctgctgtccaccctgctggccaccccagtgcctactgcctccctgctggggaacctcagacccccctcactccttcagggggaggtgatggggaccccttcctcacccaggggccctgagtccccccgactggcagcagggccctctccctgctggcacctgggagccatgcatgaatcaaggagtcgctggacagagcctgggtgttcccagtgctggtgcgaggacgggaaggtgacctgtgaaaaggtgaggtgtgaagctgcttgttcccacccaattccctccagagatggtgggtgctgcccatcgtgcacaggctgttttcacagtggtgtcgtccgagctgaaggggatgtgttttcacctcccaatgagaactgcaccgtctgtgtctgtctggctggaaacgtgtcctgcatctctcctgagtgtccttctggcccctgtcagacccccccacagacggattgctgtacttgtgttccagtgagatgctatttccacggccggtggtacgcagacggggctgtgttcagtgggggtggtgacgagtgtaccacctgtgtttgccagaatggggaggtggagtgctccttcatgccctgccctgagctggcctgcccccgagaagagtggcggctgggccctgggcagtgttgcttcacctgccaggagcccacaccctcgacaggctgctctcttgacgacaacggggttgagtttccgattggacagatctggtcgcctggtgacccctgtgagttatgcatctgccagggcggggaggcaggggccggtgtcaccggtggggtcttggtgaagttcctccttcctccaggcagatggctcggtgagctgcaagaggacagactgtgtggactcctgccctcacccgatccggatccctggacagtgctgcccagactgttcagcaggctgcacctacacaggcagaatcttctataacaacgagaccttcccgtctgtgctggacccatgtctgagctgcatctgcctgctgggctcagtggcctgttcccccgtggactgccccatcacctgtacctaccctttccaccctgacggggagtgctgccccgtgtgccgagactgcaactacgagggaaggaaggtggcgaatggccaggtgttcaccttggatgatgaaccctgcacccggtgcacgtgccagctgggagaggtgagctgtgagaaggttccctgccagcgggcctgtgccgaccctgccctgcttcctggggactgctgctcttcctgtccagattccctgtctcctctggaagaaaagcaggggctctcccctcacggaaatgtggcattcagcaaagctggtcggagcctgcatggagacactgaggcccctgtcaactgtagctcctgtcctgggcccccgacagcatcaccctcgaggccggtgcttcatctcctccagctccttttaagaacgaacttgatgaaaacacagactttacctacaagcccggcaggagctcatggtccacactcactcgctttggggctgacagccactttcccaggggagcctggggcctcccctcgactctcaccagggccttcgacccctccaggagcccccactctacctctagcttccccaggggctcctcagccacctcctgtgactccagagcgctcgttctcagcctctggggcccagatagtgtccaggtggcctcctctgcctggcaccctcctgacggaagcttcagcactttccatgatggaccccagcccctcgaagacccccatcaccctcctcgggcctcgcgtgctttctcccaccacctctagactctccacagcccttgcagccaccacccaccctggcccccagcagcccccagtgggggcttctcggggggaagagtccaccatgtaaggaggtcactgtgtccgggagactctggagagaggacctctgccagtggcccagggtgtgtgcagggcagctccaaggatgaacctggtggggatgcctgggctccctcctgcaggggccctggtgaggatggaagacccccaaggctggatgtaaccttgttcccaagaagtgtttggaatgtgctgtaagaatggaggaagtcgtttccactgtcagcatcctccctggaccgcgtggctggctcatcttttgagaagggttgggactgccaagttctcctggaggaagagttgcgtccggctgggattccactcactgggactgtaccgccaggtgtcatgcgtctctctgaggtttcctgattaaaggttgtctcggtttcccca

SEQ ID NO: 199375 - DNA, 3640 bp, Homo sapiens
  Payload ID: 19334
  Gene Name: von Willebrand factor C and EGF domains
  Uniprot ID: Q96DN2
  ENST ID: ENST00000335613
  CDS Start-End: 388-3255
agtcagcgcttcgcaggaagccgactcccaaaccggggcagggggtgtgggccgagggcgaaaccccgcccccaggggtccctgatctttgcccccgccccgggctccgcgcctctcggagaggcatcagcaggcgggcggcgttgcctttgtgtgtttcgcttcgaggtgccagagaccctccccacaatcgtccgccgcgtcccctcgcggccctcggcccctcctctcggcgtcccaagcccccctgctcagctctgcgtgccatttcggggatcgctggttcgctccccacggcgccaggaggaggggcgagggccggcagccccctctcccgcgcgcggcgcaggagccgagcccagcccgggggacccgccgccgccggtcatgtgggccggactgctccttcgggccgcctgtgtcgcgctcctgctgccgggggcaccagcccgaggctacaccgggaggaagccgcccgggcacttcgcggccgagagacgccgactgggcccccacgtctgcctctctgggtttgggagtggctgctgccctggctgggcgccctctatgggtggtgggcactgcaccctgcccctctgctccttcggctgtgggagtggcatctgcatcgctcccaatgtctgctcctgccaggatggagagcaaggggccacctgcccagaaacccatggaccatgtggggagtacggctgtgaccttacctgcaaccatggaggctgtcaggaggtggcccgagtgtgccccgtgggcttctcgatgacggagacagctgttggcatcaggtgtacagacattgacgaatgtgtaacctcctcctgcgagggccactgtgtgaacacagaaggtgggtttgtgtgcgagtgtgggccgggcatgcagctgtctgccgaccgccacagctgccaagacactgacgaatgcctagggactccctgtcagcagagatgtaaaaacagcattggcagctacaagtgttcctgtcgaactggcttccaccttcatggcaaccggcactcctgtgtagatgtaaacgagtgtcggaggccattggagaggcgagtctgtcaccattcctgccacaacaccgtgggcagcttcctatgcacatgccgacctggcttcaggctccgagctgaccgcgtgtcctgtgaagctttcccgaaagccgtgctggccccatctgccatcctgcaaccccggcaacacccgtccaagatgcttctgttgcttcctgaggccggccggcctgccctgtccccaggacatagccctccttctggggctccagggcccccagccggagtcaggaccacccgcctgccatctcccaccccacgactacccacatcctccccttctgcccctgtgtggctgctgtccaccctgctggccaccccagtgcctactgcctccctgctggggaacctcagacccccctcactccttcagggggaggtgatggggaccccttcctcacccaggggccctgagtccccccgactggcagcagggccctctccctgctggcacctgggagccatgcatgaatcaaggagtcgctggacagagcctgggtgttcccagtgctggtgcgaggacgggaaggtgacctgtgaaaaggtgaggtgtgaagctgcttgttcccacccaattccctccagagatggtgggtgctgcccatcgtgcacaggctgttttcacagtggtgtcgtccgagctgaaggggatgtgttttcacctcccaatgagaactgcaccgtctgtgtctgtctggctggaaacgtgtcctgcatctctcctgagtgtccttctggcccctgtcagacccccccacagacggattgctgtacttgtgttccagtgagatgctatttccacggccggtggtacgcagacggggctgtgttcagtgggggtggtgacgagtgtaccacctgtgtttgccagaatggggaggtggagtgctccttcatgccctgccctgagctggcctgcccccgagaagagtggcggctgggccctgggcagtgttgcttcacctgccaggagcccacaccctcgacaggctgctctcttgacgacaacggggttgagtttccgattggacagatctggtcgcctggtgacccctgtgagttatgcatctgccaggcagatggctcggtgagctgcaagaggacagactgtgtggactcctgccctcacccgatccggatccctggacagtgctgcccagactgttcagcaggctgcacctacacaggcagaatcttctataacaacgagaccttcccgtctgtgctggacccatgtctgagctgcatctgcctgctgggctcagtggcctgttcccccgtggactgccccatcacctgtacctaccctttccaccctgacggggagtgctgccccgtgtgccgagactgcaactacgagggaaggaaggtggcgaatggccaggtgttcaccttggatgatgaaccctgcacccggtgcacgtgccagctgggagaggtgagctgtgagaaggttccctgccagcgggcctgtgccgaccctgccctgcttcctggggactgctgctcttcctgtccagattccctgtctcctctggaagaaaagcaggggctctcccctcacggaaatgtggcattcagcaaagctggtcggagcctgcatggagacactgaggcccctgtcaactgtagctcctgtcctgggcccccgacagcatcaccctcgaggccggtgcttcatctcctccagctccttttaagaacgaacttgatgaaaacacagactttacctacaagcccggcaggagctcatggtccacactcactcgctttggggctgacagccactttcccaggggagcctggggcctcccctcgactctcaccagggccttcgacccctccaggagcccccactctacctctagcttccccaggggctcctcagccacctcctgtgactccagagcgctcgttctcagcctctggggcccagatagtgtccaggtggcctcctctgcctggcaccctcctgacggaagcttcagcactttccatgatggaccccagcccctcgaagacccccatcaccctcctcgggcctcgcgtgctttctcccaccacctctagactctccacagcccttgcagccaccacccaccctggcccccagcagcccccagtgggggcttctcggggggaagagtccaccatgtaaggaggtcactgtgtccgggagactctggagagaggacctctgccagtggcccagggtgtgtgcagggcagctccaaggatgaacctggtggggatgcctgggctccctcctgcaggggccctggtgaggatggaagacccccaaggctggatgtaaccttgttcccaagaagtgtttggaatgtgctgtaagaatggaggaagtcgtttccactgtcagcatcctccctggaccgcgtggctggctcatcttttgagaagggttgggactgccaagttctcctggaggaagagttgcgtccggctgggattccactcactgggactgtaccgccaggtgtcatgcgtctctctgaggtttcctgattaaaggttgtctcggtttc

SEQ ID NO: 199376 - DNA, 883 bp, Homo sapiens
  Payload ID: 19334
  Gene Name: von Willebrand factor C and EGF domains
  ENST ID: ENST00000535599
  CDS Start-End: 59-580
ctctcccgcgcgcggcgcaggagccgagcccagcccgggggacccgccgccgccggtcatgtgggccggactgctccttcgggccgcctgtgtcgcgctcctgctgccgggggcaccagcccgaggctacaccgggaggaagccgcccgggcacttcgcggccgagagacgccgactgggcccccacgtctgcctctctgggtttgggagtggctgctgccctggctgggcgccctctatgggtggtgggcactgcaccctgcgtaagtgcttgtccctgtgccccaagtcttctcctccagcagtgtgtgttgccagccctcagtccctggtccgaggggcagacgggaggccccagttcctcgtgtctcacctgcacttctcctctcagccctctgctccttcggctgtgggagtggcatctgcatcgctcccaatgtctgctcctgccaggatggagagcaaggggccacctgcccagaaacccatggaccatgtggggagtacggctgtgaccttacctgcaaccatggaggctgtcaggaggtggcccgagtgtgccccgtgggcttctcgatgacggagacagctgttggcatcaggtgtacagacattgacgaatgtgtaacctcctcctgcgagggccactgtgtgaacacagaaggtgggtttgtgtgcgagtgtgggccgggcatgcagctgtctgccgaccgccacagctgccaagacactgacgaatgcctagggactccctgtcagcagagatgtaaaaacagcattggcagctacaagtgttcctgtcgaactggcttccaccttcatggcaaccggcactcctgtgtagatacaccccaaggattcctctctgctcacccattttctt

SEQ ID NO: 199377 - DNA, 1437 bp, Homo sapiens
  Payload ID: 19334
  Gene Name: von Willebrand factor C and EGF domains
  ENST ID: ENST00000535710
  CDS Start-End: 124-1386
ctctctgctccccagggagtgggggtggtgaccatctaggcatctctggaggacgcagctgccgtcagccactggcagtacttcggagacaggacctggaatggggaggtggagtgctccttcatgccctgccctgagctggcctgcccccgagaagagtggcggctgggccctgggcagtgttgcttcacctgccaggagcccacaccctcgacaggctgctctcttgacgacaacggggttgagtttccgattggacagatctggtcgcctggtgacccctgtgagttatgcatctgccaggcagatggctcggtgagctgcaagaggacagactgtgtggactcctgccctcacccgatccggatccctggacagtgctgcccagactgttcagcaggctgcacctacacaggcagaatcttctataacaacgagaccttcccgtctgtgctggacccatgtctgagctgcatctgcctgctgggctcagtggcctgttcccccgtggactgccccatcacctgtacctaccctttccaccctgacggggagtgctgccccgtgtgccgagactgcaactacgagggaaggaaggtggcgaatggccaggtgttcaccttggatgatgaaccctgcacccggtgcacgtgccagctgggagaggtgagctgtgagaaggttccctgccagcgggcctgtgccgaccctgccctgcttcctggggactgctgctcttcctgtccagattccctgtctcctctggaagaaaagcaggggctctcccctcacggaaatgtggcattcagcaaagctggtcggagcctgcatggagacactgaggcccctgtcaactgtagctcctgtcctgggcccccgacagcatcaccctcgaggccggtgcttcatctcctccagctccttttaagaacgaacttgatgaaaacacagactttacctacaagcccggcaggagctcatggtccacactcactcgctttggggctgacagccactttcccaggggagcctggggcctcccctcgactctcaccagggccttcgacccctccaggagcccccactctacctctagcttccccaggggctcctcagccacctcctgtgactccagagcgctcgttctcagcctctggggcccagatagtgtccaggtggcctcctctgcctggcaccctcctgacggaagcttcagcactttccatgatggaccccagcccctcgaagacccccatcaccctcctcgggcctcgcgtgctttctcccaccacctctagactctccacagcccttgcagccaccacccaccctggcccccagcagcccccagtgggggcttctcggggggaagagtccaccatgtaaggaggtcactgtgtccgggagactctggagagaggacctctgccagtggcc

SEQ ID NO: 199378 - DNA, 3032 bp, Homo sapiens
  Payload ID: 19334
  Gene Name: von Willebrand factor C and EGF domains
  ENST ID: ENST00000613271
  CDS Start-End: 634-2646
ttcggctgtgggagtggcatctgcatcgctcccaatgtctgctcctgccaggatggagagcaaggggccacctgcccagaaacccatggaccatgtggggagtacggctgtgaccttacctgcaaccatggaggctgtcaggaggtggcccgagtgtgccccgtgggcttctcgatgacggagacagctgttggcatcaggtgtacagacattgacgaatgtgtaacctcctcctgcgagggccactgtgtgaacacagaaggtgggtttgtgtgcgagtgtgggccgggcatgcagctgtctgccgaccgccacagctgccaagacactgacgaatgcctagggactccctgtcagcagagatgtaaaaacagcattggcagctacaagtgttcctgtcgaactggcttccaccttcatggcaaccggcactcctgtgtagatgtaaacgagtgtcggaggccattggagaggcgagtctgtcaccattcctgccacaacaccgtgggcagcttcctatgcacatgccgacctggcttcaggctccgagctgaccgcgtgtcctgtgaagctttcccgaaagccgtgctggccccatctgccatcctgcaaccccggcaacacccgtccaagatgcttctgttgcttcctgaggccggccggcctgccctgtccccaggacatagccctccttctggggctccagggcccccagccggagtcaggaccacccgcctgccatctcccaccccacgactacccacatcctccccttctgcccctgtgtggctgctgtccaccctgctggccaccccagtgcctactgcctccctgctggggaacctcagacccccctcactccttcagggggaggtgatggggaccccttcctcacccaggggccctgagtccccccgactggcagcagggccctctccctgctggcacctgggagccatgcatgaatcaaggagtcgctggacagagcctgggtgttcccagtgctggtgcgaggacgggaaggtgacctgtgaaaaggtgaggtgtgaagctgcttgttcccacccaattccctccagagatggtgggtgctgcccatcgtgcacaggctgttttcacagtggtgtcgtccgagctgaaggggatgtgttttcacctcccaatgagaactgcaccgtctgtgtctgtctggctggaaacgtgtcctgcatctctcctgagtgtccttctggcccctgtcagacccccccacagacggattgctgtacttgtgttccagtgagatgctatttccacggccggtggtacgcagacggggctgtgttcagtgggggtggtgacgagtgtaccacctgtgtttgccagaatggggaggtggagtgctccttcatgccctgccctgagctggcctgcccccgagaagagtggcggctgggccctgggcagtgttgcttcacctgccaggagcccacaccctcgacaggctgctctcttgacgacaacggggttgagtttccgattggacagatctggtcgcctggtgacccctgtgagttatgcatctgccaggcagatggctcggtgagctgcaagaggacagactgtgtggactcctgccctcacccgatccggatccctggacagtgctgcccagactgttcagcaggctgcacctacacaggcagaatcttctataacaacgagaccttcccgtctgtgctggacccatgtctgagctgcatctgcctgctgggctcagtggcctgttcccccgtggactgccccatcacctgtacctaccctttccaccctgacggggagtgctgccccgtgtgccgagactgcaactacgagggaaggaaggtggcgaatggccaggtgttcaccttggatgatgaaccctgcacccggtgcacgtgccagctgggagaggtgagctgtgagaaggttccctgccagcgggcctgtgccgaccctgccctgcttcctggggactgctgctcttcctgtccaggattccctgtctcctctggaagaaaagcaggggctctcccctcacggaaatgtcattcagcaaagctggtcggagcctgcatggagacagaggcccctgtcaactgtagctcctgtcctgggcccccgacagcatcaccctcgaggccggtgcttcatctcctccagctccttttaagaacgaacttgatgaaaacacagactttacctacaagcccggcaggagctcatggtccacactcactcgctttggggctgacagccactttcccaggggagcctggggcctcctcgactctcaccagggccttcgacccctccaggagcccccactctacctctagcttccccaggggctcctcagccacctcctgtgactccagagcgctcgttctcagcctctggggcccagatagtgtccaggtggcctcctctgcctggcaccctcctgacggaagcttcagcactttccatgatggaccccagcccctcgaagaccccatcaccctcctcgggcctcgcgtgctttctcccaccacctctagactctccacagcccttgcagccaccacccaccctggcccccagcagcccccagtgggggcttctcggggggaagagtccaccatgtaaggaggtcactgtgtccgggagactctggagagaggacctctgccagtggcccagggtgtgtgcagggcagctccaaggatgaacctggtggggatgcctgggctccctcctgcaggggccctggtgaggatggaagacccccaaggctggatgtaaccttgttcccaagaagtgtttggaatgtgctgtaagaatggaggaagtcgtttccactgtcagcatcctccctggaccgcgtggctggctcatcttttgagaagggttgggactgccaagttctcctggaggaagagttgcgtccggctgggattccactcactgggactgtaccgccaggtgtcatgcgtctctctgaggtttcctgattaaaggttgtctcggtttcc

SEQ ID NO: 199379 - DNA, 11299 bp, Homo sapiens
  Payload ID: 19335
  Gene Name: von Willebrand factor C domain containing 2
  Uniprot ID: Q2TAL6
  ENST ID: ENST00000340652
  CDS Start-End: 557-1534
ggtgccactcgcgcgccggccgcgctccgggcttctcttttccctccgacgcgccacggctgcccagacattccggctgccgggtctggagagctccccgaacccctccgcggagaggagcgaggcggcgccagggtggcccccggggcgcgcttggtctcggagaagcggggacgaggccggaggatgagcgactgagggcgacgcgggcactgacgcgagttggggccgcgactaccggcagctgacagcgcgatgagcgactccccagagacgccctagcccggtgtgcgcgccaggcggagcgcgcaggtggggctgggctgttagtggtccgccccacgcgggtcgccggccggcccaggatgggcgctggcaacccgggcccgcgcccgccgctgctacccctgcgcccgctgcgagcccggcgtccggcccgcgccctgcgctcatggacggcggctcccggctggcggcggcgcgcccccgggctgtgaatgcgactcgcccctcggccgcgctccccgcccgcccgcccgccgggacgtggtaggggatgcccagctccactgcgatggcagttggcgcgctctccagttccctcctggtcacctgctgcctgatggtggctctgtgcagtccgagcatcccgctggagaagctggcccaggcaccagagcagccgggccaggagaagcgtgagcacgcctctcgggacggcccggggcgggtgaacgagctcgggcgcccggcgagggacgagggcggcagcggccgggactggaagagcaagagcggccgtgggctcgccggccgtgagccgtggagcaagctgaagcaggcctgggtctcccagggcgggggcgccaaggccggggatctgcaggtccggccccgcggggacaccccgcaggcggaagccctggccgcagccgcccaggacgcgattggcccggaactcgcgcccacgcccgagccacccgaggagtacgtgtacccggactaccgtggcaagggctgcgtggacgagagcggcttcgtgtacgcgatcggggagaagttcgcgccgggcccctcggcctgcccgtgcctgtgcaccgaggaggggccgctgtgcgcgcagcccgagtgcccgaggctgcacccgcgctgcatccacgtcgacacgagccagtgctgcccgcagtgcaaggagaggaagaactactgcgagttccggggcaagacctatcagactttggaggagttcgtggtgtctccatgcgagaggtgtcgctgtgaagccaacggtgaggtgctatgcacagtgtcagcgtgtccccagacggagtgtgtggaccctgtgtacgagcctgatcagtgctgtcccatctgcaaaaatggtccaaactgctttgcagaaaccgcggtgatccctgctggcagagaagtgaagactgacgagtgcaccatatgccactgtacttatgaggaaggcacatggagaatcgagcggcaggccatgtgcacgagacatgaatgcaggcaaatgtagacgcttcccagaacacaaactctgactttttctagaacattttactgatgtgaacattctagatgactctgggaactatcagtcaaagaagacttttgatgaggaataatggaaaattgttggtacttttccttttcttgataacagttactacaacagaaggaaatggatatatttcaaaacatcaacaagaactttgggcataaaatccttctctaaataaatgtgctattttcacagtaagtacacaaaagtacactattatatatcaaatgtatttctataatccctccattagagagcttatataagtgttttctatagatgcagattaaaaatgctgtgttgtcaaccgtcctcaccgtgtacctgcatatctttttcagttctgattccatcacccaggaatgttccccctgcacattttcacagggcagagtcacgcatgaatggatcataagatattaggaccaatttccactgaaaccctgtttaaattctatttaattacagacatatctctaatgttgatgtctacttcacataaatatatttcctttttataataatatatggcttttatctgcttcattctcagtcacttgtgaaatgcaggtgtaaagatcactaactcacactttctcagttctttcccctaagctcctgtattgtacaccataggtaagcacatacatatatttcattcttatttacattattttctcttctaaggataactttaattcattccctaaactgaggaataaagtaggctggaaaatttgcattactgttccatcaagctgaagcagacaacaaaataggggaggagtccttcgattctcctaggatagttaaggaaaatcaaactcctaaacaagtttatatacctgaaatctaaatgtgctacagataactcagctgtcagttcagtggaatcatatttgtcatcagacttgagtcatctatcctccataaactacacagtaaaatcttgactgataaccttgaattagccacccttcacaagcagagtgaggaagcagttattttgttaaaacaaagctgaagaccaagtgcactccacaactttcctatagttataattccaaaccaacttcttttctcttcatttgaacagagaacataaaaagccactgcaaagtcctgctaatctaattaatgcataatagaaaatagttctacctttatcaatcatatcagcatgcggtgtgttgatgaaagaggtaattggagtcttaataggtgtaggataaaaaaagcaaaactataatcactattaatgtctttaaaggattaaaatatatataatcattatttgaagcctctaaaggtatttttcatatttttgtttattctgaaattttgcattaagaacctattaagtacaaagcattgacaacaagggaataaggcttgatttcttgccttcttggactttcggtctctggcataagaagtatatgaaatcataatgtattgtattaggagccaaactagagaccagcaaatggagattagaaagccttcctaatgagaagatggagaacatgaaaaaatcattatataaaaaataattcaatcattaaagactgaataacattcaagaaaaatggatacatctatcataattgaaaaattaaactattgtgaaccttagtaagtataaagatgccactgactgagtcatcaaaacactacatatagtcatttaatttttgtcttgttcataaagaacaccttgagccaaaggaactaccagtacatagatttcatgaaaatactcaggggaattattagctaattgttctcaggtgtaatcagctttccaaaatttaacctttgtattaaagactggtagacattggccatccctcctttattcaaggatggattgtttgagacacagttatttaaagttgtcgttttgctaataaatggccctagcccccatgggtaggtgggccattagtaacctcttctctctccatcaggcatgatgcagttagagactcagtccatgcagctcaaagtcttcctgtttcccttaataataattcctaccagaatggatgatgagctctgaaataattgcaatggtgttttcaatgctgtgagaatttcagaaaacctagtattttgttgcatatagagagaatgaacccagtatcatcttgggaagttaactgactcacttgctctaaacttagtttgacctgcagggtcaccagcacacactcctaagagctaaagctcaatggctgttattacaccaaagtaactcccctccccatctctgatttcaaccccctcattcctctctcctcatagaaataatgcataaaccaaacacatggaagaacttggatttttgacactgtatatactcattaataataatggcattatttgcatttttgtccaagatcaacttcttcttgcagttagactttcacaaatacatagctatctcagattgacattctattttcctcccctctgttgtcagagaactctttgctgagattgtcaacaacaaactgttctattcaataaataacctgaataactgcccaataaaaaaggaaagtataagttactcaatttcaaaataatatggtttggagatagcacagaaaagggggcctcagaattcaagtatagaagttctggaaaagccataatcactaaaattcaaataggcctgctctataagtacctaataattgttaaatgatttgttcaagttaataaactaaatcgtgcttacaaatgtattaatgaatttatttcaaattttcaacccatatttagatctgaaagtataaagctacttatgtaagcaatagaatggttctggaaattatctgatgtcttagaggttttcaagttaaattcattctttcagtgataggatatttacttgttgggtggattaacaatactttttattgacatttcccagaagtcttgagaaaagtcatttcaaaaacttgtatttcatccctgcatgcaagaagtattagatgcactccagtccaggcaagtcctgctataatgttgcagctagtgcagatggagaggcacagtgtccttgacatcaaggggtctgtaagccttgaaactaatttaggtttgattataatacttttaatcttttgatacttagaatttcatcacctgctttgtgcagtaaaacatgctaagaagaattatcatgcagttttaagttcataacatcaataatatgtttaataaactttcttccctcgttctccaacataaatgttgcatttatataaggttaaaagtcctaaaaaatcataaaattcagatgtttaatttttgtttttaagcagtgaaatgggtttttaaatgtatacattatctgaaacttacaaaatatacactgtttcaaacaagcattgttggaaactaaatccattattttaaatgtggactatttaaacatgtagaaaacaaaattatagacataaactatgattttaaaaatattaacaatttgctaaatttgcttcaatgggcaagagatcaatcctacttttcattgttatttttaatatcatatttttccccaacataatgttattatgaagagtatcagatgtacaaataagcatcattggtaaaaacatacatgcttctttggccaacataatttgtaactgtcttactgaacctacttacctactatattttttttcctcactagtagcatctgatggttgatacagtcagtaactattctgaagaatcagattaagagagaacaatttacttattcaggaataagtgcatttttacagtacatatttttcacatttcagctgcaacttccaaagatcaggttctcattgctccgtagcacagattaaacagcctacttatgtcatatcctcacttcacaccaacttcttcagtctattattttagttttctaaatgtagatctagttttcaactgaattctttgaggatcgcaatcacacacaaaataacatccaaactcctcaacatggaagactggtgtcttcacaattagatcatggacaacaccatgacccaggcccctgtggctggtgagacttctgggccctgggtaccacagactatactctaaacatggtctttactatctcagatcctgccctgagtgtcctttgcagcatgttgagtattagccattttcaatgtccagttcaagtgccattgctggtaaggcttctgtagttcttattggaagaattgtcactctatgtcccagtaatagtactaatttggtttcttattttaacatatcatttaggaatcataccatagtttgcataatggttaattttatgcctgcttcttctattatttacaaatccctttagtttgggctgtgaaatattcaattcccaaaacatcacccaatatctatatgttaaaggcttgttgaattgtattccatctattagttcagagttatttgctattcttgtttaaggacaatgtatgtattaaagagcaactaaaaactcccattactgtttgccaacccagttgtcttttgatttctctgtcaacttacaagtatcaaatatctaagtcacagaacccagagacacatcaaataccccaaataccccatggtagttttcggatgaactctgacagctattggccatttctggtgcaagtcagaaaaaaattgcttttagtgtgaaatttttgatgctgaagaaagttgattgtattgaagagacactggccctttatgataaaggaagtcaagtttacagttttgatatttgtttactttcttatttctaatttttggaaaacaattttcttagactttcatttgtgatattgatcatttctgtgtgttttaatctttctacataacataattaaacacctcagtaggtatctagtgaactgatacaataatgagctgagtcatttgtacagaaatatagtagcttccataatctgaatgataaccatttaaaagtgatggttgttgaaattttactgtagtgtcaaatttcactttaaattttgcaaagcacctgctattctagccttaacacaaagatttggctaatttttaaatgaacaaatcccattgaatattaagtgacactgacaatcaccctgaaaagtattcagccaaagtttcaatagaattaggaaacttaaatgaaaatgtgctctcagtgcttggcccatgagcagtttatgatttaagacgtgcatactgtttaactctttcctttaaagttcagaaaagtacataaaacctctggctgacctattatataggcacagaattatcaaaagcaatcaaagtatgtacctaaagtcaatttagtatattatgaatacagcctgatgactaaacacaattgcaaatattgcgactttagtttttaattcaattttcagcaagtagaaatatttctcaattttatttggtatctaattatattaagaccaacatatacattaaagtgtatttagatgattaatatttaatgatcattattttatttaatgattaatattttctattatttgaatttctgtaatttatgttttagaaagaactgtttccaaacacattttatggaaagatttcatttttccattccctttacttttatatttacattgtcaaataaatacaattctattttcatttctattagttttcagggtttattcttttcctaagcatataattcttataatggaaaaaagtgaaaagtatccagtaagtaatatacacctatgaaactattaatgttctttatactaccaagtagtttcatagttttaaaaagccattcttaagcagtcggtgaatgtatatcatcggccaaaagttatgctaggtttccttcacttattatcacatttaacctcacagttctcccaaattgtgggtaatgctatcccctttgttgcagaaaagtaaatataggctcagggaaatttaaaaactgccttaagattcagtctagtgaatgagaggctgagttaagaatccaaatctgctttatatcagagcccgtgatttgaagtcttatcatttgtgtttaggtcagggacctctagaaaatagacagaaatttccaaaatggtcttttaccccactccccataaataagataatgaatagcaacactgatccctaattctagaatatcaatcttgatacttgtcaaagtaaatagtagctcgtcacaaaaatgttgtagcctccctagtctaaatgcttatgctatattttgtttcctaaatctagagatctctttttaaaaatagtattgaagcatcaggttgttcaggtatgattctcatattgaaatttacaaaatataaccaaatattgtgacccagtttttctggagccaagagaagtaaactgccatttattaggtgatgattatagggcaaacactacaatttcaaatttcatattcttttatctgatttattcattttatcaactctgctatattgatgaagaagtcaacatatggtgggtaacttatccaaatttcagtgatgggctgggcgtggtggctcacgcctataatcccagcactttgggaggctgaggcaggtggatcaggagtttgaggccaacctgaccaacatgtgaaaccccatctctactaaaaatacaaaaaaattacctgggcatggtggcacatgcctgtaatctactcgggaggctgaggcaggagaatcccttaaaccgagggggtggaggttgcttgagccgagatcgcgtcactgcactccagcctgggtaacagagcaagactctgtttaaaaaaaaaaaaaaaatcagtgatggaactgaggccaaatctgtctggttccaaagctatcctacatggggcacagtcaggactggaatggatagctctacctgcttccaaatattcttccctggggagcagctgtgagtcttactgaatcgatttattcattgcattctatgtgtcaactgcaatttagacctgggtgatagagtcatatatggtctttggacccatgaagctctgagtcaaggataccagcagatatccttaaactaataaaaaaagcgatggcatcacatgccattttgaacttttgcattaaagtcataaacttacatcagtattatgatttatacttttaagcaaaattttgccattttctgatacatagtagctagctagtgataaaattatgaagttaccattgtatgttccaatgacataaaaaactaagtgcctgcttgggctagttatactctgcagtataccctggtttattgtgaggattaaataaaaaatcctcacaaaccccaatttaatttaatatagattaattataaaaataatctacccatgttacataatgttaaatctgtagtttcaaggtgtatgctatttcttaaaacaaaaacaaagattgtccccactccaaacaataacagcaatggtgaaggttgtgggtggacagaggtagtcccactcatccccagggggctcagctgccaccggccaggtctatctattgctcccacctgctctgactgttttctctcaagaaaaagattttcattttaagataggcatcagtgcaataaaggagcttgatacaaaaatcattatgttctatatatgtttttgtaggttttagattaattatggccaactgataccttaaaatatttgttacaaataacactgaagtgagattcaaaattgtgccttctattgaagccaagaaagtaaatgtctttaaaataaacataatggtgtttttttttggtacaataaacagcatacctacatttcagaggacaaatcatgttattataataaccaggagagaaaataaaaggagacattaatttggatatggaagcaaaatggaacagagcaatatagagcaaaacagaggtttgtctgaaacatttaaaatattaagaagtatgactaaaaaactcaaacattttaatacacgatgaatccttttcttaaggaaaaaatgaaaataataaaagtggtatttggatgagataattttcctttaaatttattcctcagaatgatgtaaattttccagctggaaggtcatctttctatacatgcatgcatctatacaaatggttaaacagttactctctcaatttgctgtgataggaaaggtggatataaatataagcaagggtctgattaaaacaaaacaaaacaaacaaaagacaagagaagcactgcattgttggcaagaaattccttttaagtcagacttaagtccacggaaagctggacctaagcagtgaaggatgtaagggaacagagagagactctgcttggccgagtttgctattctcatttgtctatgtcaatacggctacataaagttcacaactatttgcacatagctataaatatagcatgaataaaacacatatgtatttaattgtgttatttactatttataatttgaattgtttaaaataattttaaatacttattccataaactcagtatttgaaaacttaaaaaaaaagtcattttaaataacatcatttaccaagtctgtgtgatgctttacaaggtacctgatgaatgtaaaattatagctttttgtcttcatttctaatagactgttataggggaaatgtactaaaatgttgtacttattacatttatgaatttctgacagtttctatagactgagaataatgatatgcttttataaattatttggtgaaagttttccagtaagtgttcatgtcctgtacaaatttattaaacaacatcaattttacctaacaactgtaaccactaataaatcatcagtcaccacctttcctgcatatctgacagatggagaacactgtgcttagtgttgaagataccaaagggaattcaagtgaggggaaaagaggagagcaaactgatcaaaagggaatgcccatgatgctttcaggaaaccagggtgagaacatgctggctggaggatgggtctggtttccagcagagatgataggagttaaaaggcataggtgagttgttcccatccctggcctgagccttactccatagctatagagacatagtctctagaaacaaaggccagagcatccttttaacatttatatcataagtattctcaataaacgtttgcaatttatttgctttaatgtaacttggcagtaaagactttggcctttggaggtctgattctaatcccagttctaccacttactggttatttatcaggtacacgttacctacctctctgtaactcagattgctcatcagtaacatggggagagtggtatcaaccactaagaggattaaatgagtgaatatttgtaaaacacgtagcctagaatagatatttataaagcacaagatctatgtaaagtgtttataacataatacattggaatatgagacttgaacattttgaagattctaataaatgaataatttaatttagtgctcatttgaaaaatattttatcctcatgtttacatttaacacatataatttatatcttagtttttatcccatttatatatatatttaccagaaaaatgttttgtaataccttaattttatgtggagttgaatttaaataattaggccgaatttgtatgtattgttggatgggtatgtgtattgacctgatttataaaataaagtatttattaaactga

SEQ ID NO: 199380 - DNA, 4610 bp, Homo sapiens
  Payload ID: 19336
  Gene Name: von Willebrand factor C domain containing protein 2-like
  Uniprot ID: B2RUY7
  ENST ID: ENST00000312504
  CDS Start-End: 803-1471
aagcagctctgggatttcgacagagctgggctcagaagccagttgttggcgctgtccgtggtgctgaggaattcccggctgccggcagaatgagctccaaatcagcaatctgcaaactgctcttactgatgcagaaacccagctaaagttgctcctttccttcacatccacagttagtattttccggtgtgtaagaggggattcaagcaacacactgtggacgatggtgatggtattgccagcggagtgggctttaagctacagcatgctgttgctgtttgtgatcctcagagcctagccaaatcacctctactgccgtagcaaacactgtgtaagtgaactcatgtgtggaggaggcgtaatcagccgggaaatttcatagaaggatctaagaaaatgctaaaaataagttcaacatgattctgctactggggtctggatttctacaggaccagctttgcttcttgctttgaattctgaagacaggtccaaagcaaatttcttatatgtgtctgctgtgtttctttctggaagggcgggagactgcttctttactgtgttttgaaatgggaggtagagagaatggattgcctttaattcatgcctaaaaaatgtattctttgggtaattaaagaggaactgctttcttaaaacatacctgaccttttagttcattttgggctgtgacccctaccaccaccattaacctccagagtgattagcctacccctcttgtattcccatggaaggagctgagtatatttaatattaggagcacatccagaagtctttgaagagggggatggctcttcatattcatgaagcttgcatacttctgttggtcatccctggattggtcacctctgctgctatcagtcatgaagactatcctgctgatgaaggtgaccagatctccagtaatgacaatctgatctttgatgactatcgagggaaagggtgtgtcgatgacagcggctttgtatacaagttgggagaacgatttttccctgggcattccaactgtccatgtgtctgtgctctagatggacctgtttgcgaccaaccagaatgccctaaaattcacccaaagtgtactaaagtggaacacaatggatgctgtcctgagtgcaaagaagtaaaaaacttctgtgaatatcacgggaaaaattacaaaatcttggaggaatttaagccctctccatgtgaatggtgtcgctgtgagcccagcaatgaagttcactgtgttgtagcagactgcgcagttcctgagtgtgtcaacccagtctatgaaccagaacaatgttgtcctgtctgcaaaaatggtccaaactgctttgcaggaacgacgataattccagctggcattgaagtgaaagtggacgaatgtaacatctgtcattgtcacaacggggactggtggaagcctgctcagtgttcgaaacgtgaatgccaaggcaagcagactgtgtaggacaaacttccacccaatgatgagttcttaggaaaggatgctatggcttcaacactgcacatgtttaacacaaaacaaaacaaacaaactcctgccagctacaacagggtcaccagcaaaactttctagggttgacaaaagtgaatattttcctaagaggaaatttctttctctcttgctatataaaatatatatagtatatagctatctaaatcgcttttgtatttaccaatgcttgatggtgacttgacgactggattgctggaacaaaaagaaagaaatagccttgcacaggctccttccctggtaatgcctctgacctaccagctcactgtcccctggtttacttcatttttactcttctgtacattgtacatggcattgttctcctgtaatatttgttttttcacttttagagtctaaggggctaaatttgactgcacagtaaagttttgagttgtgtaaaaaaaaaagtttggtaaaggaatgtcaggggaaatatctttcccgagctgggaaacacaagagcatccagtcaattgctcccctagggtgaatcatgccctgtagactaaggaaagaggggtgggcacatagacgggcctattgctggacagggttgggaacaagtactttgtccattacgtgggggctcacaatttaattcttacaaaccacacatttcatatggaaaacctcgaaactgccaatcaaaatctattacgtaaagaacaccataagctcaactaaagaatccaaagagagacagatctttaaaattgtagcattaatcatcagactttttcatgatgtgaaatttgagtttggtttgtagctaaacacactctaaactcactgtcatcaggcaatataaataccagaaccagggtgagaaaacccactgtgaatccaaatccttatgaacatctctggcttttgagttcagatttggctaaaagtcagtagtacacactggcagtttttgtggttcgggactgtgtttgccatgttgtagtaacaaccactcagccctatgtctgaaacacagattcaggacaccctttccacctcaagtgctgatttaaattaaagattagggtagagtgagtcttgcacaatacaattccatttgttgaacattttttaaaatgtatatattagatactgaaaaattaaagtgaacctttgaagagtctctaggttgccctggtaatgctgctagtatagtaacagaaaaaacaaaacacacagggtatctgatgccacctcgattcaagtgcaaaattaacaattctgaaaccacatggcatagttagtcgcttattccatgctcctgccctaaaaaccctggcacagatctgatagggtccttgaagagactttacagttgtctttattatcaatgttctttctttttctgctcccccaacctgggctttgccatagctcctgtggagagccatattctagagcaaggtgtctcaatcttagtaggattgacatttggggccagatcattattcgttggtgggggctgtcctgtgtgcttttaggatgtttagcaccatcactggcctctatccactagcaacatcccagcaactggtgacaaccaaatttctccagacattgcctaatgtccctaaggagtgggagtgaggggcctaatttcacctcgttgagaaccagtggtctagaataatcagtatagagtggtttctggcaggggacacagtaggcaagctctagcagcacctgtggcttttgtgagcttctgatccctatgggacatacacagtcagcatttccaaggggtcagtcttctccatagagagtgaggcttctaatgctataggcccaccctcaggaaacatatttttttgagtcttgtcaactggtttttcatttaaaattgtcagcctctcctccctggaagcatctgctgtcatcaagaaagagttgtcatttccaaaattaacgtgctgacgagtcagacctgacattcttatgcacactgtgcttgcgttatgatacaaatagccatgccggcaccatcccgaggaagagcatcaagccaccttcccttagaacaccaatttgcagcaaggttggtgcctttcatttgccaccatggatacatcatatagacagtcatgaatcattcatgagcaatgctgcatgatttatgtctgcactcaaaagtaaaggaattccacactttagcttatgtctagacagagatgtattatagagctttctttgccccgaggttgcctgttgccaacttcaaaaatccacactcttggaaagaaataataataataaatgacaggaataaggtttgaaactcagaaaatatcattaatagagccatgcagcatagtaccttatctattattaaggagttactatgtccttttttagaaaacagaaagagagtacaactgggaagctgaagtgcagaaattttgcatcaaagcattggcacagcgagagtcacagcaagaatttactagaattgaatgggacatccattaaggatctctcttcagagagtttgcagaaagcaggctgttctgtggcctctgataaccagctagagagagggatttttatggttggttttgttgttgttggattttctttttctcaaagtttcactgcaggctgtttcctttaagattttgtagcactgacatttttccccctttagggagagatgaacctatactgtgacaatttctcataaactgataaacattttacaacttccttctacccaggtcattgagaaattctttccagactctgaacaacagagctctggtctcatctgttgtttgtttcttgtgaagtctttgtttgcagccacactgtcatctctgtactcctatttctcctccgcctttggttctcggctttaacaacagctatgttaaaataagggatcaacatcttgtttgtcagctgatgcctattaaaaacgattcagtttctaaaatctttgaaaaatggcgtgcctgaaaactagtgagaaaaaaaaaaaacctaaacactaaactgtaaaaaggggattctagcaacaatatttgatgtgtaaaagaatatattattaaaaaattattttgttaaatataaa

SEQ ID NO: 199381 - DNA, 4480 bp, Homo sapiens
  Payload ID: 19336
  Gene Name: von Willebrand factor C domain containing protein 2-like
  ENST ID: ENST00000427124
  CDS Start-End: 803-1222
aagcagctctgggatttcgacagagctgggctcagaagccagttgttggcgctgtccgtggtgctgaggaattcccggctgccggcagaatgagctccaaatcagcaatctgcaaactgctcttactgatgcagaaacccagctaaagttgctcctttccttcacatccacagttagtattttccggtgtgtaagaggggattcaagcaacacactgtggacgatggtgatggtattgccagcggagtgggctttaagctacagcatgctgttgctgtttgtgatcctcagagcctagccaaatcacctctactgccgtagcaaacactgtgtaagtgaactcatgtgtggaggaggcgtaatcagccgggaaatttcatagaaggatctaagaaaatgctaaaaataagttcaacatgattctgctactggggtctggatttctacaggaccagctttgcttcttgctttgaattctgaagacaggtccaaagcaaatttcttatatgtgtctgctgtgtttctttctggaagggcgggagactgcttctttactgtgttttgaaatgggaggtagagagaatggattgcctttaattcatgcctaaaaaatgtattctttgggtaattaaagaggaactgctttcttaaaacatacctgaccttttagttcattttgggctgtgacccctaccaccaccattaacctccagagtgattagcctacccctcttgtattcccatggaaggagctgagtatatttaatattaggagcacatccagaagtctttgaagagggggatggctcttcatattcatgaagcttgcatacttctgttggtcatccctggattggtcacctctgctgctatcagtcatgaagactatcctgctgatgaaggtgaccagatctccagtaatgacaatctgatctttgatgactatcgagggaaagggtgtgtcgatgacagcggctttgtatacaagttgggagaacgatttttccctgggcattccaactgtccatgtgtctgtgctctagatggacctgtttgcgaccaaccagaatgccctaaaattcacccaaagtgtactaaagtggaacacaatggatgctgtcctgagtgcaaagaagtaaaaaacttctgtgaatatcacgggaaaaattacaaaatcttggaggaatttaaggtccaaactgctttgcaggaacgacgataattccagctggcattgaagtgaaagtggacgaatgtaacatctgtcattgtcacaacggggactggtggaagcctgctcagtgttcgaaacgtgaatgccaaggcaagcagactgtgtaggacaaacttccacccaatgatgagttcttaggaaaggatgctatggcttcaacactgcacatgtttaacacaaaacaaaacaaacaaactcctgccagctacaacagggtcaccagcaaaactttctagggttgacaaaagtgaatattttcctaagaggaaatttctttctctcttgctatataaaatatatatagtatatagctatctaaatcgcttttgtatttaccaatgcttgatggtgacttgacgactggattgctggaacaaaaagaaagaaatagccttgcacaggctccttccctggtaatgcctctgacctaccagctcactgtcccctggtttacttcatttttactcttctgtacattgtacatggcattgttctcctgtaatatttgttttttcacttttagagtctaaggggctaaatttgactgcacagtaaagttttgagttgtgtaaaaaaaaaagtttggtaaaggaatgtcaggggaaatatctttcccgagctgggaaacacaagagcatccagtcaattgctcccctagggtgaatcatgccctgtagactaaggaaagaggggtgggcacatagacgggcctattgctggacagggttgggaacaagtactttgtccattacgtgggggctcacaatttaattcttacaaaccacacatttcatatggaaaacctcgaaactgccaatcaaaatctattacgtaaagaacaccataagctcaactaaagaatccaaagagagacagatctttaaaattgtagcattaatcatcagactttttcatgatgtgaaatttgagtttggtttgtagctaaacacactctaaactcactgtcatcaggcaatataaataccagaaccagggtgagaaaacccactgtgaatccaaatccttatgaacatctctggcttttgagttcagatttggctaaaagtcagtagtacacactggcagtttttgtggttcgggactgtgtttgccatgttgtagtaacaaccactcagccctatgtctgaaacacagattcaggacaccctttccacctcaagtgctgatttaaattaaagattagggtagagtgagtcttgcacaatacaattccatttgttgaacattttttaaaatgtatatattagatactgaaaaattaaagtgaacctttgaagagtctctaggttgccctggtaatgctgctagtatagtaacagaaaaaacaaaacacacagggtatctgatgccacctcgattcaagtgcaaaattaacaattctgaaaccacatggcatagttagtcgcttattccatgctcctgccctaaaaaccctggcacagatctgatagggtccttgaagagactttacagttgtctttattatcaatgttctttctttttctgctcccccaacctgggctttgccatagctcctgtggagagccatattctagagcaaggtgtctcaatcttagtaggattgacatttggggccagatcattattcgttggtgggggctgtcctgtgtgcttttaggatgtttagcaccatcactggcctctatccactagcaacatcccagcaactggtgacaaccaaatttctccagacattgcctaatgtccctaaggagtgggagtgaggggcctaatttcacctcgttgagaaccagtggtctagaataatcagtatagagtggtttctggcaggggacacagtaggcaagctctagcagcacctgtggcttttgtgagcttctgatccctatgggacatacacagtcagcatttccaaggggtcagtcttctccatagagagtgaggcttctaatgctataggcccaccctcaggaaacatatttttttgagtcttgtcaactggtttttcatttaaaattgtcagcctctcctccctggaagcatctgctgtcatcaagaaagagttgtcatttccaaaattaacgtgctgacgagtcagacctgacattcttatgcacactgtgcttgcgttatgatacaaatagccatgccggcaccatcccgaggaagagcatcaagccaccttcccttagaacaccaatttgcagcaaggttggtgcctttcatttgccaccatggatacatcatatagacagtcatgaatcattcatgagcaatgctgcatgatttatgtctgcactcaaaagtaaaggaattccacactttagcttatgtctagacagagatgtattatagagctttctttgccccgaggttgcctgttgccaacttcaaaaatccacactcttggaaagaaataataataataaatgacaggaataaggtttgaaactcagaaaatatcattaatagagccatgcagcatagtaccttatctattattaaggagttactatgtccttttttagaaaacagaaagagagtacaactgggaagctgaagtgcagaaattttgcatcaaagcattggcacagcgagagtcacagcaagaatttactagaattgaatgggacatccattaaggatctctcttcagagagtttgcagaaagcaggctgttctgtggcctctgataaccagctagagagagggatttttatggttggttttgttgttgttggattttctttttctcaaagtttcactgcaggctgtttcctttaagattttgtagcactgacatttttccccctttagggagagatgaacctatactgtgacaatttctcataaactgataaacattttacaacttccttctacccaggtcattgagaaattctttccagactctgaacaacagagctctggtctcatctgttgtttgtttcttgtgaagtctttgtttgcagccacactgtcatctctgtactcctatttctcctccgcctttggttctcggctttaacaacagctatgttaaaataagggatcaacatcttgtttgtcagctgatgcctattaaaaacgattcagtttctaaaatctttgaaaaatggcgtgcctgaaaactagtgagaaaaaaaaaaaacctaaacactaaactgtaaaaaggggattctagcaacaatatttgatgtgtaaaagaatatattattaaaaaattattttgttaaatataaa

SEQ ID NO: 199382 - DNA, 5260 bp, Homo sapiens
  Payload ID: 19337
  Gene Name: von Willebrand factor D and EGF domains
  Uniprot ID: Q8N2E2
  ENST ID: ENST00000275358
  CDS Start-End: 190-4962
acgcgaaggctctatcccacgaaaggactgggtgcaccccagaacgaggacgcggagcttccctgttccaagcagcaacagactgagaaaatccaagaaaggaggcccgaggggctgctgtggccccatcctcctggcacccgcggcccgggctctgcgacgcctttcgccccacctgcggaagcagcgatgcctggcggagcctgcgtgctggtgatcgcgctgatgttcctggcctggggggaagctcaggagtgctctcctgggggacaccagtttcttcggagtccttatagaagtgtccgttttgactcatggcacctccagcagtcagctgttcaagacctaatatgtgaccattccctctcccctggatggtatagatttctcatccttgacagacctgccgagatgccaaccaaatgtgttgagatgaaccattgtggaactcaggcccccatctggctgtctctgagagattcagaaacactgccatctcctggggagatcaagcaattgacagcttgtgcaacatggcagtttttgttcagcactacaaaagactgctgtctctttcaaatcccagtgtctgtaagaaactgtgggaacttttctgtatacttactacaaccaactcagggatgtatgggctactgtgcggaagctatttctgatgcacgattacacccatgtggttctgatgaaactgaaacaggaggtgattgtgttcgtcagctggctgcctcattgccacctccacctgcaggaaggccagaggttctggtggagttgattgagtccaggcttttctgtaggtgttcttttgatgttcccgctacaaaaaactcagtgggatttcacatagcttggtctaggctttcttctcaagaagtcaaagaggagctgacacaagagaccacagttcaggcattctctcttttagaacttgatggcataaatctcagacttggagacaggatattctgcagcgcttctgtctttttcttggagaatcctcatgtacaaagtgtagccatcgaaagccaagaattttttgcaggctttaagctacagcctgaattgagcactatatcagaggatgggaaagaatactacctgaggatagaaagcacagttcctattatttgttctgaatttagtgagcttgatcaagaatgcaaaatctcattaaaactgaaaactattggtcaaggtagagagcacctaggcttaaatttggcactgtcttcctgtcatgtggaccttctccagacatcttcctgtgctaatggaacctgtagccacacttttgtgtactacactgctgtcacagatttttctcgagatggagatagagtctcaaacattgtagtgcaaccaatagttaatgaggatttcctgtggaacaactacattccagacagcatccagatcaaagtaaaggatgtcccaactgcttactgctatacatttactgacccacatataattacatttgatggcagggtatatgataatttcaagactggaacatttgtgctttataagagtatgtcacgtgattttgaagtccatgtacgtcagtgggactgcagaagccttcactatccagtgtcatgtaattgtgggtttgttgcccaggaaggaggtgatatagttacttttgatatgtgcaatggtcagctacgtgaatcacaaccatatttgttcataaaaagccaagatgtaaccaggaatatcaagataagtgaatcttacttaggaagaaaagtcacaatctggttttcttctggggcatttatccgtgctgatcttggtgaatggggcatgagtctaacgatcagagcccctagtgtagattacagaaacactctgggactttgtggaacctttgatgaaaatccggaaaatgatttccatgacaaaaatgggatgcaaattgatcaaaattttaacaattatgttgcttttattaatgaatggaggattttaccaggaaaaagcatgtctgacacactgccagtttctatgacatcacctggaaagccatcctattgtagctgttcattggacactgcagcgtatccgtcttccgaagatctggacagtgtttctcgatcagaaattgccttgggttgcaaagacctcaatcatgtcagcttatcttctttgataccagaactagatgtcacctccgaatatattaattcagacactcttgtcagagagataaacaagcatacatctccagaagaatataatctaaatttatttctgcaagaaaaaaaacacataaacctgactaaactcggcttaaatgtacaaaaacatcctggaaatgagaaagaagattcactacaatatttggccaataagaaatatacacaaggccggggaagccacagccaagaaatgaggtacaatcgacaaaacagatggaaacggcagaactttcatgagtttcctcctttgtttgctttcccgagtctcagccaaacggatctggaagaacttacttattttttcccagaggaccatgctgaggatgtacagcaagagtttttcccctcttggcccactccctctggcctcaccgagtatagcaccttgaccctctgtcaggagactctagccaactccagcataggaaggctgtgtcttgcttttcttggcaagagattagacagtgttatagagatgtgtgtgaaggatgttctgttaaaagatgatcttagttgggcagaagcaggtgtggcccttttagaaaatgaatgtgaaaagaggattgtggaggaggggaaatataacacagaagagtatggcacatcaattgaagacattctctcagtattaaaatgccccaatttatgcagcggcaatgggcagtgcatggaatgggggtgtgcgtgttccccaagctttagttcctatgactgcagtgattcctatgacaaagctcctgaaattacagagcttgggaatgctggattctgtgatgttcaaaaatataattgtatgatggtgagagtttttggcaaaggcttcaaagaattaccttcaattaaatgtgaagttactaagctacagtataatagcagtgaatggatgcctggagaacccatctatacacagactgttttccacaatagcagagctgttgattgtcagctgcccactgatgttcagcagtttgataccatggatctggtgggtgggaaaccaactgggaagtggcagttgaaggtatctaatgatggttataaattcagtaatcccaaaataacggtcatatatgatggtgcttgccaagtttgtggtctctataaaaatgactcatgtactataaaggaaaatgtttgcattattgatggactctgctatgttgaaggagacaaaaatccaaccagcccttgtttgatttgtagacccaaaatttcaagatttacttggtcatttttagaaaacaaccagcccccagtgattcaagcattgcaagacaaattacagacattttatggtgaaaactttgagtatcagttcgtggccttcgatccagaaggttctgacatccattttacgttggactctggtcctgaaggggcaagtgtttcctctgcagggctttttatgtggaaaacagatttactaactacccaacaaattactgtacgccttaatgatgactgcgatgctgaaactagagtcacgattgaggtgactgtgaagtcttgtgattgcttgaatggtggatcatgtgtatctgataggaacttttctccagggagtggagtgtacctgtgtgtctgcttgcctggcttccatggcagcctttgtgaagtggacattagtgggtgccaatccaacccttgtggtcttggcagctatattagtggttttcacagttattcctgtgattgtccacctgagctcaaagttgaaacacagtttgtaaatcaatttactacacaaactgtggttctcacaagatctgataaaagtgtaaataaagaagaggatgataaaaatgcccaagggagaaagaggcatgttaagccaacaagtggaaatgccttcaccatttgtaaatatccatgtggaaaaagtagggagtgtgttgccccaaacatctgcaaatgtaaacctggttacattggttctaactgccaaactgctctttgtgaccctgattgcaaaaaccatggaaaatgtattaagcctaacatttgtcagtgtcttccaggacatggtggagcaacctgtgatgaagaacattgtaacccaccttgtcaacatggtggcacatgcttggctgggaatctctgcacttgtccttatggttttgtaggaccaaggtgtgaaacaatggtttgtaacaggcactgtgaaaatggaggccagtgtcttacaccagatatttgccagtgcaaacctggctggtatggacccacctgtagtacagctttgtgcgaccctgtctgcctcaatggtggttcgtgtaataagccaaatacttgcctctgtccaaatggattctttggggaacactgtcagaatgctttctgtcaccctccctgtaagaatggtggccactgcatgagaaataatgtgtgcgtctgtcgtgaaggatacactggtaggagattccaaaaaagcatctgtgatcctacgtgcatgaatggaggaaaatgtgtgggaccaagcacttgctcttgtccttctggttggagtgggaaacgatgcaacacacctatctgcttgcagaaatgtaaaaacggtggtgaatgcattgcgcccagcatatgccattgtccttcctcctgggaaggagtgcggtgtcaaataccaatttgcaacccaaaatgtctttatggaggcagatgcatatttcccaatgtgtgttcctgccgcactgaatactctggagtcaaatgtgagaagaaaatacagataagacgccattgagtagcatcaagtatatgaattacaagcctgtatcttaagaatggaaatattttgttcagaaaaagttggagataacttggagtttatttgaacatcattcaaaaaatatcttaaagactgaagaaactaataaaatacataatgatctctgttgtaatcatagagaaaagcaaagaagaaatccaggtaatctaaatttgatgttgagatgggataggatatttacatattgagatgatgtatctgatattccacccattcacaatatttaataaactgaatattttctcagccctaa

SEQ ID NO: 199383 - DNA, 1394 bp, Homo sapiens
  Payload ID: 19337
  Gene Name: von Willebrand factor D and EGF domains
  ENST ID: ENST00000326715
  CDS Start-End: 9-521
aagcagcgatgcctggcggagcctgcgtgctggtgatcgcgctgatgttcctggcctggggggaagctcaggagtgctctcctgggggacaccagtttcttcggagtccttatagaagtgtccgttttgactcatggcacctccagcagtcagctgttcaagacctaatatgtgaccattccctctcccctggatggtatagatttctcatccttgacagacctgccgagatgccaaccaaatgtgttgagatgaaccattgtggaactcaggcccccatctggctgtctctgagagattcagaaacactgccatctcctggggagatcaagcaattgacagcttgtgcaacatggcagtttttgttcagcactacaaaagactgctgtctctttcaaatcccagtgtctgtaagaaactgtgggaacttttctgtatacttactacaaccaactcagggatgtatgggctactgtgcggaagggttctttgccaagattgtaaagtccccccacacgtgaaagcatcaaaacagacatctcacatttttccactggacataatgattgagtgtgttaaaaattctttggtttcctcaagtccattcctgttttaattaaaggatgaagaaggctatttctgatgcacgattacacccatgtggttctgatgaaactgaaacaggaggtgattgtgttcgtcagctggctgcctcattgccacctccacctgcaggaaggccagaggttctggtggagttgattgagtccaggcttttctgtaggtgttcttttgatgttcccgctacaaaaaactcagtgggatttcacatagcttggtctaggctttcttctcaagaagtcaaagaggagctgacacaagagaccacagttcaggcattctctcttttagaacttgatggcataaatctcagacttggagacaggatattctgcagcgcttctgtctttttcttggagaatcctcatgtacaaagtgtagccatcgaaagccaagaattttttgcaggctttaagctacagcctgaattgagcactatatcagaggatgggaaagaatactacctgaggatagaaagcacagttcctattatttgttctgaatttagtgagcttgatcaagaatgcaaaatctcattaaaactgaaaactattggtcaaggtaatatactaactttattttatcttattattagattgcaaacaataatgcttttttttcctgtaggaaaagtcactggagtgtactcatataataaatcatgttgcatgttgacatcaaattttagcccaatcatattactaatactcggccaaactgacgattgccaaagcaattcacatttcttcttcttggctgaaagcatacatttt

SEQ ID NO: 199384 - DNA, 5936 bp, Homo sapiens
  Payload ID: 19337
  Gene Name: von Willebrand factor D and EGF domains
  ENST ID: ENST00000452576
  CDS Start-End: 226-4134
cagccaaaatgggaagggaggagtcgcagacggattacgcgaaggctctatcccacgaaaggactgggtgcaccccagaacgaggacgcggagcttccctgttccaagcagcaacagactgagaaaatccaagaaaggaggcccgaggggctgctgtggccccatcctcctggcacccgcggcccgggctctgcgacgcctttcgccccacctgcggaagcagcgatgcctggcggagcctgcgtgctggtgatcgcgctgatgttcctggcctggggggaagctcaggagtgctctcctgggggacaccagtttcttcggagtccttatagaagtgtccgttttgactcatggcacctccagcagtcagctgttcaagacctaatatgtgaccattccctctcccctggatggtatagatttctcatccttgacagacctgccgagatgccaaccaaatgtgttgagatgaaccattgtggaactcaggcccccatctggctgtctctgagagattcagaaacactgccatctcctggggagatcaagcaattgacagcttgtgcaacatggcagtttttgttcagcactacaaaagactgctgtctctttcaaatcccagtgtctgtaagaaactgtgggaacttttctgtatacttactacaaccaactcagggatgtatgggctactgtgcggaagctatttctgatgcacgattacacccatgtggttctgatgaaactgaaacaggaggtgattgtgttcgtcagctggctgcctcattgccacctccacctgcaggaaggccagaggttctggtggagttgattgagtccaggcttttctgtaggtgttcttttgatgttcccgctacaaaaaactcagtgggatttcacatagcttggtctaggctttcttctcaagaagtcaaagaggagctgacacaagagaccacagttcaggcattctctcttttagaacttgatggcataaatctcagacttggagacaggatattctgcagcgcttctgtctttttcttggagaatcctcatgtacaaagtgtagccatcgaaagccaagaattttttgcaggctttaagctacagcctgaattgagcactatatcagaggatgggaaagaatactacctgaggatagaaagcacagttcctattatttgttctgaatttagtgagcttgatcaagaatgcaaaatctcattaaaactgaaaactattggtcaaggtagagagcacctaggcttaaatttggcactgtcttcctgtcatgtggaccttctccagacatcttcctgtgctaatggaacctgtagccacacttttgtgtactacactgctgtcacagatttttctcgagatggagatagagtctcaaacattgtagtgcaaccaatagttaatgaggatttcctgtggaacaactacattccagacagcatccagatcaaagtaaaggatgtcccaactgcttactgctatacatttactgacccacatataattacatttgatggcagggtatatgataatttcaagactggaacatttgtgctttataagagtatgtcacgtgattttgaagtccatgtacgtcagtgggactgcagaagccttcactatccagtgtcatgtaattgtgggtttgttgcccaggaaggaggtgatatagttacttttgatatgtgcaatggtcagctacgtgaatcacaaccatatttgttcataaaaagccaagatgtaaccaggaatatcaagataagtgaatcttacttaggaagaaaagtcacaatctggttttcttctggggcatttatccgtgctgatcttggtgaatggggcatgagtctaacgatcagagcccctagtgtagattacagaaacactctgggactttgtggaacctttgatgaaaatccggaaaatgatttccatgacaaaaatgggatgcaaattgatcaaaattttaacaattatgttgcttttattaatgaatggaggattttaccaggaaaaagcatgtctgacacactgccagtttctatgacatcacctggaaagccatcctattgtagctgttcattggacactgcagcgtatccgtcttccgaagatctggacagtgtttctcgatcagaaattgccttgggttgcaaagacctcaatcatgtcagcttatcttctttgataccagaactagatgtcacctccgaatatattaattcagacactcttgtcagagagataaacaagcatacatctccagaagaatataatctaaatttatttctgcaagaaaaaaaacacataaacctgactaaactcggcttaaatgtacaaaaacatcctggaaatgagaaagaagattcactacaatatttggccaataagaaatatacacaaggccggggaagccacagccaagaaatgaggtacaatcgacaaaacagatggaaacggcagaactttcatgagtttcctcctttgtttgctttcccgagtctcagccaaacggatctggaagaacttacttattttttcccagaggaccatgctgaggatgtacagcaagagtttttcccctcttggcccactccctctggcctcaccgagtatagcaccttgaccctctgtcaggagactctagccaactccagcataggaaggctgtgtcttgcttttcttggcaagagattagacagtgttatagagatgtgtgtgaaggatgttctgttaaaagatgatcttagttgggcagaagcaggtgtggcccttttagaaaatgaatgtgaaaagaggattgtggaggaggggaaatataacacagaagagtatggcacatcaattgaagacattctctcagtattaaaatgccccaatttatgcagcggcaatgggcagtgcatggaatgggggtgtgcgtgttccccaagctttagttcctatgactgcagtgattcctatgacaaagctcctgaaattacagagcttgggaatgctggattctgtgatgttcaaaaatataattgtatgatggtgagagtttttggcaaaggcttcaaagaattaccttcaattaaatgtgaagttactaagctacagtataatagcagtgaatggatgcctggagaacccatctatacacagactgttttccacaatagcagagctgttgattgtcagctgcccactgatgttcagcagtttgataccatggatctggtgggtgggaaaccaactgggaagtggcagttgaaggtatctaatgatggttataaattcagtaatcccaaaataacggtcatatatgatggtgcttgccaagtttgtggtctctataaaaatgactcatgtactataaaggaaaatgtttgcattattgatggactctgctatgttgaaggagacaaaaatccaaccagcccttgtttgatttgtagacccaaaatttcaagatttacttggtcatttttagaaaacaaccagcccccagtgattcaagcattgcaagacaaattacagacattttatggtgaaaactttgagtatcagttcgtggccttcgatccagaaggttctgacatccattttacgttggactctggtcctgaaggggcaagtgtttcctctgcagggctttttatgtggaaaacagatttactaactacccaacaaattactgtacgccttaatgatgactgcgatgctgaaactagagtcacgattgaggtgactgtgaagtcttgtgattgcttgaatggtggatcatgtgtatctgataggaacttttctccagggagtggagtgtacctgtgtgtctgcttgcctggcttccatggcagcctttgtgaagtggacattagtgggtgccaatccaacccttgtggtcttggcagctatattagtggttttcacagttattcctgtgattgtccacctgagctcaaaggcaaaaattgccaggaagatgttgatgagtgtgactccaagccttgctttgagggagtagcatgcctgaatacctttggttcctatcattgtggttcatgtccagaaggattttatggggatggaaaaatatgccatggtaaaagtttctattttctgctatgagattttttttgctgcagttaattattttttaatagcatagtttctgtttttgactcatgtatttatttagtgtaaatgcattaagtgtcatgcattgaactagatacaaaggatgcaaaaatatataagacatgttttctgacttaataggtagagtgtaacagcagggaatatgactagtaattacagagtataataaagtgttctgtgtcttttgatagaaatcacaaaagggctagtaggaatactacacagggaatcttatctacctggagaaataatgaaaaagttttaaaaaaggaagcgactagactatactagacacatgagaactgaatctgatagatcaagagagagaaaggcattccaggcaaaaccaacagcaggagcaaagggacagaagcaggcaacatcacagcactccttgggcagccagccactgtgaatagttcagtgtgcctggaatataggaagaaaggggagctgctacaagagttggagctagagagttgaaacacagtttgtaaatcaatttactacacaaactgtggttctcacaagatctgataaaagtgtaaataaagaagaggatgataaaaatgcccaagggagaaagaggcatgttaagccaacaagtggaaatgccttcaccatttgtaaatatccatgtggaaaaagtagggagtgtgttgccccaaacatctgcaaatgtaaacctggttacattggttctaactgccaaactgctctttgtgaccctgattgcaaaaaccatggaaaatgtattaagcctaacatttgtcagtgtcttccaggacatggtggagcaacctgtgatgaagaacattgtaacccaccttgtcaacatggtggcacatgcttggctgggaatctctgcacttgtccttatggttttgtaggaccaaggtgtgaaacaatggtttgtaacaggcactgtgaaaatggaggccagtgtcttacaccagatatttgccagtgcaaacctggctggtatggacccacctgtagtacagctttgtgcgaccctgtctgcctcaatggtggttcgtgtaataagccaaatacttgcctctgtccaaatggattctttggggaacactgtcagaatgctttctgtcaccctccctgtaagaatggtggccactgcatgagaaataatgtgtgcgtctgtcgtgaaggatacactggtaggagattccaaaaaagcatctgtgatcctacgtgcatgaatggaggaaaatgtgtgggaccaagcacttgctcttgtccttctggttggagtgggaaacgatgcaacacacctatctgcttgcagaaatgtaaaaacggtggtgaatgcattgcgcccagcatatgccattgtccttcctcctgggaaggagtgcggtgtcaaataccaatttgcaacccaaaatgtctttatggaggcagatgcatatttcccaatgtgtgttcctgccgcactgaatactctggagtcaaatgtgagaagaaaatacagataagacgccattgagtagcatcaagtatatgaattacaagcctgtatcttaagaatggaaatattttgttcagaaaaagttggagataacttggagtttatttgaacatcattcaaaaaatatcttaaagactgaagaaactaataaaatacataatgatctctgttgtaatcatagagaaaagcaaagaagaaatccaggtaatctaaatttgatgttgagatgggataggatatttacatattgagatgatgtatctgatattccacccattcacaa

SEQ ID NO: 199385 - DNA, 4700 bp, Homo sapiens
  Payload ID: 19337
  Gene Name: von Willebrand factor D and EGF domains
  ENST ID: ENST00000521169
  CDS Start-End: 226-1284
cagccaaaatgggaagggaggagtcgcagacggattacgcgaaggctctatcccacgaaaggactgggtgcaccccagaacgaggacgcggagcttccctgttccaagcagcaacagactgagaaaatccaagaaaggaggcccgaggggctgctgtggccccatcctcctggcacccgcggcccgggctctgcgacgcctttcgccccacctgcggaagcagcgatgcctggcggagcctgcgtgctggtgatcgcgctgatgttcctggcctggggggaagctcaggagtgctctcctgggggacaccagtttcttcggagtccttatagaagtgtccgttttgactcatggcacctccagcagtcagctgttcaagacctaatatgtgaccattccctctcccctggatggtatagatttctcatccttgacagacctgccgagatgccaaccaaatgtgttgagatgaaccattgtggaactcaggcccccatctggctgtctctgagagattcagaaacactgccatctcctggggagatcaagcaattgacagcttgtgcaacatggcagtttttgttcagcactacaaaagactgctgtctctttcaaatcccagtgtctgtaagaaactgtgggaacttttctgtatacttactacaaccaactcagggatgtatgggctactgtgcggaagctatttctgatgcacgattacacccatgtggttctgatgaaactgaaacaggaggtgattgtgttcgtcagctggctgcctcattgccacctccacctgcaggaaggccagaggttctggtggagttgattgagtccaggcttttctgtaggtgttcttttgatgttcccgctacaaaaaactcagtgggatttcacatagcttggtctaggctttcttctcaagaagtcaaagaggagctgacacaagagaccacagttcaggcattctctcttttagaacttgatggcataaatctcagacttggagacaggatattctgcagcgcttctgtctttttcttggagaatcctcatgtacaaagtgtagccatcgaaagccaagaattttttgcaggctttaagctacagcctgaattgagcactatatcagaggatgggaaagaatactacctgaggatagaaagcacagttcctattatttgttctgaatttagtgagcttgatcaagaatgcaaaatctcattaaaactgaaaactattggtcaagatctggttttcttctggggcatttatccgtgctgatcttggtgaatggggcatgagtctaacgatcagagcccctagtgtagattacagaaacactctgggactttgtggaacctttgatgaaaatccggaaaatgatttccatgacaaaaatgggatgcaaattgatcaaaattttaacaattatgttgcttttattaatgaatggaggattttaccaggaaaaagcatgtctgacacactgccagtttctatgacatcacctggaaagccatcctattgtagctgttcattggacactgcagcgtatccgtcttccgaagatctggacagtgtttctcgatcagaaattgccttgggttgcaaagacctcaatcatgtcagcttatcttctttgataccagaactagatgtcacctccgaatatattaattcagacactcttgtcagagagataaacaagcatacatctccagaagaatataatctaaatttatttctgcaagaaaaaaaacacataaacctgactaaactcggcttaaatgtacaaaaacatcctggaaatgagaaagaagattcactacaatatttggccaataagaaatatacacaaggccggggaagccacagccaagaaatgaggtacaatcgacaaaacagatggaaacggcagaactttcatgagtttcctcctttgtttgctttcccgagtctcagccaaacggatctggaagaacttacttattttttcccagaggaccatgctgaggatgtacagcaagagtttttcccctcttggcccactccctctggcctcaccgagtatagcaccttgaccctctgtcaggagactctagccaactccagcataggaaggctgtgtcttgcttttcttggcaagagattagacagtgttatagagatgtgtgtgaaggatgttctgttaaaagatgatcttagttgggcagaagcaggtgtggcccttttagaaaatgaatgtgaaaagaggattgtggaggaggggaaatataacacagaagagtatggcacatcaattgaagacattctctcagtattaaaatgccccaatttatgcagcggcaatgggcagtgcatggaatgggggtgtgcgtgttccccaagctttagttcctatgactgcagtgattcctatgacaaagctcctgaaattacagagcttgggaatgctggattctgtgatgttcaaaaatataattgtatgatggtgagagtttttggcaaaggcttcaaagaattaccttcaattaaatgtgaagttactaagctacagtataatagcagtgaatggatgcctggagaacccatctatacacagactgttttccacaatagcagagctgttgattgtcagctgcccactgatgttcagcagtttgataccatggatctggtgggtgggaaaccaactgggaagtggcagttgaaggtatctaatgatggttataaattcagtaatcccaaaataacggtcatatatgatggtgcttgccaagtttgtggtctctataaaaatgactcatgtactataaaggaaaatgtttgcattattgatggactctgctatgttgaaggagacaaaaatccaaccagcccttgtttgatttgtagacccaaaatttcaagatttacttggtcatttttagaaaacaaccagcccccagtgattcaagcattgcaagacaaattacagacattttatggtgaaaactttgagtatcagttcgtggccttcgatccagaaggttctgacatccattttacgttggactctggtcctgaaggggcaagtgtttcctctgcagggctttttatgtggaaaacagatttactaactacccaacaaattactgtacgccttaatgatgactgcgatgctgaaactagagtcacgattgaggtgactgtgaagtcttgtgattgcttgaatggtggatcatgtgtatctgataggaacttttctccagggagtggagtgtacctgtgtgtctgcttgcctggcttccatggcagcctttgtgaagtggacattagtgggtgccaatccaacccttgtggtcttggcagctatattagtggttttcacagttattcctgtgattgtccacctgagctcaaagttgaaacacagtttgtaaatcaatttactacacaaactgtggttctcacaagatctgataaaagtgtaaataaagaagaggatgataaaaatgcccaagggagaaagaggcatgttaagccaacaagtggaaatgccttcaccatttgtaaatatccatgtggaaaaagtagggagtgtgttgccccaaacatctgcaaatgtaaacctggttacattggttctaactgccaaactgctctttgtgaccctgattgcaaaaaccatggaaaatgtattaagcctaacatttgtcagtgtcttccaggacatggtggagcaacctgtgatgaagaacattgtaacccaccttgtcaacatggtggcacatgcttggctgggaatctctgcacttgtccttatggttttgtaggaccaaggtgtgaaacaatggtttgtaacaggcactgtgaaaatggaggccagtgtcttacaccagatatttgccagtgcaaacctggctggtatggacccacctgtagtacagctttgtgcgaccctgtctgcctcaatggtggttcgtgtaataagccaaatacttgcctctgtccaaatggattctttggggaacactgtcagaatgctttctgtcaccctccctgtaagaatggtggccactgcatgagaaataatgtgtgcgtctgtcgtgaaggatacactggtaggagattccaaaaaagcatctgtgatcctacgtgcatgaatggaggaaaatgtgtgggaccaagcacttgctcttgtccttctggttggagtgggaaacgatgcaacacacctatctgcttgcagaaatgtaaaaacggtggtgaatgcattgcgcccagcatatgccattgtccttcctcctgggaaggagtgcggtgtcaaataccaatttgcaacccaaaatgtctttatggaggcagatgcatatttcccaatgtgtgttcctgccgcactgaatactctggagtcaaatgtgagaagaaaatacagataagacgccattgagtagcatcaagtatatgaattacaagcctgtatcttaagaatggaaatattttgttcagaaaaagttggagataacttggagtttatttgaacatcattcaaaaaatatcttaaagactgaagaaactaataaaatacataatgatctctgttgtaatcatagagaaaagcaaagaagaaatccaggtaatctaaatttgatgttgagatgggataggatatttacatattgagatgatgtatctgatattccacccattcacaa

SEQ ID NO: 199386 - DNA, 4701 bp, Homo sapiens
  Payload ID: 19337
  Gene Name: von Willebrand factor D and EGF domains
  ENST ID: ENST00000614403
  CDS Start-End: 1301-4135
cagccaaaatgggaagggaggagtcgcagacggattacgcgaaggctctatcccacgaaaggactgggtgcaccccagaacgaggacgcggagcttccctgttccaagcagcaacagactgagaaaatccaagaaaggaggcccgaggggctgctgtggccccatcctcctggcacccgcggcccgggctctgcgacgcctttcgccccacctgcggaagcagcgatgcctggcggagcctgcgtgctggtgatcgcgctgatgttcctggcctggggggaagctcaggagtgctctcctgggggacaccagtttcttcggagtccttatagaagtgtccgttttgactcatggcacctccagcagtcagctgttcaagacctaatatgtgaccattccctctcccctggatggtatagatttctcatccttgacagacctgccgagatgccaaccaaatgtgttgagatgaaccattgtggaactcaggcccccatctggctgtctctgagagattcagaaacactgccatctcctggggagatcaagcaattgacagcttgtgcaacatggcagtttttgttcagcactacaaaagactgctgtctctttcaaatcccagtgtctgtaagaaactgtgggaacttttctgtatacttactacaaccaactcagggatgtatgggctactgtgcggaagctatttctgatgcacgattacacccatgtggttctgatgaaactgaaacaggaggtgattgtgttcgtcagctggctgcctcattgccacctccacctgcaggaaggccagaggttctggtggagttgattgagtccaggcttttctgtaggtgttcttttgatgttcccgctacaaaaaactcagtgggatttcacatagcttggtctaggctttcttctcaagaagtcaaagaggagctgacacaagagaccacagttcaggcattctctcttttagaacttgatggcataaatctcagacttggagacaggatattctgcagcgcttctgtctttttcttggagaatcctcatgtacaaagtgtagccatcgaaagccaagaattttttgcaggctttaagctacagcctgaattgagcactatatcagaggatgggaaagaatactacctgaggatagaaagcacagttcctattatttgttctgaatttagtgagcttgatcaagaatgcaaaatctcattaaaactgaaaactattggtcaagatctggttttcttctggggcatttatccgtgctgatcttggtgaatggggcatgagtctaacgatcagagcccctagtgtagattacagaaacactctgggactttgtggaacctttgatgaaaatccggaaaatgatttccatgacaaaaatgggatgcaaattgatcaaaattttaacaattatgttgcttttattaatgaatggaggattttaccaggaaaaagcatgtctgacacactgccagtttctatgacatcacctggaaagccatcctattgtagctgttcattggacactgcagcgtatccgtcttccgaagatctggacagtgtttctcgatcagaaattgccttgggttgcaaagacctcaatcatgtcagcttatcttctttgataccagaactagatgtcacctccgaatatattaattcagacactcttgtcagagagataaacaagcatacatctccagaagaatataatctaaatttatttctgcaagaaaaaaaacacataaacctgactaaactcggcttaaatgtacaaaaacatcctggaaatgagaaagaagattcactacaatatttggccaataagaaatatacacaaggccggggaagccacagccaagaaatgaggtacaatcgacaaaacagatggaaacggcagaactttcatgagtttcctcctttgtttgctttcccgagtctcagccaaacggatctggaagaacttacttattttttcccagaggaccatgctgaggatgtacagcaagagtttttcccctcttggcccactccctctggcctcaccgagtatagcaccttgaccctctgtcaggagactctagccaactccagcataggaaggctgtgtcttgcttttcttggcaagagattagacagtgttatagagatgtgtgtgaaggatgttctgttaaaagatgatcttagttgggcagaagcaggtgtggcccttttagaaaatgaatgtgaaaagaggattgtggaggaggggaaatataacacagaagagtatggcacatcaattgaagacattctctcagtattaaaatgccccaatttatgcagcggcaatgggcagtgcatggaatgggggtgtgcgtgttccccaagctttagttcctatgactgcagtgattcctatgacaaagctcctgaaattacagagcttgggaatgctggattctgtgatgttcaaaaatataattgtatgatggtgagagtttttggcaaaggcttcaaagaattaccttcaattaaatgtgaagttactaagctacagtataatagcagtgaatggatgcctggagaacccatctatacacagactgttttccacaatagcagagctgttgattgtcagctgcccactgatgttcagcagtttgataccatggatctggtgggtgggaaaccaactgggaagtggcagttgaaggtatctaatgatggttataaattcagtaatcccaaaataacggtcatatatgatggtgcttgccaagtttgtggtctctataaaaatgactcatgtactataaaggaaaatgtttgcattattgatggactctgctatgttgaaggagacaaaaatccaaccagcccttgtttgatttgtagacccaaaatttcaagatttacttggtcatttttagaaaacaaccagcccccagtgattcaagcattgcaagacaaattacagacattttatggtgaaaactttgagtatcagttcgtggccttcgatccagaaggttctgacatccattttacgttggactctggtcctgaaggggcaagtgtttcctctgcagggctttttatgtggaaaacagatttactaactacccaacaaattactgtacgccttaatgatgactgcgatgctgaaactagagtcacgattgaggtgactgtgaagtcttgtgattgcttgaatggtggatcatgtgtatctgataggaacttttctccagggagtggagtgtacctgtgtgtctgcttgcctggcttccatggcagcctttgtgaagtggacattagtgggtgccaatccaacccttgtggtcttggcagctatattagtggttttcacagttattcctgtgattgtccacctgagctcaaagttgaaacacagtttgtaaatcaatttactacacaaactgtggttctcacaagatctgataaaagtgtaaataaagaagaggatgataaaaatgcccaagggagaaagaggcatgttaagccaacaagtggaaatgccttcaccatttgtaaatatccatgtggaaaaagtagggagtgtgttgccccaaacatctgcaaatgtaaacctggttacattggttctaactgccaaactgctctttgtgaccctgattgcaaaaaccatggaaaatgtattaagcctaacatttgtcagtgtcttccaggacatggtggagcaacctgtgatgaagaacattgtaacccaccttgtcaacatggtggcacatgcttggctgggaatctctgcacttgtccttatggttttgtaggaccaaggtgtgaaacaatggtttgtaacaggcactgtgaaaatggaggccagtgtcttacaccagatatttgccagtgcaaacctggctggtatggacccacctgtagtacagctttgtgcgaccctgtctgcctcaatggtggttcgtgtaataagccaaatacttgcctctgtccaaatggattctttggggaacactgtcagaatgctttctgtcaccctccctgtaagaatggtggccactgcatgagaaataatgtgtgcgtctgtcgtgaaggatacactggtaggagattccaaaaaaggcatctgtgatcctacgtgcatgaatggaggaaaatgtgtgggaccaagcacttgctcttgtccttctggttggagtgggaaacgatgcaacacacctatctgcttgcagaaatgtaaaaacggtggtgaatgcattgcgcccagcatatgccattgtccttcctcctgggaaggagtgcggtgtcaaataccaatttgcaacccaaaatgtctttatggaggcagatgcatatttcccaatgtgtgttcctgccgcactgaatactctggagtcaaatgtgagaagaaaatacagataagacgccattgagtagcatcaagtatatgaattacaagcctgtatcttaagaatggaaatattttgttcagaaaaagttggagataacttggagtttatttgaacatcattcaaaaaatatcttaaagactgaagaaactaataaaatacataatgatctctgttgtaatcatagagaaaagcaaagaagaaatccaggtaatctaaatttgatgttgagatgggataggatatttacatattgagatgatgtatctgatattccacccattcacaa

SEQ ID NO: 199387 - DNA, 4114 bp, Homo sapiens
  Payload ID: 19338
  Gene Name: Vpr (HIV-1) binding protein
  Uniprot ID: Q9Y4B6
  ENST ID: ENST00000335891
  CDS Start-End: 11-3187
aggcaaagccatgactacagtagtggtacatgtggactccaaagctgagctcactaccctgctggagcagtgggaaaaggaacatggcagtgggcaggacatggtacctatccttaccaggatgtctcaattgattgaaaaagaaactgaagagtatcgtaaaggggatccagacccatttgatgatcgacatcctggtcgagctgatccagagtgtatgctgggccacttgctgagaatactcttcaagaatgatgatttcatgaatgcactggtgaatgcatatgtgatgacaagccgagagccccctttaaacactgcagcttgcagactcctattagacatcatgccagggctggaaactgctgtcgtctttcaagaaaaggagggaattgtcgagaatcttttcaaatgggcccgagaggccgatcaaccattgaggacatattctactggactgttaggaggtgctatggaaaatcaagacattgctgccaactatagagatgaaaattcacagctggtggcaatagtgcttcgaagactgagggagctacagctacaggaagtggctttgcggcaggaaaacaagcgtcccagtccacggaagctctcttctgaaccccttttgcctctggatgaggaggctgtggatatggactatggtgacatggctgtagatgatgctgaaattcagaagtcagcacttcagattatcatcaattgtgtgtgtggcccagataaccgaatatccagtattggtaaatttatctctggtactcctcggagaaagctgcctcagaaccctaaaagcagtgagcacaccctggccaagatgtggaatgtggttcagtccaacaacggcatcaaggtgctcctgtccttactgtccattaagatgcccatcacagatgcagaccaaatccgggccctggcctgcaaagccctagtgggcctgtctcgcagtagcactgtccggcagatcatcagtaaactgccccttttcagcagctgccagatccagcagctgatgaaggagcctgtgctgcaggacaagcgcagtgaccatgtcaagttctgcaagtatgctgctgaactcattgaacgggtgtcaggaaaaccacttctcattggcactgatgtttccctagcacgactgcagaaagcagatgttgttgcccagtcaaggatctccttccctgagaaagagctgcttttgttgatacgaaaccatcttatttctaaagggcttggagaaacagcaaccgtgctgacaaaagaggctgacctgcccatgactgctgcctcccattcttctgcctttaccccagtcactgctgctgcttctcctgtctctctaccccgaacccctcgtatcgctaatggcattgcaactcgtctgggcagccatgctgctgtgggtgcctctgcgccttctgcccctactgctcatcctcagccacggcccccccagggtccgctagctctgcccggcccatcttatgcaggcaactcccctttgattggtagaatcagttttatcagagagaggccatcaccctgcaatggcaggaaaatcagagtgttgcggcagaagtcggaccatggtgcctacagccaaagcccagccataaaaaaacagctggacagacatcttccttccccacctacgctggacagtataatcacagagtatcttagagaacaacatgctcgctgcaagaatccagttgccacctgcccacctttctccctctttactcctcaccaatgtcctgagccaaaacagaggcggcaagcgccaataaactttacgtcaaggctaaaccgcagggcatcatttccaaagtatggaggggtggatggcggatgctttgataggcaccttatctttagcagattccgtcctatttcagtgttccgggaagccaatgaagatgagagtggcttcacctgctgtgcattctcagcacgggagcggttcctgatgcttggcacctgcacagggcagctgaagctctataatgtgtttagtggacaggaggaggccagctataactgtcacaactcagccatcacacatcttgaaccttccagggatgggtccttgctgctgacatctgctacttggagccagcctttgtctgcactttggggaatgaagtcagtatttgatatgaagcattccttcacagaagatcactatgttgagttcagtaagcactcccaggatcgggtcatcggcacaaaaggagacattgcccacatttatgatattcagactggcaacaagctgttgactctgtttaacccagatcttgccaacaactacaagaggaactgtgccacctttaatcctacagatgatcttgtcttaaatgatggcgtcctctgggatgtccgctctgcacaggccatccacaagtttgacaagttcaatatgaacatcagtggtgttttccatccaaatggactggaggtgatcattaatactgagatttgggaccttcgaacttttcatcttttgcatactgttcccgctctggatcagtgtcgcgtggtgttcaatcacacgggaacagtgatgtatggagctatgttgcaggcagatgatgaagatgacttaatggaagagaggatgaaaagcccctttgggtcatccttccgaacatttaatgcaactgactacaaacctatagcaaccattgatgtgaaacggaacatctttgacctgtgtacagacaccaaagactgctatcttgctgtcattgagaatcaaggcagcatggatgccctgaacatggacacagtatgcaggctgtatgaagtgggcaggcagcgtctggcagaggatgaggatgaagaggaggaccaggaagaggaagaacaggaggaagaagatgatgatgaagatgatgatgacaccgatgatttagatgagcttgacactgaccagttgctggaggcggagttggaggaggacgacaataatgagaacgcaggggaagatggggacaatgacttctctccctctgatgaggagctagcaaaccttctagaggagggagaggacggggaggatgaagactctgatgcagatgaggaggtggaactgatcctgggggacactgacagctctgacaactctgatttggaagatgacatcatcttatctctgaatgagtgaggagccatcactgcttggaagagattcttggcaggcgagaaactgagtcaaatgaattcagaacatattcccttctctttctcccagggctgtctgtcttttaaggagctgcatgccctgcattcagaagattatggcttagagagcctcattggcacccgagggtccttccagaatcaataaccaccacaaaaatgacaacagggactaggccctactctgcaccccccacatccaccccccaccatttcctaggatggacatatctttcaaggggaaaaaaaaaccatgtctctggggtatttcacaatatattttctttgtatagtgttctttacttaaagaacaagaaatagttttttataaaactttaaaaaggaaaaaaaaacaggcatttataactgagggtatgaacttatatccaccaggtctcttgtccctgcacttcattttctttggaagaaaatgatgtctaaagaacaatatagaggcatttttacatacgtatttaaatgaaaaggaaaatcgtggtttcttaaattgataaggattaagaatattttattataaatataatatatgattttttaacctgttttgttgcctcatatgctgtcaggttaatttgttttccttcgtgccagaggtggggaggaaggcactctgtctgctgggtaaatgcctaaattcactcaccttcatggtttgggggcagcatggtcattgtggatattggttttgtggagttgagggaacttaggatataagttcactccctctatttttctttgtgattcagtttttcaaaaatctttttttcttccctttctccccattgtggaaattacaaatcaaaggcctttttctttaatgtaaagtgtatttatttaaaaaaaatacaaaataaactacaagtctgtctttgtt

SEQ ID NO: 199388 - DNA, 5946 bp, Homo sapiens
  Payload ID: 19338
  Gene Name: Vpr (HIV-1) binding protein
  Uniprot ID: Q9Y4B6
  ENST ID: ENST00000423656
  CDS Start-End: 131-4654
agccgtggtcgcgctgtgtgtgtgtgtgagtggagagtgagtgcgggacctgaggctgtgtgtgtgtgaactgtggccactggcggggtcgggggggggcagcggcggagccgcctcggacggcaaagccatgactacagtagtggtacatgtggactccaaagctgagctcactaccctgctggagcagtgggaaaaggaacatggcagtgggcaggacatggtacctatccttaccaggatgtctcaattgattgaaaaagaaactgaagagtatcgtaaaggggatccagacccatttgatgatcgacatcctggtcgagctgatccagagtgtatgctgggccacttgctgagaatactcttcaagaatgatgatttcatgaatgcactggtgaatgcatatgtgatgacaagccgagagccccctttaaacactgcagcttgcagactcctattagacatcatgccagggctggaaactgctgtcgtctttcaagaaaaggagggaattgtcgagaatcttttcaaatgggcccgagaggccgatcaaccattgaggacatattctactggactgttaggaggtgctatggaaaatcaagacattgctgccaactatagagatgaaaattcacagctggtggcaatagtgcttcgaagactgagggagctacagctacaggaagtggctttgcggcaggaaaacaagcgtcccagtccacggaagctctcttctgaaccccttttgcctctggatgaggaggctgtggatatggactatggtgacatggctgtagatgtagtggatggagaccaagaggaagcttctggagacatggagatctcctttcatcttgattcaggccacaagactagtagcagagtgaactcaacaaccaaacctgaggatggaggattaaagaaaaacaagtcagcaaaacagggtgacagagagaactttaggaaagccaagcaaaagttgggtttctcatcttctgatccagatcgcatgtttgttgagctgtctaatagcagttggtcagaaatgtctccctgggtgattggcaccaattataccctttatcctatgactcctgctatcgagcagcgactcattctccaatatttgacccctctaggagaatatcaggagctacttcccatattcatgcaacttggatcacgggagctgatgatgttctatattgacctgaagcaaactaatgatgtcctgcttacatttgaggcactaaagcacctagcatctctcctgctccataacaaatttgccacagaatttgttgcgcatggtggagtacagaaattactggaaatacctcgtccttctatggctgcaaccggtgtgtctatgtgtttgtattacctatcctacaatcaggatgccatggaaagagtttgcatgcatccccacaatgttctgtctgatgtggtgaactataccctgtggttaatggagtgttctcatgcttcaggatgctgccatgctaccatgtttttttcaatttgcttctcatttcgggccgtcttggagctctttgaccgctatgatggtcttcgtcgtctggtgaacttgatcagtactttggagattctaaatttggaagatcagggtgcacttctgagtgatgatgaaatatttgctagccgccaaactgggaaacatacctgcatggccttgcgcaaatactttgaggctcacctggccattaaattggaacaagtgaagcagtcacttcagaggactgagggtggcattcttgtccacccacaacccccgtacaaggcatgctcatatactcatgaacagattgtggaaatgatggaatttttgatagaatatggcccagcgcagctatattgggaaccagctgaagttttcctcaaactttcttgtgtgcaactcttgttgcagcttatttctattgcctgcaattggaagacctattatgcaaggaatgacactgtgcgctttgctttggatgtcctggctattcttactgtggtgccaaaaatccagctccagttggcagaatcagtggacgtgttggatgaggctggatctacagtctctactgtaggtatcagcattattttgggagtggctgagggtgagttcttcatccatgatgctgaaattcagaagtcagcacttcagattatcatcaattgtgtgtgtggcccagataaccgaatatccagtattggtaaatttatctctggtactcctcggagaaagctgcctcagaaccctaaaagcagtgagcacaccctggccaagatgtggaatgtggttcagtccaacaacggcatcaaggtgctcctgtccttactgtccattaagatgcccatcacagatgcagaccaaatccgggccctggcctgcaaagccctagtgggcctgtctcgcagtagcactgtccggcagatcatcagtaaactgccccttttcagcagctgccagatccagcagctgatgaaggagcctgtgctgcaggacaagcgcagtgaccatgtcaagttctgcaagtatgctgctgaactcattgaacgggtgtcaggaaaaccacttctcattggcactgatgtttccctagcacgactgcagaaagcagatgttgttgcccagtcaaggatctccttccctgagaaagagctgcttttgttgatacgaaaccatcttatttctaaagggcttggagaaacagcaaccgtgctgacaaaagaggctgacctgcccatgactgctgcctcccattcttctgcctttaccccagtcactgctgctgcttctcctgtctctctaccccgaacccctcgtatcgctaatggcattgcaactcgtctgggcagccatgctgctgtgggtgcctctgcgccttctgcccctactgctcatcctcagccacggcccccccagggtccgctagctctgcccggcccatcttatgcaggcaactcccctttgattggtagaatcagttttatcagagagaggccatcaccctgcaatggcaggaaaatcagagtgttgcggcagaagtcggaccatggtgcctacagccaaagcccagccataaaaaaacagctggacagacatcttccttccccacctacgctggacagtataatcacagagtatcttagagaacaacatgctcgctgcaagaatccagttgccacctgcccacctttctccctctttactcctcaccaatgtcctgagccaaaacagaggcggcaagcgccaataaactttacgtcaaggctaaaccgcagggcatcatttccaaagtatggaggggtggatggcggatgctttgataggcaccttatctttagcagattccgtcctatttcagtgttccgggaagccaatgaagatgagagtggcttcacctgctgtgcattctcagcacgggagcggttcctgatgcttggcacctgcacagggcagctgaagctctataatgtgtttagtggacaggaggaggccagctataactgtcacaactcagccatcacacatcttgaaccttccagggatgggtccttgctgctgacatctgctacttggagccagcctttgtctgcactttggggaatgaagtcagtatttgatatgaagcattccttcacagaagatcactatgttgagttcagtaagcactcccaggatcgggtcatcggcacaaaaggagacattgcccacatttatgatattcagactggcaacaagctgttgactctgtttaacccagatcttgccaacaactacaagaggaactgtgccacctttaatcctacagatgatcttgtcttaaatgatggcgtcctctgggatgtccgctctgcacaggccatccacaagtttgacaagttcaatatgaacatcagtggtgttttccatccaaatggactggaggtgatcattaatactgagatttgggaccttcgaacttttcatcttttgcatactgttcccgctctggatcagtgtcgcgtggtgttcaatcacacgggaacagtgatgtatggagctatgttgcaggcagatgatgaagatgacttaatggaagagaggatgaaaagcccctttgggtcatccttccgaacatttaatgcaactgactacaaacctatagcaaccattgatgtgaaacggaacatctttgacctgtgtacagacaccaaagactgctatcttgctgtcattgagaatcaaggcagcatggatgccctgaacatggacacagtatgcaggctgtatgaagtgggcaggcagcgtctggcagaggatgaggatgaagaggaggaccaggaagaggaagaacaggaggaagaagatgatgatgaagatgatgatgacaccgatgatttagatgagcttgacactgaccagttgctggaggcggagttggaggaggacgacaataatgagaacgcaggggaagatggggacaatgacttctctccctctgatgaggagctagcaaaccttctagaggagggagaggacggggaggatgaagactctgatgcagatgaggaggtggaactgatcctgggggacactgacagctctgacaactctgatttggaagatgacatcatcttatctctgaatgagtgaggagccatcactgcttggaagagattcttggcagagagaagaggggacaaatttggttgtgaagtaaacaagaaacacaagacggctaaaactctccaggggcaggtaaagccctgctgggctcagaagcactatagaatttgctgtacacactgaagtgggtctgtgtcacacaggtatttcttggtcctctggagagcagaggactcactcagctctttgcttcatgcctcgctttaatggtagtaaacacttaaccagtggaatagtctgactgctggtactgatggcatcagaagaaaacaggttaacaatcaagtagtgaaagcactatattctagtcattaactcaacggagccagtctcaactctgctgggagcacccacaggtctctgtgggggagacagggactataacagggaggcagaattcaggttggcttgacaacacaccttaggaacatgtgctaaggggctaaggaggcatcagctgtcttccttattctaccagggctgaaaatcggagtcacttaggaggcagcatgagaacagtggcacaccaccagtgaggcacatgttgcctttttgtctttaagcaacaccttagacagggcctgaaccctgggtgggggcactggatgcctgaagtaagtaagttttctcagtggggcagtctcataaaatcaccaggacattgaccacctgacctcccctaactagtgctggccaaggcctgagagttcacagaacctgctaggtcttaagagccaaaggaaggaagtggttgagggccaggaaagagaaggaatgtcatgccagggtgttactcctcaccaaaacttggcagttctttttggggccatgggacacctttctctgaagaggggttggataaggcaaaggttgaagtgtcttctctaggcacgttttctagcatgtttccttttacttggttctgtctcacaaagctgggaggtagatgattcttccgggtcctgagcacctgcttcatgaaggaagataggtagcccagagaagaagttttggacttaacaacataccaaggcagctctggcctgtgactcaggcgtttgttggagagctgcaggaaaaccactgcagtgtgcctgcaacaggacaagacccactcctgtttctggcggtaccagctaccctggaatggtggcgtgtcctgctgtacccaactgacttgcttaggtacctggcagctgtgaccacagctcaagtaaaaaaacaaaaacaggcaaataaataaacatgcttaacatgtc

SEQ ID NO: 199389 - DNA, 5951 bp, Homo sapiens
  Payload ID: 19338
  Gene Name: Vpr (HIV-1) binding protein
  Uniprot ID: Q9Y4B6
  ENST ID: ENST00000504652
  CDS Start-End: 139-4659
cgctgtggagccgtggtcgcgctgtgtgtgtgtgtgagtggagagtgagtgcgggacctgaggctgtgtgtgtgtgaactgtggccactggcggggtcgggggggggcagcggcggagccgcctcggacggcaaagccatgactacagtagtggtacatgtggactccaaagctgagctcactaccctgctggagcagtgggaaaaggaacatggcagtgggcaggacatggtacctatccttaccaggatgtctcaattgattgaaaaagaaactgaagagtatcgtaaaggggatccagacccatttgatgatcgacatcctggtcgagctgatccagagtgtatgctgggccacttgctgagaatactcttcaagaatgatgatttcatgaatctggtgaatgcatatgtgatgacaagccgagagccccctttaaacactgcagcttgcagactcctattagacatcatgccagggctggaaactgctgtcgtctttcaagaaaaggagggaattgtcgagaatcttttcaaatgggcccgagaggccgatcaaccattgaggacatattctactggactgttaggaggtgctatggaaaatcaagacattgctgccaactatagagatgaaaattcacagctggtggcaatagtgcttcgaagactgagggagctacagctacaggaagtggctttgcggcaggaaaacaagcgtcccagtccacggaagctctcttctgaaccccttttgcctctggatgaggaggctgtggatatggactatggtgacatggctgtagatgtagtggatggagaccaagaggaagcttctggagacatggagatctcctttcatcttgattcaggccacaagactagtagcagagtgaactcaacaaccaaacctgaggatggaggattaaagaaaaacaagtcagcaaaacagggtgacagagagaactttaggaaagccaagcaaaagttgggtttctcatcttctgatccagatcgcatgtttgttgagctgtctaatagcagttggtcagaaatgtctccctgggtgattggcaccaattataccctttatcctatgactcctgctatcgagcagcgactcattctccaatatttgacccctctaggagaatatcaggagctacttcccatattcatgcaacttggatcacgggagctgatgatgttctatattgacctgaagcaaactaatgatgtcctgcttacatttgaggcactaaagcacctagcatctctcctgctccataacaaatttgccacagaatttgttgcgcatggtggagtacagaaattactggaaatacctcgtccttctatggctgcaaccggtgtgtctatgtgtttgtattacctatcctacaatcaggatgccatggaaagagtttgcatgcatccccacaatgttctgtctgatgtggtgaactataccctgtggttaatggagtgttctcatgcttcaggatgctgccatgctaccatgtttttttcaatttgcttctcatttcgggccgtcttggagctctttgaccgctatgatggtcttcgtcgtctggtgaacttgatcagtactttggagattctaaatttggaagatcagggtgcacttctgagtgatgatgaaatatttgctagccgccaaactgggaaacatacctgcatggccttgcgcaaatactttgaggctcacctggccattaaattggaacaagtgaagcagtcacttcagaggactgagggtggcattcttgtccacccacaacccccgtacaaggcatgctcatatactcatgaacagattgtggaaatgatggaatttttgatagaatatggcccagcgcagctatattgggaaccagctgaagttttcctcaaactttcttgtgtgcaactcttgttgcagcttatttctattgcctgcaattggaagacctattatgcaaggaatgacactgtgcgctttgctttggatgtcctggctattcttactgtggtgccaaaaatccagctccagttggcagaatcagtggacgtgttggatgaggctggatctacagtctctactgtaggtatcagcattattttgggagtggctgagggtgagttcttcatccatgatgctgaaattcagaagtcagcacttcagattatcatcaattgtgtgtgtggcccagataaccgaatatccagtattggtaaatttatctctggtactcctcggagaaagctgcctcagaaccctaaaagcagtgagcacaccctggccaagatgtggaatgtggttcagtccaacaacggcatcaaggtgctcctgtccttactgtccattaagatgcccatcacagatgcagaccaaatccgggccctggcctgcaaagccctagtgggcctgtctcgcagtagcactgtccggcagatcatcagtaaactgccccttttcagcagctgccagatccagcagctgatgaaggagcctgtgctgcaggacaagcgcagtgaccatgtcaagttctgcaagtatgctgctgaactcattgaacgggtgtcaggaaaaccacttctcattggcactgatgtttccctagcacgactgcagaaagcagatgttgttgcccagtcaaggatctccttccctgagaaagagctgcttttgttgatacgaaaccatcttatttctaaagggcttggagaaacagcaaccgtgctgacaaaagaggctgacctgcccatgactgctgcctcccattcttctgcctttaccccagtcactgctgctgcttctcctgtctctctaccccgaacccctcgtatcgctaatggcattgcaactcgtctgggcagccatgctgctgtgggtgcctctgcgccttctgcccctactgctcatcctcagccacggcccccccagggtccgctagctctgcccggcccatcttatgcaggcaactcccctttgattggtagaatcagttttatcagagagaggccatcaccctgcaatggcaggaaaatcagagtgttgcggcagaagtcggaccatggtgcctacagccaaagcccagccataaaaaaacagctggacagacatcttccttccccacctacgctggacagtataatcacagagtatcttagagaacaacatgctcgctgcaagaatccagttgccacctgcccacctttctccctctttactcctcaccaatgtcctgagccaaaacagaggcggcaagcgccaataaactttacgtcaaggctaaaccgcagggcatcatttccaaagtatggaggggtggatggcggatgctttgataggcaccttatctttagcagattccgtcctatttcagtgttccgggaagccaatgaagatgagagtggcttcacctgctgtgcattctcagcacgggagcggttcctgatgcttggcacctgcacagggcagctgaagctctataatgtgtttagtggacaggaggaggccagctataactgtcacaactcagccatcacacatcttgaaccttccagggatgggtccttgctgctgacatctgctacttggagccagcctttgtctgcactttggggaatgaagtcagtatttgatatgaagcattccttcacagaagatcactatgttgagttcagtaagcactcccaggatcgggtcatcggcacaaaaggagacattgcccacatttatgatattcagactggcaacaagctgttgactctgtttaacccagatcttgccaacaactacaagaggaactgtgccacctttaatcctacagatgatcttgtcttaaatgatggcgtcctctgggatgtccgctctgcacaggccatccacaagtttgacaagttcaatatgaacatcagtggtgttttccatccaaatggactggaggtgatcattaatactgagatttgggaccttcgaacttttcatcttttgcatactgttcccgctctggatcagtgtcgcgtggtgttcaatcacacgggaacagtgatgtatggagctatgttgcaggcagatgatgaagatgacttaatggaagagaggatgaaaagcccctttgggtcatccttccgaacatttaatgcaactgactacaaacctatagcaaccattgatgtgaaacggaacatctttgacctgtgtacagacaccaaagactgctatcttgctgtcattgagaatcaaggcagcatggatgccctgaacatggacacagtatgcaggctgtatgaagtgggcaggcagcgtctggcagaggatgaggatgaagaggaggaccaggaagaggaagaacaggaggaagaagatgatgatgaagatgatgatgacaccgatgatttagatgagcttgacactgaccagttgctggaggcggagttggaggaggacgacaataatgagaacgcaggggaagatggggacaatgacttctctccctctgatgaggagctagcaaaccttctagaggagggagaggacggggaggatgaagactctgatgcagatgaggaggtggaactgatcctgggggacactgacagctctgacaactctgatttggaagatgacatcatcttatctctgaatgagtgaggagccatcactgcttggaagagattcttggcagagagaagaggggacaaatttggttgtgaagtaaacaagaaacacaagacggctaaaactctccaggggcaggtaaagccctgctgggctcagaagcactatagaatttgctgtacacactgaagtgggtctgtgtcacacaggtatttcttggtcctctggagagcagaggactcactcagctctttgcttcatgcctcgctttaatggtagtaaacacttaaccagtggaatagtctgactgctggtactgatggcatcagaagaaaacaggttaacaatcaagtagtgaaagcactatattctagtcattaactcaacggagccagtctcaactctgctgggagcacccacaggtctctgtgggggagacagggactataacagggaggcagaattcaggttggcttgacaacacaccttaggaacatgtgctaaggggctaaggaggcatcagctgtcttccttattctaccagggctgaaaatcggagtcacttaggaggcagcatgagaacagtggcacaccaccagtgaggcacatgttgcctttttgtctttaagcaacaccttagacagggcctgaaccctgggtgggggcactggatgcctgaagtaagtaagttttctcagtggggcagtctcataaaatcaccaggacattgaccacctgacctcccctaactagtgctggccaaggcctgagagttcacagaacctgctaggtcttaagagccaaaggaaggaagtggttgagggccaggaaagagaaggaatgtcatgccagggtgttactcctcaccaaaacttggcagttctttttggggccatgggacacctttctctgaagaggggttggataaggcaaaggttgaagtgtcttctctaggcacgttttctagcatgtttccttttacttggttctgtctcacaaagctgggaggtagatgattcttccgggtcctgagcacctgcttcatgaaggaagataggtagcccagagaagaagttttggacttaacaacataccaaggcagctctggcctgtgactcaggcgtttgttggagagctgcaggaaaaccactgcagtgtgcctgcaacaggacaagacccactcctgtttctggcggtaccagctaccctggaatggtggcgtgtcctgctgtacccaactgacttgcttaggtacctggcagctgtgaccacagctcaagtaaaaaaacaaaaacaggcaaataaataaacatgcttaacatgtc

SEQ ID NO: 199390 - DNA, 3313 bp, Homo sapiens; identical to SEQ ID NO: 198578
  Payload ID: 19339
  Gene Name: VPS11, CORVET/HOPS core subunit
  ENST ID: ENST00000626621
  CDS Start-End: 133-2958

SEQ ID NO: 199391 - DNA, 3388 bp, Homo sapiens; identical to SEQ ID NO: 198579
  Payload ID: 19339
  Gene Name: VPS11, CORVET/HOPS core subunit
  ENST ID: ENST00000629865
  CDS Start-End: 249-3044

SEQ ID NO: 199392 - DNA, 542 bp, Homo sapiens; identical to SEQ ID NO: 198580
  Payload ID: 19339
  Gene Name: VPS11, CORVET/HOPS core subunit
  ENST ID: ENST00000629256
  CDS Start-End: 1-542

SEQ ID NO: 199393 - DNA, 2739 bp, Homo sapiens; identical to SEQ ID NO: 198577
  Payload ID: 19339
  Gene Name: VPS11, CORVET/HOPS core subunit
  ENST ID: ENST00000630977
  CDS Start-End: 1206-2660

SEQ ID NO: 199394 - DNA, 2697 bp, Homo sapiens
  Payload ID: 19340
  Gene Name: VPS26 retromer complex component A
  Uniprot ID: O75436
  ENST ID: ENST00000263559
  CDS Start-End: 127-1110
gagcggtcacgtgtgaggggcggcccgaggtcacgtgacggagcgccggagcggagggagccggggctgggagttctcctgagggaagaggagtggagtaggggggacgcggcggcggcgttgacaatgagttttcttggaggcttttttggtccaatttgtgagatcgatattgttcttaatgatggggaaaccaggaaaatggcagaaatgaaaactgaagatggcaaagtagaaaaacactatctcttctatgacggagaatccgtttcaggaaaggtaaacctagcctttaagcaacctggaaagaggctagaacaccaaggaattagaattgaatttgtaggtcaaattgaacttttcaatgacaagagtaatactcatgaatttgtaaacctagtgaaagaactagccttacctggagaactgactcagagcagaagttatgattttgaatttatgcaagttgaaaagccatatgaatcttacatcggtgccaatgtccgcttgaggtattttcttaaagtgacaatagtgagaagactgacagatttggtaaaagagtatgatcttattgttcaccagcttgccacctatcctgatgttaacaactctattaagatggaagtgggcattgaagattgtctacatatagaatttgaatataataaatcaaagtatcatttaaaggatgtgattgttggaaaaatttacttcttattagtaagaataaaaatacaacatatggagttacagctgatcaaaaaagagatcacaggaattggacccagtaccacaacagaaacagaaacaatcgccaaatatgaaataatggatggtgcaccagtaaaaggtgaatcaattccaataaggctatttttagcaggatatgacccaactccaacaatgagagatgtgaacaaaaaattttcagtaaggtactttttgaatttagtgcttgttgatgaggaagaccggaggtacttcaaacagcaggagataattttatggagaaaagctcctgaaaaactgaggaaacagagaacaaactttcaccagcgatttgaatctccagaatcacaggcatctgccgaacagcctgaaatgtgaactgaacaggagaaaaaaagaaaagcaaaaaactcctgtaacccttgagattaagttcagcaggttaaagatggttgcagctggagggggcggaaaaaggccaaaactccatatatgttagtcttcctttatcttacagcgcagcatttattttatgatataatgaaatgttcgttcatgtatatacatttttaaaagtgctttctttgaaacactggaactttgttaagctgcctttttttttttaacttcctactttgatgataagcactcagatatatatcagcgtaaacatgaaaaattttcatgtgagtaggctggtatttgtaattttgctttctttctgcataatgttgattataaatcctctcttttcaggctaatgattacctcttattctctacatgcaaaaaattaaatattttgtgttcaaataaaattagaaaacctgagtggcctcttgtgtcctgcagagatttaaaacatggcatctcaatatttttgagaactacatttgtttttaacatatgtgtttgagaaaagcatatggagtgtttcaccgcaggcacttctgagtaccattccatggcttccagaattttatcctctttgaggtcttctgtgctatgaatattagatttctttccccaagggattatgtggcaggtcattatggccttcttttttttggccatattaagtaacagttttgctatattccagtagtaccgttgtgtgttttctgcaatgtggagttgacttagcttggcattttagatttgttaaaactattttttccataaatactttgaaacatatttatatatttcaatttaaggaatctttttgccatgtgtatgcaaatattattttcttcatacattcattttcttttcaggggaaaattttgggatgggggactcaggaggacctgtgaagcatgtagttatctagatctgggtaatttcatgtttattaaactcgaactttggctagttaaactcatattgaaacttcatctagtctcttaattttttaacactaaattcaagtcatttgttttaagtctctaaaaaagaagattgcagtcatccattcatatgcatggggtctgatcgcaaatacactaaatgtggagtgtaggaaccaaaatgaaacctgctgtatggaaactactttcacttatggttcattggtttttgtaccaatattttttatgcacttcagtgcaagtcttgtcagttaaccttactttatgagtaagctaaataacccaaattacatttctttaaacctgttttactactatggcactttgataaaatggtcaggaaccaactttactggcaaaagggtccatgtaccaccatgtgctggagcatctgttctacatgtggatatctatgaatggtaatgttttccttcatgtaagtgcctattcagagtttcagaattttaaaatgccaaatattttcatggtcatttgcatgtagtaagccagaaaatattcaaagagattttgaaaaccaattgtatttaaccagcctcaaattgtgcaaccatgatgtataataaagaatttgaaac

SEQ ID NO: 199395 - DNA, 3229 bp, Homo sapiens
  Payload ID: 19340
  Gene Name: VPS26 retromer complex component A
  Uniprot ID: O75436
  ENST ID: ENST00000373382
  CDS Start-End: 654-1637
gcgcctttgccctctcagaacggctgggcggaacgaggcgagaaagccaagttaagaaaacccagactcagaaggaggtggagcgggactgcgttcaggcaaggtggcagaacgcctcgccgtggacgaagagagcacatctcttcttgcgaggcctaaggaagtagggctcccactcgcctcggcaacccaaggacccagccaaggagagagcctccagatgaatccttcctctcctccttccttcccagccgctcaaactttcacaaagaggaactgggtgcggtaaagaggccggacacggaaccgctcgtccggtgaccgaagagacggcgaggaggagcccgcgaacccgcctctgttcaggccccgcccactcgacgtaatttgcccgcccctctccaccctccgaagggtggagcctgaggccccgcctccaagcggcctctccccggagtgcctggcggccagcagggcggggcaggaggctgggagagggacgggtgcgggggtgggggagaggaagggagcggtcacgtgtgaggggcggcccgaggtcacgtgacggagcgccggagcggagggagccggggctgggagttctcctgagggaagaggagtggagtaggggggacgcggcggcggcgttgacaatgagttttcttggaggcttttttggtccaatttgtgagatcgatattgttcttaatgatggggaaaccaggaaaatggcagaaatgaaaactgaagatggcaaagtagaaaaacactatctcttctatgacggagaatccgtttcaggaaaggtaaacctagcctttaagcaacctggaaagaggctagaacaccaaggaattagaattgaatttgtaggtcaaattgaacttttcaatgacaagagtaatactcatgaatttgtaaacctagtgaaagaactagccttacctggagaactgactcagagcagaagttatgattttgaatttatgcaagttgaaaagccatatgaatcttacatcggtgccaatgtccgcttgaggtattttcttaaagtgacaatagtgagaagactgacagatttggtaaaagagtatgatcttattgttcaccagcttgccacctatcctgatgttaacaactctattaagatggaagtgggcattgaagattgtctacatatagaatttgaatataataaatcaaagtatcatttaaaggatgtgattgttggaaaaatttacttcttattagtaagaataaaaatacaacatatggagttacagctgatcaaaaaagagatcacaggaattggacccagtaccacaacagaaacagaaacaatcgccaaatatgaaataatggatggtgcaccagtaaaaggtgaatcaattccaataaggctatttttagcaggatatgacccaactccaacaatgagagatgtgaacaaaaaattttcagtaaggtactttttgaatttagtgcttgttgatgaggaagaccggaggtacttcaaacagcaggagataattttatggagaaaagctcctgaaaaactgaggaaacagagaacaaactttcaccagcgatttgaatctccagaatcacaggcatctgccgaacagcctgaaatgtgaactgaacaggagaaaaaaagaaaagcaaaaaactcctgtaacccttgagattaagttcagcaggttaaagatggttgcagctggagggggcggaaaaaggccaaaactccatatatgttagtcttcctttatcttacagcgcagcatttattttatgatataatgaaatgttcgttcatgtatatacatttttaaaagtgctttctttgaaacactggaactttgttaagctgcctttttttttttaacttcctactttgatgataagcactcagatatatatcagcgtaaacatgaaaaattttcatgtgagtaggctggtatttgtaattttgctttctttctgcataatgttgattataaatcctctcttttcaggctaatgattacctcttattctctacatgcaaaaaattaaatattttgtgttcaaataaaattagaaaacctgagtggcctcttgtgtcctgcagagatttaaaacatggcatctcaatatttttgagaactacatttgtttttaacatatgtgtttgagaaaagcatatggagtgtttcaccgcaggcacttctgagtaccattccatggcttccagaattttatcctctttgaggtcttctgtgctatgaatattagatttctttccccaagggattatgtggcaggtcattatggccttcttttttttggccatattaagtaacagttttgctatattccagtagtaccgttgtgtgttttctgcaatgtggagttgacttagcttggcattttagatttgttaaaactattttttccataaatactttgaaacatatttatatatttcaatttaaggaatctttttgccatgtgtatgcaaatattattttcttcatacattcattttcttttcaggggaaaattttgggatgggggactcaggaggacctgtgaagcatgtagttatctagatctgggtaatttcatgtttattaaactcgaactttggctagttaaactcatattgaaacttcatctagtctcttaattttttaacactaaattcaagtcatttgttttaagtctctaaaaaagaagattgcagtcatccattcatatgcatggggtctgatcgcaaatacactaaatgtggagtgtaggaaccaaaatgaaacctgctgtatggaaactactttcacttatggttcattggtttttgtaccaatattttttatgcacttcagtgcaagtcttgtcagttaaccttactttatgagtaagctaaataacccaaattacatttctttaaacctgttttactactatggcactttgataaaatggtcaggaaccaactttactggcaaaagggtccatgtaccaccatgtgctggagcatctgttctacatgtggatatctatgaatggtaatgttttccttcatgtaagtgcctattcagagtttcagaattttaaaatgccaaatattttcatggtcatttgcatgtagtaagccagaaaatattcaaagagattttgaaaaccaattgtatttaaccagcctcaaattgtgcaaccatgatgtataataaagaatttgaaacagaaa

SEQ ID NO: 199396 - DNA, 2554 bp, Homo sapiens
  Payload ID: 19340
  Gene Name: VPS26 retromer complex component A
  Uniprot ID: O75436
  ENST ID: ENST00000395098
  CDS Start-End: 127-882
gagcggtcacgtgtgaggggcggcccgaggtcacgtgacggagcgccggagcggagggagccggggctgggagttctcctgagggaagaggagtggagtaggggggacgcggcggcggcgttgacaatgagttttcttggaggcttttttggtccaatttgtgagatcgatattgttcttaatgatggggaaaccaggaaaatggcagaaatgaaaactgaagatggcaaagtagaaaaacactatctcttctatgacggagaatccgtttcaggaaaggtaaacctagcctttaagcaacctggaaagaggctagaacaccaaggaattagaattgaatttgtaggtcaaattgaacttttcaatgacaagagtaatactcatgaatttgtaaacctagtgaaagaactagccttacctggagaactgactcagagcagaagttatgattttgaatttatgcaagttgaaaagccatatgaatcttacatcggtgccaatgtccgcttgaggtattttcttaaagtgacaatagtgagaagactgacagatttggtaaaagagtatgatcttattgttcaccagcttgccacctatcctgatgttaacaactctattaagatggaagtgggcattgaagattgtctacatatagaatttgaatataataaatcaaagtatcatttaaaggatgtgattgttggaaaaatttacttcttattagtaagaataaaaatacaacatatggagttacagctgatcaaaaaagagatcacaggaattggacccagtaccacaacagaaacagaaacaatcgccaaatatgaaataatggatggtgcaccagtaaaaggagataattttatggagaaaagctcctgaaaaactgaggaaacagagaacaaactttcaccagcgatttgaatctccagaatcacaggcatctgccgaacagcctgaaatgtgaactgaacaggagaaaaaaagaaaagcaaaaaactcctgtaacccttgagattaagttcagcaggttaaagatggttgcagctggagggggcggaaaaaggccaaaactccatatatgttagtcttcctttatcttacagcgcagcatttattttatgatataatgaaatgttcgttcatgtatatacatttttaaaagtgctttctttgaaacactggaactttgttaagctgcctttttttttttaacttcctactttgatgataagcactcagatatatatcagcgtaaacatgaaaaattttcatgtgagtaggctggtatttgtaattttgctttctttctgcataatgttgattataaatcctctcttttcaggctaatgattacctcttattctctacatgcaaaaaattaaatattttgtgttcaaataaaattagaaaacctgagtggcctcttgtgtcctgcagagatttaaaacatggcatctcaatatttttgagaactacatttgtttttaacatatgtgtttgagaaaagcatatggagtgtttcaccgcaggcacttctgagtaccattccatggcttccagaattttatcctctttgaggtcttctgtgctatgaatattagatttctttccccaagggattatgtggcaggtcattatggccttcttttttttggccatattaagtaacagttttgctatattccagtagtaccgttgtgtgttttctgcaatgtggagttgacttagcttggcattttagatttgttaaaactattttttccataaatactttgaaacatatttatatatttcaatttaaggaatctttttgccatgtgtatgcaaatattattttcttcatacattcattttcttttcaggggaaaattttgggatgggggactcaggaggacctgtgaagcatgtagttatctagatctgggtaatttcatgtttattaaactcgaactttggctagttaaactcatattgaaacttcatctagtctcttaattttttaacactaaattcaagtcatttgttttaagtctctaaaaaagaagattgcagtcatccattcatatgcatggggtctgatcgcaaatacactaaatgtggagtgtaggaaccaaaatgaaacctgctgtatggaaactactttcacttatggttcattggtttttgtaccaatattttttatgcacttcagtgcaagtcttgtcagttaaccttactttatgagtaagctaaataacccaaattacatttctttaaacctgttttactactatggcactttgataaaatggtcaggaaccaactttactggcaaaagggtccatgtaccaccatgtgctggagcatctgttctacatgtggatatctatgaatggtaatgttttccttcatgtaagtgcctattcagagtttcagaattttaaaatgccaaatattttcatggtcatttgcatgtagtaagccagaaaatattcaaagagattttgaaaaccaattgtatttaaccagcctcaaattgtgcaaccatgatgtataataaagaatttgaaac

SEQ ID NO: 199397 - DNA, 817 bp, Homo sapiens
  Payload ID: 19340
  Gene Name: VPS26 retromer complex component A
  ENST ID: ENST00000489656
  CDS Start-End: 123-314
ggtcacgtgtgaggggcggcccgaggtcacgtgacggagcgccggagcggagggagccggggctgggagttctcctgagggaagaggagtggagtaggggggacgcggcggcggcgttgacaatgagttttcttggaggcttttttggtccaatttgtgagatcgatattgttcttaatgatggggaaaccaggaaaatggcagaaatgaaaactgaagatggcaaagtagaaaaacactatctcttctatgacggagaatccgtttcaggaaagaacttttcaatgacaagagtaatactcatgaatttgtaaacctagtgaaagaactagccttacctggagaactgactcagagcagaagttatgattttgaatttatgcaagttgaaaagccatatgaatcttacatcggtgccaatgtccgcttgaggtattttcttaaagtgacaatagtgagaagactgacagatttggtaaaagagtatgatcttattgttcaccagcttgccacctatcctgatgttaacaactctattaagatggaagtgggcattgaagattgtctacatatagaatttgaatataataaatcaaagtatcatttaaaggatgtgattgttggaaaaatttacttcttattagtaagaataaaaatacaacatatggagttacagctgatcaaaaaagagatcacaggaattggacccagtaccacaacagaaacagaaacaatcgccaaatatgaaataatggatggtgcaccagtaaaaggtgaatcaattccaataaggctatttttagcaggatatgaccca

SEQ ID NO: 199398 - DNA, 928 bp, Homo sapiens
  Payload ID: 19340
  Gene Name: VPS26 retromer complex component A
  ENST ID: ENST00000489794
  CDS Start-End: 73-753
agttttcttggaggcttttttggtccaatttgtgagatcgatattgttcttaatgatggggaaaccaggaaaatggcagaaatgaaaactgaagatggcaaagtagaaaaacactatctcttctatgacggagaatccgtttcaggaaaggtaaacctagcctttaagcaacctggaaagaggctagaacaccaaggaattagaattgaatttgtaggtcaaattgaacttttcaatgacaagagtaatactcatgaatttgtaaacctagtgaaagaactagccttacctggagaactgactcagagcagaagttatgattttgaatttatgcaagttgaaaagccatatgaatcttacatcggtgccaatgtccgcttgaggtattttcttaaagtgacaatagtgagaagactgacagatttggtaaaagagtatgatcttattgttcaccagcttgccacctatcctgatgttaacaactctattaagatggaagtgggcattgaagattgtctacatatagaatttgaatataataaatcaaagtatcatttaaaggatgtgattgttggaaaaatttacttcttattagtaagaataaaaatacaacatatggagttacagctgatcaaaaaagagatcacaggaattggacccagtaccacaacagaaacagaaacaatcgccaaatatgaaataatggatggtgcaccagtaaaaggagataattttatggagaaaagctcctgaaaaactgaggaaacagagaacaaactttcaccagcgatttgaatctccagaatcacaggcatctgccgaacagcctgaaatgtgaactgaacaggagaaaaaaagaaaagcaaaaaactcctgtaacccttgagattaagttcagcaggttaaagatggttgcagctggaggggg

SEQ ID NO: 199399 - DNA, 3691 bp, Homo sapiens
  Payload ID: 19341
  Gene Name: VPS26 retromer complex component B
  Uniprot ID: Q4G0F5
  ENST ID: ENST00000281187
  CDS Start-End: 479-1489
gagctcgcccgccccctcccccgcccggagccgccgaagcgcctcggtgcgttgcaccgccggaggctgggcagctcgcagcgctgctcggcgctggaccccacccggcaggcgcaggccacccacacccggctctgtgcggctgccccccgcagcattgcacggccgaccctcgcccgcccactgccaccggccgcgggactggctgggactggctcggccgagggcactgctcctcggtgcattgctgctcgggcgccgcagcccgcagccgccagcctcccccggccgtgcccctcccccgtggagccggctgtccgtcggcgcccactgcccggcggcagcggcggagccaggcagccccgcggcggccgagcgcgctcgcgcatcgggccctctggccttctttacctagggcagcccgcgccccggtgcgagggagcggtccttaccgagacccgcccggcccggcggtgcgatgagcttcttcggcttcgggcagagcgtggaggtggaaatccttctgaacgatgcagagagtaggaagcgggccgagcacaagacggaggacgggaagaaggagaaatatttcctcttctacgacggggagacggtctccgggaaggtgagccttgccctcaagaaccccaacaagcggctggagcaccagggcatcaagatcgagttcatcgggcagatcgaactctactacgatcgcgggaaccaccatgagtttgtgtccctggtgaaggacctggcccggcctggagagatcacccagtcgcaggccttcgactttgagtttacccacgtggagaagccgtatgagtcctacacagggcagaatgtgaagctacgctatttccttcgtgctaccatcagccgccgcctcaatgatgttgtcaaagagatggacattgtagttcacacactcagcacatacccagagctgaactcttccatcaagatggaggttgggattgaggactgtctgcacattgaatttgagtacaataaatccaaataccacttgaaagatgtcattgtagggaagatatacttcctgctggtgagaatcaaaatcaagcacatggagatagacatcatcaagcgagaaacgacgggtacaggccccaacgtgtaccatgagaatgacacgatagccaagtacgagatcatggacggggcaccagtgcgaggagagtccatcccgatccggctcttcctggccgggtatgagctcacgcccaccatgcgggacatcaacaagaagttctctgtgcgctattacctcaacctggtgctgatagacgaggaggagcggcgctacttcaagcagcaggaagtggtgttgtggcggaagggtgacatcgtacggaagagcatgtcccaccaggcggccatcgcctcacagcgctttgagggcaccacctccctgggtgaggtgcggacccccagccagctgtctgacaacaactgcaggcagtaggcccccagggccgagaagatgctgggcacccacccagcacccccatctaccaacaccagcggctgggggcgggggcggaccttgtgaggctcagttgacccgttacttgcaacctgaaaacaaatcatgtttttgacttaaattcttttctctggagaacccaaggggcttggggtgggaagcagtctctccttgggattctgcggccgatgtgggatagaagaggtagcatcctggaagccagcctctctggggaacatgagcccccttcctcggggggctgccttgcgtcttagaggagggagagcagagagcacgcatccttggctcctggctctctgagcttcctgatacaggatctgagcatgtccctgggattctgagctgccaacagggccctgggtagtcacatcttgtactcccctttgctgtcccggaggtagtggcaggagttgggccagcccccactaagtggcaggggaagactcacgattgggaagctacctctttgggaatcttggatgtggtgatctcaagttcccacaggccacctccttctggccactcactgctgggacccaggcacctcccttctccatcctctctggattgtcagtaatgtcctggaacagaagcctgtgggatggccttgggcacggagaagccctggggtcagtgtcgtgcacggatggcggcagtgttgaacccaggaggctgaacccggcccaccacggaagatgagtgcatggcaaccgcctgccttcacgtcgctccacttggtaaccccaaggtctgggctgttctaggtattgcttcacgtgccccagcaagcccttaacaagagggcctggttccctgaagaaccaatcccaggaaggggccttgatccctccgccttgctgagagtgaaccctcgtctctcctcaccctccatttcatttctgggaattggggcttagtttcgaacctttggcaaggctgttcttactaatgcccaagcccctttacccctctccctataggttacacaggggagaccagggcctcggcagaagactgctgccacacttccgaatcattctgcttgccaaataggtcatcttcaccagttgactgacccaagtttaggaccattggtatcgtgtgtttaaaaaacacatataaaaaaactcttgtgaatattcttgttatgctagagaggaaggtacttctccctctacggctctgcgctggggcctatggtagtaaagttgtttactgtcctttttctgcttcccctggaaatgacaggcattactctcccattggcctcccttccctttatagaaagaccaagcaggccccactggccaagaggtacggtatttggcagtctgagttctcagtaatttggaaagttaaggagttggttcctgtgtcacctttcagttagtgtgggaaaggaagacttctgttttcctgagatcagtgcagtctcaggcctttggcagggctcatggatcagagctgagactggagggagaggcattttgggtagcctaggagggcgactggcggcagcagaaccgaggaaggcaaggttgtttcccccacgctgtgtcctgtgttcaggtgcgacacacaatcctcatgggaacaggatcacccatgcgctgcccttgatgatcaaggttggggcttaagtggataagggaggcaagttctgggttccttgccttttcagagcatgaggtcaggctctgtatccctccttttcctagctgatattctaactagaagcatttgtcaattcctttgcctcccaactgacaacacacgttcattttccaaccttcctaacatcttaaacctttcttctgggagaactagaagacagaatttgctttgattctctcaggcgctgtgcacaagccaggtcttctgttttctctttcttactctacccacattcttgccttctctatccaactgtgaaagtgaggggaggctcctgtccccctctcttaaggtccccaaacctgggagtgcataggtactaaatcaagcagtgcaacttgtaattaagcagctgcagtgtttacatgtttcttaatgtgtcatcttttcaatggctgtattaaaagaagaacgtttgttttaatggtctttctgattaaagaaagcccctgtggctttggaggcattgtgcccacggtccaccaa

SEQ ID NO: 199400 - DNA, 800 bp, Homo sapiens
  Payload ID: 19341
  Gene Name: VPS26 retromer complex component B
  ENST ID: ENST00000527586
  CDS Start-End: 1-217
ggccgagcacaagacggaggacgggaagaaggagaaatatttcctcttctacgacggggagacggtctccgggaaggtgagccttgccctcaagaaccccaacaagcggctggagcaccagggcatcaagatcgagttcatcgggcagatcgctatttccttcgtgctaccatcagccgccgcctcaatgatgttgtcaaagagatggacattgtagttcacacactcagcacatacccagagctgaactcttccatcaagatggaggttgggattgaggactgtctgcacattgaatttgagtacaataaatccaaataccacttgaaagatgtcattgtagggaagatatacttcctgctggtgagaatcaaaatcaagcacatggagatagacatcatcaagcgagaaacgacgggtacaggccccaacgtgtaccatgagaatgacacgatagccaagtacgagatcatggacggggcaccagtgcgagtttacaccgtgggtggccataaggaagaaaaggaaggctgagtgtgtagaacttgaggctactatcccatcttcaccctgaaaagttgcacttagacttggattatatatcgggcttgtactgaagattgaacctcaagcgtcactttggaaggtccaggtttagcagatgtggtttgaaaacgtttctgcttcttcctgttgacattctggcattctctgctgctcaggagcaagggatgcatgcacagcagcctgtctgtgacttggctctagctccgatttattttctgaattcacttgtcagg

SEQ ID NO: 199401 - DNA, 1558 bp, Homo sapiens
  Payload ID: 19341
  Gene Name: VPS26 retromer complex component B
  Uniprot ID: Q4G0F5
  ENST ID: ENST00000525095
  CDS Start-End: 409-1419
gccgaagcgcctcggtgcgttgcaccgccggaggctgggcagctcgcagcgctgctcggcgctggaccccacccggcaggcgcagcattgcacggccgaccctcgcccgcccactgccaccggccgcgggactggctgggactggctcggccgagggcactgctcctcggtgcattgctgctcgggcgccgcagcccgcagccgccagcctcccccggccgtgcccctcccccgtggagccggctgtccgtcggcgcccactgcccggcggcagcggcggagccaggcagccccgcggcggccgagcgcgctcgcgcatcgggccctctggccttctttacctagggcagcccgcgccccggtgcgagggagcggtccttaccgagacccgcccggcccggcggtgcgatgagcttcttcggcttcgggcagagcgtggaggtggaaatccttctgaacgatgcagagagtaggaagcgggccgagcacaagacggaggacgggaagaaggagaaatatttcctcttctacgacggggagacggtctccgggaaggtgagccttgccctcaagaaccccaacaagcggctggagcaccagggcatcaagatcgagttcatcgggcagatcgaactctactacgatcgcgggaaccaccatgagtttgtgtccctggtgaaggacctggcccggcctggagagatcacccagtcgcaggccttcgactttgagtttacccacgtggagaagccgtatgagtcctacacagggcagaatgtgaagctacgctatttccttcgtgctaccatcagccgccgcctcaatgatgttgtcaaagagatggacattgtagttcacacactcagcacatacccagagctgaactcttccatcaagatggaggttgggattgaggactgtctgcacattgaatttgagtacaataaatccaaataccacttgaaagatgtcattgtagggaagatatacttcctgctggtgagaatcaaaatcaagcacatggagatagacatcatcaagcgagaaacgacgggtacaggccccaacgtgtaccatgagaatgacacgatagccaagtacgagatcatggacggggcaccagtgcgaggagagtccatcccgatccggctcttcctggccgggtatgagctcacgcccaccatgcgggacatcaacaagaagttctctgtgcgctattacctcaacctggtgctgatagacgaggaggagcggcgctacttcaagcagcaggaagtggtgttgtggcggaagggtgacatcgtacggaagagcatgtcccaccaggcggccatcgcctcacagcgctttgagggcaccacctccctgggtgaggtgcggacccccagccagctgtctgacaacaactgcaggcagtaggcccccagggccgagaagatgctgggcacccacccagcacccccatctaccaacaccagcggctgggggcgggggcggaccttgtgaggctcagttgacccgttacttgcaacctgaaaacaaatcatgtttttgactt

SEQ ID NO: 199402 - DNA, 740 bp, Homo sapiens
  Payload ID: 19341
  Gene Name: VPS26 retromer complex component B
  ENST ID: ENST00000530402
  CDS Start-End: 1-147
ggagagatcacccagtcgcaggccttcgactttgagtttacccacgtggagaagccgtatgagtcctacacagggcagaatgtgaagctacgtggatttgtcttaagcgtttgtacggcagaaagaaaggtgttgaaaccagtatagcagtgcctcaaaaaattaaacagaattaccatatgatctagcaattcctcttttggatccagaagcggatccaaaagaatggaaaacaggatctcgaacggatatctgtacacccatattcacagcagcattattcgcaataaccaaaaggtagaagcaacccaagtgtccatcagtgggtaaatggacacaggaaatgtgttttgtccgtacagtggactgttatacagccttcaaaaggaaggacattctgtcctatgctacaacatgggtgaacctaaaggacattgtgctacgtgaaagaagcctgtcacaaaaggacaaatactgtctgattccatatatatgagctatttccttcgtgctaccatcagccgccgcctcaatgatgttgtcaaagagatggacattgtagttcacacactcagcacatacccagagctgaactcttccatcaagatggaggttgggattgaggactgtctgcacattgaatttgagtacaataaatccaaataccacttgaaagatgtcattgtagggaagatatacttcctgctggtgagaatcaaaatcaagcacatggagataga

SEQ ID NO: 199403 - DNA, 1091 bp, Homo sapiens
  Payload ID: 19342
  Gene Name: VPS29 retromer complex component
  Uniprot ID: Q9UBQ0
  ENST ID: ENST00000360579
  CDS Start-End: 49-609
gaagagggcggcgacggtggtggtgactgagcggagcccggtgacaggatggctgggcacagattggtgttggtattaggagatctgcacatcccacaccggtgcaacagtttgccagctaaattcaaaaaactcctggtgccaggaaaaattcagcacattctctgcacaggaaacctttgcaccaaagagagttatgactatctcaagactctggctggtgatgttcatattgtgagaggagacttcgatgagaatctgaattatccagaacagaaagttgtgactgttggacagttcaaaattggtctgatccatggacatcaagttattccatggggagatatggccagcttagccctgttgcagaggcaatttgatgtggacattcttatctcgggacacacacacaaatttgaagcatttgagcatgaaaataaattctacattaatccaggttctgccactggggcatataatgccttggaaacaaacattattccatcatttgtgttgatggatatccaggcttctacagtggtcacctatgtgtatcagctaattggagatgatgtgaaagtagaacgaatcgaatacaaaaaaccttaaagccaggcctgtcttgatgatttttggttttttttcattgtcctgttgaaatcaagtaattaaacatttaagagccacaaaattgtatcacttttataatattttgcagtaaaatataataccatcttctctgttaatacataattgctccaagcttcctgtaaactataagaatatatttagtttacagtatatggattctatgaaaaaatgtccacaacacagtaattggtcacttgttaagaaaaatttatccttgtaagtatcttcaaagttgatatttggaactttattccaaaagtagtgcatgtggagaaagaatctagactttcttgtatacatttttctcttctccagtaataaacaattacctttcatttatactttgataacctgtatttaatttaaaaaaaaacataaaaatgaggaaccaagtgaaactacggatataaatattaaagtggacgagatgacctttcaga

SEQ ID NO: 199404 - DNA, 996 bp, Homo sapiens
  Payload ID: 19342
  Gene Name: VPS29 retromer complex component
  ENST ID: ENST00000447578
  CDS Start-End: 353-616
ggtgactgagcggagcccggtgacaggatgaaggaatccccctctaaaatgaagattgttctatatccagttggtgttggtattaggagatctgcacatcccacaccggtgcaacagtttgccagctaaattcaaaaaactcctggtgccaggaaaaattcagcacattctctgcacaggaaacctttgcaccaaagagagttatgactatctcaagactctggctggtgatgttcatattgtgagaggagacttcgatgagaatctgaattatccagaacagaaagttgtgactgttggacagttcaaaattggtctgatccatggacatcaagttattccatggggagatatggccagcttagccctgttgcagaggcaatttgatgtggacattcttatctcgggacacacacacaaatttgaagcatttgagcatgaaaataaattctacattaatccaggttctgccactggggcatataatgccttggaaacaaacattattccatcatttgtgttgatggatatccaggcttctacagtggtcacctatgtgtatcagctaattggagatgatgtgaaagtagaacgaatcgaatacaaaaaaccttaaagccaggcctgtcttgatgatttttggttttttttcattgtcctgttgaaatcaagtaattaaacatttaagagccacaaaattgtatcacttttataatattttgcagtaaaatataataccatcttctctgttaatacataattgctccaagcttcctgtaaactataagaatatatttagtttacagtatatggattctatgaaaaaatgtccacaacacagtaattggtcacttgttaagaaaaatttatccttgtaagtatcttcaaagttgatatttggaactttattccaaaagtagtgcatgtggagaaagaatctagactttcttgtatacatttttctcttctccagtaataaacaattacctttcattt

SEQ ID NO: 199405 - DNA, 1523 bp, Homo sapiens
  Payload ID: 19342
  Gene Name: VPS29 retromer complex component
  Uniprot ID: Q9UBQ0
  ENST ID: ENST00000549578
  CDS Start-End: 67-615
gtcgccgaggagcctgaggaagagggcggcgacggtggtggtgactgagcggagcccggtgacaggatgttggtgttggtattaggagatctgcacatcccacaccggtgcaacagtttgccagctaaattcaaaaaactcctggtgccaggaaaaattcagcacattctctgcacaggaaacctttgcaccaaagagagttatgactatctcaagactctggctggtgatgttcatattgtgagaggagacttcgatgagaatctgaattatccagaacagaaagttgtgactgttggacagttcaaaattggtctgatccatggacatcaagttattccatggggagatatggccagcttagccctgttgcagaggcaatttgatgtggacattcttatctcgggacacacacacaaatttgaagcatttgagcatgaaaataaattctacattaatccaggttctgccactggggcatataatgccttggaaacaaacattattccatcatttgtgttgatggatatccaggcttctacagtggtcacctatgtgtatcagctaattggagatgatgtgaaagtagaacgaatcgaatacaaaaaaccttaaagccaggcctgtcttgatgatttttggttttttttcattgtcctgttgaaatcaagtaattaaacatttaagagccacaaaattgtatcacttttataatattttgcagtaaaatataataccatcttctctgttaatacataattgctccaagcttcctgtaaactataagaatatatttagtttacagtatatggattctatgaaaaaatgtccacaacacagtaattggtcacttgttaagaaaaatttatccttgtaagtatcttcaaagttgatatttggaactttattccaaaagtagtgcatgtggagaaagaatctagactttcttgtatacatttttctcttctccagtaataaacaattacctttcatttatactttgataacctgtatttaatttaaaaaaaaacataaaaatgaggaaccaagtgaaactacggatataaatattaaagtggacgagatgacctttcagagctcttctcttacattgtgtcataatgttggactcagattttatttgctaaataatataccatgccgacattaacagtgattcttcaaactgttgctatttccatttttcaaggtttaataaaagttttaaaaatacaagtttaggggccgggcacagtggctcacaccctaatcccaacactttgggaggctgaggcaggtggatcacctgaggtcaggagttcaagaccagcctggccaacatggtgaaaccctgtctgtactaaaaatacaaaattagccagcatggtgctacatgcctgtattcccagctactcgggaggctgaggcagtagaatcacttgaatcctggagttggaggttgcagtgagccgagatcacaccattgcactccagcctggtcaacaagagcataactccgtctc

SEQ ID NO: 199406 - DNA, 818 bp, Homo sapiens
  Payload ID: 19342
  Gene Name: VPS29 retromer complex component
  ENST ID: ENST00000549970
  CDS Start-End: 436-699
gaggagcctgaggaagagggcggcgacggtggtggtgactgagcggagcccggtgacaggatggctgggcacagagtaagtttcttcacttagctcctactaacagtggtggttgggtggctgtttactgactggatttcttacccttttaagttggtgttggtattaggagatctgcacatcccacaccggtgcaacagtttgccagctaaattcaaaaaactcctggtgccaggaaaaattcagcacattctctgcacaggaaacctttgcaccaaagagagttatgactatctcaagactctggctggtgatgttcatattgtgagaggagacttcgatgagaatctgaattatccagaacagaaagttgtgactgttggacagttcaaaattggtctgatccatggacatcaagttattccatggggagatatggccagcttagccctgttgcagaggcaatttgatgtggacattcttatctcgggacacacacacaaatttgaagcatttgagcatgaaaataaattctacattaatccaggttctgccactggggcatataatgccttggaaacaaacattattccatcatttgtgttgatggatatccaggcttctacagtggtcacctatgtgtatcagctaattggagatgatgtgaaagtagaacgaatcgaatacaaaaaaccttaaagccaggcctgtcttgatgatttttggttttttttcattgtcctgttgaaatcaagtaattaaacatttaagagccacaaaattgtatcacttttataatattttgcagtaaaatataa

SEQ ID NO: 199407 - DNA, 1059 bp, Homo sapiens
  Payload ID: 19342
  Gene Name: VPS29 retromer complex component
  ENST ID: ENST00000546588
  CDS Start-End: 101-745
gcggcgacggtggtggtgactgagcggagcccggtgacaggatgggaaagggaataaaccaccctcctcgctcctgaaataacatctagctgccattgagatgagcaggtgtgctctcagagggcgggatttggcgcttgcaattgctggaactgtttctttccacgggttgctacgcctctttagggctgggcacagattggtgttggtattaggagatctgcacatcccacaccggtgcaacagtttgccagctaaattcaaaaaactcctggtgccaggaaaaattcagcacattctctgcacaggaaacctttgcaccaaagagagttatgactatctcaagactctggctggtgatgttcatattgtgagaggagacttcgatgagaatctgaattatccagaacagaaagttgtgactgttggacagttcaaaattggtctgatccatggacatcaagttattccatggggagatatggccagcttagccctgttgcagaggcaatttgatgtggacattcttatctcgggacacacacacaaatttgaagcatttgagcatgaaaataaattctacattaatccaggttctgccactggggcatataatgccttggaaacaaacattattccatcatttgtgttgatggatatccaggcttctacagtggtcacctatgtgtatcagctaattggagatgatgtgaaagtagaacgaatcgaatacaaaaaaccttaaagccaggcctgtcttgatgatttttggttttttttcattgtcctgttgaaatcaagtaattaaacatttaagagccacaaaattgtatcacttttataatattttgcagtaaaatataataccatcttctctgttaatacataattgctccaagcttcctgtaaactataagaatatatttagtttacagtatatggattctatgaaaaaatgtccacaacacagtaattggtcacttgttaagaaaaatttatccttgtaagtatcttcaaagttgatatttggaactttattccaaaagtagtgcatgtgga

SEQ ID NO: 199408 - DNA, 1057 bp, Homo sapiens
  Payload ID: 19342
  Gene Name: VPS29 retromer complex component
  ENST ID: ENST00000552130
  CDS Start-End: 413-676
gctgggcacagagtaagtttcttcacttagctcctactaacagtggtggttgggtggctgtttactgactggatttcttacccttttaagaaggaatccccctctaaaatgaagattgttctatatccagttggtgttggtattaggagatctgcacatcccacaccggtgcaacagtttgccagctaaattcaaaaaactcctggtgccaggaaaaattcagcacattctctgcacaggaaacctttgcaccaaagagagttatgactatctcaagactctggctggtgatgttcatattgtgagaggagacttcgatgagaatctgaattatccagaacagaaagttgtgactgttggacagttcaaaattggtctgatccatggacatcaagttattccatggggagatatggccagcttagccctgttgcagaggcaatttgatgtggacattcttatctcgggacacacacacaaatttgaagcatttgagcatgaaaataaattctacattaatccaggttctgccactggggcatataatgccttggaaacaaacattattccatcatttgtgttgatggatatccaggcttctacagtggtcacctatgtgtatcagctaattggagatgatgtgaaagtagaacgaatcgaatacaaaaaaccttaaagccaggcctgtcttgatgatttttggttttttttcattgtcctgttgaaatcaagtaattaaacatttaagagccacaaaattgtatcacttttataatattttgcagtaaaatataataccatcttctctgttaatacataattgctccaagcttcctgtaaactataagaatatatttagtttacagtatatggattctatgaaaaaatgtccacaacacagtaattggtcacttgttaagaaaaatttatccttgtaagtatcttcaaagttgatatttggaactttattccaaaagtagtgcatgtggagaaagaatctagactttcttgtatacatttttctcttctccagtaataaacaattacctttcattta

SEQ ID NO: 199409 - DNA, 1124 bp, Homo sapiens
  Payload ID: 19342
  Gene Name: VPS29 retromer complex component
  ENST ID: ENST00000621131
  CDS Start-End: 1-645
atgagcaggtgtgctctcagagggcgggatttggcgcttgcaattgctggaactgtttctttccacgggttgctacgcctctttagggctgggcacagattggtgttggtattaggagatctgcacatcccacaccggtgcaacagtttgccagctaaattcaaaaaactcctggtgccaggaaaaattcagcacattctctgcacaggaaacctttgcaccaaagagagttatgactatctcaagactctggctggtgatgttcatattgtgagaggagacttcgatgagaatctgaattatccagaacagaaagttgtgactgttggacagttcaaaattggtctgatccatggacatcaagttattccatggggagatatggccagcttagccctgttgcagaggcaatttgatgtggacattcttatctcgggacacacacacaaatttgaagcatttgagcatgaaaataaattctacattaatccaggttctgccactggggcatataatgccttggaaacaaacattattccatcatttgtgttgatggatatccaggcttctacagtggtcacctatgtgtatcagctaattggagatgatgtgaaagtagaacgaatcgaatacaaaaaaccttaaagccaggcctgtcttgatgatttttggttttttttcattgtcctgttgaaatcaagtaattaaacatttaagagccacaaaattgtatcacttttataatattttgcagtaaaatataataccatcttctctgttaatacataattgctccaagcttcctgtaaactataagaatatatttagtttacagtatatggattctatgaaaaaatgtccacaacacagtaattggtcacttgttaagaaaaatttatccttgtaagtatcttcaaagttgatatttggaactttattccaaaagtagtgcatgtggagaaagaatctagactttcttgtatacatttttctcttctccagtaataaacaattacctttcatttatactttgataacctgtatttaatttaaaaaaaaacataaaaatgaggaaccaagtgaaactacggatataaatattaaagtggacgagatgacctttc

SEQ ID NO: 199410 - DNA, 2614 bp, Homo sapiens
  Payload ID: 19343
  Gene Name: VPS33B interacting protein, apical-basolateral polarity regulator, spe-39 homolog
  Uniprot ID: Q9H9C1
  ENST ID: ENST00000327028
  CDS Start-End: 339-1673
agaagggctggtccagcggcggcggaggctggcgctgtcctgagagggagggctctgtgcggaagagtcagggcgacccttgggcgctggagtacgcttgggactggggctgcgagtgagcaccagcgattggttcggaagcggacatttggttcagaacgagcatttaactctgccagggatccgctgggctctgacgactgcggtagatccatggcttcctggacgttcacccgtagagtcatcctagcttaactcttgttccctggtctcagttcacaagcctcacctgtatcttcctggctcggaagataattgaaaccaagtctgacttctcaatgaatcggacaaagggtgatgaggaggagtattggaacagctccaagttcaaggcttttacctttgacgatgaagacgatgagctttcacagttaaaggagtccaagcgggcggtgaacagcctccgagacttcgtggatgatgatgacgatgatgacctggagcgagtcagctggagtggggaacctgtgggaagtagaactagacctggaagtttccagtccctttctgatgctctgtcagacacacctgccaaaagctatgctccagagctggggagacccaaaggggagtatagggattacagcaatgactggagccccagtgatacagtgcgacgtctccggaagggcaaggtttgctcactagagagattccgctccttacaggacaaactacaactcctagaagaggcagtaagcatgcatgatggaaacgtcattactgcagttctgattttcctgaagaggacactgagcaaagagatcctcttccgagagctggaggtgcgacaggttgccctgagacatcttattcacttccttaaggaaataggggatcaaaagttgcttttagacctcttcaggttcctagatagaacagaagagcttgcgctatctcattatcgagagcatttgaacattcaggaccctgacaaacgaaaagaatttcttaaaacctgtgttggtttgccattttcagcagaagattccgcacacatacaggaccattacacgctcctggaacgtcagatcattattgaggcaaatgatcgccatctagaatcagcaggacagactgagatcttccgaaagcacccccgcaaagcctccatcctcaacatgccactagtgacaacacttttctactcctgcttctatcactacacagaggctgaggggacattcagcagtcccgtcaacctgaagaagacatttaagatcccagataaacagtatgtgctgacagccctggctgctcgtgccaagcttcgagcctggaatgatgtagatgccctattcaccacaaagaactggctgggctataccaagaagagagcacccattggcttccatcgggttgtcgaaattttgcacaagaacaatgcccctgtgcagatattacaggagtatgtcaatctggtggaagatgtggacacgaagttgaacttagccactaagttcaagtgccatgatgtcgtcattgatacctaccgggacctgaaggatcgtcaacagttgctagcatacaggagtaaggtagataaaggatcagcagaggaggagaagattgatgctcttctcagcagctcgcaaattcgatggaagaattaagtggcattgactaccttgaagcctgcctcatttcctcctctcctgcctgtgaaagcagagagagctcttctttgggagagctgcggcatcacatcgcttgggcccattacccatgggcagtgccagctactcttgacacagataacttcagactgatcttctgtccaaggaacatcatctgaggatcgagatctaaagctttgagtcatgagaatgattctctccacctggtgctcatatgaaggtgggagtgatttctagattgggcccctactgggtaagatctcacttggtctgagaaaagtgactgctccagaaaggaagaggtatgggagtcatagggtggctactgcattccactcagctaattatgatccaggacttggcgctggacattggcagttctgctctgaatgaagtcagaacagaaccaaaatggcctcaggaaggaatgccagtgtttcccaagacctcctggagatgcactcacaccagactgcacagacccctccacattatgccacacatggcctagacgttgtgtttcctcagccattttccctctgctgccccagtttactctgtccaaaaccctaaggttcttctctcacttgaacacagacgaccttgcttgggtgatgagacatcccctttatctcttcctctactgctggccaagacccgtcactttataagaagctcagatgcagcagtgctggagagctctctctttatgcaaaaatctcatttcaccaggagctttcagaagtttcacctgggctaaattcagcagcatttctgttaggatatttagatggaggttttattttcacacttggattcttgctctgtaccaatatttgcctccttttctgtgactgaactgggtttttctgacatgcctagactcctaataaaggtatttcttccttggtgccttc

SEQ ID NO: 199411 - DNA, 2761 bp, Homo sapiens
  Payload ID: 19343
  Gene Name: VPS33B interacting protein, apical-basolateral polarity regulator, spe-39 homolog
  Uniprot ID: Q9H9C1
  ENST ID: ENST00000343765
  CDS Start-End: 339-1820
agaagggctggtccagcggcggcggaggctggcgctgtcctgagagggagggctctgtgcggaagagtcagggcgacccttgggcgctggagtacgcttgggactggggctgcgagtgagcaccagcgattggttcggaagcggacatttggttcagaacgagcatttaactctgccagggatccgctgggctctgacgactgcggtagatccatggcttcctggacgttcacccgtagagtcatcctagcttaactcttgttccctggtctcagttcacaagcctcacctgtatcttcctggctcggaagataattgaaaccaagtctgacttctcaatgaatcggacaaagggtgatgaggaggagtattggaacagctccaagttcaaggcttttacctttgacgatgaagacgatgagctttcacagttaaaggagtccaagcgggcggtgaacagcctccgagacttcgtggatgatgatgacgatgatgacctggagcgagtcagctggagtggggaacctgtgggaagtatctcatggtccatcagagagactgctggtaatagcggctcaacccacgaggggcgtgaacagctaaagagccgaaacagcttctcctcctatgcacaactacccaagcctacttctacctactccctgagcagcttttttagaggtagaactagacctggaagtttccagtccctttctgatgctctgtcagacacacctgccaaaagctatgctccagagctggggagacccaaaggggagtatagggattacagcaatgactggagccccagtgatacagtgcgacgtctccggaagggcaaggtttgctcactagagagattccgctccttacaggacaaactacaactcctagaagaggcagtaagcatgcatgatggaaacgtcattactgcagttctgattttcctgaagaggacactgagcaaagagatcctcttccgagagctggaggtgcgacaggttgccctgagacatcttattcacttccttaaggaaataggggatcaaaagttgcttttagacctcttcaggttcctagatagaacagaagagcttgcgctatctcattatcgagagcatttgaacattcaggaccctgacaaacgaaaagaatttcttaaaacctgtgttggtttgccattttcagcagaagattccgcacacatacaggaccattacacgctcctggaacgtcagatcattattgaggcaaatgatcgccatctagaatcagcaggacagactgagatcttccgaaagcacccccgcaaagcctccatcctcaacatgccactagtgacaacacttttctactcctgcttctatcactacacagaggctgaggggacattcagcagtcccgtcaacctgaagaagacatttaagatcccagataaacagtatgtgctgacagccctggctgctcgtgccaagcttcgagcctggaatgatgtagatgccctattcaccacaaagaactggctgggctataccaagaagagagcacccattggcttccatcgggttgtcgaaattttgcacaagaacaatgcccctgtgcagatattacaggagtatgtcaatctggtggaagatgtggacacgaagttgaacttagccactaagttcaagtgccatgatgtcgtcattgatacctaccgggacctgaaggatcgtcaacagttgctagcatacaggagtaaggtagataaaggatcagcagaggaggagaagattgatgctcttctcagcagctcgcaaattcgatggaagaattaagtggcattgactaccttgaagcctgcctcatttcctcctctcctgcctgtgaaagcagagagagctcttctttgggagagctgcggcatcacatcgcttgggcccattacccatgggcagtgccagctactcttgacacagataacttcagactgatcttctgtccaaggaacatcatctgaggatcgagatctaaagctttgagtcatgagaatgattctctccacctggtgctcatatgaaggtgggagtgatttctagattgggcccctactgggtaagatctcacttggtctgagaaaagtgactgctccagaaaggaagaggtatgggagtcatagggtggctactgcattccactcagctaattatgatccaggacttggcgctggacattggcagttctgctctgaatgaagtcagaacagaaccaaaatggcctcaggaaggaatgccagtgtttcccaagacctcctggagatgcactcacaccagactgcacagacccctccacattatgccacacatggcctagacgttgtgtttcctcagccattttccctctgctgccccagtttactctgtccaaaaccctaaggttcttctctcacttgaacacagacgaccttgcttgggtgatgagacatcccctttatctcttcctctactgctggccaagacccgtcactttataagaagctcagatgcagcagtgctggagagctctctctttatgcaaaaatctcatttcaccaggagctttcagaagtttcacctgggctaaattcagcagcatttctgttaggatatttagatggaggttttattttcacacttggattcttgctctgtaccaatatttgcctccttttctgtgactgaactgggtttttctgacatgcctagactcctaataaaggtatttcttccttggtgccttc

SEQ ID NO: 199412 - DNA, 1623 bp, Homo sapiens
  Payload ID: 19343
  Gene Name: VPS33B interacting protein, apical-basolateral polarity regulator, spe-39 homolog
  Uniprot ID: Q9H9C1
  ENST ID: ENST00000448935
  CDS Start-End: 93-1427
cttctctaagctgcacagcctgaatagaagggctggtccagcggcggcggaggctggcgctgtcctgagagggagggctctgtgcggaagagatgaatcggacaaagggtgatgaggaggagtattggaacagctccaagttcaaggcttttacctttgacgatgaagacgatgagctttcacagttaaaggagtccaagcgggcggtgaacagcctccgagacttcgtggatgatgatgacgatgatgacctggagcgagtcagctggagtggggaacctgtgggaagtagaactagacctggaagtttccagtccctttctgatgctctgtcagacacacctgccaaaagctatgctccagagctggggagacccaaaggggagtatagggattacagcaatgactggagccccagtgatacagtgcgacgtctccggaagggcaaggtttgctcactagagagattccgctccttacaggacaaactacaactcctagaagaggcagtaagcatgcatgatggaaacgtcattactgcagttctgattttcctgaagaggacactgagcaaagagatcctcttccgagagctggaggtgcgacaggttgccctgagacatcttattcacttccttaaggaaataggggatcaaaagttgcttttagacctcttcaggttcctagatagaacagaagagcttgcgctatctcattatcgagagcatttgaacattcaggaccctgacaaacgaaaagaatttcttaaaacctgtgttggtttgccattttcagcagaagattccgcacacatacaggaccattacacgctcctggaacgtcagatcattattgaggcaaatgatcgccatctagaatcagcaggacagactgagatcttccgaaagcacccccgcaaagcctccatcctcaacatgccactagtgacaacacttttctactcctgcttctatcactacacagaggctgaggggacattcagcagtcccgtcaacctgaagaagacatttaagatcccagataaacagtatgtgctgacagccctggctgctcgtgccaagcttcgagcctggaatgatgtagatgccctattcaccacaaagaactggctgggctataccaagaagagagcacccattggcttccatcgggttgtcgaaattttgcacaagaacaatgcccctgtgcagatattacaggagtatgtcaatctggtggaagatgtggacacgaagttgaacttagccactaagttcaagtgccatgatgtcgtcattgatacctaccgggacctgaaggatcgtcaacagttgctagcatacaggagtaaggtagataaaggatcagcagaggaggagaagattgatgctcttctcagcagctcgcaaattcgatggaagaattaagtggcattgactaccttgaagcctgcctcatttcctcctctcctgcctgtgaaagcagagagagctcttctttgggagagctgcggcatcacatcgcttgggcccattacccatgggcagtgccagctactcttgacacagataacttcagactgatcttctgtccaaggaacatcatctgaggatcgagatctaa

SEQ ID NO: 199413 - DNA, 1832 bp, Homo sapiens
  Payload ID: 19343
  Gene Name: VPS33B interacting protein, apical-basolateral polarity regulator, spe-39 homolog
  ENST ID: ENST00000556412
  CDS Start-End: 171-1730
gaatagaagggctggtccagcggcggcggaggctggcgctgtcctgagagggagggctctgtgcggaagaggtgagggtgtcccaagccccttgggtcgcgtatctggctggatccagcctctccgcatcttgatcttttcccctcttctaggaggcatccctacaccctatgactacaggcctgattctcttctttcagtcagggcgacccttgggcgctggagtacgcttgggactggggctgcgaatgaatcggacaaagggtgatgaggaggagtattggaacagctccaagttcaaggcttttacctttgacgatgaagacgatgagctttcacagttaaaggagtccaagcgggcggtgaacagcctccgagacttcgtggatgatgatgacgatgatgacctggagcgagtcagctggagtggggaacctgtgggaagtatctcatggtccatcagagagactgctggtaatagcggctcaacccacgaggggcgtgaacagctaaagagccgaaacagcttctcctcctatgcacaactacccaagcctacttctacctactccctgagcagcttttttagaggtagaactagacctggaagtttccagtccctttctgatgctctgtcagacacacctgccaaaagctatgctccagagctggggagacccaaaggggagtatagggattacagcaatgactggagccccagtgatacagtgcgacgtctccggaagggcaaggtttgctcactagagagattccgctccttacaggacaaactacaactcctagaagaggcagtaagcatgcatgatggaaacgtcattactgcagttctgattttcctgaagaggacactgagcaaagagatcctcttccgagagctggaggtgcgacaggttgccctgagacatcttattcacttccttaaggaaataggggatcaaaagttgcttttagacctcttcaggttcctagatagaacagaagagcttgcgctatctcattatcgagagcatttgaacattcaggaccctgacaaacgaaaagaatttcttaaaacctgtgttggtttgccattttcagcagaagattccgcacacatacaggaccattacacgctcctggaacgtcagatcattattgaggcaaatgatcgccatctagaatcagcaggacagactgagatcttccgaaagcacccccgcaaagcctccatcctcaacatgccactagtgacaacacttttctactcctgcttctatcactacacagaggctgaggggacattcagcagtcccgtcaacctgaagaagacatttaagatcccagataaacagtatgtgctgacagccctggctgctcgtgccaagcttcgagcctggaatgatgtagatgccctattcaccacaaagaactggctgggctataccaagaagagagcacccattggcttccatcgggttgtcgaaattttgcacaagaacaatgcccctgtgcagatattacaggagtatgtcaatctggtggaagatgtggacacgaagttgaacttagccactaagttcaagtgccatgatgtcgtcattgatacctaccgggacctgaaggatcgtcaacagttgctagcatacaggagtaaggtagataaaggatcagcagaggaggagaagattgatgctcttctcagcagctcgcaaattcgatggaagaattaagtggcattgactaccttgaagcctgcctcatttcctcctctcctgcctgtgaaagcagagagagctcttctttgggagagctgcggcatcacatcgcttggg

SEQ ID NO: 199414 - DNA, 533 bp, Homo sapiens
  Payload ID: 19343
  Gene Name: VPS33B interacting protein, apical-basolateral polarity regulator, spe-39 homolog
  ENST ID: ENST00000557466
  CDS Start-End: 398-533
acagcctgaatagaagggctggtccagcggcggcggaggctggcgctgtcctgagagggagggctctgtgcggaagaggaggcatccctacaccctatgactacaggcctgattctcttctttcagtcagggcgacccttgggcgctggagtacgcttgggactggggctgcgagtgagcaccagcgattggttcggaagcggacatttggttcagaacgagcatttaactctgccagggatccgctgggctctgacgactgcggtagatccatggcttcctggacgttcacccgtagagtcatcctagcttaactcttgttccctggtctcagttcacaagcctcacctgtatcttcctggctcggaagataattgaaaccaagtctgacttctcaatgaatcggacaaagggtgatgaggaggagtattggaacagctccaagttcaaggcttttacctttgacgatgaagacgatgagctttcacagttaaaggagtccaagcgggcggtgaacagcctccgagacttcg

SEQ ID NO: 199415 - DNA, 2934 bp, Homo sapiens
  Payload ID: 19343
  Gene Name: VPS33B interacting protein, apical-basolateral polarity regulator, spe-39 homolog
  Uniprot ID: Q9H9C1
  ENST ID: ENST00000553888
  CDS Start-End: 512-1993
gattattcccttccgcccccttctctaagctgcacagcctgaatagaagggctggtccagcggcggcggaggctggcgctgtcctgagagggagggctctgtgcggaagaggtgagggtgtcccaagccccttgggtcgcgtatctggctggatccagcctctccgcatcttgatcttttcccctcttctaggaggcatccctacaccctatgactacaggcctgattctcttctttcagtcagggcgacccttgggcgctggagtacgcttgggactggggctgcgagtgagcaccagcgattggttcggaagcggacatttggttcagaacgagcatttaactctgccagggatccgctgggctctgacgactgcggtagatccatggcttcctggacgttcacccgtagagtcatcctagcttaactcttgttccctggtctcagttcacaagcctcacctgtatcttcctggctcggaagataattgaaaccaagtctgacttctcaatgaatcggacaaagggtgatgaggaggagtattggaacagctccaagttcaaggcttttacctttgacgatgaagacgatgagctttcacagttaaaggagtccaagcgggcggtgaacagcctccgagacttcgtggatgatgatgacgatgatgacctggagcgagtcagctggagtggggaacctgtgggaagtatctcatggtccatcagagagactgctggtaatagcggctcaacccacgaggggcgtgaacagctaaagagccgaaacagcttctcctcctatgcacaactacccaagcctacttctacctactccctgagcagcttttttagaggtagaactagacctggaagtttccagtccctttctgatgctctgtcagacacacctgccaaaagctatgctccagagctggggagacccaaaggggagtatagggattacagcaatgactggagccccagtgatacagtgcgacgtctccggaagggcaaggtttgctcactagagagattccgctccttacaggacaaactacaactcctagaagaggcagtaagcatgcatgatggaaacgtcattactgcagttctgattttcctgaagaggacactgagcaaagagatcctcttccgagagctggaggtgcgacaggttgccctgagacatcttattcacttccttaaggaaataggggatcaaaagttgcttttagacctcttcaggttcctagatagaacagaagagcttgcgctatctcattatcgagagcatttgaacattcaggaccctgacaaacgaaaagaatttcttaaaacctgtgttggtttgccattttcagcagaagattccgcacacatacaggaccattacacgctcctggaacgtcagatcattattgaggcaaatgatcgccatctagaatcagcaggacagactgagatcttccgaaagcacccccgcaaagcctccatcctcaacatgccactagtgacaacacttttctactcctgcttctatcactacacagaggctgaggggacattcagcagtcccgtcaacctgaagaagacatttaagatcccagataaacagtatgtgctgacagccctggctgctcgtgccaagcttcgagcctggaatgatgtagatgccctattcaccacaaagaactggctgggctataccaagaagagagcacccattggcttccatcgggttgtcgaaattttgcacaagaacaatgcccctgtgcagatattacaggagtatgtcaatctggtggaagatgtggacacgaagttgaacttagccactaagttcaagtgccatgatgtcgtcattgatacctaccgggacctgaaggatcgtcaacagttgctagcatacaggagtaaggtagataaaggatcagcagaggaggagaagattgatgctcttctcagcagctcgcaaattcgatggaagaattaagtggcattgactaccttgaagcctgcctcatttcctcctctcctgcctgtgaaagcagagagagctcttctttgggagagctgcggcatcacatcgcttgggcccattacccatgggcagtgccagctactcttgacacagataacttcagactgatcttctgtccaaggaacatcatctgaggatcgagatctaaagctttgagtcatgagaatgattctctccacctggtgctcatatgaaggtgggagtgatttctagattgggcccctactgggtaagatctcacttggtctgagaaaagtgactgctccagaaaggaagaggtatgggagtcatagggtggctactgcattccactcagctaattatgatccaggacttggcgctggacattggcagttctgctctgaatgaagtcagaacagaaccaaaatggcctcaggaaggaatgccagtgtttcccaagacctcctggagatgcactcacaccagactgcacagacccctccacattatgccacacatggcctagacgttgtgtttcctcagccattttccctctgctgccccagtttactctgtccaaaaccctaaggttcttctctcacttgaacacagacgaccttgcttgggtgatgagacatcccctttatctcttcctctactgctggccaagacccgtcactttataagaagctcagatgcagcagtgctggagagctctctctttatgcaaaaatctcatttcaccaggagctttcagaagtttcacctgggctaaattcagcagcatttctgttaggatatttagatggaggttttattttcacacttggattcttgctctgtaccaatatttgcctccttttctgtgactgaactgggtttttctgacatgcctagactcctaataaaggtatttcttccttggtgccttc

SEQ ID NO: 199416 - DNA, 2562 bp, Homo sapiens
  Payload ID: 19343
  Gene Name: VPS33B interacting protein, apical-basolateral polarity regulator, spe-39 homolog
  Uniprot ID: Q9H9C1
  ENST ID: ENST00000557658
  CDS Start-End: 147-1628
gcggtctcgttattcgtgttttctctccgccctacgattattcccttccgcccccttctctaagctgcacagcctgaatagaagggctggtccagcggcggcggaggctggcgctgtcctgagagggagggctctgtgcggaagagatgaatcggacaaagggtgatgaggaggagtattggaacagctccaagttcaaggcttttacctttgacgatgaagacgatgagctttcacagttaaaggagtccaagcgggcggtgaacagcctccgagacttcgtggatgatgatgacgatgatgacctggagcgagtcagctggagtggggaacctgtgggaagtatctcatggtccatcagagagactgctggtaatagcggctcaacccacgaggggcgtgaacagctaaagagccgaaacagcttctcctcctatgcacaactacccaagcctacttctacctactccctgagcagcttttttagaggtagaactagacctggaagtttccagtccctttctgatgctctgtcagacacacctgccaaaagctatgctccagagctggggagacccaaaggggagtatagggattacagcaatgactggagccccagtgatacagtgcgacgtctccggaagggcaaggtttgctcactagagagattccgctccttacaggacaaactacaactcctagaagaggcagtaagcatgcatgatggaaacgtcattactgcagttctgattttcctgaagaggacactgagcaaagagatcctcttccgagagctggaggtgcgacaggttgccctgagacatcttattcacttccttaaggaaataggggatcaaaagttgcttttagacctcttcaggttcctagatagaacagaagagcttgcgctatctcattatcgagagcatttgaacattcaggaccctgacaaacgaaaagaatttcttaaaacctgtgttggtttgccattttcagcagaagattccgcacacatacaggaccattacacgctcctggaacgtcagatcattattgaggcaaatgatcgccatctagaatcagcaggacagactgagatcttccgaaagcacccccgcaaagcctccatcctcaacatgccactagtgacaacacttttctactcctgcttctatcactacacagaggctgaggggacattcagcagtcccgtcaacctgaagaagacatttaagatcccagataaacagtatgtgctgacagccctggctgctcgtgccaagcttcgagcctggaatgatgtagatgccctattcaccacaaagaactggctgggctataccaagaagagagcacccattggcttccatcgggttgtcgaaattttgcacaagaacaatgcccctgtgcagatattacaggagtatgtcaatctggtggaagatgtggacacgaagttgaacttagccactaagttcaagtgccatgatgtcgtcattgatacctaccgggacctgaaggatcgtcaacagttgctagcatacaggagtaaggtagataaaggatcagcagaggaggagaagattgatgctcttctcagcagctcgcaaattcgatggaagaattaagtggcattgactaccttgaagcctgcctcatttcctcctctcctgcctgtgaaagcagagagagctcttctttgggagagctgcggcatcacatcgcttgggcccattacccatgggcagtgccagctactcttgacacagataacttcagactgatcttctgtccaaggaacatcatctgaggatcgagatctaaagctttgagtcatgagaatgattctctccacctggtgctcatatgaaggtgggagtgatttctagattgggcccctactgggtaagatctcacttggtctgagaaaagtgactgctccagaaaggaagaggtatgggagtcatagggtggctactgcattccactcagctaattatgatccaggacttggcgctggacattggcagttctgctctgaatgaagtcagaacagaaccaaaatggcctcaggaaggaatgccagtgtttcccaagacctcctggagatgcactcacaccagactgcacagacccctccacattatgccacacatggcctagacgttgtgtttcctcagccattttccctctgctgccccagtttactctgtccaaaaccctaaggttcttctctcacttgaacacagacgaccttgcttgggtgatgagacatcccctttatctcttcctctactgctggccaagacccgtcactttataagaagctcagatgcagcagtgctggagagctctctctttatgcaaaaatctcatttcaccaggagctttcagaagtttcacctgggctaaattcagcagcatttctgttaggatatttagatggaggttttattttcacacttggattcttgctctgtaccaatatttgcctccttttctgtgactgaactgggtttttctgacatgcctagactcctaataaaggtatttcttccttgg

SEQ ID NO: 199417 - DNA, 6790 bp, Homo sapiens
  Payload ID: 19344
  Gene Name: VPS35 retromer complex component
  Uniprot ID: Q96QK1
  ENST ID: ENST00000299138
  CDS Start-End: 60-2450
gaccgcgggaggctacgcgcggggcgggtgctgcttgctgcaggctctggggagtcgccatgcctacaacacagcagtcccctcaggatgagcaggaaaagctcttggatgaagccatacaggctgtgaaggtccagtcattccaaatgaagagatgcctggacaaaaacaagcttatggatgctctaaaacatgcttctaatatgcttggtgaactccggacttctatgttatcaccaaagagttactatgaactttatatggccatttctgatgaactgcactacttggaggtctacctgacagatgagtttgctaaaggaaggaaagtggcagatctctacgaacttgtacagtatgctggaaacattatcccaaggctttaccttttgatcacagttggagttgtatatgtcaagtcatttcctcagtccaggaaggatattttgaaagatttggtagaaatgtgccgtggtgtgcaacatcccttgaggggtctgtttcttcgaaattaccttcttcagtgtaccagaaatatcttacctgatgaaggagagccaacagatgaagaaacaactggtgacatcagtgattccatggattttgtactgctcaactttgcagaaatgaacaagctctgggtgcgaatgcagcatcagggacatagccgagatagagaaaaaagagaacgagaaagacaagaactgagaattttagtgggaacaaatttggtgcgcctcagtcagttggaaggtgtaaatgtggaacgttacaaacagattgttttgactggcatattggagcaagttgtaaactgtagggatgctttggctcaagaatatctcatggagtgtattattcaggttttccctgatgaatttcacctccagactttgaatccttttcttcgggcctgtgctgagttacaccagaatgtaaatgtgaagaacataatcattgctttaattgatagattagctttatttgctcaccgtgaagatggacctggaatcccagcggatattaaactttttgatatattttcacagcaggtggctacagtgatacagtctagacaagacatgccttcagaggatgttgtatctttacaagtctctctgattaatcttgccatgaaatgttaccctgatcgtgtggactatgttgataaagttctagaaacaacagtggagatattcaataagctcaaccttgaacatattgctaccagtagtgcagtttcaaaggaactcaccagacttttgaaaataccagttgacacttacaacaatattttaacagtcttgaaattaaaacattttcacccactctttgagtactttgactacgagtccagaaagagcatgagttgttatgtgcttagtaatgttctggattataacacagaaattgtctctcaagaccaggtggattccataatgaatttggtatccacgttgattcaagatcagccagatcaacctgtagaagaccctgatccagaagattttgctgatgagcagagccttgtgggccgcttcattcatctgctgcgctctgaggaccctgaccagcagtacttgattttgaacacagcacgaaaacattttggagctggtggaaatcagcggattcgcttcacactgccacctttggtatttgcagcttaccagctggcttttcgatataaagagaattctaaagtggatgacaaatgggaaaagaaatgccagaagattttttcatttgcccaccagactatcagtgctttgatcaaagcagagctggcagaattgcccttaagactttttcttcaaggagcactagctgctggggaaattggttttgaaaatcatgagacagtcgcatatgaattcatgtcccaggcattttctctgtatgaagatgaaatcagcgattccaaagcacagctagctgccatcaccttgatcattggcacttttgaaaggatgaagtgcttcagtgaagagaatcacgaacctctgaggactcagtgtgcccttgctgcatccaaacttctaaagaaacctgatcagggccgagctgtgagcacctgtgcacatctcttctggtctggcagaaacacggacaaaaatggggaggagcttcacggaggcaagagggtaatggagtgcctaaaaaaagctctaaaaatagcaaatcagtgcatggacccctctctacaagtgcagctttttatagaaattctgaacagatatatctatttttatgaaaaggaaaatgatgcggtaacaattcaggttttaaaccagcttatccaaaagattcgagaagacctcccgaatcttgaatccagtgaagaaacagagcagattaacaaacattttcataacacactggagcatttgcgcttgcggcgggaatcaccagaatccgaggggccaatttatgaaggtctcatcctttaaaaaggaaatagctcaccatactcctttccatgtacatccagtgagggttttattacgctaggtttcccttccatagattgtgcctttcagaaatgctgaggtaggtttcccatttcttacctgtgatgtgttttacccagcacctccggacactcaccttcaggaccttaataaaattattcacttggtaagtgttcaagtctttctgatcaccccaagtagcatgactgatctgcaatttaaaattcctgtgatctgtaaaaaaaaaaaaaaaaaaaaacacaaaacccacaagcacttatcttggctactaatgaagctctccttttttttgtttgtttgtttgcttcattgttgattgtgtattttcttcattcctggggagtactaacccaaaagcgtctgtctcttgttttctagtccagtttgagattaatttagaagaaaggaatactgtatgtgaaattcatcttgggctttcccctaaattgcaagataaggccatgtgtaagattttccctaaaactagaatatattaatgcatgtttgagaattttaaagcaccatggtcaaaaccagaagctatattttgcatatttggactcagccatccattaagaacccatgttgtcctctggacatatttatcaatataattgggttttaaatagtataaaagaaaacttgtgatctatataatttatgtatcaccttcattgtaaatttagcaggaaatgcatcacaattatgatttttttttttgcaccagtgaaacaataaagatgctattaacaattttggagctttttttcccctttcatactatctttaattgataaaaagtactagtagtatggctatagagtttaatagtcattctcatatattcacagagctcacttaactctagttttaagcacttgttgaacaaggcagcatctactcttttagtcatttataccccttttctttcctcaactttaccctgcttttcccaaggcatgatgaattcacataaaccccccaaaggctcaccaccgatactagttacctactatataataaaccatcccaaaacttactgtcttaaaacagcaaacatttatctcacaggtctctggatcaggaatttgggagcagcttagctggtggttctggcaaagagtgtggtgtaaggttgcaaacaagatactggttggggctgcagtcatctgatgctttgactggggctgacttttctgctcactgacctggctgttaggcagaggccccagttcctcttcttgagggcagaggccccagttcctctccttgagggcagaggcctaagttcctttccttgagggcagaggccccagttcctctccttgacggcccttccatagagtgtcctcacagcatggtggctggctttcccctgagtatgaaagcaagaaggaaaccacagtgcctttcagtggcctccctgtggaagtgacatgctcatttttgccttattctgtaagtggggagtcactaagtctagcctatattcaagggtaaggagaattaagctccacctcttaaagggaaaatttatagacattttcaaatgactacatcacttaacccctcaccatctgccctcccattgctagcacttgatgactagcccttgctgggctttacatgaacagatgtttcccaaagttataaaattagtaccactaaaatgtatcaaatgttaagccattctgtggtatgtcatagtccagcaaaccctttctgttctttgtaggtgttagtttaccccgtataaacctgattatggcttgacatgtccatattatttacatgttttgtgaaatacaactggaatagtagaaaagacatgagtcaagaacacttgagttggagagcttggtttgcaagtaaggtaatgtcagtacagtgtgtaaattatctcttattttctgggttgaggtaaacccaattttaaaaataataaaccaacaaaagtaaataaaagtgaaacaaaagcactgctagtatccttaacttacagattttttttgttgaacaaaaactgggtaccagatatagttaggcactgaatctaaaggtgaagaagatcatagcctctagcttcaagaacgttagtctgctgtgaagacagacctgtagttacagaagatggtaagggtttgtgcaggagagcagtgaagaagagctttgagggattggggatggggaagttctgcagagggttgtatgaattctcatggaacatcaagtccaatagtttatttagccttctgaggccagtgctttggcctgcagtcccaggctcctcagacccatgggctgaagcaagttatactcttggctgcctgtagtgaaatagatatttagaaattgacttagcatttaaaaccctttatagcaatttgacagagtaattttatgtctattggatgtaataaatatttggctttgtgctttgtgtgtctgctattccctgttctccttttttagtaatttttattgtgtcttacaaaaaagtacctgtccttaattggggtgtggtggggaatccctcacaggtggatggaaacgctgaaccagggcaggcttggtgctgaatggcattaaattccaagactaggggatagtttggggggacacatctaggaagatgctgtgactggatgagagatgcctgccgtgttagactttcctaccctccctttcctgcctctacccaggaaaccagtgattcttagagtccagatgatcccttctttgcctagaaattcatgtttctgactcatcctcaagcctgaaattggtggtcatcaggttaatgaactgcaaaaacagcccctgctgatagacactgctcaaagagagaggcgtttgagttgatcaggcaccagagcacctagaaggagaatgatgagcacttgtgtacagttcgtgtgcagctctcaaaggcattgagaaatgtgacagacctcaaggaataaatgcaccaccacaggcactgaggggatttaaacacaaagtctaggttccagaggggtcttctgttaacatttgctctctcattcagagacctcaaggtaataagctcaagcagaaaggatttcccaacagaattgtctttgacaatgggaattccagactgcatattgtaaatgaaaggtagagaaatctgtgcaggagaccttcctgtttgctggggtttgtcctatggggatgctgtaggcatggacaacagacactgattcaggtgccagtatctacacatttaccatacacttgaattcccaagagtagtgacttgccttaggtttgattaaagacaaatgtttcctggcttgtggtcttgtattgctgattactccagtagggcaccctgcattgtccaacaaaatggtccatgcttccaaaatctctggagagggactgtatattttatttttttgagacggagtcttgctctgtcacccaagcaggagtgcagtggtgcgatcttggctcactgcaacctccgcctccccagttcaagcaattctcctgcctcagcctcccgagtagctgggattacaggcgtgcaccaccatgcctggctaatttttgtatttttagtacagatgggggtttcaccatgttggccaggctggtcacgaacttctgaccttgtgatccacctggctcagcctcccaaagtgctggaattacaggcatgagccaccttgcccagccagattgtatattgtaccactcattgctgtgttcaggcttgcatcagtagtgtcttcaaataagtaaaatcttaggctgtgacttaaatccattttcacttagagaaatagaaacacaaggaaacctttggacgcttcataactgctgggaaaggggtattatcaattgtgtttgagagtcaaactataaattacttcccaaggttagttctacctatgcccaggaatgaacaaggacagcttaaaggttagaagcaagatggagtcatttgggtctgatctctttcactgtcataatttcctcagttacaatttttgtaaaggtggtttcaaatgctttgctgacctcccataaacaaggatgtgccaattgtaacttcagttctgcaattcaagtctgctcccaaaactaaagtccattgaattgcatactgattgataatgttcattacgagtttatcttcccatgtgcagagcaaagacaagaggagatcagccattcctccacctacccagagacgttgcattggaaaggagccgtatcttctagtatggttttgcaaatgtaaaatgtaaaatctatgcacgctcaca

SEQ ID NO: 199418 - DNA, 4017 bp, Homo sapiens
  Payload ID: 19344
  Gene Name: VPS35 retromer complex component
  ENST ID: ENST00000568784
  CDS Start-End: 15-161
tctggggagtcgccatggtgagtgctgagggggcagtggcacctgggtcgaccctccttgtagcccctgctctctcccaccgccccgcactccagcgagtggagaaggggccccacagaccgttcgggattaagaccagcccgatttggcctgcgggataggggacagcaggaggaaggccgcgggcaggctgatccgggccggggtgggcggcggctcttggctgcggccgttgctgagagacggggcggcctctctgtggggttgacttggcatgtaggctttggggtccatgaaggcctgcggcctcctttaagtggaatcggtcacctgcctaccacgaggggaccggtagtcctaggtctgagcgtctggcccccggggcgcgtggaggccctgagactcggaggtggcgccgggacccgcccagatgttgcgtttctacctttgtgcctagttgtgctcggccgtccccacgccctcctggaggggtcgcagtgattccttggcctttcttggcctcatacccgccttcggctgcagtgtttgtcagcgagttctggggacctgcttacatgaatttcctggaaggactcaggctgtcttctaatcctgacggtcgcaaaggagactgattgtttactttagcatttgtgcattgggcgcaccttgcctcttttgtctcgccattgataaaatccaagtatttgacttgctggaagcagtacttctccttagggcccgtctatgacggcagcaaatcgtggtgtggctgttggccggtaaacttgaacttcctcaaaatgtgaatctttgtgtctggttcccacaaagcctacaacacagcagtcccctcaggatgagcaggaaaagctcttggatgaagccatacaggctgtgaaggtccagtcattccaaatgaagagatgcctggacaaaaacaagcttatggatgctctaaaacatgcttctaatatgcttggtgaactccggacttctatgttatcaccaaagagttactatgaactttatatggccatttctgatgaactgcactacttggaggtctacctgacagatgagtttgctaaaggaaggaaagtggcagatctctacgaacttgtacagtatgctggaaacattatcccaaggctttaccttttgatcacagttggagttgtatatgtcaagtcatttcctcagtccaggaaggatattttgaaagatttggtagaaatgtgccgtggtgtgcaacatcccttgaggggtctgtttcttcgaaattaccttcttcagtgtaccagaaatatcttacctgatgaaggagagccaacagatgaagaaacaactggtgacatcagtgattccatggattttgtactgctcaactttgcagaaatgaacaagctctgggtgcgaatgcagcatcagggacatagccgagatagagaaaaaagagaacgagaaagacaagaactgagaattttagtgggaacaaatttggtgcgcctcagtcagttggaaggtgtaaatgtggaacgttacaaacagattgttttgactggcatattggagcaagttgtaaactgtagggatgctttggctcaagaatatctcatggagtgtattattcaggttttccctgatgaatttcacctccagactttgaatccttttcttcgggcctgtgctgagttacaccagaatgtaaatgtgaagaacataatcattgctttaattgatagattagctttatttgctcaccgtgaagatggacctggaatcccagcggatattaaactttttgatatattttcacagcaggtggctacagtgatacagtctagacaagacatgccttcagaggatgttgtatctttacaagtctctctgattaatcttgccatgaaatgttaccctgatcgtgtggactatgttgataaagttctagaaacaacagtggagatattcaataagctcaaccttgaacatattgctaccagtagtgcagtttcaaaggaactcaccagacttttgaaaataccagttgacacttacaacaatattttaacagtcttgaaattaaaacattttcacccactctttgagtactttgactacgagtccagaaagagcatgagttgttatgtgcttagtaatgttctggattataacacagaaattgtctctcaagaccaggtggattccataatgaatttggtatccacgttgattcaagatcagccagatcaacctgtagaagaccctgatccagaagattttgctgatgagcagagccttgtgggccgcttcattcatctgctgcgctctgaggaccctgaccagcagtacttgattttgaacacagcacgaaaacattttggagctggtggaaatcagcggattcgcttcacactgccacctttggtatttgcagcttaccagctggcttttcgatataaagagaattctaaagtggatgacaaatgggaaaagaaatgccagaagattttttcatttgcccaccagactatcagtgctttgatcaaagcagagctggcagaattgcccttaagactttttcttcaaggagcactagctgctggggaaattggttttgaaaatcatgagacagtcgcatatgaattcatgtcccaggcattttctctgtatgaagatgaaatcagcgattccaaagcacagctagctgccatcaccttgatcattggcacttttgaaaggatgaagtgcttcagtgaagagaatcacgaacctctgaggactcagtgtgcccttgctgcatccaaacttctaaagaaacctgatcagggccgagctgtgagcacctgtgcacatctcttctggtctggcagaaacacggacaaaaatggggaggagcttcacggaggcaagagggtaatggagtgcctaaaaaaagctctaaaaatagcaaatcagtgcatggacccctctctacaagtgcagctttttatagaaattctgaacagatatatctatttttatgaaaaggaaaatgatgcggtaacaattcaggttttaaaccagcttatccaaaagattcgagaagacctcccgaatcttgaatccagtgaagaaacagagcagattaacaaacattttcataacacactggagcatttgcgcttgcggcgggaatcaccagaatccgaggggccaatttatgaaggtctcatcctttaaaaaggaaatagctcaccatactcctttccatgtacatccagtgagggttttattacgctaggtttcccttccatagattgtgcctttcagaaatgctgaggtaggtttcccatttcttacctgtgatgtgttttacccagcacctccggacactcaccttcaggaccttaataaaattattcacttggtaagtgttcaagtctttctgatcaccccaagtagcatgactgatctgcaatttaaaattcctgtgatctgtaaaaaaaaaaaaaaaaaaaaacacaaaacccacaagcacttatcttggctactaatgaagctctccttttttttgtttgtttgtttgcttcattgttgattgtgtattttcttcattcctggggagtactaacccaaaagcgtctgtctcttgttttctagtccagtttgagattaatttagaagaaaggaatactgtatgtgaaattcatcttgggctttcccctaaattgcaagataaggccatgtgtaagattttccctaaaactagaatatattaatgcatgtttgagaattttaaagcaccatggtcaaaaccagaagctatattttgcatatttggactcagccatccattaagaacccatgttgtcctctggacatatttatcaatataattgggttttaaatagtataaaagaaaacttgtgatctatataatttatgtatcaccttcattgtaaatttagcaggaaatgcatcacaattatgatttttttttttgcaccagtgaaacaataaagatgctattaacaa

SEQ ID NO: 199419 - DNA, 589 bp, Homo sapiens
  Payload ID: 19344
  Gene Name: VPS35 retromer complex component
  ENST ID: ENST00000561713
  CDS Start-End: 62-205
atgaccgcgggaggctacgcgcggggcgggtgctgcttgctgcaggctctggggagtcgccatgcctacaacacagcagtcccctcaggatgagcaggaaaagctcttggatgaagccatacaggctgtgaaggtccagtcattccaaatgaagagatgcctgtgtttcctctatctcaaggaattgcttgcatttctgagttaagtggaacatatgggcattgtgagggcttgaagaatgcaagaggaaagcaaacttacatggatagtcatttcagacagctctgaagagtctttaacccatgacaaagccatgtcaggatagtatcttccttcacctgaatcagtatgccagttctcttgattgcaggacaaaaacaagcttatggatgctctaaaacatgcttctaatatgcttggtgaactccggacttctatgttatcaccaaagagttactatgaactttatatggccatttctgatgaactgcactacttggaggtctacctgacagatgagtttgctaaaggaaggaaagtggcagatctctacgaacttgtacagtatgctggaaacattatcccaagg

SEQ ID NO: 199420 - DNA, 697 bp, Homo sapiens
  Payload ID: 19344
  Gene Name: VPS35 retromer complex component
  ENST ID: ENST00000568612
  CDS Start-End: 19-144
aggctctggggagtcgccatgcctacaacacagcagtcccctcaggatgagcaggaaaagctcttggatgaagccatacaggctgtgaaggtccagtcattccaaatgaagagatgcctggaattgcttgcatttctgagttaagtggaacatatgggcattgtgagggcttgaagaatgcaagaggaaagcaaacttacatggatagtcatttcagacagctctgaagagtctttaacccatgacaaagccatgtcaggatagtatcttccttcacctgaatcagtatgccagttctcttgattgcaggacaaaaacaagcttatggatgctctaaaacatgcttctaatatgcttggtgaactccggacttctatgttatcaccaaagagttactatgaactttatatggccatttctgatgaactgcactacttggaggtctacctgacagatgagtttgctaaaggaaggaaagtggcagatctctacgaacttgtacagtatgctggaaacattatcccaaggctttaccttttgatcacagttggagttgtatatgtcaagtcatttcctcagtccaggaaggatattttgaaagatttggtagaaatgtgccgtggtgtgcaacatcccttgaggggtctgtttcttcgaaattaccttcttcagtgtaccagaaatatcttacctgatg

SEQ ID NO: 199421 - DNA, 1193 bp, Homo sapiens
  Payload ID: 19345
  Gene Name: VPS50 EARP/GARPII complex subunit
  Uniprot ID: Q96JG6
  ENST ID: ENST00000251739
  CDS Start-End: 129-1112
aggataccctgggtcggctcctccacgtgaccacccactatggcttcctagtgtcagggccagctgtgtagtggctcggtgtgatttgttagctctttgaggcagggtaccctcctcaggatttcgatatgcaaaaaatcaaatctctcatgacccgacagggtctgaaaagccctcaagaaagcctcagtgatcttggtgccatagagagtctccgggtccctggaaaggaagaattcagggaacttcgagaacagccaagtgaccctcaagctgaacaagagcttattaatagtattgaacaagtatatttttctgtggattcatttgatattgttaaatatgagctggagaagcttccacctgttctcaatttgcaagaattagaggcgtatagagacaaattgaaacaacagcaagctgcagtatctaaaaaagtggcagatttaatccttgaaaaacagcctgcttatgtaaaggaacttgaaagagttacctcattgcagacaggtcttcaattagctgctgttatctgtacaaatgggagaagacacttgaatattgcaaaggaaggttttactcaagctagtttaggccttcttgcaaatcaaaggaaacgtcagttgctgattggacttctgaaatctctgagaactataaaaacattgcaaagaacagatgtacggttaagtgaaatgctggaggaggaagattatccaggagctattcagttgtgccttgaatgtcaaaaagctgccagcacttttaaacattacagttgtataagtgaactgaattcaaagctgcaagatactttggaacagattgaggaacagctggacgtagctctttccaaaatctgcaagaattttgacattaaccattataccaaggttcaacaagcttatcgacttcttggaaaaacacagacagcaatggatcaacttcatatgcacttcacccaagccattcacaacaccgtgtttcaagttgttcttggttatgtggaactatgtgcaggaaacacagacacaaaattccaaaagctgcaatataaggatctctgtacagtatgtagtgacttaattactattcatatatctctcctttagattttaaatttatatttcctttatcttggtacatacctatttgaaaatgctactaaaataaaaataaatctttgccaaaaa

SEQ ID NO: 199422 - DNA, 3613 bp, Homo sapiens
  Payload ID: 19345
  Gene Name: VPS50 EARP/GARPII complex subunit
  Uniprot ID: Q96JG6
  ENST ID: ENST00000305866
  CDS Start-End: 129-3023
aggataccctgggtcggctcctccacgtgaccacccactatggcttcctagtgtcagggccagctgtgtagtggctcggtgtgatttgttagctctttgaggcagggtaccctcctcaggatttcgatatgcaaaaaatcaaatctctcatgacccgacagggtctgaaaagccctcaagaaagcctcagtgatcttggtgccatagagagtctccgggtccctggaaaggaagaattcagggaacttcgagaacagccaagtgaccctcaagctgaacaagagcttattaatagtattgaacaagtatatttttctgtggattcatttgatattgttaaatatgagctggagaagcttccacctgttctcaatttgcaagaattagaggcgtatagagacaaattgaaacaacagcaagctgcagtatctaaaaaagtggcagatttaatccttgaaaaacagcctgcttatgtaaaggaacttgaaagagttacctcattgcagacaggtcttcaattagctgctgttatctgtacaaatgggagaagacacttgaatattgcaaaggaaggttttactcaagctagtttaggccttcttgcaaatcaaaggaaacgtcagttgctgattggacttctgaaatctctgagaactataaaaacattgcaaagaacagatgtacggttaagtgaaatgctggaggaggaagattatccaggagctattcagttgtgccttgaatgtcaaaaagctgccagcacttttaaacattacagttgtataagtgaactgaattcaaagctgcaagatactttggaacagattgaggaacagctggacgtagctctttccaaaatctgcaagaattttgacattaaccattataccaaggttcaacaagcttatcgacttcttggaaaaacacagacagcaatggatcaacttcatatgcacttcacccaagccattcacaacaccgtgtttcaagttgttcttggttatgtggaactatgtgcaggaaacacagacacaaaattccaaaagctgcaatataaggatctctgtacacatgttacaccagacagctatattccatgccttgcagacctgtgcaaagcactatgggaagttatgctcagctattataggactatggaatggcatgaaaagcatgacaatgaggatactgcttcagcttctgaagggagtaatatgataggtactgaagaaactaattttgatcgtggctacataaaaaagaaattagaacatggacttacacgaatatggcaggatgttcagctaaaagtaaaaacctacttgcttggaactgatttgtctatattcaaatatgatgatttcatctttgttttggatataatcagcaggttgatgcaagttggagaagaattttgtggtagcaagtctgaagttttacaggaatctattagaaaacaaagtgtcaattatttcaagaattaccatagaacacggctcgatgaactgagaatgttcttagagaatgagacttgggaactttgtcctgttaagtcaaatttcagcatcttgcaacttcatgaatttaaattcatggaacagtctcgctccccatcagtttcacctagtaaacagccagtctcaacttcttcaaaaacagtgaccttgtttgagcagtactgtagtggtgggaatccatttgaaattcaggccaaccacaaagatgaagaaacagaagatgtcttagcttctaatgggtatgaatctgatgaacaagaaaagagtgcctatcaagagtatgacagtgacagtgatgttcctgaggaactcaaacgagactatgtggatgagcagacaggagatggtcctgtgaaaagtgtttctcgggaaactctaaaaagcaggaagaaatcagattacagtctaaataaagtgaatgcacctatcttaacaaatacaacattgaacgtcataagacttgttggaaaatatatgcagatgatgaacattcttaagccaattgcctttgatgttattcatttcatgtctcaactatttgattattacttgtatgcaatatataccttttttggtcggaatgattcattggaatcaactggactcggccttagtagtagtagactaagaacaactctaaacagaatacaagaaagccttattgatctagaagtttcagctgatcctactgccacactcacagcagcagaagaaagaaaggagaaggtgccaagtccacacctcagtcacctagtggttttgacatctggggatacgctgtatgggttggcagaaagagtggtagccacggaatccttggtattcttggctgaacagtttgagttccttcagccacatctggatgctgtgatgcctgcagtcaaaaagccctttcttcagcagttctattctcagacagtctcaaccgccagtgaactacggaaaccaatttactggattgtagctggtaaagcccttgattatgaacagatgctgcttctcatggctaatgtgaaatgggatgtaaaagaaattatgtcacagcacaacatatatgtagatgcactattaaaggaatttgagcagtttaacaggaggctaaatgaagtttctaagagagttcgcatacccttgcctgtgtctaatatactttgggaacattgtatacgattggctaatcgaactattgtagaaggatatgccaatgtcaagaaatgcagtaatgagggtcgtgccctgatgcaattggattttcaacagtttttaatgaaacttgaaaaactaacagatattagacccattcctgataaagaatttgtagaaacttatattaaagcttattacctaactgagaatgacatggaacggtggatcaaagagcacagggaatattcaacgaagcagctgaccaatctggtgaatgtttgcctgggatcccatatcaataagaaagcaagacaaaaacttctagcagctatagatgatatagacagacctaaaagataatgaacacagctctctttcctcaatggcattgatcctcactcaacatatatgacctgaaagccagtttttttatgcacttctgacaactatctgctaagaaaactttgtgcatgtttttttgactggaaagtggaaaatattgaaatgtgtgtggtgttctcatgacttttatatgctgtggtctcttcaacttttggtctcatttgttgtaatctgaaatgatgttgccgccttgtcataacaatggttatgtgactacagttatacattttacagaagaatgtaccataagtatataattagaagaacagtggcttaatatatgtatgggaagtttatggaaaatgaagttggcacttttctaccctctgagcttggttcttaataagcataatgtgagggtgaatatgtagtatctcctaattatgagcactgcatgagaattaaaaaacacatgtaagtaaaatagttgaaaaatcagtatgttctctgtttttaaaatgtcaaagtttatgtcagggttaatttagttataacaaagtgatcataatggtgaaatttaataaatatactctagtatgatcagccta

SEQ ID NO: 199423 - DNA, 554 bp, Homo sapiens
  Payload ID: 19345
  Gene Name: VPS50 EARP/GARPII complex subunit
  ENST ID: ENST00000443443
  CDS Start-End: 1-466
acggaaaccaatttactggattgtagctggtaaagcccttgattatgaacagatgctgcttctcatggctaatgtgaaatgggatgtaaaagaaattatgtcacagcacaacatatatgtagatgcactattaaaggaatttgagcagtttaacaggaggctaaatgaagtttctaagagagttcgcatacccttgcctgtgtctaatatactttgggaacattgtatacgattggctaatcgaactattgtagaaggatatgccaatgtcaagaaatgcagtaatgagggtcgtgccctgatgcaattggattttcaacagtttttaatgaaacttgaaaaactaacagatattagacccattcctgataaagaatttgtagaaacttatattaaagcttattacctaactgagaatgacatggaacggtggatcaaagagcacagggtgagagctggaaaatagttaattaagtttttattcctttttctttgtgctgttcttgttgggtgtgttatttaattcaaaatcatgagagtgaaatataaagaaa

SEQ ID NO: 199424 - DNA, 538 bp, Homo sapiens
  Payload ID: 19345
  Gene Name: VPS50 EARP/GARPII complex subunit
  ENST ID: ENST00000438395
  CDS Start-End: 103-216
gtgaccacccactatggcttcctagtgtcagggccagctgtgtagtggctcggtgtgatttgttagctctttgaggcagggtaccctcctcaggatttcgatatgcaaaaaatcaaatctctcatgacccgacagggtctgaaaagccctcaagaaagcctcagtgatcttggtgccatagagagtctccgggtccctggaaagttagagccctaacgtgatgttaactttggaagaattcagggaacttcgagaacagccaagtgaccctcaagctgaacaagagcttattaatagtattgaacaagtatatttttctgtggattcatttgatattgttaaatatgagctggagaagcttccacctgttctcaatttgcaagaattagaggcgtatagagacaaattgaaacaacagcaagctgcagtatctaaaaaagtggcagatttaatccttgaaaaacagcctgcttatgtaaaggaacttgaaagagttacctcattgcagacaggtcttcaattagctgctgttatctgt

SEQ ID NO: 199425 - DNA, 667 bp, Homo sapiens
  Payload ID: 19345
  Gene Name: VPS50 EARP/GARPII complex subunit
  ENST ID: ENST00000458530
  CDS Start-End: 100-667
accacccactatggcttcctagtgtcagggccagctgtgtagtggctcggtgtgatttgttagctctttgaggcagggtaccctcctcaggatttcgatatgcaaaaaatcaaatctctcatgacccgacagggtctgaaaagccctcaagaaagcctcagtgatcttggtgccatagagagtctccgggtccctggaaaggaagaattcagggaacttcgagaacagccaagtgaccctcaagctgaacaagagcttattaatagtattgaacaagtatatttttctgtggattcatttgatattgttaaatatgagctggagcttccacctgttctcaatttgcaagaattagaggcgtatagagacaaattgaaacaacagcaagctgcagtatctaaaaaagtggcagatttaatccttgaaaaacagcctgcttatgtaaaggaacttgaaagagttacctcattgcagacaggtcttcaattagctgctgttatctgtacaaatgggagaagacacttgaatattgcaaaggaaggttttactcaagctagtttaggccttcttgcaaatcaaaggaaacgtcagttgctgattggacttctgaaatctctgagaactataaaaacattgcaaagaacagatgtacggttaagtgaaatgc

SEQ ID NO: 199426 - DNA, 603 bp, Homo sapiens
  Payload ID: 19345
  Gene Name: VPS50 EARP/GARPII complex subunit
  ENST ID: ENST00000436177
  CDS Start-End: 93-212
actatggcttcctagtgtcagggccagctgtgtagtggctcggtgtgatttgttagctctttgaggcagggtaccctcctcaggatttcgatatgcaaaaaatcaaatctctcatgacccgacagggtctgaaaagccctcaagaaagcctcagtgatcttggtgccatagagagtctccgggtccctggaaaggtattgagctacacgtgaagaattcagggaacttcgagaacagccaagtgaccctcaagctgaacaagagcttattaatagtattgaacaagtatatttttctgtggattcatttgatattgttaaatatgagctggagaagcttccacctgttctcaatttgcaagaattagaggcgtatagagacaaattgaaacaacagcaagctgcagtatctaaaaaagtggcagatttaatccttgaaaaacagcctgcttatgtaaaggaacttgaaagagttacctcattgcagacaggtcttcaattagctgctgttatctgtacaaatgggagaagacacttgaatattgcaaaggaaggttttactcaagctagtttaggccttcttgcaaatcaaaggaaacgtcag

SEQ ID NO: 199427 - DNA, 1898 bp, Homo sapiens
  Payload ID: 19345
  Gene Name: VPS50 EARP/GARPII complex subunit
  ENST ID: ENST00000458707
  CDS Start-End: 1-1409
aacattacagttgtataagtgaactgaattcaaagctgcaagatactttggaacagattgaggaacagctggacgtagctctttccaaaatctgcaagaattttgacattaaccattataccaaggttcaacaagcttatcgacttcttggaaaaacacagacagcaatggatcaacttcatatgcacttcacccaagccattcacaacaccgtgtttcaagttgttcttggttatgtggaactatgtgcaggaaacacagacacaaaattccaaaagctgcaatataaggatctctgtacacatgttacaccagacagctatattccatgccttgcagacctgtgcaaagcactatgggaagttatgctcagctattataggactatggaatggcatgaaaagcatgacaatgaggatactgcttcagcttctgaagggagtaatatgataggtactgaagaaactaattttgatcgtggctacataaaaaagaaattagaacatggacttacacgaatatggcaggatgttcagctaaaagtaaaaacctacttgcttggaactgatttgtctatattcaaatatgatgatttcatctttgttttggatataatcagcaggttgatgcaagttggagaagaattttgtggtagcaagtctgaagttttacaggaatctattagaaaacaaagtgtcaattatttcaagaattaccatagaacacggctcgatgaactgagaatgttcttagagaatgagacttgggaactttgtcctgttaagtcaaatttcagcatcttgcaacttcatgaatttaaattcatggaacagtctcgctccccatcagtttcacctagtaaacagccagtctcaacttcttcaaaaacagtgaccttgtttgagcagtactgtagtggtgggaatccatttgaaattcaggccaaccacaaagatgaagaaacagaagatgtcttagcttctaatgggtatgaatctgatgaacaagaaaagagtgcctatcaagagtatgacagtgacagtgatgttcctgaggaactcaaacgagactatgtggatgagcagacaggagatggtcctgtgaaaagtgtttctcgggaaactctaaaaagcaggaagaaatcagattacagtctaaataaagtgaatgcacctatcttaacaaatacaacattgaacgtcataagacttgttgacggagtctcactctgttgcctaggctggagtacagtggcgcatctccactcactgcaagctccgcctcccgggttcaagccattctcctgcctcagcctcccgcgtagctgggactacaggcgcccgccaccacgcccggctaattttttgtattttcttttttttagtagagacggggtttcaccgtgttagcggggatggtctctatctatctcctgacctcgtgatccgcccgcctcggcctcccaaagtgctgggattacaggcatgaaccaccgctcccagcttatcatttcttttagagaggaaccttaagggtttctattttgttttatgggtaaattctagcagcctacacctctaactgctggagaggagaggggaatggtggtggtggggaatgcagactgttacagtttgtcccatatgtgaacctgtagcttgatcgtttttcagccccgtttctgactcctgcagttccagcttgattctaagtagttactgtcctagtgaatagcttccacctcctttttggccctcttatggttttattggcttatgtttttccatcaacgtgttcccatctactgtctgtcatctacaacagacgttttgagatgtcaaatgttttgagctgctggctgcttgtttttgtaaataaagttttattggcacacccat

SEQ ID NO: 199428 - DNA, 3474 bp, Homo sapiens
  Payload ID: 19345
  Gene Name: VPS50 EARP/GARPII complex subunit
  ENST ID: ENST00000441602
  CDS Start-End: 103-222
gtgaccacccactatggcttcctagtgtcagggccagctgtgtagtggctcggtgtgatttgttagctctttgaggcagggtaccctcctcaggatttcgatatgcaaaaaatcaaatctctcatgacccgacagggtctgaaaagccctcaagaaagcctcagtgatcttggtgccatagagagtctccgggtccctggaaaggtattgagctacacgtaagcttccacctgttctcaatttgcaagaattagaggcgtatagagacaaattgaaacaacagcaagctgcagtatctaaaaaagtggcagatttaatccttgaaaaacagcctgcttatgtaaaggaacttgaaagagttacctcattgcagacaggtcttcaattagctgctgttatctgtacaaatgggagaagacacttgaatattgcaaaggaaggttttactcaagctagtttaggccttcttgcaaatcaaaggaaacgtcagttgctgattggacttctgaaatctctgagaactataaaaacattgcaaagaacagatgtacggttaagtgaaatgctggaggaggaagattatccaggagctattcagttgtgccttgaatgtcaaaaagctgccagcacttttaaacattacagttgtataagtgaactgaattcaaagctgcaagatactttggaacagattgaggaacagctggacgtagctctttccaaaatctgcaagaattttgacattaaccattataccaaggttcaacaagcttatcgacttcttggaaaaacacagacagcaatggatcaacttcatatgcacttcacccaagccattcacaacaccgtgtttcaagttgttcttggttatgtggaactatgtgcaggaaacacagacacaaaattccaaaagctgcaatataaggatctctgtacacatgttacaccagacagctatattccatgccttgcagacctgtgcaaagcactatgggaagttatgctcagctattataggactatggaatggcatgaaaagcatgacaatgaggatactgcttcagcttctgaagggagtaatatgataggtactgaagaaactaattttgatcgtggctacataaaaaagaaattagaacatggacttacacgaatatggcaggatgttcagctaaaagtaaaaacctacttgcttggaactgatttgtctatattcaaatatgatgatttcatctttgttttggatataatcagcaggttgatgcaagttggagaagaattttgtggtagcaagtctgaagttttacaggaatctattagaaaacaaagtgtcaattatttcaagaattaccatagaacacggctcgatgaactgagaatgttcttagagaatgagacttgggaactttgtcctgttaagtcaaatttcagcatcttgcaacttcatgaatttaaattcatggaacagtctcgctccccatcagtttcacctagtaaacagccagtctcaacttcttcaaaaacagtgaccttgtttgagcagtactgtagtggtgggaatccatttgaaattcaggccaaccacaaagatgaagaaacagaagatgtcttagcttctaatgggtatgaatctgatgaacaagaaaagagtgcctatcaagagtatgacagtgacagtgatgttcctgaggaactcaaacgagactatgtggatgagcagacaggagatggtcctgtgaaaagtgtttctcgggaaactctaaaaagcaggaagaaatcagattacagtctaaataaagtgaatgcacctatcttaacaaatacaacattgaacgtcataagacttgttggaaaatatatgcagatgatgaacattcttaagccaattgcctttgatgttattcatttcatgtctcaactatttgattattacttgtatgcaatatataccttttttggtcggaatgattcattggaatcaactggactcggccttagtagtagtagactaagaacaactctaaacagaatacaagaaagccttattgatctagaagtttcagctgatcctactgccacactcacagcagcagaagaaagaaaggagaaggtgccaagtccacacctcagtcacctagtggttttgacatctggggatacgctgtatgggttggcagaaagagtggtagccacggaatccttggtattcttggctgaacagtttgagttccttcagccacatctggatgctgtgatgcctgcagtcaaaaagccctttcttcagcagttctattctcagtctcaaccgccagtgaactacggaaaccaatttactggattgtagctggtaaagcccttgattatgaacagatgctgcttctcatggctaatgtgaaatgggatgtaaaagaaattatgtcacagcacaacatatatgtagatgcactattaaaggaatttgagcagtttaacaggaggctaaatgaagtttctaagagagttcgcatacccttgcctgtgtctaatatactttgggaacattgtatacgattggctaatcgaactattgtagaaggatatgccaatgtcaagaaatgcagtaatgagggtcgtgccctgatgcaattggattttcaacagtttttaatgaaacttgaaaaactaacagatattagacccattcctgataaagaatttgtagaaacttatattaaagcttattacctaactgagaatgacatggaacggtggatcaaagagcacagggaatattcaacgaagcagctgaccaatctggtgaatgtttgcctgggatcccatatcaataagaaagcaagacaaaaacttctagcagctatagatgatatagacagacctaaaagataatgaacacagctctctttcctcaatggcattgatcctcactcaacatatatgacctgaaagccagtttttttatgcacttctgacaactatctgctaagaaaactttgtgcatgtttttttgactggaaagtggaaaatattgaaatgtgtgtggtgttctcatgacttttatatgctgtggtctcttcaacttttggtctcatttgttgtaatctgaaatgatgttgccgccttgtcataacaatggttatgtgactacagttatacattttacagaagaatgtaccataagtatataattagaagaacagtggcttaatatatgtatgggaagtttatggaaaatgaagttggcacttttctaccctctgagcttggttcttaataagcataatgtgagggtgaatatgtagtatctcctaattatgagcactgcatgagaattaaaaaacacatgtaagtaaaatagttgaaaaatcagtatgttctctgtttttaaaatgtcaaagtttatgtcagggttaatttagttataacaaagtgatcataatggtgaaatttaataaatatactctagtatgatcagcc

SEQ ID NO: 199429 - DNA, 5736 bp, Homo sapiens
  Payload ID: 19345
  Gene Name: VPS50 EARP/GARPII complex subunit
  Uniprot ID: Q96JG6
  ENST ID: ENST00000544910
  CDS Start-End: 247-3051
aggataccctgggtcggctcctccacgtgaccacccactatggcttcctagtgtcagggccagctgtgtagtggctcggtgtgatttgttagctctttgaggcagggtaccctcctcaggatttcgatatgcaaaaaatcaaatctctcatgacccgacagggtctgaaaagccctcaagaaagcctcagtgatcttggtgccatagagagtctccgggtccctggaaagttagagccctaacgtgatgttaactttggaagaattcagggaacttcgagaacagccaagtgaccctcaagctgaacaagagcttattaatagtattgaacaagtatatttttctgtggattcatttgatattgttaaatatgagctggagaagcttccacctgttctcaatttgcaagaattagaggcgtatagagacaaattgaaacaacagcaagctgcagtatctaaaaaagtggcagatttaatccttgaaaaacagcctgcttatgtaaaggaacttgaaagagttacctcattgcagacaggtcttcaattagctgctgttatctgtacaaatgggagaagacacttgaatattgcaaaggaaggttttactcaagctagtttaggccttcttgcaaatcaaaggaaacgtcagttgctgattggacttctgaaatctctgagaactataaaaacattgcaaagaacagatgtacggttaagtgaaatgctggaggaggaagattatccaggagctattcagttgtgccttgaatgtcaaaaagctgccagcacttttaaacattacagttgtataagtgaactgaattcaaagctgcaagatactttggaacagattgaggaacagctggacgtagctctttccaaaatctgcaagaattttgacattaaccattataccaaggttcaacaagcttatcgacttcttggaaaaacacagacagcaatggatcaacttcatatgcacttcacccaagccattcacaacaccgtgtttcaagttgttcttggttatgtggaactatgtgcaggaaacacagacacaaaattccaaaagctgcaatataaggatctctgtacacatgttacaccagacagctatattccatgccttgcagacctgtgcaaagcactatgggaagttatgctcagctattataggactatggaatggcatgaaaagcatgacaatgaggatactgcttcagcttctgaagggagtaatatgataggtactgaagaaactaattttgatcgtggctacataaaaaagaaattagaacatggacttacacgaatatggcaggatgttcagctaaaagtaaaaacctacttgcttggaactgatttgtctatattcaaatatgatgatttcatctttgttttggatataatcagcaggttgatgcaagttggagaagaattttgtggtagcaagtctgaagttttacaggaatctattagaaaacaaagtgtcaattatttcaagaattaccatagaacacggctcgatgaactgagaatgttcttagagaatgagacttgggaactttgtcctgttaagtcaaatttcagcatcttgcaacttcatgaatttaaattcatggaacagtctcgctccccatcagtttcacctagtaaacagccagtctcaacttcttcaaaaacagtgaccttgtttgagcagtactgtagtggtgggaatccatttgaaattcaggccaaccacaaagatgaagaaacagaagatgtcttagcttctaatgggtatgaatctgatgaacaagaaaagagtgcctatcaagagtatgacagtgacagtgatgttcctgaggaactcaaacgagactatgtggatgagcagacaggagatggtcctgtgaaaagtgtttctcgggaaactctaaaaagcaggaagaaatcagattacagtctaaataaagtgaatgcacctatcttaacaaatacaacattgaacgtcataagacttgttggaaaatatatgcagatgatgaacattcttaagccaattgcctttgatgttattcatttcatgtctcaactatttgattattacttgtatgcaatatataccttttttggtcggaatgattcattggaatcaactggactcggccttagtagtagtagactaagaacaactctaaacagaatacaagaaagccttattgatctagaagtttcagctgatcctactgccacactcacagcagcagaagaaagaaaggagaaggtgccaagtccacacctcagtcacctagtggttttgacatctggggatacgctgtatgggttggcagaaagagtggtagccacggaatccttggtattcttggctgaacagtttgagttccttcagccacatctggatgctgtgatgcctgcagtcaaaaagccctttcttcagcagttctattctcagacagtctcaaccgccagtgaactacggaaaccaatttactggattgtagctggtaaagcccttgattatgaacagatgctgcttctcatggctaatgtgaaatgggatgtaaaagaaattatgtcacagcacaacatatatgtagatgcactattaaaggaatttgagcagtttaacaggaggctaaatgaagtttctaagagagttcgcatacccttgcctgtgtctaatatactttgggaacattgtatacgattggctaatcgaactattgtagaaggatatgccaatgtcaagaaatgcagtaatgagggtcgtgccctgatgcaattggattttcaacagtttttaatgaaacttgaaaaactaacagatattagacccattcctgataaagaatttgtagaaacttatattaaagcttattacctaactgagaatgacatggaacggtggatcaaagagcacagggaatattcaacgaagcagctgaccaatctggtgaatgtttgcctgggatcccatatcaataagaaagcaagacaaaaacttctagcagctatagatgatatagacagacctaaaagataatgaacacagctctctttcctcaatggcattgatcctcactcaacatatatgacctgaaagccagtttttttatgcacttctgacaactatctgctaagaaaactttgtgcatgtttttttgactggaaagtggaaaatattgaaatgtgtgtggtgttctcatgacttttatatgctgtggtctcttcaacttttggtctcatttgttgtaatctgaaatgatgttgccgccttgtcataacaatggttatgtgactacagttatacattttacagaagaatgtaccataagtatataattagaagaacagtggcttaatatatgtatgggaagtttatggaaaatgaagttggcacttttctaccctctgagcttggttcttaataagcataatgtgagggtgaatatgtagtatctcctaattatgagcactgcatgagaattaaaaaacacatgtaagtaaaatagttgaaaaatcagtatgttctctgtttttaaaatgtcaaagtttatgtcagggttaatttagttataacaaagtgatcataatggtgaaatttaataaatatactctagtatgatcagcctatgtgagactacattttgattttttgtgtggcatgcagatgtcatgaactatagtgcagcttttagtgtgttctaattttaattgttttatatcctgaaaccaatggtgaaaagtaatttcattgagggtaccttttcaatgcctgagtagcatacagaatcatgattatgagactttcttttatctttctttataaaaatatgtggtttttttgttgaaagttttggtctctttaaattcagattttgtcttaggacagtaaaacccaggttgactgactcaggaaacagttgtctgctagtcactcataaatgtacggtcatatgttcactcttcttaaatatccaccttttataacacaaatgtaaaatagtatcagtctagccaatgatgaactctggaatccacttagtcttcagtaagtatgtgctgttcctctaaactttgccctgaagccagggatcttctcctaatgtatgtgacataaaaatccattttccatgtactcttgccaactgtctgataaggaattttgtgtgtgttctttctgactggagagtggaggacatctaagcttgtgtggcattggtccaatgattgccatgcatgacctgtaacatcaacagctcacagaatcctaaggaatcatgtgagaaacaggccttgggtcttatgagtcttctgggacctaaggtgataaaatggatggcacagaatggcatgtgatcaagcatggaggtgataaggaaacaattgctactctgtgtccatcagtccctgcgatgtctgtaaatgcacagtgtaatgtgaagcactttcagaatatgtttgtgtgtgtctgtatgctgagtgttttcttttcatcctctcatgtcggagttcatttactgtcaatttaaaactttcctcttgtaaaaaggtatgagtttggtgccattatgatttggttgtggctagattatatacttgtgaagtagattctgcctgtagccattatttatatgcagccacttgaagaaaacaaacatgagataagcttggtccttgagtttaaatggcatatttagctgggcacataaagagctaatcaatcttttaaaatttgcagttgatgaagagctgcttatttttctcttctacatggattttatagttggtttcctttaatttctactttagttggccctagataatatgaacaggaatcacctgcctggtagagcccagtgttttccaaggtaataggaattgatacaaaagaattacttatcttgttagagactcgaccatgcaatctgacagaccttttaacctacccttactttgctttctccatcttcaaaatgaaatggtggatctttttaatgctttttgaaaaaggttttttttttttttttttttcattaaaaggtagcttaataagtgctagctagcatcaaaacagtaacaggaggtttgagtcatgaagttacctaatcacaagagagttaccagacatttctcaaatactttatacagtaatattgagttataaccatgtaacattttatgaaactaattttcagataaatacaattgaaaagctgagaatgtaaatggaattatacgtgttccaaaaactatcattaccaaaaatttattatttttgagtctaaactttccttaactttgacattttccatgaaagtttcctgtagaatttaccatgggagcatggtaaattagcattccctgagaaagaatgatcatttctacaaatacattgtcttgcatttaaaaatgctaggggggcacatagcaattcaaatgaactagtttgctttggtttataaaaccaacagagattttgtaagttcactttaactaataaactcatttacacaacttattaaatgaatttctcttgaaaccagggccatatggtattttatcatatctttaaataaaatttcgaaatttctatttagctgagtgctaaagtgaaactttgttagattaaatagctttttcttaactcaccaaaaagtagtaaaaggcttgtaattcaattcaccttgtaagcatagttgtcttttgtaataaaaaactagatctg

SEQ ID NO: 199430 - DNA, 2748 bp, Homo sapiens
  Payload ID: 19346
  Gene Name: VPS9 domain containing 1
  Uniprot ID: Q9Y2B5
  ENST ID: ENST00000389386
  CDS Start-End: 126-2021
gcggccgcgtcccttcctgcggtccgctgctcgggcggctccagcaccagcgccggctgcgttccgggcctccggtcgcccgtccagcccctcggctaccgccgccgcctcccccgctcggcgccatggccgctgcggccggggacggcacggtgaagccgctgcagagcgccatgaagcttgccaacggggccatcgagctggacaccggcaaccggccccgggaggcatacacggaatacctgaggagcatccactatatctcccaggtgttactagaagaagtggaaaccactaaagaagctggggaaactgtgccccccgacacctccaagatgctgaagctagcacagcagtgtctggagagggcccagtcgacggccgccaagcttgggaaaacacgcctgaagccaaccatgcctgcagctgctcccattccccagcctgccggccgacaccgccgtgtatactccgatgaaggaggaaagctctctccttttctgccacccgagatcttccagaagcttcagggggcagagtcacaaagctgtaagaaagagctgacgccactggaggaggcctccctgcagaatcagaagctgaaggctgcgtatgaggcccgaatggcgcggctagaccccagccaggccatgcagaagacatccctgaccctctctctacagcggcagatgatggagaacctagtgattgccaaagcccgggaggagacactccagagaaagatggaggagcgccggctgcggctccaggaggccgccaacaggaggttttgcagccaagtcgccctgaccccggaggaacgggagcagcgggccctttacgccgccatcctggagtacgaacaggaccatgactggccgaagcactggaaggccaagctcaagaggaatccgggggacctgtcactcgtgaccagcctggtctcacacctgctcagcctccccgaccacccgatcgcgcagctcctgaggcggctgcagtgctccgtgtacagcgccctgtatcccgccgtgagcagagcagccgcgccagccccaggctgctgccccccgacccccaaccccggaagccgacggctgcggccctcgcagagcctccattgcatgctgtccccgcccgagcccagcgcagccccgcggccccaggacagtccccccacgcccccactccaacccggccccgtggggtctccctcacccctgggggacaccgcatctggattgccagacaaggacagctcgttcgaggacctggagcagttcctggggacgtctgagcggcagggccggggccgtggggtacagccggagccccagctgcagcagctgaagaccgcggtggaggagatccacaatgccgtagacaggctgctctcgctgacccttctggccttcgaaggcctaaacacagctgcctccaaggaccgctgcctggcctgcattgaggaaccctttttctccccgctgtggcctctgctgctggccctgtacaggagcgtgcaccgagcccgggaggctgccctgagcaggagcatggagctctacaggaatgcaccccccaccgccattggcatccccaccaagctcctcccccagaaccctgaggccaagggggccactggctacccctactgcgcggcggcccaggagctcggactgctggtcctggagagctgcccccagaagaagctggagtgcatagtgcggaccctgcggatcatctgtgtctgtgcggaagactactgccccaccccagaggccacaccccaggccgggcccccgcccatcgctgcagctgccattggtgccgatgacctgctgcccatcctgtccttcgtggtgctgaggagcggcctccctcagctggtgtcggagtgcgcggccctggaggagttcatccacgaggggtacctgatcggagaggagggctactgcctcacatcactgcagagtgccctgagctacgtggagctgctgccccggggaggcctggccaagtagtacagctagagcccagggtccctgcagggcctggcctcgcctcccagggctgtctctcctacacctggagccatgggatctactgaggaccatcctggagcctcacgctgctctgcacatggtgggggcttgtccactgtggtgtgctctccagctcttcaccttcctcacctcacatctgaccctggagcttggggttggcacctctgccccgacagaatggggctgaatcagctccaggaggaaccaggccctgctctcctgtgtaggcctcagagaggccaagaagggaagctttgggcttcggtgggtgcaggctcagcgatgaacatctggctggggcagctcctggggagcatcagggaagagggggccatgagccggccagcagtggagacggcagtccagtttctctcccctctgacccctagaaggggagttgtagccccatgaactagtttcttgtctgggtcaggaacaagggccggctggggcctggggtgcagctggtgtcagggtatgctgtttgctgatgggcagggacacccctgcagggtctcgggctctgagcccaggacattccctgccccttactcaccttggctgtgggctgtgaacattccgggaccctgggcatcttatctaggtccgtgcagcccaagggtcagccctcttgactgtcacatgctgcccccacccagcctaaaataaagagctcactgctgtg

SEQ ID NO: 199431 - DNA, 2791 bp, Homo sapiens
  Payload ID: 19346
  Gene Name: VPS9 domain containing 1
  ENST ID: ENST00000561976
  CDS Start-End: 379-2064
atgaggtccagctcgtccctggctctctctctctctcaggtcctgatgtcttttccaagtctggagagcagcgatgctgcctgtgccctgcgcagaaaaccgtgttccggctgcagctaaccaccgcaggctcaatgtctctgggtgtatctcagagataagcaggtggtggtgttccttgcttatcccacaagggcacctggccggaataatggagtcacttccctccactggcctgaccccactctttctctttcctggacacaggaggcatacacggaatacctgaggagcatccactatatctcccaggtgttactagaagaagtggaaaccactaaagaagctggggaaactgtgccccccgacacctccaagatgctgaagctagcacagcagtgtctggagagggcccagtcgacggccgccaagcttgggaaaacacgcctgaagccaaccatgcctgcagctgctcccattccccagcctgccggccgacaccgccgtgtatactccgatgaaggaggaaagctctctccttttctgccacccgagatcttccagaagcttcagggggcagagtcacaaagctgtaagaaagagctgacgccactggaggaggcctccctgcagaatcagaagctgaaggctgcgtatgaggcccgaatggcgcggctagaccccagccaggccatgcagaagacatccctgaccctctctctacagcggcagatgatggagaacctagtgattgccaaagcccgggaggagacactccagagaaagatggaggagcgccggctgcggctccaggaggccgccaacaggaggttttgcagccaagtcgccctgaccccggaggaacgggagcagcgggccctttacgccgccatcctggagtacgaacaggaccatgactggccgaagcactggaaggccaagctcaagaggaatccgggggacctgtcactcgtgaccagcctggtctcacacctgctcagcctccccgaccacccgatcgcgcagctcctgaggcggctgcagtgctccgtgtacagcgccctgtatcccgccgtgagcagagcagccgcgccagccccaggctgctgccccccgacccccaaccccggaagccgacggctgcggccctcgcagagcctccattgcatgctgtccccgcccgagcccagcgcagccccgcggccccaggacagtccccccacgcccccactccaacccggccccgtggggtctccctcacccctgggggacaccgcatctggattgccagacaaggacagctcgttcgaggacctggagcagttcctggggacgtctgagcggcagggccggggccgtggggtacagccggagccccagctgcagcagctgaagaccgcggtggaggagatccacaatgccgtagacaggctgctctcgctgacccttctggccttcgaaggcctaaacacagctgcctccaaggaccgctgcctggcctgcattgaggaaccctttttctccccgctgtggcctctgctgctggccctgtacaggagcgtgcaccgagcccgggaggctgccctgagcaggagcatggagctctacaggaatgcaccccccaccgccattggcatccccaccaagctcctcccccagaaccctgaggccaagggggccactggctacccctactgcgcggcggcccaggagctcggactgctggtcctggagagctgcccccagaagaagctggagtgcatagtgcggaccctgcggatcatctgtgtctgtgcggaagactactgccccaccccagaggccacaccccaggccgggcccccgcccatcgctgcagctgccattggtgccgatgacctgctgcccatcctgtccttcgtggtgctgaggagcggcctccctcagctggtgtcggagtgcgcggccctggaggagttcatccacgaggggtacctgatcggagaggagggctactgcctcacatcactgcagagtgccctgagctacgtggagctgctgccccggggaggcctggccaagtagtacagctagagcccagggtccctgcagggcctggcctcgcctcccagggctgtctctcctacacctggagccatgggatctactgaggaccatcctggagcctcacgctgctctgcacatggtgggggcttgtccactgtggtgtgctctccagctcttcaccttcctcacctcacatctgaccctggagcttggggttggcacctctgccccgacagaatggggctgaatcagctccaggaggaaccaggccctgctctcctgtgtaggcctcagagaggccaagaagggaagctttgggcttcggtgggtgcaggctcagcgatgaacatctggctggggcagctcctggggagcatcagggaagagggggccatgagccggccagcagtggagacggcagtccagtttctctcccctctgacccctagaaggggagttgtagccccatgaactagtttcttgtctgggtcaggaacaagggccggctggggcctggggtgcagctggtgtcagggtatgctgtttgctgatgggcagggacacccctgcagggtctcgggctctgagcccaggacattccctgccccttactcaccttggctgtgggctgtgaacattccgggaccctgggcatcttatctaggtccgtgcagcccaagggtcagccctcttgactgtcacatgctgcccccacccagcctaaaataaagagctcactgctgtg

SEQ ID NO: 199432 - DNA, 459 bp, Homo sapiens
  Payload ID: 19346
  Gene Name: VPS9 domain containing 1
  ENST ID: ENST00000563798
  CDS Start-End: 25-183
ccgccgcctcccccgctcggcgccatggccgctgcggccggggacggcacggtgaagccgctgcagagcgccatgaagcttgccaacggggccatcgagctggacaccggcaaccggccccggagagctgacgccactggaggaggcctccctgcagaatcagaagctgaaggctgcgtatgaggcccgaatggcgcggctagaccccagccaggccatgcagaagacatccctgaccctctctctacagcggcagatgatggagaacctagtgattgccaaagcccgggaggagacactccagagaaagatggaggagcgccggctgcggctccaggaggccgccaacaggaggttttgcagccaagtcgccctgaccccggaggaacgggagcagcgggccctttacgccgccatcctggagtacgaacaggaccatgactggccgaagcactggaa

SEQ ID NO: 199433 - DNA, 775 bp, Homo sapiens
  Payload ID: 19346
  Gene Name: VPS9 domain containing 1
  ENST ID: ENST00000565023
  CDS Start-End: 1-698
cggagccccagctgcagcagctgaagaccgcggtggaggagatccacaatgccgtagcagacaggctgctctcgctgacccttctggccttcgaaggcctaaacacagctgcctccaaggaccgctgcctggcctgcattgaggaaccctttttctccccgctgtggcctctgctgctggccctgtacaggagcgtgcaccgagcccgggaggctgccctgagcaggagcatggagctctacaggaatgcaccccccaccgccattggcatccccaccaagctcctcccccagaaccctgaggccaagggggccactggctacccctactgcgcggcggcccaggagctcggactgctggtcctggagagctgcccccagaagaagctggagtgcatagtgcggaccctgcggatcatctgtgtctgtgcggaagactactgccccaccccagaggccacaccccaggccgggcccccgcccatcgctgcagctgccattggtgccgatgacctgctgcccatcctgtccttcgtggtgctgaggagcggcctccctcagctggtgtcggagtgcgcggccctggaggagttcatccacgaggggtacctgatcggagaggagggctactgcctcacatcactgcagagtgccctgagctacgtggagctgctgccccggggaggcctggccaagtagtacagctagagcccagggtccctgcagggcctggcctcgcctcccagggctgtctctcctacacctggagccatggg

SEQ ID NO: 199434 - DNA, 2788 bp, Homo sapiens
  Payload ID: 19346
  Gene Name: VPS9 domain containing 1
  ENST ID: ENST00000614968
  CDS Start-End: 74-1390
atgaggtccagctcgtccctggctctctctctctctcaggtcctgatgtcttttccaagtctggagagcagcgatgctgctgtgccctgcgcagaaaaccgtgttccggctgcagctaaccaccgcagctcaatgtctctgggtgtatctcagagataagcaggtggtggtgttccttgcttatcccacaagggcacctggccggaataatggagtcacttccctccactggcctgaccccactctttctctttcctggacacaggaggcatacacggaatacctgaggagcatccactatatctcccaggtgttactagaagaagtggaaaccactaaagaagctggggaaactgtgccccccgacacctccaagatgctgaagctagcacagcagtgtctggagagggcccagtcgacggccgccaagcttgggaaaacacgcctgaagccaaccatgcctgcagctgctcccattccccagcctgccggccgacaccgccgtgtatactccgatgaaggaggaaagctctctccttttctgccacccgagatcttccagaagcttcagggggcagagtcacaaagctgtaagaaagagctgacgccactggaggaggcctccctgcagaatcagaagctgaaggctgcgtatgaggcccgaatggcgcggctagaccccagccaggccatgcagaagacatccctgaccctctctctacagcggcagatgatggagaacctagtgattgccaaagcccgggaggagacactccagagaaagatggaggagcgccggctgcggctccaggaggccgccaacaggaggttttgcagccaagtcgccctgaccccggaggaacgggagcagcgggccctttacgccgccatcctggagtacgaacaggaccatgactggccgaagcactggaaggccaagctcaagaggaatccgggggacctgtcactcgtgaccagcctggtctcacacctgctcagcctccccgaccacccgatcgcgcagctcctgaggcggctgcagtgctccgtgtacagcgccctgtatcccgccgtgagcagagcagccgcgccagccccaggctgctgccccccgacccccaaccccggaagccgacggctgcggccctcgcagagcctccattgcatgctgtccccgcccgagcccagcgcagccccgcggccccaggacagtccccccacgcccccactccaacccggcccgtggggtctccctcacccctgggggacaccgcatctggattgccagacaaggacagctcgttcgaggacctggagcagttcctggggacgtctgagcggcagggccggggccgtggggtacagccggagccccagctgcagcagctgaagaccgcggtggaggagatccacaatgccgtagacaggctgctctcgctgacccttctggccttcgaaggcctaaacacagctgcctccaaggaccgctgcctggcctgcattgaggaaccctttttctccccgctgtggcctctgctgctggccctgtacaggagcgtgcaccgagcccgggaggctgccctgagcaggagcatggagctctacaggaatgcaccccccaccgccattggcatccccaccaagctcctcccccagaaccctgaggccaagggggccactggctacccctactgcgcggcggcccaggagctcggactgctggtcctggagagctgcccccagaagaagctggagtgcatagtgcggaccctgcggatcatctgtgtctgtgcggaagactactgccccaccccagaggccacaccccaggccgggcccccgcccatcgctgcagctgccattggtgccgatgacctgctgcccatcctgtccttcgtggtgctgaggagcggcctccctcagctggtgtcggagtgcgcggccctggaggagttcatccacgaggggtacctgatcggagaggagggctactgcctcacatcactgcagagtgccctgagctacgtggagctgctgccccggggaggcctggccaagtagtacagctagagcccagggtccctgcagggcctggcctcgcctcccagggctgtctctcctacacctggagccatgggatctactgaggaccatcctggagcctcacgctgctctgcacatggtgggggcttgtccactgtggtgtgctctccagctcttcaccttcctcacctcacatctgaccctggagcttggggttggcacctctgccccgacagaatggggctgaatcagctccaggaggaaccaggccctgctctcctgtgtaggcctcagagaggccaagaagggaagctttgggcttcggtgggtgcaggctcagcgatgaacatctggctggggcagctcctggggagcatcagggaagagggggccatgagccggccagcagtggagacggcagtccagtttctctcccctctgacccctagaaggggagttgtagccccatgaactagtttcttgtctgggtcaggaacaagggccggctggggcctggggtgcagctggtgtcagggtatgctgtttgctgatgggcagggacacccctgcagggtctcgggctctgagcccaggacattccctgccccttactcaccttggctgtgggctgtgaacattccgggaccctgggcatcttatctaggtccgtgcagcccaagggtcagccctcttgactgtcacatgctgcccccacccagcctaaaataaagagctcactgctgtg

SEQ ID NO: 199435 - DNA, 2880 bp, Homo sapiens
  Payload ID: 19347
  Gene Name: v-ral simian leukemia viral oncogene homolog A (ras related)
  Uniprot ID: P11233
  ENST ID: ENST00000005257
  CDS Start-End: 381-1001
aggcccatgatcaccctcctctcagcccacggacaggaagtcgctccccagctgccccgccccgctccccagcgccccggaagtgatctgtggcggctgctgcagagccgccaggaggagggtggatctccccagagcaaagcgtcggagtcctcctcctccttctcctcctcctcctcctcctcctccagccgcccaggctcccccgccacccgtcagactcctccttcgaccgctcccggcgcggggccttccaggcgacaaggaccgagtaccctccggccggagccacgcagccgcggcttccggagccctcggggcggcggactggctcgcggtgcagattcttcttaatcctttggtgaaaactgagacacaaaatggctgcaaataagcccaagggtcagaattctttggctttacacaaagtcatcatggtgggcagtggtggcgtgggcaagtcagctctgactctacagttcatgtacgatgagtttgtggaggactatgagcctaccaaagcagacagctatcggaagaaggtagtgctagatggggaggaagtccagatcgatatcttagatacagctgggcaggaggactacgctgcaattagagacaactacttccgaagtggggaggggttcctctgtgttttctctattacagaaatggaatcctttgcagctacagctgacttcagggagcagattttaagagtaaaagaagatgagaatgttccatttctactggttggtaacaaatcagatttagaagataaaagacaggtttctgtagaagaggcaaaaaacagagctgagcagtggaatgttaactacgtggaaacatctgctaaaacacgagctaatgttgacaaggtattttttgatttaatgagagaaattcgagcgagaaagatggaagacagcaaagaaaagaatggaaaaaagaagaggaaaagtttagccaagagaatcagagaaagatgctgcattttataatcaaagcccaaactcctttcttatcttgaccatactaataaatataatttataagcattgccattgaaggcttaattgactgaaattactttaacattttggaaattgttgtatatcactaaaagcatgaattggaactgcaatgaaagtcaaatttactttaaaaagaaattaatatggcttcaccaagaagcaaagttcaacttatttcataattgcctacatttatcatggtcctgaatgtagcgtgtaagcttgtgtttcttgggcagtctttcttgaaattgaagaggtgaaatgggggtggggagtgggaggaaaggtgacttcctctggtgtttattataaagcttaaattttatatcattttaaaatgtcttggtcttctactgccttgaaaaatgacaattgtgaacatgatagttaaactaccactttttttaaccattattatgcaaaatttagaagaaaagttattggcatggttgttgcatatagttaaactgagagtaattcatctgtgaatctgctttaattacctggtgagtaacttagaaaagtggtgtaaacttgtacatggaattttttgaatatgccttaatttagaaactgaaaaatatctggttatatcattctgggtgtgttcttactgacaccaggggtccgctgccccatgtgtcctggtgagaaaatatatgcctggcacagcttttgtatagaaaattcttgagaagtaactgtccgctagaagtctgtccaaatttaaaatgtgtgccatattctggttcttgaaaataagattccagagctctttgatcgcttttaataaactgcaagttcattttaaatgaagggccagcatatatacttgcaagataattttcagctgcaaggattcagcaccagttatgtttgaatgaaccctccttttctctgagattctggtccctggaaatccctttctgctagtggtgagcatgtaagtgttaagtttttaatctgggagcagggcataggaagaaaatgtcagtagtgctaatgcattttgcactagaacgcttcgggaaaatattcatgcttgccatctgttcatttctaaatttatattcataaagttacagtttgatacaggaattattaggagtaattcttttctgtttctgtttataatgaagaacactgtagctacattttcagaagttaacatcaagccatcaaacctgggtatagtgcagaaaacgtggcacacactgaccacacattaggctgtgtcaccattgtgtggtgtacctgctggaagaattctagcatgctacttggggacataatttcagtgggaaatatgccactgaccgattttttttttttcctctttgcagtggggctaggacagttgattcaacaaagtatttttttcttttttctcagtcctaatttgaacaggtcaaagatgtgttcaggcattccaggtaacaggtgtgtatgtaaagttaaaaataggctttttaggaactcactctttagatatttacatccagcttctcatgttaaatatttgtccttaaagggtttgagatgtacatctttcatttcgtatttctcataggctatgccatgtgcggaattcaagttaccaatgtaacactggccagcgggcccagcaatctccatgtgtacttattacagtcttatttaaccaggggtcctaaccactaacattgtgactttgctttgagacctttcctctcctgggtactgaggtgctatgaagccaactgacaaagatgcatcacgtgtcttaggctgatgccactacccgatttgtttatttgcaatttgagccatttaaagaccaataaacttccttttttaaaatgtt

SEQ ID NO: 199436 - DNA, 882 bp, Homo sapiens
  Payload ID: 19347
  Gene Name: v-ral simian leukemia viral oncogene homolog A (ras related)
  ENST ID: ENST00000436179
  CDS Start-End: 580-882
ggtgtgtccgggcggcggcgggccgaggccctgacgcgggttcgggctgccgagattgcacatcccacgttctgcccggggacgagctgcgagatgagcccggctggaatccggggcaccgcgttcgccgctgtggggcgagtgagcccccgagagtgagcggctgcggagaggtcccctgcgcccggcagccggtctcagttggcctcgtccgaaggtcaccccgcacctttcgtccacggcgcccaagttcccgcccgggcggtgcccgcgacctggggcaacccgctgccgccgcagtccccgcgcctcactccacccctctcccctccttccctttctttccactccttgcctgtgctagagccgctgctttttaagcatctccgccagggttttttgtttgtttgttttgtttgtttgtgtttttttttttttttgccagttaaaggaatggtttttcagacttaaagtcattagactctccgcactgaactgaatacctggccttgggcgcttgcacagctttagcccattttcagattcttcttaatcctttggtgaaaactgagacacaaaatggctgcaaataagcccaagggtcagaattctttggctttacacaaagtcatcatggtgggcagtggtggcgtgggcaagtcagctctgactctacagttcatgtacgatgagtttgtggaggactatgagcctaccaaagcagacagctatcggaagaaggtagtgctagatggggaggaagtccagatcgatatcttagatacagctgggcaggaggactacgctgcaattagagacaactacttccgaagtggggaggggttcctctgtgttttctctattacagaaatggaatccttt

SEQ ID NO: 199437 - DNA, 768 bp, Homo sapiens
  Payload ID: 19347
  Gene Name: v-ral simian leukemia viral oncogene homolog A (ras related)
  ENST ID: ENST00000434466
  CDS Start-End: 1-494
agggtcagaattctttggctttacacaaagtcatcatggtgggcagtggtggcgtgggcaagtcagctctgactctacagttcatgtacgatgagtttgtggaggactatgagcctaccaaagcagacagctatcggaagaaggtagtgctagatggggaggaagtccagatcgatatcttagatacagctgggcaggaggactacgctgcaattagagacaactacttccgaagtggggaggggttcctctgtgttttctctattacagaaatggaatcctttgcagctacagctgacttcagggagcagattttaagagtaaaagaagatgagaatgttccatttctactggttggtaacaaatcagatttagaagataaaagacaggtttctgtagaagaggcaaaaaacagagctgagcagtggaatgttaactacgtggaaacatctgctaaaacacgagctaatgttgacaagagtggcccttcctgaagaccagatgtggaacacctgcaagtacatttcatcccactgccctagaccagctccagtatctagaaagactgctcactgggctgaggtattttttgatttaatgagagaaattcgagcgagaaagatggaagacagcaaagaaaagaatggaaaaaagaagaggaaaagtttagccaagagaatcagagaaagatgctgcattttataatcaaagcccaaactcctttcttatcttgaccatactaataaatataatttataagcattgcca

SEQ ID NO: 199438 - DNA, 2344 bp, Homo sapiens
  Payload ID: 19348
  Gene Name: v-ral simian leukemia viral oncogene homolog B
  Uniprot ID: P11234
  ENST ID: ENST00000272519
  CDS Start-End: 271-891
gtggcttccgaggagagggcaagaacggaagcgagggcgcgctctcgagaggaggggttgcctaggcgacgccggaggcgcgctcggggggtgggaaagcgagcccggcagctcaatgacaaatcggtggaggacggctggggtccggccccgggagggggcggggcgcgtttaagagctgcgggccgggtgcggacggcggaggcggcgggactggtccctgctcttcagtgggtcatctgtgtgtcacagcctcagaagaccagcgagatggctgccaacaagagtaagggccagagctccttggccctccacaaggtgatcatggttggcagcggaggcgttggcaagtcagccctgacgcttcagttcatgtatgacgagtttgtagaagactatgaacctaccaaagctgacagttatagaaagaaagtggttcttgatggggaagaagttcagatagatattctggacaccgctgggcaagaggactacgcagccattcgagataactactttcggagtggggaagggtttcttcttgtgttctcaatcacagaacatgaatcctttacagcaactgccgaattcagggaacagattctccgtgtgaaggctgaagaagataaaattccactgctcgtcgtgggaaacaagtctgacctagaggagcggaggcaggtgcctgtggaggaggccaggagtaaagccgaagagtggggcgtgcagtacgtggagacgtcagcgaagacccgggccaacgtggacaaggtgttctttgacctaatgagagaaatcagaacaaagaagatgtcagaaaacaaagacaagaatggcaagaaaagcagcaagaacaagaaaagttttaaagaaagatgttgcttactatgagtgtcaaggtgacggatgaagccagctgctcctaaggacacagggctgggttggtaaagagaaggctatggttgacttcttgcttgtgcttcccactctccccgacttcattcactcaaacttctttaaatggggaaaaatatttgtgactctgtggctggcagaagaaataagcccatgcaagtggaagggctgctttgtcaggaggttgtggaatttctttcttctccccttcttccctcccaaaagcttagctatgtataaagtgccacagataggaaacagctgttaattacaaagagaaagaattgtcatagcatcttattttgttcctagttttataacattaccatccttcgttttgaactacagatgttgtagtgggttttggaggagggagtggagtaagatgccctcccacttttatcagtttagtagtagtactgagaaaaatcccttcagctctaagaacactgaaaaatccaccgattttttgggtaagcttcttggcaataccctgtggatctgaaacagctaaaaaaatgaatttgaattgcgccagataggtcaataccaagcttctgattcctcctcacatatgaaaagtgaaagttgtgagttgttttcctcttatttaaacattggcctattataatctgtgttggttatttttctcctgtaagcatcctgatttttctgtaggaacttttctttggcagaccaagtgaagactcaggaatggtgtgcattataaatgacacacattgccacttgtgtagatatttttaagttctttggctaagtcctctcctaactgcctgtcctctggttaggcccctccctctccactagtggtgaatgcatgtgtctgtctgatcagcatcactgcacacggaggtctagtgagcctcttgctaagtgtcacacacactcttcccaaagacgtgatgagttaaagttgtattctgaaatcatgaagccagagcctgtgccagaccttctgctacctctcatagaattgctctgtaattctaaatttaaaattagaagtagagagagataagccatcgcccctttgcctctgagaattggctgctgtttctaatataattattttctaagatagccagatagttagaaaaagattttcattgatgacatatctttaaactttcttgcatcagtattctaaattgagcaaactgaaagattttcatcaggaaaggagcactgtgggaagagcccagtattcacattttttccccatttttcagaagcgacatttcatatataggtgccaaaagtgaatcggggtgcggagagtgggaaccttttgaatttatgattgtcacagagatggtagaaattatgatctgactggaaaacaatcctgtatcccctcccaaagaatcatgggctttttttttgaataaaaaagcagacaaatagactt

SEQ ID NO: 199439 - DNA, 767 bp, Homo sapiens
  Payload ID: 19348
  Gene Name: v-ral simian leukemia viral oncogene homolog B
  ENST ID: ENST00000431732
  CDS Start-End: 179-319
gggaaagcgagcccggcagctcaatgacaaatcggtggaggacggctggggtccggccccgggagggggcggggcgcgtttaagagctgcgggccgggtgcggacggcggaggcggcgggactggtccctgctcttcagtgggtcatctgtgtgtcacagcctcagaagaccagcgagatggctgccaacaagagtaagggccagagctccttggccctccacaaggtgatcatggttggcagcggaggcgttggcaagtcagccctgacgcttcagttcatgtatgacgaggaatgtttcaaaatcattggcatatgacaagaaaaagtatacagcaaacaaaaaagtagaaggtattctagagtttgtagaagactatgaacctaccaaagctgacagttatagaaagaaagtggttcttgatggggaagaagttcagatagatattctggacaccgctgggcaagaggactacgcagccattcgagataactactttcggagtggggaagggtttcttcttgtgttctcaatcacagaacatgaatcctttacagcaactgccgaattcagggaacagattctccgtgtgaaggctgaagaagataaaattccactgctcgtcgtgggaaacaagtctgacctagaggagcggaggcaggtgcctgtggaggaggccaggagtaaagccgaagagtggggcgtgcagtacgtggagacgtcagcgaagacccgggccaacgtggacaaggtgttctttgaccta

SEQ ID NO: 199440 - DNA, 981 bp, Homo sapiens
  Payload ID: 19348
  Gene Name: v-ral simian leukemia viral oncogene homolog B
  ENST ID: ENST00000412383
  CDS Start-End: 481-981
ctcccgctcgggaccgtccacttcctcagtcctccggccgcggcttgggcagggtcagggctgggaagtgttgcaaaaacttaactgccctcggaacttgcacgcgccgtgaactgggcggtgttcctaaagggcttcggtttgctggttttgttttggtcctgtcttgcaaatgagcataaagttgtttctcccccagcctcctcccctttcctttctgataggggccagcggcgaaggggcttctaaggggaagcgcctggactgggcatcgccgtcccggttcttgccgcctgtgggagtgtgaggttaaccgtgctcggtgcagggttgcggggcgcggagcttgctgcgtccacactgcttgtgtgagcagtgtcctctctgtgctcatttccaacgagaaacgttggaactttggtgttcttatcagctcttcagtgggtcatctgtgtgtcacagcctcagaagaccagcgagatggctgccaacaagagtaagggccagagctccttggccctccacaaggtgatcatggttggcagcggaggcgttggcaagtcagccctgacgcttcagttcatgtatgacgagtttgtagaagactatgaacctaccaaagctgacagttatagaaagaaagtggttcttgatggggaagaagttcagatagatattctggacaccgctgggcaagaggactacgcagccattcgagataactactttcggagtggggaagggtttcttcttgtgttctcaatcacagaacatgaatcctttacagcaactgccgaattcagggaacagattctccgtgtgaaggctgaagaagataaaattccactgctcgtcgtgggaaacaagtctgacctagaggagcggaggcaggtgcctgtggaggaggccaggagtaaagccgaagagtggggcgtgcagtacgtggagacgtcagcgaagacccgggccaacgtggacaag

SEQ ID NO: 199441 - DNA, 558 bp, Homo sapiens
  Payload ID: 19348
  Gene Name: v-ral simian leukemia viral oncogene homolog B
  ENST ID: ENST00000447591
  CDS Start-End: 44-558
gatttcagcagcgggagagcgggtggcaggaggaggtctctgcatgaaacagcggcagtcagctcttcagtgggtcatctgtgtgtcacagcctcagaagaccagcgagatggctgccaacaagagtaagggccagagctccttggccctccacaaggtgatcatggttggcagcggaggcgttggcaagtcagccctgacgcttcagttcatgtatgacgagtttgtagaagactatgaacctaccaaagctgacagttatagaaagaaagtggttcttgatggggaagaagttcagatagatattctggacaccgctgggcaagaggactacgcagccattcgagataactactttcggagtggggaagggtttcttcttgtgttctcaatcacagaacatgaatcctttacagcaactgccgaattcagggaacagattctccgtgtgaaggctgaagaagataaaattccactgctcgtcgtgggaaacaagtctgacctagaggagcggaggcaggtgcctgtggaggaggccaggagtaaagccgaagagtg

SEQ ID NO: 199442 - DNA, 667 bp, Homo sapiens
  Payload ID: 19348
  Gene Name: v-ral simian leukemia viral oncogene homolog B
  ENST ID: ENST00000449649
  CDS Start-End: 332-667
gttttggtcctgtcttgcaaatgagcataaagttgtttctcccccagcctcctcccctttcctttctgataggggccagcggcgaaggggcttctaaggggaagcgcctggactgggcatcgccgtcccggttcttgccgcctgtgggagtgtgaggttaaccgtgctcggtgcagggttgcggggcgcggagcttgctgcgtccacactgcttgtgtgagcagtgtcctctctgtgctcatttccaacgagaaacgttggaactttggtgttcttatcagcagctcttcagtgggtcatctgtgtgtcacagcctcagaagaccagcgagatggctgccaacaagagtaagggccagagctccttggccctccacaaggtgatcatggttggcagcggaggcgttggcaagtcagccctgacgcttcagttcatgtatgacgagtttgtagaagactatgaacctaccaaagctgacagttatagaaagaaagtggttcttgatggggaagaagttcagatagatattctggacaccgctgggcaagaggactacgcagccattcgagataactactttcggagtggggaagggtttcttcttgtgttctcaatcacagaacatgaatcctttacagcaactgccgaattcagggaacagattctc

SEQ ID NO: 199443 - DNA, 1252 bp, Homo sapiens
  Payload ID: 19348
  Gene Name: v-ral simian leukemia viral oncogene homolog B
  Uniprot ID: P11234
  ENST ID: ENST00000420510
  CDS Start-End: 227-847
agaggaggggttgcctaggcgacgccggaggcgcgctcggggggtgggaaagcgagcccggcagctcaatgacaaatcggtggaggacggctggggtccggccccgggagggggcggggcgcgtttaagagctgcgggccgggtgcggacggcggaggcggcgggactggtccctgcagctcttcagtgggtcatctgtgtgtcacagcctcagaagaccagcgagatggctgccaacaagagtaagggccagagctccttggccctccacaaggtgatcatggttggcagcggaggcgttggcaagtcagccctgacgcttcagttcatgtatgacgagtttgtagaagactatgaacctaccaaagctgacagttatagaaagaaagtggttcttgatggggaagaagttcagatagatattctggacaccgctgggcaagaggactacgcagccattcgagataactactttcggagtggggaagggtttcttcttgtgttctcaatcacagaacatgaatcctttacagcaactgccgaattcagggaacagattctccgtgtgaaggctgaagaagataaaattccactgctcgtcgtgggaaacaagtctgacctagaggagcggaggcaggtgcctgtggaggaggccaggagtaaagccgaagagtggggcgtgcagtacgtggagacgtcagcgaagacccgggccaacgtggacaaggtgttctttgacctaatgagagaaatcagaacaaagaagatgtcagaaaacaaagacaagaatggcaagaaaagcagcaagaacaagaaaagttttaaagaaagatgttgcttactatgagtgtcaaggtgacggatgaagccagctgctcctaaggacacagggctgggttggtaaagagaaggctatggttgacttcttgcttgtgcttcccactctccccgacttcattcactcaaacttctttaaatggggaaaaatatttgtgactctgtggctggcagaagaaataagcccatgcaagtggaagggctgctttgtcaggaggttgtggaatttctttcttctccccttcttccctcccaaaagcttagctatgtataaagtgccacagataggaaacagctgttaattacaaagagaaagaattgtcatagcatcttattttgttcctagttttataacattaccatccttcgttttgaactacagatgttgtagtgggttttggaggagggagtggag

SEQ ID NO: 199444 - DNA, 311 bp, Homo sapiens
  Payload ID: 19348
  Gene Name: v-ral simian leukemia viral oncogene homolog B
  ENST ID: ENST00000631312
  CDS Start-End: 171-311
gagcccggcagctcaatgacaaatcggtggaggacggctggggtccggccccgggagggggcggggcgcgtttaagagctgcgggccgggtgcggacggcggaggcggcgggactggtccctgctcttcagtgggtcatctgtgtgtcacagcctcagaagaccagcgagatggctgccaacaagagtaagggccagagctccttggccctccacaaggtgatcatggttggcagcggaggcgttggcaagtcagccctgacgcttcagttcatgtatgacgaggaatgtttcaaaatcattggcatatga

SEQ ID NO: 199445 - DNA, 11255 bp, Homo sapiens
  Payload ID: 19349
  Gene Name: v-rel avian reticuloendotheliosis viral oncogene homolog
  Uniprot ID: Q04864
  ENST ID: ENST00000295025
  CDS Start-End: 321-2180
agccgcgggaaattcccctcccgccaggctgctcgcctctcggctgggccagcactcggctctccccgctccgccccctgcccctggctcccgtacggtggacggcgacgctgggtgacccggggtgcaagaattcaggggttgggaaggtgtgagccgcaaacccagcggagggcgggaagaaggaggaggcctctagggtggtcgggggactgggggccccgccggcagaggtccctcggcctcctgactgactgactgcggccgcctccggccaggacgctgggagctgcctgcgggaaggtgcggggagcggagccatggcctccggtgcgtataacccgtatatagagataattgaacaacccaggcagaggggaatgcgttttagatacaaatgtgaagggcgatcagcaggcagcattccaggggagcacagcacagacaacaaccgaacatacccttctatccagattatgaactattatggaaaaggaaaagtgagaattacattagtaacaaagaatgacccatataaacctcatcctcatgatttagttggaaaagactgcagagacggctactatgaagcagaatttggacaagaacgcagacctttgtttttccaaaatttgggtattcgatgtgtgaagaaaaaagaagtaaaagaagctattattacaagaataaaggcaggaatcaatccattcaatgtccctgaaaaacagctgaatgatattgaagattgtgacctcaatgtggtgagactgtgttttcaagtttttctccctgatgaacatggtaatttgacgactgctcttcctcctgttgtctcgaacccaatttatgacaaccgtgctccaaatactgcagaattaaggatttgtcgtgtaaacaagaattgtggaagtgtcagaggaggagatgaaatatttctactttgtgacaaagttcagaaagatgacatagaagttcgttttgtgttgaacgattgggaagcaaaaggcatcttttcacaagctgatgtacaccgtcaagtagccattgttttcaaaactccaccatattgcaaagctatcacagaacccgtaacagtaaaaatgcagttgcggagaccttctgaccaggaagttagtgaatctatggattttagatatctgccagatgaaaaagatacttacggcaataaagcaaagaaacaaaagacaactctgcttttccagaaactgtgccaggatcacgtagaaacagggtttcgccatgttgaccaggatggtcttgaactcctgacatcaggtgatccacccaccttggcctcccaaagtgctgggattacagttaattttcctgagagaccaagacctggtctcctcggttcaattggagaaggaagatacttcaaaaaagaaccaaacttgttttctcatgatgcagttgtgagagaaatgcctacaggggtttcaagtcaagcagaatcctactatccctcacctgggcccatctcaagtggattgtcacatcatgcctcaatggcacctctgccttcttcaagctggtcatcagtggcccaccccaccccacgctcaggcaatacaaacccactgagtagtttttcaacaaggacacttccttctaattcgcaaggtatcccaccattcctgagaatacctgttgggaatgatttaaatgcttctaatgcttgcatttacaacaatgccgatgacatagtcggaatggaagcgtcatccatgccatcagcagatttatatggtatttctgatcccaacatgctgtctaattgttctgtgaatatgatgacaaccagcagtgacagcatgggagagactgataatccaagacttctgagcatgaatcttgaaaacccctcatgtaattcagtgttagacccaagagacttgagacagctccatcagatgtcctcttccagtatgtcagcaggcgccaattccaatactactgtttttgtttcacaatcagatgcatttgagggatctgacttcagttgtgcagataacagcatgataaatgagtcgggaccatcaaacagtactaatccaaacagtcatggttttgttcaagatagtcagtattcaggtattggcagtatgcaaaatgagcaattgagtgactcctttccatatgaattttttcaagtataacttgcaagatttaaatccttttaaatcttgataccacctatatagatgcagcattttgtatttgtctaactggggatataatactatatttatactgtatatataatactgactgagaatataatactgtatttgagaatataaaaaacttttttcagggaagaagcatacaactttggacatagcgaatacaaaattggaagctgtcataaaaagacaactcagaggccaggcgcaggggctcacacctgtaatcctagcactttgggaggccaaggcgggtggatcacttgagaccaggaattcgagaccagcctggccaacatggtgaaaccccgtctctactaaaaatacaaaaattagctgagcatggtggtacgtgcctgtactgtcagctacttgggaggctgaggcacaataattgtttgaacccaggaagcagaggttgcagtgagctgagatcacaccaccgcactccagcctgggtgacagagtgagactctgtctcaaaaaaaaaaaaacaaaaaaaacacacttttttatatttctttttataatgttttaatgtattcttaaatttcaagcaaatttaagataaaacttgtaatggctatgccattgaaaaacttaattttttatttttgaggcccatgggccaaggtaacccctaaggggttttcttaggcttcttggagcttagatttgtatgtatatcaaaatgtctttaaaatgttaagttgggcagaaggcagttgaagtgagctttcaaggtatgggaggttttctacattttatactatttcaatctatgcctttaaagttgcttatgattttagctgtacactcattttttaaggggaagaagtttccttggaccattcgcctttcttagatgtcctcactccctgtgatctcataaaactgcctatttgacatctctatctagaaatctaattaaagctcacactcagcatatccaaaactgaattcttggtcttccctcccaaacttgcttctccttcagtcttctccaactcagtaaatggcaatgccatacttctggttgctcaggccaaaaaccctgaagtcatccttgattcttcttttagcacccatatccaatccattagcaaatctggtagaccctaccttcacaatatatctaaagctgaccacctcttttgacctctactattaacgccctattccaagccaccatcatctcttccctggattgaagctgtcatctacaaaaattcttcttatatccttgcattcctacagtctgttccccataaagtagccagaatgattatttttaaaacaagtcaactcataccattcatctgctcaaaaccattcattggcttctcatctcactcagagcagtcaaagtccttaaaagttgcaggcctagactccctgtcctacctcaggtaccaccatatcccacctcctcatgcagctccaggcaccttggcctcagtgctcctcaaagcatcaagtatgcacttgccttggacagtctgtacttggtattccctctgccttgaatgttgttctcccagaaaaatgcatagttcactcttacatccttcaggtgtcactccactgttacctgagcaggtcgtccttgaatatatacatcagcattccctttcccccctgctttatgtatgtccatagcactcaccacgatctgactttactaagtatttattcatttactgtttgttttcccataccgaaatataaactttctaaggacagaaatttttgtgctttattgttgaatctccaatttgtagaaaaatgcctaccttatattaaacactcagtaaatgtttattgaacattaaaagtattactaatagaactttggtttttgaaagaaataataactttaattataagacgtatatgatttttgcagttttacttagtgtgacattgggtttatgagaatcgtgtacattcaagtccaggaataataatggtcatccaaattgtttgaaaggaaaataatcccagtggcaaaatgatggtagaatttgggtaatcttttttttccttttatgaaaagagattttattgaaggtaaaacattagaggttcattgagaatctctaaatccatgttttgacattgtcaagctcattgcaacttccagattgagtaacacttataacacatttccttttcaaagtgcaagatttttaaaagagacttgtcacatattcatttggctggtttcaaatggtgagctgaatgctgggtaatctctactagctccttaatcagatttaaaattctcagtgtttcctagttgtttctgcatactttatgtgagttgttatagctgtaacattacactttatttgctgtttgtgtttcgtgacttttggtaattctggcatttagaaacctttcactttgcttcaaaacgtagttatattttggagttttcatttgatatataattatttattttgcccttttatttcccaaagacattgtaagggttaattagatcattatattttattattacagattaaagttgggcagtaatcttaattatgatggaattatcattatgctaagtaattaactttacctagtttgttttacaactagaacctgccctaaatgttgaatatcttcctagcaagaaacagtctgtcattttacttacacgatgtctaaccaaaccataactttacataaactagtcgtttcggtcaaatagaaaaatgtgtgaatgccataaaaacaaaaattctcagttaaatgatactgggaaatagggaagacagcaaagtgagacttgggctcaggatggttcaggaagaaaaaaaaagaaagacccctgagtaccattaatattcctcagaaattattatttcaaaaggaaatatttctgtattataaatttttcatgagcagccattatgaaatctcacaagaatcatagaattcaataaaaaaggtagaaagtaatttttttacttaaaaatataaattaaaataaatttttaaaatcataagcacataaatagaacttaccagggagaaagaaaaacctgaaggcacaatttcttttctgttcaaaatgtgaacccaggatgtctctagatgatgatggatgataggtggggagattttttttttttttaatacagaatctcatagttttggattaattagcaccaatcagtttaaacactgactgttagaatagctgcatgggtttttttctttaaactaattaagcgttggctacttagtataagtaagtataagccgaattaaggttctgctacatctgtgtttagaatatttttttaaaactaaataagtgttggctagttttgcggtgtaagcagaattaaggttctgctacctctgtgtgtagaatattcccaatggatttttcatttttcaggtgctattttttgaccctgtatagactttaatttaaaatgaatttggtaacgtttctcctctgtctctacatatattcatgctttcacctgctcttttaacacctgcttttagtatctgaggcactttttctgaactctacttgtgcactggatccctcctcctttctctgccaggctgtgtttactttatccttacatcaccacttagtgattcctttctttgtataaacatggtaaatgtcttcattagcctaaaaggaaagaccaaataaaacctttcctaccacttggatgcatttgcatcctgacttctgaaatgcctccagcctccattttctcccttcccagttattccttagcccagccatctctgtctttagctcctacaattttcttaggatattctgggaaagatgagcggagactgcccgccttgtcaaatctagtgtctttttttcagtcctcacactgcttgacctatgtataacctcctatacttccctctttgcatactcctctgggttttctgtggtagtcaagattcctccctgagatttatttcccatgagtcttgacccctcccctcagttggtgctatttccccctacccgccctccgatgatcttatcagagcccacaggttcagttttctttcatgctacctgaatgtcctgataaactggctcgctctcttctttaccttccataatggcattaccatttaccacgccacccaagatacttactaggaacctcaaagtattgtattctttttctccatcacactcatacttaatcatcaagtccttttgagcttgtctcctcttgaatatgtcccttcttaattcctgctgccttcttagtaaaggccttcattcttttttccctagtaataatcttttccatatgttccagttaaaataccatgttctccctattccttattacatagctagcattccttgaaaaaaaacaattctctcaggcctccatacctttagcatgttacccactctgcctctgctcttctggaactagaacactcatccttgaaggctgggcttctgtatgaaggttggtcctgcctccttacttgaggtgaagctttgtacatgcctgtattacggacatcctcttatttaagtgtttgtctctttcgtcattgggactccagcacccagcatagtccctagtatactagttggtgctgaataaatagtagctattattagaaaaggaagggtgaaattgacatgggagttagtaaaatgtatatggaaatgatttttaaagggaaaggtaatgattttctggcaggaaaagcagcaatgacaagattacttaagtcttgtgaaataacacttctcttccttgacctgctgcttcccttttttaccacacacacacgcacacataccacagccctttgagactgaaagcagctctattgagaatagtagtgtcaactgtattatgtagaaattctaaagtttttgggattatttcatagccctgaccttgctacttctctccactttatgtggcaggtttaatctcaggtctccctcatacacttctcagcctcagcacctaaccctcacacaacactccagtattgatgcagtcaatcttgtataacattttttgaatgtccaatgtgcaaagcacgatgttggaaattatacagaggtgaataagacaaaaactcttgctctcaaagatgtcagtctttttctttgcaaggataacacatgtagagtaaaatgcataaaggggactaattttaaatgtacagcttaattaatttttatgtatgttaacacccatgtcaccaccatgtttaggacatttccagcacccctgaaatttccttcatgccccttcccagtctgtacctacacctctaaatctattttcaatcttaatggccttttaaataactgggcttctcacaaccatagtgaacagaaacagctgggttgtcaacgtctaacctaatacttcaggaaaactcatgatggtttccatgttaagagagacatggagcagggcactggcatggtggatggatcacgcctgtaatcccagcactttgggaggccgaggtagggggattgcttgagcccaggagttcaagactagcctgggtaatataaggaaaacctgtctctgcaaaaaaaaaaaaaaaaagaggatacaaccaaatggaagaacattccatgctcatgggtaggaagaatcaatatcgtgaaaatggccatactgcccaaggtaatttacagattcagtgccatccccatcaagctaccaatgcctttcttcacagaattggaaaaaactactttaaagttcatatggaaccaaaaaagagcccatatcgccaagtcaatcctaagccaaaagaacaaagctggaggcatcacactacctgacttcaaactatactacaaggctacagtaaccaaaacagcatggtactggtaccaaaacagagatatagatcactggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagctgctgcacagcaaaagaaactaccatcagagtgaacaggcaacctacaaaatgggagaaaattttcgcaacctacttatctgacaaagggctaatatccagaatctacaatgaactcaaacaaatttacaagaaaaaaacaaccccatcaaaaagtgggcgaaggacatgaacagacacttctcaaaagaagacatttatgcagccaaaaaacacatgaaaaaatgctcatcatgactggccatcagagaaatgcaaatcaaaaccacaatgagataccatctcacaccagttagaatggcaatcattaaaaagtcaggagacaacaggtgctggagaggatgtggagaaataggaacacttttacactgttggtgggactgtaaactagttcaaccattgtggaagtcagtgtggcgattcctcagggatgtagaactggaaataccgtttgacccagccatcccattactgggtatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgaattcatgtcctttgtagggacatggatgaaattggaaaacatcattctcagtaaactatcgcaagaacaagaaaccaaacaccacatattctcactcataggtgggaattgaacaatgagaacacatggacacaggaaggggaatatcacactggggactgttgtggggtggggggaggggggagggatagcattgggagatatacctaatgctagatgacgagttagtgggtgcagtgcaccagcatggcacatgtatacatatgtaagtaacctgcacaatgtgcacatgtaccctaaagcttaaagtataataaaaaataaataaataaataaataagaaaaagaaagccaggcatggtgacatgtgcctgtggtcccagctattagggaggctgaggtgggaggatcccttgaacccaggaggttgagtctgtagtgagcagtgattacgccactgcactccagcctgggcaagaccctgtctcaaaaaaaaaaaagacttagaattggtgatccaggccgcctaatggcatcaaataatttgttatatctttaatttattgaaggatcaccacatgcttttaaatagcatggagaaatggaaagaatagggactttttactcaggtaatacccagcctgctacctaacaggttgtgttgtactaaataaaatggtacataagaagaaacactgtaaattatatagtgcgaatcaaatattgttaataaaccaatatctgtatatcctatgtcccggattaatctttaatttagatactccttctagttatctaatacacagcagagtgagaaaaatcattatggattaggttctttagtaagaaacctgagatggacttctcattagcattaactagttattgcccagctttggagagccttcttttggcttatcatttattataagcccagaaataggtgactaatcagagataaatgtatgggttgtctgtatctagttttatgccttttttttgcctaagacgtagtcaaattaatattttaactaatacatcttagcagagtttagttaagcacaaagttaacagtgggtaggattgaatcttgaaagtaatcatgtctgtaatgtttttcatgcatgcaaaaagcacagacaaaaccactcatgccctattaataaacaaaatacagatcaaagttttcaaaagtaatcactctatttattctaaatgtctgtggctttaggaaaataccaccagctagtacttacctatttaaagatgtagaatttattatcctctaatattcttatcagttgtttccacaactttagtttactattggactttcaaaaatttaaagaattacaagtaaaattcattaaacacttgtgtgtgaatagtaatacacagtaattagtacagcatgttgcttcttcaacaaattgagttttcagggaaatcagcaagtaaatgaaatataaatttttggtaaaagtatcaaacattcatcttgcccatttttcctcttaaactttattatctaatcaaacatagttttccataagatgtaataaaatatagataaggttggaatatttgaggatccatttgtggaactgaatttaatgagacttcattggtgatacactcaatttttactgggtaattagctaataatgttggtcactgtctcacagttcaagtagctttaagatgatgtggcaaggaaaacacaaagcttttgggtaaccagcgttcttaaatgtatggtttttgaccaggtgaaccctttagaagtgatttctgttttaaaagtatgtacttaaaatacctttggctgtgatgaatgtagatcccagcagaataccaaaatcctattttttttgactgagtatttgtagatgcttaatgactgaaatgaatttggaggcactgatgaaagtgatttttttaaagttctcaggtactgttcaattatttaatgttaagtttagtatcaagatacagttgtttttaaaatgccaaaatgctgtttattatacagaatattttattacatttgcaatatctttgtatatagtgatttttttcttgataataaatggaaaaattctaaaa

SEQ ID NO: 199446 - DNA, 2398 bp, Homo sapiens
  Payload ID: 19349
  Gene Name: v-rel avian reticuloendotheliosis viral oncogene homolog
  Uniprot ID: Q04864
  ENST ID: ENST00000394479
  CDS Start-End: 186-1949
caggggttgggaaggtgtgagccgcaaacccagcggagggcgggaagaaggaggaggcctctagggtggtcgggggactgggggccccgccggcagaggtccctcggcctcctgactgactgactgcggccgcctccggccaggacgctgggagctgcctgcgggaaggtgcggggagcggagccatggcctccggtgcgtataacccgtatatagagataattgaacaacccaggcagaggggaatgcgttttagatacaaatgtgaagggcgatcagcaggcagcattccaggggagcacagcacagacaacaaccgaacatacccttctatccagattatgaactattatggaaaaggaaaagtgagaattacattagtaacaaagaatgacccatataaacctcatcctcatgatttagttggaaaagactgcagagacggctactatgaagcagaatttggacaagaacgcagacctttgtttttccaaaatttgggtattcgatgtgtgaagaaaaaagaagtaaaagaagctattattacaagaataaaggcaggaatcaatccattcaatgtccctgaaaaacagctgaatgatattgaagattgtgacctcaatgtggtgagactgtgttttcaagtttttctccctgatgaacatggtaatttgacgactgctcttcctcctgttgtctcgaacccaatttatgacaaccgtgctccaaatactgcagaattaaggatttgtcgtgtaaacaagaattgtggaagtgtcagaggaggagatgaaatatttctactttgtgacaaagttcagaaagatgacatagaagttcgttttgtgttgaacgattgggaagcaaaaggcatcttttcacaagctgatgtacaccgtcaagtagccattgttttcaaaactccaccatattgcaaagctatcacagaacccgtaacagtaaaaatgcagttgcggagaccttctgaccaggaagttagtgaatctatggattttagatatctgccagatgaaaaagatacttacggcaataaagcaaagaaacaaaagacaactctgcttttccagaaactgtgccaggatcacgttaattttcctgagagaccaagacctggtctcctcggttcaattggagaaggaagatacttcaaaaaagaaccaaacttgttttctcatgatgcagttgtgagagaaatgcctacaggggtttcaagtcaagcagaatcctactatccctcacctgggcccatctcaagtggattgtcacatcatgcctcaatggcacctctgccttcttcaagctggtcatcagtggcccaccccaccccacgctcaggcaatacaaacccactgagtagtttttcaacaaggacacttccttctaattcgcaaggtatcccaccattcctgagaatacctgttgggaatgatttaaatgcttctaatgcttgcatttacaacaatgccgatgacatagtcggaatggaagcgtcatccatgccatcagcagatttatatggtatttctgatcccaacatgctgtctaattgttctgtgaatatgatgacaaccagcagtgacagcatgggagagactgataatccaagacttctgagcatgaatcttgaaaacccctcatgtaattcagtgttagacccaagagacttgagacagctccatcagatgtcctcttccagtatgtcagcaggcgccaattccaatactactgtttttgtttcacaatcagatgcatttgagggatctgacttcagttgtgcagataacagcatgataaatgagtcgggaccatcaaacagtactaatccaaacagtcatggttttgttcaagatagtcagtattcaggtattggcagtatgcaaaatgagcaattgagtgactcctttccatatgaattttttcaagtataacttgcaagatttaaatccttttaaatcttgataccacctatatagatgcagcattttgtatttgtctaactggggatataatactatatttatactgtatatataatactgactgagaatataatactgtatttgagaatataaaaaacttttttcagggaagaagcatacaactttggacatagcgaatacaaaattggaagctgtcataaaaagacaactcagaggccaggcgcaggggctcacacctgtaatcctagcactttgggaggccaaggcgggtggatcacttgagaccaggaattcgagaccagcctggccaacatggtgaaaccccgtctctactaaaaatacaaaaattagctgagcatggtggtacgtgcctgtactgtcagctacttgggaggctgaggcacaataattgtttgaacccaggaagcagaggttgc

SEQ ID NO: 199447 - DNA, 2681 bp, Homo sapiens
  Payload ID: 19350
  Gene Name: v-rel avian reticuloendotheliosis viral oncogene homolog A
  Uniprot ID: Q04206
  ENST ID: ENST00000308639
  CDS Start-End: 259-1905
cgtcctcggcgaggcgcgcacttggccccgacccccggcagcggctgtgcgtgcagcctcttcgtcctccgcgcggcgtgcacttgctcccggcccctgcgccgggcggcggcggggcagcgcgcaggcgcggccggattccgggcagtgacgcgacggcgggccgcgcggcgcatttccgcctctggcgaatggctcgtctgtagtgcacgccgcgggcccagctgcgaccccggccccgcccccgggaccccggccatggacgaactgttccccctcatcttcccggcagagccagcccaggcctctggcccctatgtggagatcattgagcagcccaagcagcggggcatgcgcttccgctacaagtgcgaggggcgctccgcgggcagcatcccaggcgagaggagcacagataccaccaagacccaccccaccatcaagatcaatggctacacaggaccagggacagtgcgcatctccctggtcaccaaggaccctcctcaccggcctcacccccacgagcttgtaggaaaggactgccgggatggcttctatgaggctgagctctgcccggaccgctgcatccacagtttccagaacctgggaatccagtgtgtgaagaagcgggacctggagcaggctatcagtcagcgcatccagaccaacaacaaccccttccaagaagagcagcgtggggactacgacctgaatgctgtgcggctctgcttccaggtgacagtgcgggacccatcaggcaggcccctccgcctgccgcctgtcctttctcatcccatctttgacaatcgtgcccccaacactgccgagctcaagatctgccgagtgaaccgaaactctggcagctgcctcggtggggatgagatcttcctactgtgtgacaaggtgcagaaagaggacattgaggtgtatttcacgggaccaggctgggaggcccgaggctccttttcgcaagctgatgtgcaccgacaagtggccattgtgttccggacccctccctacgcagaccccagcctgcaggctcctgtgcgtgtctccatgcagctgcggcggccttccgaccgggagctcagtgagcccatggaattccagtacctgccagatacagacgatcgtcaccggattgaggagaaacgtaaaaggacatatgagaccttcaagagcatcatgaagaagagtcctttcagcggacccaccgacccccggcctccacctcgacgcattgctgtgccttcccgcagctcagcttctgtccccaagccagcaccccagccctatccctttacgtcatccctgagcaccatcaactatgatgagtttcccaccatggtgtttccttctgggcagatcagccaggcctcggccttggccccggcccctccccaagtcctgccccaggctccagcccctgcccctgctccagccatggtatcagctctggcccaggccccagcccctgtcccagtcctagccccaggccctcctcaggctgtggccccacctgcccccaagcccacccaggctggggaaggaacgctgtcagaggccctgctgcagctgcagtttgatgatgaagacctgggggccttgcttggcaacagcacagacccagctgtgttcacagacctggcatccgtcgacaactccgagtttcagcagctgctgaaccagggcatacctgtggccccccacacaactgagcccatgctgatggagtaccctgaggctataactcgcctagtgacaggggcccagaggccccccgacccagctcctgctccactgggggccccggggctccccaatggcctcctttcaggagatgaagacttctcctccattgcggacatggacttctcagccctgctgagtcagatcagctcctaagggggtgacgcctgccctccccagagcactgggttgcaggggattgaagccctccaaaagcacttacggattctggtggggtgtgttccaactgcccccaactttgtggatgtcttccttggaggggggagccatattttattcttttattgtcagtatctgtatctctctctctttttggaggtgcttaagcagaagcattaacttctctggaaaggggggagctggggaaactcaaacttttcccctgtcctgatggtcagctcccttctctgtagggaactctggggtcccccatccccatcctccagcttctggtactctcctagagacagaagcaggctggaggtaaggcctttgagcccacaaagccttatcaagtgtcttccatcatggattcattacagcttaatcaaaataacgccccagataccagcccctgtatggcactggcattgtccctgtgcctaacaccagcgtttgaggggctggccttcctgccctacagaggtctctgccggctctttccttgctcaaccatggctgaaggaaaccagtgcaacagcactggctctctccaggatccagaaggggtttggtctgggacttccttgctctccctcttctcaagtgccttaatagtagggtaagttgttaagagtgggggagagcaggctggcagctctccagtcaggaggcatagtttttactgaacaatcaaagcacttggactcttgctctttctactctgaactaataaatctgttgccaagctg

SEQ ID NO: 199448 - DNA, 2700 bp, Homo sapiens
  Payload ID: 19350
  Gene Name: v-rel avian reticuloendotheliosis viral oncogene homolog A
  Uniprot ID: Q04206
  ENST ID: ENST00000406246
  CDS Start-End: 263-1918
tcttcgtcctcggcgaggcgcgcacttggccccgacccccggcagcggctgtgcgtgcagcctcttcgtcctccgcgcggcgtgcacttgctcccggcccctgcgccgggcggcggcggggcagcgcgcaggcgcggccggattccgggcagtgacgcgacggcgggccgcgcggcgcatttccgcctctggcgaatggctcgtctgtagtgcacgccgcgggcccagctgcgaccccggccccgcccccgggaccccggccatggacgaactgttccccctcatcttcccggcagagccagcccaggcctctggcccctatgtggagatcattgagcagcccaagcagcggggcatgcgcttccgctacaagtgcgaggggcgctccgcgggcagcatcccaggcgagaggagcacagataccaccaagacccaccccaccatcaagatcaatggctacacaggaccagggacagtgcgcatctccctggtcaccaaggaccctcctcaccggcctcacccccacgagcttgtaggaaaggactgccgggatggcttctatgaggctgagctctgcccggaccgctgcatccacagtttccagaacctgggaatccagtgtgtgaagaagcgggacctggagcaggctatcagtcagcgcatccagaccaacaacaaccccttccaagttcctatagaagagcagcgtggggactacgacctgaatgctgtgcggctctgcttccaggtgacagtgcgggacccatcaggcaggcccctccgcctgccgcctgtcctttctcatcccatctttgacaatcgtgcccccaacactgccgagctcaagatctgccgagtgaaccgaaactctggcagctgcctcggtggggatgagatcttcctactgtgtgacaaggtgcagaaagaggacattgaggtgtatttcacgggaccaggctgggaggcccgaggctccttttcgcaagctgatgtgcaccgacaagtggccattgtgttccggacccctccctacgcagaccccagcctgcaggctcctgtgcgtgtctccatgcagctgcggcggccttccgaccgggagctcagtgagcccatggaattccagtacctgccagatacagacgatcgtcaccggattgaggagaaacgtaaaaggacatatgagaccttcaagagcatcatgaagaagagtcctttcagcggacccaccgacccccggcctccacctcgacgcattgctgtgccttcccgcagctcagcttctgtccccaagccagcaccccagccctatccctttacgtcatccctgagcaccatcaactatgatgagtttcccaccatggtgtttccttctgggcagatcagccaggcctcggccttggccccggcccctccccaagtcctgccccaggctccagcccctgcccctgctccagccatggtatcagctctggcccaggccccagcccctgtcccagtcctagccccaggccctcctcaggctgtggccccacctgcccccaagcccacccaggctggggaaggaacgctgtcagaggccctgctgcagctgcagtttgatgatgaagacctgggggccttgcttggcaacagcacagacccagctgtgttcacagacctggcatccgtcgacaactccgagtttcagcagctgctgaaccagggcatacctgtggccccccacacaactgagcccatgctgatggagtaccctgaggctataactcgcctagtgacaggggcccagaggccccccgacccagctcctgctccactgggggccccggggctccccaatggcctcctttcaggagatgaagacttctcctccattgcggacatggacttctcagccctgctgagtcagatcagctcctaagggggtgacgcctgccctccccagagcactgggttgcaggggattgaagccctccaaaagcacttacggattctggtggggtgtgttccaactgcccccaactttgtggatgtcttccttggaggggggagccatattttattcttttattgtcagtatctgtatctctctctctttttggaggtgcttaagcagaagcattaacttctctggaaaggggggagctggggaaactcaaacttttcccctgtcctgatggtcagctcccttctctgtagggaactctggggtcccccatccccatcctccagcttctggtactctcctagagacagaagcaggctggaggtaaggcctttgagcccacaaagccttatcaagtgtcttccatcatggattcattacagcttaatcaaaataacgccccagataccagcccctgtatggcactggcattgtccctgtgcctaacaccagcgtttgaggggctggccttcctgccctacagaggtctctgccggctctttccttgctcaaccatggctgaaggaaaccagtgcaacagcactggctctctccaggatccagaaggggtttggtctgggacttccttgctctccctcttctcaagtgccttaatagtagggtaagttgttaagagtgggggagagcaggctggcagctctccagtcaggaggcatagtttttactgaacaatcaaagcacttggactcttgctctttctactctgaactaataaatctgttgccaagctggctaga

SEQ ID NO: 199449 - DNA, 567 bp, Homo sapiens
  Payload ID: 19350
  Gene Name: v-rel avian reticuloendotheliosis viral oncogene homolog A
  ENST ID: ENST00000532879
  CDS Start-End: 84-567
tttccgcctctggcgaatggctcgtctgtagtgcacgccgcgggcccagctgcgaccccggccccgcccccgggaccccggccatggacgaactgttccccctcatcttcccggcagagccagcccaggcctctggcccctatgtggagatcattgagcagcccaagcagcggggcatgcgcttccgctacaagtgcgaggggcgctccgcgggcagcatcccaggcgagaggagcacagataccaccaagacccaccccaccatcaagatcaatggctacacaggaccagggacagtgcgcatctccctggtcaccaaggaccctcctcaccggcctcacccccacgagcttgtaggaaaggactgccgggatggcttctatgaggctgagctctgcccggaccgctgcatccacagtttccagaacctgggaatccagtgtgtgaagaagcgggacctggagcaggctatcagtcagcgcatccagaccaacaacaaccccttccaaggtgacagtgcgggacccatcaggcaggcccctccgcctgccgcctgtcctttctcat

SEQ ID NO: 199450 - DNA, 215 bp, Homo sapiens
  Payload ID: 19350
  Gene Name: v-rel avian reticuloendotheliosis viral oncogene homolog A
  ENST ID: ENST00000526257
  CDS Start-End: 1-215
tccaggtgacagtgcgggacccatcaggcaggcccctccgcctgccgcctgtcctttctcatcccatctttgacaatcacgatcgtcaccggattgaggagaaacgtaaaaggacatatgagaccttcaagagcatcatgaagaagagtcctttcagcggacccaccgacccccggcctccacctcgacgcattgctgtgccttcccgcagctca

SEQ ID NO: 199451 - DNA, 3183 bp, Homo sapiens
  Payload ID: 19350
  Gene Name: v-rel avian reticuloendotheliosis viral oncogene homolog A
  ENST ID: ENST00000525693
  CDS Start-End: 64-1197
ctcgtctgtagtgcacgccgcgggcccagctgcgaccccggccccgcccccgggaccccggccatggacgaactgttccccctcatcttcccggcagagccagcccaggcctctggcccctatgtggagatcattgagcagcccaagcagcggggcatgcgcttccgctacaagtgcgaggggcgctccgcgggcagcatcccaggcgagaggagcacagataccaccaagacccaccccaccatcaagatcaatggctacacaggaccagggacagtgcgcatctccctggtcaccaaggaccctcctcaccggcctcacccccacgagcttgtaggaaaggactgccgggatggcttctatgaggctgagctctgcccggaccgctgcatccacagtttccagaacctgggaatccagtgtgtgaagaagcgggacctggagcaggctatcagtcagcgcatccagaccaacaacaaccccttccaagttcctatagaagagcagcgtggggactacgacctgaatgctgtgcggctctgcttccaggtgacagtgcgggacccatcaggcaggcccctccgcctgccgcctgtcctttctcatcccatctttgacaatcgtgcccccaacactgccgagctcaagatctgccgagtgaaccgaaactctggcagctgcctcggtggggatgagatcttcctactgtgtgacaaggtgcagaaagaggacattgaggtgtatttcacgggaccaggctgggaggcccgaggctccttttcgcaagctgatgtgcaccgacaagtggccattgtgttccggacccctccctacgcagaccccagcctgcaggctcctgtgcgtgtctccatgcagctgcggcggccttccgaccgggagctcagtgagcccatggaattccagtacctgccagatacagacgatcgtcaccggattgaggagaaacgtaaaaggacatatgagaccttcaagagcatcatgaagaagagtcctttcagcggacccaccgacccccggcctccacctcgacgcattgctgtgccttcccgcagctcagcttctgtccccaagccaggtaaggatttccttttgtcccactggaacgacaggttcagctctgttcagctgaggagcagtggagatgaagactcctgggccccattacagacctactgaatcagaggctttgaaaggatggcgcaggaaccagcgacttcctgggatgctaatgcacactgaagcctgggaaccaccgtgccacttaaattctatattgggtatcttgggaatcagaagttaaaaatgcagaatctctgctctcatctctcacttgaattgggggaacaaaaatcacctctaaattagcaagatgtgtgtgcctgtgcgaggctcaaaaactgacaagctctgcacttcaggccgctgctcacttggtgctccatgggctcattgcctctcaggacttagtttttcagctgtaaactgaggagtccagcttatctctccaagtgtcccttcctctaaaaggctggaagagtttcgtgggcttgagtagtcagggaggactccaaggtggaggtgtggctagaactggaccctacaggctgggtcagatggggtaagaggaaggagatagggtgttggcagtgactccctagagagggattgagcctgagcaccatgaagaggggctggggtacagaggacggggtggatctctagggctttctctgacccctgcctctctgtctctctcctccagcaccccagccctatccctttacgtcatccctgagcaccatcaactatgatgagtttcccaccatggtgtttccttctgggcagatcagccaggcctcggccttggccccggcccctccccaagtcctgccccaggctccagcccctgcccctgctccagccatggtatcagctctggcccaggccccagcccctgtcccagtcctagccccaggccctcctcaggctgtggccccacctgcccccaagcccacccaggctggggaaggaacgctgtcagaggccctgctgcagctgcagtttgatgatgaagacctgggggccttgcttggcaacagcacagacccagctgtgttcacagacctggcatccgtcgacaactccgagtttcagcagctgctgaaccagggcatacctgtggccccccacacaactgagcccatgctgatggagtaccctgaggctataactcgcctagtgacaggggcccagaggccccccgacccagctcctgctccactgggggccccggggctccccaatggcctcctttcaggagatgaagacttctcctccattgcggacatggacttctcagccctgctgagtcagatcagctcctaagggggtgacgcctgccctccccagagcactgggttgcaggggattgaagccctccaaaagcacttacggattctggtggggtgtgttccaactgcccccaactttgtggatgtcttccttggaggggggagccatattttattcttttattgtcagtatctgtatctctctctctttttggaggtgcttaagcagaagcattaacttctctggaaaggggggagctggggaaactcaaacttttcccctgtcctgatggtcagctcccttctctgtagggaactctggggtcccccatccccatcctccagcttctggtactctcctagagacagaagcaggctggaggtaaggcctttgagcccacaaagccttatcaagtgtcttccatcatggattcattacagcttaatcaaaataacgccccagataccagcccctgtatggcactggcattgtccctgtgcctaacaccagcgtttgaggggctggccttcctgccctacagaggtctctgccggctctttccttgctcaaccatggctgaaggaaaccagtgcaacagcactggctctctccaggatccagaaggggtttggtctgggacttccttgctctccctcttctcaagtgccttaatagtagggtaagttgttaagagtgggggagagcaggctggcagctctccagtcaggaggcatagtttttactgaacaatcaaagcacttggactcttgctctttctactctgaactaataaatctgttgccaagctgg

SEQ ID NO: 199452 - DNA, 591 bp, Homo sapiens
  Payload ID: 19350
  Gene Name: v-rel avian reticuloendotheliosis viral oncogene homolog A
  ENST ID: ENST00000527909
  CDS Start-End: 77-481
ctctggcgaatggctcgtctgtagtgcacgccgcgggcccagctgcgaccccggccccgcccccgggaccccggccatggacgaactgttccccctcatcttcccggcagagccagcccaggcctctggcccctatgtggagatcattgagcagcccaagcagcggggcatgcgcttccgctacaagtgcgaggggcgctccgcgggcagcatcccaggcgagaggagcacagataccaccaagacccaccccaccatcaagtttccagaacctgggaatccagtgtgtgaagaagcgggacctggagcaggctatcagtcagcgcatccagaccaacaacaaccccttccaagttcctatagaagagcagcgtggggactacgacctgaatgctgtgcggctctgcttccaggtgacagtgcgggacccatcaggcaggcccctccgcctgccgcctgtcctttctcatcccatctttgacaatcgtgcccccaacactgccgagctcaagatctgccgagtgaaccgaaactctggcagctgcctcggtggggatgagatcttcctactgtgtgacaaggtgcagaaag

SEQ ID NO: 199453 - DNA, 569 bp, Homo sapiens
  Payload ID: 19350
  Gene Name: v-rel avian reticuloendotheliosis viral oncogene homolog A
  ENST ID: ENST00000533546
  CDS Start-End: 77-271
ctctggcgaatggctcgtctgtagtgcacgccgcgggcccagctgcgaccccggccccgcccccgggaccccggccatggacgaactgttccccctcatcttcccggcagagccagcccaggcctctggcccctatgtggagatcattgagcagcccaagcagcggggcatgcgcttccgctacaagtgcgaggggcgctccgcgggcagcatcccaggcgagaggagcacagataccaccaagacccaccccaccatcaagttcctatagaagagcagcgtggggactacgacctgaatgctgtgcggctctgcttccaggtgacagtgcgggacccatcaggcaggcccctccgcctgccgcctgtcctttctcatcccatctttgacaatcgtgcccccaacactgccgagctcaagatctgccgagtgaaccgaaactctggcagctgcctcggtggggatgagatcttcctactgtgtgacaaggtgcagaaagaggacattgaggtgtatttcacgggaccaggctgggaggcccgaggctccttttcgcaagctgatgtgca

SEQ ID NO: 199454 - DNA, 1341 bp, Homo sapiens
  Payload ID: 19350
  Gene Name: v-rel avian reticuloendotheliosis viral oncogene homolog A
  ENST ID: ENST00000532999
  CDS Start-End: 87-1341
gcatttccgcctctggcgaatggctcgtctgtagtgcacgccgcgggcccagctgcgaccccggccccgcccccgggaccccggccatggacgaactgttccccctcatcttcccggcagagccagcccaggcctctggcccctatgtggagatcattgagcagcccaagcagcggggcatgcgcttccgctacaagtgcgaggggcgctccgcgggcagcatcccaggcgagaggagcacagataccaccaagacccaccccaccatcaaggtttggatgtctgggcctctgtactttggacagatcaatggctacacaggaccagggacagtgcgcatctccctggtcaccaaggaccctcctcaccggcctcacccccacgagcttgtaggaaaggactgccgggatggcttctatgaggctgagctctgcccggaccgctgcatccacagtttccagaacctgggaatccagtgtgtgaagaagcgggacctggagcaggctatcagtcagcgcatccagaccaacaacaaccccttccaagttcctatagaagagcagcgtggggactacgacctgaatgctgtgcggctctgcttccaggtgacagtgcgggacccatcaggcaggcccctccgcctgccgcctgtcctttctcatcccatctttgacaatcgtgcccccaacactgccgagctcaagatctgccgagtgaaccgaaactctggcagctgcctcggtggggatgagatcttcctactgtgtgacaaggtgcagaaagaggacattgaggtgtatttcacgggaccaggctgggaggcccgaggctccttttcgcaagctgatgtgcaccgacaagtggccattgtgttccggacccctccctacgcagaccccagcctgcaggctcctgtgcgtgtctccatgcagctgcggcggccttccgaccgggagctcagtgagcccatggaattccagtacctgccagatacagacgatcgtcaccggattgaggagaaacgtaaaaggacatatgagaccttcaagagcatcatgaagaagagtcctttcagcggacccaccgacccccggcctccacctcgacgcattgctgtgccttcccgcagctcagcttctgtccccaagccagcaccccagccctatccctttacgtcatccctgagcaccatcaactatgatgagtttcccaccatggtgtttccttctgggcagatcagccaggcctcggccttggccccggcccctccccaagtcctgccccaggctccagcccctgcccctgctccagccatggtatcagctctggcccaggccccag

SEQ ID NO: 199455 - DNA, 575 bp, Homo sapiens
  Payload ID: 19350
  Gene Name: v-rel avian reticuloendotheliosis viral oncogene homolog A
  ENST ID: ENST00000534283
  CDS Start-End: 489-575
cgcggctgtggcgggagcccccgcgccgctttccgccccttcctgcgccgacgggcgctgcgcagggagcggtcggcctgccggatggtggcgcggggcggggcaggcggggaggggtctgactcagtttcccctctgggtggagggggtggcccttgactcagcatcctccctgggtgggggagcagagggaaccttgactcagtttccctccacaccgtccatgggggcagctctggcttcgtttccctattaggggagaacgcatctgattcagtttcctctctggagggaggtggggcgtgccctccctcaattttccttaagaaagtacaacaggccctgattcagcttccctctggagaagaaggattccttaccccgttttccctcaagaagcagaactgttccccctcatcttcccggcagagccagcccaggcctctggcccctatgtggagatcattgagcagcccaagcagcggggcatgcgcttccgctacaagtgcgaggggcgctccgcgggcagcatcccaggcgagaggagcacagataccaccaagacccaccccacc

SEQ ID NO: 199456 - DNA, 808 bp, Homo sapiens
  Payload ID: 19350
  Gene Name: v-rel avian reticuloendotheliosis viral oncogene homolog A
  ENST ID: ENST00000525658
  CDS Start-End: 84-233
tttccgcctctggcgaatggctcgtctgtagtgcacgccgcgggcccagctgcgaccccggccccgcccccgggaccccggccatggacgaactgttccccctcatcttcccggcagatcaatggctacacaggaccagggacagtgcgcatctccctggtcaccaaggaccctcctcaccggcctcacccccacgagcttgtaggaaaggactgccgggatggcttctatgaggctgagctctgcccggaccgctgcatccacagtttccagaacctgggaatccagtgtgtgaagaagcgggacctggagcaggctatcagtcagcgcatccagaccaacaacaaccccttccaagttcctatagaagagcagcgtggggactacgacctgaatgctgtgcggctctgcttccaggtgacagtgcgggacccatcaggcaggcccctccgcctgccgcctgtcctttctcatcccatctttgacaatcgtgcccccaacactgccgagctcaagatctgccgagtgaaccgaaactctggcagctgcctcggtggggatgagatcttcctactgtgtgacaaggtgcagaaagaggacattgaggtgtatttcacgggaccaggctgggaggcccgaggctccttttcgcaagctgatgtgcaccgacaagtggccattgtgttccggacccctccctacgcagaccccagcctgcaggctcctgtgcgtgtctccatgcagctgcggcggccttccgaccgggagctcagtgagcccatggaattccagtacctgccagatacag

SEQ ID NO: 199457 - DNA, 456 bp, Homo sapiens
  Payload ID: 19350
  Gene Name: v-rel avian reticuloendotheliosis viral oncogene homolog A
  ENST ID: ENST00000533187
  CDS Start-End: 171-456
tcgccggggccgccgcggctgtggcgggagcccccgcgccgctttccgccccttcctgcgccgacgggcgctgcgcagggagcgaactgttccccctcatcttcccggcagagccagcccaggcctctggcccctatgtggagatcattgagcagcccaagcagcggggcatgcgcttccgctacaagtgcgaggggcgctccgcgggcagcatcccaggcgagaggagcacagataccaccaagacccaccccaccatcaagatcaatggctacacaggaccagggacagtgcgcatctccctggtcaccaaggaccctcctcaccggcctcacccccacgagcttgtaggaaaggactgccgggatggcttctatgaggctgagctctgcccggaccgctgcatccacagtttccagaacctgggaatccagtgtgtgaagaagcgggacctgg

SEQ ID NO: 199458 - DNA, 692 bp, Homo sapiens
  Payload ID: 19350
  Gene Name: v-rel avian reticuloendotheliosis viral oncogene homolog A
  ENST ID: ENST00000534558
  CDS Start-End: 68-692
atggctcgtctgtagtgcacgccgcgggcccagctgcgaccccggccccgcccccgggaccccggccatggacgagccagcccaggcctctggcccctatgtggagatcattgagcagcccaagcagcggggcatgcgcttccgctacaagtgcgaggggcgctccgcgggcagcatcccaggcgagaggagcacagataccaccaagacccaccccaccatcaagatcaatggctacacaggaccagggacagtgcgcatctccctggtcaccaaggaccctcctcaccggcctcacccccacgagcttgtaggaaaggactgccgggatggcttctatgaggctgagctctgcccggaccgctgcatccacagtttccagaacctgggaatccagtgtgtgaagaagcgggacctggagcaggctatcagtcagcgcatccagaccaacaacaaccccttccaagttcctatagaagagcagcgtggggactacgacctgaatgctgtgcggctctgcttccaggtgacagtgcgggacccatcaggcaggcccctccgcctgccgcctgtcctttctcatcccatctttgacaatcgtgcccccaacactgccgagctcaagatctgccgagtgaaccgaaactctggcagctgcctcggtggggatgagatcttcctactgtgtgaca

SEQ ID NO: 199459 - DNA, 541 bp, Homo sapiens
  Payload ID: 19350
  Gene Name: v-rel avian reticuloendotheliosis viral oncogene homolog A
  ENST ID: ENST00000531238
  CDS Start-End: 77-334
ctctggcgaatggctcgtctgtagtgcacgccgcgggcccagctgcgaccccggccccgcccccgggaccccggccatggacgaactgttccccctcatcttcccggcagagccagcccaggcctctggcccctatgtggagatcattgagcagcccaagcagcggggcatgcgcttccgctacaagtgcgaggggcgctccgcgggcagcatcccaggcgagaggagcacagataccaccaagacccaccccaccatcaaggaccagggacagtgcgcatctccctggtcaccaaggaccctcctcaccggcctcacccccacgagcttgtaggaaaggactgccgggatggcttctatgaggctgagctctgcccggaccgctgcatccacagtttccagaacctgggaatccagtgtgtgaagaagcgggacctggagcaggctatcagtcagcgcatccagaccaacaacaaccccttccaagttcctatagaagagcagcgtggggactacgacctgaatgctgtgcggctctgct

SEQ ID NO: 199460 - DNA, 2004 bp, Homo sapiens
  Payload ID: 19350
  Gene Name: v-rel avian reticuloendotheliosis viral oncogene homolog A
  ENST ID: ENST00000526283
  CDS Start-End: 64-777
ctcgtctgtagtgcacgccgcgggcccagctgcgaccccggccccgcccccgggaccccggccatggacgaactgttccccctcatcttcccggcagagccagcccaggcctctggcccctatgtggagatcattgagcagcccaagcagcggggcatgcgcttccgctacaagtgcgaggggcgctccgcgggcagcatcccaggcgagaggagcacagataccaccaagacccaccccaccatcaagatcaatggctacacaggaccagggacagtgcgcatctccctggtcaccaaggaccctcctcaccggcctcacccccacgagcttgtaggaaaggactgccgggatggcttctatgaggctgagctctgcccggaccgctgcatccacagtttccagaacctgggaatccagtgtgtgaagaagcgggacctggagcaggctatcagtcagcgcatccagaccaacaacaaccccttccaagttcctatagaagagcagcgtggggactacgacctgaatgctgtgcggctctgcttccaggtgacagtgcgggacccatcaggcaggcccctccgcctgccgcctgtcctttctcatcccatctttgacaatcgtgcccccaacactgccgagctcaagatctgccgagtgaaccgaaactctggcagctgcctcggtggggatgagatcttcctactgtgtgacaaggtgcagaaagcccatggaattccagtacctgccagatacagacgatcgtcaccggattgaggagaaacgtaaaaggacatatgagaccttcaagagcatcatgaagaagagtcctttcagcggacccaccgacccccggcctccacctcgacgcattgctgtgccttcccgcagctcagcttctgtccccaagccagcaccccagccctatccctttacgtcatccctgagcaccatcaactatgatgagtttcccaccatggtgtttccttctgggcagatcagccaggcctcggccttggccccggcccctccccaagtcctgccccaggctccagcccctgcccctgctccagccatggtatcagctctggcccagaggccccccgacccagctcctgctccactgggggccccggggctccccaatggcctcctttcaggagatgaagacttctcctccattgcggacatggacttctcagccctgctgagtcagatcagctcctaagggggtgacgcctgccctccccagagcactgggttgcaggggattgaagccctccaaaagcacttacggattctggtggggtgtgttccaactgcccccaactttgtggatgtcttccttggaggggggagccatattttattcttttattgtcagtatctgtatctctctctctttttggaggtgcttaagcagaagcattaacttctctggaaaggggggagctggggaaactcaaacttttcccctgtcctgatggtcagctcccttctctgtagggaactctggggtcccccatccccatcctccagcttctggtactctcctagagacagaagcaggctggaggtaaggcctttgagcccacaaagccttatcaagtgtcttccatcatggattcattacagcttaatcaaaataacgccccagataccagcccctgtatggcactggcattgtccctgtgcctaacaccagcgtttgaggggctggccttcctgccctacagaggtctctgccggctctttccttgctcaaccatggctgaaggaaaccagtgcaacagcactggctctctccaggatccagaaggggtttggtctgggacttccttgctctccctcttctcaagtgccttaatagtagggtaagttgttaagagtgggggagagcaggctggcagctctccagtcaggaggcatagtttttactgaacaatcaaagcacttggactcttgctctttctactctgaactaataaatctgttgccaagctg

SEQ ID NO: 199461 - DNA, 578 bp, Homo sapiens
  Payload ID: 19350
  Gene Name: v-rel avian reticuloendotheliosis viral oncogene homolog A
  ENST ID: ENST00000527874
  CDS Start-End: 310-578
ttccctctggagaagaaggattccttaccccgttttccctcaagaagcaggtgtttctggttcctttcctccaccccttagtttcaccgcaggttctagggagcaggtcctgactcagttcccctgggagggagcctggcttctcctctccgtggagagcagattcctccttgtgagaatgggcattgggtgtgtgctgaccctgatctccctcccctttcagaactgttccccctcatcttcccggcagagccagcccaggcctctggcccctatgtggagatcattgagcagcccaagcagcggggcatgcgcttccgctacaagtgcgaggggcgctccgcgggcagcatcccaggcgagaggagcacagataccaccaagacccaccccaccatcaagatcaatggctacacaggaccagggacagtgcgcatctccctggtcaccaaggaccctcctcaccggcctcacccccacgagcttgtaggaaaggactgccgggatggcttctatgaggctgagctctgcccggaccgctgcatccacagtttccagaacctgggaatccagtgtgt

SEQ ID NO: 199462 - DNA, 771 bp, Homo sapiens
  Payload ID: 19350
  Gene Name: v-rel avian reticuloendotheliosis viral oncogene homolog A
  ENST ID: ENST00000527749
  CDS Start-End: 215-771
cgccggggccgccgcggctgtggcgggagcccccgcgccgctttccgccccttcctgcgccgacgggcgctgcgcagggagcggtcggcctgccggatggtggcgcggggcggggcaggcggggagggaactgttccccctcatcttcccggcagagccagcccaggcctctggcccctatgtggagatcattgagcagcccaagcagcggggcatgcgcttccgctacaagtgcgaggggcgctccgcgggcagcatcccaggcgagaggagcacagataccaccaagacccaccccaccatcaagatcaatggctacacaggaccagggacagtgcgcatctccctggtcaccaaggaccctcctcaccggcctcacccccacgagcttgtaggaaaggactgccgggatggcttctatgaggctgagctctgcccggaccgctgcatccacagtttccagaacctgggaatccagtgtgtgaagaagcgggacctggagcaggctatcagtcagcgcatccagaccaacaacaaccccttccaagttcctatagaagagcagcgtggggactacgacctgaatgctgtgcggctctgcttccaggtgacagtgcgggacccatcaggcaggcccctccgcctgccgcctgtcctttctcatcccatctttgacaatcgtgcccccaacactgccgagctcaagatctgccgagtgaaccgaaactctggcagctgcctcggtggggatgagatcttcctactgtgtga

SEQ ID NO: 199463 - DNA, 992 bp, Homo sapiens
  Payload ID: 19350
  Gene Name: v-rel avian reticuloendotheliosis viral oncogene homolog A
  ENST ID: ENST00000529389
  CDS Start-End: 129-590
cggccggattccgggcagtgacgcgacggcgggccgcgcggcgcatttccgcctctggcgaatggctcgtctgtagtgcacgccgcgggcccagctgcgaccccggccccgcccccgggaccccggccatggacgaactgttccccctcatcttcccggcagagccagcccaggcctctggcccctatgtggagatcattgagcagcccaagcagcggggcatgcgcttccgctacaagtgcgaggggcgctccgcgggcagcatcccaggcgagaggagcacagataccaccaagacccaccccaccatcaagatcaatggctacacaggaccagggacagtgcgcatctccctggtcaccaaggaccctcctcaccggcctcacccccacgagcttgtaggaaaggactgccgggatggcttctatgaggctgagctctgcccggaccgctgcatccacagttcctatagaagagcagcgtggggactacgacctgaatgctgtgcggctctgcttccaggtgacagtgcgggacccatcaggcaggcccctccgcctgccgcctgtcctttctcatcccatctttgacaatcgtgcccccaacactgccgagctcaagatctgccgagtgaaccgaaactctggcagctgcctcggtggggatgagatcttcctactgtgtgacaaggtgcagaaagaggacattgaggtgtatttcacgggaccaggctgggaggcccgaggctccttttcgcaagctgatgtgcaccgacaagtggccattgtgttccggacccctccctacgcagaccccagcctgcaggctcctgtgcgtgtctccatgcagctgcggcggccttccgaccgggagctcagtgagcccatggaattccagtacctgccagatacagacgatcgtcaccggattgaggagaaacgtaaaaggacatatgagaccttcaagagcatcatgaagaagagtcctttcag

SEQ ID NO: 199464 - DNA, 2236 bp, Homo sapiens
  Payload ID: 19350
  Gene Name: v-rel avian reticuloendotheliosis viral oncogene homolog A
  ENST ID: ENST00000615805
  CDS Start-End: 141-881
agcgcgcaggcgcggccggattccgggcagtgacgcgacggcgggccgcgcggcgcatttccgcctctggcgaatggctcgtctgtagtgcacgccgcgggcccagctgcgaccccggccccgcccccgggaccccggccatggacgaactgttccccctcatcttcccggcagagccagcccaggcctctggcccctatgtggagatcattgagcagcccaagcagcggggcatgcgcttccgctacaagtgcgaggggcgctccgcgggcagcatcccaggcgagaggagcacagataccaccaagacccaccccaccatcaagatcaatggctacacaggaccagggacagtgcgcatctccctggtcaccaaggaccctcctcaccggcctcacccccacgagcttgtaggaaaggactgccgggatggcttctatgaggctgagctctgcccggaccgctgcatccacagtttccagaacctgggaatccagtgtgtgaagaagcgggacctggagcaggctatcagtcagcgcatccagaccaacaacaaccccttccaagttcctatagaagagcagcgtggggactacgacctgaatgctgtgcggctctgcttccaggtgacagtgcgggacccatcaggcaggcccctccgcctgccgcctgtcctttctcatcccatctttgacaatcgtgcccccaacactgccgagctcaagatctgccgagtgaaccgaaactctggcagctgcctcggtggggatgagatcttcctactgtgtgacaaggtgcagaaagaggacattgagttctgtccccaagccagcaccccagccctatccctttacgtcatccctgagcaccatcaactatgatgagtttcccaccatggtgtttccttctgggcagatcagccaggcctcggccttggccccggcccctccccaagtcctgccccaggctccagcccctgcccctgctccagccatggtatcagctctggcccaggccccagcccctgtcccagtcctagccccaggccctcctcaggctgtggccccacctgcccccaagcccacccaggctggggaaggaacgctgtcagaggccctgctgcagctgcagtttgatgatgaagacctgggggccttgcttggcaacagcacagacccagctgtgttcacagacctggcatccgtcgacaactccgagtttcagcagctgctgaaccagggcatacctgtggccccccacacaactgagcccatgctgatggagtaccctgaggctataactcgcctagtgacaggggcccagaggccccccgacccagctcctgctccactgggggccccggggctccccaatggcctcctttcaggagatgaagacttctcctccattgcggacatggacttctcagccctgctgagtcagatcagctcctaagggggtgacgcctgccctccccagagcactgggttgcaggggattgaagccctccaaaagcacttacggattctggtggggtgtgttccaactgcccccaactttgtggatgtcttccttggaggggggagccatattttattcttttattgtcagtatctgtatctctctctctttttggaggtgcttaagcagaagcattaacttctctggaaaggggggagctggggaaactcaaacttttcccctgtcctgatggtcagctcccttctctgtagggaactctggggtcccccatccccatcctccagcttctggtactctcctagagacagaagcaggctggaggtaaggcctttgagcccacaaagccttatcaagtgtcttccatcatggattcattacagcttaatcaaaataacgccccagataccagcccctgtatggcactggcattgtccctgtgcctaacaccagcgtttgaggggctggccttcctgccctacagaggtctctgccggctctttccttgctcaaccatggctgaaggaaaccagtgcaacagcactggctctctccaggatccagaaggggtttggtctgggacttccttgctctccctcttctcaagtgccttaatagtagggtaagttgttaagagtgggggagagcaggctggcagctctccagtcaggaggcatagtttttactgaacaatcaaagcacttggactcttgctctttctactctgaactaataaatctgttgccaagctggctag

SEQ ID NO: 199465 - DNA, 2266 bp, Homo sapiens
  Payload ID: 19350
  Gene Name: v-rel avian reticuloendotheliosis viral oncogene homolog A
  ENST ID: ENST00000612991
  CDS Start-End: 141-1487
agcgcgcaggcgcggccggattccgggcagtgacgcgacggcgggccgcgcggcgcatttccgcctctggcgaatggctcgtctgtagtgcacgccgcgggcccagctgcgaccccggccccgcccccgggaccccggccatggacgaactgttccccctcatcttcccggcagagccagcccaggcctctggcccctatgtggagatcattgagcagcccaagcagcggggcatgcgcttccgctacaagtgcgaggggcgctccgcgggcagcatcccaggcgagaggagcacagataccaccaagacccaccccaccatcaagatcaatggctacacaggaccagggacagtgcgcatctccctggtcaccaaggaccctcctcaccggcctcacccccacgagcttgtaggaaaggactgccgggatggcttctatgaggctgagctctgcccggaccgctgcatccacagtttccagaacctgggaatccagtgtgtgaagaagcgggacctggagcaggctatcagtcagcgcatccagaccaacaacaaccccttccaagttcctatagaagagcagcgtggggactacgacctgaatgctgtgcggctctgcttccaggtgacagtgcgggacccatcaggcaggcccctccgcctgccgcctgtcctttctcatcccatctttgacaatcgtgcccccaacactgccgagctcaagatctgccgagtgaaccgaaactctggcagctgcctcggtggggatgagatcttcctactgtgtgacaaggtgcagaaagaggacattgaggtgtatttcacgggaccaggctgggaggcccgaggctccttttcgcaagctgatgtgcaccgacaagtggccattgtgttccggacccctccctacgcagaccccagcctgcaggctcctgtgcgtgtctccatgcagctgcggcggccttccgaccgggagctcagtgagcccatggaattccagtacctgccagatacagacgatcgtcaccggattgaggagaaacgtaaaaggacatatgagaccttcaagagcatcatgaagaagagtcctttcagcggacccaccgacccccggcctccacctcgacgcattgctgtgccttcccgcagctcagcttctgtccccaagccagcaccccagccctatccctttacgtcatccctgagcaccatcaactatgatgagtttcccaccatggtgtttccttctgggcagatcagccaggcctcggccttggccccggcccctccccaagtcctgccccaggctccagcccctgcccctgctccagccatggtatcagctctggcccagaggccccccgacccagctcctgctccactgggggccccggggctccccaatggcctcctttcaggagatgaagacttctcctccattgcggacatggacttctcagccctgctgagtcagatcagctcctaagggggtgacgcctgccctccccagagcactgggttgcaggggattgaagccctccaaaagcacttacggattctggtggggtgtgttccaactgcccccaactttgtggatgtcttccttggaggggggagccatattttattcttttattgtcagtatctgtatctctctctctttttggaggtgcttaagcagaagcattaacttctctggaaaggggggagctggggaaactcaaacttttcccctgtcctgatggtcagctcccttctctgtagggaactctggggtcccccatccccatcctccagcttctggtactctcctagagacagaagcaggctggaggtaaggcctttgagcccacaaagccttatcaagtgtcttccatcatggattcattacagcttaatcaaaataacgccccagataccagcccctgtatggcactggcattgtccctgtgcctaacaccagcgtttgaggggctggccttcctgccctacagaggtctctgccggctctttccttgctcaaccatggctgaaggaaaccagtgcaacagcactggctctctccaggatccagaaggggtttggtctgggacttccttgctctccctcttctcaagtgccttaatagtagggtaagttgttaagagtgggggagagcaggctggcagctctccagtcaggaggcatagtttttactgaacaatcaaagcacttggactcttgctctttctactctgaactaataaatctgttgccaagctggct

SEQ ID NO: 199466 - DNA, 2294 bp, Homo sapiens
  Payload ID: 19351
  Gene Name: v-rel avian reticuloendotheliosis viral oncogene homolog B
  Uniprot ID: Q01201
  ENST ID: ENST00000221452
  CDS Start-End: 151-1890
cccgccgcccgcccggcccggccccgcgccccgcgcagccccgggcgccgcgcgtcctgcccggcctgcggccccagcccttgcgccgctcgtccgacccgcgatcgtccaccagaccgtgcctcccggccgcccggccggcccgcgtgcatgcttcggtctgggccagcctctgggccgtccgtccccactggccgggccatgccgagtcgccgcgtcgccagaccgccggctgcgccggagctgggggccttagggtcccccgacctctcctcactctcgctcgccgtttccaggagcacagatgaattggagatcatcgacgagtacatcaaggagaacggcttcggcctggacgggggacagccgggcccgggcgaggggctgccacgcctggtgtctcgcggggctgcgtccctgagcacggtcaccctgggccctgtggcgcccccagccacgccgccgccttggggctgccccctgggccgactagtgtccccagcgccgggcccgggcccgcagccgcacctggtcatcacggagcagcccaagcagcgcggcatgcgcttccgctacgagtgcgagggccgctcggccggcagcatccttggggagagcagcaccgaggccagcaagacgctgcccgccatcgagctccgggattgtggagggctgcgggaggtggaggtgactgcctgcctggtgtggaaggactggcctcaccgagtccacccccacagcctcgtggggaaagactgcaccgacggcatctgcagggtgcggctccggcctcacgtcagcccccggcacagttttaacaacctgggcatccagtgtgtgaggaagaaggagattgaggctgccattgagcggaagattcaactgggcattgacccctacaacgctgggtccctgaagaaccatcaggaagtagacatgaatgtggtgaggatctgcttccaggcctcatatcgggaccagcagggacagatgcgccggatggatcctgtgctttccgagcccgtctatgacaagaaatccacaaacacatcagagctgcggatttgccgaattaacaaggaaagcgggccgtgcaccggtggcgaggagctctacttgctctgcgacaaggtgcagaaagaggacatatcagtggtgttcagcagggcctcctgggaaggtcgggctgacttctcccaggccgacgtgcaccgccagattgccattgtgttcaagacgccgccctacgaggacctggagattgtcgagcccgtgacagtcaacgtcttcctgcagcggctcaccgatggggtctgcagcgagccattgcctttcacgtacctgcctcgcgaccatgacagctacggcgtggacaagaagcggaaacgggggatgcccgacgtccttggggagctgaacagctctgacccccatggcatcgagagcaaacggcggaagaaaaagccggccatcctggaccacttcctgcccaaccacggctcaggcccgttcctcccgccgtcagccctgctgccagaccctgacttcttctctggcaccgtgtccctgcccggcctggagccccctggcgggcctgacctcctggacgatggctttgcctacgaccctacggcccccacactcttcaccatgctggacctgctgcccccggcaccgccacacgctagcgctgttgtgtgcagcggaggtgccggggccgtggttggggagacccccggccctgaaccactgacactggactcgtaccaggccccgggccccggggatggaggcaccgccagccttgtgggcagcaacatgttccccaatcattaccgcgaggcggcctttgggggcggcctcctatccccggggcctgaagccacgtagccccgcgatgccagaggaggggcactgggtggggagggaggtggaggagccgtgcaatcccaaccaggatgtctagcacccccatccccttggcccttcctcatgcttctgaagtggacatattcagccttggcgagaagctccgttgcacgggtttccccttgagcccattttacagatgaggaaactgagtccggagaggaaaagggacatggctcccgtgcactagcttgttacagctgcctctgtccccacatgtgggggcaccttctccagtaggattcggaaaagattgtacatatgggaggagggggcagattcctggccctccctccccagacttgaaggtggggggtaggttggttgttcagagtcttcccaataaagatgagtttttgagcctc

SEQ ID NO: 199467 - DNA, 2219 bp, Homo sapiens
  Payload ID: 19351
  Gene Name: v-rel avian reticuloendotheliosis viral oncogene homolog B
  ENST ID: ENST00000505236
  CDS Start-End: 120-1850
cgcgcagccccgggcgccgcgcgtcctgcccggcctgcggccccagcccttgcgccgctcgtccgacccgcgatcgtccaccagaccgtgcctcccggccgcccggccggcccgcgtgcatgcttcggtctgggccagcctctgggccgtccgtccccactggccgggccatgccgagtcgccgcgtcgccagaccgccggctgcgccggagctgggggccttagggtcccccgacctctcctcactctcgctcgccgtttccaggagcacagagatcatcgacgagtacatcaaggagaacggcttcggcctggacgggggacagccgggcccgggcgaggggctgccacgcctggtgtctcgcggggctgcgtccctgagcacggtcaccctgggccctgtggcgcccccagccacgccgccgccttggggctgccccctgggccgactagtgtccccagcgccgggcccgggcccgcagccgcacctggtcatcacggagcagcccaagcagcgcggcatgcgcttccgctacgagtgcgagggccgctcggccggcagcatccttggggagagcagcaccgaggccagcaagacgctgcccgccatcgagctccgggattgtggagggctgcgggaggtggaggtgactgcctgcctggtgtggaaggactggcctcaccgagtccacccccacagcctcgtggggaaagactgcaccgacggcatctgcagggtgcggctccggcctcacgtcagcccccggcacagttttaacaacctgggcatccagtgtgtgaggaagaaggagattgaggctgccattgagcggaagattcaactgggcattgacccctacaacgctgggtccctgaagaaccatcaggaagtagacatgaatgtggtgaggatctgcttccaggcctcatatcgggaccagcagggacagatgcgccggatggatcctgtgctttccgagcccgtctatgacaagaaatccacaaacacatcagagctgcggatttgccgaattaacaaggaaagcgggccgtgcaccggtggcgaggagctctacttgctctgcgacaaggtgcagaaagaggacatatcagtggtgttcagcagggcctcctgggaaggtcgggctgacttctcccaggccgacgtgcaccgccagattgccattgtgttcaagacgccgccctacgaggacctggagattgtcgagcccgtgacagtcaacgtcttcctgcagcggctcaccgatggggtctgcagcgagccattgcctttcacgtacctgcctcgcgaccatgacagctacggcgtggacaagaagcggaaacgggggatgcccgacgtccttggggagctgaacagctctgacccccatggcatcgagagcaaacggcggaagaaaaagccggccatcctggaccacttcctgcccaaccacggctcaggcccgttcctcccgccgtcagccctgctgccagaccctgacttcttctctggcaccgtgtccctgcccggcctggagccccctggcgggcctgacctcctggacgatggctttgcctacgaccctacggcccccacactcttcaccatgctggacctgctgcccccggcaccgccacacgctagcgctgttgtgtgcagcggaggtgccggggccgtggttggggagacccccggccctgaaccactgacactggactcgtaccaggccccgggccccggggatggaggcaccgccagccttgtgggcagcaacatgttccccaatcattaccgcgaggcggcctttgggggcggcctcctatccccggggcctgaagccacgtagccccgcgatgccagaggaggggcactgggtggggagggaggtggaggagccgtgcaatcccaaccaggatgtctagcacccccatccccttggcccttcctcatgcttctgaagtggacatattcagccttggcgagaagctccgttgcacgggtttccccttgagcccattttacagatgaggaaactgagtccggagaggaaaagggacatggctcccgtgcactagcttgttacagctgcctctgtccccacatgtgggggcaccttctccagtaggattcggaaaagattgtacatatgggaggagggggcagattcctggccctccctccccagacttgaaggtggggggtaggttggttgttc

SEQ ID NO: 199468 - DNA, 840 bp, Homo sapiens
  Payload ID: 19351
  Gene Name: v-rel avian reticuloendotheliosis viral oncogene homolog B
  ENST ID: ENST00000509480
  CDS Start-End: 120-296
cgcgcagccccgggcgccgcgcgtcctgcccggcctgcggccccagcccttgcgccgctcgtccgacccgcgatcgtccaccagaccgtgcctcccggccgcccggccggcccgcgtgcatgcttcggtctgggccagcctctgggccgtccgtccccactggccgggccatgccgagtcgccgcgtcgccagaccgccggctgcgccggagctgggggccttagggtcccccgacctctcctcactctcgctcgccgtttccaggagcacaggttcatccagcacagatgcctaagaaggattttcccagttcaagtgacttgaggttggccctgccactgacctagagcgtgtcccttcctctctgccagcctcagtatccccatctgccaaattggggggaccttggcaccctactggcttcacagatcccatgagataaggggtgcaggaaaactacctttcaaggggcaaaggtctggctgccaggagccactccctgagaacagaggaggacagatctagcagcggaacagatgaattggagatcatcgacgagtacatcaaggagaacggcttcggcctggacgggggacagccgggcccgggcgaggggctgccacgcctggtgtctcgcggggctgcgtccctgagcacggtcaccctgggccctgtggcgcccccagccacgccgccgccttggggctgccccctgggccgactagtgtccccagcgccgggcccgggcccgcagccgcacctggtcatcacggagcagcccaagcagcgcggcatgcgcttccgctacgagtgcgagggccgctcggccggcagcatcc

SEQ ID NO: 199469 - DNA, 760 bp, Homo sapiens
  Payload ID: 19351
  Gene Name: v-rel avian reticuloendotheliosis viral oncogene homolog B
  ENST ID: ENST00000589972
  CDS Start-End: 1-428
gcagcgagccattgcctttcacgtacctgcctcgcgaccatggcccgttcctcccgccgtcagccctgctgccagaccctgacttcttctctggcaccgtgtccctgcccggcctggagccccctggcgggcctgacctcctggacgatggctttgcctacgaccctacggcccccacactcttcaccatgctggacctgctgcccccggcaccgccacacgctagcgctgttgtgtgcagcggaggtgccggggccgtggttggggagacccccggccctgaaccactgacactggactcgtaccaggccccgggccccggggatggaggcaccgccagccttgtgggcagcaacatgttccccaatcattaccgcgaggcggcctttgggggcggcctcctatccccggggcctgaagccacgtagccccgcgatgccagaggaggggcactgggtggggagggaggtggaggagccgtgcaatcccaaccaggatgtctagcacccccatccccttggcccttcctcatgcttctgaagtggacatattcagccttggcgagaagctccgttgcacgggtttccccttgagcccattttacagatgaggaaactgagtccggagaggaaaagggacatggctcccgtgcactagcttgttacagctgcctctgtccccacatgtgggggcaccttctccagtaggattcggaaaagattgtacatatgggaggagggggcagattcctggccctccc

SEQ ID NO: 199470 - DNA, 2279 bp, Homo sapiens
  Payload ID: 19351
  Gene Name: v-rel avian reticuloendotheliosis viral oncogene homolog B
  Uniprot ID: Q01201
  ENST ID: ENST00000625761
  CDS Start-End: 132-1871
ggccccgcgccccgcgcagccccgggcgccgcgcgtcctgcccggcctgcggccccagcccttgcgccgctcgtccgacccgcgatcgtccaccagaccgtgcctcccggccgcccggccggcccgcgtgcatgcttcggtctgggccagcctctgggccgtccgtccccactggccgggccatgccgagtcgccgcgtcgccagaccgccggctgcgccggagctgggggccttagggtcccccgacctctcctcactctcgctcgccgtttccaggagcacagatgaattggagatcatcgacgagtacatcaaggagaacggcttcggcctggacgggggacagccgggcccgggcgaggggctgccacgcctggtgtctcgcggggctgcgtccctgagcacggtcaccctgggccctgtggcgcccccagccacgccgccgccttggggctgccccctgggccgactagtgtccccagcgccgggcccgggcccgcagccgcacctggtcatcacggagcagcccaagcagcgcggcatgcgcttccgctacgagtgcgagggccgctcggccggcagcatccttggggagagcagcaccgaggccagcaagacgctgcccgccatcgagctccgggattgtggagggctgcgggaggtggaggtgactgcctgcctggtgtggaaggactggcctcaccgagtccacccccacagcctcgtggggaaagactgcaccgacggcatctgcagggtgcggctccggcctcacgtcagcccccggcacagttttaacaacctgggcatccagtgtgtgaggaagaaggagattgaggctgccattgagcggaagattcaactgggcattgacccctacaacgctgggtccctgaagaaccatcaggaagtagacatgaatgtggtgaggatctgcttccaggcctcatatcgggaccagcagggacagatgcgccggatggatcctgtgctttccgagcccgtctatgacaagaaatccacaaacacatcagagctgcggatttgccgaattaacaaggaaagcgggccgtgcaccggtggcgaggagctctacttgctctgcgacaaggtgcagaaagaggacatatcagtggtgttcagcagggcctcctgggaaggtcgggctgacttctcccaggccgacgtgcaccgccagattgccattgtgttcaagacgccgccctacgaggacctggagattgtcgagcccgtgacagtcaacgtcttcctgcagcggctcaccgatggggtctgcagcgagccattgcctttcacgtacctgcctcgcgaccatgacagctacggcgtggacaagaagcggaaacgggggatgcccgacgtccttggggagctgaacagctctgacccccatggcatcgagagcaaacggcggaagaaaaagccggccatcctggaccacttcctgcccaaccacggctcaggcccgttcctcccgccgtcagccctgctgccagaccctgacttcttctctggcaccgtgtccctgcccggcctggagccccctggcgggcctgacctcctggacgatggctttgcctacgaccctacggcccccacactcttcaccatgctggacctgctgcccccggcaccgccacacgctagcgctgttgtgtgcagcggaggtgccggggccgtggttggggagacccccggccctgaaccactgacactggactcgtaccaggccccgggccccggggatggaggcaccgccagccttgtgggcagcaacatgttccccaatcattaccgcgaggcggcctttgggggcggcctcctatccccggggcctgaagccacgtagccccgcgatgccagaggaggggcactgggtggggagggaggtggaggagccgtgcaatcccaaccaggatgtctagcacccccatccccttggcccttcctcatgcttctgaagtggacatattcagccttggcgagaagctccgttgcacgggtttccccttgagcccattttacagatgaggaaactgagtccggagaggaaaagggacatggctcccgtgcactagcttgttacagctgcctctgtccccacatgtgggggcaccttctccagtaggattcggaaaagattgtacatatgggaggagggggcagattcctggccctccctccccagacttgaaggtggggggtaggttggttgttcagagtcttcccaataaagatgagtttttgagcctccggg

SEQ ID NO: 199471 - DNA, 2997 bp, Homo sapiens
  Payload ID: 19352
  Gene Name: V-set and immunoglobulin domain containing 1
  Uniprot ID: Q86XK7
  ENST ID: ENST00000217957
  CDS Start-End: 118-1281
ggcgatgcccagcagataagccaggcaaacctcggtgtgatcgaagaagccaatttgagactcagcctagtccaggcaagctactggcacctgctgctctcaactaacctccacacaatggtgttcgcattttggaaggtctttctgatcctaagctgccttgcaggtcaggttagtgtggtgcaagtgaccatcccagacggtttcgtgaacgtgactgttggatctaatgtcactctcatctgcatctacaccaccactgtggcctcccgagaacagctttccatccagtggtctttcttccataagaaggagatggagccaatttctatttacttttctcaaggtggacaagctgtagccatcgggcaatttaaagatcgaattacagggtccaacgatccaggtaatgcatctatcactatctcgcatatgcagccagcagacagtggaatttacatctgcgatgttaacaaccccccagactttctcggccaaaaccaaggcatcctcaacgtcagtgtgttagtgaaaccttctaagcccctttgtagcgttcaaggaagaccagaaactggccacactatttccctttcctgtctctctgcgcttggaacaccttcccctgtgtactactggcataaacttgagggaagagacatcgtgccagtgaaagaaaacttcaacccaaccaccgggattttggtcattggaaatctgacaaattttgaacaaggttattaccagtgtactgccatcaacagacttggcaatagttcctgcgaaatcgatctcacttcttcacatccagaagttggaatcattgttggggccttgattggtagcctggtaggtgccgccatcatcatctctgttgtgtgcttcgcaaggaataaggcaaaagcaaaggcaaaagaaagaaattctaagaccatcgcggaacttgagccaatgacaaagataaacccaaggggagaaagcgaagcaatgccaagagaagacgctacccaactagaagtaactctaccatcttccattcatgagactggccctgataccatccaagaaccagactatgagccaaagcctactcaggagcctgccccagagcctgccccaggatcagagcctatggcagtgcctgaccttgacatcgagctggagctggagccagaaacgcagtcggaattggagccagagccagagccagagccagagtcagagcctggggttgtagttgagcccttaagtgaagatgaaaagggagtggttaaggcataggctggtggcctaagtacagcattaatcattaaggaacccattactgccatttggaattcaaataacctaaccaacctccacctcctccttccattttgaccaaccttcttctaacaaggtgctcattcctactatgaatccagaataaacacgccaagataacagctaaatcagcaagggttcctgtattaccaatatagaatactaacaattttactaacacgtaagcataacaaatgacagggcaagtgatttctaacttagttgagttttgcaacagtacctgtgttgttatttcagaaaatattatttctctctttttaactactctttttttttattttagacagagtcttgctccgtcgcgcaggctgtgatcgtagtggtgcgatctcggctcactgcaacctccgctccctgggttcaagcgattctcctgcctgagcctcctgagtagctgggactacaggcacgtgccaccacgcccggctaattttttgtatttttagtagagatggggtttcacgttgttagccaggatggtctccatctcctgacctcatgatccgcccaccttggcctcccaaaatgctgggattacaggcatgagccactgcgcccggcctctttttagctactcttatgttccacatgcacatatgacaaggtggcattaattagattcaatattatttctaggaatagttcctcattcatttttatattgaccactaagaaaataattcatcagcattatctcatagattggaaaattttctccaaatacaatagaggagaatatgtaaagggtatacattaattggtacgtagcatttaaaatcaggtcttataattaatgcttcattcctcatattagatttcccaagaaatcaccctggtatccaatatctgagcatggcaaatttaaaaaataacacaatttcttgcctgtaaccctagcactttgggaggccgaggcaggtggatcacctgaggtcaggagttcgagaccagcctggccaacatggcgaaaccccttctctactaaaaatacaaaaattagctgggcgtggtagtgcatgcctgtaatcccagctacttgggaggctgaggcaggagaatcgcttgaacccaggaggtggaggttgcagtgagccgagattgtgccactgcactccaacctgggtgacagagtgagattccatctgaaaaacaaaaacaaaaacagaaaacaaacaaacaaaaaacaaaaaatccccacaactttgtcaaataatgtacaggcaaacactttcaaatataatttccttcagtgaatacaaaatgttgatatcataggtgatgtacaatttagttttgaatgagttattatgttatcactgtgtctgatgttatctactttgaaaggcagtccagaaaagtgttctaagtgaactcttaagatctattttagataatttcaactaattaaataacctgttttactgcctgtacattccacattaataaagcgataccaatcttatatgaatgctaatattactaaaatgcactgatatcacttcttcttcccctgttgaaaagctttctcatgatcatatttcacccacatctcaccttgaagaaacttacaggtagacttaccttttcacttgtggaattaatcatatttaaatcttactttaaggctcaataaataatactcataatgtctca

SEQ ID NO: 199472 - DNA, 3236 bp, Homo sapiens
  Payload ID: 19352
  Gene Name: V-set and immunoglobulin domain containing 1
  Uniprot ID: Q86XK7
  ENST ID: ENST00000415430
  CDS Start-End: 162-1433
aaagtctatacgcaataagtaagcccaaagaggcatgtttgcttggcgatgcccagcagataagccaggcaaacctcggtgtgatcgaagaagccaatttgagactcagcctagtccaggcaagctactggcacctgctgctctcaactaacctccacacaatggtgttcgcattttggaaggtctttctgatcctaagctgccttgcaggtcaggttagtgtggtgcaagtgaccatcccagacggtttcgtgaacgtgactgttggatctaatgtcactctcatctgcatctacaccaccactgtggcctcccgagaacagctttccatccagtggtctttcttccataagaaggagatggagccaatttctcacagctcgtgcctcagtactgagggtatggaggaaaaggcagtcagtcagtgtctaaaaatgacgcacgcaagagacgctcggggaagatgtagctggacctctgagatttacttttctcaaggtggacaagctgtagccatcgggcaatttaaagatcgaattacagggtccaacgatccaggtaatgcatctatcactatctcgcatatgcagccagcagacagtggaatttacatctgcgatgttaacaaccccccagactttctcggccaaaaccaaggcatcctcaacgtcagtgtgttagtgaaaccttctaagcccctttgtagcgttcaaggaagaccagaaactggccacactatttccctttcctgtctctctgcgcttggaacaccttcccctgtgtactactggcataaacttgagggaagagacatcgtgccagtgaaagaaaacttcaacccaaccaccgggattttggtcattggaaatctgacaaattttgaacaaggttattaccagtgtactgccatcaacagacttggcaatagttcctgcgaaatcgatctcacttcttcacatccagaagttggaatcattgttggggccttgattggtagcctggtaggtgccgccatcatcatctctgttgtgtgcttcgcaaggaataaggcaaaagcaaaggcaaaagaaagaaattctaagaccatcgcggaacttgagccaatgacaaagataaacccaaggggagaaagcgaagcaatgccaagagaagacgctacccaactagaagtaactctaccatcttccattcatgagactggccctgataccatccaagaaccagactatgagccaaagcctactcaggagcctgccccagagcctgccccaggatcagagcctatggcagtgcctgaccttgacatcgagctggagctggagccagaaacgcagtcggaattggagccagagccagagccagagccagagtcagagcctggggttgtagttgagcccttaagtgaagatgaaaagggagtggttaaggcataggctggtggcctaagtacagcattaatcattaaggaacccattactgccatttggaattcaaataacctaaccaacctccacctcctccttccattttgaccaaccttcttctaacaaggtgctcattcctactatgaatccagaataaacacgccaagataacagctaaatcagcaagggttcctgtattaccaatatagaatactaacaattttactaacacgtaagcataacaaatgacagggcaagtgatttctaacttagttgagttttgcaacagtacctgtgttgttatttcagaaaatattatttctctctttttaactactctttttttttattttagacagagtcttgctccgtcgcgcaggctgtgatcgtagtggtgcgatctcggctcactgcaacctccgctccctgggttcaagcgattctcctgcctgagcctcctgagtagctgggactacaggcacgtgccaccacgcccggctaattttttgtatttttagtagagatggggtttcacgttgttagccaggatggtctccatctcctgacctcatgatccgcccaccttggcctcccaaaatgctgggattacaggcatgagccactgcgcccggcctctttttagctactcttatgttccacatgcacatatgacaaggtggcattaattagattcaatattatttctaggaatagttcctcattcatttttatattgaccactaagaaaataattcatcagcattatctcatagattggaaaattttctccaaatacaatagaggagaatatgtaaagggtatacattaattggtacgtagcatttaaaatcaggtcttataattaatgcttcattcctcatattagatttcccaagaaatcaccctggtatccaatatctgagcatggcaaatttaaaaaataacacaatttcttgcctgtaaccctagcactttgggaggccgaggcaggtggatcacctgaggtcaggagttcgagaccagcctggccaacatggcgaaaccccttctctactaaaaatacaaaaattagctgggcgtggtagtgcatgcctgtaatcccagctacttgggaggctgaggcaggagaatcgcttgaacccaggaggtggaggttgcagtgagccgagattgtgccactgcactccaacctgggtgacagagtgagattccatctgaaaaacaaaaacaaaaacagaaaacaaacaaacaaaaaacaaaaaatccccacaactttgtcaaataatgtacaggcaaacactttcaaatataatttccttcagtgaatacaaaatgttgatatcataggtgatgtacaatttagttttgaatgagttattatgttatcactgtgtctgatgttatctactttgaaaggcagtccagaaaagtgttctaagtgaactcttaagatctattttagataatttcaactaattaaataacctgttttactgcctgtacattccacattaataaagcgataccaatcttatatgaatgctaatattactaaaatgcactgatatcacttcttcttcccctgttgaaaagctttctcatgatcatatttcacccacatctcaccttgaagaaacttacaggtagacttaccttttcacttgtggaattaatcatatttaaatcttactttaaggctcaataaataatactcataatgtctcattttagtgactcctaaggctagtccttttataaacaactttttctgacatagcatttatgtataataaaccagacatttaaagtgta

SEQ ID NO: 199473 - DNA, 570 bp, Homo sapiens
  Payload ID: 19352
  Gene Name: V-set and immunoglobulin domain containing 1
  ENST ID: ENST00000458383
  CDS Start-End: 67-570
aatttgagactcagcctagtccaggcaagctactggcacctgctgctctcaactaacctccacacaatggtgttcgcattttggaaggtctttctgatcctaagctgccttgcaggtcaggttagtgtggtgcaagtgaccatcccagacggtttcgtgaacgtgactgttggatctaatgtcactctcatctgcatctacaccaccactgtggcctcccgagaacagctttccatccagtggtctttcttccataagaaggagatggagccaatttctcacagctcgtgcctcagtactgagggtatggaggaaaaggcagtcagtcagtgtctaaaaatgacgcacgcaagagacgctcggggaagatgtagctggacctctgagatttacttttctcaaggtggacaagctgtagccatcgggcaatttaaagatcgaattacagggtccaacgatccaggtaatgcatctatcactatctcgcatatgcagccagcagacagtggaatttacatctgcgatgttaacaaccccccagactttctcggccaaaaccaaggcatcctc

SEQ ID NO: 199474 - DNA, 4946 bp, Homo sapiens
  Payload ID: 19353
  Gene Name: V-set and immunoglobulin domain containing 10
  Uniprot ID: Q8N0Z9
  ENST ID: ENST00000359236
  CDS Start-End: 278-1900
cggcaggagtaggctggcgggcgcagggggcggggtgcgccctccctccccggccagggcgctcgggagcggggacccgagcctgcagccgagctccgctgccggccctggacactcggctcagccaagcatccttcctgggggccgaggaagtggggccactctgccgttccgaggacctgggaggagccctcggtaccccgggccccggggccctggggcacacacgtccagcccagcccgagcctgcgtttcctgagccgggatctggggcgagatggccgcaggcggcagtgcgcccgagccccgcgtcctcgtctgcctcggggcgctcctggccggctgggtcgccgtaggattggaggctgttgtcattggagaagttcatgagaatgttactctgcactgtggcaacatctcgggactgaggggccaggtgacctggtaccggaacaactcggagcctgtcttccttctctcgtccaactctagcctccggccagctgagcctcgcttctctctagtggatgccacctccctgcacattgaatcgctgagcctgggagatgagggaatctacacctgccaggagatcctgaatgtgactcagtggttccaagtgtggctgcaggtggccagcggcccctatcagattgaggtccacatcgtggccaccggcacactccccaacggcaccctctacgcagccaggggctcccaggtggacttcagctgcaacagcagctccaggccaccacccgtggttgaatggtggttccaggccctgaattccagcagcgagtcctttggccacaacctgacagtcaactttttctcactgttactgatatcgccaaacctccaagggaactacacctgtttagccttgaatcagctcagcaagagacatcgaaaggtgaccaccgagctcctggtctactatccccctccatcagctccccagtgctgggcacagatggcatcaggatcgttcatgttgcagcttacctgtcgctgggatgggggataccctgaccctgacttcctgtggatagaagagccaggaggtgtaatcgtggggaagtcaaagctgggggtggaaatgctgagcgagtcccagctgtcggatggcaagaagttcaagtgtgttacaagccacatagttgggccagagtcgggcgccagctgcatggtgcagatcaggggtccctcccttctctctgagcccatgaagacttgcttcactgggggcaatgtgacgcttacatgccaggtgtctggggcctacccccctgccaagatcctgtggctgaggaaccttacccagcccgaggtgatcatccagcctagcagccgccatctcattacccaggatggccagaactccaccctcactatccacaactgctcccaggacctggatgagggctactacatctgccgagctgacagccctgtaggggtgagggagatggaaatctggctgagtgtgaaagaacctttaaatatcggggggattgtgggaaccattgtgagcctccttctgctgggactggccattatctcagggcttctgttgcattatagccctgtgttctgctggaaagtaggaaacacttccaggggacaaaacatggatgatgtcatggttttggtggattcagaagaggaagaggaggaggaggaggaggaggaggaagatgctgcagtaggggaacaggagggagcacgtgagagagaggagttgccaaaagaaatacctaagcaggaccacattcacagagtgaccgccttggtgaatgggaacatagaacagatgggaaatggattccaggatcttcaagatgacagcagtgaggagcaaagtgacattgttcaagaagaagacaggccagtctgaagaagaggatggtccatggttgtcttgctctgaaagcttggagagctacattgaagacgagctcttcattcagctttgactccacctgcacccctggcgggggcttgcactaacaatgtttgggtctcagcaaaaaacaaaaccaagcacacacatctttccttccatgtattgaaaaacattggtttgatttgctctaagttttcccaatgatgtttaaaagctttgagaaggaaagctgctttggtgtctgaggtgccacttctgctgtgaatcctggctttatccaggttgatctactgtgatagatgctgatttagagggaacagaggtcagggaagcactgggtcttggtgccttttgccgcttttttttttttttttttttttttttgagacggagtctccctctattgcccaggctggagtgcaatggcacgatcttggctcaccacaacttctgcctcccaggttcaagcgattctcctgcctcagccacggcaccttgcaaatatcagctccttggaacaggtgaagttccaggtaccaatgccaatcagaggaaggcagtttggttcaggctttggagttagaaacacctgaagttgaatctgggctctgttgcttccttctttcatgggctagagcacgactctttacctctctcttggcctcaatttcctcacctgtaaaatagatgaggaagctgctcacttattattgtctcgttctgaaagcttggaaagctacatcgaagatgagctcttcattcagctttgatttgacctgtacccctggtgggggattgcactggcaacatttgggtctcagcaaaaaaaccaagcacacacatctttccttccatttattgaaaaacatctttgtaagatccattcattgaaaaacataatccatttattgaaaaatatctttgtaagatcacctgctaaatatgaaaatctgacttgaatttgtactctttaaagttgcgtatctgctctagtgggcaggacctagggcttaaaggggaacttcctttctccatttctaagaactgggactctaaaatgagaagctggttgtctgaagtaaccctgcaggtgtggttggggaaggtctgttttcttggatgaaggaactaaactaagcatatcagagcactgtcttaaccagttttatttccctggagatagaattcttttaaaaagagttagggagctggtaataggaagtgcctttcattataactacattttgcagagcttcatatttatatacaagcctcctaggtgatacactgttagcttgcagactttcctatgcttcatttctcctgttgctttcaaagaaggcaggagacacgtttaataacggagtatctggtgataagaattgcttgggcaaaccagctcatctggactctttctcagtcttggaagtgggaagaggaaaacttgtttccttcctgcttcttaaggatattctgagggtacactgatcaataacactaaatttggaatgaaaataccatgtgatgagtttagcctgctgatgcttccagtagatccttgtatagtttcaagatttaagttttccgatttcatataaatttcttaaagtcgaggaccttataagggtgcaatggatgtttgctaaatatgaaaaactgacttgaatttgcactctttaatgttgcgtatctgctctagtgggcaggacctagggcttaaaggggaacttcctttctccaattctaggaactgggactctaaaatgagaagctggttgtctgaagtaaccctgcaggtgtggttggggaaggtctgttttcttggatgaagggattaaactgagcaaatcactagaagtatgccctgtcccctgctcagaacactggggagctcaagagtgggctgcaatgtgcacccctcaggaatagctgtgaattgcaggtctactggctttttgctttttgtcttttgctgcaaggtaccccacgtacttaaccattctcaacagtgtaaatcagtgtcattttagaatgagatactcagcttgcttctaaagtcactgaattactgagtgagtctctcctttagagtcttcggcaaccaaattccagaattgaagagtctactactcagaggcaacaagattaaaaaaagaaaacacaaaaactgttgaggtgaaaaaaaaaaaaaaccctagctaggaacacagagaatgttttgtaggatcactgggatattttccacaacttcctcttctctagcacacacatctgttgataggaaatatttgagggtttttccactaccaaatgggagcttcatggtcctggtgtcaaacactataaacctttgaccagctgagctgtgactgctgtcacatatctgagtcctgtgtgcacagtaatatcctgggtcaggtaaaatccaggtcttcaagttttaaggattttttgaagaattcgggcttctttaagacgatccatgcccaaatccacaagcttgttgacagtggattacagtttgtgtggcaaagtccaagttgttacactgtgctttaaaaaaaatcttatctgcatgtattgttaacttagagaccatgagatctatttatcaggaccaggaagatacacacttcaggtccattgcaactgacttttttcttgtttttctcaaaccctggtggagcctgggaagggggcctccacaattctgtggctttgatattagccccaattctcacaagcacatacaagccccataattgccgcaggaaaacacaagatggaaaattgcaataacccatgcactgagacttagaaaatcatccttactaggcaaaatgtattatgatgcaataagtgccaactgatatttctcacgttgggactggccaggaactgctgcaaagaaaaataagcagctccttctccattatttacattttaagatgtggtggggggaggttgggagaaattagttctgaggttatcatatgccttttttaaaagataatggaataaagctatttttaagtaa

SEQ ID NO: 199475 - DNA, 802 bp, Homo sapiens
  Payload ID: 19353
  Gene Name: V-set and immunoglobulin domain containing 10
  ENST ID: ENST00000538357
  CDS Start-End: 234-802
cctccccggccagggcgctcgggagcggggacccgagcctgcagccgagctccgctgccggccctggacactcggctcagccaagcatccttcctgggggccgaggaagtggggccactctgccgttccgaggacctgggaggagccctcggtaccccgggccccggggccctggggcacacacgtccagcccagcccgagcctgcgtttcctgagccgggatctggggcgagatggccgcaggcggcagtgcgcccgagccccgcgtcctcgtctgcctcggggcgctcctggccggctgggtcgccgtaggattggaggctgttgtcattggagaagttcatgagaatgttactctgcactgtggcaacatctcgggactgaggggccaggtgacctggtaccggaacaactcggagcctgtcttccttctctcgtccaactctagcctccggccagctgagcctcgcttctctctagtggatgccacctccctgcacattgaatcgctgagcctgggagatgagggaatctacacctgccaggagatcctgaatgtgactcagtggttccaagtgtggctgcaggtggccaatccccctccatcagctccccagtgctgggcacagatggcatcaggatcgttcatgttgcagcttacctgtcgctgggatgggggataccctgaccctgacttcctgtggatagaagagccaggaggtgtaatcgtggggaagtcaaagctgggggtggaaatgctgagcgagtcccagctgtcggatggcaagaagttcaagtgtgt

SEQ ID NO: 199476 - DNA, 3397 bp, Homo sapiens
  Payload ID: 19354
  Gene Name: V-set and immunoglobulin domain containing 10 like
  Uniprot ID: Q86VR7
  ENST ID: ENST00000335624
  CDS Start-End: 1-2604
atggacaacccacaggctctgccactcttcctactcctggcctccttggtagggatcctcaccctcagagcctcttctggacttcagcaaaccaacttctcctctgccttctcttcagactcaaagagctcttcccaggggctgggtgtggaagttccctccatcaaacctcccagctggaaagttccagatcagttcctggattcaaaagcctctgctggaatctctgattccagctggtttcctgaggccctgagttccaacatgtctgggtccttctggtcaaatgtttctgctgagggccaagatttgagcccggtttcccccttctctgaaacccctggttctgaagtatttcctgatatttcggatcctcaagttcctgccaaagaccccaagccttccttcactgttaagaccccagcttcaaacatttctactcaagtctcccataccaaactgtctgttgaggccccagattcaaaattctccccggatgatatggatcttaaactctctgcccagagccctgaatccaaattttctgcagagacccactcagctgcaagctttccccagcaggtggggggcccactcgctgtgctggtggggaccaccatccggctccccctagtcccaatccccaaccctgggccccccacctctctggtggtctggcgccggggctcaaaggtgctggcagctgggggcctggggccaggggcacctctgatcagcctggaccctgctcaccgagaccacctgcgatttgaccaggcccggggggttctggagctcgcctctgcccagctggacgatgcaggggtctacacggctgaggtcatccgggcaggggtctcccagcagactcacgagttcacggtgggtgtgtatgagcccctaccccagctgtcggttcagcccaaggctccagagacagaggagggggcggccgagctccggctgcgctgcctggggtgggggccaggtcgcggggagctgagctggagccgggacggacgcgccctggaggcggcggaatcggagggagccgagacgccccggatgcgctcagagggcgaccagctgctcatcgtgcgccctgtgcgcagcgaccacgcccggtacacttgccgcgtccgcagccccttcggccacagggaggctgccgccgacgtcagcgtcttctacggcccggacccgccgaccatcacggtctcctcggaccgcgacgccgcgcctgcccgctttgtcaccgcgggcagtaacgtgaccttgcgctgcgccgccgcctcgcggccgcccgccgacatcacgtggagcctggcggacccggccgaggccgcggtgcccgcggggtcgcgcctcctgctgcccgcggtcggaccgggccacgcaggcacctacgcctgcctggcggcgaacccgcgtaccggccgccgccgccgctcgctgctcaaccttacagtggcggacctgccccccggggccccacagtgctcagttgaagggggtcccggggaccgcagcctccgcttccgctgctcgtggcccggcggggcccctgctgcctccctgcagttccagggtctccccgaaggcatccgcgccgggccagtgtcctctgtgctgctggcggccgtccccgcccacccccggctcagcggcgtccccatcacctgccttgctcgccacctggtggccacgcgtacctgcacagtcacgccggaggccccccgagaggtgctgctgcatccgctggtggcagagacacggttgggggaggcagaggtggcactggaggcctctggttgtcccccaccctcacgggcatcctgggcccgggaagggaggcccctggctccaggaggcgggagtcgcctgcggctcagtcaagatgggcggaaactccacatcggcaacttcagcctggattgggacctgggaaattactccgtgctgtgcagtggggcgctgggtgctggcggtgaccagatcaccctcattggaccctccatatcctcgtggaggcttcagagagccagagatgcagccgtgctgacttgggatgtggagcgcggggccctgatcagcagttttgagatccaggcatggccagatgggcctgctctgggcaggacttccacctacagggactgggtctccctgctcatcctggggcctcaggagcggtcagccgtggtgccccttccacctcggaacccagggacctggacctttcggatcctgcccatcctggggggccagccagggactccatcacaaagccgggtctaccgggccggccccacgttgagccatggggccatcgctggcatcgtcctgggctccctgctgggcctggcgctgctagccgtacttctcctcctttgcatctgctgcctgtgccgctttcgtggaaagactcctgagaaaaagaagcatccttctaccttggtccccgtggtcaccccctcagaaaagaagatgcatagtgtgaccccagtggagatttcatggcctctggacctcaaagtccctctggaggaccacagctcaactagggcctaccaagcacagaccccagttcagttgtctctgtaggcggaggctcaaagactgttcgcgcagccacacaggtgtgatcagagccagtggtctgccctgcacagggcgttttgggccagaacttcctatttcactccagcagcagccagggcctgctatgactgagggttggaccctgaaagtgggactttctgtctccctctcttgctgcagaagaagagtcttcctgtatttgtgcaagtaaggagatgtgacttcttggctgggaaactcttgctgatctaactgtgtggtttgcacaacctccaagcctctgcagcagacaggcagggcttgctgtgttgctctgagctagagagggagcttggccatgttctctgaaaaggtccccttacattcactttgccacctgtaggccacaccccatccagctcccagcatcttcatcttaaaacagatcagatcatgtcactcttctctttaaacgcttctacggcctgtgcatttcccttcagatattatccaaactcatcgtcgtgaccttcaaaaccttgtggtctggcctctgttggcctccctgacctcccctcccaattctttctctgcccccggactccagtatcacagtctgtctctcagccacaatttattttgcccctagagtttgctgtgcttataacacttctttttcccatatgtcattcatttctcaagtctaagagtagcagttaccatcttagacgaccgttcccttacccctcccttagtcttgggttaagtcccagaatccttgaatttgccgttcctgatacataaatatgtaatttct

SEQ ID NO: 199477 - DNA, 2297 bp, Homo sapiens
  Payload ID: 19354
  Gene Name: V-set and immunoglobulin domain containing 10 like
  ENST ID: ENST00000600663
  CDS Start-End: 90-680
gatgaccaggactgacgggccggcccagcactgagagggcggacattcctgggcatggaacactcgacaaagtcgacaagcggagttaaatgacctgccccccggggccccacagtgctcagttgaagggggtcccggggaccgcagcctccgcttccgctgctcgtggcccggcggggcccctgctgcctccctgcagttccagggtctccccgaaggcatccgcgccgggccagtgtcctctgtgctgctggcggccgtccccgcccacccccggctcagcggcgtccccatcacctgccttgctcgccacctggtggccacgcgtacctgcacagtcacgccggaggccccccgagaggtgctgctgcatccgctggtggcagagacacggttgggggaggcagaggtggcactggaggcctctggttgtcccccaccctcacgggcatcctgggcccgggaagggaggcccctggctccaggaggcgggagtcgcctgcggctcagtcaagatgggcggaaactccacatcggcaacttcagcctggattgggacctgggaaattactccgtgctgtgcagtggggcgctgggtgctggcggtgaccagatcaccctcattggaccctccatatcctcgtggaggcttcagagagccagagatgcagccgtgctgacttgggatgtggagcgcggggccctgatcagcagttttgagatccaggcatggccagatgggcctgctctgggcaggacttccacctacagggactgggtctccctgctcatcctggggcctcaggagcggtcagccgtggtgccccttccacctcggaacccagggacctggacctttcggatcctgcccatcctggggggccagccagggactccatcacaaagccgggtctaccgggccggccccacgttgagccatggggccatcgctggcatcgtcctgggctccctgctgggcctggcgctgctagccgtacttctcctcctttgcatctgctgcctgtgccgctttcgtggaaagactcctgagaaaaagaagcatccttctaccttggtccccgtggtcaccccctcagaaaagaagatgcatagtgtgaccccagtggagatttcatggcctctggacctcaaagtccctctggaggaccacagctcaactagggcctaccaagcacagaccccagttcagttgtctctgtaggcggaggctcaaagactgttcgcgcagccacacaggtgtgatcagagccagtggtctgccctgcacagggcgttttgggccagaacttcctatttcactccagcagcagccagggcctgctatgactgagggttggaccctgaaagtgggactttctgtctccctctcttgctgcagaagaagagtcttcctgtatttgtgcaagtaaggagatgtgacttcttggctgggaaactcttgctgatctaactgtgtggtttgcacaacctccaagcctctgcagcagacaggcagggcttgctgtgttgctctgagctagagagggagcttggccatgttctctgaaaaggtccccttacattcactttgccacctgtaggccacaccccatccagctcccagcatcttcatcttaaaacagatcagatcatgtcactcttctctttaaacgcttctacggcctgtgcatttcccttcagatattatccaaactcatcgtcgtgaccttcaaaaccttgtggtctggcctctgttggcctccctgacctcccctcccaattctttctctgcccccggactccagtatcacagtctgtctctcagccacaatttattttgcccctagagtttgctgtgcttataacacttctttttcccatatgtcattcatttctcaagtctaagagtagcagttaccatcttagacgaccgttcccttacccctcccttagtcttgggttaagtcccagaatccttgaatttgccgttcctgatacataaatatgtaatttcttgtgtggcctgagactctctctctaaactaagggctttacaaaagcagagaccacatcattaactcagcacttaacccagagcctcacacacagcaggcaatcaataaatatttgttgactgatcaaatgttttggtgccagtgaagagttgggcttgctgctgctgtcttcagcgtaagtcttgctttttcagctgggtttctaattgagaatttagagagtgcattggtgaggattcttttgactgcaagtaacaaaataaaatggtggcaagaactatg

SEQ ID NO: 199478 - DNA, 1148 bp, Homo sapiens
  Payload ID: 19355
  Gene Name: V-set and immunoglobulin domain containing 2
  Uniprot ID: Q96IQ7
  ENST ID: ENST00000326621
  CDS Start-End: 102-1085
gcccgggcggctgcccttgggtgctcccttccctgcccgacacccagaccgaccttgaccgcccacctggcaggagcaggacaggacggccggacgcggccatggccgagctcccggggccctttctctgcggggccctgctaggcttcctgtgcctgagtgggctggccgtggaggtgaaggtacccacagagccgctgagcacgcccctggggaagacagccgagctgacctgcacctacagcacgtcggtgggagacagcttcgccctggagtggagctttgtgcagcctgggaaacccatctctgagtcccatccaatcctgtacttcaccaatggccatctgtatccaactggttctaagtcaaagcgggtcagcctgcttcagaacccccccacagtgggggtggccacactgaaactgactgacgtccacccctcagatactggaacctacctctgccaagtcaacaacccaccagatttctacaccaatgggttggggctaatcaaccttactgtgctggttccccccagtaatcccttatgcagtcagagtggacaaacctctgtgggaggctctactgcactgagatgcagctcttccgagggggctcctaagccagtgtacaactgggtgcgtcttggaacttttcctacaccttctcctggcagcatggttcaagatgaggtgtctggccagctcattctcaccaacctctccctgacctcctcgggcacctaccgctgtgtggccaccaaccagatgggcagtgcatcctgtgagctgaccctctctgtgaccgaaccctcccaaggccgagtggccggagctctgattggggtgctcctgggcgtgctgttgctgtcagttgctgcgttctgcctggtcaggttccagaaagagagggggaagaagcccaaggagacatatgggggtagtgaccttcgggaggatgccatcgctcctgggatctctgagcacacttgtatgagggctgattctagcaaggggttcctggaaagaccctcgtctgccagcaccgtgacgaccaccaagtccaagctccctatggtcgtgtgacttctcccgatccctgagggcggtgagggggaatatcaataattaaagtctgtgggtaccata

SEQ ID NO: 199479 - DNA, 1191 bp, Homo sapiens
  Payload ID: 19355
  Gene Name: V-set and immunoglobulin domain containing 2
  Uniprot ID: Q96IQ7
  ENST ID: ENST00000403470
  CDS Start-End: 57-911
agaccgaccttgaccgcccacctggcaggagcaggacaggacggccggacgcggccatggccgagctcccggggccctttctctgcggggccctgctaggcttcctgtgcctgagtgggctggccgtggaggtgaaggtacccacagagccgctgagcacgcccctggggaagacagccgagctgacctgcacctacagcacgtcggtgggagacagcttcgccctggagtggagctttgtgcagcctgggaaacccatctctgagtcccatccaatcctgtacttcaccaatggccatctgtatccaactggttctaagtcaaagcgggtcagcctgcttcagaacccccccacagtgggggtggccacactgaaactgactgacgtccacccctcagatactggaacctacctctgccaagtcaacaacccaccagatttctacaccaatgggttggggctaatcaaccttactgtgctggttccccccagtaatcccttatgcagtcagagtggacaaacctctgtgggaggctctactgcactgagatgcagctcttccgagggggctcctaagccagtgtacaactgggtgcgtcttggaacttttcctacaccttctcctggcagcatggttcaagatgaggtgtctggccagctcattctcaccaacctctccctgacctcctcgggcacctaccgctgtgtggccaccaaccagatgggcagtgcatcctgtgagctgaccctctctgtgaccgaaccctcccaaggccgagtggccggagctctgattggggtgctcctgggcgtgctgttgctgtcagttgctgcgttctgcctggtcaggttccagaaagagagggggaagaagcccaaggagacatatgggggtagtgaccttcggtgagcaggagggctggggggtggcgcaaggagggaggaaagggcttgagttaaaagcgggtgcctgcaaccctcaaactccgacatcattcagtgtgtttaggggcaggaggtgttgttcagccgtggaatttgctggtggcagcagtgtaacctgtgtatttgagggtacaggcaagcggtacagggtggagtggctggtccacaagctgtggcagggaagctgtttgcaggactgccctgcccctcctcatatttaataaagtttacttttctgttccgaa

SEQ ID NO: 199480 - DNA, 1834 bp, Homo sapiens
  Payload ID: 19356
  Gene Name: V-set and immunoglobulin domain containing 4
  Uniprot ID: Q9Y279
  ENST ID: ENST00000374737
  CDS Start-End: 110-1309
atagggaaggaagggaagtaagcagtcacagacgctggcggccaccagaagtttgagcctctttggtagcaggaggctggaagaaaggacagaagtagctctggctgtgatggggatcttactgggcctgctactcctggggcacctaacagtggacacttatggccgtcccatcctggaagtgccagagagtgtaacaggaccttggaaaggggatgtgaatcttccctgcacctatgaccccctgcaaggctacacccaagtcttggtgaagtggctggtacaacgtggctcagaccctgtcaccatctttctacgtgactcttctggagaccatatccagcaggcaaagtaccagggccgcctgcatgtgagccacaaggttccaggagatgtatccctccaattgagcaccctggagatggatgaccggagccactacacgtgtgaagtcacctggcagactcctgatggcaaccaagtcgtgagagataagattactgagctccgtgtccagaaactctctgtctccaagcccacagtgacaactggcagcggttatggcttcacggtgccccagggaatgaggattagccttcaatgccaggctcggggttctcctcccatcagttatatttggtataagcaacagactaataaccaggaacccatcaaagtagcaaccctaagtaccttactcttcaagcctgcggtgatagccgactcaggctcctatttctgcactgccaagggccaggttggctctgagcagcacagcgacattgtgaagtttgtggtcaaagactcctcaaagctactcaagaccaagactgaggcacctacaaccatgacataccccttgaaagcaacatctacagtgaagcagtcctgggactggaccactgacatggatggctaccttggagagaccagtgctgggccaggaaagagcctgcctgtctttgccatcatcctcatcatctccttgtgctgtatggtggtttttaccatggcctatatcatgctctgtcggaagacatcccaacaagagcatgtctacgaagcagccagggcacatgccagagaggccaacgactctggagaaaccatgagggtggccatcttcgcaagtggctgctccagtgatgagccaacttcccagaatctgggcaacaactactctgatgagccctgcataggacaggagtaccagatcatcgcccagatcaatggcaactacgcccgcctgctggacacagttcctctggattatgagtttctggccactgagggcaaaagtgtctgttaaaaatgccccattaggccaggatctgctgacataattgcctagtcagtccttgccttctgcatggccttcttccctgctacctctcttcctggatagcccaaagtgtccgcctaccaacactggagccgctgggagtcactggctttgccctggaatttgccagatgcatctcaagtaagccagctgctggatttggctctgggcccttctagtatctctgccgggggcttctggtactcctctctaaataccagagggaagatgcccatagcactaggacttggtcatcatgcctacagacactattcaactttggcatcttgccaccagaagacccgagggaggctcagctctgccagctcagaggaccagctatatccaggatcatttctctttcttcagggccagacagcttttaattgaaattgttatttcacaggccagggttcagttctgctcctccactataagtctaatgttctgactctctcctggtgctcaataaatatctaatcataacagcaa

SEQ ID NO: 199481 - DNA, 1170 bp, Homo sapiens
  Payload ID: 19356
  Gene Name: V-set and immunoglobulin domain containing 4
  ENST ID: ENST00000427538
  CDS Start-End: 1-823
agaccatatccagcaggcaaagtaccagggccgcctgcatgtgagccacaaggttccaggagatgtatccctccaattgagcaccctggagatggatgaccggagccactacacgtgtgaagtcacctggcagactcctgatggcaaccaagtcgtgagagataagattactgagctccgtgtccagaaactctctgtctccaagcccacagtgacaactggcagcggttatggcttcacggtgccccagggaatgaggattagccttcaatgccaggctcggggttctcctcccatcagttatatttggtataagcaacagactaataaccaggaacccatcaaagtagcaaccctaagtaccttactcttcaagcctgcggtgatagccgactcaggctcctatttctgcactgccaagggccaggttggctctgagcagcacagcgacattgtgaagtttgtggtcaaagactcctcaaagctactcaagaccaagactgaggcacctacaaccatgacataccccttgaaagcaacatctacagtgaagcagtcctgggactggaccactgacatggatggctaccttggagagaccagtgctgggccaggaaagagcctgcctgtctttgccatcatcctcatcatctccttgtgctgtatggtggtttttaccatggcctatatcatgctctgtcggaagacatcccaacaagagcatgtctacgaagcagccagcccaaagtgtccgcctaccaacactggagccgctgggagtcactggctttgccctggaatttgccagatgcatctcaagtaagccagctgctggatttggctctgggcccttctagtatctctgccgggggcttctggtactcctctctaaataccagagggaagatgcccatagcactaggacttggtcatcatgcctacagacactattcaactttggcatcttgccaccagaagacccgagggaggctcagctctgccagctcagaggaccagctatatccaggatcatttctctttcttcagggccagacagcttttaattgaaattgttatttcacaggccagggttcagttctgctcctccactataagtctaatgttctgactctctcctggtgctcaataaatatctaatcataacagcaa

SEQ ID NO: 199482 - DNA, 1474 bp, Homo sapiens
  Payload ID: 19356
  Gene Name: V-set and immunoglobulin domain containing 4
  Uniprot ID: Q9Y279
  ENST ID: ENST00000412866
  CDS Start-End: 63-980
gaagtttgagcctctttggtagcaggaggctggaagaaaggacagaagtagctctggctgtgatggggatcttactgggcctgctactcctggggcacctaacagtggacacttatggccgtcccatcctggaagtgccagagagtgtaacaggaccttggaaaggggatgtgaatcttccctgcacctatgaccccctgcaaggctacacccaagtcttggtgaagtggctggtacaacgtggctcagaccctgtcaccatctttctacgtgactcttctggagaccatatccagcaggcaaagtaccagggccgcctgcatgtgagccacaaggttccaggagatgtatccctccaattgagcaccctggagatggatgaccggagccactacacgtgtgaagtcacctggcagactcctgatggcaaccaagtcgtgagagataagattactgagctccgtgtccagaaacactcctcaaagctactcaagaccaagactgaggcacctacaaccatgacataccccttgaaagcaacatctacagtgaagcagtcctgggactggaccactgacatggatggctaccttggagagaccagtgctgggccaggaaagagcctgcctgtctttgccatcatcctcatcatctccttgtgctgtatggtggtttttaccatggcctatatcatgctctgtcggaagacatcccaacaagagcatgtctacgaagcagccagggcacatgccagagaggccaacgactctggagaaaccatgagggtggccatcttcgcaagtggctgctccagtgatgagccaacttcccagaatctgggcaacaactactctgatgagccctgcataggacaggagtaccagatcatcgcccagatcaatggcaactacgcccgcctgctggacacagttcctctggattatgagtttctggccactgagggcaaaagtgtctgttaaaaatgccccattaggccaggatctgctgacataattgcctagtcagtccttgccttctgcatggccttcttccctgctacctctcttcctggatagcccaaagtgtccgcctaccaacactggagccgctgggagtcactggctttgccctggaatttgccagatgcatctcaagtaagccagctgctggatttggctctgggcccttctagtatctctgccgggggcttctggtactcctctctaaataccagagggaagatgcccatagcactaggacttggtcatcatgcctacagacactattcaactttggcatcttgccaccagaagacccgagggaggctcagctctgccagctcagaggaccagctatatccaggatcatttctctttcttcagggccagacagcttttaattgaaattgttatttcacaggccagggttcagttctgctcctccactataagtctaatgttctgactctctcctg

SEQ ID NO: 199483 - DNA, 2190 bp, Homo sapiens
  Payload ID: 19356
  Gene Name: V-set and immunoglobulin domain containing 4
  Uniprot ID: Q9Y279
  ENST ID: ENST00000455586
  CDS Start-End: 128-1093
ggagtttgagtgagagatatagggaaggaagggaagtaagcagtcacagacgctggcggccaccagaagtttgagcctctttggtagcaggaggctggaagaaaggacagaagtagctctggctgtgatggggatcttactgggcctgctactcctggggcacctaacagtggacacttatggccgtcccatcctggaagtgccagagagtgtaacaggaccttggaaaggggatgtgaatcttccctgcacctatgaccccctgcaaggctacacccaagtcttggtgaagtggctggtacaacgtggctcagaccctgtcaccatctttctacgtgactcttctggagaccatatccagcaggcaaagtaccagggccgcctgcatgtgagccacaaggttccaggagatgtatccctccaattgagcaccctggagatggatgaccggagccactacacgtgtgaagtcacctggcagactcctgatggcaaccaagtcgtgagagataagattactgagctccgtgtccagaaactctctgtctccaagcccacagtgacaactggcagcggttatggcttcacggtgccccagggaatgaggattagccttcaatgccaggctcggggttctcctcccatcagttatatttggtataagcaacagactaataaccaggaacccatcaaagtagcaaccctaagtaccttactcttcaagcctgcggtgatagccgactcaggctcctatttctgcactgccaagggccaggttggctctgagcagcacagcgacattgtgaagtttgtggtcaaagactcctcaaagctactcaagaccaagactgaggcacctacaaccatgacataccccttgaaagcaacatctacagtgaagcagtcctgggactggaccactgacatggatggctaccttggagagaccagtgctgggccaggaaagagcctgcctgtctttgccatcatcctcatcatctccttgtgctgtatggtggtttttaccatggcctatatcatgctctgtcggaagacatcccaacaagagcatgtctacgaagcagccaggtaagaaagtctctcctcttccatttttgaccccgtccctgccctcaattttgattactggcaggaaatgtggaggaaggggggtgtggcacagacccaatcctaaggccggaggccttcagggtcaggacatagctgccttccctctctcaggcaccttctgaggttgttttggccctctgaacacaaaggataatttagatccatctgccttctgcttccagaatccctgggtggtaggatcctgataattaattggcaagaattgaggcagaagggtgggaaaccaggaccacagccccaagtcccttcttatgggtggtgggctcttgggccatagggcacatgccagagaggccaacgactctggagaaaccatgagggtggccatcttcgcaagtggctgctccagtgatgagccaacttcccagaatctgggcaacaactactctgatgagccctgcataggacaggagtaccagatcatcgcccagatcaatggcaactacgcccgcctgctggacacagttcctctggattatgagtttctggccactgagggcaaaagtgtctgttaaaaatgccccattaggccaggatctgctgacataattgcctagtcagtccttgccttctgcatggccttcttccctgctacctctcttcctggatagcccaaagtgtccgcctaccaacactggagccgctgggagtcactggctttgccctggaatttgccagatgcatctcaagtaagccagctgctggatttggctctgggcccttctagtatctctgccgggggcttctggtactcctctctaaataccagagggaagatgcccatagcactaggacttggtcatcatgcctacagacactattcaactttggcatcttgccaccagaagacccgagggaggctcagctctgccagctcagaggaccagctatatccaggatcatttctctttcttcagggccagacagcttttaattgaaattgttatttcacaggccagggttcagttctgctcctccactataagtctaatgttctgactctctcctggtgctcaataaatatctaatcataacagc

SEQ ID NO: 199484 - DNA, 1818 bp, Homo sapiens
  Payload ID: 19357
  Gene Name: V-set and immunoglobulin domain containing 8
  Uniprot ID: Q5VU13
  ENST ID: ENST00000368100
  CDS Start-End: 137-1381
actcattgcaccttcctgccaccccaggcagtgtctgggccctcagctccccctccctccacctaccccctcacacccaccactacgaccccacgggatacccagcccagacggaggaaacaccgagcctagagacatgagagttggaggagcattccaccttctactcgtgtgcctgagcccagcactgctgtctgctgtgcggatcaacggggatggacaggaggtcctgtacctggcagaaggtgataatgtgaggctgggctgcccctacgtcctggaccctgaggactatggtcccaatgggctggacatcgagtggatgcaggtcaactcagaccccgcccaccaccgagagaacgtgttccttagttaccaggacaagaggatcaaccatggcagccttccccatctgcagcagagggtccgctttgcagcctcagacccaagccagtacgatgcctccatcaacctcatgaacctgcaggtatctgatacagccacttatgagtgccgggtgaagaagaccaccatggccacccggaaggtcattgtcactgtccaagcacgacctgcagtgcccatgtgctggacagagggccacatgacatatggcaacgatgtggtgctgaagtgctatgccagtgggggctcccagcccctctcctacaagtgggccaagatcagtgggcaccattacccctatcgagctgggtcttacacctcccagcacagctaccactcagagctgtcctaccaggagtccttccacagctccataaaccaaggcctgaacaatggggacctggtgttgaaggatatctccagagcagatgatgggctgtatcagtgcacagtggccaacaacgtgggctacagtgtttgtgtggtggaggtgaaggtctcagactcccggcgtataggcgtgatcatcggcatcgtcctgggctctctgctcgcgctgggctgcctggccgtaggcatctgggggctcgtctgctgctgctgcgggggctccggggctggcggcgcccgcggtgccttcggctacggcaacggcggcggggtcggcggaggggcctgcggcgacttggctagtgagatcagagaggacgccgtggcgcccgggtgcaaggccagcgggcgcggcagccgcgtcacccacctcctggggtacccgacgcagaacgtcagccgctccctgcgccgcaagtacgcgcctcccccctgcggcggccccgaggacgtggccctggcgccctgcaccgccgccgccgcctgcgaagcgggcccctccccggtctacgtcaaggtcaagagcgcggagccggctgactgcgccgaggggccggtgcagtgcaagaacggcctcttggtgtgagcgcgcgcgccgggccgggctgcgccccagccaggaggagggcgcggggctctctgtctgcagctggggacacgtcggggctggggacgacctcgctcgccccaggctgccaggcggctgggggtgaaggcatttccctaaggaaatgcgtagggaggcagagcctcctccccaaaagtgggaaggggcgggcgagggcggaggaaggcgatcctgagccttctccgcacccccgggaccgaaggcttgggggagagggagggaggaggaggctgagtgtcctagagcggctgaggccggaggcctggtgtccccagcctaagcagagggccccgggggccgggtgggtgggggtctgtctggacgaattgttctgtgtgtgaggtctgagctctgaggcagcagtgttagcacaataaagaaacattgagacgtga

SEQ ID NO: 199485 - DNA, 1023 bp, Homo sapiens
  Payload ID: 19358
  Gene Name: V-set and transmembrane domain containing 1
  Uniprot ID: Q6UX27
  ENST ID: ENST00000338372
  CDS Start-End: 177-887
gtgagaaggaaactgcaagagtggggcagagaaccagagtgtcagagcaaaacctcctctatctgcacatcctggggacgaaccgggcagccggagagctgcggccggcccagtcccgctccgcctttgaagggtaaaacccaaggcggggccttggttctggcagaagggacgctatgaccgcagaattcctctccctgctttgcctcgggctgtgtctgggctacgaagatgagaaaaagaatgagaaaccgcccaagccctccctccacgcctggcccagctcggtggttgaagccgagagcaatgtgaccctgaagtgtcaggctcattcccagaatgtgacatttgtgctgcgcaaggtgaacgactctgggtacaagcaggaacagagctcggcagaaaacgaagctgaattccccttcacggacctgaagcctaaggatgctgggaggtacttttgtgcctacaagacaacagcctcccatgagtggtcagaaagcagtgaacacttgcagctggtggtcacagataaacacgatgaacttgaagctccctcaatgaaaacagacaccagaaccatctttgtcgccatcttcagctgcatctccatccttctcctcttcctctcagtcttcatcatctacagatgcagccagcacagttcatcatctgaggaatccaccaagagaaccagccattccaaacttccggagcaggaggctgccgaggcagatttatccaatatggaaagggtatctctctcgacggcagacccccaaggagtgacctatgctgagctaagcaccagcgccctgtctgaggcagcttcagacaccacccaggagcccccaggatctcatgaatatgcggcactgaaagtgtagcaagaagacagccctggccactaaaggaggggggatcgtgctggccaaggttatcggaaatctggagatgcagatactgtgtttccttgctcttcgtccatatcaataaaattaagtttctcgtcttaaaaagaaa

SEQ ID NO: 199486 - DNA, 922 bp, Homo sapiens
  Payload ID: 19358
  Gene Name: V-set and transmembrane domain containing 1
  Uniprot ID: Q6UX27
  ENST ID: ENST00000376626
  CDS Start-End: 177-794
gtgagaaggaaactgcaagagtggggcagagaaccagagtgtcagagcaaaacctcctctatctgcacatcctggggacgaaccgggcagccggagagctgcggccggcccagtcccgctccgcctttgaagggtaaaacccaaggcggggccttggttctggcagaagggacgctatgaccgcagaattcctctccctgctttgcctcgggctgtgtctgggctacgaagatgagaaaaagaatgagaaaccgcccaagccctccctccacgcctggcccagctcggtggttgaagccgagagcaatgtgaccctgaagtgtcaggctcattcccagaatgtgacatttgtgctgcgcaaggtgaacgactctgggtacaagcaggaacagagctcggcagaaaacgaagctgaattccccttcacggacctgaagcctaaggatgctgggaggtacttttgtgcctacaagacaacagcctcccatgagtggtcagaaagcagtgaacacttgcagctggtggtcacagataaacacgatgaacttgaagctccctcaatgaaaacaggttcatcatctgaggaatccaccaagagaaccagccattccaaacttccggagcaggaggctgccgaggcagatttatccaatatggaaagggtatctctctcgacggcagacccccaaggagtgacctatgctgagctaagcaccagcgccctgtctgaggcagcttcagacaccacccaggagcccccaggatctcatgaatatgcggcactgaaagtgtagcaagaagacagccctggccactaaaggaggggggatcgtgctggccaaggttatcggaaatctggagatgcagatactgtgtttccttgctcttcgtccatatcaataaaattaagtttctcgtctta

SEQ ID NO: 199487 - DNA, 1041 bp, Homo sapiens
  Payload ID: 19358
  Gene Name: V-set and transmembrane domain containing 1
  Uniprot ID: Q6UX27
  ENST ID: ENST00000447872
  CDS Start-End: 177-701
gtgagaaggaaactgcaagagtggggcagagaaccagagtgtcagagcaaaacctcctctatctgcacatcctggggacgaaccgggcagccggagagctgcggccggcccagtcccgctccgcctttgaagggtaaaacccaaggcggggccttggttctggcagaagggacgctatgaccgcagaattcctctccctgctttgcctcgggctgtgtctgggctacgaagatgagaaaaagaatgagaaaccgcccaagccctccctccacgcctggcccagctcggtggttgaagccgagagcaatgtgaccctgaagtgtcaggctcattcccagaatgtgacatttgtgctgcgcaaggtgaacgactctgggtacaagcaggaacagagctcggcagaaaacgaagctgaattccccttcacggacctgaagcctaaggatgctgggaggtacttttgtgcctacaagacaacagcctcccatgagtggtcagaaagcagtgaacacttgcagctggtggtcacagataaacacgatgaacttgaagctccctcaatgaaaacagacaccagaaccatctttgtcgccatcttcagctgcatctccatccttctcctcttcctctcagtcttcatcatctacagatgcagccagcacagtgagctcagagaacgcaaagggagagagggggagtgaaggattttctcgaaccagccattccaaacttccggagcaggaggctgccgaggcagatttatccaatatggaaagggtatctctctcgacggcagacccccaaggagtgacctatgctgagctaagcaccagcgccctgtctgaggcagcttcagacaccacccaggagcccccaggatctcatgaatatgcggcactgaaagtgtagcaagaagacagccctggccactaaaggaggggggatcgtgctggccaaggttatcggaaatctggagatgcagatactgtgtttccttgctcttcgtccatatcaataaaattaagtttctcgtcttaaaaa

SEQ ID NO: 199488 - DNA, 517 bp, Homo sapiens
  Payload ID: 19358
  Gene Name: V-set and transmembrane domain containing 1
  ENST ID: ENST00000419106
  CDS Start-End: 1-381
gaattccccttcacggacctgaagcctaaggatgctgggaggtacttttgtgcctacaagacaacagcctcccatgagtggtcagaaagcagtgaacacttgcagctggtggtcacagataaacacgatgaacttgaagctccctcaatgaaaacaggttcatcatctgaggaatccaccaagagaaccagccattccaaacttccggagcaggaggctgccgaggcagatttatccaatatggaaagggtatctctctcgacggcagacccccaaggagtgacctatgctgagctaagcaccagcgccctgtctgaggcagcttcagacaccacccaggagcccccaggatctcatgaatatgcggcactgaaagtgtagcaagaagacagccctggccactaaaggaggggggatcgtgctggccaaggttatcggaaatctggagatgcagatactgtgtttccttgctcttcgtccatatcaataaaattaagtttctcgtcttaaaaagaaa

SEQ ID NO: 199489 - DNA, 608 bp, Homo sapiens
  Payload ID: 19358
  Gene Name: V-set and transmembrane domain containing 1
  ENST ID: ENST00000425006
  CDS Start-End: 177-608
gtgagaaggaaactgcaagagtggggcagagaaccagagtgtcagagcaaaacctcctctatctgcacatcctggggacgaaccgggcagccggagagctgcggccggcccagtcccgctccgcctttgaagggtaaaacccaaggcggggccttggttctggcagaagggacgctatgaccgcagaattcctctccctgctttgcctcgggctgtgtctgggctacgaagatgagaaaaagaatgagaaaccgcccaagccctccctccacgcctggcccagctcggtggttgaagccgagagcaatgtgaccctgaagtgtcaggctcattcccagaatgtgacatttgtgctgcgcaaggtgaacgactctgggtacaagcaggaacagagctcggcagaaaacgaagctgaattccccttcacggacctgaagcctaaggatgctgggaggtacttttgtgcctacaagacaacagcctcccatgagtggtcagaaagcagtgaacacttgcagctggtggtcacagataaacacgatgaacttgaagctccctcaatgaaaacagtggctcacgtctgtaataccaggactttgggaagatga

SEQ ID NO: 199490 - DNA, 654 bp, Homo sapiens
  Payload ID: 19358
  Gene Name: V-set and transmembrane domain containing 1
  ENST ID: ENST00000366170
  CDS Start-End: 177-527
gtgagaaggaaactgcaagagtggggcagagaaccagagtgtcagagcaaaacctcctctatctgcacatcctggggacgaaccgggcagccggagagctgcggccggcccagtcccgctccgcctttgaagggtaaaacccaaggcggggccttggttctggcagaagggacgctatgaccgcagaattcctctccctgctttgcctcgacaccagaaccatctttgtcgccatcttcagctgcatctccatccttctcctcttcctctcagtcttcatcatctacagatgcagccagcacagttcatcatctgaggaatccaccaagagaaccagccattccaaacttccggagcaggaggctgccgaggcagatttatccaatatggaaagggtatctctctcgacggcagacccccaaggagtgacctatgctgagctaagcaccagcgccctgtctgaggcagcttcagacaccacccaggagcccccaggatctcatgaatatgcggcactgaaagtgtagcaagaagacagccctggccactaaaggaggggggatcgtgctggccaaggttatcggaaatctggagatgcagatactgtgtttccttgctcttcgtccatatcaataaaattaagtttctcgtctt

SEQ ID NO: 199491 - DNA, 373 bp, Homo sapiens
  Payload ID: 19358
  Gene Name: V-set and transmembrane domain containing 1
  ENST ID: ENST00000615538
  CDS Start-End: 12-362
gaagggacgctatgaccgcagaattcctctccctgctttgcctcgacaccagaaccatctttgtcgccatcttcagctgcatctccatccttctcctcttcctctcagtcttcatcatctacagatgcagccagcacagttcatcatctgaggaatccaccaagagaaccagccattccaaacttccggagcaggaggctgccgaggcagatttatccaatatggaaagggtatctctctcgacggcagacccccaaggagtgacctatgctgagctaagcaccagcgccctgtctgaggcagcttcagacaccacccaggagcccccaggatctcatgaatatgcggcactgaaagtgtagcaagaagacag

SEQ ID NO: 199492 - DNA, 608 bp, Homo sapiens; identical to SEQ ID NO: 199489
  Payload ID: 19358
  Gene Name: V-set and transmembrane domain containing 1
  ENST ID: ENST00000613106
  CDS Start-End: 177-608

SEQ ID NO: 199493 - DNA, 1015 bp, Homo sapiens
  Payload ID: 19358
  Gene Name: V-set and transmembrane domain containing 1
  ENST ID: ENST00000610794
  CDS Start-End: 177-887
gtgagaaggaaactgcaagagtggggcagagaaccagagtgtcagagcaaaacctcctctatctgcacatcctggggacgaaccgggcagccggagagctgcggccggcccagtcccgctccgcctttgaagggtaaaacccaaggcggggccttggttctggcagaagggacgctatgaccgcagaattcctctccctgctttgcctcgggctgtgtctgggctacgaagatgagaaaaagaatgagaaaccgcccaagccctccctccacgcctggcccagctcggtggttgaagccgagagcaatgtgaccctgaagtgtcaggctcattcccagaatgtgacatttgtgctgcgcaaggtgaacgactctgggtacaagcaggaacagagctcggcagaaaacgaagctgaattccccttcacggacctgaagcctaaggatgctgggaggtacttttgtgcctacaagacaacagcctcccatgagtggtcagaaagcagtgaacacttgcagctggtggtcacagataaacacgatgaacttgaagctccctcaatgaaaacagacaccagaaccatctttgtcgccatcttcagctgcatctccatccttctcctcttcctctcagtcttcatcatctacagatgcagccagcacagttcatcatctgaggaatccaccaagagaaccagccattccaaacttccggagcaggaggctgccgaggcagatttatccaatatggaaagggtatctctctcgacggcagacccccaaggagtgacctatgctgagctaagcaccagcgccctgtctgaggcagcttcagacaccacccaggagcccccaggatctcatgaatatgcggcactgaaagtgtagcaagaagacagccctggccactaaaggaggggggatcgtgctggccaaggttatcggaaatctggagatgcagatactgtgtttccttgctcttcgtccatatcaataaaattaagtttctcgtctta

SEQ ID NO: 199494 - DNA, 922 bp, Homo sapiens; identical to SEQ ID NO: 199486
  Payload ID: 19358
  Gene Name: V-set and transmembrane domain containing 1
  ENST ID: ENST00000615235
  CDS Start-End: 177-794

SEQ ID NO: 199495 - DNA, 608 bp, Homo sapiens; identical to SEQ ID NO: 199489
  Payload ID: 19358
  Gene Name: V-set and transmembrane domain containing 1
  ENST ID: ENST00000619066
  CDS Start-End: 177-608

SEQ ID NO: 199496 - DNA, 654 bp, Homo sapiens; identical to SEQ ID NO: 199490
  Payload ID: 19358
  Gene Name: V-set and transmembrane domain containing 1
  ENST ID: ENST00000617097
  CDS Start-End: 177-527

SEQ ID NO: 199497 - DNA, 575 bp, Homo sapiens
  Payload ID: 19358
  Gene Name: V-set and transmembrane domain containing 1
  ENST ID: ENST00000613774
  CDS Start-End: 1-447
ctcagaagtagacagggtcccactcggttgcccaggctggagtgcagtggtgcaatcacagctcactgcagccttgacctcccaggcccagataaacacgatgaacttgaagctccctcaatgaaaacagacaccagaaccatctttgtcgccatcttcagctgcatctccatccttctcctcttcctctcagtcttcatcatctacagatgcagccagcacagttcatcatctgaggaatccaccaagagaaccagccattccaaacttccggagcaggaggctgccgaggcagatttatccaatatggaaagggtatctctctcgacggcagacccccaaggagtgacctatgctgagctaagcaccagcgccctgtctgaggcagcttcagacaccacccaggagcccccaggatctcatgaatatgcggcactgaaagtgtagcaagaagacagccctggccactaaaggaggggggatcgtgctggccaaggttatcggaaatctggagatgcagatactgtgtttccttgctcttcgtccatatcaataaaattaagtttctcgtctta

SEQ ID NO: 199498 - DNA, 922 bp, Homo sapiens; identical to SEQ ID NO: 199486
  Payload ID: 19358
  Gene Name: V-set and transmembrane domain containing 1
  ENST ID: ENST00000613042
  CDS Start-End: 177-794

SEQ ID NO: 199499 - DNA, 654 bp, Homo sapiens; identical to SEQ ID NO: 199490
  Payload ID: 19358
  Gene Name: V-set and transmembrane domain containing 1
  ENST ID: ENST00000613085
  CDS Start-End: 177-527

SEQ ID NO: 199500 - DNA, 654 bp, Homo sapiens; identical to SEQ ID NO: 199490
  Payload ID: 19358
  Gene Name: V-set and transmembrane domain containing 1
  ENST ID: ENST00000614154
  CDS Start-End: 177-527

SEQ ID NO: 199501 - DNA, 922 bp, Homo sapiens; identical to SEQ ID NO: 199486
  Payload ID: 19358
  Gene Name: V-set and transmembrane domain containing 1
  ENST ID: ENST00000616717
  CDS Start-End: 177-794

SEQ ID NO: 199502 - DNA, 608 bp, Homo sapiens; identical to SEQ ID NO: 199489
  Payload ID: 19358
  Gene Name: V-set and transmembrane domain containing 1
  ENST ID: ENST00000612784
  CDS Start-End: 177-608

SEQ ID NO: 199503 - DNA, 1015 bp, Homo sapiens; identical to SEQ ID NO: 199493
  Payload ID: 19358
  Gene Name: V-set and transmembrane domain containing 1
  ENST ID: ENST00000610804
  CDS Start-End: 177-887

SEQ ID NO: 199504 - DNA, 1015 bp, Homo sapiens; identical to SEQ ID NO: 199493
  Payload ID: 19358
  Gene Name: V-set and transmembrane domain containing 1
  ENST ID: ENST00000617281
  CDS Start-End: 177-887

SEQ ID NO: 199505 - DNA, 654 bp, Homo sapiens; identical to SEQ ID NO: 199490
  Payload ID: 19358
  Gene Name: V-set and transmembrane domain containing 1
  ENST ID: ENST00000612942
  CDS Start-End: 177-527

SEQ ID NO: 199506 - DNA, 608 bp, Homo sapiens; identical to SEQ ID NO: 199489
  Payload ID: 19358
  Gene Name: V-set and transmembrane domain containing 1
  ENST ID: ENST00000621018
  CDS Start-End: 177-608

SEQ ID NO: 199507 - DNA, 608 bp, Homo sapiens; identical to SEQ ID NO: 199489
  Payload ID: 19358
  Gene Name: V-set and transmembrane domain containing 1
  ENST ID: ENST00000610857
  CDS Start-End: 177-608

SEQ ID NO: 199508 - DNA, 922 bp, Homo sapiens; identical to SEQ ID NO: 199486
  Payload ID: 19358
  Gene Name: V-set and transmembrane domain containing 1
  ENST ID: ENST00000617115
  CDS Start-End: 177-794

SEQ ID NO: 199509 - DNA, 575 bp, Homo sapiens; identical to SEQ ID NO: 199497
  Payload ID: 19358
  Gene Name: V-set and transmembrane domain containing 1
  ENST ID: ENST00000613399
  CDS Start-End: 1-447

SEQ ID NO: 199510 - DNA, 575 bp, Homo sapiens; identical to SEQ ID NO: 199497
  Payload ID: 19358
  Gene Name: V-set and transmembrane domain containing 1
  ENST ID: ENST00000618529
  CDS Start-End: 1-447

SEQ ID NO: 199511 - DNA, 1041 bp, Homo sapiens; identical to SEQ ID NO: 199487
  Payload ID: 19358
  Gene Name: V-set and transmembrane domain containing 1
  Uniprot ID: Q6UX27
  ENST ID: ENST00000612864
  CDS Start-End: 177-701

SEQ ID NO: 199512 - DNA, 1015 bp, Homo sapiens; identical to SEQ ID NO: 199493
  Payload ID: 19358
  Gene Name: V-set and transmembrane domain containing 1
  ENST ID: ENST00000610629
  CDS Start-End: 177-887

SEQ ID NO: 199513 - DNA, 654 bp, Homo sapiens; identical to SEQ ID NO: 199490
  Payload ID: 19358
  Gene Name: V-set and transmembrane domain containing 1
  ENST ID: ENST00000612639
  CDS Start-End: 177-527

SEQ ID NO: 199514 - DNA, 1015 bp, Homo sapiens; identical to SEQ ID NO: 199493
  Payload ID: 19358
  Gene Name: V-set and transmembrane domain containing 1
  ENST ID: ENST00000611293
  CDS Start-End: 177-887

SEQ ID NO: 199515 - DNA, 608 bp, Homo sapiens; identical to SEQ ID NO: 199489
  Payload ID: 19358
  Gene Name: V-set and transmembrane domain containing 1
  ENST ID: ENST00000611985
  CDS Start-End: 177-608

SEQ ID NO: 199516 - DNA, 608 bp, Homo sapiens; identical to SEQ ID NO: 199489
  Payload ID: 19358
  Gene Name: V-set and transmembrane domain containing 1
  ENST ID: ENST00000611605
  CDS Start-End: 177-608

SEQ ID NO: 199517 - DNA, 1015 bp, Homo sapiens; identical to SEQ ID NO: 199493
  Payload ID: 19358
  Gene Name: V-set and transmembrane domain containing 1
  Uniprot ID: Q6UX27
  ENST ID: ENST00000612436
  CDS Start-End: 177-887

SEQ ID NO: 199518 - DNA, 922 bp, Homo sapiens; identical to SEQ ID NO: 199486
  Payload ID: 19358
  Gene Name: V-set and transmembrane domain containing 1
  ENST ID: ENST00000622762
  CDS Start-End: 177-794

SEQ ID NO: 199519 - DNA, 654 bp, Homo sapiens; identical to SEQ ID NO: 199490
  Payload ID: 19358
  Gene Name: V-set and transmembrane domain containing 1
  ENST ID: ENST00000614572
  CDS Start-End: 177-527

SEQ ID NO: 199520 - DNA, 922 bp, Homo sapiens; identical to SEQ ID NO: 199486
  Payload ID: 19358
  Gene Name: V-set and transmembrane domain containing 1
  ENST ID: ENST00000619024
  CDS Start-End: 177-794

SEQ ID NO: 199521 - DNA, 1015 bp, Homo sapiens; identical to SEQ ID NO: 199493
  Payload ID: 19358
  Gene Name: V-set and transmembrane domain containing 1
  ENST ID: ENST00000612105
  CDS Start-End: 177-887

SEQ ID NO: 199522 - DNA, 654 bp, Homo sapiens; identical to SEQ ID NO: 199490
  Payload ID: 19358
  Gene Name: V-set and transmembrane domain containing 1
  ENST ID: ENST00000616582
  CDS Start-End: 177-527

SEQ ID NO: 199523 - DNA, 575 bp, Homo sapiens; identical to SEQ ID NO: 199497
  Payload ID: 19358
  Gene Name: V-set and transmembrane domain containing 1
  ENST ID: ENST00000619907
  CDS Start-End: 1-447

SEQ ID NO: 199524 - DNA, 922 bp, Homo sapiens; identical to SEQ ID NO: 199486
  Payload ID: 19358
  Gene Name: V-set and transmembrane domain containing 1
  ENST ID: ENST00000619921
  CDS Start-End: 177-794

SEQ ID NO: 199525 - DNA, 608 bp, Homo sapiens; identical to SEQ ID NO: 199489
  Payload ID: 19358
  Gene Name: V-set and transmembrane domain containing 1
  ENST ID: ENST00000614756
  CDS Start-End: 177-608

SEQ ID NO: 199526 - DNA, 575 bp, Homo sapiens; identical to SEQ ID NO: 199497
  Payload ID: 19358
  Gene Name: V-set and transmembrane domain containing 1
  ENST ID: ENST00000613096
  CDS Start-End: 1-447

SEQ ID NO: 199527 - DNA, 575 bp, Homo sapiens; identical to SEQ ID NO: 199497
  Payload ID: 19358
  Gene Name: V-set and transmembrane domain containing 1
  ENST ID: ENST00000618109
  CDS Start-End: 1-447

SEQ ID NO: 199528 - DNA, 575 bp, Homo sapiens; identical to SEQ ID NO: 199497
  Payload ID: 19358
  Gene Name: V-set and transmembrane domain containing 1
  ENST ID: ENST00000614390
  CDS Start-End: 1-447

SEQ ID NO: 199529 - DNA, 575 bp, Homo sapiens; identical to SEQ ID NO: 199497
  Payload ID: 19358
  Gene Name: V-set and transmembrane domain containing 1
  ENST ID: ENST00000618448
  CDS Start-End: 1-447

SEQ ID NO: 199530 - DNA, 608 bp, Homo sapiens; identical to SEQ ID NO: 199489
  Payload ID: 19358
  Gene Name: V-set and transmembrane domain containing 1
  ENST ID: ENST00000610575
  CDS Start-End: 177-608

SEQ ID NO: 199531 - DNA, 872 bp, Homo sapiens
  Payload ID: 19358
  Gene Name: V-set and transmembrane domain containing 1
  Uniprot ID: Q6UX27
  ENST ID: ENST00000617776
  CDS Start-End: 154-771
gggcagagaaccagagtgtcagagcaaaacctcctctatctgcacatcctggggacgaaccgggcagccggagagctgcggccggcccagtcccgctccgcctttgaagggtaaaacccaaggcggggccttggttctggcagaagggacgctatgaccgcagaattcctctccctgctttgcctcgggctgtgtctgggctacgaagatgagaaaaagaatgagaaaccgcccaagccctccctccacgcctggcccagctcggtggttgaagccgagagcaatgtgaccctgaagtgtcaggctcattcccagaatgtgacatttgtgctgcgcaaggtgaacgactctgggtacaagcaggaacagagctcggcagaaaacgaagctgaattccccttcacggacctgaagcctaaggatgctgggaggtacttttgtgcctacaagacaacagcctcccatgagtggtcagaaagcagtgaacacttgcagctggtggtcacagataaacacgatgaacttgaagctccctcaatgaaaacaggttcatcatctgaggaatccaccaagagaaccagccattccaaacttccggagcaggaggctgccgaggcagatttatccaatatggaaagggtatctctctcgacggcagacccccaaggagtgacctatgctgagctaagcaccagcgccctgtctgaggcagcttcagacaccacccaggagcccccaggatctcatgaatatgcggcactgaaagtgtagcaagaagacagccctggccactaaaggaggggggatcgtgctggccaaggttatcggaaatctggagatgcagatactgtgtttccttgctcttcgtccat

SEQ ID NO: 199532 - DNA, 654 bp, Homo sapiens; identical to SEQ ID NO: 199490
  Payload ID: 19358
  Gene Name: V-set and transmembrane domain containing 1
  ENST ID: ENST00000620314
  CDS Start-End: 177-527

SEQ ID NO: 199533 - DNA, 1015 bp, Homo sapiens; identical to SEQ ID NO: 199493
  Payload ID: 19358
  Gene Name: V-set and transmembrane domain containing 1
  Uniprot ID: Q6UX27
  ENST ID: ENST00000620474
  CDS Start-End: 177-887

SEQ ID NO: 199534 - DNA, 1015 bp, Homo sapiens; identical to SEQ ID NO: 199493
  Payload ID: 19358
  Gene Name: V-set and transmembrane domain containing 1
  ENST ID: ENST00000617862
  CDS Start-End: 177-887

SEQ ID NO: 199535 - DNA, 922 bp, Homo sapiens; identical to SEQ ID NO: 199486
  Payload ID: 19358
  Gene Name: V-set and transmembrane domain containing 1
  Uniprot ID: Q6UX27
  ENST ID: ENST00000615508
  CDS Start-End: 177-794

SEQ ID NO: 199536 - DNA, 831 bp, Homo sapiens
  Payload ID: 19359
  Gene Name: V-set and transmembrane domain containing 2 like
  Uniprot ID: Q96N03
  ENST ID: ENST00000373459
  CDS Start-End: 241-639
ggaagggaagagtcccgcagtcggaggcggccggctgggcgtgcgctcgctccccgaagccggggctgggccggagccgggcgagggctgggagctgggccgggtccggggacagcgggcgaggggcagctgccggagccgggcagccaggccgctcagggcaggggacagctggcgccggttctgcggtctccggggcccagatgtgaggcggcggcgcccccggcccgagagcgcacgatgggggccccgctcgccgtagcgctgggcgccctccactacctggcacttttcctgcaactcggcggcgccacgcggcccgccggccacgcgccctgggacaaccacgtctccggccacggtggtcaaggtggtgggcagcaacatctcccacaagctgcgcctgtcccgggtgaagcccacggacgaaggcacctacgagtgccgcgtcatcgacttcagcgacggcaaggcccggcaccacaaggtcaaggcctacctgcgggtgcagccaggggagaactccgtcctgcatctgcccgaagcccctcccgccgcgcccgccccgccgccccccaagccaggcaaggagctgaggaagcgctcggtggaccaggaggcctgcagcctctagactgatgcccctgcccccgcccatccgcccccacgctgtacagagtgcatgaggagccgccggaccaccggggaccgactgcctgcgtccagccgcgccccatccccgaggccgcctgtggccaccatgtcggccctctttccaccaccccttgctcagcatgtaagccccacccacccctgccctttcagacccct

SEQ ID NO: 199537 - DNA, 1959 bp, Homo sapiens
  Payload ID: 19359
  Gene Name: V-set and transmembrane domain containing 2 like
  Uniprot ID: Q96N03
  ENST ID: ENST00000373461
  CDS Start-End: 248-862
cttccgcggaagggaagagtcccgcagtcggaggcggccggctgggcgtgcgctcgctccccgaagccggggctgggccggagccgggcgagggctgggagctgggccgggtccggggacagcgggcgaggggcagctgccggagccgggcagccaggccgctcagggcaggggacagctggcgccggttctgcggtctccggggcccagatgtgaggcggcggcgcccccggcccgagagcgcacgatgggggccccgctcgccgtagcgctgggcgccctccactacctggcacttttcctgcaactcggcggcgccacgcggcccgccggccacgcgccctgggacaaccacgtctccggccacgccctgttcacagagacaccccatgacatgacagcacggacgggcgaggacgtggagatggcctgctccttccgcggcagcggctccccctcctactcgctggagatccagtggtggtatgtacggagccaccgggactggaccgacaagcaggcgtgggcctcgaaccagctaaaagcatctcagcaggaagacgcagggaaggaggcaaccaaaataagtgtggtcaaggtggtgggcagcaacatctcccacaagctgcgcctgtcccgggtgaagcccacggacgaaggcacctacgagtgccgcgtcatcgacttcagcgacggcaaggcccggcaccacaaggtcaaggcctacctgcgggtgcagccaggggagaactccgtcctgcatctgcccgaagcccctcccgccgcgcccgccccgccgccccccaagccaggcaaggagctgaggaagcgctcggtggaccaggaggcctgcagcctctagactgatgcccctgcccccgcccatccgcccccacgctgtacagagtgcatgaggagccgccggaccaccggggaccgactgcctgcgtccagccgcgccccatccccgaggccgcctgtggccaccatgtcggccctctttccaccaccccttgctcagcatgtaagccccacccacccctgccctttcagacccctgcggtgacctggctcggagaaggtggccctgggcaccaaggggccaaccgccctgaacactggggcagggaccatgctggggcccggggccacccccttcctgtcaccagcttctgtggagtccagtgttttgctttgcttgcttgtcccccatcctgtcctgagccggggccccccagcctcgcctccctcctcctaccatccctcacttggacctgggggtgtggacagtgacccctccctgaatatggacttgaatcttctgagcagaactagggcctctcccctggtgaagacccagggaacccaggagggcccttctggggcagtggctctgcagggtcactcatggaggcctaggggaacagcgagatgccccaccacctcctggcgagtccttcctgttcagctccctgtgcgaccctccagggatgcaggggatccaggattctctgccctgtcacacggcgagtcagaagggaggggcctttccctcggacccatggccccaggcagagttttgcaccagcaggacccctttgagggccttcaaggctctcccaggagtccccctctgccggccccccaatgccccagctccctcttgggtcctgtgccaagtccgccccagggcctggggctgttgggagccaagggccccctggtactcagttccctcacgattcccgatcacgggcacacctgccccctggttatttgtaaatatttctattggacccaattctcctcggaattggctggcacctctggctgccgcagctcagtgatgacgtgggggaggtgggagaggccgagggctttgcctaggggtgggttgccctgtatacatgatccagtctgtgactaccagccaacctgaataaagcggttttaaaaaaa

SEQ ID NO: 199538 - DNA, 656 bp, Homo sapiens
  Payload ID: 19359
  Gene Name: V-set and transmembrane domain containing 2 like
  Uniprot ID: Q96N03
  ENST ID: ENST00000448944
  CDS Start-End: 210-656
cggctgggcgtgcgctcgctccccgaagccggggctgggccggagccgggcgagggctgggagctgggccgggtccggggacagcgggcgaggggcagctgccggagccgggcagccaggccgctcagggcaggggacagctggcgccggttctgcggtctccggggcccagatgtgaggcggcggcgcccccggcccgagagcgcacgatgggggccccgctcgccgtagcgctgggcgccctccactacctggcacttttcctgcaactcggcggcgccacgcggcccgccggccacgcgccctgggacaaccacgtctccggccacgccctgttcacagagacaccccatgacatgacagcacggacgggcgaggacgtggagatggcctgctccttccgcggcagcggctccccctcctactcgctggagatccagtggtggtatgtacggagccaccgggactggaccgacaagcaggcgtgggcctcgaaccaggtggtcaaggtggtgggcagcaacatctcccacaagctgcgcctgtcccgggtgaagcccacggacgaaggcacctacgagtgccgcgtcatcgacttcagcgacggcaaggcccggcaccacaaggtcaaggcctacctgcgggtgcagccaggg

SEQ ID NO: 199539 - DNA, 3401 bp, Homo sapiens
  Payload ID: 19360
  Gene Name: V-set and transmembrane domain containing 2A
  Uniprot ID: Q8TAG5
  ENST ID: ENST00000302287
  CDS Start-End: 407-1141
gcgccgcgagcccggcgaagtcctcagcccgccccgcttgcccactccccacttcccgagccggctccgtgtttagggagggcagtgatcacgcaagccggagcggcgggctgacgttggacgagctgccaggtagctgaaagcaggcagccaggcagccgagacacttcccagcgattccagcctgggctccgcaggaagcctcgctgaatcccagccagctggttctaaccttccagaatcgcaatcccttctccccacagccagccctcgccaagcaagcagcaggatgtttgcagtgtcgcgcccagggctctgagactgagcctgccatccactcgcacgcctttctttcagggcttttcggctgttggctacactgatgtgacccccctccctttttggaatgatggggatctttttggtgtatgttggatttgttttcttttccgttttatatgtacaacaagggctttcttctcaagcaaaatttaccgagtttccgcggaacgtgacggcgaccgaggggcagaatgtggagatgtcctgcgccttccagagcggctccgcctcggtgtatctggagatccaatggtggttcctgcgggggccggaggacctggatcccggggccgagggggccggcgcgcaggtggagctcttgcccgacagagacccggacagcgacgggaccaagatcagcacagtgaaagtccaaggcaatgacatctcccacaagcttcagatttccaaagtgaggaaaaaggatgaaggcttatatgagtgcagggtgactgatgccaactacggggagcttcaggaacacaaggcccaggcctatctgaaagtcaatgccaacagccatgcccgcagaatgcaggccttcgaagcctcgcccatgtggctgcaggatatgaagccccgcaagaacgtctccgcagccatccccagcagcatccatggctctgccaaccaacgaacgcactccacctccagccctcaagtggtagccaaaatccccaaacaaagtccacaatcaggtatggaaacccatttcgagccttttattttaccactcacaaacgctccacagaaaggtcagtcgtatagagtagacagatttatgaatggtgatttttaaaatcggagacctagttcagtgcaagtgattatgagaggtgagcaccgagcctgcaccaattcactcagagctcaaagcatgtgggtgcaccccgtcagtcccctagtggtgcttcatttccagggcatctgagagctggactctggtttttatcctttctgtatttacacattataagaacaataaatcatgtaatgttggttacattacaaatgcatgttcattttctctacagatttatgtatcgataatgacccaaattaagaggctttcacttaatcaaaatgtaaatgagagagacatgccatatcatgcattttcagcgacccatagctctaagcaggactattctccaagggcttttgattttgaaggagaaacctcagctgcctgtgatgatgataatggaaggatggaggggggattgaagactgtaagtggtgcagagataaggcaactcctctgtgaatttgccttccaggccaatttagaagcttagtcacaggattctgaaggcagctgtgcaagttaaagctgttctgaatggcattaatgtatgcagtcattcagccaatggaaatgcgtggaagttttaaccttgatgtgggataaaggcttcgtggaatgagcagtaccctgcacaaccccgcggccgtcccgatttcctcaaacacgtgacatgggatgaagggagcacaaacatactgactttatccttctttaggtttttccctaaagaagtattgatgctaccatcagtaatggaaaattacattgctaatatttaaggtctcttcagccattaaattaaaaagtctgattacttcaccaggatgatttctgagatctcatctcatatcgtcctgaatacacacacacacacacacacacgcacacacacacacatctcagaaatcatcctaatcaaatatagactttatatatatcaaatatatatatacatgtagaaatacatataggtatgtatctttaagtccttgcttgtgaacaatgcttttaaatgtttttaaaatactgtatgccaaaataggttttctcttaatgctttacttcctaatggatgtgatttgcagatttgtagggcacttggattagggttctctgagtttgccctgccttataatgtagatgagcaactctcctggcatgccttggtcattgcaatttatgtcagtctgatgaacagatggcttagcctctctgaagcccaatgtgtgtggatttgtctaatttttttctttataatcttttctgcttaccaaattaaaggacaaactagtatagctggaacatatatgtgtgtatccatacacactaaacacacaggtatatgctaaattgtaatggtaaccaaatgatggttacaactttgtgactattatttgaggaagatttaatgtctttggagtgattttcccctctttcttcacattatcataaaagaagttagacactacaggcaagattacagagtagcctaagcagacaatttacaacctaattagcaagaactccaaatcatggaagtgaaattattattatcctacatagactgttccaagttagatgtcatcaatctgttcggcagaataaaatcaaacagattacctattccaagtgaagaattccaagggtagaatgaaatgctttatctatttctagaatgttttcttagcttttggggtttaataatgcaatctcaaaatatctatttattttattttaatatctcttagcgctgtgattagtgctaaatgataaactctagatctcttctaacaattatcaaataaaaattactgctctttttgcatcccattgccagccttgctgtcagattcaaaattgctttttctagagttaaaggtagaaggagagaaaaaagtgactcatgaagtctatattcattaaaagtcctgttcactaaacatatctgcttatatcaaagagtaacttgaaatatctgaaaatatttaatttcaatatttccaaccagtgaatactggataatatttttatatacttctatcaacattttctaatttcgatttcagaagctggggcagtccagtcactcactttacttatgtgtaagttcctatacttgcacaattattatatatgattcagtatctggggtggatatttatatattatattcactgtaatacccacatcctgatttatgatttttgcctcacgattttcagattatattcaaataaagcttatttcaata

SEQ ID NO: 199540 - DNA, 1076 bp, Homo sapiens
  Payload ID: 19360
  Gene Name: V-set and transmembrane domain containing 2A
  ENST ID: ENST00000402613
  CDS Start-End: 127-849
agcagcaggatgtttgcagtgtcgcgcccagggctctgagactgagcctgccatccactcgcacgcctttctttcagggcttttcggctgttggctacactgatgtgacccccctccctttttggaatgatggggatctttttggtgtatgttggatttgttttcttttccgttttatatgtacaacaagggctttcttctcaagcaaaatttaccgagtttccgcggaacgtgacggcgaccgaggggcagaatgtggagatgtcctgcgccttccagagcggctccgcctcggtgtatctggagatccaatggtggttcctgcgggggccggaggacctggatcccggggccgagggggccggcgcgcaggtggagctcttgcccgacagagacccggacagcgacgggaccaagatcagcacagtgaaagtccaaggcaatgacatctcccacaagcttcagatttccaaagtgaggaaaaaggatgaaggcttatatgagtgcagggtgactgatgccaactacggggagcttcaggaacacaaggcccaggcctatctgaaagtcaatgccaacagccatgcccgcagaatgcaggccttcgaagcctcgcccatgtggctgcaggatatgaagccccgcaagaacgtctccgcagccatccccagcagcatccatggctctgccaaccaacgaacgcactccacctccagccctcaagtggtagccaaaatccccaaacaaagtccacaatcagcaaagagcaaatcgcctgtaaaatctacggagcggacagcaaagttgaccctaaactccaagcaccaccctgcacccactgtactctaattcactacacaaggagcgcctgcttccggaagcataaatgaagaggctatcacatgctttgttgatcatattttctttggcaaaacactgatcttttattttaagagaattaacgtgaagtgatagaacgttttctaatagcaagatctattttttcccttttctttcggcgactaaaatcatctcactgactgctcaagggttggcctgaatgtcatcaggatagg

SEQ ID NO: 199541 - DNA, 2521 bp, Homo sapiens
  Payload ID: 19360
  Gene Name: V-set and transmembrane domain containing 2A
  ENST ID: ENST00000404951
  CDS Start-End: 316-1245
cgcaagccggagcggcgggctgacgttggacgagctgccaggtagctgaaagcaggcagccaggcagccgagacacttcccagcgattccagcctgggctccgcaggaagcctcgctgaatcccagccagctggttctaaccttccagaatcgcaatcccttctccccacagccagccctcgccaagcaagcagcaggatgtttgcagtgtcgcgcccagggctctgagactgagcctgccatccactcgcacgcctttctttcagggcttttcggctgttggctacactgatgtgacccccctccctttttggaatgatggggatctttttggtgtatgttggatttgttttcttttccgttttatatgtacaacaagggctttcttctcaagcaaaatttaccgagtttccgcggaacgtgacggcgaccgaggggcagaatgtggagatgtcctgcgccttccagagcggctccgcctcggtgtatctggagatccaatggtggttcctgcgggggccggaggacctggatcccggggccgagggggccggcgcgcaggtggagctcttgcccgacagagacccggacagcgacgggaccaagatcagcacagtgaaagtccaaggcaatgacatctcccacaagcttcagatttccaaagtgaggaaaaaggatgaaggcttatatgagtgcagggtgactgatgccaactacggggagcttcaggaacacaaggcccaggcctatctgaaagtcaatgccaacagccatgcccgcagaatgcaggccttcgaagcctcgcccatgtggctgcaggatatgaagccccgcaagaacgtctccgcagccatccccagcagcatccatggctctgccaaccaacgaacgcactccacctccagccctcaagtggtagccaaaatccccaaacaaagtccacaatcagtgtctccaatccttccagaagtcaaacatctccacagaccacctctactagtccttcctttcttctctctgtcttcacttttttctactgacccccttcccaccttcccaacgtcacacagaactgtgaagcggcttcctgctcctcttccccaacctggccatggatcaacccctggtgtgcagagctgcgtgctggctcctccagcaaagagcaaatcgcctgtaaaatctacggagcggacagcaaagttgaccctaaactccaagcaccaccctgcacccactgtactctaattcactacacaaggagcgcctgcttccggaagcataaatgaagaggctatcacatgctttgttgatcatattttctttggcaaaacactgatcttttattttaagagaattaacgtgaagtgatagaacgttttctaatagcaagatctattttttcccttttctttcggcgactaaaatcatctcactgactgctcaagggttggcctgaatgtcatcaggatagggaatatttactatggataccactaatttcctactaaaggacccagcatcttcaggaagcaaacagagatcaaaaggctacagaacagaagctatcatcagacaaaaccccctttttaggggaagaacaaaactatcaacactgcaagtcaacaaggaggacattactttaaggaataacatgagaaagaaatttttttattttcccctttttttcttggatttttcttctttttcttgattacagttcttgttcaatggtggcaagtgctggttatggccaatctccgtcaatcctaggaggtttatagaactacattttgagtgttctatatttcagtgtattttaattcattttgcaattcctgtgtatgcaaacctgataaattctgtaaattgcttatagtatgtgtgctataacttcaaagtagatgtactgcgaccctcatgcaagctgatttttatcattatatatataaatatatacttaagaatatctgtgtgttgggccaatgaccaactttttttgacgaagcatttgtttttcgttgataattcatacactgcgtgaattttgtaattcattgtttcacttccacaggtttgacagctgcagatggtctctattgtcctctgcttcattctggaaagtgcatattcaaaattgtatcagtctctgatcgatgaattaattttgttatgtctgtgctaagttggaatttactatgttcctttatacatggtgtttattgaggtttgagagtctcttgactgtgaagaatgtacactgtctggttttgacagctatttctgtattattatcattataatcttgtcaaatagaaatgttgcttctagaaaatttgcctaggaggcgaatgtggggaaggtgaagcactcaccataattccctaaattcatgttagaacatttcttgctatggttaaaaatgctgcttcctttgacctttatgaatttctgtacctttgtcattctgttacctttgtcattctgttatttgcgctaattatattttaatgtctcctaatta

SEQ ID NO: 199542 - DNA, 3112 bp, Homo sapiens
  Payload ID: 19360
  Gene Name: V-set and transmembrane domain containing 2A
  Uniprot ID: Q8TAG5
  ENST ID: ENST00000407838
  CDS Start-End: 407-1117
gcgccgcgagcccggcgaagtcctcagcccgccccgcttgcccactccccacttcccgagccggctccgtgtttagggagggcagtgatcacgcaagccggagcggcgggctgacgttggacgagctgccaggtagctgaaagcaggcagccaggcagccgagacacttcccagcgattccagcctgggctccgcaggaagcctcgctgaatcccagccagctggttctaaccttccagaatcgcaatcccttctccccacagccagccctcgccaagcaagcagcaggatgtttgcagtgtcgcgcccagggctctgagactgagcctgccatccactcgcacgcctttctttcagggcttttcggctgttggctacactgatgtgacccccctccctttttggaatgatggggatctttttggtgtatgttggatttgttttcttttccgttttatatgtacaacaagggctttcttctcaagcaaaatttaccgagtttccgcggaacgtgacggcgaccgaggggcagaatgtggagatgtcctgcgccttccagagcggctccgcctcggtgtatctggagatccaatggtggttcctgcgggggccggaggacctggatcccggggccgagggggccggcgcgcaggtggagctcttgcccgacagagacccggacagcgacgggaccaagatcagcacagtgaaagtccaaggcaatgacatctcccacaagcttcagatttccaaagtgaggaaaaaggatgaaggcttatatgagtgcagggtgactgatgccaactacggggagcttcaggaacacaaggcccaggcctatctgaaagtcaatgccaacagccatgcccgcagaatgcaggccttcgaagcctcgcccatgtggctgcaggatatgaagccccgcaagaacgtctccgcagccatccccagcagcatccatggctctgccaaccaacgaacgcactccacctccagccctcaagtggtagccaaaatccccaaacaaagtccacaatcaggtgcgaggatagctacaagccatggactttctgtcctgcttcttgtttgtggctttgtgaagggtgctttgctttaatctaaagtgctgacttttttccaatatcactttctcttcttaaagcaaagagcaaatcgcctgtaaaatctacggagcggacagcaaagttgaccctaaactccaagcaccaccctgcacccactgtactctaattcactacacaaggagcgcctgcttccggaagcataaatgaagaggctatcacatgctttgttgatcatattttctttggcaaaacactgatcttttattttaagagaattaacgtgaagtgatagaacgttttctaatagcaagatctattttttcccttttctttcggcgactaaaatcatctcactgactgctcaagggttggcctgaatgtcatcaggatagggaatatttactatggataccactaatttcctactaaaggacccagcatcttcaggaagcaaacagagatcaaaaggctacagaacagaagctatcatcagacaaaaccccctttttaggggaagaacaaaactatcaacactgcaagtcaacaaggaggacattactttaaggaataacatgagaaagaaatttttttattttcccctttttttcttggatttttcttctttttcttgattacagttcttgttcaatggtggcaagtgctggttatggccaatctccgtcaatcctaggaggtttatagaactacattttgagtgttctatatttcagtgtattttaattcattttgcaattcctgtgtatgcaaacctgataaattctgtaaattgcttatagtatgtgtgctataacttcaaagtagatgtactgcgaccctcatgcaagctgatttttatcattatatatataaatatatacttaagaatatctgtgtgttgggccaatgaccaactttttttgacgaagcatttgtttttcgttgataattcatacactgcgtgaattttgtaattcattgtttcacttccacaggtttgacagctgcagatggtctctattgtcctctgcttcattctggaaagtgcatattcaaaattgtatcagtctctgatcgatgaattaattttgttatgtctgtgctaagttggaatttactatgttcctttatacatggtgtttattgaggtttgagagtctcttgactgtgaagaatgtacactgtctggttttgacagctatttctgtattattatcattataatcttgtcaaatagaaatgttgcttctagaaaatttgcctaggaggcgaatgtggggaaggtgaagcactcaccataattccctaaattcatgttagaacatttcttgctatggttaaaaatgctgcttcctttgacctttatgaatttctgtacctttgtcattctgttacctttgtcattctgttatttgcgctaattatattttaatgtctcctaattaaaaattaaaatttggttgttggctaaatacaatatgcaaaagatgatggcaggtccccgactaaagaagattaatgtgttcagttttcactggttaagtgaattataattttaaatattccattcttatttatgtctttatgataattcagactattttattttgaacctgttttctactctggcaaagaaagataggcagaactattagtgttccatatacattatggaatagataaagcttgagagataaatgacctaagttttccttccagagagactcttccattttctctcattacaaaaccagaagatcagctatgtggggccatcagctcccagcctaaggtcctataacccgaagcttgaaggcaatcagtacctctgcttttcaaaggtaaatgcattcattttctttgattcagttataagcaagtatatattttcataatattcttgacattacctgagaaataatacttcatgctaaatcttttactgccacttttctcattcatttggtttatcatttcagtttaatgagaaaaattaataaaggttttgattgcactattttattaaccta

SEQ ID NO: 199543 - DNA, 1488 bp, Homo sapiens
  Payload ID: 19361
  Gene Name: V-set and transmembrane domain containing 2B
  Uniprot ID: A6NLU5
  ENST ID: ENST00000335523
  CDS Start-End: 86-943
agcccgagccggagccgatccgagcccacgcggccgccgcctctccgctcccgggcccccgccgccaccgcgccccccgcgggagatggaacagcggaaccggctcggtgccctcggatacctgccgcctctgctgctgcatgccctgctgctcttcgtggccgacgctgcattcacagaagtccccaaagatgtgacagtacgggagggagacgacatcgaaatgccctgcgcgttccgggccagcggagccacctcgtattcgctggagattcagtggtggtacctcaaggagccaccccgggagctgctgcacgagctggcgctcagcgtgccgggcgcccggagcaaggtaacaaataaggatgcaactaaaatcagcaccgtacgcgtccagggcaatgacatctcacaccggcttcggctgtctgccgtgcggctgcaggacgagggcgtgtacgagtgccgcgtgtcggactacagcgacgacgacacgcaggagcacaaggcccaggcgatgctgcgcgtgctctcgcgcttcgcgccgcccaacatgcaggccgccgaggccgtgtcccacatccagagcagcggcccgcgtcgccacggcccagccagcgccgccaacgccaacaacgcgggcgccgcgagccgtaccacctccgagcccggccgcggcgacaagagcccgccgcccgggagccctcccgccgccatcgatcccgcagtccccgaggccgcggcagcctcggcggcccacacgcccaccaccacagtcgcggcagctgctgctgcctcgtcagcgtcgccgccatcgggacaggcggtcctgctgcgccagaggcacggctcgggcaccggccgtagctacaccacagacccactcttgtccctgctcctgttagctctgcataagttcctgcgcctgctcttgggacattgacagacaagaccaacccgagcatctcagaggccgcacatgacctgcccggggccctcggtgaggaccatgtcgctggatggacacagagagactgagagacgcatgaaaaagtccacatggaaaataaataaatcatatttttgggaaagttacacaaatgtagaacacctaaaataatgcatctagtttccaaataatttggagtttggcccatgcagtctgcatgggaatcaatgatttctctacttcaatgtagttttcttttctacactttccctccaagtcttcattttgcacgaactgttgagcagttatctttaggataatatgtacaaatgttggggtcaaagccttttgacaaagcaaaatatttttagtagattattgtgtttaggatttttttttaatttactttttttctttgggggcttttcttttttattaaattatttcttttgaggcattttgattaaaaaagacacatcttatcataattaaaattcactgtcaataatatttatttttaaataaagattggaaacaag

SEQ ID NO: 199544 - DNA, 2170 bp, Homo sapiens
  Payload ID: 19362
  Gene Name: V-set and transmembrane domain containing 4
  Uniprot ID: Q8IW00
  ENST ID: ENST00000298454
  CDS Start-End: 25-600
acagcgccgggcggcggcggggagatgcggctgctggcactggcggcggccgcgctgctggcgcgggctccggctccggaggtctgtgcggccctcaatgtcactgtgtccccggggcccgtggttgactacctggagggggagaatgccactctcctctgccacgtctcccagaaaaggcggaaggacagcttgctggccgtgcgctggttctttgcacactccttcgactcccaggaggccttgatggtgaagatgaccaagctccgggtggtgcagtactatgggaatttcagccgcagcgccaaacggcggaggctgcgcctgctggaggagcagcggggggcgctctacaggctctccgtcttgacactgcagccctccgatcaagggcattacgtctgcagagtccaggaaatcagcaggcacaggaacaagtggacggcctggtccaatggctcctcagccacggaaatgagaggagtctccagccatccagtggagaggggagcttttcttgggatttcccttgtaatactacctcactctttgcccttcaccgcagacttaaccatggcctccttcctgcagagttcttgatgtgagataaaattgcttgtctttcactggaaactcccagaaagaaaggctggtgcctggtctctcctcatttccctgtcatgaacacctcgcccagcacatggagggtgacttgcgatgatatatttaaaaaataactcccagttctgagaagagccataggagtgttggctcttattatctgtcctgatttccatatgttggttgttttctattgcaaaagtaatatagtgtaatatagttcaattatagaaaacatggaaaaatactgaaagggtttaaagaagaaaataaaaatgacttaccatatctctactcaacttaacatttcagtgcaaatccttcctgtcattttatgcaaattaaaatttaaaacctaatttcaatcttactgtaaagagtgttctgtgactcgcttttctgatattactaaatagtgtgcacattttcccttgttaaatatgcctcaaaaacataatgttaatgatggaataatgttccatcatgcaggtggacctcaatttagcttcctgcttattgttactggacatttgaagctgctgtaaatctttgtcaataaatctccatgaatatccctgaccttagcataaaatcctggaaataagattgccgggtccaaagatctacccaaattaaaaatggacacaatttcaagaagtgaattgacctctaaaatagtttacaaatttatattaccaccagcattgaaaatgccttttccccacggattggtctacataagagtgttggttaattttatgtgttgacttgactaggctaaacgatgcccagatagcaggtaaaacattatttctgggtgtgttcgttctgtttctctgggatcccagactaacacaatcatatactttttgaggatgatgatgataacaatgaatgcctgcaacagtgcctggtacacagttgatcctcaatagatacttgatgaatgaataaaatgttctttgtcaagtgtcattagcaactgttgctgtggatgactttgaagtaggcgtgacttggtggatgtagtcaccctctctgggatgccttacctctctttcccttgacctatttcaatcatacatattttttggggctccacatccagctttcatcttccatcaatgccttctttgggcatgccagcccatggagtgctctcccactggcaacatcttgtagcttctgtttttagcactgtagacacaacattatgtggtcatgccgttgtttttcaagctgctgtggcacagtgatgatgtcaaaaatattatacataaaagagttggccaggcatggtggcttacgcctgtaatcccagcactttgggaggccgaggtgggtggatcacgaagtcaagagttcaagaccagcctggccaacatggtgaaaccccatctctacaaaaatacaaaaattagccaggtgtggtggtgtgcacctgtaatcccagctactcgggaggctgagatgaagaattgcttaaacccaggaggcaaaggctgcagtgagccaagatcccgccactgcactccagcactccgctctc

SEQ ID NO: 199545 - DNA, 6392 bp, Homo sapiens
  Payload ID: 19362
  Gene Name: V-set and transmembrane domain containing 4
  Uniprot ID: Q8IW00
  ENST ID: ENST00000332853
  CDS Start-End: 25-987
acagcgccgggcggcggcggggagatgcggctgctggcactggcggcggccgcgctgctggcgcgggctccggctccggaggtctgtgcggccctcaatgtcactgtgtccccggggcccgtggttgactacctggagggggagaatgccactctcctctgccacgtctcccagaaaaggcggaaggacagcttgctggccgtgcgctggttctttgcacactccttcgactcccaggaggccttgatggtgaagatgaccaagctccgggtggtgcagtactatgggaatttcagccgcagcgccaaacggcggaggctgcgcctgctggaggagcagcggggggcgctctacaggctctccgtcttgacactgcagccctccgatcaagggcattacgtctgcagagtccaggaaatcagcaggcacaggaacaagtggacggcctggtccaatggctcctcagccacggaaatgagagtcatttccctcaaagcttctgaagagtcatcctttgagaaaacaaaagagacttgggcattttttgaagatctctatgtgtatgctgtcctcgtgtgctgcgtggggatcctcagcattctgctcttcatgctggtcatcgtctggcagtctgtgtttaacaagcggaaatccagagtgagacattatttggtgaaatgccctcagaacagctcaggggagactgtcactagcgtgaccagcttggccccactacagcccaagaagggcaagaggcagaaggagaagcctgacattcctcccgcagtccctgccaaagctccgatagcccccacgttccataaaccgaagctgctgaaaccacagagaaaagtcacgctgccaaagattgctgaggaaaacttaacctatgccgaactggagctgatcaaaccccaccgggctgccaaaggcgcccccaccagcactgtctacgcccagatcctcttcgaggagaacaagctgtagtacagcgtccacctccaaggttctatttaatacctgccacccagtgatttatgaagccttggagacaaagcccttatgtctgtattttcactcatgccttctgagtggtggggagccccttttcagcagcattctgggtgcctttgaagaggtacaagcctgctctccccaaaagaatcggggccacagctcttgacagatctcccgggacaagatgcgcctgggtttgagccctgagcgtaaggattctgatcctgagagcagccaaggagattttctgctgagccaaaccccttcacatttttctcctctttccccaggttttctttaaaatcgtttttaaatcttaattttactctctactcttcctgtatccacgatacaagctcacagtatatagctagaggaaatgccattatggacccaactgtaagatggcacatatgttggttttccaaggatcagatggcattgccagggccacagccaactgctgattgccagcaccacctgagatggcatctcttgttttaaatagatgcactaaccctgaagattaaggccagaggggcagactgactagagaagtataaggtctgtctctgaatgccatggtgcccacctatgagaccctgaggccgcaggacaagaagaacaccattctagagggcttccagccctttcacaaggtggacctgtactgatagagaaacacactctctaagaagtgcttactcacccttttccaaaggagcacaggtgttggccatcagaagacacactggagcgcatgggcctcttcactgtgtgccaagctcagtcacctctgattcagcccctgaaggtgtctgctgccaggtgccctcagggtaggagagtgggaagtacacgccaagctggaaagtgtgttctgaagaccctcctcttgccaagtgccttgcccattgcaaccttgtgtgtgaattctaatgggtttgaatgggggtcagggtgcatggggaagttgctctgtggacctttgggacacaggaatcttggacttactggcaggggatccattctgaaagcaccatcctgtcaactgtgttattgaggacatttcttgatgtgagtatagtctgggtggctatttactgcccactatagaaattgtttgactatgtagtggaccatgtatatatgataaattatctattttaaacacagctggggtatgagttgtgccctctatatagctgtgtgaacttggctaaatttcttatcccctaatgacctcagactccatgtttgtgtaaagacgacttaacttcccatagaattcttgagggtaaaatgggataatgaatcttgccagttctagaaactgtaaattgctacacaaatgctctgtgttgacattcatgctaaagccagtctgcattttcaaaatgaaaatttcttcactatttaaggctttcattgcaataactttaaaaaccaaatatttgtccaccaacttagccctacagtaatgttcccaaagactcatgagagtttatggtttattggaaagggtccaaattggaagcagatattgattttctgggagcaaactggtctgcctttacaaagtggaagttcaccctctctggataacacctgtgtctcattcctccctctctgccagatctcgaaggcactgaataaaccatgcagcttttgaggaagaaagaaccatttggaagaactcactagaacttctttgagcatctctttgggaggggaggatatatggttagcacaccatttatataataattatcacagggatttttaattttatcatggcagtgttctgacagatgtatagtgttttgagggcagaggatgatctcctaatttgcccaaagagccttatgggtttgtggggctctgggggtgccaaatgggaaggagagggggcacatgaaaaggaaatggcgggaagagggcaacaggccagggggtaatatcttcccaggccccttaggcctctacagaacggaaatgaacttcattcacccccaaacccacccacttaaatccaaagagagcttagggttattatgcatggacaggaacacattctaccaagaacacatgctcttaagagctagtagctcccagttagagtcaaaccagtcattgttatattatagattgaatccagcctctttctcccaaactgtggtcatcactgcatgaatccacactaaggtgtgtgaatgggaacctgcagattatctcctcctactgaaaatgctgcccaggggaatcttggaagctatggacagcatccaggcagagctggtcccactgttatctccagaagcaaatgcccaagctgtgctcagaactggaagcaatggatgacttgtatcaggtgcttgtttgagaggatatattgacattattgccatagtaagcttaaaaaaatgtgcccactcattcattctttgtccatggaccactaatcatgcattgtcatttccaaagataaggggaaacatatcacatatcattgaaatagaaattagggaaagtttgtcaatttgttttcactataaggcatcaatggcagaaactacatatgagtaattttcaaaatagaccattgcttaaatgtttaaatgaagctaaaagaagtatgaacccattggttagagtgcagtggcttctttcaggcagacagcagatgctctcagatttggtggtgagttttggccttggcatggttggcatggagtcagcacaggaagccgggaggtatgaaggggcatccacctgggtgaaactgtcttgccaagccaaagccccgaggcctgccctgaagcagctgtagtggaggagaggcctgggattccttagagtcacctttttacgaatgtaccgccactctgttagctcacagggaaaataaggaaaagccaggcctcccacctcttgactcttgtgagagtgaagacaacatggggcatttagaaaatatatttttagtgtatgataatgtgggctggcccacacagcaatgagcccaaagaccccctcgctttgggaattattcatggccctgctcatcacagcctctgatatgcatgactgtaacctaggctgagccaagaatggagctcatgccagaaatggtcctaagcatgcacatggccccctggaatatcaaaatcctggggagaaagaaatcatctttgccttgggcagtgaagctggaatggcacatatctatctgttgccacatctcctgcctagtggagaagccttggaaggcaacagacactgagcaagcagcagggaggagaatgtcctggaagggcaggactctacccaagtccctaacatccccagactcttctcttccataaactctctaattactctgctgtttaaatcctggttttggtcaagccagtcaggttgcataaagaatatgaatacagtatgcatcaaagttgcttcccagaacaggaagcaaaacaaacaaacaaacaaacaaacaaaatactgatatcagtacccagggtgcccaattaggtcacacccagtggctgcattgcagcccctgagctcctgctgcaccgtgtgtcctgctgcccgagtgggccccaccctgggttctgaagatgcccttcttaatggagagctcccgatggagggctccaggactgatgctctccctaaggaagggaggcctcagatttggagagggacaccaacaggaccagaggaggactgaggggcactggcaccaataagtggaagggaacagcgtggtaacaaaaaagagccatgccacttgcatgctggagggagtctttttgtgtcagcctaaagcttaggctggtgtccatgtggaacatgacatctttccagtatccctgatccaggaaactgcagtgagacccaggtgacccagctctgtgtcatttggagcccattaaaaagtgaggcagccacatggcggggacattgaccccactccagaccacactcccatctccatacataggatagaaactgttcatcaggaaggaaaaccaaacagaaattcgtggtctaggggaggggtctgcattcagcatggccatgctgggctggagtggctgtggggtgtccagatagatgggcatgtagactagtgctttctcaacctttaatgcatgcacaaatcatcgagatcttgttaaaatgtagatcctgggtgggcacggtggctcacgcctgtaatcccagcactttgggaggctgaggcgggcggatcatgaggtcaggagatcgagaccatcctggctaacacggtgaaaccctgtctctactaaaaatacaaaaaattagccaggcatggtggtgggtgcctgtagtcccagctactcgggaggctgaggcaggagaatggcatgaacccgggaggcggagcttgcagtgagccgagatcgtgctgctgcactccagcctgggcaatagagtgagattccgtctcaaaaaaaaaaaaaaaaaaaatgtagatcctggctcaggaggtctgggataggacctgggattctgagtttctaacaagctcccagggatgtccatgcttctggtccctgaaccacactttgagtgacaaggatgtaaactgttggaaacatggatctggtgctcattgcgggaaagggggtgtcctcagggcataggtcacagccaaagccctgacagcgggcaagagtcccagggagaggctgcctgcacattgaggaggggaagggctgggcctgagcagtggggagcatccatgctggcaggtatgcagcaggcaaggagatccaggtggagatcagaggacagtgacagtcacagcagcaggggagagccaggagaaagctgctcctaggggtgtctcaaaggaagaagggatctgcagtgtgaactctgcagagggcagggagaatagaggttaagcctttgctcattctgaattaattgattactgctttttaaaagtgctttctttctctgggaaaaaaaaaacattccccagtgcctaaggctaacagacgtgggcgctgagctgtgtctggtctgctgagtgtattttccccagagcaatcctcatcttctcagggggtggggatttggacaagactcttcctgaacacgcagcgtggtggggaagggtggccatggaggttttctgttccttctgttgtcactggtgaaagacgacttggtgcccaatttctaataaacacaatgctattagcgtcactccaatttagtgtctgattgttaaatgttaatgtactgcactctacagttttaaatataattagagatgtttacagctttggttaaatgcaccttgttcttccacattaaactttattacaagcgtc

SEQ ID NO: 199546 - DNA, 389 bp, Homo sapiens
  Payload ID: 19363
  Gene Name: V-set and transmembrane domain containing 5
  ENST ID: ENST00000398221
  CDS Start-End: 1-61
aagacacaaactcaaagaaagcacaactgaggagattgagctggaagatgttgagtgttagccaaggctgggcctgactgcattcctacctcaagaggaaaccattctccaacaaaaagagcaagcacagctattatacccattgtgtgtggtcctgttgcagcccgctcctaacaggacagtgggagattaacaacattgactgcatggagttgaggactgtggatgggacaaagctagtattaggactcgcgctaagttcaaggagaagagtgattgaggctttgaaccaggagcttcgcttggctgcagcatcagggccgtgctgacacataaccaatggcagtcggaggaaccaggctctgggccaggacagtttccagtgctgt

SEQ ID NO: 199547 - DNA, 2969 bp, Homo sapiens
  Payload ID: 19363
  Gene Name: V-set and transmembrane domain containing 5
  Uniprot ID: A8MXK1
  ENST ID: ENST00000409977
  CDS Start-End: 30-632
ccccggcccgcgaggccccgggctcgcccatgaggcctctgcccagcgggaggaggaagacccgaggcatctccctaggactcttcgccctctgcctggccgcagcccgctgtctgcagagtcagggtgtgtccctatacattcctcaggccaccatcaatgccactgtcaaagaagacatcctgctctcagttgagtactcctgtcatggagtgcccaccatcgaatggacatattcatccaattggggaacgcagaagatcgtggagtggaaaccagggactcaggccaacatctctcaaagccacaaggacagagtctgcacctttgacaacggctccatccagctcttcagcgtgggagtgagggattccggctactatgtcatcaccgtgacggagcgcctggggagcagccagtttggcaccatcgtgctgcacgtctctgagatcctctatgaagacctgcactttgtcgctgtcatccttgcttttctcgctgctgtggccgcagtattaatcagcctcatgtgggtttgtaataagtgtgcatataaatttcagaggaagagaagacacaaactcaaagaaagcacaactgaggagattgagctggaagatgttgagtgttagccaaggctgggcctgactgcattcctacctcaagaggaaaccattctccaacaaaaagagcaagcacagctattatacccattgtgtgtggtcctgttgcagcccgctcctaacaggacagtgggagattaacaacattgactgcatggagttgaggactgtggatgggacaaagctagtattaggactcgcgctaagttcaaggagaagagtgattgaggctttgaaccaggagcttcgcttggctgcagcatcagggccgtgctgacacataaccaatgggtgagtgcaggcgttggctgcttgctcacgacacttgctctggtgtgcaggatggcctgttgtcagagtccctgtatcagaggccagaggatttccagatggatgtgcagccagcattagaacatgctttctgtgctcctgtctgctctgcaactgctgtgccaaccagccccccatctggtatcccacaagcaagcactgctgtgggagctattgtgagaaaacctgaggcttttagacaatctgctgcctcagagcagaggtggaaagagactgggggtgggggttggtgctgttgtgctgcagagtttttcattggtgaggcccggtggctgggagttttatgggagaggagctcaatggactcctgagaggccagctttggatacaaggaatagagaaaattatctttctcttcctccctcattccaacgttaattggattttccctcccatggctcaaacttaggccattgtaagtaaaacaacagctcatctccattatgggcagcacctggcctcctgacgagctggatgccacctgtgtgaaagctgagcttgcatagtgggtgatgcagctggaaaatcagtcatctcgggctttgcatctgtccccctcagtcactaacacttcacgtctcaagtcaggcccttgccctctcctacctgggctgaggaacgcttggcccttgcctacctcacagtcagagtatcaagagaagcccacagtatgcacagagttctctgagcaacttacgaaatgcatgaggcttcttcaaggatctggaaagctatactggaaaacgctattctgagtattagaaattgataaaatcctctgaggtcttggggctccaggtgagattggggactggaccacagctggccttggccattattccctcaggttgttggtcaccatgttcacctgtaagtttctccatcccaacttccatttgacaagctctaaaagcaggcatggatttattttccattctcttatctctccaatattcatagctacagaccaaaggtaccatccgatgatgatgtgttcctagtcctcagttgcaaattcacccatgcaaaggttaagaagtcttagaacattcctttctcttcttcctcctttcaggcctccaatgtccatatcttctctatttcctatgtggcagaggagttgcttggataagttacagccctttccctcaatattgaatccagagttttgggaagggatctctcagaatattcagacaggaactctcagtatccagagcaggactcccaaggcactgcttgattcaaaaggcgacagcagttggtctacacaacggatgtgtagctctagcacctgacaggtagaagataccctcaaggcgcctcctgtagacacacgggtaaactcacacactatgtcctatccccacgcagcagtcggaggaaccaggctctgggccaggacagtttccagtgctgtgaagaaacgaggtgagcagtatccaaggggctcaaggataatctgctgatttctttcttgtctttcacacagagaggccaccagcaggaaagcagtgggagttgggtagctgctggggccagcatgtcctcttccacactacctgcctttcagaactctgctcttccgcttgtcccgaagtcagggctggcaatcttcataatcaaaggggagttggaaaagaacacccactaagaggcctccatggcagatgtcaattaaattgcccccccgcccaaatctcatgacagtttattcacatcagtagtgtgggaagttacaatgttttttttaaaaaaagcttctttccttggctttccatttctttgaaaaaagggtttcttttgaatttttaaagctctgccatactgaacattcctgtggaaaggtttaaaatgcagagcctgaggtttttgcttttcagaaaaataaaaatcttagagattagctagtgtaaatgttaagctataaattatatttcaaactgtgaaaaaaaaaagttttaaagaatgaatgaaataaaacctgaaaataaa

SEQ ID NO: 199548 - DNA, 2289 bp, Homo sapiens
  Payload ID: 19364
  Gene Name: V-set domain containing T cell activation inhibitor 1
  Uniprot ID: Q7Z7D3
  ENST ID: ENST00000328189
  CDS Start-End: 106-606
acactatttaaggccaatacacgggagctggttgtgagtcaccaaggaaggcagcggcagctccactcagccagtacccagatacgctgggaaccttccccagccatggcttccctggggcagatcctcttctggagcataattagcatcatcattattctggctggagcaattgcactcatcattggctttggtatttcagccttcagcatgccggaagtgaatgtggactataatgccagctcagagaccttgcggtgtgaggctccccgatggttcccccagcccacagtggtctgggcatcccaagttgaccagggagccaacttctcggaagtctccaataccagctttgagctgaactctgagaatgtgaccatgaaggttgtgtctgtgctctacaatgttacgatcaacaacacatactcctgtatgattgaaaatgacattgccaaagcaacaggggatatcaaagtgacagaatcggagatcaaaaggcggagtcacctacagctgctaaactcaaaggcttctctgtgtgtctcttctttctttgccatcagctgggcacttctgcctctcagcccttacctgatgctaaaataatgtgcctcggccacaaaaaagcatgcaaagtcattgttacaacagggatctacagaactatttcaccaccagatatgacctagttttatatttctgggaggaaatgaattcatatctagaagtctggagtgagcaaacaagagcaagaaacaaaaagaagccaaaagcagaaggctccaatatgaacaagataaatctatcttcaaagacatattagaagttgggaaaataattcatgtgaactagacaagtgtgttaagagtgataagtaaaatgcacgtggagacaagtgcatccccagatctcagggacctccccctgcctgtcacctggggagtgagaggacaggatagtgcatgttctttgtctctgaatttttagttatatgtgctgtaatgttgctctgaggaagcccctggaaagtctatcccaacatatccacatcttatattccacaaattaagctgtagtatgtaccctaagacgctgctaattgactgccacttcgcaactcaggggcggctgcattttagtaatgggtcaaatgattcactttttatgatgcttccaaaggtgccttggcttctcttcccaactgacaaatgccaaagttgagaaaaatgatcataattttagcataaacagagcagtcggcgacaccgattttataaataaactgagcaccttctttttaaacaaacaaatgcgggtttatttctcagatgatgttcatccgtgaatggtccagggaaggacctttcaccttgtctatatggcattatgtcatcacaagctctgaggcttctcctttccatcctgcgtggacagctaagacctcagttttcaatagcatctagagcagtgggactcagctggggtgatttcgccccccatctccgggggaatgtctgaagacaattttggttacctcaatgagggagtggaggaggatacagtgctactaccaactagtggatagaggccagggatgctgctcaacctcctaccatgtacaggacgtctccccattacaactacccaatccgaagtgtcaactgtgtcagggctaagaaaccctggttttgagtagaaaagggcctggaaagaggggagccaacaaatctgtctgcttcctcacattagtcattggcaaataagcattctgtctctttggctgctgcctcagcacagagagccagaactctatcgggcaccaggataacatctctcagtgaacagagttgacaaggcctatgggaaatgcctgatgggattatcttcagcttgttgagcttctaagtttctttcccttcattctaccctgcaagccaagttctgtaagagaaatgcctgagttctagctcaggttttcttactctgaatttagatctccagaccctgcctggccacaattcaaattaaggcaacaaacatataccttccatgaagcacacacagacttttgaaagcaaggacaatgactgcttgaattgaggccttgaggaatgaagctttgaaggaaaagaatactttgtttccagcccccttcccacactcttcatgtgttaaccactgccttcctggaccttggagccacggtgactgtattacatgttgttatagaaaactgattttagagttctgatcgttcaagagaatgattaaatatacatttcctacacc

SEQ ID NO: 199549 - DNA, 2581 bp, Homo sapiens
  Payload ID: 19364
  Gene Name: V-set domain containing T cell activation inhibitor 1
  ENST ID: ENST00000359008
  CDS Start-End: 40-897
ctgcaattgtgtccggaatttattccttctggtgggttcatggtcttgctgacttcaagaatgaagccgctgacctcgcgcataattagcatcatcattattctggctggagcaattgcactcatcattggctttggtatttcagggagacactccatcacagtcactactgtcgcctcagctgggaacattggggaggatggaatcctgagctgcacttttgaacctgacatcaaactttctgatatcgtgatacaatggctgaaggaaggtgttttaggcttggtccatgagttcaaagaaggcaaagatgagctgtcggagcaggatgaaatgttcagaggccggacagcagtgtttgctgatcaagtgatagttggcaatgcctctttgcggctgaaaaacgtgcaactcacagatgctggcacctacaaatgttatatcatcacttctaaaggcaaggggaatgctaaccttgagtataaaactggagccttcagcatgccggaagtgaatgtggactataatgccagctcagagaccttgcggtgtgaggctccccgatggttcccccagcccacagtggtctgggcatcccaagttgaccagggagccaacttctcggaagtctccaataccagctttgagctgaactctgagaatgtgaccatgaaggttgtgtctgtgctctacaatgttacgatcaacaacacatactcctgtatgattgaaaatgacattgccaaagcaacaggggatatcaaagtgacagaatcggagatcaaaaggcggagtcacctacagctgctaaactcaaaggcttctctgtgtgtctcttctttctttgccatcagctgggcacttctgcctctcagcccttacctgatgctaaaataatgtgcctcggccacaaaaaagcatgcaaagtcattgttacaacagggatctacagaactatttcaccaccagatatgacctagttttatatttctgggaggaaatgaattcatatctagaagtctggagtgagcaaacaagagcaagaaacaaaaagaagccaaaagcagaaggctccaatatgaacaagataaatctatcttcaaagacatattagaagttgggaaaataattcatgtgaactagacaagtgtgttaagagtgataagtaaaatgcacgtggagacaagtgcatccccagatctcagggacctccccctgcctgtcacctggggagtgagaggacaggatagtgcatgttctttgtctctgaatttttagttatatgtgctgtaatgttgctctgaggaagcccctggaaagtctatcccaacatatccacatcttatattccacaaattaagctgtagtatgtaccctaagacgctgctaattgactgccacttcgcaactcaggggcggctgcattttagtaatgggtcaaatgattcactttttatgatgcttccaaaggtgccttggcttctcttcccaactgacaaatgccaaagttgagaaaaatgatcataattttagcataaacagagcagtcggcgacaccgattttataaataaactgagcaccttctttttaaacaaacaaatgcgggtttatttctcagatgatgttcatccgtgaatggtccagggaaggacctttcaccttgtctatatggcattatgtcatcacaagctctgaggcttctcctttccatcctgcgtggacagctaagacctcagttttcaatagcatctagagcagtgggactcagctggggtgatttcgccccccatctccgggggaatgtctgaagacaattttggttacctcaatgagggagtggaggaggatacagtgctactaccaactagtggatagaggccagggatgctgctcaacctcctaccatgtacaggacgtctccccattacaactacccaatccgaagtgtcaactgtgtcagggctaagaaaccctggttttgagtagaaaagggcctggaaagaggggagccaacaaatctgtctgcttcctcacattagtcattggcaaataagcattctgtctctttggctgctgcctcagcacagagagccagaactctatcgggcaccaggataacatctctcagtgaacagagttgacaaggcctatgggaaatgcctgatgggattatcttcagcttgttgagcttctaagtttctttcccttcattctaccctgcaagccaagttctgtaagagaaatgcctgagttctagctcaggttttcttactctgaatttagatctccagaccctgcctggccacaattcaaattaaggcaacaaacatataccttccatgaagcacacacagacttttgaaagcaaggacaatgactgcttgaattgaggccttgaggaatgaagctttgaaggaaaagaatactttgtttccagcccccttcccacactcttcatgtgttaaccactgccttcctggaccttggagccacggtgactgtattacatgttgttatagaaaactgattttagagttctgatcgttcaagagaatgattaaatatacatttcctacacca

SEQ ID NO: 199550 - DNA, 2612 bp, Homo sapiens
  Payload ID: 19364
  Gene Name: V-set domain containing T cell activation inhibitor 1
  Uniprot ID: Q7Z7D3
  ENST ID: ENST00000369458
  CDS Start-End: 80-928
gctggttgtgagtcaccaaggaaggcagcggcagctccactcagccagtacccagatacgctgggaaccttccccagccatggcttccctggggcagatcctcttctggagcataattagcatcatcattattctggctggagcaattgcactcatcattggctttggtatttcagggagacactccatcacagtcactactgtcgcctcagctgggaacattggggaggatggaatcctgagctgcacttttgaacctgacatcaaactttctgatatcgtgatacaatggctgaaggaaggtgttttaggcttggtccatgagttcaaagaaggcaaagatgagctgtcggagcaggatgaaatgttcagaggccggacagcagtgtttgctgatcaagtgatagttggcaatgcctctttgcggctgaaaaacgtgcaactcacagatgctggcacctacaaatgttatatcatcacttctaaaggcaaggggaatgctaaccttgagtataaaactggagccttcagcatgccggaagtgaatgtggactataatgccagctcagagaccttgcggtgtgaggctccccgatggttcccccagcccacagtggtctgggcatcccaagttgaccagggagccaacttctcggaagtctccaataccagctttgagctgaactctgagaatgtgaccatgaaggttgtgtctgtgctctacaatgttacgatcaacaacacatactcctgtatgattgaaaatgacattgccaaagcaacaggggatatcaaagtgacagaatcggagatcaaaaggcggagtcacctacagctgctaaactcaaaggcttctctgtgtgtctcttctttctttgccatcagctgggcacttctgcctctcagcccttacctgatgctaaaataatgtgcctcggccacaaaaaagcatgcaaagtcattgttacaacagggatctacagaactatttcaccaccagatatgacctagttttatatttctgggaggaaatgaattcatatctagaagtctggagtgagcaaacaagagcaagaaacaaaaagaagccaaaagcagaaggctccaatatgaacaagataaatctatcttcaaagacatattagaagttgggaaaataattcatgtgaactagacaagtgtgttaagagtgataagtaaaatgcacgtggagacaagtgcatccccagatctcagggacctccccctgcctgtcacctggggagtgagaggacaggatagtgcatgttctttgtctctgaatttttagttatatgtgctgtaatgttgctctgaggaagcccctggaaagtctatcccaacatatccacatcttatattccacaaattaagctgtagtatgtaccctaagacgctgctaattgactgccacttcgcaactcaggggcggctgcattttagtaatgggtcaaatgattcactttttatgatgcttccaaaggtgccttggcttctcttcccaactgacaaatgccaaagttgagaaaaatgatcataattttagcataaacagagcagtcggcgacaccgattttataaataaactgagcaccttctttttaaacaaacaaatgcgggtttatttctcagatgatgttcatccgtgaatggtccagggaaggacctttcaccttgtctatatggcattatgtcatcacaagctctgaggcttctcctttccatcctgcgtggacagctaagacctcagttttcaatagcatctagagcagtgggactcagctggggtgatttcgccccccatctccgggggaatgtctgaagacaattttggttacctcaatgagggagtggaggaggatacagtgctactaccaactagtggatagaggccagggatgctgctcaacctcctaccatgtacaggacgtctccccattacaactacccaatccgaagtgtcaactgtgtcagggctaagaaaccctggttttgagtagaaaagggcctggaaagaggggagccaacaaatctgtctgcttcctcacattagtcattggcaaataagcattctgtctctttggctgctgcctcagcacagagagccagaactctatcgggcaccaggataacatctctcagtgaacagagttgacaaggcctatgggaaatgcctgatgggattatcttcagcttgttgagcttctaagtttctttcccttcattctaccctgcaagccaagttctgtaagagaaatgcctgagttctagctcaggttttcttactctgaatttagatctccagaccctgcctggccacaattcaaattaaggcaacaaacatataccttccatgaagcacacacagacttttgaaagcaaggacaatgactgcttgaattgaggccttgaggaatgaagctttgaaggaaaagaatactttgtttccagcccccttcccacactcttcatgtgttaaccactgccttcctggaccttggagccacggtgactgtattacatgttgttatagaaaactgattttagagttctgatcgttcaagagaatgattaaatatacatttcctacacca

SEQ ID NO: 199551 - DNA, 2719 bp, Homo sapiens
  Payload ID: 19364
  Gene Name: V-set domain containing T cell activation inhibitor 1
  Uniprot ID: Q7Z7D3
  ENST ID: ENST00000539893
  CDS Start-End: 473-1036
ctggtaatctgtggcgtaacaagacctccaggtgattctctgtattagcagccgctctgtgctccctgattcctccagaaaagcacaaggatttaatccagatagatataaatttcacctgggatcatttatcattccacattcttctttaagaaatgtgctaaagagccacagatgggtcttgatgaaaacaaaggaaaagccatgaagtttctacagcataattagcatcatcattattctggctggagcaattgcactcatcattggctttggtatttcagggagacactccatcacagtcactactgtcgcctcagctgggaacattggggaggatggaatcctgagctgcacttttgaacctgacatcaaactttctgatatcgtgatacaatggctgaaggaaggtgttttaggcttggtccatgagttcaaagaaggcaaagatgagctgtcggagcaggatgaaatgttcagaggccggacagcagtgtttgctgatcaagtgatagttggcaatgcctctttgcggctgaaaaacgtgcaactcacagatgctggcacctacaaatgttatatcatcacttctaaaggcaaggggaatgctaaccttgagtataaaactggagccttcagcatgccggaagtgaatgtggactataatgccagctcagagaccttgcggtgtgaggctccccgatggttcccccagcccacagtggtctgggcatcccaagttgaccagggagccaacttctcggaagtctccaataccagctttgagctgaactctgagaatgtgaccatgaaggttgtgtctgtgctctacaatgttacgatcaacaacacatactcctgtatgattgaaaatgacattgccaaagcaacaggggatatcaaagtgacagaatcggagatcaaaaggcggagtcacctacagctgctaaactcaaaggcttctctgtgtgtctcttctttctttgccatcagctgggcacttctgcctctcagcccttacctgatgctaaaataatgtgcctcggccacaaaaaagcatgcaaagtcattgttacaacagggatctacagaactatttcaccaccagatatgacctagttttatatttctgggaggaaatgaattcatatctagaagtctggagtgagcaaacaagagcaagaaacaaaaagaagccaaaagcagaaggctccaatatgaacaagataaatctatcttcaaagacatattagaagttgggaaaataattcatgtgaactagacaagtgtgttaagagtgataagtaaaatgcacgtggagacaagtgcatccccagatctcagggacctccccctgcctgtcacctggggagtgagaggacaggatagtgcatgttctttgtctctgaatttttagttatatgtgctgtaatgttgctctgaggaagcccctggaaagtctatcccaacatatccacatcttatattccacaaattaagctgtagtatgtaccctaagacgctgctaattgactgccacttcgcaactcaggggcggctgcattttagtaatgggtcaaatgattcactttttatgatgcttccaaaggtgccttggcttctcttcccaactgacaaatgccaaagttgagaaaaatgatcataattttagcataaacagagcagtcggcgacaccgattttataaataaactgagcaccttctttttaaacaaacaaatgcgggtttatttctcagatgatgttcatccgtgaatggtccagggaaggacctttcaccttgtctatatggcattatgtcatcacaagctctgaggcttctcctttccatcctgcgtggacagctaagacctcagttttcaatagcatctagagcagtgggactcagctggggtgatttcgccccccatctccgggggaatgtctgaagacaattttggttacctcaatgagggagtggaggaggatacagtgctactaccaactagtggatagaggccagggatgctgctcaacctcctaccatgtacaggacgtctccccattacaactacccaatccgaagtgtcaactgtgtcagggctaagaaaccctggttttgagtagaaaagggcctggaaagaggggagccaacaaatctgtctgcttcctcacattagtcattggcaaataagcattctgtctctttggctgctgcctcagcacagagagccagaactctatcgggcaccaggataacatctctcagtgaacagagttgacaaggcctatgggaaatgcctgatgggattatcttcagcttgttgagcttctaagtttctttcccttcattctaccctgcaagccaagttctgtaagagaaatgcctgagttctagctcaggttttcttactctgaatttagatctccagaccctgcctggccacaattcaaattaaggcaacaaacatataccttccatgaagcacacacagacttttgaaagcaaggacaatgactgcttgaattgaggccttgaggaatgaagctttgaaggaaaagaatactttgtttccagcccccttcccacactcttcatgtgttaaccactgccttcctggaccttggagccacggtgactgtattacatgttgttatagaaaactgattttagagttctgatcgttcaagagaatgattaaatatacatttcctacacc

SEQ ID NO: 199552 - DNA, 569 bp, Homo sapiens
  Payload ID: 19364
  Gene Name: V-set domain containing T cell activation inhibitor 1
  ENST ID: ENST00000430871
  CDS Start-End: 73-336
gtgagtcaccaaggaaggcagcggcagctccactcagccagtacccagatacgctgggaaccttccccagccatggcttccctggggcagatcctcttctggagcataattagcatcatcattattctggctggagcaattgcactcatcattggctttggtatttcagaagtctctgtctggctttcagcaatgaagggtttgtgtagaagttccaaggcttcccttagcattgatctttgcttcctgaactgcagggagacactccatcacagtcactactgtcgcctcagctgggaacattggggaggatggaatcctgagctgcacttttgaacctgacatcaaactttctgatatcgtgatacaatggctgaaggaaggtgttttaggcttggtccatgagttcaaagaaggcaaagatgagctgtcggagcaggatgaaatgttcagaggccggacagcagtgtttgctgatcaagtgatagttggcaatgcctctttgcggctgaaaaacgtgcaactcacagatgctggcacctacaaatgttatatcatcacttctaaag

SEQ ID NO: 199553 - DNA, 1534 bp, Homo sapiens
  Payload ID: 19365
  Gene Name: WAP four-disulfide core domain 1
  Uniprot ID: Q9HC57
  ENST ID: ENST00000219454
  CDS Start-End: 327-989
gacaggccactcccggccacgtctccaagcaagccggtgccccctcctcctgctgccaccgcccactgagctgcctgggctgcagacgccctggttggagcgtctggggccagatgttatagggcaagctaaaaataaccgggcaggccagccaccatcgaggaaggggcatgtgctggacgcggacacatgatccgagggaccctgctgggtggaactaagaaagtccagcagactgtgcacgctcctgtccccactcacaggcccacgcagcgaggggggcccctcttctgtgtgcgtctggaaggtcgctgcccagggaggaaatgcctttaaccggcgtggggccgggcagctgcaggaggcagatcatccgggctctgtgcctcttgctacttctcctccacgccggctctgccaagaatatctggaaacgggcattgcctgcgaggctggccgagaaatcccgtgccgaggaggcgggcgcgcccggcggcccccggcagccccgagcagaccgctgcccgccgcctccgcggacgctgccccccggcgcctgccaggccgcgcgctgtcaggcggactccgagtgcccgcggcaccggcgctgctgctacaacggatgcgcctacgcctgcctagaagctgtgccgcccccgccagtcttagactggctggtgcagccgaaacctcgatggcttggtggcaatggctggctcctggatggccctgaggaggtgttacaagcagaggcgtgcagcaccacggaggatggggccgaacccctgctctgtccctcgggctatgagtgccacatcctgagcccaggtgacgtggccgaaggtatccccaaccgtgggcagtgcgtcaagcagcgccggcaagcagatgggcgaatcctacgacacaaactttacaaagaatatccagaaggtgactcaaagaatgtggcagaacctggaaggggacaacagaagcactttcagtaaagcaacggcaagcagctaggttgcaagaacattcctctactttctgctaagccttggaaacagttgggaaaagtagtttgaccctcacagttcacattcagctcagcagagcaagaccccagagatgcttagagacaggacacctggccatcaaacccagtttggcccagcctggttgggtgactttgtgggagccacttaacagctctgggtccctgttttaccatcctgggagcaaggccctgcagctccacgagacctttaccccgggaagaagccgccacccatgaaagcatttctgaagcccctttctaagacaaggctcagcatcttgatatttttgacagattcctcccaagtctggctctgggaggtatgtacccatctcaaatgttcccaagataaattcatccttcaggaaatggaaatgaacttgcttactaatgtgtgattcctagttgtagccaccggatgtgctgaggcctaaatgttagcaggtgggaggaggccacagaacaataaaaacaaccaaataagatgccgag

SEQ ID NO: 199554 - DNA, 1319 bp, Homo sapiens
  Payload ID: 19365
  Gene Name: WAP four-disulfide core domain 1
  Uniprot ID: Q9HC57
  ENST ID: ENST00000568638
  CDS Start-End: 127-789
gaccctgctgggtggaactaagaaagtccagcagactgtgcacgctcctgtccccactcacaggcccacgcagcgaggggggcccctcttctgtgtgcgtctggaaggtcgctgcccagggaggaaatgcctttaaccggcgtggggccgggcagctgcaggaggcagatcatccgggctctgtgcctcttgctacttctcctccacgccggctctgccaagaatatctggaaacgggcattgcctgcgaggctggccgagaaatcccgtgccgaggaggcgggcgcgcccggcggcccccggcagccccgagcagaccgctgcccgccgcctccgcggacgctgccccccggcgcctgccaggccgcgcgctgtcaggcggactccgagtgcccgcggcaccggcgctgctgctacaacggatgcgcctacgcctgcctagaagctgtgccgcccccgccagtcttagactggctggtgcagccgaaacctcgatggcttggtggcaatggctggctcctggatggccctgaggaggtgttacaagcagaggcgtgcagcaccacggaggatggggccgaacccctgctctgtccctcgggctatgagtgccacatcctgagcccaggtgacgtggccgaaggtatccccaaccgtgggcagtgcgtcaagcagcgccggcaagcagatgggcgaatcctacgacacaaactttacaaagaatatccagaaggtgactcaaagaatgtggcagaacctggaaggggacaacagaagcactttcagtaaagcaacggcaagcaggttgcaagaacattcctctactttctgctaagccttggaaacagttgggaaaagtagtttgaccctcacagttcacattcagctcagcagagcaagaccccagagatgcttagagacaggacacctggccatcaaacccagtttggcccagcctggttgggtgactttgtgggagccacttaacagctctgggtccctgttttaccatcctgggagcaaggccctgcagctccacgagacctttaccccgggaagaagccgccacccatgaaagcatttctgaagcccctttctaagacaaggctcagcatcttgatatttttgacagattcctcccaagtctggctctgggaggtatgtacccatctcaaatgttcccaagataaattcatccttcaggaaatggaaatgaacttgcttactaatgtgtgattcctagttgtagccaccggatgtgctgaggcctaaatgttagcaggtgggaggaggccacagaacaataaaaacaaccaaat

SEQ ID NO: 199555 - DNA, 549 bp, Homo sapiens
  Payload ID: 19365
  Gene Name: WAP four-disulfide core domain 1
  ENST ID: ENST00000613603
  CDS Start-End: 29-229
gtctggaaggtcgctgcccagggaggaaatgcctttaaccggcgtggggccgggcagctgcaggaggcagatcatccgggctctgtgcctcttgctacttctcctccacgccggctctgccaagaatatctggaaacgggcattgcctgcgaggctggccgagaaatcccgtgtaagtgcctgggatggggaggctggggcagcctgtgtgggtgggagtcagccttgaggagaggcgatccctagacactgccttctcctgtaagtgctcccccaaaacgtggcaaggcaggcgtcttcctatccgtgtgtgtctgagttgtgtggtgggcagatggggctcacccccaaaaaaggacccttatctgtgaatcaagaggcaaaagacacatcacaaatgtgccaaagaatcgtgccttacttttgccttgttacaaaagtatgcttgctcctgaaagacagcatctcatttcggaaccccaggatttaaacggagcattccgtctccctgatcagtaccaaatgtttgtgaaatacacttatgcattc

SEQ ID NO: 199556 - DNA, 706 bp, Homo sapiens
  Payload ID: 19366
  Gene Name: WAP four-disulfide core domain 10A
  Uniprot ID: Q9H1F0
  ENST ID: ENST00000372643
  CDS Start-End: 289-528
aaagcagaaataaatgatatctttcattctatcggcaagaacacaagactggttatgtgaaaggaggaggcgtcattcctgcggaagccctatcccacatgacgaacgacaaggccaggggcaagcaaaaagaggaaggactctcttgctctgctccgacttggccagtagaggcagtgaggagctaaagatcattccttctttccttccttcactctccgtagacagctctgcagggaagtctgtgacaacctggccagacatagggctcacgatctgatcagagtcatggcaccccagactctgctgcctgtcctggttctctgtgtgctgctgctgcaggcccagggaggataccgtgacaagaagaggatgcagaaaacacagctatccccagaaatcaaagtctgccagcagcagcctaaactatatctatgcaaacacttatgtgaatctcaccgagattgtcaagcaaataacatatgctgttctacctactgtgggaatgtttgcatgagcatcctgtgagtgggagagtgggctgggatgtgcatcctgcttcccaactcctctatccaagactgtgcccacatccgaagcacaaggacctcaagtcaccagcataagaacatcaacaggaatgccgccctctctactgtctgaaccccttgtccctgtcaaataaaccagaacaaatgcccaggga

SEQ ID NO: 199557 - DNA, 630 bp, Homo sapiens
  Payload ID: 19367
  Gene Name: WAP four-disulfide core domain 10B
  Uniprot ID: Q8IUB3
  ENST ID: ENST00000330523
  CDS Start-End: 232-453
agagcccaagaacactggtggccaaaggatggtgtcttgtgaaaggagggcaagcaaaagtgtaggacaaattttgctttgggattttggttacacctgcagactatcccacagaaggaggaacagcactgaaatcctttctcgcaatcttcctgcattgtacacaggcagctctgcagggaagtctgtgactgcctggccagacttagggctcacgctctggtcagagttatggcaccccagactctgctgcttgtcctggttctctgtgtgctgctgctgcaggcccagggaggataccgtgacaagatgaggatgcagagaatcaaggtctgtgagaagcgacccagcatagatctatgcatccaccactgttcatatttccaaaagtgtgaaacaaataagatatgctgttcagccttctgtgggaacatttgtatgagcatcctatgagtgggagagtgggctgggatgtgcatcctgctccctgaacccttccatccgagactgtgcccacatccgaagcacaaggacatcaaatcatcagcacaagaacatcaacaggaatgccaccctccccagtgtctgaactccctgtccctgtcaaataaaccagaacaaatgcccatg

SEQ ID NO: 199558 - DNA, 475 bp, Homo sapiens
  Payload ID: 19367
  Gene Name: WAP four-disulfide core domain 10B
  Uniprot ID: Q8IUB3
  ENST ID: ENST00000335769
  CDS Start-End: 29-298
agagcccaagaacactggtggccaaaggatggtgtcttgtgaaaggagggcaagcaaaagtgtaggacaaattttgctttgggattttggttacacctgcagactatcccacagaaggaggaacagcactgaaatcctttctcgcaatcttcctgcattgtacacaggaatcaaggtctgtgagaagcgacccagcatagatctatgcatccaccactgttcatatttccaaaagtgtgaaacaaataagatatgctgttcagccttctgtgggaacatttgtatgagcatcctatgagtgggagagtgggctgggatgtgcatcctgctccctgaacccttccatccgagactgtgcccacatccgaagcacaaggacatcaaatcatcagcacaagaacatcaacaggaatgccaccctccccagtgtctgaactccctgtccctgtcaaataaaccagaacaaatgcccatg

SEQ ID NO: 199559 - DNA, 614 bp, Homo sapiens
  Payload ID: 19368
  Gene Name: WAP four-disulfide core domain 11
  Uniprot ID: Q8NEX6
  ENST ID: ENST00000324384
  CDS Start-End: 196-459
ttctttatatgtctggtagaatttggctgtgaatccatctggtccagggccttttctggttggggctccatggttcctagaggcaaggaagaagagccaccagtcaaataggtttcagcacctccaactccaacatcttcaaagcagcgactgggaagaaaaataatccttctgacaacacatattcagacacatatggtcagcctcatgaagctctggatacccatgctcatgacattcttctgtacggtgctactgtctgtgctgggagaaatgaggaagaaaagatatgacaggaaggaattgttacttgaagaatgctggggaaagccaaatgtcaaagaatgtaccaataagtgttctaaagcctttagatgtaaagacaaaaattacacatgctgctggacctattgtggaaacatctgctggataaacgtcgaaaccagtggagattactaaaaccgtagcttcccaccaggctgccacctgtgtgggctgggaaatgtttaagaggtctcatagtagtaccctgtggctacttttaggaacaccagtctatttttactgagagctggacaacagcaaacacttgacaaataaacttatttaccagt

SEQ ID NO: 199560 - DNA, 642 bp, Homo sapiens
  Payload ID: 19368
  Gene Name: WAP four-disulfide core domain 11
  Uniprot ID: Q8NEX6
  ENST ID: ENST00000356562
  CDS Start-End: 223-486
ggaataatttcagtaggattggcaccagctcttctttatatgtctggtagaatttggctgtgaatccatctggtccagggccttttctggggctccatggttcctagaggcaaggaagaagagccaccagtcaaataggtttcagcacctccaactccaacatcttcaaagcagcgactgggaagaaaaataatccttctgacaacacatattcagacacatatggtcagcctcatgaagctctggatacccatgctcatgacattcttctgtacggtgctactgtctgtgctgggagaaatgaggaagaaaagatatgacaggaaggaattgttacttgaagaatgctggggaaagccaaatgtcaaagaatgtaccaataagtgttctaaagcctttagatgtaaagacaaaaattacacatgctgctggacctattgtggaaacatctgctggataaacgtcgaaaccagtggagattactaaaaccgtagcttcccaccaggctgccacctgtgtgggctgggaaatgtttaagaggtctcatagtagtaccctgtggctacttttaggaacaccagtctatttttactgagagctggacaacagcaaacacttgacaaataaacttatttaccagta

SEQ ID NO: 199561 - DNA, 561 bp, Homo sapiens
  Payload ID: 19368
  Gene Name: WAP four-disulfide core domain 11
  Uniprot ID: Q8NEX6
  ENST ID: ENST00000618797
  CDS Start-End: 142-405
ctgtgcaggggctccatggttcctagaggcaaggaagaagagccaccagtcaaataggtttcagcacctccaactccaacatcttcaaagcagcgactgggaagaaaaataatccttctgacaacacatattcagacacatatggtcagcctcatgaagctctggatacccatgctcatgacattcttctgtacggtgctactgtctgtgctgggagaaatgaggaagaaaagatatgacaggaaggaattgttacttgaagaatgctggggaaagccaaatgtcaaagaatgtaccaataagtgttctaaagcctttagatgtaaagacaaaaattacacatgctgctggacctattgtggaaacatctgctggataaacgtcgaaaccagtggagattactaaaaccgtagcttcccaccaggctgccacctgtgtgggctgggaaatgtttaagaggtctcatagtagtaccctgtggctacttttaggaacaccagtctatttttactgagagctggacaacagcaaacacttgacaaataaacttatttaccagta

SEQ ID NO: 199562 - DNA, 775 bp, Homo sapiens
  Payload ID: 19369
  Gene Name: WAP four-disulfide core domain 12
  Uniprot ID: Q8WWY7
  ENST ID: ENST00000372785
  CDS Start-End: 19-354
aagcacctgcctggcaacatggggtccagcagcttcttggtcctcatggtgtctctcgttcttgtgaccctggtggctgtggaaggagttaaagagggtatagagaaagcaggggtttgcccagctgacaacgtacgctgcttcaagtccgatcctccccagtgtcacacagaccaggactgtctgggggaaaggaagtgttgttacctgcactgtggcttcaagtgtgtgattcctgtgaaggaactggaagaaggaggaaacaaggatgaagatgtgtcaaggccataccctgagccaggatgggaggccaagtgtccaggctcctcctctaccaggtgtcctcagaaatgatgctgggtcctttctacctctgggggtcactctcacttggcacctgcccctgagggtcctgagacttggaatatggaagaagcaatacccaaccccaccaaagaaaacctgagcttgaagtccttttccccaaaaagagggaagagtcacaaaaagtccagaccccagggacggtactttccctctctacctggtgctcctccctaatgctcatgaatggacccctcatgaatgaaaccagtgcccttataagagaccccaaagagctgccttgcccttctgcaatgtgtgatcacagctagaaggcactgtcagagaagagaaactggtcctcaccagatgctgaatctgctggtgccttgatcttggacttcccagcctctagaactgtaagaaataaatatttgctgtttataatcca

SEQ ID NO: 199563 - DNA, 1372 bp, Homo sapiens
  Payload ID: 19370
  Gene Name: WAP four-disulfide core domain 13
  Uniprot ID: Q8IUB5
  ENST ID: ENST00000305479
  CDS Start-End: 109-390
cacactgggcctccactttgccctctttccttctcttctcctcacagcagtgcctggtcaaacccagcaacccttggccagaacttactcacccatcccactgacaccatgaagcctgtgctgcctctccagttcctggtggtgttctgcctagcactgcagctggtgcctgggagtcccaagcagcgtgttctgaagtatatcttggaacctccaccctgcatatcagcacctgaaaactgtactcacctgtgtacaatgcaggaagattgcgagaaaggatttcagtgctgttcctccttctgtgggatagtctgttcatcagaaacatttcaaaagcgcaacagaatcaaacacaagggctcagaagtcatcatgcctgccaactgaggcatatttcctagatcattttgcctctacgatgttttttcttggtccacctttaggaaggtattgagaagcaagaaactggaggcccaatatctaacctgcaaatcgtttttgagtttggcaataaaggctaatctaccataaaactcttgaagcttaagctttaggtcaacacttgcaagagccccttccaaagctcagcacagtttcctcctgggatgaggagaggaatcagaaaccccactttggcatagagacaagcagcactgttccagtccagggatgctgtgtgtgccctggtggtggtcttaaggacctaccacatcaacatctggacaaccctcactgattacctgcccttggttgcactcatcaggctaattgatcccatatttaacctcaaggagaaatatcaaccagacactgcatggcaacctccttggggccagccttcaaggcttcatggccatatcatgaacccaggacaggcacagtgggggtggtgaggacctgatagagttggatcagtgactaagaggctgcaataaggtgccatgaaatcaaaatcaaagggctagaactctccaaggtcttgcccccggcatgtagcaccacctgagccagaaactgcagaggacatgacagtgtggcattactgataagttatggaaatggaaataatctttcctaaactaccaataataactttaaatttttgatcaaccatgctagagcaaagattgaattatccttctgttctctctacagaaatgatataaaaactatagtcataagaagagacaatcaaaaataatcagccataaaatattaaaaaggtattataaaggtatttaaaataataataataaagtgttattttcctgggattcatgatatttgatatattcgtaagcttttgttaagtttgtaatttgttgcaatttctttttcatttcaaataaatattcacttacgtgtctaa

SEQ ID NO: 199564 - DNA, 356 bp, Homo sapiens
  Payload ID: 19371
  Gene Name: WAP four-disulfide core domain 2
  Uniprot ID: Q14508
  ENST ID: ENST00000217425
  CDS Start-End: 27-335
cctgcaccccgcccgggcatagcaccatgcctgcttgtcgcctaggcccgctagccgccgccctcctcctcagcctgctgctgttcggcttcaccctagtctcaggcacaggagcagagaagactggcgtgtgccccgagctccaggctgaccagaactgcacgcaagagtgcgtctcggacagcgaatgcgccgacaacctcaagtgctgcagcgcgggctgtgccaccttctgctctctgcccaatgcactgttccactggcacctaaagacacggaggctctgggagatttctggccctaggccacgaaggcccacttgggactcaagctgaggtcctgtgattccatttggg

SEQ ID NO: 199565 - DNA, 420 bp, Homo sapiens
  Payload ID: 19371
  Gene Name: WAP four-disulfide core domain 2
  Uniprot ID: Q14508
  ENST ID: ENST00000339946
  CDS Start-End: 27-257
cctgcaccccgcccgggcatagcaccatgcctgcttgtcgcctaggcccgctagccgccgccctcctcctcagcctgctgctgttcggcttcaccctagtctcagataaggagggttcctgcccccaggtgaacattaactttccccagctcggcctctgtcgggaccagtgccaggtggacagccagtgtcctggccagatgaaatgctgccgcaatggctgtgggaaggtgtcctgtgtcactcccaatttctgagctccagccaccaccaggctgagcagtgaggagagaaagtttctgcctggccctgcatctggttccagcccacctgccctcccctttttcgggactctgtattccctcttgggctgaccacagcttctccctttcccaaccaataaagtaaccactttcagca

SEQ ID NO: 199566 - DNA, 818 bp, Homo sapiens
  Payload ID: 19371
  Gene Name: WAP four-disulfide core domain 2
  Uniprot ID: Q14508
  ENST ID: ENST00000342873
  CDS Start-End: 434-655
agatccctccccttcttttaggattattgtgagaattagaagagttaatatatgttaggggcttgatacctggcatgtaataagagctaattaagtgttcactgttataatttctcataactacagagtagtttgatatttcagggagaaataatatatgtttgtttcccactgctttcacaacaaccctatgttgtaattagcactgttccactggcacctaaagacacggaggctctgggagatttctggccctaggccacgaaggcccacttgggactcaagctgaggtcctgtgattccatttgggagcaggaggagggatttgcaggtgatcttcctgggcctcctgagagcagctcaggtgcccaagatggactcaggcaggcagctctgctgtatgtgaagcccagtgaggggcagtgggggggccatgctgcaggtacaagttaatctccctgtatcgcctctgcccacttacccttactcctttttctacccagataaggagggttcctgcccccaggtgaacattaactttccccagctcggcctctgtcgggaccagtgccaggtggacagccagtgtcctggccagatgaaatgctgccgcaatggctgtgggaaggtgtcctgtgtcactcccaatttctgagctccagccaccaccaggctgagcagtgaggagagaaagtttctgcctggccctgcatctggttccagcccacctgccctcccctttttcgggactctgtattccctcttgggctgaccacagcttctccctttcccaaccaataaagtaaccactttcagca

SEQ ID NO: 199567 - DNA, 614 bp, Homo sapiens
  Payload ID: 19371
  Gene Name: WAP four-disulfide core domain 2
  Uniprot ID: Q14508
  ENST ID: ENST00000372676
  CDS Start-End: 77-451
ccccctcccgcgcgcgcggttaaatccccgcacctgagcatcggctcacacctgcaccccgcccgggcatagcaccatgcctgcttgtcgcctaggcccgctagccgccgccctcctcctcagcctgctgctgttcggcttcaccctagtctcaggcacaggagcagagaagactggcgtgtgccccgagctccaggctgaccagaactgcacgcaagagtgcgtctcggacagcgaatgcgccgacaacctcaagtgctgcagcgcgggctgtgccaccttctgctctctgcccaatgataaggagggttcctgcccccaggtgaacattaactttccccagctcggcctctgtcgggaccagtgccaggtggacagccagtgtcctggccagatgaaatgctgccgcaatggctgtgggaaggtgtcctgtgtcactcccaatttctgagctccagccaccaccaggctgagcagtgaggagagaaagtttctgcctggccctgcatctggttccagcccacctgccctcccctttttcgggactctgtattccctcttgggctgaccacagcttctccctttcccaaccaataaagtaaccactttcagca

SEQ ID NO: 199568 - DNA, 692 bp, Homo sapiens
  Payload ID: 19371
  Gene Name: WAP four-disulfide core domain 2
  ENST ID: ENST00000447118
  CDS Start-End: 27-266
cctgcaccccgcccgggcatagcaccatgcctgcttgtcgcctaggcccgctagccgccgccctcctcctcagcctgctgctgttcggcttcaccctagtctcaggcacaggagcagagaagactggcgtgtgccccgagctccaggctgaccagaactgcacgcaagagtgcgtctcggacagcgaatgcgccgacaacctcaagtgctgcagcgcgggctgtgccaccttctgctctctgcccaatggccaactggctgagtgattcgaagaaagtgaggaatcctccctggacactgtatcgcccttcgtcgtctttcagtcaatctcttccactctaaggattgagtgagcgcgagctggggactctctcaaagataaggagggttcctgcccccaggtgaacattaactttccccagctcggcctctgtcgggaccagtgccaggtggacagccagtgtcctggccagatgaaatgctgccgcaatggctgtgggaaggtgtcctgtgtcactcccaatttctgagctccagccaccaccaggctgagcagtgaggagagaaagtttctgcctggccctgcatctggttccagcccacctgccctcccctttttcgggactctgtattccctcttgggctgaccacagcttctccctttcccaaccaataaagtaaccactttcagc

SEQ ID NO: 199569 - DNA, 1000 bp, Homo sapiens
  Payload ID: 19372
  Gene Name: WAP four-disulfide core domain 3
  Uniprot ID: Q8IUB2
  ENST ID: ENST00000243938
  CDS Start-End: 85-780
gcgacgctggagctgcggggttaccatgggaaccgaaccgccgcgcctcgcccaggacagttacacttagaggccttcatcatcatgatgttaagctgcctctttcttctgaaggcacttcttgctcttgggtctctggaatcctggataactgcaggagaacatgcaaaagagggagaatgccctccccataagaacccatgcaaagagctgtgccagggtgatgaattgtgtccggctgaacagaagtgctgcaccacaggctgtggtcggatctgccgagacattcctaaggggaggaaaagagattgccctagggttattcggaaacaatcctgtttgaaaaggtgcatcactgatgagacatgtccaggtgtaaagaaatgctgcacgcttggctgcaacaagagctgtgtagtcccaatctctaaacagaagctggcagagtttggtggtgaatgtcccgctgacccccttccgtgtgaggagctgtgtgatggggatgcatcctgtccccaggggcataaatgctgcagcaccggctgtggccgcacctgcctcggagacattgagggagggcggggcggtgattgtccaaaagttctggtgggcctgtgcattgttggctgtgtgatggatgagaattgtcaagctggagaaaaatgttgcaagtcaggctgtggccgcttctgtgtcccaccagtcctgcccccaaaactgaccatgaaccccaactggactgtgaggtctgattccgaattagagatcccggtgccctagctgtgctgatttgtctggagcttctttggtaattctggaagcttttcctggcagtcaagagagggtgacatcctggggcttgtgacatttccaggggcactcatggccctctctgctctgcttctcctcctgccgctgaccagagcatgggaaatagccctggattgggtagtgggtgtgtggtgcttctctttcccgataaaggctggtgctgacctct

SEQ ID NO: 199570 - DNA, 897 bp, Homo sapiens
  Payload ID: 19372
  Gene Name: WAP four-disulfide core domain 3
  ENST ID: ENST00000337205
  CDS Start-End: 1-677
aaataaaggaggcacttcttgctcttgggtctctggaatcctggataactgcaggagaacatgcaaaagagggagaatgccctccccataagaacccatgcaaagagctgtgccagggtgatgaattgtgtccggctgaacagaagtgctgcaccacaggctgtggtcggatctgccgagacattcctaaggggaggaaaagagattgccctagggttattcggaaacaatcctgtttgaaaaggtgcatcactgatgagacatgtccaggtgtaaagaaatgctgcacgcttggctgcaacaagagctgtgtagtcccaatctctaaacagaagctggcagagtttggtggtgaatgtcccgctgacccccttccgtgtgaggagctgtgtgatggggatgcatcctgtccccaggggcataaatgctgcagcaccggctgtggccgcacctgcctcggagacattgagggagggcggggcggtgattgtccaaaagttctggtgggcctgtgcattgttggctgtgtgatggatgagaattgtcaagctggagaaaaatgttgcaagtcaggctgtggccgcttctgtgtcccaccagtcctgcccccaaaactgaccatgaaccccaactggactgtgaggtctgattccgaattagagatcccggtgccctagctgtgctgatttgtctggagcttctttggtaattctggaagcttttcctggcagtcaagagagggtgacatcctggggcttgtgacatttccaggggcactcatggccctctctgctctgcttctcctcctgccgctgaccagagcatgggaaatagccctggattgggtagtgggtgtgtggtgcttctctttcccgataaaggctggtgctgacctct

SEQ ID NO: 199571 - DNA, 597 bp, Homo sapiens
  Payload ID: 19372
  Gene Name: WAP four-disulfide core domain 3
  ENST ID: ENST00000372630
  CDS Start-End: 98-382
ggccatccctagtcctgctcatacctcagctgatactctgggcaaggtgtacacctctagcctgaactgagctcttgtcccaactctcagcatcatcatgatgttaagctgcctctttcttctgaaggcacttcttgctcttgggtctctggaatcctggataactgcaggagaacatgggcggggcggtgattgtccaaaagttctggtgggcctgtgcattgttggctgtgtgatggatgagaattgtcaagctggagaaaaatgttgcaagtcaggctgtggccgcttctgtgtcccaccagtcctgcccccaaaactgaccatgaaccccaactggactgtgaggtctgattccgaattagagatcccggtgccctagctgtgctgatttgtctggagcttctttggtaattctggaagcttttcctggcagtcaagagagggtgacatcctggggcttgtgacatttccaggggcactcatggccctctctgctctgcttctcctcctgccgctgaccagagcatgggaaatagccctggattgggtagtgggtgtgtggtgcttctctttcccgataaaggctggtgctga

SEQ ID NO: 199572 - DNA, 704 bp, Homo sapiens
  Payload ID: 19372
  Gene Name: WAP four-disulfide core domain 3
  ENST ID: ENST00000372632
  CDS Start-End: 76-489
acctcagctgatactctgggcaaggtgtacacctctagcctgaactgagctcttgtcccaactctcagcatcatcatgatgttaagctgcctctttcttctgaaggcacttcttgctcttgggtctctggaatcctggataactgcaggagaacatgcaaaagagggagaatgccctccccataagaacccatgcaaagagctgtgccagggtgatgaattgtgtccggctgaacagaagtgctgcaccacaggctgtggtcggatctgccgagacattcctaaggggcggggcggtgattgtccaaaagttctggtgggcctgtgcattgttggctgtgtgatggatgagaattgtcaagctggagaaaaatgttgcaagtcaggctgtggccgcttctgtgtcccaccagtcctgcccccaaaactgaccatgaaccccaactggactgtgaggtctgattccgaattagagatcccggtgccctagctgtgctgatttgtctggagcttctttggtaattctggaagcttttcctggcagtcaagagagggtgacatcctggggcttgtgacatttccaggggcactcatggccctctctgctctgcttctcctcctgccgctgaccagagcatgggaaatagccctggattgggtagtgggtgtgtggtgcttctctttcccgataaaggctggtgctga

SEQ ID NO: 199573 - DNA, 1034 bp, Homo sapiens
  Payload ID: 19373
  Gene Name: WAP four-disulfide core domain 5
  Uniprot ID: Q8TCV5
  ENST ID: ENST00000307971
  CDS Start-End: 80-754
ctgactaagtttctctggcttccctgaggctgcaggtgttaatctggggggccctgggccctgagccggcagcagaaatatgaggacccagagccttctcctcctgggggccctcctggctgtggggagtcagctgcctgctgtctttggcaggaagaagggagagaaatcggggggctgcccgccagatgatgggccctgcctcctatcggtgcctgaccagtgcgtggaagacagccagtgtcccttgaccaggaagtgctgctacagagcttgcttccgccagtgtgtccccagggtctctgtgaagctgggcagctgcccagaggaccaactgcgctgcctcagccccatgaaccacctgtgtcacaaggactcagactgctcgggcaaaaagcgatgctgccacagcgcctgcgggcgggattgccgggatcctgccagaggtacggctcctgggtgcccagggcaggctaattctgatttaggatctgtggctctgcacctaagctggggaccaacggaaagagttcacgatgggaggcctggggccctgcccgctggacagcactatctctaccagcggtggttccagccttctgataatcactggcctgctgacacttccctgcaacccatccacccctggtttctcctcctgggagtcaaagtccatagcctgagctcggaggaaggcctctgtatcaccccagtactctgcaccactgccatacgagcttcccacccttcctaacgctttcacaccaatccgtacatgctgcttcctccaccaaaaatgcccaattcaggcagaccctgacctctccctcaggcagcccaaccatccagaatgaatattcttgcagagttttccaaacatcagtcattcacctctttcatgattttcaccatacctacaaaatagcaccatgataggttgcacgctgcctgtaccaccatttacttaatgttttctttaaatggctcacttttgtatataaataaattcatttcaaaagaaaattgatatcact

SEQ ID NO: 199574 - DNA, 1018 bp, Homo sapiens
  Payload ID: 19373
  Gene Name: WAP four-disulfide core domain 5
  Uniprot ID: Q8TCV5
  ENST ID: ENST00000372789
  CDS Start-End: 90-461
ctttcctctcctgactaagtttctctggcttccctgaggctgcaggtgttaatctggggggccctgggccctgagccggcagcagaaatatgaggacccagagccttctcctcctgggggccctcctggctgtggggagtcagctgcctgctgtctttggcaggaagaagggagagaaatcggggggctgcccgccagatgatgggccctgcctcctatcggtgcctgaccagtgcgtggaagacagccagtgtcccttgaccaggaagtgctgctacagagcttgcttccgccagtgtgtccccagggtctctgtgaagctgggcagctgcccagaggaccaactgcgctgcctcagccccatgaaccacctgtgtcacaaggactcagactgctcgggcaaaaagcgatgctgccacagcgcctgcgggcgggattgccgggatcctgccagaggctaattctgatttaggatctgtggctctgcacctaagctggggaccaacggaaagagttcacgatgggaggcctggggccctgcccgctggacagcactatctctaccagcggtggttccagccttctgataatcactggcctgctgacacttccctgcaacccatccacccctggtttctcctcctgggagtcaaagtccatagcctgagctcggaggaaggcctctgtatcaccccagtactctgcaccactgccatacgagcttcccacccttcctaacgctttcacaccaatccgtacatgctgcttcctccaccaaaaatgcccaattcaggcagaccctgacctctccctcaggcagcccaaccatccagaatgaatattcttgcagagttttccaaacatcagtcattcacctctttcatgattttcaccatacctacaaaatagcaccatgataggttgcacgctgcctgtaccaccatttacttaatgttttctttaaatggctcacttttgtatataaataaattcatttcaaaagaaaattgatatcact

SEQ ID NO: 199575 - DNA, 394 bp, Homo sapiens
  Payload ID: 19374
  Gene Name: WAP four-disulfide core domain 6
  Uniprot ID: Q9BQY6
  ENST ID: ENST00000372665
  CDS Start-End: 1-394
atgggactctcaggacttctgccaatcctggtaccattcatccttttgggggacatccaggaacctgggcacgctgaaggcatccttggcaagccgtgtcccaaaatcaaagtggaatgcgaagtggaagaaatagaccagtgtaccaaacccagagattgcccagaaaacatgaagtgttgcccgttcagccgtggaaagaaatgtttagacttcagaaagatatatgcagtatgccacaggaggctggcccctgcctggcctccataccacactggtggtacaataaaaaaaactaagatctgctccgaattcatctatggcggtagccaggggaacaataacaacttccaaactgaagctatctgtctggtcacctgcaaaaaataccata

SEQ ID NO: 199576 - DNA, 620 bp, Homo sapiens
  Payload ID: 19374
  Gene Name: WAP four-disulfide core domain 6
  Uniprot ID: Q9BQY6
  ENST ID: ENST00000372670
  CDS Start-End: 89-349
acaccggggcaggcaaagtgcagatgtaggagctgctgaggagcagttcttagttttggtgccatcaaccaggccagtacttcctaaaatgggactctcaggacttctgccaatcctggtaccattcatccttttgggggacatccaggaacctgggcacgctgaaggcatccttggcaagccgtgtcccaaaatcaaagtggaatgcgaagtggaagaaatagaccagtgtaccaaacccagagattgcccagaaaacatgaagtgttgcccgttcagccgtggaaagaaatgtttagacttcagaaaggtcagccttactttataccataaggaggagcttgaataacctccaggatttggctcataatccaggcctctctccacgtgtgcctgattgatgctccaaattggcttccacgggccaaaccttggctgttccagaaactgaaccccaggaattgcttacacactttcttccagcgtagcatctcttcaaacacaatgctcttccccttgaccacttctcagtatgaaactctatgtcttcaactttcagaccccccatttatttgtatgaaggcttcagttgccttaataaagtgctctgtggggtccga

SEQ ID NO: 199577 - DNA, 1069 bp, Homo sapiens
  Payload ID: 19375
  Gene Name: WAP four-disulfide core domain 8
  Uniprot ID: Q8IUA0
  ENST ID: ENST00000289953
  CDS Start-End: 80-805
ccaggcaggggagcagatgagggaggagccttagagctggagcaaagtgaggaagctgtctccatagggaagaggcctgatgtggactgtccgaactgaaggagggcactttcctctccatagccccaccttctcctggaggaatgtagctttcctgctgcttctctcccttgctttggagtggacttctgcaatgctgaccaagaagatcaaacacaaaccagggttatgtcccaaagagaggctcacctgtaccactgaacttccggactcatgtaacacagattttgactgcaaggaataccagaagtgctgcttttttgcctgtcagaagaagtgcatggatccctttcaagaaccctgcatgctacctgtgaggcatggaaactgtaatcatgaggcacagcgctggcattttgactttaaaaattaccgctgcacacccttcaaatacaggggctgcgaagggaatgccaacaacttcttaaatgaggatgcctgcagaacggcctgcatgttaattgttaaggatggacaatgcccactcttccctttcactgaacgtaaggagtgtccaccttcatgtcacagtgacatcgattgtccccagacagacaaatgttgtgaatccaggtgtggctttgtttgtgccagggcctggacagtcaaaaaaggtttctgcccacgcaagcccttgctatgtaccaagattgataaacccaagtgcctgcaggatgaggagtgcccattggtggaaaagtgctgctcacattgtggactgaaatgtatggaccccagacgttgaatagtaagtagaaaatattatcatcaaaatcattaattatgagtagcatgataaagagctgtcagttttgtcttgtatccaacttgccaaattatcttaagtatcacaatattgaatgatgttactttgattttatatataatcccatcatctgaaagtgatgatatatttggctttttttcaacttcatgactttattttcttgtcttcttgtattgtgtagaacctccaaaataataatgaaaataaaggcaatggcatcca

SEQ ID NO: 199578 - DNA, 1268 bp, Homo sapiens
  Payload ID: 19375
  Gene Name: WAP four-disulfide core domain 8
  Uniprot ID: Q8IUA0
  ENST ID: ENST00000357199
  CDS Start-End: 80-805
ccaggcaggggagcagatgagggaggagccttagagctggagcaaagtgaggaagctgtctccatagggaagaggcctgatgtggactgtccgaactgaaggagggcactttcctctccatagccccaccttctcctggaggaatgtagctttcctgctgcttctctcccttgctttggagtggacttctgcaatgctgaccaagaagatcaaacacaaaccagggttatgtcccaaagagaggctcacctgtaccactgaacttccggactcatgtaacacagattttgactgcaaggaataccagaagtgctgcttttttgcctgtcagaagaagtgcatggatccctttcaagaaccctgcatgctacctgtgaggcatggaaactgtaatcatgaggcacagcgctggcattttgactttaaaaattaccgctgcacacccttcaaatacaggggctgcgaagggaatgccaacaacttcttaaatgaggatgcctgcagaacggcctgcatgttaattgttaaggatggacaatgcccactcttccctttcactgaacgtaaggagtgtccaccttcatgtcacagtgacatcgattgtccccagacagacaaatgttgtgaatccaggtgtggctttgtttgtgccagggcctggacagtcaaaaaaggtttctgcccacgcaagcccttgctatgtaccaagattgataaacccaagtgcctgcaggatgaggagtgcccattggtggaaaagtgctgctcacattgtggactgaaatgtatggaccccagacgttgaataacggagttttgctcttattgcccaggcgcaatctcggctcactgcaacctctgcttcccgggttcaagtgattctcctgcctcagcctcccaagtagctgggattacaggtgcccaccatcatgcccagctaattttttgtatttttagtagagatggggttttaccatgttggccaagctggtcacaaactcctgacctcaggtgatccacccacctcagcctccgaaagtgctgggatcacaggtgggagccactgtgcctggccagttatttcctttttaagcctatttcctatccatttatagctactactgaaaatgactactgaattttatcaaataccttttaagcatacagtcacataatgatttttctcttctaatttgttggcataataaattactaaattttcttgagccatccttgcattcttaataaacttaattgcagactgctgt

SEQ ID NO: 199579 - DNA, 659 bp, Homo sapiens
  Payload ID: 19376
  Gene Name: WAP four-disulfide core domain 9
  Uniprot ID: Q8NEX5
  ENST ID: ENST00000326000
  CDS Start-End: 219-488
acaagtggggcatctgtaggggccacagtgagctctcaatgatcatctgtagtggcagcaaaagagttcgagccccacttcaaacaacttcataataaaaggccagacaaaagagctgtcagccagttactacagacactcaatgcagacaccttcagagtattgggaaaagacttgccttctgccagaacttaacccaaatacacacagagagcaccatgaagccctggattcttctactcgtcatgttcatctctggagttgtgatgcttctgcctgtgctgggaagcttctggaacaaagatccctttctagatatgataagagaaactgagcagtgctgggtacagcctccatataagtactgtgagaaaaggtgtactaaaataatgacttgtgtacgtccaaatcatacatgctgctggacctactgtggaaacatctgcttagacaacgaagagccccttaaatcaatgctaaacccctagattctattggccgatcactactgtgggctgaaggatgaccatctggtctaagaagagtgctgcctacttccttcttgggacacccactggctctagctggtaacctttctgctatttccttgacctctttaccctgaagcttttgtcaaataaactgctacatcaacctga

SEQ ID NO: 199580 - DNA, 2028 bp, Homo sapiens
  Payload ID: 19377
  Gene Name: WAP, follistatin/kazal, immunoglobulin, kunitz and netrin domain containing 1
  Uniprot ID: Q96NZ8
  ENST ID: ENST00000319070
  CDS Start-End: 323-1969
cctcctcccctctgccctgtgctgaccagggcctgggagcccccgcacggttcagacagaggggccaggctgaagctggagaggaaccagcgtcacacagacggcctctgagaacttggagaccccgttacccacccagcaggggtgtcaggacaagcatctgctgcaggcttcagcctcaggggcaaaagggagccccggggtcctggtgggggcaccgaccacaggcccggagggtggatgcctgcaggaagctgggctctgtggagcccgaggaggggctggtggccacaccccccggccccctggctcggcggccctcatgcccgccctacgtccactcctgccgctcctgctcctcctccggctgacctcgggggctggcttgctgccagggctggggagccacccgggcgtgtgccccaaccagctcagccccaacctgtgggtggacgcccagagcacctgtgagcgcgagtgtagcagggaccaggactgtgcggctgctgagaagtgctgcatcaacgtgtgtggactgcacagctgcgtggcagcacgcttccccggcagcccagctgcgccgacgacagcggcctcctgcgagggctttgtgtgcccacagcagggctcggactgcgacatctgggacgggcagcccgtgtgccgctgccgcgaccgctgtgagaaggagcccagcttcacctgcgcctcggacggcctcacctactacaaccgctgctatatggacgccgaggcctgcctgcggggcctgcacctccacatcgtgccctgcaagcacgtgctcagctggccgcccagcagcccggggccgccggagaccactgcccgccccacacctggggccgcgcccgtgcctcctgccctgtacagcagcccctccccacaggcggtgcaggttgggggtacggccagcctccactgcgacgtcagcggccgcccgccgcctgctgtgacctgggagaagcagagtcaccagcgagagaacctgatcatgcgccctgatcagatgtatggcaacgtggtggtcaccagcatcgggcagctggtgctctacaacgcgcggcccgaagacgccggcctgtacacctgcaccgcgcgcaacgctgctgggctgctgcgggctgacttcccactctctgtggtccagcgagagccggccagggacgcagcccccagcatcccagccccggccgagtgcctgccggatgtgcaggcctgcacgggccccacttccccacaccttgtcctctggcactacgacccgcagcggggcggctgcatgaccttcccggcccgtggctgtgatggggcggcccgcggctttgagacctacgaggcatgccagcaggcctgtgcccgcggccccggcgacgcctgcgtgctgcctgccgtgcagggcccctgccggggctgggagccgcgctgggcctacagcccgctgctgcagcagtgccatcccttcgtgtacggtggctgcgagggcaacggcaacaacttccacagccgcgagagctgcgaggatgcctgccccgtgccgcgcacaccgccctgccgcgcctgccgcctccggagcaagctggcgctgagcctgtgccgcagcgacttcgccatcgtggggcggctcacggaggtgctggaggagcccgaggccgccggcggcatcgcccgcgtggcgctcgaggacgtgctcaaggatgacaagatgggcctcaagttcttgggcaccaagtacctggaggtgacgctgagtggcatggactgggcctgcccctgccccaacatgacggcgggcgacgggccgctggtcatcatgggtgaggtgcgcgatggcgtggccgtgctggacgccggcagctacgtccgcgccgccagcgagaagcgcgtcaagaagatcttggagctgctggagaagcaggcctgcgagctgctcaaccgcttccaggactagcccccgcaggggcctgcgccaccccgtcctggtgaataaacgcactccctgtgcctcag

SEQ ID NO: 199581 - DNA, 3588 bp, Homo sapiens
  Payload ID: 19378
  Gene Name: WAP, follistatin/kazal, immunoglobulin, kunitz and netrin domain containing 2
  Uniprot ID: Q8TEU8
  ENST ID: ENST00000311378
  CDS Start-End: 529-2259
tggagccagctccccgcaaagcacatgccatttctggcccttgaaggggttaaaggcctcctggagtcaaaaacaagcaggtgtcccaccgtgccagatacgctgcctaaactgcttccagcttctttttttttttttccccccttctgcaataagtctgtgatcagccacgggacagaggcgccagcagcctgcctgtgacaggcatcaggttagctggctcccactcgggtggcgcgcccaggatataaatccgggcgcgggcccctgctgtggctcctctccctgcacactcaggagagggagcttccttctaaagacctttcttttatctgaagccgcacagcccggcaggctgtgctgacttggtggaggcagcagcggcagagcagcctgagcagcagcctgagcaggaaacctgctggggtggggagggcaggtgtctgcagcccctgagaagaaggccctggtgggccccagaccctggcatcgtttcaggggaggtctctagccgccccagcctgcaccatgtgggccccaaggtgtcgccggttctggtctcgctgggagcaggtggcagcgctgctgctgctgctgctactgctcggggtgcccccgcgaagcctggcgctgccgcccatccgctattcccacgccggcatctgccccaacgacatgaatcccaacctctgggtggacgcacagagcacctgcaggcgggagtgtgagacggaccaggagtgtgagacctatgagaagtgctgccccaacgtatgtgggaccaagagctgcgtggcggcccgctacatggacgtgaaagggaagaagggcccagtgggcatgcccaaggaggccacatgtgaccacttcatgtgtctgcagcagggctctgagtgtgacatctgggatggccagcccgtgtgtaagtgcaaagaccgctgtgagaaggagcccagctttacctgcgcctcggacggcctcacctactataaccgctgctacatggatgccgaggcctgctccaaaggcatcacactggccgttgtaacctgccgctatcacttcacctggcccaacaccagccccccaccacctgagaccaccatgcaccccaccacagcctccccagagacccctgagctggacatggcggcccctgcgctgctcaacaaccctgtgcaccagtcggtcaccatgggtgagacagtgagcttcctctgtgatgtggtgggccggccccggcctgagatcacctgggagaagcagttggaggatcgggagaatgtggtcatgcggcccaaccatgtgcgtggcaacgtggtggtcaccaacattgcccagctggtcatctataacgcccagctgcaggatgctgggatctacacctgcacggcccggaacgtggctggggtcctgagggctgatttcccgctgtcggtggtcaggggtcatcaggctgcagccacctcagagagcagccccaatggcacggctttcccggcggccgagtgcctgaagcccccagacagtgaggactgtggcgaagagcagacccgctggcacttcgatgcccaggccaacaactgcctgaccttcaccttcggccactgccaccgtaacctcaaccactttgagacctatgaggcctgcatgctggcctgcatgagcgggccgctggccgcgtgcagcctgcccgccctgcaggggccctgcaaagcctacgcgcctcgctgggcttacaacagccagacgggccagtgccagtcctttgtctatggtggctgcgagggcaatggcaacaactttgagagccgtgaggcctgtgaggagtcgtgccccttccccagggggaaccagcgctgtcgggcctgcaagcctcggcagaagctcgttaccagcttctgtcgcagcgactttgtcatcctgggccgagtctctgagctgaccgaggagcctgactcgggccgcgccctggtgactgtggatgaggtcctaaaggatgagaaaatgggcctcaagttcctgggccaggagccattggaggtcactctgcttcacgtggactgggcatgcccctgccccaacgtgaccgtgagcgagatgccgctcatcatcatgggggaggtggacggcggcatggccatgctgcgccccgatagctttgtgggcgcatcgagtgcccgccgggtcaggaagcttcgtgaggtcatgcacaagaagacctgtgacgtcctcaaggagtttcttggcttgcactgaagccccccacccctccctgccccctccctggccttcttccacctatccaccccaatgcctctcagcaaactgggcgaggtcagattagacaggcttgggacagcagggaaacatcaaccgacgtgtcacagaaaaagccacagaaggtctcagatcagcatctattctttgggttcaataaggggttcatatcttttttagctgagggggacaagaggagaagtcagtggacacatggaagttactcgtgaccaccagcttgctcagatattctcctcctcccctcactggccccacacccctggctctcccagtcaccctcccctagccagtctcccagcaagggtttaagagatggccgctgtgtgctggtcacaggaagtgttgaatggattggcttgcaaagggggtaggtggggagagataggagggcccagggactcatgggacacctttcccacagcctcctcgattgctgtgagcagaggccactcggagttaggggcatgggcaatagcaagctggcggcagagtccagcccagcatatgacttgccctgaatggaagctgctgaaacgggtgcctttgggtggtggtcggcttgcctctgaggccaccacggcaccagcagaatacgtatttcttctccttggctgcactggtttgtcgatctagttcagttcaactcagtggatgttctctgaatgcttactgggtgccaggaccacagagagatgttagtcactgcccagttcttagagccccaacacagataccctcatcccagggcccccagacacacccctccgctggactcacaactgtctggagtttctgtctgatggatggtgtgctttcatatgccactggcttccttggacatagatcagacaaaagccccgggatctgtttggtagcaggagaaatgaaggaagatgaaaaagcaggcagggaagggggtagtaaaggactgagagaggagggaggtggctggagaaggaaaaggaacattgctcgatgctcccatctggtggcggcctcaggaacccacgggaacctggaaggaggctctttgtgagacctgggcaaaggatggggcagctcgtcgatgatttttttgtgtttccaggcttcctgtgtgatcctggccctccggccgctagagagaggattgggaaaccccactgtcagctctgcatctgcccccactaccctcctctgccctattctgtccctgcccctccaagctgaagaaggtccttgtggggcgtcctcatttcttcctcaaatataaggaggaagataccaattaaaagctcatagtatcaa

SEQ ID NO: 199582 - DNA, 2193 bp, Homo sapiens
  Payload ID: 19378
  Gene Name: WAP, follistatin/kazal, immunoglobulin, kunitz and netrin domain containing 2
  ENST ID: ENST00000426127
  CDS Start-End: 453-1904
gtgcgtcctttcctccgatctgaaatggaggtgcagtttgttgtgaggattaaatgagatgatgcgttcagagaagccacacgtgtgaagagcccagtgcatctggcagctggtaccaccaggactgctcactctgtgcgaccttggacaagtcgctcgccctcttcgaccacagaccttctcctttgggaagtgggggaggccagacaaggctggcagtcagaaggagctcactgaagagcagccactgtggtcgtcagcgagggcagctggactccggcacaatcctgagacactgtgaccgcggaggttttctcggtgtgtcgatggaagagggaggaatgtgatccgtcccagccgccggcggggccagagcatatctggagtgtgagacctatgagaagtgctgccccaacgtatgtgggaccaagagctgcgtggcggcccgctacatggacgtgaaagggaagaagggcccagtgggcatgcccaaggaggccacatgtgaccacttcatgtgtctgcagcagggctctgagtgtgacatctgggatggccagcccgtgtgtaagtgcaaagaccgctgtgagaaggagcccagctttacctgcgcctcggacggcctcacctactataaccgctgctacatggatgccgaggcctgctccaaaggcatcacactggccgttgtaacctgccgctatcacttcacctggcccaacaccagccccccaccacctgagaccaccatgcaccccaccacagcctccccagagacccctgagctggacatggcggcccctgcgctgctcaacaaccctgtgcaccagtcggtcaccatgggtgagacagtgagcttcctctgtgatgtggtgggccggccccggcctgagatcacctgggagaagcagttggaggatcgggagaatgtggtcatgcggcccaaccatgtgcgtggcaacgtggtggtcaccaacattgcccagctggtcatctataacgcccagctgcaggatgctgggatctacacctgcacggcccggaacgtggctggggtcctgagggctgatttcccgctgtcggtggtcaggggtcatcaggctgcagccacctcagagagcagccccaatggcacggctttcccggcggccgagtgcctgaagcccccagacagtgaggactgtggcgaagagcagacccgctggcacttcgatgcccaggccaacaactgcctgaccttcaccttcggccactgccaccgtaacctcaaccactttgagacctatgaggcctgcatgctggcctgcatgagcgggccgctggccgcgtgcagcctgcccgccctgcaggggccctgcaaagcctacgcgcctcgctgggcttacaacagccagacgggccagtgccagtcctttgtctatggtggctgcgagggcaatggcaacaactttgagagccgtgaggcctgtgaggagtcgtgccccttccccagggggaaccagcgctgtcgggcctgcaagcctcggcagaagctcgttaccagcttctgtcgcagcgactttgtcatcctgggccgagtctctgagctgaccgaggagcctgactcgggccgcgccctggtgactgtggatgaggtcctaaaggatgagaaaatgggcctcaagttcctgggccaggagccattggaggtcactctgcttcacgtggactgggcatgcccctgccccaacgtgaccgtgagcgagatgccgctcatcatcatgggggaggtggacggcggcatggccatgctgcgccccgatagctttgtgggcgcatcgagtgcccgccgggtcaggaagcttcgtgaggtcatgcacaagaagacctgtgacgtcctcaaggagtttcttggcttgcactgaagccccccacccctccctgccccctccctggccttcttccacctatccaccccaatgcctctcagcaaactgggcgaggtcagattagacaggcttgggacagcagggaaacatcaaccgacgtgtcacagaaaaagccacagaaggtctcagatcagcatctattctttgggttcaataaggggttcatatcttttttagctgagggggacaagaggagaagtcagtggacacatggaagttactcgtgaccaccagcttgctcagatattctcctcctcccctcact

SEQ ID NO: 199583 - DNA, 5987 bp, Homo sapiens
  Payload ID: 19379
  Gene Name: WAPL cohesin release factor
  ENST ID: ENST00000263070
  CDS Start-End: 2493-3701
ggaaggaggtgggggccgggagcgcaaatggcgttgagatggttcagggccctgttcaaactccagcactgaccattcaccggcggaagcggcgccgctcctgcccccccaaccgggcttcctatttaccgaaagcagagtccctcgcctctctcggctctcacctgccggccctgctctcccgcgcgagggttccgcgcccgcccgcgggccgtagggagcgggagaggcggaggcggcccgtggccaaagcacccgccaggctccgaggagaatatgaaactggtgtcaaaatgacatccagatttgggaaaacatacagtaggaaaggtggaaatggcagttcaaaattcgatgaagtcttttccaacaaacggactacccttagcacaaaatggggagagaccacatttatggctaaattagggcagaagaggcccaatttcaaaccagatatccaagaaattccgaagaaacctaaagtggaagaagaaagtactggagatccttttggatttgatagtgatgatgagtctctaccagtttcttcaaagaatttagcccaggttaagtgttcctcttattcagaatctagtgaagctgctcagttggaagaggtcacttcagtacttgaagctaatagcaaaattagtcatgtggtcgttgaagacactgtcgtttctgataaatgcttccctttggaggacactttacttgggaaagaaaagagcacaaaccgaattgtagaagatgatgcaagcataagtagctgtaataaattaataacttcagataaagtggagaattttcatgaagaacatgaaaagaatagtcaccatattcacaaaaatgctgatgacagtactaagaaacccaatgcagaaactacagtggcttctgaaatcaaggaaacaaatgatacttggaactcccagtttgggaaaaggccagaatcaccatcagaaatatctccaatcaagggatctgttagaactggtttgtttgaatgggataatgattttgaagatatcagatcagaagactgtattttaagtttggatagtgatccccttttggagatgaaggatgacgattttaaaaatcgattggaaaatctgaatgaagccattgaggaagatattgtacaaagtgttcttaggccaaccaactgtaggacgtactgtagggccaataaaacgaaatcctcccaaggagcatcaaattttgataagctgatggacggcaccagtcaggccttagccaaagcaaacagtgaatcgagtaaagatggcctgaatcaggcaaagaaagggggtgtaagttgtgggaccagttttagagggacagttggacggactagagattacactgttttacatccatcttgcttgtcagtttgtaatgttaccatacaggatactatggaacgcagcatggatgagttcactgcatccactcctgcagatttgggagaagctggtcgtctcagaaaaaaggcagatattgcaacttctaagactactactagatttcgacctagtaatactaaatccaaaaaggatgttaaacttgaattttttggttttgaagatcatgagacaggaggtgatgaaggaggttctggaagttctaattacaaaattaagtattttggctttgatgatctcagtgaaagcgaagatgatgaagatgatgactgtcaagtagaaagaaagacaagcaaaaaaagaactaaaacagctccatcaccctccttgcagcctcccccagaaagcaatgataattcccaggacagtcagtctggtactaacaatgcagaaaacttggattttacagaggacttgcctggtgtgcctgaaagtgtgaagaagcccataaataaacaaggagataaatcaaaggaaaataccagaaagatttttagtggccccaaacggtcacccacaaaagctgtatataatgccagacattggaatcatccagattcagaagaactgcctgggccaccagtagtaaaacctcagagtgtcacagtgaggctgtcttcaaaggaaccaaatcaaaaagatgatggagtttttaaggctcctgcaccaccatccaaagtgataaaaactgtgacaatacctactcagccctaccaagatatagttactgcactgaaatgcagacgagaagacaaagaattatatactgttgttcagcacgtgaagcacttcaacgatgttgtagaatttggtgaaaatcaagagttcactgatgacattgagtacttgttaagtggcttaaagagcactcagcctctaaacacacgttgccttagtgttattagcttggctactaaatgtgccatgcccagttttcgaatgcacctgagagcacatgggatggtagcaatggtctttaaaaccttggatgattcccagcaccatcagaatctgtccctctgtacagctgccctcatgtatatactgagtagagatcgtttgaacatggatcttgatagagctagcttagatctaatgattcgacttttggaactggaacaagatgcttcatcagccaagctactgaatgaaaaagacatgaacaaaattaaagaaaaaatccgaaggctctgtgaaactgtacacaacaagcatcttgatctagaaaatataacgactgggcatttagctatggagacattattatcccttacttctaaacgagcaggagactggtttaaagaagaactccggcttttgggtggtctggatcatattgtagataaagtaaaagaatgtgtggatcatttaagtagagatgaggatgaagagaaactggtagcctcactatggggagcagagagatgtttacgagttttagaaagtgtaactgtgcataatcccgaaaatcaaagctacttgatagcatataaagattcccaacttattgtttcatcagctaaagcattacagcattgtgaagaactgattcagcagtacaaccgtgctgaggacagcatatgcttagctgacagtaagcctctgcctcaccagaatgtaactaaccatgtaggcaaagcagtggaggactgcatgagggccatcatcggggtgttgcttaatttaactaatgataatgagtggggcagcaccaaaacaggagagcaggacggtctcataggcacagcgctgaactgtgtgcttcaggttccaaagtacctacctcaggagcagagatttgatattcgagtgctgctattccttgagcgagagcgggcagcccagctagcagaaagtaaaacagatgagttgatcaaagatgctcccaccactcagcatgataagagtggagagtggcaagaaacaagtggagaaatacagtgggtgtcaactgaaaagactgatggtacagaagagaaacataagaaggaggaggaggatgaagaacttgacctcaataaagcccttcagcatgccggcaaacacatggaggattgcattgtggcctcctacacagcactacttcttgggtgtctctgccaggaaagtccaatcaatgtaaccactgtgcgggaatatctgccagaaggagacttttcaataatgacagagatgctcaaaaaatttttgagttttatgaatctcacttgtgctgttggaacaactggccagaaatctatctctagagtgattgaatatttggaacattgctagctgctttacctttgcttcaggtgctcggtaatgctggagctatccttagacaaagaaaagtcaagtcatgaaagaagtccttgaagatataccaagaacattcatcagtatcattcgtgtttggatttttaaggccacctgatttcttcgtcatgcattcggcatttgctaaatgacagttactacatcaatctgcaactatcaaaaatgaggggaaaaggttcaggctgttaacaattccatgcagtatttaaatacatttactttggcagagtttataccctccccttgttttcttgctttattctgggcaagtttgaaggggaaaatttgtgctgctgttagtgcaactgctgtgtatgttgagccactgttgtcatgccagccaggtgcaaaggcagcttagctactgaggtagcgaatgttctgaggacattctagacaacagcttagttcctttttcaggctcatttgcttttgcttttttgttgaatgattccaatcgtaaataaagcttttaataattttgtgaattttttggttgttgttccctgaactactgtctatatttaaaattagatggaatccaaagatacacgggattaatagtatatttttttattcttgattaggtttgggttattgaactattttttacttttgagaccacaaccatattcaatatcataccataatgtgtcatagctataggcacaagaaaaacaacagtttgagagaatattatataagatgatgtgccctgttaaaaggaggaggcaaaatagtcaaacccagggtagtttacacttaatgctagggaggctcttaaaacattattagattttgaggaaagactctctagatatattttctaatgttcagtacaataaatataaggaagctaaaacaccaatgtggaattcctgtttccagataacatgtatattcttctatagagtgacaggatcaattgcataagcgcaaagccttaaattgctggtttagagaagacccttttttcattcagattctttgttcgtagagcagttatttgaaaaacagttatggaacacaaaacattttatagatttaatatcataacattgcaaatttttcttgtattattcacaccactggttatacttttttttttccttttttattgattgggcctgaatacaggctttctagagatctttttcattaatacttttaaatacctttcaggtagttacatcatgtttcttcattggatttgtaaaacttgaagccataaaaatattagtttggtgtgtattggggaaaatagctaaaagtctaatttttacccatttagactttgttatttccttgtataaagtgacaaatcggggctcttgtatcagtgccagctgtaatgtttttaaatgcagtggctgccttctattgtcttcctatttttgataatgcagattgttgggaaatctgtaaggaagtaactgattccaggcaaattgttttcttccttctacccaccccaacccctacccatcaccttttaagaacatagtacgccagtgtaacgtgggaaccattgagattgtatttgccctgagtattaaagctagcttagcaaaatacttttaaaaacatattggtaaatgatacccgtaaaattaaattagttatattttattttaaaatgcaaaatacattgatatttattaatcattggatttagggaaagggacagatttttggtgaacctgacttgtggcagatggtaaggaatattataaaacatttggatgagaacaatcagggcgaactgcatttttctgttacactggtaatcatttgaaaattgatttacctcagtgtttaacagttttttgttttgttttgttttttaaataataactaattgtcgagcactgatagagatgcagattttggtggggggaggtggtgggggagataatcacttcaccaactgcagtgcatttgtgtgtttttaaccctcagagaactctgcattttagggtacttgaggctgacttaactaaaagttttaaagtaaccttttttccattgtaaatatttctgtaaatactaccaattggaaattagaacagtagagtacttttctgaatccaatcctatttttattttatacagtatttctcagctgtgatctttggagcaaaagccaacggcaggaaaaaatagtttgtaccagtttcatgaagtatgtctttgggtttttgtaaataattttaactcaaataaaattgctactttcaatac

SEQ ID NO: 199584 - DNA, 6333 bp, Homo sapiens
  Payload ID: 19379
  Gene Name: WAPL cohesin release factor
  Uniprot ID: Q7Z5K2
  ENST ID: ENST00000298767
  CDS Start-End: 474-4046
gcgcggggactgtgggaagcggagtgacggagcgagcggctgttggaggaaggaggtgggggccgggagcgcaaatggcgttgagatggttcagggccctgttcaaactccagcactgaccattcaccggcggaagcggcggcgcaggaggcggcggcggcccagcgggggcacacagcaggctctgttaccagctccagcagtggcggccagcgagagctaggcctgggcccggccggcggcgctcgaggcggggagggaagttgcggggccgccgctcctgcccccccaaccgggcttcctatttaccgaaagcagagtccctcgcctctctcggctctcacctgccggccctgctctcccgcgcgagggttccgcgcccgcccgcgggccgtagggagcgggagaggcggaggcggcccgtggccaaagcacccgccaggctccgaggagaatatgaaactggtgtcaaaatgacatccagatttgggaaaacatacagtaggaaaggtggaaatggcagttcaaaattcgatgaagtcttttccaacaaacggactacccttagcacaaaatggggagagaccacatttatggctaaattagggcagaagaggcccaatttcaaaccagatatccaagaaattccgaagaaacctaaagtggaagaagaaagtactggagatccttttggatttgatagtgatgatgagtctctaccagtttcttcaaagaatttagcccaggttaagtgttcctcttattcagaatctagtgaagctgctcagttggaagaggtcacttcagtacttgaagctaatagcaaaattagtcatgtggtcgttgaagacactgtcgtttctgataaatgcttccctttggaggacactttacttgggaaagaaaagagcacaaaccgaattgtagaagatgatgcaagcataagtagctgtaataaattaataacttcagataaagtggagaattttcatgaagaacatgaaaagaatagtcaccatattcacaaaaatgctgatgacagtactaagaaacccaatgcagaaactacagtggcttctgaaatcaaggaaacaaatgatacttggaactcccagtttgggaaaaggccagaatcaccatcagaaatatctccaatcaagggatctgttagaactggtttgtttgaatgggataatgattttgaagatatcagatcagaagactgtattttaagtttggatagtgatccccttttggagatgaaggatgacgattttaaaaatcgattggaaaatctgaatgaagccattgaggaagatattgtacaaagtgttcttaggccaaccaactgtaggacgtactgtagggccaataaaacgaaatcctcccaaggagcatcaaattttgataagctgatggacggcaccagtcaggccttagccaaagcaaacagtgaatcgagtaaagatggcctgaatcaggcaaagaaagggggtgtaagttgtgggaccagttttagagggacagttggacggactagagattacactgttttacatccatcttgcttgtcagtttgtaatgttaccatacaggatactatggaacgcagcatggatgagttcactgcatccactcctgcagatttgggagaagctggtcgtctcagaaaaaaggcagatattgcaacttctaagactactactagatttcgacctagtaatactaaatccaaaaaggatgttaaacttgaattttttggttttgaagatcatgagacaggaggtgatgaaggaggttctggaagttctaattacaaaattaagtattttggctttgatgatctcagtgaaagcgaagatgatgaagatgatgactgtcaagtagaaagaaagacaagcaaaaaaagaactaaaacagctccatcaccctccttgcagcctcccccagaaagcaatgataattcccaggacagtcagtctggtactaacaatgcagaaaacttggattttacagaggacttgcctggtgtgcctgaaagtgtgaagaagcccataaataaacaaggagataaatcaaaggaaaataccagaaagatttttagtggccccaaacggtcacccacaaaagctgtatataatgccagacattggaatcatccagattcagaagaactgcctgggccaccagtagtaaaacctcagagtgtcacagtgaggctgtcttcaaaggaaccaaatcaaaaagatgatggagtttttaaggctcctgcaccaccatccaaagtgataaaaactgtgacaatacctactcagccctaccaagatatagttactgcactgaaatgcagacgagaagacaaagaattatatactgttgttcagcacgtgaagcacttcaacgatgttgtagaatttggtgaaaatcaagagttcactgatgacattgagtacttgttaagtggcttaaagagcactcagcctctaaacacacgttgccttagtgttattagcttggctactaaatgtgccatgcccagttttcgaatgcacctgagagcacatgggatggtagcaatggtctttaaaaccttggatgattcccagcaccatcagaatctgtccctctgtacagctgccctcatgtatatactgagtagagatcgtttgaacatggatcttgatagagctagcttagatctaatgattcgacttttggaactggaacaagatgcttcatcagccaagctactgaatgaaaaagacatgaacaaaattaaagaaaaaatccgaaggctctgtgaaactgtacacaacaagcatcttgatctagaaaatataacgactgggcatttagctatggagacattattatcccttacttctaaacgagcaggagactggtttaaagaagaactccggcttttgggtggtctggatcatattgtagataaagtaaaagaatgtgtggatcatttaagtagagatgaggatgaagagaaactggtagcctcactatggggagcagagagatgtttacgagttttagaaagtgtaactgtgcataatcccgaaaatcaaagctacttgatagcatataaagattcccaacttattgtttcatcagctaaagcattacagcattgtgaagaactgattcagcagtacaaccgtgctgaggacagcatatgcttagctgacagtaagcctctgcctcaccagaatgtaactaaccatgtaggcaaagcagtggaggactgcatgagggccatcatcggggtgttgcttaatttaactaatgataatgagtggggcagcaccaaaacaggagagcaggacggtctcataggcacagcgctgaactgtgtgcttcaggttccaaagtacctacctcaggagcagagatttgatattcgagtgctgggcttaggtctgctgataaatctagtggagtatagtgctcggaatcggcactgtcttgtcaacatggaaacatcgtgctcttttgattcttccatctgtagtggagaaggggatgatagtttaaggataggtggacaagttcatgctgtccaggctttagtgcagctattccttgagcgagagcgggcagcccagctagcagaaagtaaaacagatgagttgatcaaagatgctcccaccactcagcatgataagagtggagagtggcaagaaacaagtggagaaatacagtgggtgtcaactgaaaagactgatggtacagaagagaaacataagaaggaggaggaggatgaagaacttgacctcaataaagcccttcagcatgccggcaaacacatggaggattgcattgtggcctcctacacagcactacttcttgggtgtctctgccaggaaagtccaatcaatgtaaccactgtgcgggaatatctgccagaaggagacttttcaataatgacagagatgctcaaaaaatttttgagttttatgaatctcacttgtgctgttggaacaactggccagaaatctatctctagagtgattgaatatttggaacattgctagctgctttacctttgcttcaggtgctcggtaatgctggagctatccttagacaaagaaaagtcaagtcatgaaagaagtccttgaagatataccaagaacattcatcagtatcattcgtgtttggatttttaaggccacctgatttcttcgtcatgcattcggcatttgctaaatgacagttactacatcaatctgcaactatcaaaaatgaggggaaaaggttcaggctgttaacaattccatgcagtatttaaatacatttactttggcagagtttataccctccccttgttttcttgctttattctgggcaagtttgaaggggaaaatttgtgctgctgttagtgcaactgctgtgtatgttgagccactgttgtcatgccagccaggtgcaaaggcagcttagctactgaggtagcgaatgttctgaggacattctagacaacagcttagttcctttttcaggctcatttgcttttgcttttttgttgaatgattccaatcgtaaataaagcttttaataattttgtgaattttttggttgttgttccctgaactactgtctatatttaaaattagatggaatccaaagatacacgggattaatagtatatttttttattcttgattaggtttgggttattgaactattttttacttttgagaccacaaccatattcaatatcataccataatgtgtcatagctataggcacaagaaaaacaacagtttgagagaatattatataagatgatgtgccctgttaaaaggaggaggcaaaatagtcaaacccagggtagtttacacttaatgctagggaggctcttaaaacattattagattttgaggaaagactctctagatatattttctaatgttcagtacaataaatataaggaagctaaaacaccaatgtggaattcctgtttccagataacatgtatattcttctatagagtgacaggatcaattgcataagcgcaaagccttaaattgctggtttagagaagacccttttttcattcagattctttgttcgtagagcagttatttgaaaaacagttatggaacacaaaacattttatagatttaatatcataacattgcaaatttttcttgtattattcacaccactggttatacttttttttttccttttttattgattgggcctgaatacaggctttctagagatctttttcattaatacttttaaatacctttcaggtagttacatcatgtttcttcattggatttgtaaaacttgaagccataaaaatattagtttggtgtgtattggggaaaatagctaaaagtctaatttttacccatttagactttgttatttccttgtataaagtgacaaatcggggctcttgtatcagtgccagctgtaatgtttttaaatgcagtggctgccttctattgtcttcctatttttgataatgcagattgttgggaaatctgtaaggaagtaactgattccaggcaaattgttttcttccttctacccaccccaacccctacccatcaccttttaagaacatagtacgccagtgtaacgtgggaaccattgagattgtatttgccctgagtattaaagctagcttagcaaaatacttttaaaaacatattggtaaatgatacccgtaaaattaaattagttatattttattttaaaatgcaaaatacattgatatttattaatcattggatttagggaaagggacagatttttggtgaacctgacttgtggcagatggtaaggaatattataaaacatttggatgagaacaatcagggcgaactgcatttttctgttacactggtaatcatttgaaaattgatttacctcagtgtttaacagttttttgttttgttttgttttttaaataataactaattgtcgagcactgatagagatgcagattttggtggggggaggtggtgggggagataatcacttcaccaactgcagtgcatttgtgtgtttttaaccctcagagaactctgcattttagggtacttgaggctgacttaactaaaagttttaaagtaaccttttttccattgtaaatatttctgtaaatactaccaattggaaattagaacagtagagtacttttctgaatccaatcctatttttattttatacagtatttctcagctgtgatctttggagcaaaagccaacggcaggaaaaaatagtttgtaccagtttcatgaagtatgtctttgggtttttgtaaataattttaactcaaataaaattgctactttcaataca

SEQ ID NO: 199585 - DNA, 1801 bp, Homo sapiens
  Payload ID: 19379
  Gene Name: WAPL cohesin release factor
  ENST ID: ENST00000372075
  CDS Start-End: 60-1268
agaatctgtccctctgtacagctgccctcatgtatatactgagtagagatcgtttgaacatggatcttgatagagctagcttagatctaatgattcgacttttggaactggaacaagatgcttcatcagccaagctactgaatgaaaaagacatgaacaaaattaaagaaaaaatccgaaggctctgtgaaactgtacacaacaagcatcttgatctagaaaatataacgactgggcatttagctatggagacattattatcccttacttctaaacgagcaggagactggtttaaagaagaactccggcttttgggtggtctggatcatattgtagataaagtaaaagaatgtgtggatcatttaagtagagatgaggatgaagagaaactggtagcctcactatggggagcagagagatgtttacgagttttagaaagtgtaactgtgcataatcccgaaaatcaaagctacttgatagcatataaagattcccaacttattgtttcatcagctaaagcattacagcattgtgaagaactgattcagcagtacaaccgtgctgaggacagcatatgcttagctgacagtaagcctctgcctcaccagaatgtaactaaccatgtaggcaaagcagtggaggactgcatgagggccatcatcggggtgttgcttaatttaactaatgataatgagtggggcagcaccaaaacaggagagcaggacggtctcataggcacagcgctgaactgtgtgcttcaggttccaaagtacctacctcaggagcagagatttgatattcgagtgctgctattccttgagcgagagcgggcagcccagctagcagaaagtaaaacagatgagttgatcaaagatgctcccaccactcagcatgataagagtggagagtggcaagaaacaagtggagaaatacagtgggtgtcaactgaaaagactgatggtacagaagagaaacataagaaggaggaggaggatgaagaacttgacctcaataaagcccttcagcatgccggcaaacacatggaggattgcattgtggcctcctacacagcactacttcttgggtgtctctgccaggaaagtccaatcaatgtaaccactgtgcgggaatatctgccagaaggagacttttcaataatgacagagatgctcaaaaaatttttgagttttatgaatctcacttgtgctgttggaacaactggccagaaatctatctctagagtgattgaatatttggaacattgctagctgctttacctttgcttcaggtgctcggtaatgctggagctatccttagacaaagaaaagtcaagtcatgaaagaagtccttgaagatataccaagaacattcatcagtatcattcgtgtttggatttttaaggccacctgatttcttcgtcatgcattcggcatttgctaaatgacagttactacatcaatctgcaactatcaaaaatgaggggaaaaggttcaggctgttaacaattccatgcagtatttaaatacatttactttggcagagtttataccctccccttgttttcttgctttattctgggcaagtttgaaggggaaaatttgtgctgctgttagtgcaactgctgtgtatgttgagccactgttgtcatgccagccaggtgcaaaggcagcttagctactgaggtagcgaatgttctgaggacattctagacaacagcttagttcctttttcaggctcatttgcttttgcttttttgttgaatgattccaatcgtaaataaagcttttaataattttgtgaa

SEQ ID NO: 199586 - DNA, 6152 bp, Homo sapiens
  Payload ID: 19379
  Gene Name: WAPL cohesin release factor
  Uniprot ID: Q7Z5K2
  ENST ID: ENST00000618527
  CDS Start-End: 294-3866
ggaaggaggtgggggccgggagcgcaaatggcgttgagatggttcagggccctgttcaaactccagcactgaccattcaccggcggaagcggcgccgctcctgcccccccaaccgggcttcctatttaccgaaagcagagtccctcgcctctctcggctctcacctgccggccctgctctcccgcgcgagggttccgcgcccgcccgcgggccgtagggagcgggagaggcggaggcggcccgtggccaaagcacccgccaggctccgaggagaatatgaaactggtgtcaaaatgacatccagatttgggaaaacatacagtaggaaaggtggaaatggcagttcaaaattcgatgaagtcttttccaacaaacggactacccttagcacaaaatggggagagaccacatttatggctaaattagggcagaagaggcccaatttcaaaccagatatccaagaaattccgaagaaacctaaagtggaagaagaaagtactggagatccttttggatttgatagtgatgatgagtctctaccagtttcttcaaagaatttagcccaggttaagtgttcctcttattcagaatctagtgaagctgctcagttggaagaggtcacttcagtacttgaagctaatagcaaaattagtcatgtggtcgttgaagacactgtcgtttctgataaatgcttccctttggaggacactttacttgggaaagaaaagagcacaaaccgaattgtagaagatgatgcaagcataagtagctgtaataaattaataacttcagataaagtggagaattttcatgaagaacatgaaaagaatagtcaccatattcacaaaaatgctgatgacagtactaagaaacccaatgcagaaactacagtggcttctgaaatcaaggaaacaaatgatacttggaactcccagtttgggaaaaggccagaatcaccatcagaaatatctccaatcaagggatctgttagaactggtttgtttgaatgggataatgattttgaagatatcagatcagaagactgtattttaagtttggatagtgatccccttttggagatgaaggatgacgattttaaaaatcgattggaaaatctgaatgaagccattgaggaagatattgtacaaagtgttcttaggccaaccaactgtaggacgtactgtagggccaataaaacgaaatcctcccaaggagcatcaaattttgataagctgatggacggcaccagtcaggccttagccaaagcaaacagtgaatcgagtaaagatggcctgaatcaggcaaagaaagggggtgtaagttgtgggaccagttttagagggacagttggacggactagagattacactgttttacatccatcttgcttgtcagtttgtaatgttaccatacaggatactatggaacgcagcatggatgagttcactgcatccactcctgcagatttgggagaagctggtcgtctcagaaaaaaggcagatattgcaacttctaagactactactagatttcgacctagtaatactaaatccaaaaaggatgttaaacttgaattttttggttttgaagatcatgagacaggaggtgatgaaggaggttctggaagttctaattacaaaattaagtattttggctttgatgatctcagtgaaagcgaagatgatgaagatgatgactgtcaagtagaaagaaagacaagcaaaaaaagaactaaaacagctccatcaccctccttgcagcctcccccagaaagcaatgataattcccaggacagtcagtctggtactaacaatgcagaaaacttggattttacagaggacttgcctggtgtgcctgaaagtgtgaagaagcccataaataaacaaggagataaatcaaaggaaaataccagaaagatttttagtggccccaaacggtcacccacaaaagctgtatataatgccagacattggaatcatccagattcagaagaactgcctgggccaccagtagtaaaacctcagagtgtcacagtgaggctgtcttcaaaggaaccaaatcaaaaagatgatggagtttttaaggctcctgcaccaccatccaaagtgataaaaactgtgacaatacctactcagccctaccaagatatagttactgcactgaaatgcagacgagaagacaaagaattatatactgttgttcagcacgtgaagcacttcaacgatgttgtagaatttggtgaaaatcaagagttcactgatgacattgagtacttgttaagtggcttaaagagcactcagcctctaaacacacgttgccttagtgttattagcttggctactaaatgtgccatgcccagttttcgaatgcacctgagagcacatgggatggtagcaatggtctttaaaaccttggatgattcccagcaccatcagaatctgtccctctgtacagctgccctcatgtatatactgagtagagatcgtttgaacatggatcttgatagagctagcttagatctaatgattcgacttttggaactggaacaagatgcttcatcagccaagctactgaatgaaaaagacatgaacaaaattaaagaaaaaatccgaaggctctgtgaaactgtacacaacaagcatcttgatctagaaaatataacgactgggcatttagctatggagacattattatcccttacttctaaacgagcaggagactggtttaaagaagaactccggcttttgggtggtctggatcatattgtagataaagtaaaagaatgtgtggatcatttaagtagagatgaggatgaagagaaactggtagcctcactatggggagcagagagatgtttacgagttttagaaagtgtaactgtgcataatcccgaaaatcaaagctacttgatagcatataaagattcccaacttattgtttcatcagctaaagcattacagcattgtgaagaactgattcagcagtacaaccgtgctgaggacagcatatgcttagctgacagtaagcctctgcctcaccagaatgtaactaaccatgtaggcaaagcagtggaggactgcatgagggccatcatcggggtgttgcttaatttaactaatgataatgagtggggcagcaccaaaacaggagagcaggacggtctcataggcacagcgctgaactgtgtgcttcaggttccaaagtacctacctcaggagcagagatttgatattcgagtgctgggcttaggtctgctgataaatctagtggagtatagtgctcggaatcggcactgtcttgtcaacatggaaacatcgtgctcttttgattcttccatctgtagtggagaaggggatgatagtttaaggataggtggacaagttcatgctgtccaggctttagtgcagctattccttgagcgagagcgggcagcccagctagcagaaagtaaaacagatgagttgatcaaagatgctcccaccactcagcatgataagagtggagagtggcaagaaacaagtggagaaatacagtgggtgtcaactgaaaagactgatggtacagaagagaaacataagaaggaggaggaggatgaagaacttgacctcaataaagcccttcagcatgccggcaaacacatggaggattgcattgtggcctcctacacagcactacttcttgggtgtctctgccaggaaagtccaatcaatgtaaccactgtgcgggaatatctgccagaaggagacttttcaataatgacagagatgctcaaaaaatttttgagttttatgaatctcacttgtgctgttggaacaactggccagaaatctatctctagagtgattgaatatttggaacattgctagctgctttacctttgcttcaggtgctcggtaatgctggagctatccttagacaaagaaaagtcaagtcatgaaagaagtccttgaagatataccaagaacattcatcagtatcattcgtgtttggatttttaaggccacctgatttcttcgtcatgcattcggcatttgctaaatgacagttactacatcaatctgcaactatcaaaaatgaggggaaaaggttcaggctgttaacaattccatgcagtatttaaatacatttactttggcagagtttataccctccccttgttttcttgctttattctgggcaagtttgaaggggaaaatttgtgctgctgttagtgcaactgctgtgtatgttgagccactgttgtcatgccagccaggtgcaaaggcagcttagctactgaggtagcgaatgttctgaggacattctagacaacagcttagttcctttttcaggctcatttgcttttgcttttttgttgaatgattccaatcgtaaataaagcttttaataattttgtgaattttttggttgttgttccctgaactactgtctatatttaaaattagatggaatccaaagatacacgggattaatagtatatttttttattcttgattaggtttgggttattgaactattttttacttttgagaccacaaccatattcaatatcataccataatgtgtcatagctataggcacaagaaaaacaacagtttgagagaatattatataagatgatgtgccctgttaaaaggaggaggcaaaatagtcaaacccagggtagtttacacttaatgctagggaggctcttaaaacattattagattttgaggaaagactctctagatatattttctaatgttcagtacaataaatataaggaagctaaaacaccaatgtggaattcctgtttccagataacatgtatattcttctatagagtgacaggatcaattgcataagcgcaaagccttaaattgctggtttagagaagacccttttttcattcagattctttgttcgtagagcagttatttgaaaaacagttatggaacacaaaacattttatagatttaatatcataacattgcaaatttttcttgtattattcacaccactggttatacttttttttttccttttttattgattgggcctgaatacaggctttctagagatctttttcattaatacttttaaatacctttcaggtagttacatcatgtttcttcattggatttgtaaaacttgaagccataaaaatattagtttggtgtgtattggggaaaatagctaaaagtctaatttttacccatttagactttgttatttccttgtataaagtgacaaatcggggctcttgtatcagtgccagctgtaatgtttttaaatgcagtggctgccttctattgtcttcctatttttgataatgcagattgttgggaaatctgtaaggaagtaactgattccaggcaaattgttttcttccttctacccaccccaacccctacccatcaccttttaagaacatagtacgccagtgtaacgtgggaaccattgagattgtatttgccctgagtattaaagctagcttagcaaaatacttttaaaaacatattggtaaatgatacccgtaaaattaaattagttatattttattttaaaatgcaaaatacattgatatttattaatcattggatttagggaaagggacagatttttggtgaacctgacttgtggcagatggtaaggaatattataaaacatttggatgagaacaatcagggcgaactgcatttttctgttacactggtaatcatttgaaaattgatttacctcagtgtttaacagttttttgttttgttttgttttttaaataataactaattgtcgagcactgatagagatgcagattttggtggggggaggtggtgggggagataatcacttcaccaactgcagtgcatttgtgtgtttttaaccctcagagaactctgcattttagggtacttgaggctgacttaactaaaagttttaaagtaaccttttttccattgtaaatatttctgtaaatactaccaattggaaattagaacagtagagtacttttctgaatccaatcctatttttattttatacagtatttctcagctgtgatctttggagcaaaagccaacggcaggaaaaaatagtttgtaccagtttcatgaagtatgtctttgggtttttgtaaataattttaactcaaataaaattgctactttcaatac

SEQ ID NO: 199587 - DNA, 1827 bp, Homo sapiens
  Payload ID: 19380
  Gene Name: WAS protein family homolog 1
  Uniprot ID: A8K0Z3
  ENST ID: ENST00000442898
  CDS Start-End: 144-1541
ctattctaggcacttcacaaaactggactcatacgatatctgtagttttgcgtctggcttctctattgaattcttaaaggggggtgggaactaagcagatcacaagggagctgcccacagaggtaaagacaaggtcaggcaccatgactcctgtgaggatgcagcactccctggcaggtcagacctatgccgtgcccttcatccagccagacctgcggcgagaggaggccgtccagcagatggcggatgccctgcagtacctgcagaaggtctctggagacatcttcagcaggatctcccagcaggtagagcagagccggagccaggtgcaggccattggagagaaggtctccttggcccaggccaagattgagaagatcaagggcagcaagaaggccatcaaggtgttctccagtgccaagtaccctgctccagggcgcctgcaggaatatggctccatcttcacgggcgcccaggaccctggcctgcagagacgcccccgccacaggatccagagcaagcaccgccccctggacgagcgggccctgcaggagaagctgaaggactttcctgtgtgcgtgagcaccaagccggagcccgaggacgatgcagaagagggacttgggggtcttcccagcaacatcagctctgtcagctccttgctgctcttcaacaccaccgagaacctgtacaagaagtatgtcttcctggaccccctggctggtgctgtaacaaagacccatgtgatgctgggggcagagacagaggagaagctgtttgatgcccccttgtccatcagcaagagagagcagctggaacagcaggtcccagagaactacttctatgtgccagacctgggccaggtgcctgagatccatgttccatcctacctgcctgacctgcccggcattgccaacgacctcatgtacagtgccgacctgggccccggcattgccccctctgcccctggcaccattccagaactgcccaccttccacactgaggtagccgagcctctcaaggtagacctacaagatggggtactaacaccacccccaccgcccccaccaccacccccagctcctgaggtgctggccagtgcacccccactcccaccctcaaccgcggcccctgtaggccaaggcgccaggcaggacgacagcagcagcagcgcatctccttcagtccagggagctcccagggaagtggtcgacccctccggtggctgggccactctgctagagtccatccgccaagctgggggcatcggcaaggccaagctgcgcagcatgaaggagcgaaagctggagaagcagcagcagaaggagcaggagcaagtgagagccacgagccaaggtgggcacttgatgtcggatctcttcaacaagctggtcatgaggcgcaagggcatctctgggaaaggacctggggctggtgaggggcccggaggagcctttgtccgcgtgtcagactccatccctcctttgccgccaccgcagcagccacaggcagaggaggacgaggacgactgggaatcgtagggggctccatgacaccttcccccccagacccagacttgggccgttgctctgacatggacacagccaggacaagctgctcagacctgcttccctgggagggggtgacggaaccagcagtgtgtggagaccagcttcaaggagcggaaggctggcttgaggccacacagctggggcggggacttgtctgcctgtacttcatggggggacggctccacccagcctgcgccactgtgttcttaagaggcttccagagaaaacggcacaccaatcaataaagaactgagca

SEQ ID NO: 199588 - DNA, 904 bp, Homo sapiens
  Payload ID: 19381
  Gene Name: WAS protein family, member 1
  ENST ID: ENST00000265601
  CDS Start-End: 483-904
gcgcgtcgagcacacggtgggtccggcggcgggttggcgccccaggcggcgttccctgtggcctggcgcctgggccgctgccctgagcgggttccgccccagagcccgaccctcctgggggctctaggcggagtcccgcgagccgagggggaccggcgaccgctgccgaagcatgaagaaggggtaaggcgtgagcccccaagatttcacgcatgccccctagcttcggtactctgacaccttctcttgcacttgcggatgatgaactggaataacgatgaaagaaagcacatccgatctcaacattcacgtcctgccctataaccgattaattaattgatccccagctagactagtgttggagaaatcagcatgttaaaacaactgttgatgatagctgttggagtaaagttgcagtggaagctatggctgcaaaatcgttaaaatcttcaaggtgaactggcacaaaggttaatctcaagatgccgctagtgaaaagaaacatcgatcctaggcacttgtgccacacagcactgcctagaggcattaagaatgaactggaatgtgtaaccaatatttccttggcaaatataattagacaactaagtagcctaagtaaatatgctgaagatatatttggagaattattcaatgaagcacatagtttttccttcagagtcaactcattgcaagaacgtgtggaccgtttatctgttagtgttacacagcttgatccaaaggaagaagaattgtctttgcaagatataacaatgaggaaagctttccgaagttctacaattcaagaccagcagcttttcgatcgcaagactttgcctattccattacaggagacgtacgatgtttgtgaacagcctccacctctcaatatactcactccttatag

SEQ ID NO: 199589 - DNA, 3075 bp, Homo sapiens
  Payload ID: 19381
  Gene Name: WAS protein family, member 1
  Uniprot ID: Q92558
  ENST ID: ENST00000359451
  CDS Start-End: 693-2372
agcagtgttctcttcgtccccctcccccaaactgaggattgggcaataccacagaacctcaggaaaggggggaagagcgagcttcggccccactaatgggggagtgggcggaggctggatttcccacctcggctgcacctgggcactggaggctgaagaggaaagtgagaatctgaagttttgagacctctgactggccaggaatagctcctggggcggggggcaaggatgggaccataggcggaaagagtctcgcggtcccccctgcttctggcgcgggtccctgcgcccggttgtggagcgtctcgcgcggggagggggcggggggaacggcagctcgcggtgttgttcactcgcgcgtcgagcacacggtgggtccggcggcgggttggcgccccaggcggcgttccctgtggcctggcgcctgggccgctgccctgagcgggttccgccccagagcccgaccctcctgggggctctaggcggagtcccgcgagccgagggggaccggcgaccgctgccgaagcatgaagaaggggtaaggcgtgagcccccaagatttcacgtgttggagaaatcagcatgttaaaacaactgttgatgatagctgttggagtaaagttgcagtggaagctatggctgcaaaatcgttaaaatcttcaaggtgaactggcacaaaggttaatctcaagatgccgctagtgaaaagaaacatcgatcctaggcacttgtgccacacagcactgcctagaggcattaagaatgaactggaatgtgtaaccaatatttccttggcaaatataattagacaactaagtagcctaagtaaatatgctgaagatatatttggagaattattcaatgaagcacatagtttttccttcagagtcaactcattgcaagaacgtgtggaccgtttatctgttagtgttacacagcttgatccaaaggaagaagaattgtctttgcaagatataacaatgaggaaagctttccgaagttctacaattcaagaccagcagcttttcgatcgcaagactttgcctattccattacaggagacgtacgatgtttgtgaacagcctccacctctcaatatactcactccttatagagatgatggtaaagaaggtctgaagttttataccaatccttcgtatttctttgatctatggaaagaaaaaatgttgcaagatacagaggataagaggaaggaaaagaggaagcagaagcagaaaaatctagatcgtcctcatgaaccagaaaaagtgccaagagcacctcatgacaggcggcgagaatggcagaagctggcccaaggtccagagctggctgaagatgatgctaatctcttacataagcatattgaagttgctaatggcccagcctctcattttgaaacaagacctcagacatacgtggatcatatggatggatcttactcactttctgccttgccatttagtcagatgagtgagcttctgactagagctgaggaaagggtattagtcagaccacatgaaccacctccacctccaccaatgcatggagcaggagatgcaaaaccgatacccacctgtatcagttctgctacaggtttgatagaaaatcgccctcagtcaccagctacaggcagaacacctgtgtttgtgagccccactcccccacctcctccaccacctcttccatctgccttgtcaacttcctcattaagagcttcaatgacttcaactcctccccctccagtacctcccccacctccacctccagccactgctttgcaagctccagcagtaccaccacctccagctcctcttcagattgcccctggagttcttcacccagctcctcctccaattgcacctcctctagtacagccctctccaccagtagctagagctgccccagtatgtgagactgtaccagttcatccactcccacaaggtgaagttcaggggctgcctccacccccaccaccgcctcctctgcctccacctggcattcgaccatcatcacctgtcacagttacagctcttgctcatcctccctctgggctacatccaactccatctactgccccaggtccccatgttccattaatgcctccatctcctccatcacaagttatacctgcttctgagccaaagcgccatccatcaaccctacctgtaatcagtgatgccaggagtgtgctactggaagcaatacgaaaaggtattcagctacgcaaagtagaagagcagcgtgaacaggaagctaagcatgaacgcattgaaaacgatgttgccaccatcctgtctcgccgtattgctgttgaatatagtgattcggaagatgattcagaatttgatgaagtagattggttggagtaagaaaaatgcattgataaatattacaaaactgaatgcaaatgtcctttgtggtgcttgttccttgaaaatgtttggtcattctagtgttttgctttcttttccttataataaatgacccttttcctccataacttttgatttctaaggaaaatattagcatacatttcaaactaaatgttttacagtggcttatcttttttttccccctgaaaagactaatttggtcaaataaaccactaagtattaagcatggacagctgttgttagagtagcagattcagttttttgatatatcttaattgtgtactttgtgaattttaatttaaagaaagcaactgaaattgaaatcttgagggcagctgtgtctactaatgagccttattccatttcctgatgttttaaaagaagaaacactgccttgattatacgaatacactcagaaagtacatttagcttgtagtgttgaattctcttaaaggaatgcttgaattttttcattattgttttattgtttttatatacttgccttatttgaatgtttagcagtatccccttcccacttatatattgtgtgatatgattttgcttgcctataggagttaaaaacttttccatgtgaaatactctgacttaaacatacatgtaacttacataactgttaagaataacagtctgatttaataaatggttcattttaaaagtt

SEQ ID NO: 199590 - DNA, 678 bp, Homo sapiens
  Payload ID: 19381
  Gene Name: WAS protein family, member 1
  ENST ID: ENST00000368938
  CDS Start-End: 257-678
cttcggccccactaatgggggagtgggcggaggctggatttcccacctcggctgcacctgggcactggaggctgaagaggaaacatgccccctagcttcggtactctgacaccttctcttgcacttgcggatgatgaactggaataacgatgaaagaaagcacatccgatctcaacattcacgtcctgccctataaccgattaattaattgatccccagctagactaggtgaactggcacaaaggttaatctcaagatgccgctagtgaaaagaaacatcgatcctaggcacttgtgccacacagcactgcctagaggcattaagaatgaactggaatgtgtaaccaatatttccttggcaaatataattagacaactaagtagcctaagtaaatatgctgaagatatatttggagaattattcaatgaagcacatagtttttccttcagagtcaactcattgcaagaacgtgtggaccgtttatctgttagtgttacacagcttgatccaaaggaagaagaattgtctttgcaagatataacaatgaggaaagctttccgaagttctacaattcaagaccagcagcttttcgatcgcaagactttgcctattccattacaggagacgtacgatgtttgtgaacagcctccacctctcaatatactcactccttatag

SEQ ID NO: 199591 - DNA, 2815 bp, Homo sapiens
  Payload ID: 19381
  Gene Name: WAS protein family, member 1
  Uniprot ID: Q92558
  ENST ID: ENST00000392586
  CDS Start-End: 433-2112
agtgttctcttcgtccccctcccccaaactgaggattgggcaataccacagaacctcaggaaaggggggaagagcgagcttcggccccactaatgggggagtgggcggaggctggatttcccacctcggctgcacctgggcactggaggctgaagaggaaacatgccccctagcttcggtactctgacaccttctcttgcacttgcggatgatgaactggaataacgatgaaagaaagcacatccgatctcaacattcacgtcctgccctataaccgattaattaattgatccccagctagactagtgttggagaaatcagcatgttaaaacaactgttgatgatagctgttggagtaaagttgcagtggaagctatggctgcaaaatcgttaaaatcttcaaggtgaactggcacaaaggttaatctcaagatgccgctagtgaaaagaaacatcgatcctaggcacttgtgccacacagcactgcctagaggcattaagaatgaactggaatgtgtaaccaatatttccttggcaaatataattagacaactaagtagcctaagtaaatatgctgaagatatatttggagaattattcaatgaagcacatagtttttccttcagagtcaactcattgcaagaacgtgtggaccgtttatctgttagtgttacacagcttgatccaaaggaagaagaattgtctttgcaagatataacaatgaggaaagctttccgaagttctacaattcaagaccagcagcttttcgatcgcaagactttgcctattccattacaggagacgtacgatgtttgtgaacagcctccacctctcaatatactcactccttatagagatgatggtaaagaaggtctgaagttttataccaatccttcgtatttctttgatctatggaaagaaaaaatgttgcaagatacagaggataagaggaaggaaaagaggaagcagaagcagaaaaatctagatcgtcctcatgaaccagaaaaagtgccaagagcacctcatgacaggcggcgagaatggcagaagctggcccaaggtccagagctggctgaagatgatgctaatctcttacataagcatattgaagttgctaatggcccagcctctcattttgaaacaagacctcagacatacgtggatcatatggatggatcttactcactttctgccttgccatttagtcagatgagtgagcttctgactagagctgaggaaagggtattagtcagaccacatgaaccacctccacctccaccaatgcatggagcaggagatgcaaaaccgatacccacctgtatcagttctgctacaggtttgatagaaaatcgccctcagtcaccagctacaggcagaacacctgtgtttgtgagccccactcccccacctcctccaccacctcttccatctgccttgtcaacttcctcattaagagcttcaatgacttcaactcctccccctccagtacctcccccacctccacctccagccactgctttgcaagctccagcagtaccaccacctccagctcctcttcagattgcccctggagttcttcacccagctcctcctccaattgcacctcctctagtacagccctctccaccagtagctagagctgccccagtatgtgagactgtaccagttcatccactcccacaaggtgaagttcaggggctgcctccacccccaccaccgcctcctctgcctccacctggcattcgaccatcatcacctgtcacagttacagctcttgctcatcctccctctgggctacatccaactccatctactgccccaggtccccatgttccattaatgcctccatctcctccatcacaagttatacctgcttctgagccaaagcgccatccatcaaccctacctgtaatcagtgatgccaggagtgtgctactggaagcaatacgaaaaggtattcagctacgcaaagtagaagagcagcgtgaacaggaagctaagcatgaacgcattgaaaacgatgttgccaccatcctgtctcgccgtattgctgttgaatatagtgattcggaagatgattcagaatttgatgaagtagattggttggagtaagaaaaatgcattgataaatattacaaaactgaatgcaaatgtcctttgtggtgcttgttccttgaaaatgtttggtcattctagtgttttgctttcttttccttataataaatgacccttttcctccataacttttgatttctaaggaaaatattagcatacatttcaaactaaatgttttacagtggcttatcttttttttccccctgaaaagactaatttggtcaaataaaccactaagtattaagcatggacagctgttgttagagtagcagattcagttttttgatatatcttaattgtgtactttgtgaattttaatttaaagaaagcaactgaaattgaaatcttgagggcagctgtgtctactaatgagccttattccatttcctgatgttttaaaagaagaaacactgccttgattatacgaatacactcagaaagtacatttagcttgtagtgttgaattctcttaaaggaatgcttgaattttttcattattgttttattgtttttatatacttgccttatttgaatgtttagcagtatccccttcccacttatatattgtgtgatatgattttgcttgcctataggagttaaaaacttttccatgtgaaatactctgacttaaacatacatgtaacttacataactgttaagaataacagtctgatttaataaatggttcattttaaaagtt

SEQ ID NO: 199592 - DNA, 2675 bp, Homo sapiens
  Payload ID: 19381
  Gene Name: WAS protein family, member 1
  Uniprot ID: Q92558
  ENST ID: ENST00000392587
  CDS Start-End: 293-1972
gtctcgcgcggggagggggcggggggaacggcagctcgcggtgttgttcactcgcgcgtcgagcacacggtgggtccggcggcgggttggcgccccaggcggcgttccctgtggcctggcgcctgggccgctgccctgagcgggttccgccccagagcccgaccctcctgggggctctaggcggagtcccgcgagccgagggggaccggcgaccgctgccgaagcatgaagaaggggtaaggcgtgagcccccaagatttcacggtgaactggcacaaaggttaatctcaagatgccgctagtgaaaagaaacatcgatcctaggcacttgtgccacacagcactgcctagaggcattaagaatgaactggaatgtgtaaccaatatttccttggcaaatataattagacaactaagtagcctaagtaaatatgctgaagatatatttggagaattattcaatgaagcacatagtttttccttcagagtcaactcattgcaagaacgtgtggaccgtttatctgttagtgttacacagcttgatccaaaggaagaagaattgtctttgcaagatataacaatgaggaaagctttccgaagttctacaattcaagaccagcagcttttcgatcgcaagactttgcctattccattacaggagacgtacgatgtttgtgaacagcctccacctctcaatatactcactccttatagagatgatggtaaagaaggtctgaagttttataccaatccttcgtatttctttgatctatggaaagaaaaaatgttgcaagatacagaggataagaggaaggaaaagaggaagcagaagcagaaaaatctagatcgtcctcatgaaccagaaaaagtgccaagagcacctcatgacaggcggcgagaatggcagaagctggcccaaggtccagagctggctgaagatgatgctaatctcttacataagcatattgaagttgctaatggcccagcctctcattttgaaacaagacctcagacatacgtggatcatatggatggatcttactcactttctgccttgccatttagtcagatgagtgagcttctgactagagctgaggaaagggtattagtcagaccacatgaaccacctccacctccaccaatgcatggagcaggagatgcaaaaccgatacccacctgtatcagttctgctacaggtttgatagaaaatcgccctcagtcaccagctacaggcagaacacctgtgtttgtgagccccactcccccacctcctccaccacctcttccatctgccttgtcaacttcctcattaagagcttcaatgacttcaactcctccccctccagtacctcccccacctccacctccagccactgctttgcaagctccagcagtaccaccacctccagctcctcttcagattgcccctggagttcttcacccagctcctcctccaattgcacctcctctagtacagccctctccaccagtagctagagctgccccagtatgtgagactgtaccagttcatccactcccacaaggtgaagttcaggggctgcctccacccccaccaccgcctcctctgcctccacctggcattcgaccatcatcacctgtcacagttacagctcttgctcatcctccctctgggctacatccaactccatctactgccccaggtccccatgttccattaatgcctccatctcctccatcacaagttatacctgcttctgagccaaagcgccatccatcaaccctacctgtaatcagtgatgccaggagtgtgctactggaagcaatacgaaaaggtattcagctacgcaaagtagaagagcagcgtgaacaggaagctaagcatgaacgcattgaaaacgatgttgccaccatcctgtctcgccgtattgctgttgaatatagtgattcggaagatgattcagaatttgatgaagtagattggttggagtaagaaaaatgcattgataaatattacaaaactgaatgcaaatgtcctttgtggtgcttgttccttgaaaatgtttggtcattctagtgttttgctttcttttccttataataaatgacccttttcctccataacttttgatttctaaggaaaatattagcatacatttcaaactaaatgttttacagtggcttatcttttttttccccctgaaaagactaatttggtcaaataaaccactaagtattaagcatggacagctgttgttagagtagcagattcagttttttgatatatcttaattgtgtactttgtgaattttaatttaaagaaagcaactgaaattgaaatcttgagggcagctgtgtctactaatgagccttattccatttcctgatgttttaaaagaagaaacactgccttgattatacgaatacactcagaaagtacatttagcttgtagtgttgaattctcttaaaggaatgcttgaattttttcattattgttttattgtttttatatacttgccttatttgaatgtttagcagtatccccttcccacttatatattgtgtgatatgattttgcttgcctataggagttaaaaacttttccatgtgaaatactctgacttaaacatacatgtaacttacataactgttaagaataacagtctgatttaataaatggttcattttaaaagtt

SEQ ID NO: 199593 - DNA, 3122 bp, Homo sapiens
  Payload ID: 19381
  Gene Name: WAS protein family, member 1
  Uniprot ID: Q92558
  ENST ID: ENST00000392588
  CDS Start-End: 740-2419
agcagtgttctcttcgtccccctcccccaaactgaggattgggcaataccacagaacctcaggaaaggggggaagagcgagcttcggccccactaatgggggagtgggcggaggctggatttcccacctcggctgcacctgggcactggaggctgaagaggaaagtgagaatctgaagttttgagacctctgactggccaggaatagctcctggggcggggggcaaggatgggaccataggcggaaagagtctcgcggtcccccctgcttctggcgcgggtccctgcgcccggttgtggagcgtctcgcgcggggagggggcggggggaacggcagctcgcggtgttgttcactcgcgcgtcgagcacacggtgggtccggcggcgggttggcgccccaggcggcgttccctgtggcctggcgcctgggccgctgccctgagcgggttccgccccagagcccgaccctcctgggggctctaggcggagtcccgcgagccgagggggaccggcgaccgctgccgaagcatgaagaaggggtaaggcgtgagcccccaagatttcacgcatgccccctagcttcggtactctgacaccttctcttgcacttgcggatgatgaactggaataacgatgaaagaaagcacatccgatctcaacattcacgtcctgccctataaccgattaattaattgatccccagctagactaggtgaactggcacaaaggttaatctcaagatgccgctagtgaaaagaaacatcgatcctaggcacttgtgccacacagcactgcctagaggcattaagaatgaactggaatgtgtaaccaatatttccttggcaaatataattagacaactaagtagcctaagtaaatatgctgaagatatatttggagaattattcaatgaagcacatagtttttccttcagagtcaactcattgcaagaacgtgtggaccgtttatctgttagtgttacacagcttgatccaaaggaagaagaattgtctttgcaagatataacaatgaggaaagctttccgaagttctacaattcaagaccagcagcttttcgatcgcaagactttgcctattccattacaggagacgtacgatgtttgtgaacagcctccacctctcaatatactcactccttatagagatgatggtaaagaaggtctgaagttttataccaatccttcgtatttctttgatctatggaaagaaaaaatgttgcaagatacagaggataagaggaaggaaaagaggaagcagaagcagaaaaatctagatcgtcctcatgaaccagaaaaagtgccaagagcacctcatgacaggcggcgagaatggcagaagctggcccaaggtccagagctggctgaagatgatgctaatctcttacataagcatattgaagttgctaatggcccagcctctcattttgaaacaagacctcagacatacgtggatcatatggatggatcttactcactttctgccttgccatttagtcagatgagtgagcttctgactagagctgaggaaagggtattagtcagaccacatgaaccacctccacctccaccaatgcatggagcaggagatgcaaaaccgatacccacctgtatcagttctgctacaggtttgatagaaaatcgccctcagtcaccagctacaggcagaacacctgtgtttgtgagccccactcccccacctcctccaccacctcttccatctgccttgtcaacttcctcattaagagcttcaatgacttcaactcctccccctccagtacctcccccacctccacctccagccactgctttgcaagctccagcagtaccaccacctccagctcctcttcagattgcccctggagttcttcacccagctcctcctccaattgcacctcctctagtacagccctctccaccagtagctagagctgccccagtatgtgagactgtaccagttcatccactcccacaaggtgaagttcaggggctgcctccacccccaccaccgcctcctctgcctccacctggcattcgaccatcatcacctgtcacagttacagctcttgctcatcctccctctgggctacatccaactccatctactgccccaggtccccatgttccattaatgcctccatctcctccatcacaagttatacctgcttctgagccaaagcgccatccatcaaccctacctgtaatcagtgatgccaggagtgtgctactggaagcaatacgaaaaggtattcagctacgcaaagtagaagagcagcgtgaacaggaagctaagcatgaacgcattgaaaacgatgttgccaccatcctgtctcgccgtattgctgttgaatatagtgattcggaagatgattcagaatttgatgaagtagattggttggagtaagaaaaatgcattgataaatattacaaaactgaatgcaaatgtcctttgtggtgcttgttccttgaaaatgtttggtcattctagtgttttgctttcttttccttataataaatgacccttttcctccataacttttgatttctaaggaaaatattagcatacatttcaaactaaatgttttacagtggcttatcttttttttccccctgaaaagactaatttggtcaaataaaccactaagtattaagcatggacagctgttgttagagtagcagattcagttttttgatatatcttaattgtgtactttgtgaattttaatttaaagaaagcaactgaaattgaaatcttgagggcagctgtgtctactaatgagccttattccatttcctgatgttttaaaagaagaaacactgccttgattatacgaatacactcagaaagtacatttagcttgtagtgttgaattctcttaaaggaatgcttgaattttttcattattgttttattgtttttatatacttgccttatttgaatgtttagcagtatccccttcccacttatatattgtgtgatatgattttgcttgcctataggagttaaaaacttttccatgtgaaatactctgacttaaacatacatgtaacttacataactgttaagaataacagtctgatttaataaatggttcattttaaaagtt

SEQ ID NO: 199594 - DNA, 3220 bp, Homo sapiens
  Payload ID: 19381
  Gene Name: WAS protein family, member 1
  Uniprot ID: Q92558
  ENST ID: ENST00000392589
  CDS Start-End: 838-2517
agcagtgttctcttcgtccccctcccccaaactgaggattgggcaataccacagaacctcaggaaaggggggaagagcgagcttcggccccactaatgggggagtgggcggaggctggatttcccacctcggctgcacctgggcactggaggctgaagaggaaagtgagaatctgaagttttgagacctctgactggccaggaatagctcctggggcggggggcaaggatgggaccataggcggaaagagtctcgcggtcccccctgcttctggcgcgggtccctgcgcccggttgtggagcgtctcgcgcggggagggggcggggggaacggcagctcgcggtgttgttcactcgcgcgtcgagcacacggtgggtccggcggcgggttggcgccccaggcggcgttccctgtggcctggcgcctgggccgctgccctgagcgggttccgccccagagcccgaccctcctgggggctctaggcggagtcccgcgagccgagggggaccggcgaccgctgccgaagcatgaagaaggggtaaggcgtgagcccccaagatttcacgcatgccccctagcttcggtactctgacaccttctcttgcacttgcggatgatgaactggaataacgatgaaagaaagcacatccgatctcaacattcacgtcctgccctataaccgattaattaattgatccccagctagactagtgttggagaaatcagcatgttaaaacaactgttgatgatagctgttggagtaaagttgcagtggaagctatggctgcaaaatcgttaaaatcttcaaggtgaactggcacaaaggttaatctcaagatgccgctagtgaaaagaaacatcgatcctaggcacttgtgccacacagcactgcctagaggcattaagaatgaactggaatgtgtaaccaatatttccttggcaaatataattagacaactaagtagcctaagtaaatatgctgaagatatatttggagaattattcaatgaagcacatagtttttccttcagagtcaactcattgcaagaacgtgtggaccgtttatctgttagtgttacacagcttgatccaaaggaagaagaattgtctttgcaagatataacaatgaggaaagctttccgaagttctacaattcaagaccagcagcttttcgatcgcaagactttgcctattccattacaggagacgtacgatgtttgtgaacagcctccacctctcaatatactcactccttatagagatgatggtaaagaaggtctgaagttttataccaatccttcgtatttctttgatctatggaaagaaaaaatgttgcaagatacagaggataagaggaaggaaaagaggaagcagaagcagaaaaatctagatcgtcctcatgaaccagaaaaagtgccaagagcacctcatgacaggcggcgagaatggcagaagctggcccaaggtccagagctggctgaagatgatgctaatctcttacataagcatattgaagttgctaatggcccagcctctcattttgaaacaagacctcagacatacgtggatcatatggatggatcttactcactttctgccttgccatttagtcagatgagtgagcttctgactagagctgaggaaagggtattagtcagaccacatgaaccacctccacctccaccaatgcatggagcaggagatgcaaaaccgatacccacctgtatcagttctgctacaggtttgatagaaaatcgccctcagtcaccagctacaggcagaacacctgtgtttgtgagccccactcccccacctcctccaccacctcttccatctgccttgtcaacttcctcattaagagcttcaatgacttcaactcctccccctccagtacctcccccacctccacctccagccactgctttgcaagctccagcagtaccaccacctccagctcctcttcagattgcccctggagttcttcacccagctcctcctccaattgcacctcctctagtacagccctctccaccagtagctagagctgccccagtatgtgagactgtaccagttcatccactcccacaaggtgaagttcaggggctgcctccacccccaccaccgcctcctctgcctccacctggcattcgaccatcatcacctgtcacagttacagctcttgctcatcctccctctgggctacatccaactccatctactgccccaggtccccatgttccattaatgcctccatctcctccatcacaagttatacctgcttctgagccaaagcgccatccatcaaccctacctgtaatcagtgatgccaggagtgtgctactggaagcaatacgaaaaggtattcagctacgcaaagtagaagagcagcgtgaacaggaagctaagcatgaacgcattgaaaacgatgttgccaccatcctgtctcgccgtattgctgttgaatatagtgattcggaagatgattcagaatttgatgaagtagattggttggagtaagaaaaatgcattgataaatattacaaaactgaatgcaaatgtcctttgtggtgcttgttccttgaaaatgtttggtcattctagtgttttgctttcttttccttataataaatgacccttttcctccataacttttgatttctaaggaaaatattagcatacatttcaaactaaatgttttacagtggcttatcttttttttccccctgaaaagactaatttggtcaaataaaccactaagtattaagcatggacagctgttgttagagtagcagattcagttttttgatatatcttaattgtgtactttgtgaattttaatttaaagaaagcaactgaaattgaaatcttgagggcagctgtgtctactaatgagccttattccatttcctgatgttttaaaagaagaaacactgccttgattatacgaatacactcagaaagtacatttagcttgtagtgttgaattctcttaaaggaatgcttgaattttttcattattgttttattgtttttatatacttgccttatttgaatgtttagcagtatccccttcccacttatatattgtgtgatatgattttgcttgcctataggagttaaaaacttttccatgtgaaatactctgacttaaacatacatgtaacttacataactgttaagaataacagtctgatttaataaatggttcattttaaaagtt

SEQ ID NO: 199595 - DNA, 652 bp, Homo sapiens
  Payload ID: 19381
  Gene Name: WAS protein family, member 1
  ENST ID: ENST00000447287
  CDS Start-End: 385-652
gcgcgtcgagcacacggtgggtccggcggcgggttggcgccccaggcggcgttccctgtggcctggcgcctgggccgctgccctgagcgggttccgccccagagcccgaccctcctgggggctctaggcggagtcccgcgagccgagggggaccggcgaccgctgccgaagcatgaagaaggggtaaggcgtgagcccccaagatttcacgcatgccccctagcttcggtactctgacaccttctcttgcacttgcggatgatgaactggaataacgatgaaagaaagcacatccgatctcaacattcacgtcctgccctataaccgattaattaattgatccccagctagactaggtgaactggcacaaaggttaatctcaagatgccgctagtgaaaagaaacatcgatcctaggcacttgtgccacacagcactgcctagaggcattaagaatgaactggaatgtgtaaccaatatttccttggcaaatataattagacaactaagtagcctaagtaaatatgctgaagatatatttggagaattattcaatgaagcacatagtttttccttcagagtcaactcattgcaagaacgtgtggaccgtttatctgttagtgttacacagcttgatccaaaggaagaagaat

SEQ ID NO: 199596 - DNA, 740 bp, Homo sapiens
  Payload ID: 19381
  Gene Name: WAS protein family, member 1
  ENST ID: ENST00000419252
  CDS Start-End: 473-740
agtgttctcttcgtccccctcccccaaactgaggattgggcaataccacagaacctcaggaaaggggggaagagcgagcttcggccccactaatgggggagtgggcggaggctggatttcccacctcggctgcacctgggcactggaggctgaagaggaaacatgccccctagcttcggtactctgacaccttctcttgcacttgcggatgatgaactggaataacgatgaaagaaagcacatccgatctcaacattcacgtcctgccctataaccgattaattaattgatccccagctagactaggtgttacaatccaaaatacatagttgtgatcatttataagtgttggagaaatcagcatgttaaaacaactgttgatgatagctgttggagtaaagttgcagtggaagctatggctgcaaaatcgttaaaatcttcaaggtgaactggcacaaaggttaatctcaagatgccgctagtgaaaagaaacatcgatcctaggcacttgtgccacacagcactgcctagaggcattaagaatgaactggaatgtgtaaccaatatttccttggcaaatataattagacaactaagtagcctaagtaaatatgctgaagatatatttggagaattattcaatgaagcacatagtttttccttcagagtcaactcattgcaagaacgtgtggaccgtttatctgttagtgttacacagcttgatccaaaggaagaagaat

SEQ ID NO: 199597 - DNA, 898 bp, Homo sapiens
  Payload ID: 19381
  Gene Name: WAS protein family, member 1
  ENST ID: ENST00000444391
  CDS Start-End: 359-898
agctcgcggtgttgttcactcgcgcgtcgagcacacggtgggtccggcggcgggttggcgccccaggcggcgttccctgtggcctggcgcctgggccgctgccctgagcgggttccgccccagagcccgaccctcctgggggctctaggcggagtcccgcgagccgagggggaccggcgaccgctgccgaagcatgaagaaggggtaaggcgtgagcccccaagatttcacgtgttggagaaatcagcatgttaaaacaactgttgatgatagctgttggagtaaagttgcagtggaagctatggctgcaaaatcgttaaaatcttcaaggtgaactggcacaaaggttaatctcaagatgccgctagtgaaaagaaacatcgatcctaggcacttgtgccacacagcactgcctagaggcattaagaatgaactggaatgtgtaaccaatatttccttggcaaatataattagacaactaagtagcctaagtaaatatgctgaagatatatttggagaattattcaatgaagcacatagtttttccttcagagtcaactcattgcaagaacgtgtggaccgtttatctgttagtgttacacagcttgatccaaaggaagaagaattgtctttgcaagatataacaatgaggaaagctttccgaagttctacaattcaagaccagcagcttttcgatcgcaagactttgcctattccattacaggagacgtacgatgtttgtgaacagcctccacctctcaatatactcactccttatagagatgatggtaaagaaggtctgaagttttataccaatccttcgtatttctttgatctatggaaagaaaaaatgttgcaagatacagaggataagaggaaggaaaagaggaagcagaag

SEQ ID NO: 199598 - DNA, 1083 bp, Homo sapiens
  Payload ID: 19382
  Gene Name: WAS protein family, member 2
  Uniprot ID: Q9Y6W5
  ENST ID: ENST00000536657
  CDS Start-End: 110-955
actctgtgcggagactgggcggccggccgacccttcctgtcgctgacggcgactgcgggaggccaggttgtttttcaccattcagaacattgcctgaagcaggtccaccatgccgttagtaacgaggaacatcgagccaaggcacctgtgccgtcagacgttgcctagcgttagaagcgagctggaatgcgtgaccaacatcaccctggcaaatgtcatccgacagctgggcagcctgagtaaatatgcagaggacatttttggagagctctttactcaggcaaatacctttgcctctcgggtaagctcccttgctgagagggtcgaccgactacaggttaaagtcactcagctggatcccaaggaagaagaagtgtcactgcaaggaatcaacacccgaaaagccttcagaagttccaccattcaagaccagaagctttttgacagaaactctctcccagtgcctgtcttagaaacatacaatacctgtgatactcctccccctctcaacaatcttaccccttacagggacgatggaaaagaggcactcaaattctacacagacccttcatacttctttgatctttggaaggagaagatgctgcaggacaccaaggatatcatgaaagagaagagaaagcataggaaagaaaagaaagataatccaaatcgagggaatgtaaacccacgtaaaatcaagacacgtaaggaagagtgggagaaaatgaagatggggcaagaatttgtggagtccaaagaaaagctggggacttctgggtatccacccactttggtgtaccagaatggcagcattggctgtgttgaaaacgtggatgcaagtagctatccgccaccaccacagtcagactctgcttcttcaccttctccttccttctccgaggacaacttgcctcctccaccagcagaattcaggttttcagctgcgcagggttgaggagcagcgggaacaagagaagcgggatgttgtgggcaatgacgtggccaccatcttgtctcgtcgcattgctgttgagtacagtgactcagaagatgactcctctgaatttgatgaggacgactggt

SEQ ID NO: 199599 - DNA, 5676 bp, Homo sapiens
  Payload ID: 19382
  Gene Name: WAS protein family, member 2
  Uniprot ID: Q9Y6W5
  ENST ID: ENST00000618852
  CDS Start-End: 217-1713
ggggaatcgcgtaatggcggacacaggcagggcgagcgcggctgggggcgtagcgcgctgagggggtccggccgtttggcagcccgcgaggcggtccgcgggagcacactctgtgcggagactgggcggccggccgacccttcctgtcgctgacggcgactgcgggaggccaggttgtttttcaccattcagaacattgcctgaagcaggtccaccatgccgttagtaacgaggaacatcgagccaaggcacctgtgccgtcagacgttgcctagcgttagaagcgagctggaatgcgtgaccaacatcaccctggcaaatgtcatccgacagctgggcagcctgagtaaatatgcagaggacatttttggagagctctttactcaggcaaatacctttgcctctcgggtaagctcccttgctgagagggtcgaccgactacaggttaaagtcactcagctggatcccaaggaagaagaagtgtcactgcaaggaatcaacacccgaaaagccttcagaagttccaccattcaagaccagaagctttttgacagaaactctctcccagtgcctgtcttagaaacatacaatacctgtgatactcctccccctctcaacaatcttaccccttacagggacgatggaaaagaggcactcaaattctacacagacccttcatacttctttgatctttggaaggagaagatgctgcaggacaccaaggatatcatgaaagagaagagaaagcataggaaagaaaagaaagataatccaaatcgagggaatgtaaacccacgtaaaatcaagacacgtaaggaagagtgggagaaaatgaagatggggcaagaatttgtggagtccaaagaaaagctggggacttctgggtatccacccactttggtgtaccagaatggcagcattggctgtgttgaaaacgtggatgcaagtagctatccgccaccaccacagtcagactctgcttcttcaccttctccttccttctccgaggacaacttgcctcctccaccagcagaattcagttacccagtggacaaccaaagaggatctggtttggctggacccaaaagatccagtgtggtcagcccaagccatccaccaccagctcctcctctaggctctccaccaggccctaaacccgggtttgctccaccacctgcccctccgccacctccgcctccaatgataggcatcccacctccaccaccgcctgtaggatttgggtctccagggacgcctccaccaccctcacccccatctttcccacctcaccctgattttgctgcccctccacctcctcctccaccaccagcagctgactacccaactctgccaccacctcccttgtcccagccaacaggaggagcacctcctcctccccctcctcctcctcctccggggccccctcctccccctttcactggtgcagatggccagcctgctataccaccaccgctttctgataccaccaagcccaagtcctccttgcctgccgtgagcgatgcccgtagcgacctgctttcagccatccgtcaaggttttcagctgcgcagggttgaggagcagcgggaacaagagaagcgggatgttgtgggcaatgacgtggccaccatcttgtctcgtcgcattgctgttgagtacagtgactcagaagatgactcctctgaatttgatgaggacgactggtccgattaactctttctgcctgctgcccaccttctttttctttccttcctacctgccttctttgatgccaaccccaacagacccgtagggggagaaaagggaggaaaaaagtaattttaaggggccaaagctttccctgaagcaaccaaagatatatccaagtgcttcctccaagtcaacatgtatttcctctccccattttcaggccctgtggggctcctgaggttcagtagctgggatgttccctctttccttcaagtgcctgttgcatattgaaaggaaggagaaatcccaaagcagattcctttgatcgggtttctgttggagatggggcttcccttaggagccatattcaactacagccttctaaaacctgtgccctcagccacttcgaatgccagccaccttctggttctaaaacggggagtggtctgaatgaacacagctgacccctttcccgcgcactgaaagggcagagtaggccgaagggtccaagggccagactgcctcaccctctgccctaatcagcagggtgggcctgccttttgctaagcgatctctatgcctgggatgccctttattccaggaggcatcaagcctctaaagaatgtctcacctcctctgcccaaaaatgatgcctttctgtaggctggtgttgttgcctccctcccaggatccctttggtgagtatggtgttcaggatgcaccaccaccacctctagataccttcaggcaacacagcccagttttaacctctagtatccatgaccaaactatccctgacacatgaggacaggggcctcttctggctgtcaggagcaaagcctgaagacttggagctgcaggactggaagaacagtggagccccgtgggtctcaccctttaaggatgctgaggcctagagatgggaagtgacttgctcaaggtcacacaattggatagtgacatagctagagcgcagagttcctgattccaagtcacctgtgctttctgggaccaaagaatgggcacctgctggagtccgggcagagctttctcagttgtattgctactccagacctcaccataggttggggtcccagtaggaaggctcagggtctgtgccagccctgtcggtgctgctcagaccttcatagcctctcttgtcattctttgttgccccttttctgtcaccagccaaccacatagccttgggaccagcctctctgggggaccagaagtagtgagagaaggaaggggataggcagctttgacaggtgctgctttcaattcctctgcaactcctcccccttttatttccccaatttaaacaaagattctgccaactgtggaaacttcagtccctcaggctggcagccatgccagtacctgcctgggggtggggggtgcctggcagccatgaagcaggctgaaaggcagaggggctccaggtcctgtttccagctcccctcactgcacatggtgaagctcgctccctccctccctcccttcccgcttttcccagagctaatacacaggtgctattattcagaaaaaaactggtcagctctagccaacagtgaggtttcttttcttctgccctaactattgtgtagcctcttatgctgaaatcggcttctgctggcttctccggctttcagagccctgaaacaaagagaaacaggatctgtccctacccagcacagcaaatggttgtagtaattgccaaagccctcataaagccctccggcttgaggagagagtgtatagtcatgggttctgcctctgtgcccttgctggccgcttctcctctgccttctttcctggaactcagggtgtggggactgagcctgtaggggacagcatgccgtcttgctgtggccactcccaagtgtgccctcttccctctttacacatcaggtgtctctggcacaggacttggcactaagctccatgctgagacaccaggctatgtgggcccccaccttgtttcccagcctgcaccttagaagccgaaggtgctttcatcagaaccctaaaatggtcgttgaaggcgcctgggccgcagcccagcagtagttggagaggcaggcagagggcagtggttctcccaaataggagacctggggcctggccaggccagggtttgggcctaatggctttgactaaattacccccatcctccttgcccggaaaagggagagctagagccactcactgtcattctgctctgaccttgaagggggcggtgttggcctggcttctggaatggactgagtccatcgtggaaagggctgggggcaggaggaggtggggaggggcactgcctgcggaaggtaggattagatcattagctcagtgacctcctagggtttcgatgtgctatgttctcatcctacagttggtttggtaatgatctgcaagtcccggagagcaacagcacagctctgcctgacgctctcattaaaatctatgcagccaagctcggcactttgtagcagccggccttgcgaagcctcctcagctcggggggccggggacccagtgagccgagaggccctctgggctccacttatgcatatgcaccaaaaaaaaaaaaaaaaaaaaaaaaaaaaaaaaggcttctttagacccagagccctttaagatgataaaggacccaatgcaggtaatcctgtttttggactcacgtaatgtagaatgcaaagtttagtgattatttaatctgggcctaagctagtgagagtatggaacaatggcccataaggactcctaagcgccgaagccaaggagcctcctcccttcctggttcaccccgcccaagggacctgcccccattcctgtggccctggggcccagcttccaatagtgtcagaagcaacttgtggctttgccttggttgtgagatgggtacattccaaaggagcagcctgggggagggggcaggctcagccagcccttggaggctcagagcagctggcccaggctccagctcgcctccagtggaagcccgagcgccctcagaaacgaccctggccaatgtcaacgcagagccgaggcggtgttgtcacggctaatgtgaaatctcttcccgtggcgcccatcctctgactctgcagtgccagcttggacagattgaggtctctgtggctttggtgaccctgcttaagcattcccaccgtgtcccagctctgctctaggactgcctcccactgcggcccctcacctgacttcagggtatggggagggagggagccagtgctccaaggccagggggctttgctcatgagagatgtcaggcttcctggaggcatcaggctttgagccctgctggggtccaactgacctgggaccaggtgtcgcgcagagatgtgcctcattctgtgcctccttctgtgcctcctaccatgttccctttaactgtgcctcagtgtgggttagggaacaattttgttattgtattaagtttattcagttaattcacttgaggaactaaccagtttttactttctgtctagaatgatgtacatgtagtagagtaagccataatgctcccaaagtgccttgttttctctgatacaaacatatttataaggacatattcctgtgggttcttgggtgtgtttgccacatcaagattttagggaaggggggtatatgtgtagtagggatgccgtttgaaaacaggcactcttcccctgaggatgggaaaggagctcttcagttggagatctaggcagtgggttaagccagacccctaaagtgaccctttcctcttctgccctattcttctcagaccctcagaaagacatccaatttttttaaatccctgtagctccaagcctggtctcatttgcttccctgccaggctcatcgtgtgtataccacatttgtgccccactgacctgaaggttccatgtaactgtatacacatgaatacttaaatgccaacatttaaaataatttgataaagtctttgtagccactcagcca

SEQ ID NO: 199600 - DNA, 4790 bp, Homo sapiens
  Payload ID: 19383
  Gene Name: WAS protein family, member 3
  Uniprot ID: Q9UPY6
  ENST ID: ENST00000335327
  CDS Start-End: 179-1687
gcggccgcggcgcggcgggaccatggagctcagagcgcagccccggcgccggcggcgggaccgcggaccgttttagttttgattgctgttaactactactgataactgagccaaagtggtgatgctacttgaggggaatttctgcaacccatagtcaacgattacatgattgtgaaccatgcctttagtgaagaggaacattgagccccggcacttgtgccggggagctctgcctgaagggattaccagcgaacttgaatgtgtaaccaatagtactcttgccgctatcatacgccagctgagcagtctgagcaaacatgctgaagacatatttggtgagttgtttaatgaggctaacaacttctacatcagagcaaattctcttcaagacagaattgatcgccttgctgtcaaagtcacccagctggattcaacagtggaagaggtctcactacaggatatcaacatgaaaaaagctttcaaaagttccacagtccaagaccagcaagtggtttcaaagaacagcattcctaatcctgttgctgatatttacaaccagagtgataagccaccgcctctgaacatcctgacaccatacagagatgacaagaaggatgggctgaagttctatactgatccttcctatttctttgacctctggaaagaaaaaatgctacaggacacagaagacaaaaggaaagagaaaaggcgtcaaaaggagcaaaagcgtatagatggcaccacccgtgaggtgaaaaaggttagaaaagccagaaacaggcgccaggagtggaatatgatggcatatgacaaagagcttagacccgacaacaggttgtctcagagtgtgtaccatggagcgtcttccgagggatccctgtccccagatactaggtcacatgcatcggacgttacggattactcttacccggctactcccaaccattctctgcacccccagcctgtgaccccttcctatgcagctggtgacgtgccaccacacgggcctgcaagccaggctgcggagcatgagtaccggcccccatctgcctcggcgaggcacatggccctcaacagacctcagcagccgccccccccgcctccccctcaggccccagaggggtcccaggcctctgcaccgatggctccagcagactacgggatgctcccagcgcagataattgagtattacaacccatccggaccacctcctccgccacctcctcctgtgattccctcagcacaaactgccttcgtcagccctctccagatgcccatgcagcccccgttccctgcatcagccagctccacgcacgcagctcctcctcacccaccctccaccgggctcctggtcacagccccgccacccccgggcccaccacctcccccgccaggccctcctggtcccgggtcttctctttcgtcctccccaatgcatggccccccagtagctgaggcgaagcggcaagagcctgcacagccaccaatcagtgatgctcgaagcgacctcctcgctgctattcgaatgggaattcaactgaaaaaggtgcaggagcagcgggagcaggaggccaagcgggagccagtggggaatgacgtggccacgatcctgtcccggcgcattgccgtggagtacagcgactctgacgacgactcagagttcgacgagaacgactggtccgactgagcaaaggccggcggagaggccgcgtgtgggagcgtgttgaagattttaagtggtctctacacccaaatagtggtattctaatcccgtagcatagcaccttttgtataaacaatgtgatattgcttctgcacatccaaaaattctgggtcttttcagtatttactgtgtaatacttaagtgccactaaacatagcaaattgtgctgcacatgaggaaataggctgtcactatcacattgtcctgaaaacagcatctgctttcctcttggccatgagagtatttagtgcagtttgggtttactcttactgatcaatataactctgcagacttgctgtgtgtttgtgaagctgcctggtgttaggtctctgcaagactaatgactatgtcagagtgatgtcttccaaccagtaagtgatattgtttcaccgctttggtttttccttttgtttttttaaaggatgtgtttctgaataagttggttttagagggaaaggttcaacaaacagggagaatccagtgtttctgctttcagtttcttggcttggtagcctctgagtgaatctgatgctctgctgaataatttcattacctctgcacatgcctgtcaaatatgaaattggaagggcccttttcaggctgggttccctgtgggcatttgcttagtaaatgcctgttgatggtttttgcaagagaattcagcagctcaacagtaatgaaagtgaagaacagagtccattttccttcctggggccattggggatgacactcaagatacttgccagtctctccagtgtgggcaccagccggccagaacagatgcgagcagtccatgactctgggagctacaccgctgagctgggcagagctgcggcacagggcctgggctgcaaaggagccctgctcctttagtttcctgacacctgtgtcctgagtgagccgcaggagttcttagctcctcagcgagcaacagagagcactttagatggcacctttcaccacttggtcagaattttaaaagcttaggtttaggtgaaagtagatattgacagctattcacctttcacggtgctggggccagattagggatcactcccgtgaggagggccttcaccctgttctagaagcacatggttgtcctcctgttgttggcacattaaatgataaaaagcacctcatgagattcccttgatcagccctgcagctgtagtacagtgctgtgccctcacctccacccttcctgttgttcccacgtgggcaataccagggacccatggggaaactcaagaatgacagcttctatattttgtaattctggatgaaagataactgtgttgaacaaacaggtgctccaggctttgattatagatacgacttcaaaaatatgctaagacgcttgacttattaaggactttaacctactcaacagtatttcatatccattgtggttagttactcagttatgttgagaagaatctggagctaaaagcagagatgtttgaggtgacggtaggaatgtgagcaggatggtgatgggggtttttgttaaaatgcatctgagcaagtcagccagccccgaagtcccctcagtgtgtgtgtctcgagtggctacctgttgggcttgtgggcagtgattgtacagagcctgtccattgggtgcagtcatgtagatctgaagccctgaaaagcctcatgtctgcatcccctttccaaggctgcttccctggtgtgtctgttctctcctctgtcccaggtgctgggagcgtcctcttcagcgtcttttcctagagctggtcaccactaggctgtcactataaattccttgaatataagtaacagttattaatgaacttctaaatttctaatttctctctctctctcttttttttttttttgttgttgttaaaaagggcctactacattggcgctattcttaggacttctgcaacttttaaagtcttacttgtctttcttgttgcttttgtattaggagttccccgtgtgggtctagaactcccctttggtaatgcttctttgtttttttatggcccttctgttctcaggatggagagaacacagaagctactatccatgtcaggatttattctatttatatcttattacaataaaattagtggcactttattcataaatattcatgagcctgttaattgttagttgtcttcctgtagctgaatcaacaagttattttcaactcaattttatgacttgcgaaaaagcttttgccctgttgtgtaccataacatttaaaagaatggaaaatgactgaaatccaatttagattatttttagagtatttttccagcaaattcaatttattctgaaatttaaatccagatcttttctaatatggtattacaatgaaaagaataaagagaagatttgaattttcagtttcattttcaaaaactatttaccaaaacaaatggagaagaaacatccaaaagcacatttcatttctccaaactttgtgttttaaattatagttataaattgtaaggtaattttaaattgtccctcgtattatttctccacgtctgttttagtttaatgtctcctaagcttttctctcatagcgtagacctagggaagggatgggaagattgcccagtccccgatggctgcgcacacaggaggcggcggagcacaaggcaagtgagtttgcactgtcagccccagaccgtaagcttggctacactgatgtttttctttactaaggatactattcaaaaattaacattttcatctcagtaagtttttagaacatcaaaatgttttctgagctccaagtggctaggttgtaaaagttttataataatttgcaattaaaatacatgatacatattaatccattaaagactagtgggaatgtatcagccagagtagcaagtaatttttgttttataaatcatagtatctgtcatcttgcagtattaccaatgctgttgtaaattgaatttaaagtggtattaaaaaaaactgttaaacaatttttatctgtttgtatatcttactatagattatgtacaagtaacatctaaataaaattacacttttaaccctaagaggttttgcttattaataa

SEQ ID NO: 199601 - DNA, 4823 bp, Homo sapiens
  Payload ID: 19383
  Gene Name: WAS protein family, member 3
  Uniprot ID: Q9UPY6
  ENST ID: ENST00000361042
  CDS Start-End: 226-1725
gtcgctcgcgccgctgcgtgcggtgtggtgcgaggcgggtgcgccgggcggccgcggcgcggcgggaccatggagctcagagcgcagccccggcgccggcggcgggaccgcggaccgttttagttttgattgctgttaactactactgataactgagccaaagtggtgatgctacttgaggggaatttctgcaacccatagtcaacgattacatgattgtgaaccatgcctttagtgaagaggaacattgagccccggcacttgtgccggggagctctgcctgaagggattaccagcgaacttgaatgtgtaaccaatagtactcttgccgctatcatacgccagctgagcagtctgagcaaacatgctgaagacatatttggtgagttgtttaatgaggctaacaacttctacatcagagcaaattctcttcaagacagaattgatcgccttgctgtcaaagtcacccagctggattcaacagtggaagaggtctcactacaggatatcaacatgaaaaaagctttcaaaagttccacagtccaagaccagcaagtggtttcaaagaacagcattcctaatcctgttgctgatatttacaaccagagtgataagccaccgcctctgaacatcctgacaccatacagagatgacaagaaggatgggctgaagttctatactgatccttcctatttctttgacctctggaaagaaaaaatgctacaggacacagaagacaaaaggaaagagaaaaggcgtcaaaagagagagaaacacaagctgaaccctaacagaaaccagcaagtaaatgtgagaaaagtcagaacaagaaaagaagagtgggagagaaggaaaatgggcattgagtttatgagtgacgcaaagaaactggagcaggcagggagcgccaaagaggacagagtgcccagcgggtcacatgcatcggacgttacggattactcttacccggctactcccaaccattctctgcacccccagcctgtgaccccttcctatgcagctggtgacgtgccaccacacgggcctgcaagccaggctgcggagcatgagtaccggcccccatctgcctcggcgaggcacatggccctcaacagacctcagcagccgccccccccgcctccccctcaggccccagaggggtcccaggcctctgcaccgatggctccagcagactacgggatgctcccagcgcagataattgagtattacaacccatccggaccacctcctccgccacctcctcctgtgattccctcagcacaaactgccttcgtcagccctctccagatgcccatgcagcccccgttccctgcatcagccagctccacgcacgcagctcctcctcacccaccctccaccgggctcctggtcacagccccgccacccccgggcccaccacctcccccgccaggccctcctggtcccgggtcttctctttcgtcctccccaatgcatggccccccagtagctgaggcgaagcggcaagagcctgcacagccaccaatcagtgatgctcgaagcgacctcctcgctgctattcgaatgggaattcaactgaaaaaggtgcaggagcagcgggagcaggaggccaagcgggagccagtggggaatgacgtggccacgatcctgtcccggcgcattgccgtggagtacagcgactctgacgacgactcagagttcgacgagaacgactggtccgactgagcaaaggccggcggagaggccgcgtgtgggagcgtgttgaagattttaagtggtctctacacccaaatagtggtattctaatcccgtagcatagcaccttttgtataaacaatgtgatattgcttctgcacatccaaaaattctgggtcttttcagtatttactgtgtaatacttaagtgccactaaacatagcaaattgtgctgcacatgaggaaataggctgtcactatcacattgtcctgaaaacagcatctgctttcctcttggccatgagagtatttagtgcagtttgggtttactcttactgatcaatataactctgcagacttgctgtgtgtttgtgaagctgcctggtgttaggtctctgcaagactaatgactatgtcagagtgatgtcttccaaccagtaagtgatattgtttcaccgctttggtttttccttttgtttttttaaaggatgtgtttctgaataagttggttttagagggaaaggttcaacaaacagggagaatccagtgtttctgctttcagtttcttggcttggtagcctctgagtgaatctgatgctctgctgaataatttcattacctctgcacatgcctgtcaaatatgaaattggaagggcccttttcaggctgggttccctgtgggcatttgcttagtaaatgcctgttgatggtttttgcaagagaattcagcagctcaacagtaatgaaagtgaagaacagagtccattttccttcctggggccattggggatgacactcaagatacttgccagtctctccagtgtgggcaccagccggccagaacagatgcgagcagtccatgactctgggagctacaccgctgagctgggcagagctgcggcacagggcctgggctgcaaaggagccctgctcctttagtttcctgacacctgtgtcctgagtgagccgcaggagttcttagctcctcagcgagcaacagagagcactttagatggcacctttcaccacttggtcagaattttaaaagcttaggtttaggtgaaagtagatattgacagctattcacctttcacggtgctggggccagattagggatcactcccgtgaggagggccttcaccctgttctagaagcacatggttgtcctcctgttgttggcacattaaatgataaaaagcacctcatgagattcccttgatcagccctgcagctgtagtacagtgctgtgccctcacctccacccttcctgttgttcccacgtgggcaataccagggacccatggggaaactcaagaatgacagcttctatattttgtaattctggatgaaagataactgtgttgaacaaacaggtgctccaggctttgattatagatacgacttcaaaaatatgctaagacgcttgacttattaaggactttaacctactcaacagtatttcatatccattgtggttagttactcagttatgttgagaagaatctggagctaaaagcagagatgtttgaggtgacggtaggaatgtgagcaggatggtgatgggggtttttgttaaaatgcatctgagcaagtcagccagccccgaagtcccctcagtgtgtgtgtctcgagtggctacctgttgggcttgtgggcagtgattgtacagagcctgtccattgggtgcagtcatgtagatctgaagccctgaaaagcctcatgtctgcatcccctttccaaggctgcttccctggtgtgtctgttctctcctctgtcccaggtgctgggagcgtcctcttcagcgtcttttcctagagctggtcaccactaggctgtcactataaattccttgaatataagtaacagttattaatgaacttctaaatttctaatttctctctctctctcttttttttttttttgttgttgttaaaaagggcctactacattggcgctattcttaggacttctgcaacttttaaagtcttacttgtctttcttgttgcttttgtattaggagttccccgtgtgggtctagaactcccctttggtaatgcttctttgtttttttatggcccttctgttctcaggatggagagaacacagaagctactatccatgtcaggatttattctatttatatcttattacaataaaattagtggcactttattcataaatattcatgagcctgttaattgttagttgtcttcctgtagctgaatcaacaagttattttcaactcaattttatgacttgcgaaaaagcttttgccctgttgtgtaccataacatttaaaagaatggaaaatgactgaaatccaatttagattatttttagagtatttttccagcaaattcaatttattctgaaatttaaatccagatcttttctaatatggtattacaatgaaaagaataaagagaagatttgaattttcagtttcattttcaaaaactatttaccaaaacaaatggagaagaaacatccaaaagcacatttcatttctccaaactttgtgttttaaattatagttataaattgtaaggtaattttaaattgtccctcgtattatttctccacgtctgttttagtttaatgtctcctaagcttttctctcatagcgtagacctagggaagggatgggaagattgcccagtccccgatggctgcgcacacaggaggcggcggagcacaaggcaagtgagtttgcactgtcagccccagaccgtaagcttggctacactgatgtttttctttactaaggatactattcaaaaattaacattttcatctcagtaagtttttagaacatcaaaatgttttctgagctccaagtggctaggttgtaaaagttttataataatttgcaattaaaatacatgatacatattaatccattaaagactagtgggaatgtatcagccagagtagcaagtaatttttgttttataaatcatagtatctgtcatcttgcagtattaccaatgctgttgtaaattgaatttaaagtggtattaaaaaaaactgttaaacaatttttatctgtttgtatatcttactatagattatgtacaagtaacatctaaataaaattacacttttaaccctaagaggttttgcttatt

SEQ ID NO: 199602 - DNA, 5101 bp, Homo sapiens
  Payload ID: 19384
  Gene Name: WAS protein homolog associated with actin, golgi membranes and microtubules
  Uniprot ID: Q8TF30
  ENST ID: ENST00000286760
  CDS Start-End: 100-2529
ctagcgaaaaatgatttggctcggactgtcccgtgacaggcggtgcgaggaggccaggcccgcgcccgccgagccctagggccgctgctgccgacagccatggaggacgagcagcctgacagcctggagggctgggtgccggtccgggagggcctcttcgccgagcccgagaggcaccggctgcgcttcctggtggcctggaacggcgcggagggcaagttcgctgtgacttgtcacgaccgtaccgcgcagcagcggcggctgcgcgagggggcccggttggggcccgagcccgagcccaagcctgaggccgccgtctccccgtccagctgggccggcctgctctcggccgcggggctccgcggcgcgcaccggcagttggcggcgctgtggccgcctctggagcgctgcttcccgcggctgccgccggagctggacgtgggcggcggcggggcctggggtctggggctcgggctgtgggcgctgctgtggccgacgcgcgcgggtcccggcgaggcggcgctgcaggagctgtgcgggcagctggaacgctatctgggcgcggcggccgacggctgcggcggcgccacagtgcgcgacgcactcttcccggctgagggcggcgcggccgactgcgaaagcccgcgcgagttccgggagcgggccttgcgcgcgcggtgggtcgaggcggacgcgcggctgcgccaggttattcaaggacacggaaaagccaacaccatggtagcattaatgaacgtttaccaagaggaagatgaagcataccaggaattggttaccgtggcaaccatgttcttccagtacttattgcagccatttagggctatgcgagaagttgcaactttatgtaagcttgatattttgaagtctttggatgaggatgacctaggtcctagaagggtagttgccctggagaaagaagctgaagaatggaccagacgggctgaagaagctgtcgtctctattcaggatatcacagtgaattattttaaggagacagtaaaagcattagcaggaatgcagaaagaaatggaacaggatgcgaagagatttggtcaggctgcctgggccacagcaattcccaggttggaaaaacttcagctaatgctagctcgagagactctgcaactcatgagagcgaaagagttgtgtttaaatcacaaaagagctgaaattcagggaaagatggaagatcttccagaacaagaaaaaaatacaaatgttgtagatgaattagaaatacaattttatgaaattcaattagaactatatgaagttaaatttgagatattaaaaaacgaagaaatactgcttactacacagttggactctcttaaaagacttataaaagaaaaacaagatgaagttgtctattacgatccatgtgaaaatccagaggaacttaaagtcattgactgtgtggtggggctgcaggatgataagaatttggaagtgaaagaactcagaaggcagtgccagcagctggagtctaaacggggcaggatctgtgccaaaagagcctctctccggagtagaaaggatcagtgcaaagaaaatcatcggttcagattgcaacaggctgaagaaagcataagatactctcgtcagcatcacagtattcagatgaaaagagacaagataaaagaagaggagcaaaagaaaaaagaatggatcaaccaagaacgtcaaaaaacactccaacgattgagatcatttaaagataaacgcctagctcaatctgtccgaaacacctctggctcagaacctgtggctccaaacctgccaagtgatctttcccagcagatgtgcttgccagcttcccacgcggtgtcagtaattcacccgtcctctaggaaaactagaggtgttcccctatcggaagctggtaatgtgaaaagccccaagtgtcaaaactgtcatggaaatatccctgtccaggtttttgttccagttggtgatcaaacacattccaaatccagtgaggaattgtcactgccaccacctcctcctcctccaccaccaccaccgccgccaccgccgcccccaccccctcctctccgtgctctgtcctcatcctctcaagctgcaactcatcagaacttaggcttccgggctccagtgaaagatgaccagccacgtcctctagtgtgcgaatcacctgctgagcgaccacgtgactccttggaaagtttttcatgtccaggatctatggatgaagtgttggcctccttaaggcatggcagagctcctctccggaaggtggaagtgccggcggtgcgccctccccacgcctcaatcaatgagcacattctggctgccataaggcaaggggtcaaactgaagaaagttcaccctgatcttggcccaaaccccagcagcaaaccaaccagcaacagacgcaccagtgaccttgagaggagcatcaaggctgcgctccagagaatcaagagggtgtctgctgactctgaggaggacagtgatgagcaggaccctggccagtgggatggttaggctcaagtttgacaaaggcacctgccacagtaggcttgaataaagtgggtgagtcttagacctatcgaaaagcatactaacagggtgctgatagatgggccacataacaccccggaagatcagcagggccttgtgtaggctgctgcagcattttttttttttttcttttttgagatggagtctcactctgtcgcccaggctggggtgcagtggcgccatctcggctcaccgcaagctccgcttcccaggctggggtgcagtggtgcgatcttggctcactgcaagctccgcctcctgggttcacgccattctcctgcctcagcctcccgagtagctgggactacaggcgccaccaccttgcccaactaattttttgtattttttagtagagacgaggtttcaccgtgttagccaggatggtctcgatcttctgacctcgtgatccgcctgcctcagactcccaaagtgctgggattacaggtgtgagccaccacgcccagccttttttttttctttcttttgagacagaatctctctgtcatccaggctagagtgcagtggcacgatcttggcttactgcaacctccacctcccaggttcaagcaattctctgtctcagcctcccgagtagctgggattacaggcatgcaccaccacgcctggctaatttttgtatatttaagtagagacaaggtttcgctatgttggccaggctggtcttgaactcctgacctcgtgatccacctgccttggccacccaaagtgttgggattataggcatgagccaccgtgcctggctgatgctggagcttttatgtgacatggtgactcttaaaactggggagggacgtagagatgagagtttcacacaccagcccataggtgggatgtcaagacccatcggaagtgtcgctggcctaagagaagagcacttatttctcaccatggctgatctagaattgttccctgattctgaaagaagtttacactacactggtaagcagtactattagactactgactgtggccttctgtgcatatggaataatgatttctcagatttgtaggcttgaatgtgaatgttattttatcagtaatcagaataaattgcttatattcaggagttattttaaatatttaaatgaaatttattttaggcaccaagcactacataaactcataataactatttgcaatgcattagcatcactcacggggtaatgaaaacataccttagctgctgtaaaagcaaagtcttccgtgtccgggtgggctgaaagtttttaataaaattttagctaaacatttgtttaagtgaatactaaggatggagcaatagtgttattttcctcaggaactgaagtctcatgctgaagtattttctccttaaaattaaatttttaaaatcagggaaggggaagggactgatgcaaagcagtccgttcatttctcagactgcgagcatccctactaacctcatcaccctcactctggtgatattactcctgggtctccacagaacaaaaggaacgcacctcgtttacaaagaaagtcctgattgatatagaacagaaatcttcctacttcagtttttttgtttttttttttgagacagagtcttgctctgtcaaccaggctggagtgcggtggcacgatctcagctcactgcaacctctgcctcctgggttcaagtgattctcctgcctcagcctctcgagtagctgggactacaggcgtgtgccaccacacccagctaatttttatatttttagtagagatggggtttcaccatgttggcaggatggtctcgatctcttgacctcgtgatcctcccaccttggcctcccaaatgctgggggttacaggcgtgagccaccacacctggccttccagtgtcttaactaactggtacacagcagcctgaggggcctcagttggcacagctgggaggggcgtgagtccctttcagcagctgcagcctgggtctccctctgtggcatggccactgccaggtttcccagccactgccaggttgcccacgggtctgtcatgtgtgctaccttttcagaatgcaaatccaactcctgtgtatgaatgaatgtgcctcactgtgctggcccaggcctgatgggccaagccctgactctgcactggcccctgtacctgccgctcccacccaggttcccaggggtgttccagtgggggacgcaacctgcgggctactcgctgggcatcaggtccagatcccagagacaggtccagtggctgtggcccaggcctccttccccaccacagacaggccaggctcagcatcaaacttcctagggaaagaatttggaattgaaaaagtagcaaaatcacaactttgtgggacttttcttatgcatattttgcagtttggcattgtttgtaattacgtatttataatttcagtattttgagataccagcgagcttaatcaggctaaaataattctcagaatttgctttctaagggctgccaaacacaagaggcctttgaaaaaaggatccttttcaaaagaacgttctcacaataaaaattcctggcccaa

SEQ ID NO: 199603 - DNA, 3028 bp, Homo sapiens
  Payload ID: 19385
  Gene Name: WAS/WASL interacting protein family, member 1
  Uniprot ID: O43516
  ENST ID: ENST00000272746
  CDS Start-End: 165-1697
gcagcctcccggcgctgagcgcttttcctgcccgcccggctcagccctgcggaccccgggagaagtttcccagaaaaaatgcccagcgcggcgcggggctgcggagtcgtccggagccgctgcgcgatttatcagcaagactgttgaacgcataactgcccaagatgcctgtccctccccctccagcacccccgccgcccccgacgtttgcactggccaatacagagaagcctaccttgaataagacagagcaggctgggagaaatgctctcctttctgatatcagcaaagggaagaaactaaagaagacggtcaccaatgacagaagtgcaccaatactggacaaacctaaaggagctggtgctggaggcggtggtggtggctttggtggaggcggcggatttggcggaggaggtggtggcggaggcggtggaagttttggagggggcggacctccaggtctgggaggattgttccaggctggaatgccgaagctgagatccacggccaacagggataatgattctggaggaagccgaccaccattgttgccaccgggaggaagatccacatctgcgaaacccttttcacccccaagtggcccagggaggtttcctgtgccttctccaggccacagaagtggtcccccagagcctcagaggaaccgaatgccgcccccaaggcccgacgtgggctcaaagcctgatagcattcctcctccagtacctagtactccaagacccattcaatcaagtccgcacaaccgggggtccccaccagtgcccggaggccccaggcagcccagccccgggcccactcctccccctttccctggaaaccgcggcactgctttgggaggaggctcaatacgtcagtcccccttgagctcctcctcgcccttctccaaccggcctcccctgccgcctacccccagcagggccttggatgacaaaccccctccaccacctcctccagtgggcaacaggccctccatccacagggaagcggttccccctcctcctcctcagaacaacaagcctccagtgccttccactccgcggccttcggcctcctcacaggccccacctccgccgccacctcccagcaggcccgggccgcctcctctgcctccaagttccagcggcaatgacgaaaccccaagactcccacagcggaatctgtccctcagttcgtccacgcccccgttaccttcgccaggacgttcaggtcctcttcctcccccgcccagtgagagacccccacctccagtgagggacccgccaggccgatcaggccccctcccaccacctcctccagtaagcagaaacggcagcacatctcgggccctgcctgctacccctcagttgccatccaggagtggagtagacagtcccaggagtggacccaggcctccccttcctcctgataggcccagtgctggggcacctcccccacctccaccatcaacatctattagaaatggcttccaagactctccatgtgaagatgagtgggaaagcagattctacttccatccgatttccgatttgccacctccagagccatatgtacaaacgaccaaaagttatcccagcaaactggcaagaaacgaaagccggagtggatccaaccgaagagaaaggggtgctccaccactccctcccatcccgagaccacctaagcaagctgctgagtaagggctcactggaaacttgcagtcacaggatgtccaatctttggcagtccgagcttggctctaggacagagctgtccaatagaaatataatgtgagccccatatacaatttttacatttctaatatattttaaacaagtgaagttaatatgcatccaaaatatttcaacctgtaatcaacataaaattttaatgagatattttatattattttttggtactgaatcttcaaaatccagagtgtattttacacttaccgcacatctccattcagactagtcacatttttaagtgctcagtagccacatgtggctggtggctactggattagacagcacgagtctggaagatggaagctagtgcagaaacctcttgtttaaaaaacaaaaaaggcaagatgggcttgagcgattcaagaggcaactaaaaataaaattaggacccagcaccttgtttgacacacagtttgaccttcgattttcctcccttaacttccctcttcccttaatatctgtatacaagtgttgcttcaaagtaccaaggtcagaaattgattgagtacggtttactaaagtcatgtggaataaagccattggaaacaaatggaaagcctgtcgggacttctgggctcagaaccagctggctcacgcactccacttgtcagctggacttctgccttgtgaaatggaagcagcctttgttcctttctggctgagcaagctcctgaggctgggagagactaggaaggcttggtaggaggggaaaaaagtcaggaaaatatatcaaatcagaaacatggaagaagaagggaaccgatttgagttggtgggcaaaactctaaaaatctaaatctgatgcttatgtaagggttgagcgaattagggagattgctagtggaaattggagggaatttgttttgcatcatttgtctaggatctatgcaaatatagctccactaaaggaccatagggaagagccagccttgccttttcttatatgattttgtttacaaaattttactgggacttttaaatctagctatagagttgggaaaaaatatttccacttagatattttacatggttttgtttaaaattaccattacttgttttttaaaaacacatgaccacatatgtatatgtatatctacctaaacattgtatcatggtttcagtatgttattcatgtattactgggagatgctaccaagaaaccaacccaaagaaaattctgaaaaatacatttctatttatagaataaatgtttcatttatataaaagcaaaagaacttagagttctaataaatgggatgtctaataaattatgaagttac

SEQ ID NO: 199604 - DNA, 2003 bp, Homo sapiens
  Payload ID: 19385
  Gene Name: WAS/WASL interacting protein family, member 1
  Uniprot ID: O43516
  ENST ID: ENST00000359761
  CDS Start-End: 149-1660
gagcgcttttcctgcccgcccggctcagccctgcggaccccgggagaagtttcccagaaaaaatgcccagcgcggcgcggggctgcggagtcgtccggagccgctgcgcgatttatcagcaagactgttgaacgcataactgcccaagatgcctgtccctccccctccagcacccccgccgcccccgacgtttgcactggccaatacagagaagcctaccttgaataagacagagcaggctgggagaaatgctctcctttctgatatcagcaaagggaagaaactaaagaagacggtcaccaatgacagaagtgcaccaatactggacaaacctaaaggagctggtgctggaggcggtggtggtggctttggtggaggcggcggatttggcggaggaggtggtggcggaggcggtggaagttttggagggggcggacctccaggtctgggaggattgttccaggctggaatgccgaagctgagatccacggccaacagggataatgattctggaggaagccgaccaccattgttgccaccgggaggaagatccacatctgcgaaacccttttcacccccaagtggcccagggaggtttcctgtgccttctccaggccacagaagtggtcccccagagcctcagaggaaccgaatgccgcccccaaggcccgacgtgggctcaaagcctgatagcattcctcctccagtacctagtactccaagacccattcaatcaagtccgcacaaccgggggtccccaccagtgcccggaggccccaggcagcccagccccgggcccactcctccccctttccctggaaaccgcggcactgctttgggaggaggctcaatacgtcagtcccccttgagctcctcctcgcccttctccaaccggcctcccctgccgcctacccccagcagggccttggatgacaaaccccctccaccacctcctccagtgggcaacaggccctccatccacagggaagcggttccccctcctcctcctcagaacaacaagcctccagtgccttccactccgcggccttcggcctcctcacaggccccacctccgccgccacctcccagcaggcccgggccgcctcctctgcctccaagttccagcggcaatgacgaaaccccaagactcccacagcggaatctgtccctcagttcgtccacgcccccgttaccttcgccaggacgttcaggtcctcttcctcccccgcccagtgagagacccccacctccagtgagggacccgccaggccgatcaggccccctcccaccacctcctccagtaagcagaaacggcagcacatctcgggccctgcctgctacccctcagttgccatccaggagtggagtagacagtcccaggagtggacccaggcctccccttcctcctgataggcccagtgctggggcacctcccccacctccaccatcaacatctattagaaatggcttccaagactctccatgtgaagatgagtgggaaagcagattctacttccatccgatttccgatttgccacctccagagccatatgtacaaacgaccaaaagttatcccagcaaactggcaagaaacgaaagccggagtggatccaaccgaagagaaaggggtgctccaccactccctcccatcccgaggtgatctttgcctgctcttctctacccaagctcaagagctgcttctgttgctatctaagaactgcataccctcctccctgcttcttcccttgtgcctcatgtatgggcaggaggaaaggtgggagggggagtgggaatatgcgtgtgtgggtgggaatcggtaagaaatgcacctagcttttcatattgtgtttattctccaggctattgcttgcttcagctgcagcctgcctgtgctggctgctggggtcgataggcttttgtcgtaataggcagagatgacttgcatcccagctttccaccaaccaaattcaaacattcactgcttatttgttacagactgtaat

SEQ ID NO: 199605 - DNA, 2180 bp, Homo sapiens
  Payload ID: 19385
  Gene Name: WAS/WASL interacting protein family, member 1
  Uniprot ID: O43516
  ENST ID: ENST00000392546
  CDS Start-End: 333-1844
gaagaagcccttagcctaatgaagcgataaggtaagcaaaggaggaaggaacaacaaacaacaaattaatcagacaggaagcgaataaccacagaaggacgtctgcctctgactcagtatgtcacatttaacaagaggccagagcttgtccaaaatggctgtccaaaaacgaccccacacttgcgttagaagatgatacctttttcagggacagttttctctcttggctcctgtcccgctggccctctgtctgcctgtgtccctgaccatggctccctgcagtaccctttaacgatttatcagcaagactgttgaacgcataactgcccaagatgcctgtccctccccctccagcacccccgccgcccccgacgtttgcactggccaatacagagaagcctaccttgaataagacagagcaggctgggagaaatgctctcctttctgatatcagcaaagggaagaaactaaagaagacggtcaccaatgacagaagtgcaccaatactggacaaacctaaaggagctggtgctggaggcggtggtggtggctttggtggaggcggcggatttggcggaggaggtggtggcggaggcggtggaagttttggagggggcggacctccaggtctgggaggattgttccaggctggaatgccgaagctgagatccacggccaacagggataatgattctggaggaagccgaccaccattgttgccaccgggaggaagatccacatctgcgaaacccttttcacccccaagtggcccagggaggtttcctgtgccttctccaggccacagaagtggtcccccagagcctcagaggaaccgaatgccgcccccaaggcccgacgtgggctcaaagcctgatagcattcctcctccagtacctagtactccaagacccattcaatcaagtccgcacaaccgggggtccccaccagtgcccggaggccccaggcagcccagccccgggcccactcctccccctttccctggaaaccgcggcactgctttgggaggaggctcaatacgtcagtcccccttgagctcctcctcgcccttctccaaccggcctcccctgccgcctacccccagcagggccttggatgacaaaccccctccaccacctcctccagtgggcaacaggccctccatccacagggaagcggttccccctcctcctcctcagaacaacaagcctccagtgccttccactccgcggccttcggcctcctcacaggccccacctccgccgccacctcccagcaggcccgggccgcctcctctgcctccaagttccagcggcaatgacgaaaccccaagactcccacagcggaatctgtccctcagttcgtccacgcccccgttaccttcgccaggacgttcaggtcctcttcctcccccgcccagtgagagacccccacctccagtgagggacccgccaggccgatcaggccccctcccaccacctcctccagtaagcagaaacggcagcacatctcgggccctgcctgctacccctcagttgccatccaggagtggagtagacagtcccaggagtggacccaggcctccccttcctcctgataggcccagtgctggggcacctcccccacctccaccatcaacatctattagaaatggcttccaagactctccatgtgaagatgagtgggaaagcagattctacttccatccgatttccgatttgccacctccagagccatatgtacaaacgaccaaaagttatcccagcaaactggcaagaaacgaaagccggagtggatccaaccgaagagaaaggggtgctccaccactccctcccatcccgaggtgatctttgcctgctcttctctacccaagctcaagagctgcttctgttgctatctaagaactgcataccctcctccctgcttcttcccttgtgcctcatgtatgggcaggaggaaaggtgggagggggagtgggaatatgcgtgtgtgggtgggaatcggtaagaaatgcacctagcttttcatattgtgtttattctccaggctattgcttgcttcagctgcagcctgcctgtgctggctgctggggtcgataggcttttgtcgtaataggcagagatgacttgcatcccagctttccaccaaccaaattcaaacattcactgcttatttgttacaga

SEQ ID NO: 199606 - DNA, 4587 bp, Homo sapiens
  Payload ID: 19385
  Gene Name: WAS/WASL interacting protein family, member 1
  Uniprot ID: O43516
  ENST ID: ENST00000392547
  CDS Start-End: 101-1612
ggctagaagacagcaggggaactcgagaagttggttgttttcagcagattaaaacaatacagatttatcagcaagactgttgaacgcataactgcccaagatgcctgtccctccccctccagcacccccgccgcccccgacgtttgcactggccaatacagagaagcctaccttgaataagacagagcaggctgggagaaatgctctcctttctgatatcagcaaagggaagaaactaaagaagacggtcaccaatgacagaagtgcaccaatactggacaaacctaaaggagctggtgctggaggcggtggtggtggctttggtggaggcggcggatttggcggaggaggtggtggcggaggcggtggaagttttggagggggcggacctccaggtctgggaggattgttccaggctggaatgccgaagctgagatccacggccaacagggataatgattctggaggaagccgaccaccattgttgccaccgggaggaagatccacatctgcgaaacccttttcacccccaagtggcccagggaggtttcctgtgccttctccaggccacagaagtggtcccccagagcctcagaggaaccgaatgccgcccccaaggcccgacgtgggctcaaagcctgatagcattcctcctccagtacctagtactccaagacccattcaatcaagtccgcacaaccgggggtccccaccagtgcccggaggccccaggcagcccagccccgggcccactcctccccctttccctggaaaccgcggcactgctttgggaggaggctcaatacgtcagtcccccttgagctcctcctcgcccttctccaaccggcctcccctgccgcctacccccagcagggccttggatgacaaaccccctccaccacctcctccagtgggcaacaggccctccatccacagggaagcggttccccctcctcctcctcagaacaacaagcctccagtgccttccactccgcggccttcggcctcctcacaggccccacctccgccgccacctcccagcaggcccgggccgcctcctctgcctccaagttccagcggcaatgacgaaaccccaagactcccacagcggaatctgtccctcagttcgtccacgcccccgttaccttcgccaggacgttcaggtcctcttcctcccccgcccagtgagagacccccacctccagtgagggacccgccaggccgatcaggccccctcccaccacctcctccagtaagcagaaacggcagcacatctcgggccctgcctgctacccctcagttgccatccaggagtggagtagacagtcccaggagtggacccaggcctccccttcctcctgataggcccagtgctggggcacctcccccacctccaccatcaacatctattagaaatggcttccaagactctccatgtgaagatgagtgggaaagcagattctacttccatccgatttccgatttgccacctccagagccatatgtacaaacgaccaaaagttatcccagcaaactggcaagaaacgaaagccggagtggatccaaccgaagagaaaggggtgctccaccactccctcccatcccgaggtgatctttgcctgctcttctctacccaagctcaagagctgcttctgttgctatctaagaactgcataccctcctccctgcttcttcccttgtgcctcatgtatgggcaggaggaaaggtgggagggggagtgggaatatgcgtgtgtgggtgggaatcggtaagaaatgcacctagcttttcatattgtgtttattctccaggctattgcttgcttcagctgcagcctgcctgtgctggctgctggggtcgataggcttttgtcgtaataggcagagatgacttgcatcccagctttccaccaaccaaattcaaacattcactgcttatttgttacagactgtaattattaaagtccctgagagctgttttctcccgttcctttttcgcatgcttggcctcctctctgtttctatgaaccacagaccacctaagcaagctgctgagtaagggctcactggaaacttgcagtcacaggatgtccaatctttggcagtccgagcttggctctaggacagagctgtccaatagaaatataatgtgagccccatatacaatttttacatttctaatatattttaaacaagtgaagttaatatgcatccaaaatatttcaacctgtaatcaacataaaattttaatgagatattttatattattttttggtactgaatcttcaaaatccagagtgtattttacacttaccgcacatctccattcagactagtcacatttttaagtgctcagtagccacatgtggctggtggctactggattagacagcacgagtctggaagatggaagctagtgcagaaacctcttgtttaaaaaacaaaaaaggcaagatgggcttgagcgattcaagaggcaactaaaaataaaattaggacccagcaccttgtttgacacacagtttgaccttcgattttcctcccttaacttccctcttcccttaatatctgtatacaagtgttgcttcaaagtaccaaggtcagaaattgattgagtacggtttactaaagtcatgtggaataaagccattggaaacaaatggaaagcctgtcgggacttctgggctcagaaccagctggctcacgcactccacttgtcagctggacttctgccttgtgaaatggaagcagcctttgttcctttctggctgagcaagctcctgaggctgggagagactaggaaggcttggtaggaggggaaaaaagtcaggaaaatatatcaaatcagaaacatggaagaagaagggaaccgatttgagttggtgggcaaaactctaaaaatctaaatctgatgcttatgtaagggttgagcgaattagggagattgctagtggaaattggagggaatttgttttgcatcatttgtctaggatctatgcaaatatagctccactaaaggaccatagggaagagccagccttgccttttcttatatgattttgtttacaaaattttactgggacttttaaatctagctatagagttgggaaaaaatatttccacttagatattttacatggttttgtttaaaattaccattacttgttttttaaaaacacatgaccacatatgtatatgtatatctacctaaacattgtatcatggtttcagtatgttattcatgtattactgggagatgctaccaagaaaccaacccaaagaaaattctgaaaaatacatttctatttatagaataaatgtttcatttatataaaagcaaaagaacttagagttctaataaatgggatgtctaataaattatgaagttactgatttgaatatattatatttctataacttccttgccaaagtcctgatttagtacattagagaacctgtgtttcctctctcctctaccattcatctctcttccatacagtcatttgggctttttactcaaagagaatcaagaaataataaggtataacaagcttggcaaagtgttggctttttaaaaaaaaatttttttaatctctagcagtttggtaatttagcagcatcatttatttgggattcttttatctgatttcaacagtgaaaaacatccctatgataaagcctaatgacccatttcacaaaagatggaatttgcccttcctagaaaatatgacggagaaaagtctgactcagagaaagtgggtctgaattttataaggggtagtaagaattggacaattcctttgcatatctgaacttggcaggtaccgttctaaatctgaaacagggtgatagctcaaagttgccattcatccagaatagattgttttagaatgtagtgtttaagtgactgtttcattaatacacctacaccctttctttgaaagtttgcaacctaattgcatctaaaactatgaataagttctgtggtaaaatcttaaactatggaaaattacaaaaatgaatttttcttccctgaaatcagagcttacatgtgtgtttttttataacattttcagataaatgtattcaacatgtaatacagtattttaacattcacctcttattttatattgaaatgtattacagtattaaaactcagtgttcagtatttatttcactatgcattttatttagtaaaagccaggagaaatgtttaatccaatggtgccttactttgtgatttaaaagaaatcaacttttttttatgtctaagtagtagattatttgcatatttgtaaaaactgttaggtctttatattttaaagtgtaataccagttttgttattttagtagcagaaatgggatgattgttaaagttccccaaaaatgttggcatgaaattaatttttccctccttatagtcaaggaccgtagaggaagaaaaacttttttttcataccatgcactatgtaaacagacacattttgctatctgtgtcatcaggatagtgtaagtggtagggtagagactaccctagacatctgcatctttgtaagttagccagacaataaagaaaagcagaatgata

SEQ ID NO: 199607 - DNA, 2568 bp, Homo sapiens
  Payload ID: 19385
  Gene Name: WAS/WASL interacting protein family, member 1
  Uniprot ID: O43516
  ENST ID: ENST00000409891
  CDS Start-End: 204-1685
aacaagaggccagagcttgtccaaaatggctgtccaaaaacgaccccacacttgcgttagaagatgatacctttttcagggacagttttctctcttggctcctgtcccgctggccctctgtctgcctgtgtccctgaccatggctccctgcagtaccctttaacgatttatcagcaagactgttgaacgcataactgcccaagatgcctgtccctccccctccagcacccccgccgcccccgacgtttgcactggccaatacagagaagcctaccttgaataagacagagcaggctgggagaaatgctctcctttctgatatcagcaaagggaagaaactaaagaagacggtcaccaatgacagaagtgcaccaatactggacaaacctaaaggagctggtgctggaggcggtggtggtggctttggtggaggcggcggatttggcggaggaggtggtggcggaggcggtggaagttttggagggggcggacctccaggtctgggaggattgttccaggctggaatgccgaagctgagatccacggccaacagggataatgattctggaggaagccgaccaccattgttgccaccgggaggaagatccacatctgcgaaacccttttcacccccaagtggcccagggaggtttcctgtgccttctccaggccacagaagtggtcccccagagcctcagaggaaccgaatgccgcccccaaggcccgacgtgggctcaaagcctgatagcattcctcctccagtacctagtactccaagacccattcaatcaagtccgcacaaccgggggtccccaccagtgcccggaggccccaggcagcccagccccgggcccactcctccccctttccctggaaaccgcggcactgctttgggaggaggctcaatacgtcagtcccccttgagctcctcctcgcccttctccaaccggcctcccctgccgcctacccccagcagggccttggatgacaaaccccctccaccacctcctccagtgggcaacaggccctccatccacagggaagcggttccccctcctcctcctcagaacaacaagcctccagtgccttccactccgcggccttcggcctcctcacaggccccacctccgccgccacctcccagcaggcccgggccgcctcctctgcctccaagttccagcggcaatgacgaaaccccaagactcccacagcggaatctgtccctcagttcgtccacgcccccgttaccttcgccaggacgttcaggtcctcttcctcccccgcccagtgagagacccccacctccagtgagggacccgccaggccgatcaggccccctcccaccacctcctccagtaagcagaaacggcagcacatctcgggccctgcctgctacccctcagttgccatccaggagtggagtagacagtcccaggagtggacccaggcctccccttcctcctgataggcccagtgctggggcacctcccccacctccaccatcaacatctattagaaatggcttccaagactctccatgtgaagatgagtgggaaagcagattctacttccatccgatttccgatttgccacctccagagccatatgtacaaacgaccaaaagttatcccagcaaactggcaagaaacgaaagccggagtgagtatttctgccaaggtttttgaagattcacgcttgagtagcctgagtgacactcgggctatatagaaagtccaggcttcttgcctggagtggggtagagaaccctttggagccatctacattctagtaaattccccttccacaggcagtgaggaaattgcagatgcccagaatgcatatgagaaacagttattttaatgtgtcattacaagctcaaaataccgtggtttgctagtattaaattttattattttacttctttggacgtcttcctctgttttcatcttcctgagacagcacaagtagagccatcttctattccttctagttttgaaattggcataatgtctgattaattataacaaaaactccctttaactgccttgatcttttaaacgtattgtaatcatagctttacagagcattacatgaaaatgtaaatatatccataatctctccacataatagatattttcattttaccagattctcatccaattttttatccatataattctgtttttttatgtagttataatgacgatgtacagttttttggcggggtttacataacattgcttagtaaatagtgcccatgttatcacatggtttttatttcagcatatagtaatttaccattaccatggacatttaaattatttctgttgttctgctaatgtaggtaatgctaccataaagaactaaattgcttttcctccattgaagaagaatgtcaacaagaaaggaaaaatagacaaactggaattttataacagtaaatgtataggaagtgttacagctctttgagaatttgtctagcaggctttccagggttttgctggaaagcctctgaaatttacttttaaaaaaacacaatagctgggcatggtggctcacgcctgtaat

SEQ ID NO: 199608 - DNA, 777 bp, Homo sapiens
  Payload ID: 19385
  Gene Name: WAS/WASL interacting protein family, member 1
  ENST ID: ENST00000410117
  CDS Start-End: 208-603
atttaacaagaggccagagcttgtccaaaatggctgtccaaaaacgaccccacacttgcgttagaagatgatacctttttcagggacagttttctctcttggctcctgtcccgctggccctctgtctgcctgtgtccctgaccatggctccctgcagtaccctttaacgatttatcagcaagactgttgaacgcataactgcccaagatgcctgtccctccccctccagcacccccgccgcccccgacgtttgcactggccaatacagagaagcctaccttgaataagacagagcaggctgggagaaatgctctcctttctgatatcagcaaagggaagaaactaaagaagacggtcaccaatgacagaagtgcaccaatactggacaaacctaaaggagctggtgctggaggcggtggtggtggctttggtggaggcggcggatttggcggaggaggtggtggcggaggcggtggaagttttggagggggcggacctccaggtctgggaggattgttccaggctggaatgccgaagctgagatccacggccaacagggataatgggttagctggagtgggaagaaaagggaggagcaaatagaacttgctggccctggaaatctgcctggtgacctgacagattcagctttctttgtgaggtagcccagctgtctagtagagtaaatacttgtgagccgcttttcaaacacgatggagcacatcttgtggaatatgattacaaatctcactaaatctgaaaaagtgttttgcatga

SEQ ID NO: 199609 - DNA, 1772 bp, Homo sapiens
  Payload ID: 19385
  Gene Name: WAS/WASL interacting protein family, member 1
  ENST ID: ENST00000409415
  CDS Start-End: 137-1348
tgcccgcccggctcagccctgcggaccccgggagaagtttcccagaaaaaatgcccagcgcggcgcggggctgcggagtcgtccggagccgctgcgcgatttatcagcaagactgttgaacgcataactgcccaagatgcctgtccctccccctccagcacccccgccgcccccgacgtttgcactggccaatacagagaagcctaccttgaataagacagagcaggctgggagaaatgctctcctttctgatatcagcaaagggaagaaactaaagaagacggtcaccaatgacagaagtgcaccaatactggacaaacctaaaggagctggtgctggaggcggtggtggtggctttggtggaggcggcggatttggcggaggaggtggtggcggaggcggtggaagttttggagggggcggacctccaggtctgggaggattgttccaggctggaatgccgaagctgagatccacggccaacagggataatgattctggaggaagccgaccaccattgttgccaccgggaggaagatccacatctgcgaaacccttttcacccccaagtggcccagggaggtttcctgtgccttctccaggccacagaagtggtcccccagagcctcagaggaaccgaatgccgcccccaaggcccgacgtgggctcaaagcctgatagcattcctcctccagtacctagtactccaagacccattcaatcaagtccgcacaaccgggggtccccaccagtgcccggaggccccaggcagcccagccccgggcccactcctccccctttccctggaaaccgcggcactgctttgggaggaggctcaatacgtcagtcccccttgagctcctcctcgcccttctccaaccggcctcccctgccgcctacccccagcagggccttggatgacaaaccccctccaccacctcctccagtgggcaacaggccctccatccacagggaagcggttccccctcctcctcctcagaacaacaagcctccagtgccttccactccgcggccttcggcctcctcacaggccccacctccgccgccacctcccagcaggcccgggccgcctcctctgcctccaagttccagcggcaatgacgaaaccccaagactcccacagcggaatctgtccctcagttcgtccacgcccccgttaccttcgccaggacgttcaggtcctcttcctcccccgcccagtgagagacccccacctccagtgagggacccgccaggccgatcaggtatgacaagacgtggagtgagttgcttccaaaacccagcctgcccaaatgtaccaataatcctgtcagtcaagatagtctaacaaaagcaggcataagtaaactcagactgctttgtgcttttaagtggcacacgacacgtgtgatcgtgacctcgtgtaaaccccgggggaaagtgggaccaatatttctgttggtgttttagagatgaggacactgagtagctaataaagttaaatggtcacgagctagttaataaagaagaggcaagaactttcatcttccatctctgaagtgtacttgccagtccactaccctgcctccctagagagaatttcggcggtcttaattgggaaaataagtccccacctcccgcaggagggctctgttattccaacaagaggggaagttcttcaagagctaatgaacttctcctgtacttctctcttcattcgccaggctttgaggccatttccctattcattaaagactaatgtttaaaaagtc

SEQ ID NO: 199610 - DNA, 373 bp, Homo sapiens
  Payload ID: 19385
  Gene Name: WAS/WASL interacting protein family, member 1
  ENST ID: ENST00000436221
  CDS Start-End: 75-373
aatgagaagaagcccttagcctaatgaagcgataagatttatcagcaagactgttgaacgcataactgcccaagatgcctgtccctccccctccagcacccccgccgcccccgacgtttgcactggccaatacagagaagcctaccttgaataagacagagcaggctgggagaaatgctctcctttctgatatcagcaaagggaagaaactaaagaagacggtcaccaatgacagaagtgcaccaatactggacaaacctaaaggagctggtgctggaggcggtggtggtggctttggtggaggcggcggatttggcggaggaggtggtggcggaggcggtggaagttttggagggggcggacctccaggtct

SEQ ID NO: 199611 - DNA, 488 bp, Homo sapiens
  Payload ID: 19385
  Gene Name: WAS/WASL interacting protein family, member 1
  ENST ID: ENST00000455428
  CDS Start-End: 17-488
cgcataactgcccaagatgcctgtccctccccctccagcacccccgccgcccccgacgtttgcactggccaatacagagaagcctaccttgaataagacagagcaggctgggagaaatgctctcctttctgatatcagcaaagggaagaaactaaagaagacggtcaccaatgacagaagtgcaccaatactggacagagctggtgctggaggcggtggtggtggctttggtggaggcggcggatttggcggaggaggtggtggcggaggcggtggaagttttggagggggcggacctccaggtctgggaggattgttccaggctggaatgccgaagctgagatccacggccaacagggataatgattctggaggaagccgaccaccattgttgccaccgggaggaagatccacatctgcgaaacccttttcacccccaagtggcccagggaggtttcctgtgccttctccaggccacagaagtggtc

SEQ ID NO: 199612 - DNA, 2565 bp, Homo sapiens
  Payload ID: 19385
  Gene Name: WAS/WASL interacting protein family, member 1
  ENST ID: ENST00000610916
  CDS Start-End: 204-1682
aacaagaggccagagcttgtccaaaatggctgtccaaaaacgaccccacacttgcgttagaagatgatacctttttcagggacagttttctctcttggctcctgtcccgctggccctctgtctgcctgtgtccctgaccatggctccctgcagtaccctttaacgatttatcagcaagactgttgaacgcataactgcccaagatgcctgtccctccccctccagcacccccgccgcccccgacgtttgcactggccaatacagagaagcctaccttgaataagacagagcaggctgggagaaatgctctcctttctgatatcagcaaagggaagaaactaaagaagacggtcaccaatgacagaagtgcaccaatactggacaaacctaaaggagctggtgctggaggcggtggtggtggctttggtggaggcggcggatttggcggaggaggtggtggcggaggcggtggaagttttggagggggcggacctccaggtctgggaggattgttccaggctggaatgccgaagctgagatccacggccaacagggataatgattctggaggaagccgaccaccattgttgccaccgggaggaagatccacatctgcgaaacccttttcacccccaagtggcccagggaggtttcctgtgccttctccaggccacagaagtggtcccccagagcctcagaggaaccgaatgccgcccccaaggcccgacgtgggctcaaagcctgatagcattcctcctccagtacctagtactccaagacccattcaatcaagtccgcacaaccgggggtccccaccagtgcccggaggccccaggcagcccagccccgggcccactcctccccctttccctggaaaccgcggcactgctttgggaggaggctcaatacgtcagtcccccttgagctcctcctcgcccttctccaaccggcctcccctgccgcctacccccagcagggccttggatgacaaaccccctccaccacctcctccagtgggcaacaggccctccatccacagggaagcggttccccctcctcctcctcagaacaacaagcctccagtgccttccactccgcggccttcggcccctcacaggccccacctccgcccacctcccagcaggcccgggccgcctcctctgcctccaagttccagcggcaatgacgaaaccccaagactcccacagcggaatctgtccctcagttcgtccacgcccccgttaccttcgccaggacgttcaggtcctcttcctcccccgcccagtgagagacccccacctccagtgagggacccgccaggccgatcaggccccctcccaccacctcctccagtaagcagaaacggcagcacatctcgggccctgcctgctacccctcagttgccatccaggagtggagtagacagtcccaggagtggacccaggcctccccttcctcctgataggcccagtgctggggcacctcccccacctccaccatcaacatctattagaaatggcttccaagactctccatgtgaagatgagtgggaaagcagattctacttccatccgatttccgatttgccacctccagagccatatgtacaaacgaccaaaagttatcccagcaaactggcaagaaacgaaagccggagtgagtatttctgccaaggtttttgaagattcacgcttgagtagcctgagtgacactcgggctatatagaaagtccaggcttcttgcctggagtggggtagagaaccctttggagccatctacattctagtaaattccccttccacaggcagtgaggaaattgcagatgcccagaatgcatatgagaaacagttattttaatgtgtcattacaagctcaaaataccgtggtttgctagtattaaattttattattttacttctttggacgtcttcctctgttttcatcttcctgagacagcacaagtagagccatcttctattccttctagttttgaaattggcataatgtctgattaattataacaaaaactccctttaactgccttgatcttttaaacgtattgtaatcatagctttacagagcattacatgaaaatgtaaatatatccataatctctccacataatagatattttcattttaccagattctcatccaattttttatccatataattctgtttttttatgtagttataatgacgatgtacagttttttggcggggtttacataacattgcttagtaaatagtgcccatgttatcacatggtttttatttcagcatatagtaatttaccattaccatggacatttaaattatttctgttgttctgctaatgtaggtaatgctaccataaagaactaaattgcttttcctccattgaagaagaatgtcaacaagaaaggaaaaatagacaaactggaattttataacagtaaatgtataggaagtgttacagctctttgagaatttgtctagcaggctttccagggttttgctggaaagcctctgaaatttacttttaaaaaaacacaatagctgggcatggtggctcacgcctgtaat

SEQ ID NO: 199613 - DNA, 7474 bp, Homo sapiens
  Payload ID: 19386
  Gene Name: WAS/WASL interacting protein family, member 2
  Uniprot ID: Q8TF74
  ENST ID: ENST00000323571
  CDS Start-End: 241-1563
ggggacggtgggagcagatccatttccgggttggcaaaaggggcggtggcggcggcggcggcggcggcggcggcggcgacggcgagaaagagcttgccggggggcgagcaggacaggacgaagccggagtgtaggcggcagaggattcgctcccagagcagctgcggccaggtatatgaatgacctaaaggtacaaataaagacggagagagaacagtgccaactgggagcagggcaagaatgccaattcctcctcccccgccacccccacctggtcctcctccacctcccacatttcatcaggcaaacacagagcagcccaagctgagtagagatgagcagcggggtcgaggcgccctcttacaggacatttgcaaagggaccaagctgaagaaggtgaccaacattaatgatcggagtgctcccatcctcgagaagccgaaaggaagcagtggtggctatggctctggaggagctgccctgcagcccaagggaggtctcttccaaggaggagtgctgaagcttcgacctgtgggagccaaggatggttcagagaacctagctggtaagccagccctgcaaatccccagttctcgagctgctgccccaaggcctccagtatctgccgccagcgggcgtcctcaggatgatacagacagcagccgggcctcactcccagaactgccccggatgcagagaccctctttaccggacctctctcggcctaataccaccagcagtacgggcatgaagcacagctcctctgcccctcccccaccacccccagggcggcgtgccaacgcaccccccacacctctgcctatgcacagcagcaaagcccccgcctacaacagagagaaacccttgccaccgacgcctggacaaaggcttcaccctggtcgagagggacctcctgctccacccccagtcaaaccacctccttcccctgtgaatatcagaacaggaccaagtggccagtctctggctcctcctcctccgccttaccgccagcctcctggggtccccaatggaccctctagccccactaatgagtcagcccctgagctgccacagagacacaattctttgcataggaagacaccagggcctgtcagaggcctagcacctcctccacccacctcggcctccccatctttactgagtaataggccacctcccccagcccgagaccctcccagtcggggagcagctcctccacccccaccacctgtgatccgaaatggtgccagggatgctccccctcccccaccaccataccgaatgcatgggtcagaacccccgagccgaggaaagcccccacctccaccctcaaggacgccagctgggccaccccctcctcctccaccgcccctgaggaatggccacagagattctatcaccactgtccggtctttcttggatgattttgagtcaaagtattccttccatccagtagaagactttcctgctccagaagaatataaacactttcagaggatatatcccagcaaaacaaaccgagctgcccgtggagccccacctctgccacccattctcaggtgaagcctggcttggtcccgttcctcaggaaaaggatggaccttctcttcttctcagatggtcccttccattcccctgaaacctgcatgagagctcctaacatgtttctccaatgcaatcaagccctagactccaaatgtcctcccagctcacctccatctatgcatctcatctctggatttggtgatcagactctatattgacagtaggatctcaaaccctgcatccatccttcctccagcaagccctgctagccacatgaggaacaagtttccgtgtcttctgccttcctcttggggaaaggtgccttgttgtgatgaattaactcactgttagggcagggtggagaatggtactccttccttctcctgtccactgtgggggaagcttggcaggtatattatatttcatcatttaggaggctggcatgaccaggacttatgggtgggaggggagcatttttagtgaagcaagaaaggagtttgccaagaagtgatctgttttaaaggtcatatttggagaaagggcaaggaattgggtctgctttatttttgggggtattttgtttttgttctcacctgctgcccccccaccccaccaccccagggataaattggatataaacactaaatactaatcagttgaacttaacatttaataaaaagaaagggtgaaataaactgaagaccattttagaactagtcagttctctgcagcaaagggaacaggagccatttgaaccctctgggacccctcaccccactgcttcagggtgctaggctgagggatgtttttcctcccccttaccgcccatgcccttgaaagaaaagtcactttttgtggagggcatcattcattcctgattcacaaaccccaaaaacctctggtgggagataggaagatagggcgtgggcctgggccttaacctcaatcttgtgtctgcctcagtcttttctgactggccctgaagttgtcagtggctctttctgtccttcagcccctggaaggtgctccaggataacaaagaagggcaggttgaagcccctcatggaaggagctggctttgtggggctgcaaaggacttttaagtcctgcctgtactgaagttcacagcccacctgactgagcagactcttcctgttcctttctctaccacccttgccttcccaggactgcacggtttaacacagcagagtacagaagggtgaagaagtgagcagaggcttatgaagatattcagatactcttctatgccaggaagcacaaagactttgttgagatttgcctcagttcagtagatcttccttggcagccagccataggttgtttctttgtcttccgggtcctaaagagcacagagaaaatggaggtccccagtctaggtaggaagctgattggatgaggacttctttttttccgacagcaggatggggctcttgggctccacacaccagatgctttggttttctacaactgttgctatgtgtagagggtgctcagagcgtggcatgagagcaaggagaccatggctactctttgaaatggatggggaaaattagcttaaaaatttaatcacgagattgcgccactgcactccagcctgggcgacagagccagactccgtctcaaaaaaaaaaaaaaaaaaaaaatttaatcacacacatcacaggcttaaactgtcttagagacctttccagttgattggatcacaggctagggatctgtgcatggtgccaggtgaaacccaagtctccccagtgctaggtgagggagggctcaacgggggtaatgtgtatggggtctgctgtcctttgccatcccctggaccatattaactctgggacagaccatgattaggtctgtcaccaaacttttcctaatcattttttatgtatcattcttctttctaatctgttagcagttatctcccagaagtatccctagcatcctgaagcaaacagaactgccgggcgctgtggcttatgcctgtaatctcagcaatttgggaggccgaggcgggcggatcacctgaggtcagaagttcgagaccagcctgtccaacatggtgaaaccccgtctccactaaaaacacaaaaattatctgggcgtggtggcatgtgcctgtagtcccagctactggggaggctgaggcaggagaatcgcttgaatccaggaggtggaggttgcagtgagtggagatggcgccactgcgctccagcccgggtgacagagtgaaactccatctcagaaaacaaacaaaccaaacaactgagagagggcatgctagtggagggaaaaggagagagtacaagagttgatactgcatcagagttccagggcagatactgacaagtgactgaactttgactgtgaagtcttcccatttatttttgaaatgggagtcgatgccttttgtacgttatcaaagtgtttttttttttttcctcctttactcagacatagagcatcaaaatatcacgagtaaagccaaaccccagcttttcactggggctgatatcttcctccccatggcccactgccccctcatattccccagcacttggactgtgtcacatgggtattgattgtatacttgttgtcttggcctcatgcaaaaaggcctgggtctagatctagtcagatgagttttttttagagcatgttgatgatacaacacctgtttaaatgtctgccttatatgttatttggtcccactgttaataatagatttattactatgtatatttactattgaagatgggaatgtgatctgcatagttatcagtctattttgtatgttgtaaaaagcttctaatttaggtttaaggtgggctggctacaagagcactaaaactcctcaccttttaaactgctctttttatctgcttgtgggaatgtcgtctctttcgtggaagattgggtggtctcatgttgaggctgttgcccagtcccattaactcccttgtccccccacagaaggaagagacattgcccagctaagcatcaggaagctgtgttaaaagcccttctatgggtttggttttgtgatgtttttccctaatgggaaaaacgttatagttgtttcttactgccctgtctgggaagcagggcaaacctccaggtttttaaatgagctagatgcccctcttcctcttctctggtcactgaacctggaccaaagcactttgatattccaggtgtgattttctctgtcatggggatttgctccactgcagagccccatcattttcacagcgtaggccaacagagtgagaacctagggctaccctagctgatggatgtgaggctgctgtctacaggagctcatcccagccctgttaactggcagtggcaaggatactcgtcatcggccattgcactggggaactccctcaccccatggcttcccaacttgaaacccagatttacctccagggagaggtgagaaaaaaattgtaaatagacttgctaaagagcaactcagggttggggtgtgttttaattctcctgatcacttgaaataatctgtaggctgagtgcttatgggggtgggggagaagggtgactccagggtccttccattttgtgaagctctgggggtggagtgtgggcatctgaggccctatgatggcactacattgagctgtctgcccttccggaaacccaacctgcaatcaactgcaaatcaaattcttcacattccagctacagtctttctttccccattgaatctcagtccctggccatgtggtcaaggtggctttctgttaagctaccctaatttcgggaatgggaggggagagaggagggccattacaactctgccttcaagactcatctcttaaaaacaaaacgaaacaaaactacaaccaccatcaaaaccacacgcaaaaaaaaaaaaaaaaaaaaaaaggataactttaaccgaaggaagggtttggttccattcaactccacattcattgtgcctttacttgcattagatttctgtgctttcttcctttccctctttgaagcaattaaaatcttccttgataactgctgtttctttctactcttgtttctggcaatttagtgggttccttctctagtggtcttaaatctcattccactggtggcaagatggggcctagccttcttttcacatgtctaatcttttcctttctcatggtgccctccatggaagtcacagtcaacactgaataaatgactagaatgacacgtgtgcgtgcgcacgcgtgtgcgtgtgtgtgttcatctgtctgcatgtggatcaatttcttttagaaaataatttattgtatgatttattttggagttatattctgattacagtgctccctctcccaaatagcattgattttttcccccctctaaaatgtataatctggtctcaggttggattctttggtacatttctctcttctggatgccatgcagcttaattaaaaccttgcttaaaaacaaaaagtgaaaattgtgtactcttgtctggaataccgcctcaggtggtggcacagagaggggagaaaacctttgcctcataatttgggtaagtgtagtggtttgattccaggtcccttgaaaaagtagatctactgaattgggcagactcatctatagctttctgagggtcttctctcctcctctccagctgtattttgaaaattacagttctagttggctgggcgcgatggctcatgtctgtaatcccagcactttgggaggccaaggcgggtggatcatttgaggtcaggagttcaagaccagcttggccaacatggtgaaaccccgtctctactgaaaatacaaaaattaaccggtgtcatggcgcatgcctgtagtcccagctactcgggaggccgaggcaggaaaatcacttgaacccaggaggcggaggttgcactgagctgagatcatgccactgcactaaaaaaaaaaaaaaaaaaaaaaaaaaaaaaaaaaaaaaattctagagttctagttacccttcctgggagattctgatggtccttattttattattattattatttttttttgagacaggatgttgctgtcatccaggctggagtgcagtggtgtgatcatagctcaccgcagcctccaactctcaagctcaagtgatcctcccacctcagcctcccgtgtagctgggaccacaggtgtgtaccactatgcctggctaattttgaaaatttttttgtaaagacagggtctccctatgttgcccagactggtctcaaattcctgggcttaagtgattgtcccacctcagcttctcaaagtgctgggattacaggcatgagccaccgcacccagccagtccttattttatatttccacctaactcccctttgcccacgatttcagggaacctaggaggcttcctggccttgtgaccttttccttgaatctcttataattctttctacctgtgttgcatggcagattctcagattgaggctaaagaaaagaagggtggggacaaagcatacagaatgtgtgtatctgtttttatgtgggtgttggctgtttttcgtcactgctttttaagctgaatcttagctggttttcttgaactttgactttaggtgtaaaaattcaaccagacattctctccttactgtggtcagctgacatcataaccactaaggcttaatgagcttaacttgcactttcatcactagcaaaggtcttgaagttatttctcttactgattcataatgggtgtgtgtatgaatcactctcacataatttagatataaaaacctatgaggatgagggagggaggggaagaaaaaaaaggactcctttcattttcatccgtacttcccagatgggctgaatctccgattatttgacccatcattgttattaatatggttaataaactacctatttattgattgaa

SEQ ID NO: 199614 - DNA, 2378 bp, Homo sapiens
  Payload ID: 19386
  Gene Name: WAS/WASL interacting protein family, member 2
  ENST ID: ENST00000394103
  CDS Start-End: 206-754
aaaaggggcggtggcggcggcggcggcggcggcggcggcggcgacggcgagaaagagcttgccggggggcgagcaggacaggacgaagccggagtgtaggcggcagaggattcgctcccagagcagctgcggccaggtatatgaatgacctaaaggtacaaataaagacggagagagaacagtgccaactgggagcagggcaagaatgccaattcctcctcccccgccacccccacctggtcctcctccacctcccacatttcatcaggcaaacacagagcagcccaagctgagtagagatgagcagcggggtcgaggcgccctcttacaggacatttgcaaagggaccaagctgaagaaggtgaccaacattaatgatcggagtgctcccatcctcgagactcctccacccccaccacctgtgatccgaaatggtgccagggatgctccccctcccccaccaccataccgaatgcatgggtcagaacccccgagccgaggaaagcccccacctccaccctcaaggacgccagctgggccaccccctcctcctccaccgcccctgaggaatggccacagagattctatcaccactgtccggtctttcttggatgattttgagtcaaagtattccttccatccagtagaagactttcctgctccagaagaatataaacactttcagaggatatatcccagcaaaacaaaccgagctgcccgtggagccccacctctgccacccattctcaggtgaagcctggcttggtcccgttcctcaggaaaaggatggaccttctcttcttctcagatggtcccttccattcccctgaaacctgcatgagagctcctaacatgtttctccaatgcaatcaagccctagactccaaatgtcctcccagctcacctccatctatgcatctcatctctggatttggtgatcagactctatattgacagtaggatctcaaaccctgcatccatccttcctccagcaagccctgctagccacatgaggaacaagtttccgtgtcttctgccttcctcttggggaaaggtgccttgttgtgatgaattaactcactgttagggcagggtggagaatggtactccttccttctcctgtccactgtgggggaagcttggcaggtatattatatttcatcatttaggaggctggcatgaccaggacttatgggtgggaggggagcatttttagtgaagcaagaaaggagtttgccaagaagtgatctgttttaaaggtcatatttggagaaagggcaaggaattgggtctgctttatttttgggggtattttgtttttgttctcacctgctgcccccccaccccaccaccccagggataaattggatataaacactaaatactaatcagttgaacttaacatttaataaaaagaaagggtgaaataaactgaagaccattttagaactagtcagttctctgcagcaaagggaacaggagccatttgaaccctctgggacccctcaccccactgcttcagggtgctaggctgagggatgtttttcctcccccttaccgcccatgcccttgaaagaaaagtcactttttgtggagggcatcattcattcctgattcacaaaccccaaaaacctctggtgggagataggaagatagggcgtgggcctgggccttaacctcaatcttgtgtctgcctcagtcttttctgactggccctgaagttgtcagtggctctttctgtccttcagcccctggaaggtgctccaggataacaaagaagggcaggttgaagcccctcatggaaggagctggctttgtggggctgcaaaggacttttaagtcctgcctgtactgaagttcacagcccacctgactgagcagactcttcctgttcctttctctaccacccttgccttcccaggactgcacggtttaacacagcagagtacagaagggtgaagaagtgagcagaggcttatgaagatattcagatactcttctatgccaggaagcacaaagactttgttgagatttgcctcagttcagtagatcttccttggcagccagccataggttgtttctttgtcttccgggtcctaaagagcacagagaaaatggaggtccccagtctaggtaggaagctgattggatgaggacttctttttttccgacagcaggatggggctcttgggctccacacaccagatgctttggttttctacaactgttgctatgtgtagagggtgctcagagcgtggcatgagagcaaggagaccatggctactctttgaaatggatggggaaaattagcttaaaaatttaatcacgagattgcgccactgcactccagcctgggcgacagagccagactccgtctc

SEQ ID NO: 199615 - DNA, 1529 bp, Homo sapiens
  Payload ID: 19386
  Gene Name: WAS/WASL interacting protein family, member 2
  Uniprot ID: Q8TF74
  ENST ID: ENST00000583130
  CDS Start-End: 201-1523
aggcaataagggctcctgaagggttgggtgagttaaggcggcaactctgtgaggaacgaggtaatcgtgcgcaaaaagggagacgggaacggaggacctgttgggaacggctaattagcaggatgctgtgggtatatgaatgacctaaaggtacaaataaagacggagagagaacagtgccaactgggagcagggcaagaatgccaattcctcctcccccgccacccccacctggtcctcctccacctcccacatttcatcaggcaaacacagagcagcccaagctgagtagagatgagcagcggggtcgaggcgccctcttacaggacatttgcaaagggaccaagctgaagaaggtgaccaacattaatgatcggagtgctcccatcctcgagaagccgaaaggaagcagtggtggctatggctctggaggagctgccctgcagcccaagggaggtctcttccaaggaggagtgctgaagcttcgacctgtgggagccaaggatggttcagagaacctagctggtaagccagccctgcaaatccccagttctcgagctgctgccccaaggcctccagtatctgccgccagcgggcgtcctcaggatgatacagacagcagccgggcctcactcccagaactgccccggatgcagagaccctctttaccggacctctctcggcctaataccaccagcagtacgggcatgaagcacagctcctctgcccctcccccaccacccccagggcggcgtgccaacgcaccccccacacctctgcctatgcacagcagcaaagcccccgcctacaacagagagaaacccttgccaccgacgcctggacaaaggcttcaccctggtcgagagggacctcctgctccacccccagtcaaaccacctccttcccctgtgaatatcagaacaggaccaagtggccagtctctggctcctcctcctccgccttaccgccagcctcctggggtccccaatggaccctctagccccactaatgagtcagcccctgagctgccacagagacacaattctttgcataggaagacaccagggcctgtcagaggcctagcacctcctccacccacctcggcctccccatctttactgagtaataggccacctcccccagcccgagaccctcccagtcggggagcagctcctccacccccaccacctgtgatccgaaatggtgccagggatgctccccctcccccaccaccataccgaatgcatgggtcagaacccccgagccgaggaaagcccccacctccaccctcaaggacgccagctgggccaccccctcctcctccaccgcccctgaggaatggccacagagattctatcaccactgtccggtctttcttggatgattttgagtcaaagtattccttccatccagtagaagactttcctgctccagaagaatataaacactttcagaggatatatcccagcaaaacaaaccgagctgcccgtggagccccacctctgccacccattctcaggtgaagcctg

SEQ ID NO: 199616 - DNA, 581 bp, Homo sapiens
  Payload ID: 19386
  Gene Name: WAS/WASL interacting protein family, member 2
  ENST ID: ENST00000583268
  CDS Start-End: 393-581
attttgttcgcggacgctggggacggtgggagcagatccatttccgggttggcaaaaggggcggtggcggcggcggcggcggcggcggcggcggcgacggcgagaaagagcttgccggggggcgagcaggacaggacgaagccggagtgtaggcggcagaggattcgctcccagagcagctgcggccaggtatatgaatgacctaaaggtacaaataaagacggagagagaacagtgccaactgggagcagggcaagaatgccaattcctcctcccccgccacccccacctggtcctcctccacctcccacatttcatcagctcctccacccccaccacctgtgatccgaaatggtgccagggatgctccccctcccccaccaccataccgaatgcatgggtcagaacccccgagccgaggaaagcccccacctccaccctcaaggacgccagctgggccaccccctcctcctccaccgcccctgaggaatggccacagagattctatcaccactgtccggtctttcttggatgattttgagtcaaagtattccttccatccagtagaagactttcctgct

SEQ ID NO: 199617 - DNA, 2693 bp, Homo sapiens
  Payload ID: 19386
  Gene Name: WAS/WASL interacting protein family, member 2
  Uniprot ID: Q8TF74
  ENST ID: ENST00000585043
  CDS Start-End: 239-1561
gggttggcaaaaggggcggtggcggcggcggcggcggcggcggcggcggcgacggcgagaaagagcttgccggggggcgagcaggacaggacgaagccggagtgtaggcggcagaggattcgctcccagagcagctgcggccaggtcggaaagaggccggggcggctgggtatatgaatgacctaaaggtacaaataaagacggagagagaacagtgccaactgggagcagggcaagaatgccaattcctcctcccccgccacccccacctggtcctcctccacctcccacatttcatcaggcaaacacagagcagcccaagctgagtagagatgagcagcggggtcgaggcgccctcttacaggacatttgcaaagggaccaagctgaagaaggtgaccaacattaatgatcggagtgctcccatcctcgagaagccgaaaggaagcagtggtggctatggctctggaggagctgccctgcagcccaagggaggtctcttccaaggaggagtgctgaagcttcgacctgtgggagccaaggatggttcagagaacctagctggtaagccagccctgcaaatccccagttctcgagctgctgccccaaggcctccagtatctgccgccagcgggcgtcctcaggatgatacagacagcagccgggcctcactcccagaactgccccggatgcagagaccctctttaccggacctctctcggcctaataccaccagcagtacgggcatgaagcacagctcctctgcccctcccccaccacccccagggcggcgtgccaacgcaccccccacacctctgcctatgcacagcagcaaagcccccgcctacaacagagagaaacccttgccaccgacgcctggacaaaggcttcaccctggtcgagagggacctcctgctccacccccagtcaaaccacctccttcccctgtgaatatcagaacaggaccaagtggccagtctctggctcctcctcctccgccttaccgccagcctcctggggtccccaatggaccctctagccccactaatgagtcagcccctgagctgccacagagacacaattctttgcataggaagacaccagggcctgtcagaggcctagcacctcctccacccacctcggcctccccatctttactgagtaataggccacctcccccagcccgagaccctcccagtcggggagcagctcctccacccccaccacctgtgatccgaaatggtgccagggatgctccccctcccccaccaccataccgaatgcatgggtcagaacccccgagccgaggaaagcccccacctccaccctcaaggacgccagctgggccaccccctcctcctccaccgcccctgaggaatggccacagagattctatcaccactgtccggtctttcttggatgattttgagtcaaagtattccttccatccagtagaagactttcctgctccagaagaatataaacactttcagaggatatatcccagcaaaacaaaccgagctgcccgtggagccccacctctgccacccattctcaggtgaagcctggcttggtcccgttcctcaggaaaaggatggaccttctcttcttctcagatggtcccttccattcccctgaaacctgcatgagagctcctaacatgtttctccaatgcaatcaagccctagactccaaatgtcctcccagctcacctccatctatgcatctcatctctggatttggtgatcagactctatattgacagtaggatctcaaaccctgcatccatccttcctccagcaagccctgctagccacatgaggaacaagtttccgtgtcttctgccttcctcttggggaaaggtgccttgttgtgatgaattaactcactgttagggcagggtggagaatggtactccttccttctcctgtccactgtgggggaagcttggcaggtatattatatttcatcatttaggaggctggcatgaccaggacttatgggtgggaggggagcatttttagtgaagcaagaaaggagtttgccaagaagtgatctgttttaaaggtcatatttggagaaagggcaaggaattgggtctgctttatttttgggggtattttgtttttgttctcacctgctgcccccccaccccaccaccccagggataaattggatataaacactaaatactaatcagttgaacttaacatttaataaaaagaaagggtgaaataaactgaagaccattttagaactagtcagttctctgcagcaaagggaacaggagccatttgaaccctctgggacccctcaccccactgcttcagggtgctaggctgagggatgtttttcctcccccttaccgcccatgcccttgaaagaaaagtcactttttgtggagggcatcattcattcctgattcacaaaccccaaaaacctctggtgggagataggaagatagggcgtgggcctgggccttaacctcaatcttgtgtctgcctcagtcttttctgactggccctgaagttgtcagtggctctttctgtccttcagcccctggaaggtgctccaggataacaaagaagggcaggttgaagcccctcatggaaggagctggctttgtggggctgcaaaggacttttaagtcctgcctgtactgaagttcacagcccacctgactgagcagactct

SEQ ID NO: 199618 - DNA, 572 bp, Homo sapiens
  Payload ID: 19386
  Gene Name: WAS/WASL interacting protein family, member 2
  ENST ID: ENST00000584296
  CDS Start-End: 263-572
aatcgtgcgcaaaaagggagacgggaacggaggacctgttgggaacggctaattagcaggatgctgtggagacgtggtctcactctgtcgcccgggctggagtgcagtggcatgatcatggctccttaaagcctcgacctcccgggctgaagtggtccttccacctaagccccgccaatagctgggaccacaggtatatgaatgacctaaaggtacaaataaagacggagagagaacagtgccaactgggagcagggcaagaatgccaattcctcctcccccgccacccccacctggtcctcctccacctcccacatttcatcaggcaaacacagagcagcccaagctgagtagagatgagcagcggggtcgaggcgccctcttacaggacatttgcaaagggaccaagctgaagaaggtgaccaacattaatgatcggagtgctcccatcctcgagaagccgaaaggaagcagtggtggctatggctctggaggagctgccctgcagcccaagggaggtctcttccaaggaggagtgctgaagcttcgacctgtgggagccaaggatggtt

SEQ ID NO: 199619 - DNA, 3163 bp, Homo sapiens
  Payload ID: 19386
  Gene Name: WAS/WASL interacting protein family, member 2
  ENST ID: ENST00000582781
  CDS Start-End: 237-476
acggtgggagcagatccatttccgggttggcaaaaggggcggtggcggcggcggcggcggcggcggcggcggcgacggcgagaaagagcttgccggggggcgagcaggacaggacgaagccggagtgtaggcggcagaggattcgctcccagagcagctgcggccaggtatatgaatgacctaaaggtacaaataaagacggagagagaacagtgccaactgggagcagggcaagaatgccaattcctcctcccccgccacccccacctggtcctcctccacctcccacatttcatcaggcaaacacagagcagcccaagctgagtagagatgagcagcggggtcgaggcgccctcttacaggacatttgcaaagggaccaagctgaagaagagccgaaaggaagcagtggtggctatggctctggaggagctgccctgcagcccaagggaggtctcttccaaggaggagtgctgaagcttcgacctgtgggagccaaggatggttcagagaacctagctggtaagccagccctgcaaatccccagttctcgagctgctgccccaaggcctccagtatctgccgccagcgggcgtcctcaggatgatacagacagcagccgggcctcactcccagaactgccccggatgcagagaccctctttaccggacctctctcggcctaataccaccagcagtacgggcatgaagcacagctcctctgcccctcccccaccacccccagggcggcgtgccaacgcaccccccacacctctgcctatgcacagcagcaaagcccccgcctacaacagagagaaacccttgccaccgacgcctggacaaaggcttcaccctggtcgagagggacctcctgctccacccccagtcaaaccacctccttcccctgtgaatatcagaacaggaccaagtggccagtctctggctcctcctcctccgccttaccgccagcctcctggggtccccaatggaccctctagccccactaatgagtcagcccctgagctgccacagagacacaattctttgcataggaagacaccagggcctgtcagaggcctagcacctcctccacccacctcggcctccccatctttactgagtaataggccacctcccccagcccgagaccctcccagtcggggagcagctcctccacccccaccacctgtgatccgaaatggtgccagggatgctccccctcccccaccaccataccgaatgcatgggtcagaacccccgagccgaggaaagcccccacctccaccctcaaggacgccagctgggccaccccctcctcctccaccgcccctgaggaatggccacagagattctatcaccactgtccggtctttcttggatgattttgagtcaaagtattccttccatccagtagaagactttcctgctccagaagaatataaacactttcagaggatatatcccagcaaaacaaaccgagctgcccgtggagccccacctctgccacccattctcaggtgaagcctggcttggtcccgttcctcaggaaaaggatggaccttctcttcttctcagatggtcccttccattcccctgaaacctgcatgagagctcctaacatgtttctccaatgcaatcaagccctagactccaaatgtcctcccagctcacctccatctatgcatctcatctctggatttggtgatcagactctatattgacagtaggatctcaaaccctgcatccatccttcctccagcaagccctgctagccacatgaggaacaagtttccgtgtcttctgccttcctcttggggaaaggtgccttgttgtgatgaattaactcactgttagggcagggtggagaatggtactccttccttctcctgtccactgtgggggaagcttggcaggtatattatatttcatcatttaggaggctggcatgaccaggacttatgggtgggaggggagcatttttagtgaagcaagaaaggagtttgccaagaagtgatctgttttaaaggtcatatttggagaaagggcaaggaattgggtctgctttatttttgggggtattttgtttttgttctcacctgctgcccccccaccccaccaccccagggataaattggatataaacactaaatactaatcagttgaacttaacatttaataaaaagaaagggtgaaataaactgaagaccattttagaactagtcagttctctgcagcaaagggaacaggagccatttgaaccctctgggacccctcaccccactgcttcagggtgctaggctgagggatgtttttcctcccccttaccgcccatgcccttgaaagaaaagtcactttttgtggagggcatcattcattcctgattcacaaaccccaaaaacctctggtgggagataggaagatagggcgtgggcctgggccttaacctcaatcttgtgtctgcctcagtcttttctgactggccctgaagttgtcagtggctctttctgtccttcagcccctggaaggtgctccaggataacaaagaagggcaggttgaagcccctcatggaaggagctggctttgtggggctgcaaaggacttttaagtcctgcctgtactgaagttcacagcccacctgactgagcagactcttcctgttcctttctctaccacccttgccttcccaggactgcacggtttaacacagcagagtacagaagggtgaagaagtgagcagaggcttatgaagatattcagatactcttctatgccaggaagcacaaagactttgttgagatttgcctcagttcagtagatcttccttggcagccagccataggttgtttctttgtcttccgggtcctaaagagcacagagaaaatggaggtccccagtctaggtaggaagctgattggatgaggacttctttttttccgacagcaggatggggctcttgggctccacacaccagatgctttggttttctacaactgttgctatgtgtagagggtgctcagagcgtggcatgagagcaaggagaccatggctactctttgaaatggatggggaaaattagcttaaaaatttaatcacgagattgcgccactgcactccagcctgggcgacagagccagactccgtctcaaaaaaaaaaaaaaaaaaaa

SEQ ID NO: 199620 - DNA, 4184 bp, Homo sapiens
  Payload ID: 19387
  Gene Name: WAS/WASL interacting protein family, member 3
  Uniprot ID: A6NGB9
  ENST ID: ENST00000242140
  CDS Start-End: 183-1634
tcggcggtagcggcgccgcttggagcacgggcgctgcgggacggagcccggagccggaggcggcggcggcggagacgtcggccggagctcgagtccagtccagcccccggctccgccacctgcagagcagaagccactctcttgggaccattcataagcaggagacatcaacaccgtgacacatgccagtgccaccgccacccccacctcctctgcctccacctcccccgcctctgggggctcctccccctcccccaccatcagcacccccggtaagcacagacacctccagcttgcgaagggcagatccgaaaggccggagtgcgctgttggctgatatccagcaaggaactcgcctgcgcaaagtcacgcagatcaacgaccgcagtgccccgcagatcgagagttctaaaggaaccaacaaagaaggaggaggttctgcaaacacacgaggcgcgagcacacctcccaccctgggagatctgtttgctggtggctttcctgtattgcgaccagcaggccagcgggatgtagcaggtggcaagacagggcagggccctggctcccgcgcgccctctcccaggcttcccaacaaaaccatcagcggcccgcttatcccgcctgcctctcccaggctaggcaatacctccgaggcgcatggcgctgccaggacagccccgcctcgccccaacgtgcctgccccgccccctcccaccccaccccctccgcctccacccttacccccgccccttccctcttcctcccccatcaaaactccgcttgtgtccccacccggcccactgaccaaagggaacctcccggtggttgcaccccccgtcccctgtgcgccaccacctccacctccgccacctcccccaacgccacccccgctgcccccggcctcggttcttagtgacaaggcagtgaagcctcagctggctcccttgcacctcccgcccatcccgcccccgctccctctgctcccaccttgtgggtatccggggctcaaagcggagcccgccagccctgcgcaagatgcgcaggagcctcccgccccgccgcccccgctccccccttatgcttcttgctccccgagggcttctttgcccgcgccccctttgccaggagttaatagcagcagtgaaactccacccccgctaccccctaaatcccccagcttccaggccccaccgcagaaggccggtgcgcaggccttgcccgccccgcctgcccctccgggctcccagccgttcctgcagaagaagaggcatggccgaccaggggccggtgggggaaagctaaatccacctccagcaccccctgcgagatcacctaccacagagctttcaagcaagagccagcaggccacagcctggaccccgacgcagcagcctggaggtcaactgcgaaatggaagcctgcacatcattgatgacttcgagtctaaattcacgttccattctgtggaagactttccccctccggatgaatataaaccatgccagaagatttaccccagcaagatccccagaagccgtacacctggtccctggctccaagcggaagcagtcgggcagagctctgatgacatcaaaggcagaaattctcagttatctctaaagactcttcggtgagaagacagatgaagcgaaggtcctggggttccaggttgcagaacaacatgtcagaccccacccaccccatgctcaagctgtaattcagttggcatacaggcttggaattgagaatttatttattgtaaatatgtgatttgcacgggctttaaagcagtattttaattgacttttatttcggtaatattttttaaaacacccctcatttttccattttttgcattgcatcttggcatttgtcagcacagatagagccctgtccctccacctagtgcccactccatgactgtgaatctgcttgcaggctggcccttcctagattctgaaccgtttgtagagagtccttagtttgcaggtagccccaaagttataaatatccacaacggcttcttattggcataatttcatattctcatcacactaactgcaaaatcaaaccaaataatgccttatcaatgatgcagctcagaggaagtagcgtgtcccccacacccagacagtgccgcgcagcctccagggaacgaggtgccatgtctcgcttccattttgcagtacagggaatttttttttttttttttttttttttttttgctgcctaatgtaatacatcacaaagtaaaggcaagagtgggcttggccctccgatgccaaccacagggccccttttgtaactgaataatcctccaagtagccagtgctcctactgtttacagtgtccctcgtgcccaagtctctgtcactttcatcctgttccctccaagttcccagtcccatcccagtagccagctttatgagattttggtatttcttccctacagattaaaaacatacacaactcatcattatgctaaactaccagttgtatctcagaggtctccccttctgcccttgcttcgagtgtggacttccatggaaaatatgacatgaaaaagtgtagaacgaaacatcgtgtgaaatacctgccacaaatacctagtgcctcactgcccccatcttaggatccttggagccacccgtcaggcaaaacctagctcccttctgagctaaaggagaaccttgcctgacaactccacattcattcccttgtggtgggcacctgtctgtggggagatgtgtgcaagctcagccactctgaatatggaaaaggtcaggccgggctggtcctgctcttcactccctcttcttgatcctgtagggagtggaaatgtgtttttgcttgctgcctgacccctgatgttccccatctttggtcggggaagactgtgacagaggaaggagaaaaaatagaaggaaacagactgatccctgggctgtgctcaaaatagctgccctttaaaggaaatcaggcagggaggggagggaaaccagcgaaaaagaaatttgctttgcaacaacccacgcacacattcacccctgaagtatatcatgaacagaccaagccatccagaaaggcagccggtcaggagggtgtgggcaaacatgactgcatctgcctcactgttgtctggagtaacgactcaggtggtgtcctgcagcagtgctgtgctttctcattccagatggaagcaagtgagccagggtcaaattcccttctccaggggaatgaatcaagcccaaactgtaacagctaaataagtagaagtttttgcaggtcatcagctctgggcataactaatttgttttattggttctggaagatttccaaaaagccagaatttattattataacagtgtccactccactgccctcacagttgtgtaaaataattatagaagttttaatgatcctgattaagaagaccctagacaaaggcaattccaccttcagagtagactgcctgccctaatgaggtgtttagacattcgtgtctcctatggctgggatggaaattaaaataacactatttaaggacagagcgggccaggagcagtggctcatgcaggtaatcccagcatgggaggctgaggtgggtggattacttgaggttaggagttcaagaccagcctggccaacatggtgaaaccctgtctactcaaatacaaaaaattagccaggcatggtggctcacacctgtaatcccagcaacttgggaggttcaggcacaagaattgcttgaaccctggaggtggaggttgcagtgagctgagatggcaccactgcactctagcctgggcaacagagcgagaccctaactcaaaaaaaaaaaaggacagaggggaggaaggagcagaaaccaaaaatggcaattagggagaaatctcaggaatgtggcatcccatctccccttgagacctatcactgaattcacaacccttcgagctcatgctggtgcactgagtcccttgggcgctgtaaaggtttaaccccttgactgtaaactcagacttagagacatctgagtcacacagtccccgccattgtcacatattctcactgacactgcagtctgtgactcctccaatgtttcacgtgtattttatatttattgatgtctccttccgcagattcatttctttgtacttaataaactttagtaagtggaaatgctt

SEQ ID NO: 199621 - DNA, 3491 bp, Homo sapiens
  Payload ID: 19387
  Gene Name: WAS/WASL interacting protein family, member 3
  ENST ID: ENST00000409123
  CDS Start-End: 251-1702
cccgcctccgcgtcccggcagcaccagagccggtggccggggagcgagccgggcgcaccgagcgcagctcggcggtagcggcgccgcttggagcacgggcgctgcgggacggagcccggagccggaggcggcggcggcggagacgtcggccggagctcgagtccagtccagcccccggctccgccacctgcagagcagaagccactctcttgggaccattcataagcaggagacatcaacaccgtgacacatgccagtgccaccgccacccccacctcctctgcctccacctcccccgcctctgggggctcctccccctcccccaccatcagcacccccggtaagcacagacacctccagcttgcgaagggcagatccgaaaggccggagtgcgctgttggctgatatccagcaaggaactcgcctgcgcaaagtcacgcagatcaacgaccgcagtgccccgcagatcgagagttctaaaggaaccaacaaagaaggaggaggttctgcaaacacacgaggcgcgagcacacctcccaccctgggagatctgtttgctggtggctttcctgtattgcgaccagcaggccagcgggatgtagcaggtggcaagacagggcagggccctggctcccgcgcgccctctcccaggcttcccaacaaaaccatcagcggcccgcttatcccgcctgcctctcccaggctaggcaatacctccgaggcgcatggcgctgccaggacagccccgcctcgccccaacgtgcctgccccgccccctcccaccccaccccctccgcctccacccttacccccgccccttccctcttcctcccccatcaaaactccgcttgtgtccccacccggcccactgaccaaagggaacctcccggtggttgcaccccccgtcccctgtgcgccaccacctccacctccgccacctcccccaacgccacccccgctgcccccggcctcggttcttagtgacaaggcagtgaagcctcagctggctcccttgcacctcccgcccatcccgcccccgctccctctgctcccaccttgtgggtatccggggctcaaagcggagcccgccagccctgcgcaagatgcgcaggagcctcccgccccgccgcccccgctccccccttatgcttcttgctccccgagggcttctttgcccgcgccccctttgccaggagttaatagcagcagtgaaactccacccccgctaccccctaaatcccccagcttccaggccccaccgcagaaggccggtgcgcaggccttgcccgccccgcctgcccctccgggctcccagccgttcctgcagaagaagaggcatggccgaccaggggccggtgggggaaagctaaatccacctccagcaccccctgcgagatcacctaccacagagctttcaagcaagagccagcaggccacagcctggaccccgacgcagcagcctggaggtcaactgcgaaatggaagcctgcacatcattgatgacttcgagtctaaattcacgttccattctgtggaagactttccccctccggatgaatataaaccatgccagaagatttaccccagcaagatccccagaagccgtacacctggtccctggctccaagcggaagcagtcgggcagagctctgatgacatcaaaggcagaaattctcaggtaacacaagcctcatgtctctgaatgtaaaaccaggaattctcctcaggaggcacagaaatggtaagggtatgctttctcctaaacagctttatatttttcctcacactccttttcctcagggaaagccatttggtggaccttttttcaagccagaatgaaacactcaccatttcaaaatctgaagtgtgacaaaagggggcttccctggaatcaccactacatatagaagcaagtttagcaactctgacattctgcaacaatcatgccaatcacttcccattcttccttggttatgatggcctgtgagaaaaactgaataacatgtataaaacataattcagtattctctctcatctgtagaatacatggtttcttttagcacacttggagtttttttttcccccaccaatgttataattgattttggccaaatttagtcacaattcaagtactagtacccacaagaaatgaacagaactagaaggcaagccagacagctgcttttgtgataagacagtccttgaagaaacacctttaatctcacccagggcatcttgaaccgaattatttcctaacctggacacatttccctgcacatgacagggtctcatctttaaaagccctttgtttctttgaaaacatgtattcagtcgaacaataatctccccatttctgaatactatgtgacagactacagagtcacttgcagttaaaccaggcaattctgcaactgtgtggaacatcaaggaaagtgacctgagaaggaagaggctaggttcctggaagctaggatgagttcctcagaggaaaaagtacatcctctagcagataagtatcccccttttctaaccacagctgatgcaagaattgcagtaacgattcttagacgatcacaggttcaaaactgtgtgtatgattgtagttaaggaagaagtatatatacacaggaaaaaagacaggaagaatatacacaatattgttaacaggtagagagaattctgagaagatggcagaggagaaagcaccaggaatctgtggacaacaattgcattggcagaatctgtctgatgtaatttgtctcatgtattttggaactctgggattcattaaaggcttgaaacttccatgggaaagcttggacagtaaattgtgctcttagtacaatagtaactactcatcctccaccccccaccccatggcaggcaactgggcacgtgttcctggagcagcttgcatacagcttgcaggagccaaggtgggcacaaaaaaaaaaccctgtcctccagatactggggaatctgttctctgattggttattgctgcttctgatcacagaggtacaaataaagagatgggcagccattgttgcacctcctcttattgttgtaaatccctttccctctggctgaagtggcctcctggggatttcaagggctggtggccattttgttcctcctgtccttgctctttttttttccccatttgggagccaaacattaaagatgaacattcaaaggctactacatatatgatgaaaattagaaagtgaccacatatgcccagggaaaggcacaggctcagaaaagaccaagaagaccttaagattacacctcagactgattcttagcacagagacagcctacaacaatcaaaaaaataaaatgaacaaaaacaataagaaaaaccagcaaaccctgggggacagagagaattgatatctagagttaccacattattagattaaaatgtagagttttcaacaacaacaaaaatcacatcatacaaagaaacaggagagtatggcccattc

SEQ ID NO: 199622 - DNA, 4002 bp, Homo sapiens
  Payload ID: 19387
  Gene Name: WAS/WASL interacting protein family, member 3
  Uniprot ID: A6NGB9
  ENST ID: ENST00000409290
  CDS Start-End: 1-1452
atgccagtgccaccgccacccccacctcctctgcctccacctcccccgcctctgggggctcctccccctcccccaccatcagcacccccggtaagcacagacacctccagcttgcgaagggcagatccgaaaggccggagtgcgctgttggctgatatccagcaaggaactcgcctgcgcaaagtcacgcagatcaacgaccgcagtgccccgcagatcgagagttctaaaggaaccaacaaagaaggaggaggttctgcaaacacacgaggcgcgagcacacctcccaccctgggagatctgtttgctggtggctttcctgtattgcgaccagcaggccagcgggatgtagcaggtggcaagacagggcagggccctggctcccgcgcgccctctcccaggcttcccaacaaaaccatcagcggcccgcttatcccgcctgcctctcccaggctaggcaatacctccgaggcgcatggcgctgccaggacagccccgcctcgccccaacgtgcctgccccgccccctcccaccccaccccctccgcctccacccttacccccgccccttccctcttcctcccccatcaaaactccgcttgtgtccccacccggcccactgaccaaagggaacctcccggtggttgcaccccccgtcccctgtgcgccaccacctccacctccgccacctcccccaacgccacccccgctgcccccggcctcggttcttagtgacaaggcagtgaagcctcagctggctcccttgcacctcccgcccatcccgcccccgctccctctgctcccaccttgtgggtatccggggctcaaagcggagcccgccagccctgcgcaagatgcgcaggagcctcccgccccgccgcccccgctccccccttatgcttcttgctccccgagggcttctttgcccgcgccccctttgccaggagttaatagcagcagtgaaactccacccccgctaccccctaaatcccccagcttccaggccccaccgcagaaggccggtgcgcaggccttgcccgccccgcctgcccctccgggctcccagccgttcctgcagaagaagaggcatggccgaccaggggccggtgggggaaagctaaatccacctccagcaccccctgcgagatcacctaccacagagctttcaagcaagagccagcaggccacagcctggaccccgacgcagcagcctggaggtcaactgcgaaatggaagcctgcacatcattgatgacttcgagtctaaattcacgttccattctgtggaagactttccccctccggatgaatataaaccatgccagaagatttaccccagcaagatccccagaagccgtacacctggtccctggctccaagcggaagcagtcgggcagagctctgatgacatcaaaggcagaaattctcagttatctctaaagactcttcggtgagaagacagatgaagcgaaggtcctggggttccaggttgcagaacaacatgtcagaccccacccaccccatgctcaagctgtaattcagttggcatacaggcttggaattgagaatttatttattgtaaatatgtgatttgcacgggctttaaagcagtattttaattgacttttatttcggtaatattttttaaaacacccctcatttttccattttttgcattgcatcttggcatttgtcagcacagatagagccctgtccctccacctagtgcccactccatgactgtgaatctgcttgcaggctggcccttcctagattctgaaccgtttgtagagagtccttagtttgcaggtagccccaaagttataaatatccacaacggcttcttattggcataatttcatattctcatcacactaactgcaaaatcaaaccaaataatgccttatcaatgatgcagctcagaggaagtagcgtgtcccccacacccagacagtgccgcgcagcctccagggaacgaggtgccatgtctcgcttccattttgcagtacagggaatttttttttttttttttttttttttttttgctgcctaatgtaatacatcacaaagtaaaggcaagagtgggcttggccctccgatgccaaccacagggccccttttgtaactgaataatcctccaagtagccagtgctcctactgtttacagtgtccctcgtgcccaagtctctgtcactttcatcctgttccctccaagttcccagtcccatcccagtagccagctttatgagattttggtatttcttccctacagattaaaaacatacacaactcatcattatgctaaactaccagttgtatctcagaggtctccccttctgcccttgcttcgagtgtggacttccatggaaaatatgacatgaaaaagtgtagaacgaaacatcgtgtgaaatacctgccacaaatacctagtgcctcactgcccccatcttaggatccttggagccacccgtcaggcaaaacctagctcccttctgagctaaaggagaaccttgcctgacaactccacattcattcccttgtggtgggcacctgtctgtggggagatgtgtgcaagctcagccactctgaatatggaaaaggtcaggccgggctggtcctgctcttcactccctcttcttgatcctgtagggagtggaaatgtgtttttgcttgctgcctgacccctgatgttccccatctttggtcggggaagactgtgacagaggaaggagaaaaaatagaaggaaacagactgatccctgggctgtgctcaaaatagctgccctttaaaggaaatcaggcagggaggggagggaaaccagcgaaaaagaaatttgctttgcaacaacccacgcacacattcacccctgaagtatatcatgaacagaccaagccatccagaaaggcagccggtcaggagggtgtgggcaaacatgactgcatctgcctcactgttgtctggagtaacgactcaggtggtgtcctgcagcagtgctgtgctttctcattccagatggaagcaagtgagccagggtcaaattcccttctccaggggaatgaatcaagcccaaactgtaacagctaaataagtagaagtttttgcaggtcatcagctctgggcataactaatttgttttattggttctggaagatttccaaaaagccagaatttattattataacagtgtccactccactgccctcacagttgtgtaaaataattatagaagttttaatgatcctgattaagaagaccctagacaaaggcaattccaccttcagagtagactgcctgccctaatgaggtgtttagacattcgtgtctcctatggctgggatggaaattaaaataacactatttaaggacagagcgggccaggagcagtggctcatgcaggtaatcccagcatgggaggctgaggtgggtggattacttgaggttaggagttcaagaccagcctggccaacatggtgaaaccctgtctactcaaatacaaaaaattagccaggcatggtggctcacacctgtaatcccagcaacttgggaggttcaggcacaagaattgcttgaaccctggaggtggaggttgcagtgagctgagatggcaccactgcactctagcctgggcaacagagcgagaccctaactcaaaaaaaaaaaaggacagaggggaggaaggagcagaaaccaaaaatggcaattagggagaaatctcaggaatgtggcatcccatctccccttgagacctatcactgaattcacaacccttcgagctcatgctggtgcactgagtcccttgggcgctgtaaaggtttaaccccttgactgtaaactcagacttagagacatctgagtcacacagtccccgccattgtcacatattctcactgacactgcagtctgtgactcctccaatgtttcacgtgtattttatatttattgatgtctccttccgcagattcatttctttgtacttaataaactttagtaagtggaaatgctt

SEQ ID NO: 199623 - DNA, 3403 bp, Homo sapiens
  Payload ID: 19388
  Gene Name: WBP2 N-terminal like
  Uniprot ID: Q6ICG8
  ENST ID: ENST00000329620
  CDS Start-End: 95-1024
ataatctccgccctccccttcagaaccgcgccccacagctcggcgcaggtcccgcccctttccatctacggggcggcaggaggcccgaagcaagatggcggtgaatcagagccacaccgagaaccgccgcggagccctcatccctaacggtgaaagtctcttgaagcggtctccgaatgtggagctctccttcccacagcgatcagaaggctcaaatgtctttagtggtagaaagacaggaacattgtttctcacttcataccgggtgattttcataacttcatgctccatcagtgatcccatgttgtcttttatgatgccatttgatctgatgacgaacctcactgttgaacaaccagtatttgctgcaaacttcattaagggaactattcaggcagctccatatggtggctgggaaggacaagctacttttaaattagtcttcagaaatggagatgccattgaatttgcccagttgatggtgaaagctgcctctgctgctgcccgaggatttccacttagaaccttaaatgactggttcagctctatgggaatttatgtaattactggggaagggaatatgtgcactccacagatgccttgttcagttattgtctatggagccccacctgcaggatatggagccccacctcccggatacggagccccacctgcaggatatggagcccaacccgtaggaaatgaaggcccgcctgtgggatacagagcctcacctgtgcgatatggagccccacctcttggatacggagccccacctgcaggatatggagccccacctctaggatatggagccccacctcttggatatggaaccccacctctcggatatggagccccacctctcggatatggagccccacctgcaggaaatgaaggcccgcctgcgggatacagagcctcacctgctggatcaggagccaggcctcaggaatctacagcagcccaggctcctgaaaacgaggcttctcttccctctgcctcctcttctcaggtccattcttaaccttctaagatgtaaaccttgaagactcaccaagcaaagaggtaccctaaaattgaagtcaggataaggaggacgactcagcttagagtcattgattgatctgcattgtgaaaattaggaaaccagatgctcccatgttctcaaggacagcctttcttaaggaagtcagtacgtgggcaacagtgatgagaggaagagaggagagactcaaccaactagagcagggataaggtttcccttgttcagcttttcagtgtctgctggaatgtgatggtaagttgagaacagggtgaatgggtgaggccttttttatatcagaaagttttccgagtaactgatctctggcaaatatttggggattagaattctaaaagaatacaaactagacttctcttctgctcttcatgttagttatacttgtaccaggtagatttgaggtggggtccagttacctgaaaagcgtagcaggttcgagtttcttaaaggtggaattccaccatgttctcctgtgcaaagggtacctgtttacctggtccaccaaactgccccagtacaaccaaaggctgtgactgtgtaaggatagaaccaagtggagccacagtttggacccacgtggtgctgcgtggcacacctactgttagttagctcccactgtctggtacagttgtttcccccaaaggctcagtccaatttgttctataagaagagctttgtgtcctgtatattcaaaggaccctggtttttgctttgctgaggacaaatccagtcagaattcagctgagccttctgcatgctgagagcactcatgtgctgagttcctcagctcctcactgacgttttgagtactttctttctgactcactcactgtgctggtggattccgctcttcctgtctcttccccagctgcaatacagaaactatactctgttgtctactctttcatttcctattagaaatataaagggatagaaataagaagaccttttagtcctggactatctggtattggcccctaaaatgagcctccaaatactccttttcatgggtaagtggatgctccccagcctgctggagcagaaccttcctggctcagctaccctgagatatcaggacaaaaacatatagttggtgtgattttcctctttttgtttttttttttttcaagatagaatctggctctgtcccccaggctggagtgcagtggcgcgatctcggctcactgcaacctttgccccacaggtttaagcgattctcctgcttcagcctcctgaatagcttggatgacaggtgcctgccaccatgctcggctaatttttgtgtttttagtggagacagggtttcaccatgttggccaggctggtttcgaactcctgacctcaagtgatccacccgcctcggcctcccaaagtgctgggattacaggcatcggcctgtgcctggccgatttttcaatccatagattaatatgttcaagaaatattgcatgtctttgttttctgtaaatttatttctgttaccaagatccccaccaccatctgctttgttggtgggcttctcacaaatcctaagattatgcaaaggtatccagattttatttggcaccaagatgctgagaagtttcttctggtcatcagactgcttctgaaacagccactatccagtcctggcagtcccgtcaagtctaaaagcttgttgccttgggaccccagaatcttaggtagggcttagaaccagggtgtcagagatccaactctgtgtaccatattgctccttagaactggggagtaggaccccaaaggcctccttatccttgagagtctgacaattccttaaacttccagattctgccctctcagctgtgctgttggtctgcatcacctctatctcttaagcatctatcctaatccaaatctcaggatttgggtttacccaaaaggtaatagaaagcctttgccttcatgttgacttggctttccttgcctagcacttggttgcttgcttgaaaatcatgtatgtatatatataaaatgtagaagcccaattcaaattaataatgtaaaaatttattctgttacacagattacctcattgtcaggtaggaagtgaaacgtatgatattcttcctggcctttgccttgagagtcttctggagcctgaagagggtggggcagacaaccatggactgctagagaataaactttctttgaagcttcctaaatggattagaaagaaggggttctgtcaaagggaaagggtctatacagatgtgaccagcagtttgattagtttagatgtatgatttagtagccaatataagaaacttgtaatttttagtaattagaatttattataaataataaaacagggtattaattatt

SEQ ID NO: 199624 - DNA, 2255 bp, Homo sapiens
  Payload ID: 19388
  Gene Name: WBP2 N-terminal like
  Uniprot ID: Q6ICG8
  ENST ID: ENST00000328823
  CDS Start-End: 32-961
atctacggggcggcaggaggcccgaagcaagatggcggtgaatcagagccacaccgagaaccgccgcggagccctcatccctaacggtgaaagtctcttgaagcggtctccgaatgtggagctctccttcccacagcgatcagaaggctcaaatgtctttagtggtagaaagacaggaacattgtttctcacttcataccgggtgattttcataacttcatgctccatcagtgatcccatgttgtcttttatgatgccatttgatctgatgacgaacctcactgttgaacaaccagtatttgctgcaaacttcattaagggaactattcaggcagctccatatggtggctgggaaggacaagctacttttaaattagtcttcagaaatggagatgccattgaatttgcccagttgatggtgaaagctgcctctgctgctgcccgaggatttccacttagaaccttaaatgactggttcagctctatgggaatttatgtaattactggggaagggaatatgtgcactccacagatgccttgttcagttattgtctatggagccccacctgcaggatatggagccccacctcccggatacggagccccacctgcaggatatggagcccaacccgtaggaaatgaaggcccgcctgtgggatacagagcctcacctgtgcgatatggagccccacctcttggatacggagccccacctgcaggatatggagccccacctctaggatatggagccccacctcttggatatggaaccccacctctcggatatggagccccacctctcggatatggagccccacctgcaggaaatgaaggcccgcctgcgggatacagagcctcacctgctggatcaggagccaggcctcaggaatctacagcagcccaggctcctgaaaacgaggcttctcttccctctgcctcctcttctcaggtccattcttaaccttctaagatgtaaaccttgaagactcaccaagcaaagaggtaccctaaaattgaagtcaggataaggaggacgactcaggtatgtgatcacaggcttctcgcaggtagttgttccaccctttggaagggcaatcttatgggggaaggtgaaactttacttctgtgcctagattttagaagcagaatcaactcttaaatagctggctaaaggaagaataccattgtggggctaattccccagtaatttggttgacattgggttgcatttttaaacataactttttccacactcgcattcaaggttcctgtcttcccatcctcattcaagaaacatttattatgctccgtttgctaggcactaagatgcgtgctaaaaacgtcatgttgaacacttagttgtttgagaaagctaaattttcaatagtaagagtgttataaattacggtggatccacaaaatggagtattatacacctgttgaaaactatgtctagaggtagagaaagccttctttgaggagaccaaaaccaacaaataaaagcatgataaattgactatatcaaaatttaaaacttctctatgacagaagttaaaagataggcaacagaataggaaaaagtgattttcaacatatatattaatttatagtcagaatacgtgaataactacaaatcaattctccccaaaatgacagaaatatgaattgccgaataaccaaggcaatagcatggccagaaaacgtttgaaaagatgttcagcttgactagtgttagggaaatgcaacctgagatgagaaaacatttttatctccaaagatttacaaatattaaaactcttgatatggcactttcacattttaaaatatgcctgcgagaaaacttgcatgtgtgcacaaagatgcatgtgggaagatttcattatattcattgtttctaacagcacaaaattagaaataacctatatgtccattaataggaaatatatgaataggctatggtatgcccatactacgtatgcagaaatttctaagacttgttgataaggagaaaagcaagttgtagggagcatatactatagtgattttcagcctcatcagactgaatgccccattttataacaaatatttatattttataacaaacgtttatatttgtatatttataacaaatattttgtaatgtctccttcacttcaatgaagtttgtagataattgcatatgattccacaccatttcaaccaaaattaataggccataaatgtgatagaggaaataaaaggagtttgtagtaaaa

SEQ ID NO: 199625 - DNA, 1423 bp, Homo sapiens
  Payload ID: 19388
  Gene Name: WBP2 N-terminal like
  ENST ID: ENST00000412113
  CDS Start-End: 95-916
ataatctccgccctccccttcagaaccgcgccccacagctcggcgcaggtcccgcccctttccatctacggggcggcaggaggcccgaagcaagatggcggtgaatcagagccacaccgagaaccgccgcggagccctcatccctaacggtgaaagtctcttgaagcggtctccgaatgtggagctctccttcccacagcgatcagaaggctcaaatgtctttagtggtagaaagacaggaacattgtttctcacttcataccgggtgattttcataacttcatgctccatcagtgatcccatgttgtcttttatgatgccatttgatctgatgacgaacctcactgttgaacaaccagtatttgctgcaaacttcattaagggaactattcaggcagctccatatggtggctgggaaggacaagctacttttaaattagtcttcagaaatggagatgccattgaatttgcccagttgatggtgaaagctgcctctgctgttattgtctatggagccccacctgcaggatatggagccccacctcccggatacggagccccacctgcaggatatggagcccaacccgtaggaaatgaaggcccgcctgtgggatacagagcctcacctgtgcgatatggagccccacctcttggatacggagccccacctgcaggatatggagccccacctctaggatatggagccccacctcttggatatggaaccccacctctcggatatggagccccacctctcggatatggagccccacctgcaggaaatgaaggcccgcctgcgggatacagagcctcacctgctggatcaggagccaggcctcaggaatctacagcagcccaggctcctgaaaacgaggcttctcttccctctgcctcctcttctcaggtccattcttaaccttctaagatgtaaaccttgaagactcaccaagcaaagaggtaccctaaaattgaagtcaggataaggaggacgactcagcttagagtcattgattgatctgcattgtgaaaattaggaaaccagatgctcccatgttctcaaggacagcctttcttaaggaagtcagtacgtgggcaacagtgatgagaggaagagaggagagactcaaccaactagagcagggataaggtttcccttgttcagcttttcagtgtctgctggaatgtgatgattctgccctctcagctgtgctgttggtctgcatcacctctatctcttaagcatctatcctaatccaaatctcaggatttgggtttacccaaaagattacctcattgtcaggtaggaagtgaaacgtatgatattcttcctggcctttgccttgagagtcttctggagcctgaagagggtggggcagacaaccatggactgctagagaataaactttctttgaagcttcctaaa

SEQ ID NO: 199626 - DNA, 475 bp, Homo sapiens
  Payload ID: 19388
  Gene Name: WBP2 N-terminal like
  ENST ID: ENST00000445185
  CDS Start-End: 27-278
cggggcggcaggaggcccgaagcaagatggcggtgaatcagagccacaccgagaaccgccgcggagccctcatccctaacggtgaaagtctcttgaagcggtctccgaatgtggagctctccttcccacagcgatcagaaggctcaaatgtctttagtggtagaaagacaggaacattgtttctcacttcataccggtatttgctgcaaacttcattaagggaactattcaggcagctccatatggtggctgggaaggacaagctacttttaaattagtcttcagaaatggagatgccattgaatttgcccagttgatggtgaaagctgcctctgctgctgcccgaggatttccacttagaaccttaaatgactggttcagctctatgggaatttatgtaattactggggaagggaatatgtgcactccacagatgccttgttcagttattgtctatggagccccacctgcagga

SEQ ID NO: 199627 - DNA, 1417 bp, Homo sapiens
  Payload ID: 19388
  Gene Name: WBP2 N-terminal like
  Uniprot ID: Q6ICG8
  ENST ID: ENST00000436265
  CDS Start-End: 48-977
ggtcccgcccctttccatctacggggcggcaggaggcccgaagcaagatggcggtgaatcagagccacaccgagaaccgccgcggagccctcatccctaacggtgaaagtctcttgaagcggtctccgaatgtggagctctccttcccacagcgatcagaaggctcaaatgtctttagtggtagaaagacaggaacattgtttctcacttcataccgggtgattttcataacttcatgctccatcagtgatcccatgttgtcttttatgatgccatttgatctgatgacgaacctcactgttgaacaaccagtatttgctgcaaacttcattaagggaactattcaggcagctccatatggtggctgggaaggacaagctacttttaaattagtcttcagaaatggagatgccattgaatttgcccagttgatggtgaaagctgcctctgctgctgcccgaggatttccacttagaaccttaaatgactggttcagctctatgggaatttatgtaattactggggaagggaatatgtgcactccacagatgccttgttcagttattgtctatggagccccacctgcaggatatggagccccacctcccggatacggagccccacctgcaggatatggagcccaacccgtaggaaatgaaggcccgcctgtgggatacagagcctcacctgtgcgatatggagccccacctcttggatacggagccccacctgcaggatatggagccccacctctaggatatggagccccacctcttggatatggaaccccacctctcggatatggagccccacctctcggatatggagccccacctgcaggaaatgaaggcccgcctgcgggatacagagcctcacctgctggatcaggagccaggcctcaggaatctacagcagcccaggctcctgaaaacgaggcttctcttccctctgcctcctcttctcaggtccattcttaaccttctaagatgtaaaccttgaagactcaccaagcaaagaggtaccctaaaattgaagtcaggataaggaggacgactcagcttagagtcattgattgatctgcattgtgaaaattaggaaaccagatgctcccatgttctcaaggacagcctttcttaaggaagtcagtacgtgggcaacagtgatgagaggaagagaggagagactcaaccaactagagcagggataaggtttcccttgttcagcttttcagtgtctgctggaatgtgatgatactctagctcacacatcagaagagcatgtgcaggaagagagatgaaataatggtacacgttgatggttactggagctggatgctgggtacatggaggttcactctaccattttatttttgtatttgaaagttttcatgataaaaagtttttaaaaagagaaaggg

SEQ ID NO: 199628 - DNA, 1001 bp, Homo sapiens
  Payload ID: 19388
  Gene Name: WBP2 N-terminal like
  ENST ID: ENST00000543212
  CDS Start-End: 1-708
atgccatttgatctgatgacgaacctcactgttgaacaaccagtatttgctgcaaacttcattaagggaactattcaggcagctccatatggtggctgggaaggacaagctacttttaaattagtcttcagaaatggagatgccattgaatttgcccagttgatggtgaaagctgcctctgctgctgcccgaggatttccacttagaaccttaaatgactggttcagctctatgggaatttatgtaattactggggaagggaatatgtgcactccacagatgccttgttcagttattgtctatggagccccacctgcaggatatggagccccacctcccggatacggagccccacctgcaggatatggagcccaacccgtaggaaatgaaggcccgcctgtgggatacagagcctcacctgtgcgatatggagccccacctcttggatacggagccccacctgcaggatatggagccccacctctaggatatggagccccacctcttggatatggaaccccacctctcggatatggagccccacctctcggatatggagccccacctgcaggaaatgaaggcccgcctgcgggatacagagcctcacctgctggatcaggagccaggcctcaggaatctacagcagcccaggctcctgaaaacgaggcttctcttccctctgcctcctcttctcaggtccattcttaaccttctaagatgtaaaccttgaagactcaccaagcaaagaggtaccctaaaattgaagtcaggataaggaggacgactcagcttagagtcattgattgatctgcattgtgaaaattaggaaaccagatgctcccatgttctcaaggacagcctttcttaaggaagtcagtacgtgggcaacagtgatgagaggaagagaggagagactcaaccaactagagcagggataaggtttcccttgttcagcttttcagtgtctgctggaatgtgatgattacctcattgtcaggtag

SEQ ID NO: 199629 - DNA, 4819 bp, Homo sapiens
  Payload ID: 19389
  Gene Name: WD and tetratricopeptide repeats 1
  Uniprot ID: Q8N5D0
  ENST ID: ENST00000319394
  CDS Start-End: 536-2569
aagtgggggggcccggctagccattctggaagcggccgggcgcagtcttcgtagcgtacccgccggctgcgaggcgcagggcggaggcggagactgcgtggcgcaggcgcgttgctgggcttctcctgggtccccagacagctggaggagataaacagaggaggaggagggaggggagtgcgtgtgtgagagcgcgcgagggagtgtgagtgtgtgtgagcgcgggtgtgaggcggtgcgcaggggcgggcggaggcgctgtccggccccggccaggcgccgggcggggagcatgggaaggggctagaactgctcgagccccccagccccctccccgggatccgcgccccccttcccgggagaggggccgccccccccggacggacatgggctcctgaagttgcgccgctgccggtcgggggaagagacctgacaggtaattaaatgtgtattttgtggacctgggcttggctggaatgctcaggggtcctgaagatcctattatagcttccttctgttgaaccattaagaaaagatggcgaaagtcaacataactagagacctcatccgtaggcagatcaaggagcggggtgccctgagctttgagcggcgctaccatgtcactgacccctttatccggcggctgggcctggaagcagagctgcagggtcactcaggatgtgtcaactgtctggagtggaatgagaaaggagacttgctggcctctggttccgatgaccagcacacgattgtgtgggacccgctgcaccacaagaagctgctctccatgcacacgggacacaccgcaaatatcttctctgtcaagttcctgcctcacgctggggaccgcatcttgatcacgggggcagccgactctaaggtgcatgtgcacgacctgacagtaaaggagaccatccacatgtttggagaccacacaaaccgggtgaagcgcatcgccacagcgcccatgtggcccaacacattctggagtgctgctgaggatgggcttatccgccagtatgaccttcgagagaacagcaaacactcggaggtgctgattgacctgacagagtactgtggccagctggtggaggccaagtgcctcactgtcaacccccaggacaacaactgcctggcagttggggccagcgggcccttcgtgaggctctatgacatccgcatgatccataaccacagaaagagcatgaagcagagcccttcagcgggtgtgcacaccttctgtgaccggcagaaaccccttccggacggtgcagcccagtattacgtagcaggtcacctgccagtgaagcttcctgactacaacaaccgtttgagagtgctggttgccacctatgtgaccttcagccccaatggcacagagctactagtcaacatggggggggaacaggtctatttgtttgacttgacttacaagcagcggccgtacaccttcctcttgcctagaaaatgccactcctcgggggaagtccagaatggcaagatgtccaccaacggtgtgtccaacggtgtgtccaatggcctgcaccttcatagcaatggcttccggctgccggagagtaggggacatgtcagcccccaagtagagctaccaccatacctggagcgtgtgaaacagcaagccaatgaggcttttgcctgccagcagtggacccaagccattcagctttacagcaaggctgtgcagagggcccctcacaatgccatgctttatggaaaccgagcagcagcctacatgaagcgcaagtgggatggtgaccactatgatgccctgagggactgcctcaaggccatctccctaaacccatgccacctgaaggcacactttcgcctggcccgctgcctctttgagctcaagtatgtggctgaagccctggagtgcctggacgacttcaaagggaaatttccggagcaggcccacagcagcgcttgtgatgcattgggccgcgacatcacagctgccctcttctctaaaaatgatggtgaggagaagaagggacctggtggcggcgccccagtccgcctccgcagcacgagccgcaaggactccatctcagaggatgaaatggtgctgcgggagcgaagctacgactatcagttccgctactgcggccactgcaacaccaccacggatatcaaagaggccaatttctttggcagcaacgctcagtatatcgtcagtggctctgacgatggctccttcttcatctgggaaaaggagaccaccaacctggtccgtgtgctccaaggggatgagtccattgtcaactgcctgcagccacaccccagctactgcttcctggccaccagtggcatcgatcctgttgtgcggctctggaacccccgaccagagagtgaagacctcacaggccgagtcgtggaagatatggagggtgcttcacaggccaaccagcggcgcatgaatgcagacccgttggaggtgatgctgctcaacatgggctaccggatcacgggcctgagcagtgggggtgccggggcctctgatgatgaggacagctctgagggccaggtgcagtgccggcccagctagaccctccagccctggtccccagcccctgctactggctggaccctctgccctgggcaggaggtcaggggattctgttttggtttgtcttccccaccacccttttttttcatttcccctgttttgtttgttagtttggcgttaggggtggaggttgctacaacttgctggctttcggactctgggctgattgtcccctgactatccccagccctgaaaaaaagagcaggaggggacacccctccatatgcccccccccatctcctgctttcatgtccctggagggctctggcctgcctcaaaaccccttctgcctcaggtggggaggaacaagctgaactgtcttcagggactgtcctgccctttagctggcagcagcaggaggagtgggattcccaattggtaagggctcgccttggcctgttgccactcttgctccctagcctgcaaggctagctcccctgtggtcttcaggaaaggttttgaaaaaggatgggtcccaccctccctccagagccaccagtgttagagcggagcccaaaggaaggatgggagccctggagtgggcaagaccaggccacctgctgaggtcgctgtggagcaccctcgctcctctcctggctactagctctggccctgcacctactctcactggccacctctggaggctctgcctttcccaagggccctggcagagggtggggcactgcaccttaccccacccatccatgccagcacttctgcactacggccattctcctcttgggcgctcctcagcctcactgtgacctttctgccagagctcccagccaggcctactctgctgaggtggcgcttcctgctaagggcccttctctgccctttctgccctccttcccatcccacatgctgagccgccacaaagaccaaagaagtgatggcttttctctgtcccctgctgctctgaggggagaggggtgggtctcctgagccactcagatgggaaagtcccttactcggcccctccctccccagcagccccaagctttacactggatgcagcgatcaacccaccactcaccaggcctctcctcccctctgcccccggctcttagctccagctgctccaggtagttggttcatccttccccctctctccctccctgcttccccttcagtgcttacttggctccagccctccagctgcagcccctggggaaaagcagcctcccttctcctctccctccactccctcgctccctccctcagcccctgtctctgccaggtgcctcctctcagtcaggcttcagagcagccctggagacaggagggccatgttaaaagctttttcacagttttaagaagacaagtggagggtgaggatagtggtggggggtctggcaccatctcattgctttaatcccagcaacacaggtggcagcttctcccccttccttcccaccccagtccctcttcccacccctctcttctagcttggtaatgaagtatatttattggtgaaggaaacagctgctgctgcttctcctgctgctgggacctgctcccctgtctcttctccgtgacctttctctagccagggagaagggagagcaggagtattggggctgggccctggggcccaaggaccagctgggtcccctttgctttcttgtgttccagccacctgccatttcctccctgcctcccaccctccctccctgccccctgtcctgcttcccaccccctgcctgcccagcctgggccctgcagtgtggagagacacataagccttactgtcctctgggggcaggagccgagcctttttgttgctccgctcccaggagagtgagggtgacgcaattgattaaaaccattttgttctaggtgtggctggtggcatttgtggggtgcagatgggtcttggaaccaaagtgagggcacctggtccctcacctctgtagctctatgacttagtaaccacacctctactggacagaatgaggcctgccttgaagggtcaccgtgagcagcggccacccagcccagcagggctgagtgcagagcccagctctcatggctgtgatttgtaatcatcagctttcactctctggctgttttctcatcagtaaaataagggacttggaatcttagtggtttttcaaaccattttacattgtgacccaatatacacatgattacttgtagatatgtgtgtgtgtatatatatataaaaaaaatgaacaaaagttttacacaataatatttacccttgct

SEQ ID NO: 199630 - DNA, 4275 bp, Homo sapiens
  Payload ID: 19389
  Gene Name: WD and tetratricopeptide repeats 1
  Uniprot ID: Q8N5D0
  ENST ID: ENST00000361771
  CDS Start-End: 384-2414
aaacagaggaggaggagggaggggagtgcgtgtgtgagagcgcgcgagggagtgtgagtgtgtgtgagcgcgggtgtgaggcggtgcgcaggggcgggcggaggcgctgtccggccccggccaggcgccgggcggggagcatgggaaggggctagaactgctcgagccccccagccccctccccgggatccgcgccccccttcccgggagaggggccgccccccccggacggacatgggctcctgaagttgcgccgctgccggtcgggggaagagacctgacaggtaattaaatgtgtattttgtggacctgggcttggctggaatgctcaggggtcctgaagatcctattatagcttccttctgttgaaccattaagaaaagatggcgaaagtcaacataactagagacctcatccgtaggcagatcaaggagcggggtgccctgagctttgagcggcgctaccatgtcactgacccctttatccggcggctgggcctggaagcagagctgcagggtcactcaggatgtgtcaactgtctggagtggaatgagaaaggagacttgctggcctctggttccgatgaccagcacacgattgtgtgggacccgctgcaccacaagaagctgctctccatgcacacgggacacaccgcaaatatcttctctgtcaagttcctgcctcacgctggggaccgcatcttgatcacgggggcagccgactctaaggtgcatgtgcacgacctgacagtaaaggagaccatccacatgtttggagaccacacaaaccgggtgaagcgcatcgccacagcgcccatgtggcccaacacattctggagtgctgctgaggatgggcttatccgccagtatgaccttcgagagaacagcaaacactcggaggtgctgattgacctgacagagtactgtggccagctggtggaggccaagtgcctcactgtcaacccccaggacaacaactgcctggcagttggggccagcgggcccttcgtgaggctctatgacatccgcatgatccataaccacagaaagagcatgaagcagagcccttcagcgggtgtgcacaccttctgtgaccggcagaaaccccttccggacggtgcagcccagtattacgtagcaggtcacctgccagtgaagcttcctgactacaacaaccgtttgagagtgctggttgccacctatgtgaccttcagccccaatggcacagagctactagtcaacatggggggggaacaggtctatttgtttgacttgacttacaagcagcggccgtacaccttcctcttgcctagaaaatgccactcctcgggggtccagaatggcaagatgtccaccaacggtgtgtccaacggtgtgtccaatggcctgcaccttcatagcaatggcttccggctgccggagagtaggggacatgtcagcccccaagtagagctaccaccatacctggagcgtgtgaaacagcaagccaatgaggcttttgcctgccagcagtggacccaagccattcagctttacagcaaggctgtgcagagggcccctcacaatgccatgctttatggaaaccgagcagcagcctacatgaagcgcaagtgggatggtgaccactatgatgccctgagggactgcctcaaggccatctccctaaacccatgccacctgaaggcacactttcgcctggcccgctgcctctttgagctcaagtatgtggctgaagccctggagtgcctggacgacttcaaagggaaatttccggagcaggcccacagcagcgcttgtgatgcattgggccgcgacatcacagctgccctcttctctaaaaatgatggtgaggagaagaagggacctggtggcggcgccccagtccgcctccgcagcacgagccgcaaggactccatctcagaggatgaaatggtgctgcgggagcgaagctacgactatcagttccgctactgcggccactgcaacaccaccacggatatcaaagaggccaatttctttggcagcaacgctcagtatatcgtcagtggctctgacgatggctccttcttcatctgggaaaaggagaccaccaacctggtccgtgtgctccaaggggatgagtccattgtcaactgcctgcagccacaccccagctactgcttcctggccaccagtggcatcgatcctgttgtgcggctctggaacccccgaccagagagtgaagacctcacaggccgagtcgtggaagatatggagggtgcttcacaggccaaccagcggcgcatgaatgcagacccgttggaggtgatgctgctcaacatgggctaccggatcacgggcctgagcagtgggggtgccggggcctctgatgatgaggacagctctgagggccaggtgcagtgccggcccagctagaccctccagccctggtccccagcccctgctactggctggaccctctgccctgggcaggaggtcaggggattctgttttggtttgtcttccccaccacccttttttttcatttcccctgttttgtttgttagtttggcgttaggggtggaggttgctacaacttgctggctttcggactctgggctgattgtcccctgactatccccagccctgaaaaaaagagcaggaggggacacccctccatatgcccccccccatctcctgctttcatgtccctggagggctctggcctgcctcaaaaccccttctgcctcaggtggggaggaacaagctgaactgtcttcagggactgtcctgccctttagctggcagcagcaggaggagtgggattcccaattggtaagggctcgccttggcctgttgccactcttgctccctagcctgcaaggctagctcccctgtggtcttcaggaaaggttttgaaaaaggatgggtcccaccctccctccagagccaccagtgttagagcggagcccaaaggaaggatgggagccctggagtgggcaagaccaggccacctgctgaggtcgctgtggagcaccctcgctcctctcctggctactagctctggccctgcacctactctcactggccacctctggaggctctgcctttcccaagggccctggcagagggtggggcactgcaccttaccccacccatccatgccagcacttctgcactacggccattctcctcttgggcgctcctcagcctcactgtgacctttctgccagagctcccagccaggcctactctgctgaggtggcgcttcctgctaagggcccttctctgccctttctgccctccttcccatcccacatgctgagccgccacaaagaccaaagaagtgatggcttttctctgtcccctgctgctctgaggggagaggggtgggtctcctgagccactcagatgggaaagtcccttactcggcccctccctccccagcagccccaagctttacactggatgcagcgatcaacccaccactcaccaggcctctcctcccctctgcccccggctcttagctccagctgctccaggtagttggttcatccttccccctctctccctccctgcttccccttcagtgcttacttggctccagccctccagctgcagcccctggggaaaagcagcctcccttctcctctccctccactccctcgctccctccctcagcccctgtctctgccaggtgcctcctctcagtcaggcttcagagcagccctggagacaggagggccatgttaaaagctttttcacagttttaagaagacaagtggagggtgaggatagtggtggggggtctggcaccatctcattgctttaatcccagcaacacaggtggcagcttctcccccttccttcccaccccagtccctcttcccacccctctcttctagcttggtaatgaagtatatttattggtgaaggaaacagctgctgctgcttctcctgctgctgggacctgctcccctgtctcttctccgtgacctttctctagccagggagaagggagagcaggagtattggggctgggccctggggcccaaggaccagctgggtcccctttgctttcttgtgttccagccacctgccatttcctccctgcctcccaccctccctccctgccccctgtcctgcttcccaccccctgcctgcccagcctgggccctgcagtgtggagagacacataagccttactgtcctctgggggcaggagccgagcctttttgttgctccgctcccaggagagtgagggtgacgcaattgattaaaaccattttgttctagg

SEQ ID NO: 199631 - DNA, 3115 bp, Homo sapiens
  Payload ID: 19389
  Gene Name: WD and tetratricopeptide repeats 1
  Uniprot ID: Q8N5D0
  ENST ID: ENST00000447062
  CDS Start-End: 8-1855
agaaaagatggcgaaagtcaacataactagagacctcatccgtaggcagatcaaggagcggggtgccctgagctttgagcggcgctaccatgtcactgacccctttatccggcggctgggcctggaagcagagctgcagggtcactcaggatgtgtcaactgtctggagtggaatgagaaaggagacttgctggcctctggttccgatgaccagcacacgattgtgtgggacccgctgcaccacaagaagctgctctccatgcacacgggacacaccgcaaatatcttctctgtcaagttcctgcctcacgctggggaccgcatcttgatcacgggggcagccgactctaaggtgcatgtgcacgacctgacagtaaaggagaccatccacatgtttggagaccacacaaaccgggtgaagcgcatcgccacagcgcccatgtggcccaacacattctggagtgctgctgaggatgggcttatccgccagtatgaccttcgagagaacagcaaacactcggaggtgctgattgacctgacagagtactgtggccagctggtggaggccaagtgcctcactgtcaacccccaggacaacaactgcctggcagttggggccagcgggcccttcgtgaggctctatgacatccgcatgatccataaccacagaaagagcatgaagcagagcccttcagcgggtgtgcacaccttctgtgaccggcagaaaccccttccggacggtgcagcccagtattacgtagcaggtcacctgccagtgaagcttcctgactacaacaaccgtttgagagtgctggttgccacctatgtgaccttcagccccaatggcacagagctactagtcaacatggggggggaacaggtctatttgtttgacttgacttacaagcagcggccgtacaccttcctcttgcctagaaaatgccactcctcgggggaagtccagaatggcaagatgtccaccaacggtgtgtccaacggtgtgtccaatggcctgcaccttcatagcaatggcttccggctgccggagagtaggggacatgtcagcccccaagtagagctaccaccatacctggagcgtgtgaaacagcaagccaatgaggcttttgcctgccagcagtggacccaagccattcagctttacagcaaggctgtgcagagggcccctcacaatgccatgctttatggaaaccgagcagcagcctacatgaagcgcaagtgggatggtgaccactatgatgccctgagggactgcctcaaggccatctccctaaacccatgccacctgaaggcacactttcgcctggcccgctgcctctttgagctcaagtatgtggctgaagccctggagtgcctggacgacttcaaagggaaatttccggagcaggcccacagcagcgcttgtgatgcattgggccgcgacatcacagctgccctcttctctaaaaatgatggtgaggagaagaagggacctggtggcggcgccccagtccgcctccgcagcacgagccgcaaggactccatctcagaggatgaaatggtgctgcgggagcgaagctacgactatcagttccgctactgcggccactgcaacaccaccacggatatcaaagaggccaatttctttggcaggagaccaccaacctggtccgtgtgctccaaggggatgagtccattgtcaactgcctgcagccacaccccagctactgcttcctggccaccagtggcatcgatcctgttgtgcggctctggaacccccgaccagagagtgaagacctcacaggccgagtcgtggaagatatggagggtgcttcacaggccaaccagcggcgcatgaatgcagacccgttggaggtgatgctgctcaacatgggctaccggatcacgggcctgagcagtgggggtgccggggcctctgatgatgaggacagctctgagggccaggtgcagtgccggcccagctagaccctccagccctggtccccagcccctgctactggctggaccctctgccctgggcaggaggtcaggggattctgttttggtttgtcttccccaccacccttttttttcatttcccctgttttgtttgttagtttggcgttaggggtggaggttgctacaacttgctggctttcggactctgggctgattgtcccctgactatccccagccctgaaaaaaagagcaggaggggacacccctccatatgcccccccccatctcctgctttcatgtccctggagggctctggcctgcctcaaaaccccttctgcctcaggtggggaggaacaagctgaactgtcttcagggactgtcctgccctttagctggcagcagcaggaggagtgggattcccaattggtaagggctcgccttggcctgttgccactcttgctccctagcctgcaaggctagctcccctgtggtcttcaggaaaggttttgaaaaaggatgggtcccaccctccctccagagccaccagtgttagagcggagcccaaaggaaggatgggagccctggagtgggcaagaccaggccacctgctgaggtcgctgtggagcaccctcgctcctctcctggctactagctctggccctgcacctactctcactggccacctctggaggctctgcctttcccaagggccctggcagagggtggggcactgcaccttaccccacccatccatgccagcacttctgcactacggccattctcctcttgggcgctcctcagcctcactgtgacctttctgccagagctcccagccaggcctactctgctgaggtggcgcttcctgctaagggcccttctctgccctttctgccctccttcccatcccacatgctgagccgccacaaagaccaaagaagtgatggcttttctctgtcccctgctgctctgaggggagaggggtgggtctcctgagccactcagatgggaaagtcccttactcggcccctccctccccagcagccccaagctttacactggatgcagcgatcaacccaccactcaccaggagccgagcctttttgttgctccgctcccaggagagtgagggtgacgcaattgattaaaaccattttgttct

SEQ ID NO: 199632 - DNA, 628 bp, Homo sapiens
  Payload ID: 19389
  Gene Name: WD and tetratricopeptide repeats 1
  ENST ID: ENST00000472249
  CDS Start-End: 1-378
atcgtcagtggctctgacgatggctccttcttcatctgggaaaaggagaccaccaacctggtccgtgtgctccaaggggatgagtccattgtcaactgcctgcagccacaccccagctactgcttcctggccaccagtggcatcgatcctgttgtgcggctctggaacccccgaccagagagtgaagacctcacaggccgagtcgtggaagatatggagggtgcttcacaggccaaccagcggcgcatgaatgcagacccgttggaggtgatgctgctcaacatgggctaccggatcacgggcctgagcagtgggggtgccggggcctctgatgatgaggacagctctgagggccaggtgcagtgccggcccagctagaccctccagccctggtccccagcccctgctactggctggaccctctgccctgggcaggaggtcaggggaacaagctgaactgtcttcagggactgtcctgccctttagctggcagcagcaggaggagtgggattcccaattggtaagggctcgccttggcctgttgccactcttgctccctagcctgcaaggctagctcccctgtggtcttcaggaaaggttttgaaaaaggatgggtcccaccctccct

SEQ ID NO: 199633 - DNA, 4660 bp, Homo sapiens
  Payload ID: 19390
  Gene Name: WD repeat and FYVE domain containing 1
  Uniprot ID: Q8IWB7
  ENST ID: ENST00000233055
  CDS Start-End: 104-1336
aagaggccccagcagccgaagggaaaccggcgcgtcccccgcccgcccaggcgtcagctgatgggctgcctgccgaggaggccgcagcagtcgccgcgcgaacatggcggccgaaatccactccaggccgcagagcagccgcccggtgctgctgagcaagatcgaggggcaccaggacgccgtcacggccgcgctgctcatccccaaggaggacggcgtgatcacggccagcgaggacagaaccatccgggtatggctgaaaagagacagtggtcaatactggcccagcatttaccacacaatggcctctccttgctctgctatggcttaccatcatgacagcagacggatatttgtgggccaggataatggagctgtaatggaatttcacgtttctgaagattttaataaaatgaactttatcaagacctacccagctcatcagaaccgggtgtctgcgattatcttcagcttggccacagagtgggtgatcagtaccggccacgacaagtgtgtgagctggatgtgcacgcggagcgggaacatgctcgggaggcacttcttcacgtcctgggcttcgtgtctgcaatatgactttgacactcagtatgctttcgttggtgattattctgggcagatcaccctgctgaagcttgaacagaacacgtgttcagtcatcacaaccctcaaaggacatgaaggtagtgtcgcctgcctctggtgggaccctattcagcggttactcttctcaggagcatctgacaacagcatcatcatgtgggacatcggaggaaggaaaggccggacgctgttacttcagggccatcatgacaaggtgcagtcgctgtgctaccttcagctcaccaggcagctcgtctcctgttcctcggacggcggaattgcagtgtggaacatggatgttagcagagaagaggctcctcagtggttggaaagtgattcttgtcagaaatgtgagcagccatttttctggaacataaagcagatgtgggacaccaagacgctggggctaagacaacatcactgcaggaaatgcgggcaggctgtctgcgggaagtgcagcagcaagcgctcaagttacccagtcatgggcttcgagttccaagtccgggtttgtgattcttgttacgactccatcaaagatgaagatcggacttctctagcgacctttcatgaaggaaaacataacatttcccacatgtccatggacattgccaggggactgatggtgacctgtgggaccgaccgcattgtaaagatctgggacatgacacctgtggtgggctgcagtctggcgactgggttttctccgcactgatctgagagctgggcggcgtccacacctaagaacagcagctccaccaaatgaagtccctctcacgcagctccacagcgctgtctcgtgaatggacagtagccacttacaaacaaatcaacatttttaaaaagaaaatgtaaaggtgtgttttggggcatttgtggaacttacccatggggactaatatggaaaaggtctgtccatagtggttccctgaagactggaattacttcagcaaaacttccccatgaacagctaatgtgtagtgaaagaatgagctagcaaatgagttttagcggggacaaaaaatcaaacaaaaaagtgaatgcttagaaccttctcaaagcagtcacaagtacagacacttcacttagcctagggggccttccagggttcttgtggctgttgtcagagcaggagctgggggagggaagacttgttctctctttcttgaggggtggcattaggaacttacgaaaccagagacctttccctatgacttggcagtatgtgaatatcctctacacttagttattgataaacttcttaaagagatctgttattttcaggtagtgccataatctgcacttagcattggcttgcttcagttgtttctcttcccagccagtatgccacaggtgaactttcggggttgtcattaagtaagttgtgaaatttctgtaataacaaaggcagtccgcattcttccctttcccccaaattcctagggcaaaacttttttatggtgctgttaacatgggagtcacacaagccgcctgactttttctcattgccattagtaatgactgatggaaaacccagccaccactgtgatgcgaaatgatcagtctgttgcctgaaacagcccagtcctcttaactgaaacagcattctacttcttgttccaagatgagcctctgcaatattctggcaatttaatataccccctacaaaagcactccacagcttttacactattttgactttgagttataactagtattattcatgttttcataaaaagaagttagtgacccagagctataatcatccatcaagtcttccacaataattcccaactcataaattgctttcctaacaactagcaaaagctattgttcataatggcatttctaaagcttttgggcactgtgtaccaggatgaggaagagaagaaatgaggagcctgtcttttaatattccagtatttgtgtgtttgattttttttgacaacagtacatatatctatttctctagggatatggaagtaagtggagaagggcctacctttttaaaggacaaatataaaaatagcaacagtatctttgctaatcttactaatagatattgattaaaaaaaaaaaacctcagtactgcatcactgtgttgggatcataccaggacaatagggtcattccatatgataaaactaaaggactaaatttgttttataatgatgtcttagagggactgaaaggtttaaggaggcgatcaaactaaaatgtcttaatggctgtgtgacacacgtaaggaaaggaaagggggtcacgcacatcatgtactggaatgatctgcattaaacatagacttgtcttcagaaataagactgaagggttttgttgttccttagagttttcgtgttacatcacctaaagagatttcttttaaaaactttctagactctttgcaaaatgtatattactaacatagtttggaagaaaaattgagtagtggtaagttttgttcaagcacaatgttgaatgttaagcttcctgtattaattttagttcagttaatggttcagcccatacaaaggtgctatcctagggattttatgaattcctgaaaggaaaatagaatatgatcaattccttgccctgtggaagagtgcagaactgtggttttgttttcctttgacttctgtaaaatgtgaccgtttgacatctgtggtagattgaacggaatatcacagctgctgagtttactccatagctttcaaaccttttttattttaagaaattcttgaaaaaccctatgttccatgggaacataaagttattatagtgcctcctaaggggttaatataaatcaaggaggaagtttatatttaaggaagaattggagtgacgtatcttagaaaaggaaaggctgatgtttccatatagcttgctctccaccaggcctatcatttttctttttagagacaaacgtgacaggctagtcttgtctctctcatatgctaggtagcaaatggggtgatatttttatagaagtgggcaaaaattattttctcaattttactgagtaggcacagaagaaaagtacagataggctgatggttattgccttattttgactgcatttctcttaaatggatcatttaaattagttcttcaagtaacagtttactggttgttccattcctgaatatgcaggctaatttgtacagatagggattaaggaatacagactattagagaagatccttatatttacatctagtatatatgtggtaaggaaatgccgattcttcattataaacaagttttaaaattgttctttcttagttcaaatgatagcaatacccctatagcattaggtagaaacaaattattcattacatcgtaaatctctttactatgtcctagctctgtcctgctacctaaaggatataaagaaatactattgctctagaatgtattactttgttctcccatgaaagaattcagtttgttagtacctatatttttaaactggtgaaactgacccaaatatgtaataaataccatagtagctcagacccaaggagatatttttctaaaatcagttttcgttaaagtacttctacttccgttattggatatggtatctcctaaagtgtaaaaaaaatctgttactatatagtgataaaccatctgctcatcgtaagtgtaaggcttaacaaataagtaatacatgctatatttattcaagtgtctattgcttaattgttaattgtgagcagatttattgaatgcctattctattttctgcagtttacaatacaataactctttgagtaagttgaagtttaattgtgcaacaaatttgtattagagtacaatttaaagtgtttttctctatagccttttttgactggggaagcaaggggtaatgttaattagtacactttgttcttgtactagctatgtttctataagatatggtgccctgtgtatcccagagatgctagaaaactgttctttgctcctatttgtgggttctgtttttgtgggtttttttttttgagaaaatgtacacaataaaacattccttgcttgttac

SEQ ID NO: 199634 - DNA, 719 bp, Homo sapiens
  Payload ID: 19390
  Gene Name: WD repeat and FYVE domain containing 1
  ENST ID: ENST00000429915
  CDS Start-End: 74-719
cgcgtcccccgcccgcccaggcgtcagctgatgggctgcctgccgaggaggccgcagcagtcgccgcgcgaacatggcggccgaaatccactccaggccgcagagcagccgcccggtgctgctgagcaagatcgaggggcaccaggacgccgtcacggccgcgctgctcatccccaaggaggacggcgtgatcacggccagcgaggacagaaccatccgggtatggctgaaaagagacagtggtcaatactggcccagcatttaccacacaatggcctctcatcagaaccgggtgtctgcgattatcttcagcttggccacagagtgggtgatcagtaccggccacgacaagtgtgtgagctggatgtgcacgcggagcgggaacatgctcgggaggcacttcttcacgtcctgggcttcgtgtctgcaatatgactttgacactcagtatgctttcgttggtgattattctgggcagatcaccctgctgaagcttgaacagaacacgtgttcagtcatcacaaccctcaaaggacatgaaggtagtgtcgcctgcctctggtgggaccctattcagcggttactcttctcaggagcatctgacaacagcatcatcatgtgggacatcggaggaaggaaaggccggacgctgttacttcagggccatcatgacaaggtgcagtcgctgtgctaccttcagctcaccaggcagctcgtct

SEQ ID NO: 199635 - DNA, 9321 bp, Homo sapiens
  Payload ID: 19391
  Gene Name: WD repeat and FYVE domain containing 2
  Uniprot ID: Q96P53
  ENST ID: ENST00000298125
  CDS Start-End: 181-1383
gaagcagggagcgcggagtcgttcccgagagaggcggccaggctatgctcgccggtttccggcgttccgctccggccagccagagtctctgtctcaacctgtgtccgtgctccagcagtctcctcagcccggccccgcggcgcggttggcggcggcgccccaggcgcgccccctcctccgatggcggcggagatccagcccaagcctctgacccgcaagccgatcctgctgcagcggatggaggggtcccaggaggtggtgaatatggccgtgatcgtgcccaaagaggagggcgtcatcagcgtctccgaggacaggacagttcgtgtttggttaaagagagacagtggacagtattggccaagcgtataccatgcaatgccttctccatgttcatgcatgtcttttaacccggaaacaagaagactgtccataggtctagacaatggtacaatctcagagtttatattgtcagaagattataacaagatgactcctgtgaaaaactatcaagcgcatcagagcagagtgacgatgatcctgtttgtcctggagctggagtgggtgctgagcacaggacaggacaagcaatttgcctggcactgctctgagagtgggcagcgcctgggaggttatcggaccagtgctgtggcctcaggcctgcaatttgatgttgaaacccggcatgtgtttatcggtgaccactcaggccaagtaacaatcctcaaactggagcaagaaaactgcaccctggtcacaacattcagaggacacacaggtggggtgaccgctctctgttgggacccagtccagcgggtgttgttctcaggcagttcagatcactctgtcatcatgtgggacatcggtgggagaaaaggaacagccatcgagctccaaggacacaacgacagagtccaggccctctcctatgcacagcacacgcgacaattgatctcctgtggcggtgatggtgggattgtcgtctggaacatggacgtggagaggcaggagacccctgaatggttggacagtgattcctgccaaaagtgtgatcagcctttcttctggaacttcaagcaaatgtgggacagtaagaaaattggtctaagacagcaccactgccgcaagtgtgggaaggccgtctgtggcaagtgcagctccaagcgctcctccatccccctgatgggcttcgagtttgaagtgagggtctgtgacagctgccacgaggccatcacagatgaagaacgtgcacccacagccaccttccatgacagtaaacataacattgtgcatgtgcatttcgatgcaaccagaggatggttactgacttctggaactgacaaggttattaagttgtgggatatgaccccagtcgtgtcttgatgactctcccaggaatcagaaagatagtatttactaaagaaacggttgttttaacccaaatcattaccagagtggtaaagcagacatgtgagaagtaagaaagaaactaaagaccctgaatgaatttgcagattacccatgtgcacagtggggacctggccagtgagcactcgcaaggggactcttccaacttgttcatacaatataaaagaagctatttttttaacaaatggtttatacagtctggctgtgctgcattgttttgagtgtaccgaaaaatctgtgtggggtgtttaatttttatacttttcaacaccccattttacttgttgctttgtcagagaaataagggaggtatctactcagagtattttggtcattatactttctgtgtttacttcaacatgtgtcacgtggccagcggctttttcttctcttccctctgcacctacctgcaccttctctgcctttcctggaggggatgtatttatgttatttattcccagtgtttctgctttcatgtcctcctcagtggagagatttggaaactcatcatgtggattcaccagccagctgctggaattgcctgaagagcgatttgtttgtaatgtctgcctcattcacgttcttatgaagtagaaaagactgtgtttctgcctcagttgcctctgtctttcccacattaaaaaaaaaaatgctgtgagaaagctgctcccaaccatggttatcacagaagtagattattttaactcagagcttcaacgatcagtgcctggatcatttagaattcagttggagcctcctgagcctcttgttttagcttttttgacgcagctctccctcactcgtaacaatgaaaacaaatgacacacacacaaaatcctacatcagcggccctcaaccttgttggcagcagggaccggtttcaaaatgaaactgttccacctcggatcagcaggcattagcttctcataaggagcacgcaacctaaatccctcgcatgcgcagttcacaatagagtttctgctcctgtgagaatctgacgccaccgctgatctgatgggaggcggagcccaggcagtaacacttgcttgcccactgctcacgtctgatgggtgcccccattcctcacaggctatggaccagtacccatctgcagcccagggttggggacccccaccatacatgctctgaaaataagtgtctttaagttgtgtttttctgtgtgacatcatctctgaacttgaacatgttcattacggcaagattgtaatcctgctgtattcctcgccctctgtattctatccctttaaaaactagatatttaaacattttatcctaatgtgtttcatcagaacactttgcacactttcttactaaaacggtatgtgggtggtccgagacagaatggtacctacagtgcaggctatgtttctgtgggaatggaaaagaggactttagaaagtgaacctgaagaactcttatttctaagggaatccagtcaagcttgagaaaatgaaatattcttgtgtgtagtgattcagctcaggatattgaagtcccttttaaaaatcttattttcacctgtaaaaatagaataaaaattaatggcaagcctgcgccaggtgcctgcccctcctaagcactttacacgcacagctcattcaacctcacgtgtcgggagcatcagggagctcaccagtctcttgaggatcacaggccaattgcttgtccttcccgacccaagccccaccccacagtgtcttgctctcttctgattttacaggttttttggcagtaatacacatgggagtgaaattgaaatcctccctattattttccctcttttcctggaaagccgttttttgccctcacaatcattcattacttctctaactagggggaagtactacaagctgtcctcaggtactgcccctacgtgtgtttccctgggatggggccttgctagaggtgattctgctgccccagcattgggaagcaggaccagtgcatgtgccccatgcagccacggtacatggaagctgtcacttgagccatcagaccggctcagcccatgtgaccggagctctgaagaggcacacacgcatgccccgcacaggctgttagcacttgtcgcctcgctgccctggtccagactacccttgcttgcgtcagtcaaaactgttgtaactactttgagtcttttctgcatgattgctctttgagagaactttaacaagggaattaaatttaaaatattcaaatatctattttgtagtttattactagaagctgcagccacttactaagttgtatgtaatataggactgtgtgttggaaatgagtaatagagctgaatcactccattttcccttcctaaactttgagcttggcctgccggcagagagaggaacacagtattagggcagcaaaggcccaggcgcccagcaagcctgtatgggttctgagatgggtctagatgcgttcagacctcattcgggaagcagagtgtccccgtcagatcacatatgtcctctacagtcgctctggcctgtgaccttgcacgccactctaccttctccctcccagcccacagagccactcagaggctgaagccacttcacagcccactggtgttgagaatcatcatcagaaaaccagatatgtcaaggtatccattgctctttccttttctctcatctgtgtgggtgcttgaatttggtgaaatgcgtttagcaaaccaactgtgtgtttgtaatactgtgaattcttgcgttttgcattaagtgtctcccccatttttgtaatttgtagagaaatatgtgctggtgttgggtgtcttccaagcattttatggaaatggaggctccattccttaggagtaaaagctggcgccagcacttggctcttgttctgtctaggtgaactctcataattcttgttttaccctgttggatttgcactttacatatatttttgctctattacttaaacatatagcagcttttacaaataatgcctaacatgcctgcgctgagaaagtggcagatctacacatatcatacgcagagttgttctctacctgatggggcaaaaccaaccacatgttcttggttcctccaaacgaatgacattacttgacattactgcctgagtgtatcttcacaatagcaaaatggtttgagattaagcatttggaatcttatgtcattttgtatggggtcaatccaccataacgtgtttctcatttggttttaattatttccagaaatcataaagtcacaaaactggaagggatcttcagagatctagagtgtttcaagcagaaaacacattagttatacagggcagttagatatggctgagatgtaaacaagagaatctaaaagaatgttcaaggaatagctgtttttgaacattacttagtaatggcatgagtgggaggagagactttcagcaccttgagacagggcgctctctggaaccagctttgttcctcttatcgaaagcatatatgacagtttttttggctccggccctgtggtgggggaggtaattattgccttcatccacataaattccttcctatacattcccctcagaccaccccagaggcaaaactgaaatggaaatccagtggcacttaaaattcaccctgccccgtttggctgcgattcccaggcttacagcactgcccttatggaatatcacattttcattttctgagattcattttataaaagtaaaggccaggtgccatggctcacacctataatctgaacactttgggaggacaaggtgggaggattgctgagcccaggagttcaagaccagcctgggccacacagcaagatcctgtcactaccaaaaattcaaaacttagttgggtgtggtggcacacacctgtattcccagctactcaggaagctgaggcgggaggatcactcgagcccaggaattcaaggatgcagtgagctatgattgcactactgcagtccagcctgggcagcagagcaaggccctgaataaataaacaaaagtataatttatttttgcctgatattaatcacttcttaaggcccaaatttttgtttttaagcaaaaggatagctctaagtgtgggttgcagttactggacataaatattcactaaatgagattcctttggttatggctgttcatagaattttaattctatgtcagtgttcttgttcactaagatatttcgaagtgagagaaagcattttaccaatacattcttattttttctcctttaaaataatattgaatttttcctggtacgaagacagatatttattaacttgattggaaaacacagaaattaagatcatgttgaacactgagttatctagatgatccctgagatttgaatgttcatgtcaaccgtgttgagcgctcaccagccaccaggctttaggcactggcagtgcaaggtgtctgaggcccattctcaggctgggcagaggtcacacagtgagtaaatgggtcttttcagtgcaatgtggttatgatagaggcatgccagggtgccactaacccagcaggtgtggcaggaggggcttcacagaggaaagggactttgagctcagtgttaaaggatgaggagtgagtcataagggggaaaaatggaaatgactttccaggcttcagaaacagcataaacaaacaaaggcctgagagctggagtcagtgtggtgtgtccagggatcacaagtgggctggagctgccggagaacagccaagtggctcagctgccatcccagaattgagctcgtcactatcagatgctgctgctccctggcctcagaggaaagcagcacacagctcaccacgaggggtttccccagaggctcctcctgcagccaatgctactattagtttatattataatagtatcagtttctttttctttggaaatccctagaactgttaactgaaggtgactcagggtaactaattctggatctttgggtgcacagcctctcactggagtctgagaggaggaggtggagactatcagtgcacggcccgcaaccaggaaggactcccagactaacgccaaaggtgtgttgggctcagctgctccactgtggaaaaggaaagccctggccctgtggcaggagaggattgttctagtcaagtgtggcgttgcacggacaggcggtgccgagtgtttgggtgcagacacaggcagctgctgccctccacttcctgctcttgcaagtcacagatgattccagtacaatgtgggaggtcctccttacaggggcacttgcaacaggaaggcagagagtttcgtcaattcaggtacaggtctgtctgggagacctggccctgtggaggcaggaacaccgtgcaggggcatggcagcgcctgtctttgctatcacatcatttgccttttccttgtaggacccaaagatctatgtccaaaacttagtccagaaacatctgcattcctgtttaaacttcagctcagtttcttaaccaagaaccacgtcaaccctccagggttgtggtttgtatttttgcctttaagcattatctcctttccaccaagaagcctacttaggtttaacacatgaaagcagtgtctaaaaattagatcggtcctaaattggaatgggatgtcttccttgcatgtcccataccagggaatttttttaacacacagtgtagagcctttgccagagatgttgaaagggagattaaaggcttgagggatgaatttgatcatcattcttaaagtcccttccaatcctgtgattctctgattccctgagtctcgtttattattggacatgcctagcccatcaccagtgacctgcccgcatattgctggcttcccttggataacggagagcctatcaccacatgcctttgttgtcttccatcatatcaagtgagttgctttctggactttttccatctagagcctgctaggtttggttttgagaaaagatggtgaagtttcttttcatgagtttgtagggcaaaaaaaattctttttaaagatggtaagggtggaaattaatcatggtaccatctcattaaaaatagatacctcaaaatgtttacctttacaagtcaagaagagtatctgactttcttggaagtgtcaagaattgcaggttggctgaaaagttagattgagaatctgaccttgttacttatgattcttttttcccttggttctcggggatgcatgagaaggtgagctgtcactcacaaaaaaagggaaaatgatttgaaaaatgtttcacatatacactttttatcattttagtggatggcagccttacgtcagtagtatatgccactatgaagtatggccaaaaccctagcgtcacttgtaaccattgtactcttatggatttgtgtcttacaccatttgccttgctttttaaatgactttgtttttcaaggtgctgtcattttgcaaaaggaaatctttatatgaaatgtacaaaaaccgttactaactggacaacagggaaggtgctggccccacattagtgcctgcccaccgctctacttctaaccagggacacggatcttccattctctacatccaccggactgcagcccaagtctggacctggctgcagtgggcatattaccgtatggatatctttttctttctttttttaaagtgaggagattcttcagggggtcaggctgagaatgtaataagcctgacattggaacagatttctcccgtgtggtctagctggacccctccggcatttgccacactccctgccagtcctgacattgacttcctgaatgtgattaggtggtaatgagcaagaatttcctaggatattgaaacatctgtatccaggcccccaatcaaatgctgctgaatattgtgaatgtttttactccgctcactttcccactgtgctttcctctaaccaaaatatacgtgtagccattaccaatgtacaactctcaatgcggagttgccgccacggtttaaaataaatctctgtgaaaacctttctgcagctatggtcccatcacggttacatgtggccacgcacacaccgacaaccttgctgtgctgtttagccctgtgggttctgtccagttggtgggagggggaggttccagaccactccacctgctgtctagatgccagggagagctgctgtttggaggtgaagatgagccctgttcaccacagtctaagcacagcacacgggctcaagccatggagcccttttccttcatcatgtaagtcagctttttcttgtgcttagtaaacttttccagtgaggagaaatgacttcggggcaaacactgccagggaaagcctcatttaaaacttgtgaggttcattttatggagaagaaaaataggtgcaaaggcaccaagtgacctgcatgctatggaatcaccgttgagggggtggctgggttgccccgtcctggtgctgccagcacagcgtcgcccacacccagcattgctgaggcccatcatcctcctgcagaaaaggaggcatgcagttaaatggagctggtgcttgcttgatagcgcctccttttgtcagaaagacgctgatgtttcaggctggcacacccagaaaaatcccttccttgtggtccttggctgatgatgagccctggatcagagtgtctccaggaccactgagaagctgcagccgtctgggttttcctctgctatgggggatgagttacgtttattccaccatggacaccaagaatgtatgtagatgtattctaaatctgctcattggttttattacaacttttcctggagtcactaagaggtaaaatggtgtaaattagaggttttatcaaagtgtagtaccagaatgccagatgcattactgaagccactcctaatcttaagcaaatgtaaactaggcctcattaaattgtttgtgtaaata

SEQ ID NO: 199636 - DNA, 6932 bp, Homo sapiens
  Payload ID: 19391
  Gene Name: WD repeat and FYVE domain containing 2
  ENST ID: ENST00000612477
  CDS Start-End: 234-422
tcctcttgtagtggcgccggcttgcatcccaggtcgtggcggttttggtgcctgaagcagggagcgcggagtcgttcccgagagaggcggccaggctatgctcgccggtttccggcgttccgctccggccagccagagtctctgtctcaacctgtgtccgtgctccagcagtctcctcagcccggccccgcggcgcggttggcggcggcgccccaggcgcgccccctcctccgatggcggcggagatccagcccaagcctctgacccgcaagccgatcctgctgcagcggatggaggggtcccaggaggtggtgaatatggccgtgatcgtgcccaaagaggagggcgtcatcagcgtctccgaggacagatccaatggaaaacattgtaaacatacaccagtggcaagcattctgcaatgaacagaagaaattcatggctgaaatggagtacatggatgtaggacccttttgaaattcacagagaagccttatgagaaagtttgattttttccataaaggcaaaattttattaaaaagactgcttctggacctagaaattctttggcacagtattgtttttatgggatatattccataaaatatattgaaggaatatattggtagatgtcactttcccagtctgtaactactggagatggaactgatcaatttctaactgctgtggaaaattcataagcaaattcatggaatcaagaaaaggagaagggtagttaaacctaagctgctttaatattttatttatttttttaagactagttaagtacggtagtgagaaggggaagagagtagaacaaggagttcaatctgtaactgactgtgaacaattgagataataaaactaccttcagaccatcctaagctcctttaatattaaggtgttattatagtattgaaacttctgattcccatttcaccacatttaccttgaaggaaacagctttactggggtatattttcaagtgtttggagacgctgaagtagtgtatattaatgaaactgaagaataaatttcatttgattataggatgaaagaaatgcaatgttcagctatgtcttagcctaattttcactttcctagtgtacaatgtaaataatagaaattattttgtcatggagttactgttaaataaggttcacccataagtctggaattattattaatatactttttttcaagttgacaagtctgtgcttctttgggtcatatactcaaacatgaacataactttgttatttagagctcagttttggttatggttttcattaaaataattgatctatattcttgctttccaaaattcaatgttaatgtcacttggtacaatgctaaatatatgaaaatgtaatattgattttcatcacaacctacaaagccattaccattcactgctttagctagaaactagtaatcttcattcctgaactctgaggttaaagccgcaagtaatgttccatacctgaatggcagtgttccataaattcttaatgaaaccctggtttatctttttgacctttgacttcttcattgcctttatgtgtgcctttgaaaacacttaacattttccattttaaacggtgttatacagtatatacttcatgtccattttattttctcttctgtgagttccctatggagctttgtgtgtcttattcattgtatcatcattagggcctaacatggtacctggcatgcaatacgtcctcaatacacgtttgttgtatcagtgactgatctgtttttttgctgttcctgaaagcacagcatcttaactactgtagacttttagttgatatttgttgagtgaattatatgatgacctatgaaaggcttatgtggacaagtatacacttgtaggaaaagtactggactaggtggactttaaagtacttcaaaactctgaaagtccatgaattgcttcatttattccgtcaacaaacatttgagtacttactgtgttccagtcacatgcatacatggtaatgatgaaaatgataaggtcctttcaagatgctcacaatttagtgcaggaattttagaagaatattgcttaataaaaacaaaactactacttccaagatttagtattggaaagagaatttcagatgaagaatggcaggattccacaatctgtattatcccctaaattttacctcccgttggaggattctttgactcaaactgccctcaataatggcctgataatactcaaatcttcaagcccaagagtggataaaaattcttgccttcaggttccttttagcagagttcaaacagccttgaactttactcagtattaatggaggaaatataaaggaatagaagaaatgtaaaaacaatctgatttacaaataaagatttctggtgctaccataatacagagcctgtttcaggaactccccacccttgtctgattctgtctttgctttagttgtagttagattatatacccaaagggcataccaaactttgatattttggatacctcatttcccagcttctttttggactgtcttttctgagtgaatgccattttagcattccctgcctaggagcttcctttcagacatctctgctctgttttggtcaagacttatgtttagtcagcagcttagcaggggctcctttgtttagtggcagcctcttcaagtgatgaaagccaggagggacctctctccaggtgggaccagtcccatgcagacctttgtatcttcataagttctttataagcatatcaacacaagtcagtaatcttagcattcatacagagactttcagtaacttgatagtttcgtttaggcaattataggaaatcattcccttcctaggagttaacaacaggtacaaacattgtcctctggggttgccaatgaacctcctgcttgtggtggttagagaagaccaacaatctcttctacagatgggtcttgcagggtgagtaggagttcttgtgaaaaagcctttcctgtagaggaaagggcattttagatagaggaggcaagaaaactcccattcattaagaagcactagaatgtcctgattaagggtggacaacggagccaattggcttgagttcagaactcagcactcagtgtcctcacattttgaggaatctggaaattagtgtctgcaggaggagtgactctgatagcaaaaattactgaaccctttggttgaaagatttcagggttctttttctggataaaaaggcctgtgttggtggtaaggtgtagagaaggaggctgtaggagagataactatagagaagaaagttactggggagggcgatatggggaactgcctttctatattctgactttattcaggaccaatttatacaacataggccctgctgtgttctctctaagtcctgagggcagagcacaagcaattgttaagagaggggtgagatttttaatcccaaaataaggagatctgatccccaatgcctagcacaaaggagatatgcattatatgttccttgaatgaattaagcaatgactggtgatcacctttttgaattgaaatggacctgaggattttgtgagtttctgtcagcaaaggtatttaagttgagcctgagagaagtttagcagcttgctttaggccagggtaatcaacaatacaatatgggatgggagtgggaaggggctgggatgagggggttggattttttttctgcttcgagggcctttttttcctgactctaaattactatgattcgaagtggccatgactacttgactgtttcctgaaaaaaatatgttaaaattttatttcatcttatgaatcctcatagtattggttcatttaccattaattctttttattatgaaattacactatcccagttctctgcttcaaccattagtttgataattagaccttggtgcagttcagttgagctcctgatagagttttatgtaccatgtattttataacatttgcacaattttcttaagaaatgcaaatcaaagttttatagtgccaagcacagttctgaaagttgaggacttttcagagtgagggagtgagcgctctgaagtcagcaaaattagaacccatctaaactaatttttcagtgtgtgaagtctctaatagcataaaattaatacactttccactgcgcacttgagactcatcacttggtggtaataattgtggatttcaaggtcccaaagagggaacttgtcctgtatgattgtggaaaattagacctttactccgaattcaaaacatgaagcactcttcatgctagcaaatctttctgggaacaggctgcctctgtgtttccaaaggtcagaaatagactgactttttaaggaaagatcactatgggaaagcttatttgaggaggcttactagaggaggattagcttcaagtgatcccagagctcctgacagttctgaatttcctgtttttatattattaaaccagagtctgtccaggacctcacagatcttaatcagtatatattcatccacatattgcaatgctatgggaaagttaggatggcaattctgacactcttaaaatgagtaatttttaaatcttgaaatcctgaccagctgtcttacacctcaagtgctgctaaacttactttgaaaaaggaatataggtaaaaatcataggatttaagtagctagaataaactttagagagatggccttttccaaacaaacaaaaccaaaactttagaaaaggaaatgtgagtttttacttgcacagcatctttctctggctgtctgttttcactttgcatttggctttgagaaagcatggagaatcatcttgatgtcattagaaataacagtgtggggaaaattaaaacactttgtggcatttagaaatcaataagtagattgtgatttaagactactgcaggtggtgatttgttgatatctgtaacactaaactaaattgtgtacagtatatacttagaagagactgaccaccataccaagcttttcttctcaactattggcagaatagaaagaatttaaaaagagatcacactcctttatttttatatgagtaggtctcccaaggagagtgttacaattaacctagaaattccctaacagagaaaaaaaaaacaaaaaaaactccccttgtgcaacttcagcaagcagtcttctctttaaaaaaattttttgtatttcggggcagggagcctcttcatccaaatattttatttagtccttagtaaaaattaattcagaagtatgagaaactaaccagtaagaccaaaaaagaaaaggtcatctccttgtctcttggcagggagtgctactttatggtctcctgtgcctttaatttaaggattcttggaaaagaactgggagtctgatctcagctctactctgcattgaccttggcatttcctggggcatttcatcactctaagcttcagtttgtccatctggcaaaggagggggttagatttcctagctatgactcttgtactgtgatgtgcttctgtagtgactagataagtagtctctgcaaccatatcatcctaaaatctcaagtggaggaaagcacgcattagggaaaaagcagcatgcttgtgtgaaactgtcagcacctcatgttgcaactgtaaaacgatgctttctagagcctttggatggcagcggttatttattcctggatgaaatattaagaagtatttgttttgtgttagtgcctaacacccagttgaactagattcactacattcctacttctagatgagtcctttactttcaaactctgggtggtttgccagcaaccaagtcagggcctgggttatctagattaatgctttggaaactttttagaccataaatcatagtaaaaaatatagttagcattgctacgcaagactgacatactctctcacacatagacacacatatgacagaaacaaaggttttatgaaatggtatcctcttaatgtgacatgcacactattttctgttctgttgcagcccttataagatcctagttgtgaccgtttcaattaatttcatgacccactaaaggattgtgaacaagagtttgaaatattacagagctttagaagaactggtaatgttttgtaccttctttttctcccgttatgtagtttcagttttctagaagatggaaatgtaattcaacttggggacctaaaccctgccagcctaccccacccctggcctggcctgcttttctgaaattcccattgacattatagaattgacccagtctgactggaagccttcaagttaggagataactgttctaaagcctttcagcccagagccagagagggttcagaaaaaaagtaggaatgttggggggaggggggagggatagcattaggagatatacctaatgttaaatgaagagttaatgggtgtagcacaccaacatggcacatgtatacatatgtaacaaacctgcatgttgggcacatgtaccctaaaacttaaagtgtaataaaaagaaaaaaaaaaagaaaaaaattaggaatgtaccaaattgagcatttgctattgtttgagtggctgcattttaacttcctgtcctatgttaatttattactgagttaggactcagaaatgatgcatcacatctaaattatgaatgttgccaggtggggtggctcacgcctgtaatcccagcactttggggggttgaggcgggtggatcacctgaggtcaggagtttgagaccagcctggccaacatgttgaaaccctgtctctactaaaaatacaaaaattagctgggtgtgttggtgggcacctgtaatcccagctacccgggagactaaggcaggagaatcgcttgaacccaggaggcggaagttgcagtgagccgagattgtaccactgcactccagcctgggcaacagagcgagactccatctcaaaaaaaaaaaa

SEQ ID NO: 199637 - DNA, 14247 bp, Homo sapiens
  Payload ID: 19392
  Gene Name: WD repeat and FYVE domain containing 3
  Uniprot ID: Q8IZQ1
  ENST ID: ENST00000295888
  CDS Start-End: 409-10989
gcggccgcagaatcgagctcgggccccggcccccggcccgcggcgcggggctcccgggccccgccgcggacgtcgcgccggtcgccccttccccgtagcccgtgcgccctcggcgcggagccccggcccgccgcggtcccgtctcctgggcctgtcccgcccgcgccctccgccggccctcaggtataatacttctccacgtctgcttcaggaagaaagtgcctgccattcttatcatttctaagcaggttcatgccagcccagaacagagaatcagctggagcccagatttcaagttttgagtaaaataccttcaagcgaatgggccctattgtgctcacacattcagaacctgttacccaaggaattccctaaagaattagaagtgcgtctcaccaaccagccaagatgaacatggtgaagaggatcatggggcggccgaggcaggaggagtgcagcccacaagacaacgccttaggactgatgcacctccgccggctcttcacggagttgtgccatcctccccggcacatgactcagaaggaacaagaagagaaactgtatatgatgctgccagtgtttaacagggtttttggaaatgctccgccgaatacaatgacagaaaaattttctgatcttctgcagttcacaacacaagtctcacgactaatggtgacagaaattcgaaggagagcatcaaacaaatccacagaggctgcaagtcgggccatagttcagttcctagagattaatcagagtgaagaagccagtagaggctggatgcttctaacgacaattaatttgttagcttcctctggtcagaaaaccgtggactgcatgacaacaatgtcagtgccttccaccctggttaaatgtttatatctgttttttgaccttccacatgtgcctgaggcagttggaggtgcacagaatgagctacctctagcagaacgtcgaggactactccagaaagtttttgtacagatcttagtgaaactgtgcagttttgtttcccctgcggaggagctggctcagaaagatgatctccagcttctattcagtgcaataacctcttggtgccctccctataacctgccttggagaaagagtgctggagaagtcctcatgaccatatctcgtcatggtcttagtgtcaatgtagtgaagtatattcatgagaaagagtgtttatctacatgtgttcagaatatgcagcaatcagatgacctgtctcccctagaaattgtcgaaatgtttgctgggctttcttgtttcctcaaagattccagcgatgtttcccaaacacttctggatgattttcggatatggcaaggatataattttctttgtgatctcttgcttagattggaacaagcaaaagaggcagaatccaaagatgccttgaaagatctggttaatctgataacttccctaacaacatatggtgtcagtgaactaaaaccagctggtattaccacaggggcaccctttttattgcctggatttgcagtacctcagcctgcaggcaaaggtcacagtgtgagaaacgtccaggcctttgcagttcttcagaatgcatttttaaaagcaaaaaccagcttccttgcccaaatcatccttgatgctatcacaaatatttacatggctgacaatgccaattacttcatcctagagtcacagcacacattgtcacagtttgcagagaagatttctaaactcccagaagtacaaaacaaatactttgagatgctggagtttgttgtttttagcttaaattatataccttgtaaagaacttattagtgtcagtatcctcttaaaatctagctcttcttatcactgtagcattattgcaatgaaaacacttcttaagtttacaagacatgactacatatttaaagacgtgttcagggaggttggccttttggaggtcatggtaaaccttttgcataaatatgctgccctgttgaaggatccaactcaggcactaaatgaacaaggggactcaagaaataatagttcagttgaagaccaaaaacacctggctttattggttatggagaccttgacagtgcttcttcaaggatcaaacacaaatgcaggaatttttcgagaatttggaggtgcaagatgtgcacataatatagtaaagtaccctcaatgccggcagcatgccttgatgactatccaacagctggtgctctccccaaatggggacgatgacatgggcactctcctggggctaatgcattcagccccaccgacggaattgcagttgaagactgatattttaagggccctcctgtcggtccttcgagaaagccatcgttcaagaacagtttttaggaaagttggaggatttgtgtacattacatccttgctcgttgctatggaaagatctttgagctgtccacccaagaatggctgggagaaagtgaaccagaatcaagtgtttgaacttcttcacactgtgttctgcacgttgactgcagcaatgcgctatgagccagccaactctcatttcttcaaaacagagattcagtatgagaagttggcagatgctgttcgatttcttggctgcttctcagacctaagaaaaataagcgccatgaatgtcttcccctcaaatacacagccatttcaaagacttttagaggaagatgtaatctcaatagaatcagtgtcacccacgttacggcactgcagtaaactttttatttatctttacaaagtagccacagattcttttgacagtcgtgcagaacagatccctccttgcctgacaagtgagtcttctctcccctctccttggggtacaccagctttgtccaggaaaaggcatgcatatcattctgtttcaactccccctgtttaccctcctaaaaatgttgccgacctgaaactacatgtgacaacttcatctctgcagagttctgatgcagtcatcattcatcctggagccatgcttgccatgctggacctactggcctctgttgggtcagtgacacagccagaacatgctttggatcttcaacttgccgtggcaaatattttacaatccctggtgcacacagaaaggaaccagcaagtcatgtgtgaagctggtcttcatgcacgactgctgcagaggtgcagtgctgcattggctgatgaggaccactcactgcacccgcccctgcagcggatgtttgaacgattagcctctcaggctctggaacccatggtgttgagggagtttttacgtttggcaagtcctttaaattgtggtgcctgggacaaaaaactgctaaaacaatatagggtccacaaaccaagttcactgagttatgaaccagaaatgagaagtagtatgatcacatctctggaaggtctgggtactgataatgtttttagcttacatgaagataaccattaccggataagcaagagcctggtaaaatctgcggaaggaagtactgtacccctgaccagggtgaagtgtctggtctccatgacaaccccacatgacatcagacttcatgggtcatcagttactccagcttttgttgaatttgacacatcacttgaagggtttggatgtctttttttgcccagtttggcccctcataatgctcctacaaataataccgtcacaacaggtcttattgatggggctgtggtcagtggcattggttctggtgaaagattcttccctcctccctccggcttaagttactctagctggttttgtattgaacattttagttctcctccaaataaccaccctgtcagacttcttactgttgtgcgccgagcaaattcttctgagcaacattacgtgtgccttgcaatagttctatcagcaaaagaccgatctctgattgtttccaccaaagaggaactcctccaaaattatgttgatgattttagtgaagagtcctcattttatgaaattctcccatgctgtgctcgctttcgatgtggagagcttatcattgagggacagtggcatcatttggtcctggtaatgagcaaaggcatgttgaaaaacagtactgcagccctttatattgatggacagcttgttaacactgtaaagcttcattatgtccacagtactccagggggttcaggttcggcaaatccaccagtggtgagcacggtctatgcctacattggtactccacctgcccaacgccaaattgcctcattggtttggcgcctgggacccacacattttctagaagaagttttaccttcttcaaatgttactaccatttatgaacttggaccaaattatgttggaagctttcaggctgtatgtatgccatgtaaagatgcaaaatccgaaggggtggtgccatcccctgtgtcattagtaccagaggagaaagtgtcatttggcctctatgcactctctgtgtcgtctctaacagtggcaagaatccggaaagtgtataacaaattggatagcaaagccattgctaagcagttaggcatttcctcacatgagaatgccactcctgtgaagttgatacacaattcagcaggacatcttaatggatctgcacggacaattggggccgctctgattggatacttgggagtaagaacatttgtccctaagcctgttgccactactttgcagtacgttggtggagctgcagccatcctgggcctggtggccatggcctctgatgtggaagggttatatgcagcagtcaaggccctggtttgtgtggtcaagagtaacccactagccagcaaagaaatggaaagaatcaagggctaccagttgctggcaatgttgcttaagaagaaacgttcccttcttaacagccacatcctccatctaactttttctttggtgggaactgttgatagtggacatgagacctccattattccaaattcaactgctttccaggacctcctctgtgattttgaagtctggctccatgcaccatatgaacttcatctttccttatttgaacactttattgaactgctcacagagtccagtgaagcctcaaagaatgccaaattaatgagagaattccagttaatcccaaagctgctcctgactcttcgagatatgtctttatcccagcctactattgctgctattagtaatgtcctgagcttcttactgcaaggttttcctagcagcaatgatctgctcagatttgggcagtttatttcttctactttgccaacctttgcggtttgtgagaaatttgtagtaatggaaataaataatgaagagaagcttgacactggaactgaagaggagtttggaggtcttgtatcagctaatcttatacttttgaggaacagacttctggatatcttgctaaaactaatttatacatctaaagaaaagacaagcattaatttgcaagcttgtgaagaactggtgaagacactgggttttgactggatcatgatgtttatggaggaacacttacattccaccacagttacagcagccatgaggattcttgttgtcctactaagtaatcagtctattctcatcaagtttaaagaaggactcagtggtggaggatggcttgaacagacagattctgtcttaactaataagattggaactgtattaggattcaacgtgggcagaagtgctggtgggagatcgacggtcagggagattaaccgagatgcttgtcattttcctggttttccagtccttcagtcattccttcctaaacacactaatgtccctgccctctattttctcctcatggccttgtttctgcagcagccagttagtgagctgcctgagaacctgcaggtcagtgtgcctgtcatcagctgccggagtaagcagggttgccagtttgatttggattccatttggacattcatctttggagttcctgcctccagcggaactgtggtctcttctatccataacgtatgcacagaagctgtttttttattattgggaatgctccgcagcatgctgacttcaccttggcaatcagaagaagagggatcttggctccgagaatatcctgtgaccctgatgcagttcttcagatatttgtatcacaacgtgccagaccttgcctccatgtggatgagccctgacttcctgtgtgcattagcagccaccgtcttccccttcaatattcgcccttactcagagatggtgactgaccttgatgatgaagttggatctccagcagaagagtttaaagcgtttgcagcagacacagggatgaacaggagccaatcagagtactgcaatgtgggcaccaagacatatctgaccaatcacccggctaaaaagttcgtttttgacttcatgcgggtcttaatcatagacaacctctgtctcactcctgccagcaagcaaactccactaattgatcttttgttggaggcttcccctgaaaggtctacaagaactcagcaaaaagaatttcaaacttacattttggatagcgtgatggaccatttgcttgcagctgatgtgttattaggggaagatgcatctctgcctattaccagtggaggaagctaccaggtattggtgaacaatgtgttttatttcacacagcgtgtggtggacaagctttggcaaggcatgttcaacaaagaatctaaacttcttatagattttataattcaactaattgcacagtcaaagagaagatcacagggattgtcactggatgcagtgtatcattgcctcaataggaccatcttgtaccagttctcacgggcacacaaaaccgttcctcagcaagtagctctgcttgattcactcagggtcctcactgtaaacagaaacttgatcctgggacctgggaaccatgaccaagaattcattagctgtctggcccactgcttgataaatctacatgttggaagcaacgtggatggatttggactggaagcagaagcccgcatgaccacatggcacattatgatcccctcggacattgaaccagatggtagttacagccaagatattagtgaagggcgtcagcttctcataaaagctgtcaacagagtttggactgaactgatacatagtaagaaacaagtcttagaggaacttttcaaagtaactctacctgtgaatgaaaggggccacgtggacatagctacagcaaggccactcattgaagaagctgccctgaagtgctggcagaatcatttggcccatgaaaagaaatgcataagtcgaggagaagctttagcgcccaccacacagtccaaattatcccgtgtcagcagtggctttggtctttccaagttaacaggatcaagaaggaatcgaaaagaaagtggtcttaataaacacagtctttccacccaggagatttcgcagtggatgtttactcacattgctgttgttcgtgacttagtagatacacaatataaagaatatcaggagcgtcagcagaatgccctgaagtacgtgacagaagagtggtgtcagatcgagtgcgagctgttgagggagcgggggctgtggggccctcccatcggctcccacctcgacaagtggatgctggagatgacagaagggccctgcaggatgaggaaaaagatggtgcgaaatgatatgttttataaccattacccttacgtgccagaaactgagcaagagacaaatgtggcgtctgagatcccaagtaaacagcctgagacacccgatgatattcctcaaaagaaacctgctcgatatagaagagccgtaagttatgacagtaaagagtactacatgcgactggcctctggcaatcccgccattgtccaagacgccattgtggagagttcagaaggtgaagctgctcagcaagaaccagagcatggggaagacactattgctaaagtcaaaggtttggtcaagcctcctctaaaacgctcccgatctgcacctgatggaggagatgaggagaaccaggagcagctacaagaccagattgctgagggcagctccatagaagaggaggagaaaacagataatgctaccttactgcgcctgttagaggaaggagaaaagatccaacacatgtaccgctgtgctcgagtccagggcctagataccagtgaggggctccttctttttggtaaagagcatttttatgtgattgatggatttaccatgacagcaaccagggaaataagagatattgaaaccttacctccaaatatgcatgagcctattattcctagaggagccaggcaaggccctagtcaactcaagagaacatgcagcatttttgcatatgaagatatcaaggaagttcataaaaggagatatctcctgcagcctattgctgtggaagttttctctggagatggacggaattacctccttgcttttcagaaaggaatcagaaacaaagtctatcaaaggtttttggctgtagtgccatctctaacggacagttcagaatctgtatctgggcaacgaccaaacacgagtgtggagcagggatctgggttacttagcactttggttggagagaagtctgtgactcagagatgggagagaggtgaaatcagcaacttccaatatttgatgcatttgaacactttggctggcagatcatataatgatctcatgcagtatcctgtcttcccctggatccttgcagattatgactcagaggaggtggatcttactaatcccaagacgtttagaaacctggctaagccaatgggagcacaaacagatgaacgattagctcagtataagaagcggtataaagactgggaggatcctaatggagaaactcctgcataccactatgggacccactattcatctgcaatgattgtggcctcataccttgtaaggatggagcctttcacacagatattcttaaggctacagggtggccactttgacctggctgaccggatgtttcacagtgtgcgcgaggcctggtattcagcgtcaaagcacaatatggcagatgtaaaagaacttatcccagagttcttttatttaccagaattcctgttcaattccaacaactttgatctaggctgtaaacaaaatggcaccaagcttggagatgttatccttccaccctgggcaaaaggggacccacgagaattcatcagagtccatcgtgaggctttggagtgtgattacgtgagtgcccatctacatgagtggattgacttaatcttcggttataaacagcaaggccctgctgcagtagaagctgtaaatgtcttccatcatcttttttatgagggtcaagtggatatctacaacatcaatgacccactaaaggagacagccacaattgggttcattaataacttcggtcagatccctaaacagttatttaaaaaacctcatccaccaaagcgagtgagaagtcgactcaatggagacaatgcaggaatctctgtcctaccaggatctacaagtgacaagatcttttttcatcatctagacaacttgaggccttctctaacacctgtaaaagaactcaaagaacctgtaggacaaatcgtatgtacagataaaggtattcttgcggtggaacagaataaggttcttatcccaccaacctggaataaaacttttgcttggggctatgcagacctcagttgcagactgggaacctatgagtcagacaaggccatgactgtttatgaatgcttgtctgagtggggccagattctctgtgcaatctgccccaaccccaagctggtcatcacgggtggaacaagcacggttgtgtgtgtgtgggagatgggcacctccaaagaaaaggccaagaccgtcaccctcaaacaggccttactgggccacactgataccgtcacctgcgccacagcatcattagcctatcacataattgtcagtgggtcccgtgatcgaacctgtatcatttgggatttgaacaaactgtcatttctaacccagcttcgagggcatcgagctccagtttctgctctttgtatcaatgaattaacaggggacattgtgtcctgcgctggcacatatatccatgtgtggagcatcaatgggaaccctatcgtgagtgtcaacacgttcacaggtaggagccagcagatcatctgctgctgcatgtcggagatgaacgaatgggacacgcagaacgtcatagtgacaggacactcagatggagtggttcggttttggagaatggaatttttgcaagttcctgaaacaccagctcctgagcctgctgaagtcctagaaatgcaggaagactgtccagaagcacaaatagggcaggaagcccaagacgaggacagcagtgattcagaagcagatgagcagagcatcagccaggaccctaaggacactccaagccaacccagcagcaccagccacaggccccgggcagcctcctgccgcgcaacagccgcctggtgtactgacagtggctctgacgactccagacgctggtccgaccagctcagtctagatgagaaagacggcttcatatttgtgaactattcagagggccagaccagagcccatctgcagggcccccttagccacccccaccccaatcccattgaggtgcggaattacagcagattgaaacctgggtaccgatgggaacggcagctggtgttcaggagtaagctgactatgcacacagcctttgatcgaaaggacaatgcacacccagctgaggtcactgccttgggcatctccaaggatcacagtaggatcctcgttggtgacagtcgaggccgagttttcagctggtctgtgagtgaccagccaggccgttctgctgctgatcactgggtgaaggatgaaggtggtgacagctgctcaggctgctcggtgaggttttcactcacagaaagacgacaccattgcaggaactgtggtcagctcttctgccagaagtgcagtcgctttcaatctgaaatcaaacgcttgaaaatctcatccccggtgcgtgtttgtcagaactgttattataacttacagcatgagagaggttcagaagatgggcctcgaaattgttgaagattcaacaagctgagtggagaccatggtctgtagaccccttcccgattctcctgtcccagcttggaaggcattgaaaacagtctccgtttacacatctcttcataccacgtgtttgaagtgttaaaattcaaagggatcattgaataaaacgggtgtagagtacaggaatggggcagacgcgattcaggtgaacagcacaagaagaatatgaggtggttcctaggagcaacactttcgacctccagttctccctgatgacagtagctgtctccaagagaaaaatcctcacttattaactctcttttcttgcatctcatttttatagagctactcatccttatttggaaaaaccaacaacaaaaaaggcttttagaaaatggttgtaaatctgacttctttgcaagtaactatgtatattgtaaatagatataaaaggccttttttctaaataaggacttaactgcctgtaacatgaaacttcaaactaaaccactaactcaatgaactacttatggtttgtctgacatccctcacttaccaattaattataaatatgtttttttaaatccccaaagacattatctgtggtctttttttcctttcaagctcagcctgtgtgcctgatgtcatttctttcaagttgcccacagtatctccacttaaactaggctagtaaccaaaataatgtggaccttctttaggaaacagtgtgggagaataggagtccagccgtaagataaactggaaatatttgggcgtcttgtacctggctacgcaccacctcagtgttgttcctacataaacagggccccttttaaacttgtatgtggactgctgtttggtcaaagaataccttcttagcattgcagaaaggtggtcagatgaccagtgtagtgcaggaaacagccctgtctcaactaatggaaatatatttgcatgtaacccaaaattagcttatcttgcatagaacataataagtatgtgtctttggtgacactaatgttctactatagcttattttcaaacaaggggtaaaaaaaggaaagaaagaagtgtacagaattaacatataaactttgttgtaaaactgaatcatgtcagaactgcttaaaattaacctttaccatttaatgtcatctacctgaaaacagtgagatttatactgtatcaatgtctatttttttgtttttgctatgaatataattacagtattttaatatttagttatttaatttgttctactagttggatacagaacacacaaatccagggggattaaagctggaaggggctaagagattagtttacagagaaaaggcttggtggtgggatttttttaaatgtgtgttatgtacatatatatatatatataatatatattaaaaatgaaacaattaatctagattttaacattttcagaaacttagtgataacattatgaacaattctaaaagccctgtgatttgaaaaatatagaatcattaatggcccaagataggccttcacaccttcacaggtgcgaaaggaaaggccttcacaccctcacagaggcatcatgcaaaggacagcggctttggcttttccaattttccatctttaggccctggtgagaggcacacttatgcactaaaatgcacatatatgcacatgcattcaaaaataggcatttggtacaatggtgatcttgtacctgatgggctgaaaccagcttaagaacaaatttgttcttcctgatatgataactaggtctccaagagaaaatagaaaggctgctttagtgccttacgcttactaaatttaaatctttatttacctgggtttgagcctacagtctatttatgattacatatcaaaattgattaaaacacttccatttctaaaagttcaaatatacttgttaataaaaggattatcggcattaatactttaatttaaagaaaagttgtgttctgttttcctttctgtgtcttactccccccacactctccctcccccatcaccatcttcaattctaataaataatgctgatgttcaacagttgcagaaattgtgctattatgtaactgtgggccttgcccctgtctggccctctagatgatttgtagcagtgttattctacactttttaaaagaagcgtcctccttttgtccatgaatcatgtttaccccatacccagtggcagaggtgttctttaaagacttgaatatatgaatgtgtgtgtgtagttacttaaaggttattcctctttgtaataggaaactatatgggatgaacacttttaaactttccgacacaacttccattactaactttctaacagaacttccataactagaaggtggaaaccaaaaccctcatggtagtatttcctctggcagctggtgctgtgggcaactgttttgttcaatcgggtttcttttctttttgcctctaatgcagaaatcaacagaatcactcacacatacaagtacactcacatacataaactaattatttctctggatatctttctgtgttccatgtaaatttatttaccaacatctattgtcaacatgtacatctaccttagtatggtctgcattctttttctgagagtacctcatagggctcctgcctgatctttgtagtttgttcattcatccatccacctgttcatttgttcatccatgtattctaacatttctatgtagtgtgcaactctaatgtcatgcttttgaagaagagaatagctgcccatagcagccatccgtctggataatagcaaaacactctagataagttattttgcactttcttatgtataaagttggtagaaacttatttttgctttgtatcatttaaatacattttgttttggtaaatgaactgtgtataaaatatttatgccgttaaaactgtttttagaaagtatttttaatttcagcaagtttggttacttgttgcatgactcttaacacagctgactttttgtgtcagtgcaatgtatattttttgtcctgttattaacttgtaagccctagtaatggccaattatttgtacagcaacagaagtaaattgaagatactggctaagactggattgattgtggacttttatactatattgcagaaaccaatatctgtttcttggtggttatgtaaaagacctgaagaattactatctagtgtgcagtctgtgatatctgaatgttcattgtatatttgtctctgatgcaaaaaggtagagtaacacaattacaatacatgattaaatgc

SEQ ID NO: 199638 - DNA, 425 bp, Homo sapiens
  Payload ID: 19392
  Gene Name: WD repeat and FYVE domain containing 3
  ENST ID: ENST00000502713
  CDS Start-End: 398-425
gcggccgcagaatcgagctcgggccccggcccccggcccgcggcgcggggctcccgggccccgccgcggacgtcgcgccggtcgccccttccccgtagcccgtgcgccctcggcgcggagccccggcccgccgcggtcccgtctcctgggcctgtcccgcccgcgccctccgccggccctcaggtataatacttctccacgtctgcttcaggaagaaagtgcctgccattcttatcatttctaagcaggttcatgccagcccagaacagagaatcagatgtcttcaattgctgtggtgacaagaacatagtgaatataagctgctgaaagtagagctagtcgtggctggaacagagagaaattcagaattagaagtgcgtctcaccaaccagccaagatgaacatggtgaagaggatcatggggc

SEQ ID NO: 199639 - DNA, 1918 bp, Homo sapiens
  Payload ID: 19392
  Gene Name: WD repeat and FYVE domain containing 3
  ENST ID: ENST00000514711
  CDS Start-End: 1-1918
aggaaaaagatggtgcgaaatgatatgttttataaccattacccttacgtgccagaaactgagcaagagacaaatgtggcgaaacctgctcgatatagaagagccgtaagttatgacagtaaagagtactacatgcgactggcctctggcaatcccgccattgtccaagacgccattgtggagagttcagaaggtgaagctgctcagcaagaaccagagcatggggaagacactattgctaaagtcaaaggtttggtcaagcctcctctaaaacgctcccgatctgcacctgatggaggagatgaggagaaccaggagcagctacaagaccagattgctgagggcagctccatagaagaggaggagaaaacagataatgctaccttactgcgcctgttagaggaaggagaaaagatccaacacatgtaccgctgtgctcgagtccagggcctagataccagtgaggggctccttctttttggtaaagagcatttttatgtgattgatggatttaccatgacagcaaccagggaaataagagatattgaaaccttacctccaaatatgcatgagcctattattcctagaggagccaggcaaggccctagtcaactcaagagaacatgcagcatttttgcatatgaagatatcaaggaagttcataaaaggagatatctcctgcagcctattgctgtggaagttttctctggagatggacggaattacctccttgcttttcagaaaggaatcagaaacaaagtctatcaaaggtttttggctgtagtgccatctctaacggacagttcagaatctgtatctgggcaacgaccaaacacgagtgtggagcagggatctgggttacttagcactttggttggagagaagtctgtgactcagagatgggagagaggtgaaatcagcaacttccaatatttgatgcatttgaacactttggctggcagatcatataatgatctcatgcagtatcctgtcttcccctggatccttgcagattatgactcagaggaggtggatcttactaatcccaagacgtttagaaacctggctaagccaatgggagcacaaacagatgaacgattagctcagtataagaagcggtataaagactgggaggatcctaatggagaaactcctgcataccactatgggacccactattcatctgcaatgattgtggcctcataccttgtaaggatggagcctttcacacagatattcttaaggctacagggtggccactttgacctggctgaccggatgtttcacagtgtgcgcgaggcctggtattcagcgtcaaagcacaatatggcagatgtaaaagaacttatcccagagttcttttatttaccagaattcctgttcaattccaacaactttgatctaggctgtaaacaaaatggcaccaagcttggagatgttatccttccaccctgggcaaaaggggacccacgagaattcatcagagtccatcgtgaggctttggagtgtgattacgtgagtgcccatctacatgagtggattgacttaatcttcggttataaacagcaaggccctgctgcagtagaagctgtaaatgtcttccatcatcttttttatgagggtcaagtggatatctacaacatcaatgacccactaaaggagacagccacaattgggttcattaataacttcggtcagatccctaaacagttatttaaaaaacctcatccaccaaagcgagtgagaagtcgactcaatggagacaatgcaggaatctctgtcctaccaggatctacaagtgacaagatcttttttcatcatctagacaacttgaggccttctctaacacctgtaaaagaactcaaagaacctgtaggacaaatcgtatgtacagataaaggtattcttgcggtggaac

SEQ ID NO: 199640 - DNA, 453 bp, Homo sapiens
  Payload ID: 19392
  Gene Name: WD repeat and FYVE domain containing 3
  ENST ID: ENST00000509172
  CDS Start-End: 274-453
ggcgcggggctcccgggccccgccgcggacgtcgcgccggtcgccccttccccgtagcccgtgcgccctcggcgcggagccccggcccgccgcggtcccgtctcctgggcctgtcccgcccgcgccctccgccggccctcagctggagcccagatttcaagttttgagtaaaataccttcaagcgaatgggccctattgtgctcacacattcagaacctgttacccaaggaattccctaaagaattagaagtgcgtctcaccaaccagccaagatgaacatggtgaagaggatcatggggcggccgaggcaggaggagtgcagcccacaagacaacgccttaggactgatgcacctccgccggctcttcacggagttgtgccatcctccccggcacatgactcagaaggaacaagaagagaaactgtatatgatgctgccagtgtttaacagg

SEQ ID NO: 199641 - DNA, 240 bp, Homo sapiens
  Payload ID: 19392
  Gene Name: WD repeat and FYVE domain containing 3
  ENST ID: ENST00000514071
  CDS Start-End: 1-240
atgctccgccgaatacaatgacagaaaaattttctgatcttctgcagttcacaacacaagtctcacgactaatggtgacagaaattcgaaggagagcatcaaacaaatccacagaaaaacagtgtgccctgctgtcccccaaggatttcaaagccacaacaccttcagaggctgcaagtcgggccatagttcagttcctagagattaatcagagtgaagaagccagtagaggctggatgc

SEQ ID NO: 199642 - DNA, 5996 bp, Homo sapiens
  Payload ID: 19393
  Gene Name: WD repeat and HMG-box DNA binding protein 1
  Uniprot ID: O75717
  ENST ID: ENST00000360586
  CDS Start-End: 67-3456
gcgggaagcagctcttgtggatcctcagtggcggaggctcggtcacccggataggtaaaggaaaacatgcctgccacacggaagccaatgagatatgggcatacagagggacacacggaggtctgttttgatgattctgggagttttattgtgacttgtggaagtgatggtgatgtgaggatttgggaagacttggatgatgatgatcctaagttcattaatgttggagaaaaggcatattcatgtgctttgaagagtggaaaactggtcactgcagtttctaataatactattcaagtccacacatttcctgaaggagttccagatggtatattgactcgcttcactacaaatgcaaaccatgtggtctttaatggggatggtactaaaattgctgctggatctagtgattttctagtcaaaattgtggatgtgatggatagcagccaacagaaaacatttcgaggacatgatgcccctgttttaagtctttcctttgatcctaaggacatctttctggcatcagctagttgtgatggatctgtcagagtgtggcaaatttcagatcagacatgtgctattagttggccactgctacaaaaatgcaacgatgtgataaatgcaaaatcaatctgcagacttgcttggcagccaaaaagtgggaagttactggcaattcctgtggaaaaatctgttaagctatatagaagagaatcttggagtcatcaatttgatctttcagataatttcatctctcagaccctcaatatagtaacctggtctccctgtgggcaatatttagctgcaggtagtattaatggtctaatcatagtttggaatgtggaaaccaaagactgcatggaaagggtgaaacatgagaaaggttatgcaatttgtggtctggcatggcatcctacttgtggtcgaatatcgtatactgatgcggaaggaaatctagggcttctagagaatgtttgtgaccccagtggaaagacatcaagcagtaaggtatctagcagagtggaaaaggattataatgatctttttgatggagatgatatgagtaatgctggtgattttctaaatgacaatgcagttgagatcccttctttttcaaaagggattataaatgatgatgaggatgatgaagacctcatgatggcttcaggtcgtcctagacagcgaagtcacatcctagaagatgatgaaaactcagttgatatttcaatgctaaaaactggttctagtcttctcaaagaggaggaggaagatggtcaagaaggcagcattcacaatctaccacttgtaacatcccaaaggccattttatgatggacccatgccaactccccggcaaaagccatttcagtcaggttctacaccgttgcatctcactcacagattcatggtgtggaactctattggaattattcgctgctataatgatgagcaagacaatgccatagatgtggagttccatgatacctccatacaccatgcaacacacttatcaaacactttgaattatacaatagcagatctttcccacgaagctattttgttggcatgtgaaagcactgatgaactagcaagcaagcttcactgcctgcactttagttcttgggattcaagcaaagagtggataatagacttgcctcagaatgaggatattgaagccatatgtctcggtcaaggatgggctgctgccgctactagtgccctgcttcttcgattgtttactattggaggggttcaaaaagaggtattcagccttgctggacctgtggtgtcaatggcaggacatggagaacagcttttcattgtttatcacagaggtacaggatttgatggggatcagtgccttggagttcaactgctagagctggggaaaaagaaaaaacaaattttgcatggtgaccctcttcctcttacaaggaaatcctaccttgcatggattgggttttcagctgaaggtaccccttgttacgtggattcagaaggaattgttcgaatgcttaacagaggacttggtaatacgtggactcctatatgtaatacaagagagcactgcaaaggaaaatctgatcactactgggtggttggtatccatgaaaatccccagcaactaaggtgcattccttgtaaaggttctcggtttcccccaacccttccacgccctgctgttgctatattatcctttaagcttccttactgtcagattgcaacagagaaaggacaaatggaggagcaattttggcgttcagttatatttcacaaccaccttgattatttagctaaaaatggttatgaatatgaagagagcactaaaaatcaagcaacaaaagagcaacaggaacttttaatgaaaatgcttgcgctttcttgtaaactggagcgagaattccgttgtgtggaacttgctgatctaatgactcaaaatgctgtgaatttagccattaaatatgcttctcgctctcggaaattaatactggctcaaaaactaagtgaactggctgtagagaaggcagccgaattgacagcaacccaggtggaagaggaagaagaagaagaagatttcagaaaaaagctgaatgctggttacagcaatactgctacagagtggagccaaccaaggttcagaaatcaagttgaagaagatgctgaggacagtggagaagctgatgatgaagaaaaaccagaaatacataagcctggacagaactcgttttccaaaagtacaaattcctctgatgtttcagctaagtcaggtgcagttacctttagcagccaaggacgagtaaatccctttaaggtatcagccagttccaaagaaccagccatgtcaatgaattcagcacgttcaactaatattttagacaatatgggcaaatcatccaagaaatccactgcacttagtcgaactacaaataatgaaaagtctcccattataaagcctctgattccaaagccgaagcctaagcaggcatctgcagcatcctatttccagaaaagaaattctcaaactaataaaactgaggaagtgaaagaagaaaatcttaaaaatgtattatctgaaaccccagctatatgtcctcctcaaaacactgaaaaccaaaggccaaagaccgggttccagatgtggttagaagaaaatagaagtaatattttgtctgacaatcctgacttttcagatgaagcagacataataaaagaaggaatgattcgatttagagtattgtcaactgaagaaagaaaggtgtgggctaacaaagccaaaggagaaacggcaagtgaaggaactgaagcaaagaagcgaaaacgtgtggttgatgaaagtgatgaaacagaaaaccaggaagaaaaagcaaaagagaacctgaatttgtctaaaaagcagaaacctttagatttttctacaaatcagaaactatcagcttttgcatttaagcaggagtaaaggaagaaagtgaccctagggaagtaatggatttttttttactcatctttgaatatagactcgagtctttgggaaactcattatatatatattttttaaagagtttgaagcaactgtttgtctttataagataatgtagtaattatattggtgtaggtaacaggacatatgtaaaaactatcatctttgcagattactctgcctccaaatgcagggcctttcagagatgcattgtgattgtaattactgagttgaagctccaaccaatttgaatttgtttcttaaccttgaaaaatcattaaagccaaggtattaaaacctttgtgcattaataccttctaggggtttggttcatttggtttttgtcatgtgcaaggaaggacaatagtcctctttccaagtgtgttagcatagacttctctatatgtttctactagacctaggggatgacgtcttttaataatactggccctaaacatgtaaataatcttgtaggtgagactttttcttttgtgtttcggaaatttcctatgtggctttcagttgtctgtttgtatagcctggatttttttgaggtaaatgaaactttctcatttgtatatttggcttgatatggtcttaatattatctttccacgaaatggatatatttctagaaaatatatatttactaccataatttctaccaccacccccattttgctctgcattatacacagtagagaagaactgaagacactgctgtgacagtattgcagtccaaggcatcatgtgctcttggtgggatactctgattatcagcatcaacagtactttactgagcaagactttgaaggcctgagaagagagcaaagttatggaaagtatttaactcttattttatattgaacaaacaaggtttaatcatgtcatacatttttggttttctaagcagagactaatacaaatgcagccacataaaggcagtgtactgggggtgggagggaaggaaacaatcacataaaatcagctgactcaaaattgaggatagttaataggttgaaagggaaaaagtatgttgaaaatttagacataaatgaaccaagaatattccttatctggtgatgattaaagttaggaaaacatacattttttattttttaattagtagctgctatcagagacattatagcacagtggttatgagcacagattccaaagccagattacctaggttcggagacccgcttctctacctactactaatagttgggtcatgttgggccggtgacccaaattctagccttcattcactcatctgtaaaatggatataatgatagtacctactttataggttgttatgagaattgaatgaaatgaaagcccttagtttctgacacatagtaatcttttatataaatgttagttactattctgataatgatgatgctgttggttatttcatcttgctttgtcattaggtttgattctgaatactatacaaactaattttgatttcaagatcttaagtaaaggtttatttatagtacattggaaagcatgtttgtagacatgtattttgtgtttggttcctcaacttgctttgtatatattttataatactaggttgatataaaagtaaatgcagtttcgccatttcagtggcaaaaaccgcgatttcttttgtgccaacctaatgcttaaggatataatctgtgtatattgtatttcagattcatagcaacctaataacaaggatttacaaaagggtttttacttccctacttttttttggctgaaggaaggtttttgtattgacttggtttaacttacaaatcagaactttgaaaccaagaaacattatccttatttctctgctatataatagtaaacctgtttttttccagtgttcttttttttttttccagagaattgggactgaatagtatgaaagtgaaaatggaaataaattaattattaatcatcatcatatcaataatattgcctacttgagcttattgtatactatagaaaattgacatatacttaattttattctccaaaagcaaaaactcctcacaggaggttactttacagatttattttggagaacaagtgaataggcactggggttatgtgcagctctggggactgtgctatgatctaaagcctctcatatctgtgcagcaacctggggtgagtcactgtcactaacatggaacagatgccaggtagtccctttggacaaaaggatgaggcccatccatgtagaaagcatcttaatcagtgactgtcttatgggccctctttgtttcccatctgttttattatcagaatatataattttcccccaagttttcatcttgaatctctcaaacctacagaaaatttgaaatttgacagtaagcacctgtatatccttcctctagtttgtcttattgttgacattttatcatgtatgctttatagacaggatttttcctgaaccatttggaatatgcatatacttcatccctcagttcccagcatgtaccctaagaataaagattttcttctgcata

SEQ ID NO: 199643 - DNA, 3722 bp, Homo sapiens
  Payload ID: 19393
  Gene Name: WD repeat and HMG-box DNA binding protein 1
  Uniprot ID: O75717
  ENST ID: ENST00000420358
  CDS Start-End: 371-3391
aggcgcagtgtggtgagcgagccgaagcgcgggaagcagctcttgtggatcctcagtggcggaggctcggtcacccggttttattgtgacttgtggaagtgatggtgatgtgaggatttgggaagacttggatgatgatgatcctaagttcattaatgttggagaaaaggcatattcatgtgctttgaagagtggaaaactggtcactgcagtttctaataatactattcaagtccacacatttcctgaaggagttccagatggtatattgactcgcttcactacaaatgcaaaccatgtggtctttaatggggatggtactaaaattgctgctggatctagtgattttctagtcaaaattgtggatgtgatggatagcagccaacagaaaacatttcgaggacatgatgcccctgttttaagtctttcctttgatcctaaggacatctttctggcatcagctagttgtgatggatctgtcagagtgtggcaaatttcagatcagacatgtgctattagttggccactgctacaaaaatgcaacgatgtgataaatgcaaaatcaatctgcagacttgcttggcagccaaaaagtgggaagttactggcaattcctgtggaaaaatctgttaagctatatagaagagaatcttggagtcatcaatttgatctttcagataatttcatctctcagaccctcaatatagtaacctggtctccctgtgggcaatatttagctgcaggtagtattaatggtctaatcatagtttggaatgtggaaaccaaagactgcatggaaagggtgaaacatgagaaaggttatgcaatttgtggtctggcatggcatcctacttgtggtcgaatatcgtatactgatgcggaaggaaatctagggcttctagagaatgtttgtgaccccagtggaaagacatcaagcagtaaggtatctagcagagtggaaaaggattataatgatctttttgatggagatgatatgagtaatgctggtgattttctaaatgacaatgcagttgagatcccttctttttcaaaagggattataaatgatgatgaggatgatgaagacctcatgatggcttcaggtcgtcctagacagcgaagtcacatcctagaagatgatgaaaactcagttgatatttcaatgctaaaaactggttctagtcttctcaaagaggaggaggaagatggtcaagaaggcagcattcacaatctaccacttgtaacatcccaaaggccattttatgatggacccatgccaactccccggcaaaagccatttcagtcaggttctacaccgttgcatctcactcacagattcatggtgtggaactctattggaattattcgctgctataatgatgagcaagacaatgccatagatgtggagttccatgatacctccatacaccatgcaacacacttatcaaacactttgaattatacaatagcagatctttcccacgaagctattttgttggcatgtgaaagcactgatgaactagcaagcaagcttcactgcctgcactttagttcttgggattcaagcaaagagtggataatagacttgcctcagaatgaggatattgaagccatatgtctcggtcaaggatgggctgctgccgctactagtgccctgcttcttcgattgtttactattggaggggttcaaaaagaggtattcagccttgctggacctgtggtgtcaatggcaggacatggagaacagcttttcattgtttatcacagaggtacaggatttgatggggatcagtgccttggagttcaactgctagagctggggaaaaagaaaaaacaaattttgcatggtgaccctcttcctcttacaaggaaatcctaccttgcatggattgggttttcagctgaaggtaccccttgttacgtggattcagaaggaattgttcgaatgcttaacagaggacttggtaatacgtggactcctatatgtaatacaagagagcactgcaaaggaaaatctgatcactactgggtggttggtatccatgaaaatccccagcaactaaggtgcattccttgtaaaggttctcggtttcccccaacccttccacgccctgctgttgctatattatcctttaagcttccttactgtcagattgcaacagagaaaggacaaatggaggagcaattttggcgttcagttatatttcacaaccaccttgattatttagctaaaaatggttatgaatatgaagagagcactaaaaatcaagcaacaaaagagcaacaggaacttttaatgaaaatgcttgcgctttcttgtaaactggagcgagaattccgttgtgtggaacttgctgatctaatgactcaaaatgctgtgaatttagccattaaatatgcttctcgctctcggaaattaatactggctcaaaaactaagtgaactggctgtagagaaggcagccgaattgacagcaacccaggtggaagaggaagaagaagaagaagatttcagaaaaaagctgaatgctggttacagcaatactgctacagagtggagccaaccaaggttcagaaatcaagttgaagaagatgctgaggacagtggagaagctgatgatgaagaaaaaccagaaatacataagcctggacagaactcgttttccaaaagtacaaattcctctgatgtttcagctaagtcaggtgcagttacctttagcagccaaggacgagtaaatccctttaaggtatcagccagttccaaagaaccagccatgtcaatgaattcagcacgttcaactaatattttagacaatatgggcaaatcatccaagaaatccactgcacttagtcgaactacaaataatgaaaagtctcccattataaagcctctgattccaaagccgaagcctaagcaggcatctgcagcatcctatttccagaaaagaaattctcaaactaataaaactgaggaagtgaaagaagaaaatcttaaaaatgtattatctgaaaccccagctatatgtcctcctcaaaacactgaaaaccaaaggccaaagaccgggttccagatgtggttagaagaaaatagaagtaatattttgtctgacaatcctgacttttcagatgaagcagacataataaaagaaggaatgattcgatttagagtattgtcaactgaagaaagaaaggtgtgggctaacaaagccaaaggagaaacggcaagtgaaggaactgaagcaaagaagcgaaaacgtgtggttgatgaaagtgatgaaacagaaaaccaggaagaaaaagcaaaagagaacctgaatttgtctaaaaagcagaaacctttagatttttctacaaatcagaaactatcagcttttgcatttaagcaggagtaaaggaagaaagtgaccctagggaagtaatggatttttttttactcatctttgaatatagactcgagtctttgggaaactcattatatatatattttttaaagagtttgaagcaactgtttgtctttataagataatgtagtaattatattggtgtaggtaacaggacatatgtaaaaactatcatctttgcagattactctgcctccaaatgcagggcctttcagagatgcattgtgattgtaattactgagttgaagctccaaccaatttgaatttgtttcttaaccttgaaaaatcattaaagccaaggtattaaaacctttgtgcatta

SEQ ID NO: 199644 - DNA, 768 bp, Homo sapiens
  Payload ID: 19393
  Gene Name: WD repeat and HMG-box DNA binding protein 1
  ENST ID: ENST00000455555
  CDS Start-End: 265-768
agtggcggaggctcggtcacccgggtgagtccccactccggctgcccgcgtccaccaaggagatgcgtgttccctttccggcttattgtctgacagaccctctgccttatcccgctggtgtcactcgggtgggggaaaccgggctgcggagaacgggccctagaggagactaagctctcttcctatccctagcctcgctgcttttctcttttgaaataataagactggcttttataaaacattttcagataggtaaaggaaaacatgcctgccacacggaagccaatgagatatgggcatacagagggacacacggaggtctgttttgatgattctgggagttttattgtgacttgtggaagtgatggtgatgtgaggatttgggaagacttggatgatgatgatcctaagttcattaatgttggagaaaaggcatattcatgtgctttgaagagtggaaaactggtcactgcagtttctaataatactattcaagtccacacatttcctgaaggagttccagatggtatattgactcgcttcactacaaatgcaaaccatgtggtctttaatggggatggtactaaaattgctgctggatctagtgattttctagtcaaaattgtggatgtgatggatagcagccaacagaaaacatttcgaggacatgatgcccctgttttaagtctttcctttgatcctaaggacatctttctggcatcagctagttgtgatggatctgtcagagtgtggcaaatttcagatcag

SEQ ID NO: 199645 - DNA, 2348 bp, Homo sapiens
  Payload ID: 19393
  Gene Name: WD repeat and HMG-box DNA binding protein 1
  ENST ID: ENST00000567693
  CDS Start-End: 1-194
ctggttctagtcttctcaaagaggaggaggaagatggtcaagaaggcagcattcacaatctaccacttgtaacatcccaaaggccattttatgatggacccatgccaactccccggcaaaagccatttcagtcaggttctacaccgttgcatctcactcacagattcatgcaagcttcactgcctgcactttagttcttgggattcaagcaaagagtggataatagacttgcctcagaatgaggatattgaagccatatgtctcggtcaaggatgggctgctgccgctactagtgccctgcttcttcgattgtttactattggaggggttcaaaaagaggtattcagccttgctggacctgtggtgtcaatggcaggacatggagaacagcttttcattgtttatcacagaggtacaggatttgatggggatcagtgccttggagttcaactgctagagctggggaaaaagaaaaaacaaattttgcatggtgaccctcttcctcttacaaggaaatcctaccttgcatggattgggttttcagctgaaggtaccccttgttacgtggattcagaaggaattgttcgaatgcttaacagaggacttggtaatacgtggactcctatatgtaatacaagagagcactgcaaaggaaaatctgatcactactgggtggttggtatccatgaaaatccccagcaactaaggtgcattccttgtaaaggttctcggtttcccccaacccttccacgccctgctgttgctatattatcctttaagcttccttactgtcagattgcaacagagaaaggacaaatggaggagcaattttggcgttcagttatatttcacaaccaccttgattatttagctaaaaatggttatgaatatgaagagagcactaaaaatcaagcaacaaaagagcaacaggaacttttaatgaaaatgcttgcgctttcttgtaaactggagcgagaattccgttgtgtggaacttgctgatctaatgactcaaaatgctgtgaatttagccattaaatatgcttctcgctctcggaaattaatactggctcaaaaactaagtgaactggctgtagagaaggcagccgaattgacagcaacccaggtggaagaggaagaagaagaagaagatttcagaaaaaagctgaatgctggttacagcaatactgctacagagtggagccaaccaaggttcagaaatcaagttgaagaagatgctgaggacagtggagaagctgatgatgaagaaaaaccagaaatacataagcctggacagaactcgttttccaaaagtacaaattcctctgatgtttcagctaagtcaggtgcagttacctttagcagccaaggacgagtaaatccctttaaggtatcagccagttccaaagaaccagccatgtcaatgaattcagcacgttcaactaatattttagacaatatgggcaaatcatccaagaaatccactgcacttagtcgaactacaaataatgaaaagtctcccattataaagcctctgattccaaagccgaagcctaagcaggcatctgcagcatcctatttccagaaaagaaattctcaaactaataaaactgaggaagtgaaagaagaaaatcttaaaaatgtattatctgaaaccccagctatatgtcctcctcaaaacactgaaaaccaaaggccaaagaccgggttccagatgtggttagaagaaaatagaagtaatattttgtctgacaatcctgacttttcagatgaagcagacataataaaagaaggaatgattcgatttagagtattgtcaactgaagaaagaaaggtgtgggctaacaaagccaaaggagaaacggcaagtgaaggaactgaagcaaagaagcgaaaacgtgtggttgatgaaagtgatgaaacagaaaaccaggaagaaaaagcaaaagagaacctgaatttgtctaaaaagcagaaacctttagatttttctacaaatcagaaactatcagcttttgcatttaagcaggagtaaaggaagaaagtgaccctagggaagtaatggatttttttttactcatctttgaatatagactcgagtctttgggaaactcattatatatatattttttaaagagtttgaagcaactgtttgtctttataagataatgtagtaattatattggtgtaggtaacaggacatatgtaaaaactatcatctttgcagattactctgcctccaaatgcagggcctttcagagatgcattgtgattgtaattactgagttgaagctccaaccaatttgaatttgtttcttaaccttgaaaaatcattaaagccaaggtatt

SEQ ID NO: 199646 - DNA, 5139 bp, Homo sapiens
  Payload ID: 19394
  Gene Name: WD repeat and SOCS box containing 1
  Uniprot ID: Q9Y6I7
  ENST ID: ENST00000262394
  CDS Start-End: 317-1582
agatatctccggcgccgcccgccattttgactccagtgtctcgtttgcagtcggcgctttaggggaactgtcttcctccgcaggcgcgaggctgggtacagggtctattgtctgtggttgactccgtactttggtctgaggccttcgggagctttcccgaggcagttagcagaagccgcagcggccgcccccgcccgtctcctctgtccctgggcccgggagggaccaacttggcgtcacgcccctcagcggtcgccactctcttctctgttgttgggtccgcatcgtattcccggaatcagacggtgccccatagatggccagctttcccccgagggtcaacgagaaagagatcgtgagattacgtactataggtgaacttttagctcctgcagctccttttgacaagaaatgtggtcgtgaaaattggactgttgcttttgctccagatggttcatactttgcttggtcacaaggacatcgcacagtaaagcttgttccgtggtcccagtgccttcagaactttctcttgcatggcaccaagaatgttaccaattcaagcagtttaagattgccaagacaaaatagtgatggtggtcagaaaaataagcctcgtgaacatattatagactgtggagatatagtctggagtcttgcttttgggtcatcagttccagaaaaacagagtcgctgtgtaaatatagaatggcatcgcttcagatttggacaagatcagctacttcttgctacagggttgaacaatgggcgtatcaaaatatgggatgtatatacaggaaaactcctccttaacttggtagatcatactgaagtggtcagagatttaacttttgctccagatggaagcttgatcctggtgtcagcttcaagagacaaaactctcagagtatgggacctgaaagatgatggaaacatgatgaaagtattgagggggcatcagaattgggtgtacagctgtgcattctctcctgactcttctatgctgtgttcagtcggagccagtaaagcagttttcctttggaatatggataaatacaccatgatacggaaactagaaggacatcaccatgatgtggtagcttgtgacttttctcctgatggagcattactggctactgcatcttatgatactcgagtatatatctgggatccacataatggagacattctgatggaatttgggcacctgtttcccccacctactccaatatttgctggaggagcaaatgaccggtgggtacgatctgtatcttttagccatgatggactgcatgttgcaagccttgctgatgataaaatggtgaggttctggagaattgatgaggattatccagtgcaagttgcacctttgagcaatggtctttgctgtgccttctctactgatggcagtgttttagctgctgggacacatgacggaagtgtgtatttttgggccactccacggcaggtccctagcctgcaacatttatgtcgcatgtcaatccgaagagtgatgcccacccaagaagttcaggagctgccgattccttccaagcttttggagtttctctcgtatcgtatttagaagattctgccttccctagtagtagggactgacagaatacacttaacacaaacctcaagctttactgacttcaattatctgtttttaaagacgtagaagatttatttaatttgatatgttcttgtactgcattttgatcagttgagcttttaaaatattatttatagacaatagaagtatttctgaacatatcaaatataaatttttttaaagatctaactgtgaaaacatacatacctgtacatatttagatataagctgctatatgttgaatggacccttttgcttttctgatttttagttctgacatgtatatattgcttcagtagagccacaatatgtatctttgctgtaaagtgcaaggaaattttaaattctgggacactgagttagatggtaaatactgacttacgaaagttgaattgggtgaggcgggcaaatcacctgaggtcagcagtttgagactagcctggcaaacatgatgaaaccctgtctctactaaaaatacaaaaaaaaaaaaaattagccaggcgtggtggtgcacacctgtagtcctagctacttgggaggctgaggcaggagaattgcttgaacccaggaggtggaggttgcagtaagccaagatcacaccactgcactccaacctggacaacagagcgagactccatctcaaaaaaaaaaaaaaattgtgttgcctcatacgaaatgtatttggttttgttggagagtgtcagactgatctggaagtgaaacacagtttatgtacagggaaaaggattttattatccttaggaatgtcatccaagacgtagagcttgaatgtgacgttatttaaaaacaacaacaaagaaggcagagccaggatataactagaaaaaggatgtctttttttttttttttactccccctctaaacactgctgctgccttaattttagaaagcagcttactagtttacccttgtggtataaagtattataaattgttgtgaatttgaagaatccgtctactgtattattgctaaatattttgtttatactaagggacaattattttaagaccatggatttaaaaaaaaaaaaaaaaactctgtttctgcaggggatgatattggtgagttgccaaagaagcaatacagcatatctgcttttgccttctgttgtttatcttacctgcagatattaagaatgtatgcattatgtaaaatgctcaattatatatttttgttgagttttttaattaaagacttgtaaaaaaaaaaaacagtatattgcaaatgtttcttaaataggttaggtggagtactttctctctgtctccattgtaaggttgatggtacaccacaggcaaattaagcaaaaaggacaatgaagaaagaatgcaggactcaggcgctgctctagaattcattcagggctccccgagtgcagcagctcttatggtggttttgtttttaggagaactgttgtaataatgcatattttaaaagcatagggaagctctagaacacaggaaggtgactactaagcaagagaaaagtatcttttagtggggaactaccagcctatagtaagtctatctggttaaagtagttattatgaaaatctagcagtctgggtcctttgagaaggcattaaaaaagcaaaactcttatgagccatgtgtgattttgaagactcatttccactgagaaattatttggaagttcctatggttagctctgttaaggaatgtaaaaatttatagggggtgtagggttatcaatttgaaagccagtagaaaatctgctcaagttacttcttgaggatcatctgtattttacaaaaagaagcacaagaagcatctaatctttatacttcttgtgactttttttcccctgcattttactttgtaatatatcggctttataattttaaaatacactggccgggcgcagtggcccacacctataatcccagcactttgggaggccaaggcaggtgggtcacttaaggccgggagttcatgacaagcctgaccaacatagtgaaacccctgtctctactaaaattacaaaaattagctgggcatggtggtgggttcctgtactcctagctacttaggaggctgaggcaagagaattgcttgaactggagaaatggaggttgcagtgagctgagatcacgcaactgcactccagcctgggtgacagagtaagactctaaataaataagataccattacttttcatatcattgcattatttttgctttccacaccaacatatccagtcaagtaaaaacagctttttttattttttattttttattttttttgagacggagtctcacactgtcacctgggctggagtgcagtggtgcgatcttggctcactgcagcctccacctcctgggttcaagcaattctcctgcctcagcctcccaagcagctgggattacaggcgctcccccaccacgcccagctaatttttgttgtatttttaggacagacggcgtttcactgttggccagactggtctcaaactcctgacctcgtgatccgcccgcctcggcctcccagagtgctgggattataggtgtgagccaccgaacctggcccaaaacagcatttttggaagctacattctgtgagatgttcacctgtttgccacctcttctcgtgaaaaccatagtgagtgccagtgtgaaaggaagattgcagcgtatatgtcaagtagaaacatgtttgaattttccatttgtctgtggggaagaaggtaataacagtaataacagactgaaggaccaaaggaaaatagggaagacgttgattatggacttggatcagattctagctacatgatttgaaaatgacactgcctctcctattttgccacaagcctgtcatttggagaactggcagatcatttatgttcagatttaattttctgttttagaatcccatggagtacatgtgaacataggaaaatcacactcagcagccaagctatccttttgcgataatgaaatcactttaaaacctataacttgatcttaggttggcaaatcttaaacttaacgatccttgaaatttcctgcctgctgtgactgtgatgcagttggattcaactggtttacactgctcttgggtcggcaagaccaaaaaaggttggactgcactgtagcatgcttatgggttgaggcagtggcagaggcagaggacttggccgtcagccagccagcacaggcgtaagaaaatagcatgagaagtttcacgagcctgaaaccattgagacagtgattacaacctccatattaatcagatgagggtttgtaggtgacatagcattttacccaagtaattctgaacagactgtggcttatgataatacattttaactagcaagtgtgtggactataaaacaaatatctagagttatatatggatgtactatcatttggtgataaaagcatagaaaaagcataagttggagtatactgggtttttttgttgttgttaaattcttttccatcagaagtaagagctgttggcagcaactaataaaatgcaacctagtga

SEQ ID NO: 199647 - DNA, 1611 bp, Homo sapiens
  Payload ID: 19394
  Gene Name: WD repeat and SOCS box containing 1
  Uniprot ID: Q9Y6I7
  ENST ID: ENST00000348811
  CDS Start-End: 266-1093
cggcgctttaggggaactgtcttcctccgcaggcgcgaggctgggtacagggtctattgtctgtggttgactccgtactttggtctgaggccttcgggagctttcccgaggcagttagcagaagccgcagcggccgcccccgcccgtctcctctgtccctgggcccgggagggaccaacttggcgtcacgcccctcagcggtcgccactctcttctctgttgttgggtccgcatcgtattcccggaatcagacggtgccccatagatggccagctttcccccgagggtcaacgagaaagagatcggaaaactcctccttaacttggtagatcatactgaagtggtcagagatttaacttttgctccagatggaagcttgatcctggtgtcagcttcaagagacaaaactctcagagtatgggacctgaaagatgatggaaacatgatgaaagtattgagggggcatcagaattgggtgtacagctgtgcattctctcctgactcttctatgctgtgttcagtcggagccagtaaagcagttttcctttggaatatggataaatacaccatgatacggaaactagaaggacatcaccatgatgtggtagcttgtgacttttctcctgatggagcattactggctactgcatcttatgatactcgagtatatatctgggatccacataatggagacattctgatggaatttgggcacctgtttcccccacctactccaatatttgctggaggagcaaatgaccggtgggtacgatctgtatcttttagccatgatggactgcatgttgcaagccttgctgatgataaaatggtgaggttctggagaattgatgaggattatccagtgcaagttgcacctttgagcaatggtctttgctgtgccttctctactgatggcagtgttttagctgctgggacacatgacggaagtgtgtatttttgggccactccacggcaggtccctagcctgcaacatttatgtcgcatgtcaatccgaagagtgatgcccacccaagaagttcaggagctgccgattccttccaagcttttggagtttctctcgtatcgtatttagaagattctgccttccctagtagtagggactgacagaatacacttaacacaaacctcaagctttactgacttcaattatctgtttttaaagacgtagaagatttatttaatttgatatgttcttgtactgcattttgatcagttgagcttttaaaatattatttatagacaatagaagtatttctgaacatatcaaatataaatttttttaaagatctaactgtgaaaacatacatacctgtacatatttagatataagctgctatatgttgaatggacccttttgcttttctgatttttagttctgacatgtatatattgcttcagtagagccacaatatgtatctttgctgtaaagtgcaaggaaattttaaattctgggacactgagttagatggtaaatactgacttacgaaagttgaattgggtgaggcgggcaaatcacctgaggtcagcagtttgagactagcctggcaaacatgatgaaaccctgtctctactaaaaatacaaaaaaaaaa

SEQ ID NO: 199648 - DNA, 1149 bp, Homo sapiens
  Payload ID: 19394
  Gene Name: WD repeat and SOCS box containing 1
  ENST ID: ENST00000427287
  CDS Start-End: 283-924
agtgtctcgtttgcagtcggcgctttaggggaactgtcttcctccgcaggcgcgaggctgggtacagggtctattgtctgtggttgactccgtactttggtctgaggccttcgggagctttcccgaggcagttagcagaagccgcagcggccgcccccgcccgtctcctctgtccctgggcccgggagggaccaacttggcgtcacgcccctcagcggtcgccactctcttctctgttgttgggtccgcatcgtattcccggaatcagacggtgccccatagatggccagctttcccccgagggtcaacgagaaagagatcgatggttcatactttgcttggtcacaaggacatcgcacagtaaagcttgttccgtggtcccagtgccttcagaactttctcttgcatggcaccaagaatgttaccaattcaagcagtttaagattgccaagacaaaatagtgatggtggtcagaaaaataagcctcgtgaacatattatagactgtggagatatagtctggagtcttgcttttgggtcatcagttccagaaaaacagagtcgctgtgtaaatatagaatggcatcgcttcagatttggacaagatcagctacttcttgctacagggttgaacaatgggcgtatcaaaatatgggatgtatatacaggaaaactcctccttaacttggtagatcatactgaagtggtcagagatttaacttttgctccagatggaagcttgatcctggtgtcagcttcaagagacaaaactctcagagtatgggacctgaaagatgatggaaacatgatgaaagtattgagggggcatcagaattgggtgtacagctgtgcattctctcctgactcttctatgctgtgttcagtcggagccagtaaagcagtggtggcagcaatattggtgtgattgaggttatgctggcaccactcgcacacaggcgcacaatggtgttagctgggcagaaagagtggcatctctggctaccgggctgggggcgacctttaccataggatgaagtaaccttgcattcggctgcaaggtgtactgtacgtacacaggtgctggtcgatgtccactttctgcttttctttctttctttttttcttttttaaagtaatttcccccacagta

SEQ ID NO: 199649 - DNA, 1670 bp, Homo sapiens
  Payload ID: 19394
  Gene Name: WD repeat and SOCS box containing 1
  ENST ID: ENST00000579733
  CDS Start-End: 294-590
attttgactccagtgtctcgtttgcagtcggcgctttaggggaactgtcttcctccgcaggcgcgaggctgggtacagggtctattgtctgtggttgactccgtactttggtctgaggccttcgggagctttcccgaggcagttagcagaagccgcagcggccgcccccgcccgtctcctctgtccctgggcccgggagggaccaacttggcgtcacgcccctcagcggtcgccactctcttctctgttgttgggtccgcatcgtattcccggaatcagacggtgccccatagatggccagctttcccccgagggtcaacgagaaagagatcggaaaactcctccttaacttggtagatcatactgaagtggtcagagatttaacttttgctccagatggaagcttgatcctggtgtcagcttcaagagacaaaactctcagagtatgggacctgaaagatgatggaaacatgatgaaagtattgagggggcatcagaattgggtgtacagctgtgcattctctcctgactcttctatgctgtgttcagtcggagccagtaaagcagtggtggcagcaatattggtgtgattgaggttatgctggcaccactcgcacacaggcgcacaatggtgttagctgggcagaaagagtggcatctctggctaccgggctgggggcgacctttaccataggatgaagtaaccttgcattcggctgcaaggtgtactgtacgtacacaggtgctggtcgatgtccactttctgcttttctttctttctttttttcttttttaaagtaatttcccccacagtaaaatacactgactcctgagtaaattgattttccagttttatggaattgggagtctgacaagtgaaaccaatttaatgtaaagtatttggctttcaaatggtttctctgtgctattttttggaattctttcagattccagagatatcttacgtctttgattcaatttaaaatttgtacttattttcttttagaaataatgtattgtgtctgtgcagaaaaaaaaaaaaccaaaaaggattgctttactccaagaggagagattgtcttaggataaacctccaagctcacatttaatataacagactgaagtaaacattagaatcctgtttagagctattctgcacagttaactactgatctttagaatctaaaattgtatatgaacttattcttaaataattgaaccgttttatattcaaatgacttatgatcgtggttagtttgggaaaaataagatggttaaattttgatttattgaaatgtaattgtattattttcataaaatagcattttcattttgtaatgtggtttaacatccttgttgtttgccaaagaaatttcatttggctgtgaatattctatttgcttgcagtatctgtttctcttcctaggctcaagttggtgacccaagcctattgtaaacaagtgattatctcaaagggagatgccaatggagtaacaatttgttaaccttacgttttctgtctgtatatttttttaaaaatctggtagtttctggaaaaaaaagagaagggggtttgtagtacttaaccctatttatttccgtatattttagttaattagtttttggaataaatggatttcagtatagctttgtggttaaattgcattgcc

SEQ ID NO: 199650 - DNA, 544 bp, Homo sapiens
  Payload ID: 19394
  Gene Name: WD repeat and SOCS box containing 1
  ENST ID: ENST00000583742
  CDS Start-End: 310-544
tccggcgccgcccgccattttgactccagtgtctcgtttgcagtcggcgctttaggggaactgtcttcctccgcaggcgcgaggctgggtacagggtctattgtctgtggttgactccgtactttggtctgaggccttcgggagctttcccgaggcagttagcagaagccgcagcggccgcccccgcccgtctcctctgtccctgggcccgggagggaccaacttggcgtcacgcccctcagcggtcgccactctcttctctgttgttgggtccgcatcgtattcccggaatcagacggtgccccatagatggccagctttcccccgagggtcaacgagaaagagatcgctcctgcagctccttttgacaagaaatgtggtcgtgaaaattggactgttgcttttgctccagatggttcatactttgcttggtcacaaggacatcgcacagtaaagcttgttccgtggtcccagtgccttcagaactttctcttgcatggcaccaagaatgttaccaattcaagcagtttaagattgccaagac

SEQ ID NO: 199651 - DNA, 552 bp, Homo sapiens
  Payload ID: 19394
  Gene Name: WD repeat and SOCS box containing 1
  ENST ID: ENST00000583193
  CDS Start-End: 285-449
ccagtgtctcgtttgcagtcggcgctttaggggaactgtcttcctccgcaggcgcgaggctgggtacagggtctattgtctgtggttgactccgtactttggtctgaggccttcgggagctttcccgaggcagttagcagaagccgcagcggccgcccccgcccgtctcctctgtccctgggcccgggagggaccaacttggcgtcacgcccctcagcggtcgccactctcttctctgttgttgggtccgcatcgtattcccggaatcagacggtgccccatagatggccagctttcccccgagggtcaacgagaaagagatcggaaacatgatgaaagtattgagggggcatcagaattgggtgtacagctgtgcattctctcctgactcttctatgctgtgttcagtcggagccagtaaagcagtggtggcagcaatattggtgtgattgaggttatgctggcaccactcgcacacaggcgcacaatggtgttagctgggcagaaagagtggcatctctggctaccgggctgggggcgacctttaccata

SEQ ID NO: 199652 - DNA, 943 bp, Homo sapiens
  Payload ID: 19394
  Gene Name: WD repeat and SOCS box containing 1
  ENST ID: ENST00000581440
  CDS Start-End: 321-943
gcccagatatctccggcgccgcccgccattttgactccagtgtctcgtttgcagtcggcgctttaggggaactgtcttcctccgcaggcgcgaggctgggtacagggtctattgtctgtggttgactccgtactttggtctgaggccttcgggagctttcccgaggcagttagcagaagccgcagcggccgcccccgcccgtctcctctgtccctgggcccgggagggaccaacttggcgtcacgcccctcagcggtcgccactctcttctctgttgttgggtccgcatcgtattcccggaatcagacggtgccccatagatggccagctttcccccgagggtcaacgagaaagagatcgtatttttatttttccttttagtgagattacgtactataggtgaacttttagctcctgcagctccttttgacaagaaatgtggtcgtgaaaattggactgttgcttttgctccagatggttcatactttgcttggtcacaaggacatcgcacagtaaagcttgttccgtggtcccagtgccttcagaactttctcttgcatggcaccaagaatgttaccaattcaagcagtttaagattgccaagacaaaatagtgatggtggtcagaaaaataagcctcgtgaacatattatagactgtggagatatagtctggagtcttgcttttgggtcatcagttccagaaaaacagagtcgctgtgtaaatatagaatggcatcgcttcagatttggacaagatcagctacttcttgctacagggttgaacaatgggcgtatcaaaatatgggatgtatatacaggaaaactcctccttaacttggtagatcatactgaagtggtcagagatttaacttttgctccagatggaagcttgatcctggtgtcagcttcaagagacaaaactctcagagtatgggacctgaa

SEQ ID NO: 199653 - DNA, 479 bp, Homo sapiens
  Payload ID: 19394
  Gene Name: WD repeat and SOCS box containing 1
  ENST ID: ENST00000584114
  CDS Start-End: 51-479
tctgttgttgggtccgcatcgtattcccggaatcagacggtgccccatagatggccagctttcccccgagggtcaacgagaaagagatcggaaaactcctccttaacttggtagatcatactgaagtggtcagagatttaacttttgctccagatggaagcttgatcctggtgtcagcttcaagagacaaaactctcagagtatgggacctgaaagatgatggaaacatgatgaaagtattgagggggcatcagaattgggtgtacagctgtgcattctctcctgactcttctatgctgtgttcagtcggagccagtaaagcagttttcctttggaatatggataaatacaccatgatacggaaactagaaggacatcaccatgatgtggtagcttgtgacttttctcctgatggagcattactggctactgcatcttatgatactcgagtatatatctgggatccacataatggagac

SEQ ID NO: 199654 - DNA, 625 bp, Homo sapiens
  Payload ID: 19394
  Gene Name: WD repeat and SOCS box containing 1
  ENST ID: ENST00000582208
  CDS Start-End: 208-432
gtctgtggttgactccgtactttggtctgaggccttcgggagctttcccgaggcagttagcagaagccgcagcggccgcccccgcccgtctcctctgtccctgggcccgggagggaccaacttggcgtcacgcccctcagcggtcgccactctcttctctgttgttgggtccgcatcgtattcccggaatcagacggtgccccatagatggccagctttcccccgagggtcaacgagaaagagatcgtgagattacgtactataggtgaacttttagctcctgcagctccttttgacaagaaatgtggtcgtgaaaattggactgttgcttttgctccagatggttcatactttgcttggtcacaaggacatcgcacagtaaagcttgttccgtggtcccagtgccttcagaacttgaaaactcctccttaacttggtagatcatactgaagtggtcagagatttaacttttgctccagatggaagcttgatcctggtgtcagcttcaagagacaaaactctcagagtatgggacctgaaagatgatggaaacatgatgaaagtattgagggggcatcagaattgggtgtacagctgtgcattctctcctgactcttctatgctg

SEQ ID NO: 199655 - DNA, 1900 bp, Homo sapiens
  Payload ID: 19394
  Gene Name: WD repeat and SOCS box containing 1
  ENST ID: ENST00000581185
  CDS Start-End: 283-1026
agtgtctcgtttgcagtcggcgctttaggggaactgtcttcctccgcaggcgcgaggctgggtacagggtctattgtctgtggttgactccgtactttggtctgaggccttcgggagctttcccgaggcagttagcagaagccgcagcggccgcccccgcccgtctcctctgtccctgggcccgggagggaccaacttggcgtcacgcccctcagcggtcgccactctcttctctgttgttgggtccgcatcgtattcccggaatcagacggtgccccatagatggccagctttcccccgagggtcaacgagaaagagatcgtgagattacgtactataggtgaacttttagctcctgcagctccttttgacaagaaatgtggtcgtgaaaattggactgttgcttttgctccagatggttcatactttgcttggtcacaaggacatcgcacagtaaagcttgttccgtggtcccagtgccttcagaactttctcttgcatggcaccaagaatgttaccaattcaagcagtttaagattgccaagacaaaatagtgatggtggtcagaaaaataagcctcgtgaacatattatagactgtggagatatagtctggagtcttgcttttgggtcatcagttccagaaaaacagagtcgctgtgtaaatatagaatggcatcgcttcagatttggacaagatcagctacttcttgctacagggttgaacaatgggcgtatcaaaatatgggatgtatatacaggaaaactcctccttaacttggtagatcatactgaagtggtcagagatttaacttttgctccagatggaagcttgatcctggtgtcagcttcaagagacaaaactctcagagtatgggacctgaaagatgatggaaacatgatgaaagtattgagggggcatcagaattgggtgtacagctgtgcattctctcctgactcttctatgctgtgttcagtcggagccagtaaagcagtacgtgtcaaagttcttgtacattcattatgaattggattatgataatgtgtgcataatcattttaaatctaagtaacctatgaagtctgtgctcggtgtcatgaatattttaaatgttttatttcatgatgggggagaatttgcatgaaggaaattaaatatagttattgattgccaagtgagaagttggattgtttttagagataatagataataatgggcatatcagggttttttttttttgtaagtctagaaaagtttatgtgctgtagaagagatctagtctatatgttaagacattcccttgctaattattttcttctctgttgttctatttttttggtccagtttgctgtttttaaagttttgagtcccagctggtcctgtacatttaactgaaaaaaaagtaacttaaaataatataaaaatagcactcatgtatgtcctacagttataggtgaaatttgatattgtttgtcttacatagcatacctatagacagcttaagtaaagtgactgttaagagggttatgcttattgatgaactcttgtagttgtttaccagctctgttagtatagttaaattgatctcagtagcttcaagtatttataaaatggttgaagtccaaatacatgtgataattacaatacactttgaattaatggagggtgggaggctagttgaaatgcattttatttacccaaggagtatgttaaaatgatagttataaatgttggaagtttaaagcaagatactcagtttagttctttacaaatcataagaagaacaaaattagatgttgacattgctattttaggctgtgtgttttccatatgcttcttgctttccctgtcacaggtggtggcagcaatattggtgtgattgaggttatgctggcaccact

SEQ ID NO: 199656 - DNA, 2646 bp, Homo sapiens
  Payload ID: 19395
  Gene Name: WD repeat and SOCS box containing 2
  Uniprot ID: Q9NYS7
  ENST ID: ENST00000315436
  CDS Start-End: 143-1357
catgtgacgggaagcagctgatggcctctccgggcggcggcggcggcctggccggggcgggcggcgcgggggcggcatgagggcccgcggcccggggggctgaggcgcccgccgcctgccgcgggggccgctcgcgtcctccatggaggccggagaggaaccgctgctgctggccgaactcaagcccgggcgcccccaccagtttgattggaagtccagctgtgaaacctggagcgtcgccttctccccagatggctcctggtttgcttggtctcaaggacactgcatcgtcaaactgatcccctggccgttggaggagcagttcatccctaaagggtttgaagccaaaagccgaagtagcaaaaatgagacgaaagggcggggcagcccaaaagagaagacgctggactgtggtcagattgtctgggggctggccttcagcccgtggccttccccacccagcaggaagctctgggcacgccaccacccccaagtgcccgatgtctcttgcctggttcttgctacgggactcaacgatgggcagatcaagatctgggaggtgcagacagggctcctgcttttgaatctttccggccaccaagatgtcgtgagagatctgagcttcacacccagtggcagtttgattttggtctccgcgtcacgggataagactcttcgcatctgggacctgaataaacacggtaaacagattcaagtgttatcgggccacctgcagtgggtttactgctgttccatctccccagactgcagcatgctgtgctctgcagctggagagaagtcggtctttctatggagcatgaggtcctacacgttaattcggaagctagagggccatcaaagcagtgttgtctcttgtgacttctcccccgactctgccctgcttgtcacggcttcttacgataccaatgtgattatgtgggacccctacaccggcgaaaggctgaggtcactccaccacacccaggttgaccccgccatggatgacagtgacgtccacattagctcactgagatctgtgtgcttctctccagaaggcttgtaccttgccacggtggcagatgacagactcctcaggatctgggccctggaactgaaaactcccattgcatttgctcctatgaccaatgggctttgctgcacattttttccacatggtggagtcattgccacagggacaagagatggccacgtccagttctggacagctcctagggtcctgtcctcactgaagcacttatgccggaaagcccttcgaagtttcctaacaacttaccaagtcctagcactgccaatccccaagaaaatgaaagagttcctcacatacaggactttttaagcaacaccacatcttgtgcttctttgtagcagggtaaatcgtcctgtcaaagggagttgctggaataatgggccaaacatctggtcttgcattgaaatagcatttctttgggattgtgaatagaatgtagcaaaaccagattccagtgtactagtcatggatctttctctccctggcatgtgaaagtcagtcttagaggaagagattccacttgcacggcaacagagccttacgttaaattttcagtccagttatgaacagcaagtgttgaactctttctgcttgttttgattcaaagtgcagttactgatgttgttttgattatgcaactaagtaggcctccagagcctctctagtggcagagcagctcacactccctccgctgggaacgatggcttctgcctagtacctatccttgtgtttctgatgcagtggtagcattggttcaagttctctcctgctgtggtcagagttgcttcgatgttggccaagtgcttttcttcttgggctcccttctgacctgcaggacagttttcctggagccatttggtatgaggtattaatttagcttaactaaattacaggggactcagaggccgtgctcctgaccgatccagacactattactggctttttttttttttttttaacaatggtgtgcatgtgcaggaaatgacaaatttgtatgtcagattatacaaggatgtattcttaaaccgcatgactattcagatggctactgagttatcagtggccatttattagcatcatatttatttgtattttctcaacagatgttaaggtacaactgtgtttttctcgattatctaaaaaccatagtacttaaattgaacagttgcaaagatgtcttaattgtgtaaagaattggtgtagtcatgactttagctgatactcttatgtacgagatctgtctctgctgtttaacttcattggattaatcagctggtttcaactctactgcgaaacaaaaatagctccttaaaagtactgttctccttcagtggcatgtagttatctaatcaagacacctcattcaaacaaaacctgccttaggaaaatttaatatattttaaattattttaaaagaaatacaacatcttattctttagctttcttaatcggtgctttatggaggccagtgtaacgttacatgactcgttgagaaagttgaggaatttcctctaccacctttgttgcttgaagaaaaacatgtcttttcaaaatgagaggctttcattgaagaaaagaaaaaaacaacagttaaaagc

SEQ ID NO: 199657 - DNA, 1353 bp, Homo sapiens
  Payload ID: 19395
  Gene Name: WD repeat and SOCS box containing 2
  Uniprot ID: Q9NYS7
  ENST ID: ENST00000441406
  CDS Start-End: 13-1278
tttcttgaggctatgcgggtagacagggagagcaggtttctcagggggacggggacaggcgaggctgtcgccgtagaggaaccgctgctgctggccgaactcaagcccgggcgcccccaccagtttgattggaagtccagctgtgaaacctggagcgtcgccttctccccagatggctcctggtttgcttggtctcaaggacactgcatcgtcaaactgatcccctggccgttggaggagcagttcatccctaaagggtttgaagccaaaagccgaagtagcaaaaatgagacgaaagggcggggcagcccaaaagagaagacgctggactgtggtcagattgtctgggggctggccttcagcccgtggccttccccacccagcaggaagctctgggcacgccaccacccccaagtgcccgatgtctcttgcctggttcttgctacgggactcaacgatgggcagatcaagatctgggaggtgcagacagggctcctgcttttgaatctttccggccaccaagatgtcgtgagagatctgagcttcacacccagtggcagtttgattttggtctccgcgtcacgggataagactcttcgcatctgggacctgaataaacacggtaaacagattcaagtgttatcgggccacctgcagtgggtttactgctgttccatctccccagactgcagcatgctgtgctctgcagctggagagaagtcggtctttctatggagcatgaggtcctacacgttaattcggaagctagagggccatcaaagcagtgttgtctcttgtgacttctcccccgactctgccctgcttgtcacggcttcttacgataccaatgtgattatgtgggacccctacaccggcgaaaggctgaggtcactccaccacacccaggttgaccccgccatggatgacagtgacgtccacattagctcactgagatctgtgtgcttctctccagaaggcttgtaccttgccacggtggcagatgacagactcctcaggatctgggccctggaactgaaaactcccattgcatttgctcctatgaccaatgggctttgctgcacattttttccacatggtggagtcattgccacagggacaagagatggccacgtccagttctggacagctcctagggtcctgtcctcactgaagcacttatgccggaaagcccttcgaagtttcctaacaacttaccaagtcctagcactgccaatccccaagaaaatgaaagagttcctcacatacaggactttttaagcaacaccacatcttgtgcttctttgtagcagggtaaatcgtcctgtcaaagggagttgctggaataatgggcca

SEQ ID NO: 199658 - DNA, 935 bp, Homo sapiens
  Payload ID: 19395
  Gene Name: WD repeat and SOCS box containing 2
  ENST ID: ENST00000543218
  CDS Start-End: 67-252
atgagggcccgcggcccggggggctgaggcgcccgccgcctgccgcgggggccgctcgcgtcctccatggaggccggagaggaaccgctgctgctggccgaactcaagcccgggcgcccccaccagtttgattggaagtccagctgtgaaacctggagcgtcgccttctccccagatggctcctggtttgcttggtctcaaggacactgcatcgtcaaactgatcccctggccgttggaggagcagttgtaaacagattcaagtgttatcgggccacctgcagtgggtttactgctgttccatctccccagactgcagcatgctgtgctctgcagctggagagaagtcggtctttctatggagcatgaggtcctacacgttaattcggaagctagagggccatcaaagcagtgttgtctcttgtgacttctcccccgactctgccctgcttgtcacggcttcttacgataccaatgtgattatgtgggacccctacaccggcgaaaggctgaggtcactccaccacacccaggttgaccccgccatggatgacagtgacgtccacattagctcactgagatctgtgtgcttctctccagaaggcttgtaccttgccacggtggcagatgacagactcctcaggatctgggccctggaactgaaaactcccattgcatttgctcctatgaccaatgggctttgctgcacattttttccacatggtggagtcattgccacagggacaagagatggccacgtccagttctggacagctcctagggtcctgtcctcactgaagcacttatgccggaaagcccttcgaagtttcctaacaacttaccaagtcctagcactgccaatccccaagaaaatgaaagagttcctcacatacaggactttttaagcaacaccacatcttgtgcttctttgtagca

SEQ ID NO: 199659 - DNA, 1328 bp, Homo sapiens
  Payload ID: 19395
  Gene Name: WD repeat and SOCS box containing 2
  ENST ID: ENST00000535496
  CDS Start-End: 108-1328
aagtgacaactccctctgggaatggatagtgtggctctttgccacagggagacagtggctttcctgtgtctgggtggtcagggagcaagggggtgtgtgtttgaagcatgttgtctcctgccccagaggaaccgctgctgctggccgaactcaagcccgggcgcccccaccagtttgattggaagtccagctgtgaaacctggagcgtcgccttctccccagatggctcctggtttgcttggtctcaaggacactgcatcgtcaaactgatcccctggccgttggaggagcagttcatccctaaagggtttgaagccaaaagccgaagtagcaaaaatgagacgaaagggcggggcagcccaaaagagaagacgctggactgtggtcagattgtctgggggctggccttcagcccgtggccttccccacccagcaggaagctctgggcacgccaccacccccaagtgcccgatgtctcttgcctggttcttgctacgggactcaacgatgggcagatcaagatctgggaggtgcagacagggctcctgcttttgaatctttccggccaccaagatgtcgtgagagatctgagcttcacacccagtggcagtttgattttggtctccgcgtcacgggataagactcttcgcatctgggacctgaataaacacggtaaacagattcaagtgttatcgggccacctgcagtgggtttactgctgttccatctccccagactgcagcatgctgtgctctgcagctggagagaagtcggtctttctatggagcatgaggtcctacacgttaattcggaagctagagggccatcaaagcagtgttgtctcttgtgacttctcccccgactctgccctgcttgtcacggcttcttacgataccaatgtgattatgtgggacccctacaccggcgaaaggctgaggtcactccaccacacccaggttgaccccgccatggatgacagtgacgtccacattagctcactgagatctgtgtgcttctctccagaaggcttgtaccttgccacggtggcagatgacagactcctcaggatctgggccctggaactgaaaactcccattgcatttgctcctatgaccaatgggctttgctgcacattttttccacatggtggagtcattgccacagggacaagagatggccacgtccagttctggacagctcctagggtcctgtcctcactgaagcacttatgccggaaagcccttcgaagtttcctaacaacttaccaagtcctagcactgccaatccccaagaaaatgaaagagttcctcacatacaggactttttaa

SEQ ID NO: 199660 - DNA, 795 bp, Homo sapiens
  Payload ID: 19395
  Gene Name: WD repeat and SOCS box containing 2
  ENST ID: ENST00000537945
  CDS Start-End: 60-795
caagaaccgcgggaagagcttgggcccaaagcaggaaagggaagcgctcgagttggggcatgttgtctcctgccccagaggaaccgctgctgctggccgaactcaagcccgggcgcccccaccagtttgattggaagtccagctgtgaaacctggagcgtcgccttctccccagatggctcctggtttgcttggtctcaaggacactgcatcgtcaaactgatcccctggccgttggaggagcagttcatccctaaagggtttgaagccaaaagccgaagtagcaaaaatgagacgaaagggcggggcagcccaaaagagaagacgctggactgtggtcagattgtctgggggctggccttcagcccgtggccttccccacccagcaggaagctctgggcacgccaccacccccaagtgcccgatgtctcttgcctggttcttgctacgggactcaacgatgggcagatcaagatctgggaggtgcagacagggctcctgcttttgaatctttccggccaccaagatgtcgtgagagatctgagcttcacacccagtggcagtttgattttggtctccgcgtcacgggataagactcttcgcatctgggacctgaataaacacggtaaacagattcaagtgttatcgggccacctgcagtgggtttactgctgttccatctccccagactgcagcatgctgtgctctgcagctggagagaagtcggtctttctatggagcatgaggtcctacacgttaattcggaagctagagggccatcaaagcagtgttgtct

SEQ ID NO: 199661 - DNA, 2503 bp, Homo sapiens
  Payload ID: 19395
  Gene Name: WD repeat and SOCS box containing 2
  Uniprot ID: Q9NYS7
  ENST ID: ENST00000544233
  CDS Start-End: 417-1001
gtctccgcccgcgcccaccgccatgtgacgggaagcagctgatggcctctccgggcggcggcggcggcctggccggggcgggcggcgcgggggcggcatgagggcccgcggcccggggggctgaggcgcccgccgcctgccgcgggggccgctcgcgtcctccatggaggccggagaggaaccgctgctgctggccgaactcaagcccgggcgcccccaccagtttgattggaagtccagctgtgaaacctggagcgtcgccttctccccagatggctcctggtttgcttggtctcaaggacactgcatcgtcaaactgatcccctggccgttggaggagcagttgtaaacagattcaagtgttatcgggccacctgcagtgggtttactgctgttccatctccccagactgcagcatgctgtgctctgcagctggagagaagtcggtctttctatggagcatgaggtcctacacgttaattcggaagctagagggccatcaaagcagtgttgtctcttgtgacttctcccccgactctgccctgcttgtcacggcttcttacgataccaatgtgattatgtgggacccctacaccggcgaaaggctgaggtcactccaccacacccaggttgaccccgccatggatgacagtgacgtccacattagctcactgagatctgtgtgcttctctccagaaggcttgtaccttgccacggtggcagatgacagactcctcaggatctgggccctggaactgaaaactcccattgcatttgctcctatgaccaatgggctttgctgcacattttttccacatggtggagtcattgccacagggacaagagatggccacgtccagttctggacagctcctagggtcctgtcctcactgaagcacttatgccggaaagcccttcgaagtttcctaacaacttaccaagtcctagcactgccaatccccaagaaaatgaaagagttcctcacatacaggactttttaagcaacaccacatcttgtgcttctttgtagcagggtaaatcgtcctgtcaaagggagttgctggaataatgggccaaacatctggtcttgcattgaaatagcatttctttgggattgtgaatagaatgtagcaaaaccagattccagtgtactagtcatggatctttctctccctggcatgtgaaagtcagtcttagaggaagagattccacttgcacggcaacagagccttacgttaaattttcagtccagttatgaacagcaagtgttgaactctttctgcttgttttgattcaaagtgcagttactgatgttgttttgattatgcaactaagtaggcctccagagcctctctagtggcagagcagctcacactccctccgctgggaacgatggcttctgcctagtacctatccttgtgtttctgatgcagtggtagcattggttcaagttctctcctgctgtggtcagagttgcttcgatgttggccaagtgcttttcttcttgggctcccttctgacctgcaggacagttttcctggagccatttggtatgaggtattaatttagcttaactaaattacaggggactcagaggccgtgctcctgaccgatccagacactattactggctttttttttttttttttaacaatggtgtgcatgtgcaggaaatgacaaatttgtatgtcagattatacaaggatgtattcttaaaccgcatgactattcagatggctactgagttatcagtggccatttattagcatcatatttatttgtattttctcaacagatgttaaggtacaactgtgtttttctcgattatctaaaaaccatagtacttaaattgaacagttgcaaagatgtcttaattgtgtaaagaattggtgtagtcatgactttagctgatactcttatgtacgagatctgtctctgctgtttaacttcattggattaatcagctggtttcaactctactgcgaaacaaaaatagctccttaaaagtactgttctccttcagtggcatgtagttatctaatcaagacacctcattcaaacaaaacctgccttaggaaaatttaatatattttaaattattttaaaagaaatacaacatcttattctttagctttcttaatcggtgctttatggaggccagtgtaacgttacatgactcgttgagaaagttgaggaatttcctctaccacctttgttgcttgaagaaaaacatgtcttttcaaaatgagaggctttcattgaagaaaagaaaaaaacaacagttaaaagcttttggctctctgtttcatttttttccattaagaaaaaaaaaagtccccttttaaaacaagcagggctgggtgtgacggcacatgcctgtaatcccagcactttgggaggctgaggtgggaggactgcttgagcccaggagttcaagatcagcctgggcaacagagtgagataagacccaatctttatttaaaaaataaataaataaatagcc

SEQ ID NO: 199662 - DNA, 393 bp, Homo sapiens
  Payload ID: 19395
  Gene Name: WD repeat and SOCS box containing 2
  ENST ID: ENST00000543186
  CDS Start-End: 110-280
ggataagactcttcgcatctgggacctgaataaacacggtaaacagattcaagtgttatcgggccacctgcagtgggtttactgctgttccatctccccagactgcagcatgctgtgctctgcagctggagagaagtcggtctttctatggagcatgaggtcctacacgttaattcggaagctagagggccatcaaagcagtgttgtctcttgtgacttctcccccgactctgccctgcttgtcacggcttcttacgataccaatccacacccaggttgaccccgccatggatgacagtgacgtccacattagctcactgagatctgtgtgcttctctccagaaggcttgtaccttgccacggtggcagatgacagactcctcaggatctggg

SEQ ID NO: 199663 - DNA, 3392 bp, Homo sapiens
  Payload ID: 19396
  Gene Name: WD repeat containing planar cell polarity effector
  Uniprot ID: O95876
  ENST ID: ENST00000272321
  CDS Start-End: 529-2769
actgcgctctgcgccgattgcaaagtagtccctgaggatgagcccctgtgattggaggacgacaacaaacggatggtttgggctcaggaggaaaggacctgcctgatggagcccggcaattggcgggagagatagcgtgtgtaactctagggaggggagaatcaccccttagcgacatcacccccacgcgcgtgactgagactgcatcctcccatgagggtaaacgtgggaggtaaagagaccttccgctgcgtaaagctggatcgacccggaaacaaaatcttttaaaaaacgattgacactctggaggggcgggggaattgataagttgggacgaccggacagcttctcaggttgctaagcgacgaggcgggagcgcacgcacaccctggctgctttgtagcacctgaggaaactgtggcggcggcggcggcgtcctggagacccaagagaccaagcgagcgtgtcgctccctctcgggtccgaggacctagcctaggaaccttctgcccggggtagtgtctggtgatgaggcgagagttttgctgggacgcctactccaaagcggccgggagtcgcgcttcttccccactcccgagacaggatagagattccttctgccatcagatgtctttctgcttgactgaactgcacctgtggtctttgaagaataccttacacattgcggatagagacattgggatctaccagtattatgacaagaaagatccaccagcgacagagcatggtaacttagaaaagaagcagaagctggcagagtcacgagattatccttggacgctcaaaaacagacgcccagaaaaactccgagactcgctcaaagagttggaggagctgatgcaaaacagtcggtgtgtgctgagcaaatggaagaacaaatatgtctgtcagctcctttttggttcaggtgtgctggtgtctctaagcctttctgggccgcagctggagaaagtggtgattgacagaagcctggtggggaagctcatctcagacaccatcagtgatgctcttctcacagacagttttatcatcttatcatttttggcacaaaacaaactatgttttattcagtttaccaagaagatggagtcttctgatgtaaacaaaagactggaaaaactctcagccttggattataagattttctattatgaaatacccggcccaataaacaagacaacagagcgacatctagctatcaactgtgttcatgatagagttgtttgctggtggccactggtcaacgatgatgcttggccttgggcccccatttcttctgagaaggacagagccaatctactcctcctgggttatgctcaaggaagactagaggttctgagttctgtccgcacagaatgggacccactggatgttcgctttggcaccaaacagccttatcaggtgttcacagtggagcactccgtaagtgtagacaaagagcccatggctgacagctgcatctatgaatgcattcggaataaaatccagtgtgtgtcagtcaccagaataccactaaagtcaaaggccatcagctgctgcaggaatgttactgaagacaaactgattctgggctgtgaagattcttcgctaattctttatgaaactcaccgtagagtgactctcttagcacagactgaacttttgccttcattaataagctgccacccaagtggtgccattctgctagttggcagcaaccaaggggagttgcaaatttttgatatggctctatcccctattaacatccaactgttggctgaagaccgcttacccagggagactctgcaattcagtaaattatttgatgcctccagcagtcttgttcaaatgcaatggatagctcctcaggttgtttctcagaagggtgaaggtagtgatatctatgatctcctcttcctcaggtttgaaagaggacctttgggtgtgctgttgtttaaactaggcgtcttcactcgaggacagctgggcctgatagacatcatcttccagtacattcactgtgatgagatctatgaggcaataaacatcctgagcagcatgaactgggacactctgggccaccagtgctttatcagcatgagcgccattgtaaaccatcttcttagacagaagctcactccagagagagaagcacagcttgagacaagccttggaaccttctatgctccaacaagaccacttctggattccactatattggaatatagagatcaaatcagcaaatatgcaaggagattcttccatcacttgctcaggtaccagaggtttgaaaaggcatttctcctagctgttgacgttggtgctcgtgacctctttatggatattcattaccttgcactagataaaggtgaattggcactagctgaagtggcaagaaaaagagctagtgacattgatgcagaatcaataacctctggggttgaactcctgggacccttggacagaggggatatgctaaatgaagcatttattggcctgtctttagcacctcaaggagaagactcatttccagataacctccctccctcttgcccaacccacagacatattttacaacaaagaatactgaatggctcttctaacagacaaataattgacagaaggaatgaacttgaaaaagacatctgttctggatttttgatgactaatacctgtaatgcagaagacggagaactgagagaagacggcagagaacaggaaatcagagatggtggttctctcaaaatgattcactttggtctggtgtaaacattaagaaaaaaagaaaactgccttcttcatatctaaacttttcatggcctgatacagacttaaaatcccccgtgtggatttttaacaagagacagtatgaatcatataaattagttaagagttttgagttgagtgtttgttttcaaaataaagttttattatttcaaaaacatgcagcataacagcaaagtgatcgtaagtaaaagtcttcaacctacttattttcaataatgtaaaattttgaaagtgtcttaaattgtatgttaattaggtgctacaaaaatagaatatttaaactttgttctcccaggtactttaaaaaaggggcagtagggggcaggcatagtgctcatgcctgtagtcccagtgctttaggaggccaaggctgaaggatcacttgagcccaggagttcaagactagcctgtgcaacatagtgaaacgctgtctctagaaaaaattttaaaaattagccaggcatggtggtacatgcttgtgaagctgaggcagaagaattgcttgagcccaggagttcaaggctacagtgagctgtgatcgcgccactgcactctaacctgggcaacagagagtgaccctgtctccaaaaaaaaaaaaaaaaaaa

SEQ ID NO: 199664 - DNA, 2063 bp, Homo sapiens
  Payload ID: 19396
  Gene Name: WD repeat containing planar cell polarity effector
  Uniprot ID: O95876
  ENST ID: ENST00000398544
  CDS Start-End: 125-1888
aaattttttaaataaatagactggtagagaacactgatcagtatcccctaataaatccactttatcctcggatggtttctatcatgtaaacataggattaaactcttagcacaaataaaatggaatgttttcgtctctacattcagctcttctcacagacagttttatcatcttatcatttttggcacaaaacaaactatgttttattcagtttaccaagaagatggagtcttctgatgtaaacaaaagactggaaaaactctcagccttggattataagattttctattatgaaatacccggcccaataaacaagacaacagagcgacatctagctatcaactgtgttcatgatagagttgtttgctggtggccactggtcaacgatgatgcttggccttgggcccccatttcttctgagaaggacagagccaatctactcctcctgggttatgctcaaggaagactagaggttctgagttctgtccgcacagaatgggacccactggatgttcgctttggcaccaaacagccttatcaggtgttcacagtggagcactccgtaagtgtagacaaagagcccatggctgacagctgcatctatgaatgcattcggaataaaatccagtgtgtgtcagtcaccagaataccactaaagtcaaaggccatcagctgctgcaggaatgttactgaagacaaactgattctgggctgtgaagattcttcgctaattctttatgaaactcaccgtagagtgactctcttagcacagactgaacttttgccttcattaataagctgccacccaagtggtgccattctgctagttggcagcaaccaaggggagttgcaaatttttgatatggctctatcccctattaacatccaactgttggctgaagaccgcttacccagggagactctgcaattcagtaaattatttgatgcctccagcagtcttgttcaaatgcaatggatagctcctcaggttgtttctcagaagggtgaaggtagtgatatctatgatctcctcttcctcaggtttgaaagaggacctttgggtgtgctgttgtttaaactaggcgtcttcactcgaggacagctgggcctgatagacatcatcttccagtacattcactgtgatgagatctatgaggcaataaacatcctgagcagcatgaactgggacactctgggccaccagtgctttatcagcatgagcgccattgtaaaccatcttcttagacagaagctcactccagagagagaagcacagcttgagacaagccttggaaccttctatgctccaacaagaccacttctggattccactatattggaatatagagatcaaatcagcaaatatgcaaggagattcttccatcacttgctcaggtaccagaggtttgaaaaggcatttctcctagctgttgacgttggtgctcgtgacctctttatggatattcattaccttgcactagataaaggtgaattggcactagctgaagtggcaagaaaaagagctagtgacattgatgcagaatcaataacctctggggttgaactcctgggacccttggacagaggggatatgctaaatgaagcatttattggcctgtctttagcacctcaaggagaagactcatttccagataacctccctccctcttgcccaacccacagacatattttacaacaaagaatactgaatggctcttctaacagacaaataattgacagaaggaatgaacttgaaaaagacatctgttctggatttttgatgactaatacctgtaatgcagaagacggagaactgagagaagacggcagagaacaggaaatcagagatggtggttctctcaaaatgattcactttggtctggtgtaaacattaagaaaaaaagaaaactgccttcttcatatctaaacttttcatggcctgatacagacttaaaatcccccgtgtggatttttaacaagagacagtatgaatcatataaattagttaagagttttgagttgagtgtttgttttcaaaataaagttttattatttcaaaaaca

SEQ ID NO: 199665 - DNA, 2466 bp, Homo sapiens
  Payload ID: 19396
  Gene Name: WD repeat containing planar cell polarity effector
  ENST ID: ENST00000409199
  CDS Start-End: 198-1862
atctctgcaagacaaaagtcagaaatggcttccctggggactgagagcccatagttctcttcccactgctgcttctacccttttgttttgcttggctctctaaaattgtctcagctccagctcttctcacagacagttttatcatcttatcatttttggcacaaaacaaactatgttttattcagtttaccaagaagatggagtcttctgatgtaaacaaaagactggaaaaactctcagccttggattataagattttctattatgaaatacccggcccaataaacaagacaacagagcgacatctagctatcaactgtgttcatgatagagttgtttgctggtggccactggtcaacgatgatgcttggccttgggcccccatttcttctgagaaggacagagccaatctactcctcctgggttatgctcaaggaagactagaggttctgagttctgtccgcacagaatgggacccactggatgttcgctttggcaccaaacagccttatcaggtgttcacagtggagcactccgtaagtgtagacaaagagcccatggctgacagctgcatctatgaatgcattcggaataaaatccagtgtgtgtcagtcaccagaataccactaaagtcaaaggccatcagctgctgcaggaatgttactgaagacaaactgattctgggctgtgaagattcttcgctaattctttatgaaactcaccgtagagtgactctcttagcacagactgaacttttgccttcattaataagctgccacccaagtggtgccattctgctagttggcagcaaccaaggggagttgcaaatttttgatatggctctatcccctattaacatccaactgttggctgaagaccgcttacccagggagactctgcaattcagtaaattatttgatgcctccagcagtcttgttcaaatgcaatggatagctcctcaggttgtttctcagaagggtgaaggtagtgatatctatgatctcctcttcctcaggtttgaaagaggacctttgggtgtgctgttgtttaaactaggcgtcttcactcgaggacagctgggcctgatagacatcatcttccagtacattcactgtgatgagatctatgaggcaataaacatcctgagcagcatgaactgggacactctgggccaccagtgctttatcagcatgagcgccattgtaaaccatcttcttagacagaagctcactccagagagagaagcacagcttgagacaagccttggaaccttctatgctccaacaagaccacttctggattccactatattggaatatagagatcaaatcagcaaatatgcaaggagattcttccatcacttgctcaggtaccagaggtttgaaaaggcatttctcctagctgttgacgttggtgctcgtgacctctttatggatattcattaccttgcactagataaaggtgaattggcactagctgaagtggcaagaaaaagagctagtgacattgatgcagaatcaataacctctggggttgaactcctgggacccttggacagaggggatatgctaaatgaagcatttattggcctgtctttagcacctcaaggagaagactcatttccagataacctccctccctcttgcccaacccacagacatattttacaacaaagaatactgaatggctcttctaacagacaaataattgacagaaggaatgaacttgaaaaagacatctgttctggatttttgatgactaatacctgtaatgcagaagacggagaactgagagaagacggcagagaacaggaaatcagagatggtggttctctcaaaatgattcactttggtctggtgtaaacattaagaaaaaaagaaaactgccttcttcatatctaaacttttcatggcctgatacagacttaaaatcccccgtgtggatttttaacaagagacagtatgaatcatataaattagttaagagttttgagttgagtgtttgttttcaaaataaagttttattatttcaaaaacatgcagcataacagcaaagtgatcgtaagtaaaagtcttcaacctacttattttcaataatgtaaaattttgaaagtgtcttaaattgtatgttaattaggtgctacaaaaatagaatatttaaactttgttctcccaggtactttaaaaaaggggcagtagggggcaggcatagtgctcatgcctgtagtcccagtgctttaggaggccaaggctgaaggatcacttgagcccaggagttcaagactagcctgtgcaacatagtgaaacgctgtctctagaaaaaattttaaaaattagccaggcatggtggtacatgcttgtgaagctgaggcagaagaattgcttgagcccaggagttcaaggctacagtgagctgtgatcgcgccactgcactctaacctgggcaacagagagtgaccctgtctcc

SEQ ID NO: 199666 - DNA, 5408 bp, Homo sapiens
  Payload ID: 19396
  Gene Name: WD repeat containing planar cell polarity effector
  ENST ID: ENST00000409120
  CDS Start-End: 3552-5216
ggctccatgaggccagggagggcaagggcattgtctgttttgttcattgctgtattctcagcacttggaacagtgcctggctcatatgatatactaaatatatatattttggggtaaatgagtgaatttatgaaaaagtggctgtacctattctttgagaaggattctgaaggaatgtccaacctcacttggcaggatccatagtctccaaatcactgctcctgcctccatgcatagatcagttatctaaccagtgtatgcatgcttttggctccatgacactcacccctctgaatcttttccggcataagttccctcatttacttactctcacaggctgtactttccttcttcatctcataaaagtgggtttttaaaagaattttataacaaacgctcatacatagaaaaagcagtttttgttaggatatgagatttatttcatgagagcagtggtgagaacagaaaacaaggtaaaagaaattagacacttggaaaaattaaattccagagttctgaaggaacttgcaaatattttggagataatatccttgtgaaatcatagccaatgggagaggcaacaaaagattgcattttttactaattgtaactcacctgagtgtcacacatctaacattgagtccaacctgggttacaaggtttttaaaaagacaaatgtgctcagagttggttaacaacgtagtgaggatatttgttatttgatataggattcaaagggatgaacgtcatggaggcaagagcatgcatacattggttagataactaatctatgcctggaggcaggagcagtgatttggagactatggacagcatcctacaattaatggttgaataataataataattgcaaacactgtgtgccaggcattattctaaatgttttttgtaaaaagttatttaatcctcatcctatgaagtagatactatcatgtttattttcaggtgaggaaatgaagggacagagaggttaaattacactgtcagtgtcacacagctagtaacaagtagccaatattgattttattctgatttcagagtctgtgctcttaaccactgtgttattatccttgaatatttgaggtgggtgctactgaagaataattggggtgactgttgaagttgtagggagtcagttgtatcctcagcctcaatctcaagagtcaccacctccttctcagtcagactctgagtctacccagtatgtacttctataataggtctggtaaactggtaacagcactttattagttatttgctttgatctcgacctctttctattaacctactttatttaacctactttaagaattatatttgatttctttttgagcccttaaatttaatttagtgcttggcatataatgaatattcagtttttggtgaattaaaaaaatgaatgaaggatctttaaattgattacaactgacccatggtagaatagttttcctgtgaagcagtgagctcctgatcactggcaatattcaagcatgggctagatgcttgaagggatgctgcagaaggaacatccatgtcatatgaaaatggaaaattagaccaagtttttttttttttgtaactgcaaattatctggtgttccattgagttagttgtgattctttctccaaacatttgttgagcacctactgtattcctggcactacaaagataaatgtggccaagccaacatccataaggagctggtagtcagtgagtaattaggaaaagaagtgcttaagagtataggtgtaaagctttagtagataaaaataaatagaaaagggtagattttagagatgttttgaataaaggaggaaggggagaagtagatataaaagatgtccctaaaattgcccgtctgagaaggaatttggggagttaagaccacctgctgtgttgctatggggggattcttcaaaagggaaatatcaccatttgccattaaggtatgtggtagggctgggtgtaattcagtagagattaagttgtgaagcattttaaatttcttgaaacaaatgtgccttctcttagtagtctccaaaacccataaagatgattaagtaccctccccccaactctctgcccctgtagaggtattaacgcaaaatggaataatctgttaagtcaaataaaggtaagctttctggtgactaggacaagagttctaacagtaaatgcaaagcaactcttcagtttcttttctgaatcatgtgcctggaatctgttaggcagtgaggaatggtggtctgtctttatattaccctggtccctcatgctgcttatctttcacacatgtccaaatatgtctcaacacagaatcatcctctctagctgggacatgatgcctaggtgggtgggggattcccctgttttgtttaaaatcaaagttgtctttgaatttggctagcatgtttgtgattagtttactgacaattggttttttttcttcttataccatatgttattccatgattcatcagctttgagtctgttgccttgaaggtgaaacaatttcttccaatgttgatatttcataatctcatagataacaagcatacgcatatgcatagtcctttcagaagttttaaacatttggagatgaatgaattatgctgccacaaatggaaaggagcagtataaaattataatggtgatatccaatcatcttttgttgagtggttttgtgaacactgacattgataaagcctggatgctctactatattcctttatttctccttgtgaaattgtttctgatatgtgttgtttatgattttaaaaatttaacattttacttaattgccttgatttacatgtattttaacattttagactgacaagatctttatttttagaagtaaatagtgtttaacttccaaataaatgcataacattagctgtttatattgtaatagtggcatctcttctatatttaatgtgtagcaatgactattcaaacctcaagaaatgttttagtttataatagtaatttttcaaaataatagaatacattacattttctgaatccaaaacaaagcagttatgtctgcatatgtgctttctaagtatttagaagattagatttctaataaacatggcctaaattaggtttctgcatgtagctttaatcaatgcatttattgtgttgcatcctttagccacctttctctttttactcacaatgtcagtaattgtttttcagtgaagaaaatctttataattttgtagtgtagatgcatgtgtaaaatatctgtataagttgtatatttggagagaggttttttaaagattctaaatcacagcatgtcttcctccctctctcccccacttacctggttttagctcctttttggttcaggtgtgctggtgtctctaagcctttctgggccgcagctggagaaagtggtgattgacagaagcctggtggggaagctcatctcagacaccatcagtgatgctcttctcacagacagttttatcatcttatcatttttggcacaaaacaaactatgttttattcagtttaccaagaagatggagtcttctgatgtaaacaaaagactggaaaaactctcagccttggattataagattttctattatgaaatacccggcccaataaacaagacaacagagcgacatctagctatcaactgtgttcatgatagagttgtttgctggtggccactggtcaacgatgatgcttggccttgggcccccatttcttctgagaaggacagagccaatctactcctcctgggttatgctcaaggaagactagaggttctgagttctgtccgcacagaatgggacccactggatgttcgctttggcaccaaacagccttatcaggtgttcacagtggagcactccgtaagtgtagacaaagagcccatggctgacagctgcatctatgaatgcattcggaataaaatccagtgtgtgtcagtcaccagaataccactaaagtcaaaggccatcagctgctgcaggaatgttactgaagacaaactgattctgggctgtgaagattcttcgctaattctttatgaaactcaccgtagagtgactctcttagcacagactgaacttttgccttcattaataagctgccacccaagtggtgccattctgctagttggcagcaaccaaggggagttgcaaatttttgatatggctctatcccctattaacatccaactgttggctgaagaccgcttacccagggagactctgcaattcagtaaattatttgatgcctccagcagtcttgttcaaatgcaatggatagctcctcaggttgtttctcagaagggtgaaggtagtgatatctatgatctcctcttcctcaggtttgaaagaggacctttgggtgtgctgttgtttaaactaggcgtcttcactcgaggacagctgggcctgatagacatcatcttccagtacattcactgtgatgagatctatgaggcaataaacatcctgagcagcatgaactgggacactctgggccaccagtgctttatcagcatgagcgccattgtaaaccatcttcttagacagaagctcactccagagagagaagcacagcttgagacaagccttggaaccttctatgctccaacaagaccacttctggattccactatattggaatatagagatcaaatcagcaaatatgcaaggagattcttccatcacttgctcaggtaccagaggtttgaaaaggcatttctcctagctgttgacgttggtgctcgtgacctctttatggatattcattaccttgcactagataaaggtgaattggcactagctgaagtggcaagaaaaagagctagtgacattgatgcagaatcaataacctctggggttgaactcctgggacccttggacagaggggatatgctaaatgaagcatttattggcctgtctttagcacctcaaggagaagactcatttccagataacctccctccctcttgcccaacccacagacatattttacaacaaagaatactgaatggctcttctaacagacaaataattgacagaaggaatgaacttgaaaaagacatctgttctggatttttgatgactaatacctgtaatgcagaagacggagaactgagagaagacggcagagaacaggaaatcagagatggtggttctctcaaaatgattcactttggtctggtgtaaacattaagaaaaaaagaaaactgccttcttcatatctaaacttttcatggcctgatacagacttaaaatcccccgtgtggatttttaacaagagacagtatgaatcatataaattagttaagagttttgagttgagtgtttgttttcaaaataaagttttattatttcaaaaacatgcagcataacagcaaa

SEQ ID NO: 199667 - DNA, 2122 bp, Homo sapiens
  Payload ID: 19396
  Gene Name: WD repeat containing planar cell polarity effector
  ENST ID: ENST00000409354
  CDS Start-End: 1-1209
tattatgaaatacccggcccaataaacaagacaacagagcgacatctagctatcaactgtgttcatgatagagttgtttgctggtggccactggtcaacgatgatgcttggccttgggcccccatttcttctgagaaggacagagccaatctactcctcctgggttatgctcaaggaagactagaggttctgagttctgtccgcacagaatgggacccactggatgttcgctttggcaccaaacagccttatcaggtgttcacagtggagcactccgtaagtgtagacaaagagcccatggctgacagctgcatctatgaatgcattcggaataaaatccagtgtgtgtcagtcaccagaataccactaaagtcaaaggccatcagctgctgcaggaatgttactgaagacaaactgattctgggctgtgaagattcttcgctaattctttatgaaactcaccgtagagtgactctcttagcacagactgaacttttgccttcattaataagctgccacccaagtggtgccattctgctagttggcagcaaccaaggggagttgcaaatttttgatatggctctatcccctattaacatccaactgttggctgaagaccgcttacccagggagactctgcaattcagtaaattatttgatgcctccagcagtcttgttcaaatgcaatggatagctcctcaggttgtttctcagaagggtgaaggtagtgatatctatgatctcctcttcctcaggtttgaaagaggacctttgggtgtgctgttgtttaaactaggcgtcttcactcgaggacagctgggcctgatagacatcatcttccagtacattcactgtgatgagatctatgaggcaataaacatcctgagcagcatgaactgggacactctgggccaccagtgctttatcagcatgagcgccattgtaaaccatcttcttagacagaagctcactccagagagagaagcacagcttgagacaagccttggaaccttctatgctccaacaagaccacttctggattccactatattggaatatagagatcaaatcagcaaatatgcaaggagattcttccatcacttgctcaggtaccagaggtttgaaaaggcatttctcctagctgttgacgttggtgctcgtgacctctttatgaactcctgggacccttggacagaggggatatgctaaatgaagcatttattggcctgtctttagcacctcaaggagaagactcatttccagataacctccctccctcttgcccaacccacagacatattttacaacaaagaatactgaatggctcttctaacagacaaataattgacagaaggaatgaacttgaaaaagacatctgttctggatttttgatgactaatacctgtaatgcagaagacggagaactgagagaagacggcagagaacaggaaatcagagatggtggttctctcaaaatgattcactttggtctggtgtaaacattaagaaaaaaagaaaactgccttcttcatatctaaacttttcatggcctgatacagacttaaaatcccccgtgtggatttttaacaagagacagtatgaatcatataaattagttaagagttttgagttgagtgtttgttttcaaaataaagttttattatttcaaaaacatgcagcataacagcaaagtgatcgtaagtaaaagtcttcaacctacttattttcaataatgtaaaattttgaaagtgtcttaaattgtatgttaattaggtgctacaaaaatagaatatttaaactttgttctcccaggtactttaaaaaaggggcagtagggggcaggcatagtgctcatgcctgtagtcccagtgctttaggaggccaaggctgaaggatcacttgagcccaggagttcaagactagcctgtgcaacatagtgaaacgctgtctctagaaaaaattttaaaaattagccaggcatggtggtacatgcttgtgaagctgaggcagaagaattgcttgagcccaggagttcaaggctacagtgagctgtgatcgcgccactgcactctaacctgggcaacagagagtgaccctgtctccaaaaaaaaaaaaaaaaaaa

SEQ ID NO: 199668 - DNA, 3544 bp, Homo sapiens
  Payload ID: 19396
  Gene Name: WD repeat containing planar cell polarity effector
  Uniprot ID: O95876
  ENST ID: ENST00000409562
  CDS Start-End: 248-2104
cttttaaaaaacgattgacactctggaggggcgggggaattgataagttgggacgaccggacagcttctcaggttgctaagcgacgaggcgggagcgcacgcacaccctggctgctttgtagcacctgaggaaactgtggcggcggcggcggcgtcctggagacccaagagaccaagcgagcgtgtcgctccctctcgggtccgaggacctagcctaggaaccttctgcccggggtagtgtctggtgatgaggcgagagttttgctgggacgcctactccaaagcggccgggagtcgcgcttcttccccactcccgagacaggatagagattccttctgccatcagatgtctttctgcttgactgaactgcacctgtggtctttgaagaataccttacacattgcggatagagacattgggatctaccagtattatgacaagaaagatccaccagcgacagagcatggtaacttagaaaagaagcagaagctggcagagtcacgagattatccttggacgctcaaaaacagacgcccagaaaaactccgagactcgctcaaagagttggaggagctgatgcaaaacagtcggtgtgtgctgagcaaatggaagaacaaatatgtctgtcagctcctttttggttcaggtgtgctggtgtctctaagcctttctgggccgcagctggagaaagtggtgattgacagaagcctggtggggaagctcatctcagacaccatcagtgatgctcttctcacagacagttttatcatcttatcatttttggcacaaaacaaactatgttttattcagtttaccaagaagatggagtcttctgatgtaaacaaaagactggaaaaactctcagccttggattataagattttctattatgaaatacccggcccaataaacaagacaacagagcgacatctagctatcaactgtgttcatgatagagttgtttgctggtggccactggtcaacgatgatgcttggccttgggcccccatttcttctgagaaggacagagccaatctactcctcctgggttatgctcaaggaagactagaggttctgagttctgtccgcacagaatgggacccactggatgttcgctttggcaccaaacagccttatcaggtgttcacagtggagcactccgtaagtgtagacaaagagcccatggctgacagctgcatctatgaatgcattcggaataaaatccagtgtgtgtcagtcaccagaataccactaaagtcaaaggccatcagctgctgcaggaatgttactgaagacaaactgattctgggctgtgaagattcttcgctaattctttatgaaactcaccgtagagtgactctcttagcacagactgaacttttgccttcattaataagctgccacccaagtggtgccattctgctagttggcagcaaccaaggggagttgcaaatttttgatatggctctatcccctattaacatccaactgttggctgaagaccgcttacccagggagactctgcaattcagtaaattatttgatgcctccagcagtcttgttcaaatgcaatggatagctcctcaggttgtttctcagaagggtgaaggtagtgatatctatgatctcctcttcctcaggtttgaaagaggacctttgggtgtgctgttgtttaaactaggcgtcttcactcgaggacagctgggcctgatagacatcatcttccagtacattcactgtgatgagatctatgaggcaataaacatcctgagcagcatgaactgggacactctgggccaccagtgctttatcagcatgagcgccattgtaaaccatcttcttagacagaagctcactccagagagagaagcacagcttgagacaagccttggaaccttctatgctccaacaagaccacttctggattccactatattggaatatagagatcaaatcagcaaatatgcaaggagattcttccatcacttgctcaggtaccagaggtttgaaaaggcatttctcctagctgttgacgttggtgctcgtgacctctttatggcatcatgctacctgacttcaaactacactacaaggctacagtaaccaaaacagcatggtactggtcccaaaacagagatatagaccaatggaacagaacagagccctcagaaataatgccgcatatctacaactatctgatctttgacaaacctgacaaaaacaagaaatggggaaaggattccctatttaataaatggtgctgggaaaactggctagccatatgtagaaagctgaaactggatcccttccttacaccttatacaaaaattaattcaagatggattaaagacttaaatgttagacctaaaaccataaaagccctagaagaaaacctaggcaataccattcaggacacaggcatgggcaaggacttcatgtctaaaacaccaaaagcaatggcaacaaaagccaaaattgacaaatgggatctaattaaactaaagagcttctgcacagcaaaagaaactaccatcagagtggacaggcaacctacagaatgggagaaaatttttgcaacctactcatctgacaaagggctaatatccagaatctacaaagaactcaaataaatttacaagaaaaaaacaaacaaccccatccaaaagtgggcaaaggatatgaacagacacttctcaaaagaagacatttatgcagccaaaaaacacatgaaaaaatgctcatcatcactggccatcagagaaatgcaaatcaaaaccacaatgagataccgtctcacaccagttagaatggtgatcattaaaaagtcagcaaacaacatgtgctggagaggatgtggagaaataggaacacttttacactgttggtgggactgtaaactagttcaaccattgtggaagtcagtgtggcgattcctcagggatctggaactagaaataccatttgacccagccatcccattactgggtatatacccaaaggattataaatcatgctgctataaagacacatgcacacgtatgtttattgcagcactattcacaatagctaagacttggaaccaacctaagtgtccaacaatgatagactgggttaagaaaatgtggcacatatacaccatggaatactatgcagccataaaaaaggatgagttcatgtcctttgtagggacatggatgaagctggaaaccatcattctcagcaaactaccgcaaggacaaaaaaccaaacaccatatgttctcactcataggtgggaatggaacaatgagaacacatggacacaagaaggggaacatcacacaccggggactgttgtgtggtgggggtaggggggagggatagcattaggagatatacctaatgctaaatgacgagttaatgggtgcagcacaccaccatggcacatgtatacatatgtaacaaacctgcacgttgtgcacatgtaccctaaaacttaaagtaaaataaaatttgaaaaaagaatatagaatcaatcaaaaaattcaaaaaaaaaaaaaaaaaa

SEQ ID NO: 199669 - DNA, 782 bp, Homo sapiens
  Payload ID: 19396
  Gene Name: WD repeat containing planar cell polarity effector
  ENST ID: ENST00000431065
  CDS Start-End: 529-782
actgcgctctgcgccgattgcaaagtagtccctgaggatgagcccctgtgattggaggacgacaacaaacggatggtttgggctcaggaggaaaggacctgcctgatggagcccggcaattggcgggagagatagcgtgtgtaactctagggaggggagaatcaccccttagcgacatcacccccacgcgcgtgactgagactgcatcctcccatgagggtaaacgtgggaggtaaagagaccttccgctgcgtaaagctggatcgacccggaaacaaaatcttttaaaaaacgattgacactctggaggggcgggggaattgataagttgggacgaccggacagcttctcaggttgctaagcgacgaggcgggagcgcacgcacaccctggctgctttgtagcacctgaggaaactgtggcggcggcggcggcgtcctggagacccaagagaccaagcgagcgtgtcgctccctctcgggtccgaggacctagcctaggaaccttctgcccggggtagtgtctggtgatgaggcgagagttttgctgggacgcctactccaaagcggccgggagtcgcgcttcttccccactcccgagacaggatagagattccttctgccatcagatgtctttctgcttgactgaactgcacctgtggtctttgaagaataccttacacattgcggatagagacattgggatctaccagtattatgacaagaaagatccaccagcacgagattatccttggacgctcaaaaacagacgcccagaaaaact

SEQ ID NO: 199670 - DNA, 576 bp, Homo sapiens
  Payload ID: 19396
  Gene Name: WD repeat containing planar cell polarity effector
  ENST ID: ENST00000418148
  CDS Start-End: 1-397
gcgagagttttgctgggacgcctactccaaagcggccgggagtcgcgcttcttccccactcccgagacaggatagagattccttctgccatcagatgtctttctgcttgactgaactgcacctgtggtctttgaagaataccttacacattgcggatagagacattgggatctaccagtattatgacaagaaagatccaccagcgacagagcatggtaacttagaaaagaagcagaagctggcagagtcacgagattatccttggacgctcaaaaacagacgcccagaaaaactccgagactcgctcaaagagttggaggagctgatgcaaaacagtcggtgtgtgctgagcaaatggaagaacaaatatgtctgtcaggtgtgctggtgtctctaagcctttctgggccgcagctggagaaagtggtgattgacagaagcctggtggggaagctcatctcagacaccatcagtgatgctcttctcacagacagttttatcatcttatcatttttggcacaaaacaaactatgttttattcagtttaccaagaagatggagtcttctgatgtaaac

SEQ ID NO: 199671 - DNA, 2883 bp, Homo sapiens
  Payload ID: 19396
  Gene Name: WD repeat containing planar cell polarity effector
  ENST ID: ENST00000417238
  CDS Start-End: 248-388
cttttaaaaaacgattgacactctggaggggcgggggaattgataagttgggacgaccggacagcttctcaggttgctaagcgacgaggcgggagcgcacgcacaccctggctgctttgtagcacctgaggaaactgtggcggcggcggcggcgtcctggagacccaagagaccaagcgagcgtgtcgctccctctcgggtccgaggacctagcctaggaaccttctgcccggggtagtgtctggtgatgaggcgagagttttgctgggacgcctactccaaagcggccgggagtcgcgcttcttccccactcccgagacagaaaaccatgataaattctggacaaaatacagaaaacccacaactctctgaaggcactggagagtgaccatagcaggcataaactgaaaggaagtctatacttggaaagagggagtatcaccgaataaacaaaaatgaggttttgttgccagcagaccttcactgcaagaaatgctaaaggaaattcttcaggctgaaaggaaatgataccagatggaaacttggatctgaggaatggagaactccagaaatggatagagattccttctgccatcagatgtctttctgcttgactgaactgcacctgtggtctttgaagaataccttacacattgcggatagagacattgggatctaccagtattatgacaagaaagatccaccagcgacagagcatggtaacttagaaaagaagcagaagctggcagagtcacgagattatccttggacgctcaaaaacagacgcccagaaaaactccgagactcgctcaaagagttggaggagctgatgcaaaacagtcggtgtgtgctgagcaaatggaagaacaaatatgtctgtcagctcctttttggttcaggtgtgctggtgtctctaagcctttctgggccgcagctggagaaagtggtgattgacagaagcctggtggggaagctcatctcagacaccatcagtgatgctcttctcacagacagttttatcatcttatcatttttggcacaaaacaaactatgttttattcagtttaccaagaagatggagtcttctgatgtaaacaaaagactggaaaaactctcagccttggattataagattttctattatgaaatacccggcccaataaacaagacaacagagcgacatctagctatcaactgtgttcatgatagagttgtttgctggtggccactggtcaacgatgatgcttggccttgggcccccatttcttctgagaaggacagagccaatctactcctcctgggttatgctcaaggaagactagaggttctgagttctgtccgcacagaatgggacccactggatgttcgctttggcaccaaacagccttatcaggtgttcacagtggagcactccgtaagtgtagacaaagagcccatggctgacagctgcatctatgaatgcattcggaataaaatccagtgtgtgtcagtcaccagaataccactaaagtcaaaggccatcagctgctgcaggaatgttactgaagacaaactgattctgggctgtgaagattcttcgctaattctttatgaaactcaccgtagagtgactctcttagcacagactgaacttttgccttcattaataagctgccacccaagtggtgccattctgctagttggcagcaaccaaggggagttgcaaatttttgatatggctctatcccctattaacatccaactgttggctgaagaccgcttacccagggagactctgcaattcagtaaattatttgatgcctccagcagtcttgttcaaatgcaatggatagctcctcaggttgtttctcagaagggtgaaggtagtgatatctatgatctcctcttcctcaggtttgaaagaggacctttgggtgtgctgttgtttaaactaggcgtcttcactcgaggacagctgggcctgatagacatcatcttccagtacattcactgtgatgagatctatgaggcaataaacatcctgagcagcatgaactgggacactctgggccaccagtgctttatcagcatgagcgccattgtaaaccatcttcttagacagaagctcactccagagagagaagcacagcttgagacaagccttggaaccttctatgctccaacaagaccacttctggattccactatattggaatatagagatcaaatcagcaaatatgcaaggagattcttccatcacttgctcagtgagtgaggacctgggtagaggaccacttttataagagagtgaactgcatctgcagacccaccatactcctgatcaagacagttgttgacctcaaactccagactgtcccctgctgatgacctcatcatgcttcttgtcagcaagcttggctctctttagtttggcaaggattaaaagacatacagtgcctatattcactgtattaagtaactggcctttaaggacatttgattatagtaccagcagaaattagtatgtactggagatggctatagacacttctgttacaaagctacagttgtattaaagctgtgggatgaggacagcctttaccaacatggtcaaaatcaaagatttttttttttctactatgtagtgaagggcatacatagtatgtgcaaactgcagctattaagagagatatgatgatttttggctgtttacattcatgaatactttataaaatccaggaaaaattttgttagatattctactctattgaagtctgaaaagaaacatgcagagaaaatataatcaagaatttatttggcagatttataacatctgcagagctcagagctcaaggaaagaccataacacataaaatatgaacatcaataaatgttcagaatgtg

SEQ ID NO: 199672 - DNA, 534 bp, Homo sapiens
  Payload ID: 19396
  Gene Name: WD repeat containing planar cell polarity effector
  ENST ID: ENST00000473678
  CDS Start-End: 510-534
agtaaatgcaaagcaactcttcagtttcttttctgaatcatgtgcctggaatctgttaggcagtgaggaatggtggtctgtctttatattaccctggtccctcatgctgcttatctttcacacatgtccaaatatgtctcaacacagaatcatcctctctagctgggacatgatgcctaggtgggtgggggattcccctgttttgtttaaaatcaaagttgtctttgaatttggctagcatgtttgtgattagtttactgacaattggttttttttcttcttataccatatgttattccatgattcatcagctttgagtctgttgccttgaaggtgtgctggtgtctctaagcctttctgggccgcagctggagaaagtggtgattgacagaagcctggtggggaagctcatctcagacaccatcagtgatgctcttctcacagacagttttatcatcttatcatttttggcacaaaacaaactatgttttattcagtttaccaagaagatggagtcttctgatgtaaacaaaa

SEQ ID NO: 199673 - DNA, 4011 bp, Homo sapiens
  Payload ID: 19397
  Gene Name: WD repeat containing, antisense to TP53
  Uniprot ID: Q9BUR4
  ENST ID: ENST00000316024
  CDS Start-End: 2349-3995
ttctttttttttttcctccgggaagatgagatatactcattcttgaaaatacctccgggcttgccttctgcacacttctttccctccctgtctcacgccatggtagcgtccgcctaggttgcaggcgacccgcggggtggggcacaccattcaaagaaggggagggattgaggtttgcatcaaaacaaatacccctgcctttgcaaaggccataactaagtaatccagaaaaagaaatgcaggcggagaatagcagcctccctctgccaagtaagaggaaccggcctaaaggacattttctctctctctcctcccctctcatcgggtgaatagtgagctgctccggcaaaaagaaaccggaaatgctgctgcaagaggcagaaatgtaaatgtggagccaaacaataacagggctgccgggcctctcagattgcgacggtcctcctcggcctggcgggcaaacccctggtttagcacttctcacttccacgactgacagccttcaattggattttctccatctagcggagccgggggctgcctggaaagatcgctccaggaaggacaaaggtccggaagttgtgggaccttagcagcttgggctccccggatcacccccaaatgatcatttcggaatggagccccagttttcactaggatgccatgggctctaaaatatacagctatgagttctcaatgtttcgagatccaaaagtctcagacctcaatgctttgtgcatcttttatttcagggattccctacgcccagcaccgggtggatgtgcaaagaagtacgctttaggccggctcaaggttccccaaagctccactcctctgcctaggcgttcaactttgagttcggatggtcctaacatccccatcatctacacccaggtctcccaacaatgcaactcctatgatgatccctctagccaagcttccatcccactcacccccaaactcgctaagtccccactgccccacccccagccccagcgattttcccgagctgaaaatacacggagccgagagcccgtgactcagagaggactcatcaagttcagtcaggagcttacccaatccagggaagcgtgtcaccgtcgtggaaagcacgctcccagcccgaacgcaaagtgtccccggagcccagcagctacctgctccctggacggtggctctagacttttgagaagctcaaaacttttagcgccagtcttgagcacatgggaggggaaaaccccaatcccatcaacccctgcgaggctcctggcacaaagctggacagtcgccatgacaagtaagggcaagtaatccgcctgccggaggaagcaaaggaaatggagttggggaggagggtgcagagtcaggattctcgccgacctggtgccgtagatactaacattttggggtggaaaattctgcaagccagagctgtgagggcagaattggtggaaatcattttggaggaatcctgcattgtgtcaaatatgaagggtggaaggaagaaagcttttgcgtttgctctcagctggatcctttcttctcatcagttaaaatgtcattttttaggaaggctttccgtaatatcacaccctaacgttttctcccagatactttatatcacaccatcttatttaatctccttcacaacccttatcactctgataagatttatttgttcattgctttcagtacatggaaacgtaagccttatgaggatatagaatttttctactatcttattcattgttgtattcctgagtgcctatatcagtgctgggtagcaagtaagagctcgataataaatattttttgaatgagggagacaggtctgaagcctggagaatgagatgcagaagaggtgcaagacctgctgcgccctctgcaggcggcgggggggcggtgcaggtgctttaagaattaccgcgggactcggtagggggagcgtaggcgcttctcgccaagatagaagcgttcagactacaactcccagcagccacgaggagccctagggcttgatgggaacgggaaaccttctaacctttcacgtcccggctccgcgggttccgtgggtcgcccgcgaaatctgatccgggatgcggcggcccaatcggaaggtggaccgaaatcccgcgacagcaagaggcccgtagcgacccgcggtgctaaggaacacagtgctttcaaaagaattggcgtccgctgttcgcctctcctcccgggagtcttctgcctactcccagaagaggagggaagcacaggtgggtttctttagctctgcgtcggatccctgagaacttcgaagccatcctggctgaggctaatctccgctgtgcttcctctgcagtatgaagactttggagactcaaccgttagctccggactgctgtccttcagaccaggacccagctccagcccatccttctccccacgcttccccgatgaataaaaatgcggactctgaactgatgccaccgcctcccgaaaggggggatccgccccggttgtccccagatcctgtggctggctcagctgtgtcccaggagctacgggagggggacccagtttctctctccactcccctggaaacagagtttggttcccctagtgagttgagtcctcgaatcgaggagcaagaactttctgaaaatacaagccttcctgcagaagaagcaaacgggagcctttctgaagaagaagcgaacgggccagagttggggtctggaaaagccatggaagatacctctggggaacccgctgcagaggacgagggagacaccgcttggaactacagcttctcccagctgcctcgatttctcagtggttcctggtcagagttcagcacccaacctgagaacttcttgaaaggctgtaagtgggctcctgacggttcctgcatcttgaccaatagtgctgataacatcttgcgaatttataacctgcccccagagctgtaccatgagggggagcaggtggaatatgcagaaatggtccctgtccttcgaatggtggaaggtgataccatctatgattactgctggtattctctgatgtcctcagcccagccagacacctcctacgtggccagcagcagccgggagaacccgattcatatctgggacgcattcactggagagctccgggcttcctttcgcgcctacaaccacctggatgagctgacggcagcccattcgctctgcttctccccggatggctcccagctcttctgtggcttcaaccggactgtgcgtgttttttccacggcccggcctggccgagactgcgaggtccgagccacatttgcaaaaaagcagggccagagcggcatcatctcctgcatagccttcagcccagcccagcccctctatgcctgtggctcctacggccgctccctgggtctgtatgcctgggatgatggctcccctctcgccttgctgggagggcaccaagggggcatcacccacctctgctttcatcccgatggcaaccgcttcttctcaggagcccgcaaggatgctgagctcctgtgctgggatctccggcagtctggttacccactgtggtccctgggtcgagaggtgaccaccaatcagcgcatctacttcgatctggacccgaccgggcagttcctagtgagtggcagcacgagcggggctgtctctgtgtgggacacggacgggcctggcaatgatgggaagccggagcccgtgttgagttttctgccccagaaggactgcaccaatggcgtgagcctgcaccctagcctgcctctcctggccactgcctccggtcagcgtgtgtttcctgagcccacagagagtggggacgaaggagaggagctgggccttcccttgctctccacgcgccacgtccaccttgaatgtcggcttcagctctggtggtgtgggggggcgccagactccagcatccctgatgatcaccagggcgagaaagggcagggaggaacggagggaggtgtgggtgagctgatataaaaaggtttttatgata

SEQ ID NO: 199674 - DNA, 1905 bp, Homo sapiens
  Payload ID: 19397
  Gene Name: WD repeat containing, antisense to TP53
  Uniprot ID: Q9BUR4
  ENST ID: ENST00000396463
  CDS Start-End: 243-1889
gggaacgggaaaccttctaacctttcacgtcccggctccgcgggttccgtgggtcgcccgcgaaatctgatccgggatgcggcggcccaatcggaaggtggaccgaaatcccgcgacagcaagaggcccgtagcgacccgcggtgctaaggaacacagtgctttcaaaagaattggcgtccgctgttcgcctctcctcccgggagtcttctgcctactcccagaagaggagggaagcacagtatgaagactttggagactcaaccgttagctccggactgctgtccttcagaccaggacccagctccagcccatccttctccccacgcttccccgatgaataaaaatgcggactctgaactgatgccaccgcctcccgaaaggggggatccgccccggttgtccccagatcctgtggctggctcagctgtgtcccaggagctacgggagggggacccagtttctctctccactcccctggaaacagagtttggttcccctagtgagttgagtcctcgaatcgaggagcaagaactttctgaaaatacaagccttcctgcagaagaagcaaacgggagcctttctgaagaagaagcgaacgggccagagttggggtctggaaaagccatggaagatacctctggggaacccgctgcagaggacgagggagacaccgcttggaactacagcttctcccagctgcctcgatttctcagtggttcctggtcagagttcagcacccaacctgagaacttcttgaaaggctgtaagtgggctcctgacggttcctgcatcttgaccaatagtgctgataacatcttgcgaatttataacctgcccccagagctgtaccatgagggggagcaggtggaatatgcagaaatggtccctgtccttcgaatggtggaaggtgataccatctatgattactgctggtattctctgatgtcctcagcccagccagacacctcctacgtggccagcagcagccgggagaacccgattcatatctgggacgcattcactggagagctccgggcttcctttcgcgcctacaaccacctggatgagctgacggcagcccattcgctctgcttctccccggatggctcccagctcttctgtggcttcaaccggactgtgcgtgttttttccacggcccggcctggccgagactgcgaggtccgagccacatttgcaaaaaagcagggccagagcggcatcatctcctgcatagccttcagcccagcccagcccctctatgcctgtggctcctacggccgctccctgggtctgtatgcctgggatgatggctcccctctcgccttgctgggagggcaccaagggggcatcacccacctctgctttcatcccgatggcaaccgcttcttctcaggagcccgcaaggatgctgagctcctgtgctgggatctccggcagtctggttacccactgtggtccctgggtcgagaggtgaccaccaatcagcgcatctacttcgatctggacccgaccgggcagttcctagtgagtggcagcacgagcggggctgtctctgtgtgggacacggacgggcctggcaatgatgggaagccggagcccgtgttgagttttctgccccagaaggactgcaccaatggcgtgagcctgcaccctagcctgcctctcctggccactgcctccggtcagcgtgtgtttcctgagcccacagagagtggggacgaaggagaggagctgggccttcccttgctctccacgcgccacgtccaccttgaatgtcggcttcagctctggtggtgtgggggggcgccagactccagcatccctgatgatcaccagggcgagaaagggcagggaggaacggagggaggtgtgggtgagctgatataaaaaggtttttatgata

SEQ ID NO: 199675 - DNA, 1818 bp, Homo sapiens
  Payload ID: 19397
  Gene Name: WD repeat containing, antisense to TP53
  Uniprot ID: Q9BUR4
  ENST ID: ENST00000431639
  CDS Start-End: 156-1802
tgaattcgagttccgcctcctaccaggaagaaccggctcgggccggagggctgcacggaggaccacacggacgcctgcgggcccgccccttccgcttcacgacgttcagcctgcgtctggaactggaatggcctagcccaaagctagataacagtatgaagactttggagactcaaccgttagctccggactgctgtccttcagaccaggacccagctccagcccatccttctccccacgcttccccgatgaataaaaatgcggactctgaactgatgccaccgcctcccgaaaggggggatccgccccggttgtccccagatcctgtggctggctcagctgtgtcccaggagctacgggagggggacccagtttctctctccactcccctggaaacagagtttggttcccctagtgagttgagtcctcgaatcgaggagcaagaactttctgaaaatacaagccttcctgcagaagaagcaaacgggagcctttctgaagaagaagcgaacgggccagagttggggtctggaaaagccatggaagatacctctggggaacccgctgcagaggacgagggagacaccgcttggaactacagcttctcccagctgcctcgatttctcagtggttcctggtcagagttcagcacccaacctgagaacttcttgaaaggctgtaagtgggctcctgacggttcctgcatcttgaccaatagtgctgataacatcttgcgaatttataacctgcccccagagctgtaccatgagggggagcaggtggaatatgcagaaatggtccctgtccttcgaatggtggaaggtgataccatctatgattactgctggtattctctgatgtcctcagcccagccagacacctcctacgtggccagcagcagccgggagaacccgattcatatctgggacgcattcactggagagctccgggcttcctttcgcgcctacaaccacctggatgagctgacggcagcccattcgctctgcttctccccggatggctcccagctcttctgtggcttcaaccggactgtgcgtgttttttccacggcccggcctggccgagactgcgaggtccgagccacatttgcaaaaaagcagggccagagcggcatcatctcctgcatagccttcagcccagcccagcccctctatgcctgtggctcctacggccgctccctgggtctgtatgcctgggatgatggctcccctctcgccttgctgggagggcaccaagggggcatcacccacctctgctttcatcccgatggcaaccgcttcttctcaggagcccgcaaggatgctgagctcctgtgctgggatctccggcagtctggttacccactgtggtccctgggtcgagaggtgaccaccaatcagcgcatctacttcgatctggacccgaccgggcagttcctagtgagtggcagcacgagcggggctgtctctgtgtgggacacggacgggcctggcaatgatgggaagccggagcccgtgttgagttttctgccccagaaggactgcaccaatggcgtgagcctgcaccctagcctgcctctcctggccactgcctccggtcagcgtgtgtttcctgagcccacagagagtggggacgaaggagaggagctgggccttcccttgctctccacgcgccacgtccaccttgaatgtcggcttcagctctggtggtgtgggggggcgccagactccagcatccctgatgatcaccagggcgagaaagggcagggaggaacggagggaggtgtgggtgagctgatataaaaaggtttttatgata

SEQ ID NO: 199676 - DNA, 1828 bp, Homo sapiens
  Payload ID: 19397
  Gene Name: WD repeat containing, antisense to TP53
  Uniprot ID: Q9BUR4
  ENST ID: ENST00000457584
  CDS Start-End: 166-1812
ccggagcccagcagctacctgctccctggacggtggctctagacttttgagaagctcaaaacttttagcgccagtcttgagcacatgggaggggaaaaccccaatcccatcaacccctgcgaggctcctggcacaaagctggacagtcgccatgacaagtaaggtatgaagactttggagactcaaccgttagctccggactgctgtccttcagaccaggacccagctccagcccatccttctccccacgcttccccgatgaataaaaatgcggactctgaactgatgccaccgcctcccgaaaggggggatccgccccggttgtccccagatcctgtggctggctcagctgtgtcccaggagctacgggagggggacccagtttctctctccactcccctggaaacagagtttggttcccctagtgagttgagtcctcgaatcgaggagcaagaactttctgaaaatacaagccttcctgcagaagaagcaaacgggagcctttctgaagaagaagcgaacgggccagagttggggtctggaaaagccatggaagatacctctggggaacccgctgcagaggacgagggagacaccgcttggaactacagcttctcccagctgcctcgatttctcagtggttcctggtcagagttcagcacccaacctgagaacttcttgaaaggctgtaagtgggctcctgacggttcctgcatcttgaccaatagtgctgataacatcttgcgaatttataacctgcccccagagctgtaccatgagggggagcaggtggaatatgcagaaatggtccctgtccttcgaatggtggaaggtgataccatctatgattactgctggtattctctgatgtcctcagcccagccagacacctcctacgtggccagcagcagccgggagaacccgattcatatctgggacgcattcactggagagctccgggcttcctttcgcgcctacaaccacctggatgagctgacggcagcccattcgctctgcttctccccggatggctcccagctcttctgtggcttcaaccggactgtgcgtgttttttccacggcccggcctggccgagactgcgaggtccgagccacatttgcaaaaaagcagggccagagcggcatcatctcctgcatagccttcagcccagcccagcccctctatgcctgtggctcctacggccgctccctgggtctgtatgcctgggatgatggctcccctctcgccttgctgggagggcaccaagggggcatcacccacctctgctttcatcccgatggcaaccgcttcttctcaggagcccgcaaggatgctgagctcctgtgctgggatctccggcagtctggttacccactgtggtccctgggtcgagaggtgaccaccaatcagcgcatctacttcgatctggacccgaccgggcagttcctagtgagtggcagcacgagcggggctgtctctgtgtgggacacggacgggcctggcaatgatgggaagccggagcccgtgttgagttttctgccccagaaggactgcaccaatggcgtgagcctgcaccctagcctgcctctcctggccactgcctccggtcagcgtgtgtttcctgagcccacagagagtggggacgaaggagaggagctgggccttcccttgctctccacgcgccacgtccaccttgaatgtcggcttcagctctggtggtgtgggggggcgccagactccagcatccctgatgatcaccagggcgagaaagggcagggaggaacggagggaggtgtgggtgagctgatataaaaaggtttttatgata

SEQ ID NO: 199677 - DNA, 2657 bp, Homo sapiens
  Payload ID: 19397
  Gene Name: WD repeat containing, antisense to TP53
  ENST ID: ENST00000498311
  CDS Start-End: 964-1827
aagggcaagtaatccgcctgccggaggaagcaaaggaaatggagttggggaggagggtgcagagtcaggattctcgccgacctggtgccgtagatactaacattttggggtggaaaattctgcaagccagagctgtgagggcagaattggtggaaatcattttggaggaatcctgcattgtgtcaaatatgaagggtggaaggaagaaagcttttgcgtttgctctcagctggatcctttcttctcatcagttaaaatgtcattttttaggaaggctttccgtaatatcacaccctaacgttttctcccagatactttatatcacaccatcttatttaatctccttcacaacccttatcactctgataagatttatttgttcattgctttcagtacatggaaacgtaagccttatgaggatatagaatttttctactatcttattcattgttgtattcctgagtgcctatatcagtgctgggtagcaagtaagagctcgataataaatattttttgaatgagggagacaggtctgaagcctggagaatgagatgcagaagaggtgcaagacctgctgcgccctctgcaggcggcgggggggcggtgcaggtgctttaagaattaccgcgggactcggtagggggagcgtaggcgcttctcgccaagatagaagcgttcagactacaactcccagcagccacgaggagccctagggcttgatgggaacgggaaaccttctaacctttcacgtcccggctccgcgggttccgtgggtcgcccgcgaaatctgatccgggatgcggcggcccaatcggaaggtggaccgaaatcccgcgacagcaagaggcccgtagcgacccgcggtgctaaggaacacagtgctttcaaaagaattggcgtccgctgttcgcctctcctcccgggagtcttctgcctactcccagaagaggagggaagcacagtatgaagactttggagactcaaccgttagctccggactgctgtccttcagaccaggacccagctccagcccatccttctccccacgcttccccgatgaataaaaatgcggactctgaactgatgccaccgcctcccgaaaggggggatccgccccggttgtccccagatcctgtggctggctcagctgtgtcccaggagctacgggagggggacccagtttctctctccactcccctggaaacagagtttggttcccctagtgagttgagtcctcgaatcgaggagcaagaactttctgaaaatacaagccttcctgcagaagaagcaaacgggagcctttctgaagaagaagcgaacgggccagagttggggtctggaaaagccatggaagatacctctggggaacccgctgcagaggacgagggagacaccgcttggaactacagcttctcccagctgcctcgatttctcagtggttcctggtcagagttcagcacccaacctgagaacttcttgaaaggctgtaagtgggctcctgacggttcctgcatcttgaccaatagtgctgataacatcttgcgaatttataacctgcccccagagctgtaccatgagggggagcaggtggaatatgcagaaatggtccctgtccttcgaatggtggaaggtgataccatctatgattactgctggtattctctgatgtcctcagcccagccagacacctcctacaccggggtttcagtgtccatgtctctctcagcgtggccagcagcagccgggagaacccgattcatatctgggacgcattcactggagagctccgggcttcctttcgcgcctacaaccacctggatgagctgacggcagcccattcgctctgcttctccccggatggctcccagctcttctgtggcttcaaccggactgtgcgtgttttttccacggcccggcctggccgagactgcgaggtccgagccacatttgcaaaaaagcagggccagagcggcatcatctcctgcatagccttcagcccagcccagcccctctatgcctgtggctcctacggccgctccctgggtctgtatgcctgggatgatggctcccctctcgccttgctgggagggcaccaagggggcatcacccacctctgctttcatcccgatggcaaccgcttcttctcaggagcccgcaaggatgctgagctcctgtgctgggatctccggcagtctggttacccactgtggtccctgggtcgagaggtgaccaccaatcagcgcatctacttcgatctggacccgaccgggcagttcctagtgagtggcagcacgagcggggctgtctctgtgtgggacacggacgggcctggcaatgatgggaagccggagcccgtgttgagttttctgccccagaaggactgcaccaatggcgtgagcctgcaccctagcctgcctctcctggccactgcctccggtcagcgtgtgtttcctgagcccacagagagtggggacgaaggagaggagctgggccttcccttgctctccacgcgccacgtccaccttgaatgtcggcttcagctctggtggtgtgggggggcgccagactccagcatccctgatgatcaccagggcgagaaagggcagggaggaacggagggaggtgtgggtgagctgatataaaaaggtttttatgat

SEQ ID NO: 199678 - DNA, 1736 bp, Homo sapiens
  Payload ID: 19397
  Gene Name: WD repeat containing, antisense to TP53
  ENST ID: ENST00000534050
  CDS Start-End: 173-1720
agtgctttcaaaagaattggcgtccgctgttcgcctctcctcccgggagtcttctgcctactcccagaagaggagggaagcacaggtgggtttctttagctctgcgtcggatccctgagaacttcgaagccatcctggctgaggctaatctccgctgtgcttcctctgcagtatgaagactttggagactcaaccgttagctccggactgctgtccttcagaccaggacccagctccagcccatccttctccccacgcttccccgatgaataaaaatgcggactctgaactgatgccaccgcctcccgaaaggggggatccgccccggttgtccccagatcctgtggctggctcagctgtgtcccaggagctacgggagggggacccagtttctctctccactcccctggaaacagagtttggttcccctagtgagttgagtcctcgaatcgaggagcaagaactttctgaaaatacaagccttcctgcagaagaagcaaacgggagcctttctgaagaagaagcgaacgggccagagttggggtctggaaaagccatggaagatacctctggggaacccgctgcagaggacgagggagacacggctcctgacggttcctgcatcttgaccaatagtgctgataacatcttgcgaatttataacctgcccccagagctgtaccatgagggggagcaggtggaatatgcagaaatggtccctgtccttcgaatggtggaaggtgataccatctatgattactgctggtattctctgatgtcctcagcccagccagacacctcctacgtggccagcagcagccgggagaacccgattcatatctgggacgcattcactggagagctccgggcttcctttcgcgcctacaaccacctggatgagctgacggcagcccattcgctctgcttctccccggatggctcccagctcttctgtggcttcaaccggactgtgcgtgttttttccacggcccggcctggccgagactgcgaggtccgagccacatttgcaaaaaagcagggccagagcggcatcatctcctgcatagccttcagcccagcccagcccctctatgcctgtggctcctacggccgctccctgggtctgtatgcctgggatgatggctcccctctcgccttgctgggagggcaccaagggggcatcacccacctctgctttcatcccgatggcaaccgcttcttctcaggagcccgcaaggatgctgagctcctgtgctgggatctccggcagtctggttacccactgtggtccctgggtcgagaggtgaccaccaatcagcgcatctacttcgatctggacccgaccgggcagttcctagtgagtggcagcacgagcggggctgtctctgtgtgggacacggacgggcctggcaatgatgggaagccggagcccgtgttgagttttctgccccagaaggactgcaccaatggcgtgagcctgcaccctagcctgcctctcctggccactgcctccggtcagcgtgtgtttcctgagcccacagagagtggggacgaaggagaggagctgggccttcccttgctctccacgcgccacgtccaccttgaatgtcggcttcagctctggtggtgtgggggggcgccagactccagcatccctgatgatcaccagggcgagaaagggcagggaggaacggagggaggtgtgggtgagctgatataaaaaggtttttatgata

SEQ ID NO: 199679 - DNA, 504 bp, Homo sapiens
  Payload ID: 19397
  Gene Name: WD repeat containing, antisense to TP53
  ENST ID: ENST00000463804
  CDS Start-End: 1-141
gatgagctgacggcagcccattcgctctgcttctccccggatggctcccagctcttctgtggcttcaaccggactgtgcgtgttttttccacggcccggcctggccgagactgcgaggtccgagccacatttggatgctgagctcctgtgctgggatctccggcagtctggttacccactgtggtccctgggtcgagaggtgaccaccaatcagcgcatctacttcgatctggacccgaccgggcagttcctagtgagtggcagcacgagcggggctgtctctgtgtgggacacggacgggcctggcaatgatgggaagccggagcccgtgttgagttttctgccccagaaggactgcaccaatggcgtgagcctgcaccctagcctgcctctcctggccactgcctccggtcagcgtgtgtttcctgagcccacagagagtggggacgaaggagaggagctgggccttcccttgctctccacgcgccacgtccaccttgaatg

SEQ ID NO: 199680 - DNA, 1665 bp, Homo sapiens
  Payload ID: 19398
  Gene Name: WD repeat containing, antisense to TP73
  Uniprot ID: Q9P2S5
  ENST ID: ENST00000270708
  CDS Start-End: 75-1457
gttgcagcctgctgcgcgcccaggggtcccgcgggttttcgggcgcagggtggcgcccgcggcaggcggcggccatgaacttctccgaggtattcaagctctccagcttactctgcaagttctccccggacggcaagtacctggcttcctgtgtccagtaccggttagtggtccgggatgtgaacacccttcagatccttcagctgtacacgtgcctagaccagatccagcacatcgagtggtcggcagactcgctcttcatcctgtgcgccatgtacaagcgagggctggtgcaggtctggtctttagagcagcccgaatggcactgcaaaatagacgagggctcagccgggctggtggcctcgtgctggagcccggacgggcgccacattctcaacaccacggaattccatctgcggataaccgtctggtccttgtgcacaaaatccgtgtcttacatcaaatacccgaaagcttgtctgcagggaatcaccttcaccagggacggccgctacatggcgctggcagaacggcgcgactgcaaagattacgtgagcatcttcgtctgcagtgattggcagctcctgcggcattttgatacggacacccaggatctcacagggattgagtgggccccaaacggctgtgtgctggcagtgtgggacacctgcttggagtacaagattctgctgtactcattggatggccggttgttgtccacgtacagcgcttacgagtggtccctgggcatcaagtctgtggcctggagccccagcagtcagttcctggcagttgggagctatgatggaaaggtgcgcatccttaatcacgtgacttggaaaatgatcacggagtttgggcatcctgcagccattaatgatcccaagatagtggtgtataaggaggccgagaagagcccacagctgggactgggctgcctctccttcccgccgccccgggccggggccggccctctcccgagctcagagagtaaatatgagatcgcctctgtcccagtctccttacagacactgaaacctgttaccgacagagcaaacccgaaaatcggcataggaatgctggcatttagtcctgacagctacttcctggcgacaaggaacgacaacattcccaatgccgtctgggtctgggacattcagaagctgaggctgttcgcggtgctcgagcagctgtccccagtgcgcgcatttcagtgggacccgcagcagccgcggctggccatctgcacgggaggcagcaggctctacctgtggtccccagcgggctgcatgtcggtgcaggtgcctggggaaggcgactttgcagtgctctctctgtgctggcatttaagcggagactcgatggccctcctcagcaaggatcacttctgcctctgcttcctggagacagaggcagtggtcggcacagcctgcagacagctgggcggccacacgtagcagcggtgcactaacgtgtgcagaaacagggctactctgtgtttccagtgtgggaaaaaacacagcttcaccaggaggttctccactgtggtggtctggattcagtgattgattctatttttctatagcaaagcatttttgtaaatatgtatggtataaaactgtagttttattatttaaaataaatacttgctgatttatacaacta

SEQ ID NO: 199681 - DNA, 1998 bp, Homo sapiens
  Payload ID: 19398
  Gene Name: WD repeat containing, antisense to TP73
  ENST ID: ENST00000378322
  CDS Start-End: 60-1367
gcgcccaggggtcccgcgggttttcgggcgcagggtggcgcccgcggcaggcggcggccatgaacttctccgaggtattcaagctctccagcttactctgcaagttctccccggacggcaagtacctggcttcctgtgtccagtaccggttagtggtccgggatgtgaacacccttcagatccttcagctgtacacgtgcctagaccagatccagcacatcgagtggtcggcagactcgctcttcatcctgtgcgccatgtacaagcgagggctggtgcaggtctggtctttagagcagcccgaatggcactgcaaaatagacgagggctcagccgggctggtggcctcgtgctggagcccggacgggcgccacattctcaacaccacggaattccatctgcggataaccgtctggtccttgtgcacaaaatccgtgtcttacatcaaatacccgaaagcttgtctgcagggaatcaccttcaccagggacggccgctacatggcgctggcagaacggcgcgactgcaaagattacgtgagcatcttcgtctgcagtgattggcagctcctgcggcattttgatacggacacccaggatctcacagggattgagtgggccccaaacggctgtgtgctggcagtgtgggacacctgcttggagtacaagattctgctgtactcattggatggccggttgttgtccacgtacagcgcttacgagtggtccctgggcatcaagtctgtggcctggagccccagcagtcagttcctggcagttgggagctatgatggaaaggtgcgcatccttaatcacgtgacttggaaaatgatcacggagtttgggcatcctgcagccattaatgatcccaagatagtggtgtataaggaggccgagaagagcccacagctgggactgggctgcctctccttcccgccgccccgggccggggccggccctctcccgagctcagagagtaaatatgagatcgcctctgtcccagtctccttacagacactgaaacctgttaccgacagagcaaacccgaaaatcggcataggaatgctggcatttagtcctgacagctacttcctggcgacaaggaacgacaacattcccaatgccgtctgggtctgggacattcagaagctgaggctgttcgcggtgctcgagcagctgtccccagtgcgcgcatttcagtgggacccgcagcagccgcggctggccatctgcacgggaggcagcaggctctacctgtggtccccagcgggctgcatgtcggtgcaggtgcctggggaaggtaagcacatccccgaggccacggacgtggcagccttgctgtgtgcagtctggcatcacacgggctgaactgttgaagcccagctgctgtctccggcagcactccagggaaactgccctcagagtctttgcgtaaacctcaagacggacacacaggggacccgctgccctcagctttatgggctagaagcagcctctccctgacttgaggcagctctggggctccaccctggctctgcctatgtgggtcactccaggcactgtgctggcctgcaggacaagggggtgcccatcccccagaatctgggcctcccctgctgtaatcctctggccacctgtctctctctaggcgactttgcagtgctctctctgtgctggcatttaagcggagactcgatggccctcctcagcaaggatcacttctgcctctgcttcctggagacagaggcagtggtcggcacagcctgcagacagctgggcggccacacgtagcagcggtgcactaacgtgtgcagaaacagggctactctgtgtttccagtgtgggaaaaaacacagcttcaccaggaggttctccactgtggtggtctggattcagtgattgattctatttttctatagcaaagcatttttgtaaatatgtatggtataaaactgtagttttattatttaaaataaatacttgctgatttatacaacta

SEQ ID NO: 199682 - DNA, 603 bp, Homo sapiens
  Payload ID: 19398
  Gene Name: WD repeat containing, antisense to TP73
  ENST ID: ENST00000419924
  CDS Start-End: 65-603
gctgcgcgcccaggggtcccgcgggttttcgggcgcagggtggcgcccgcggcaggcggcggccatgaacttctccgaggtattcaagctctccagcttactctgcaagttctccccggacggcaagtacctggcttcctgtgtccagtaccggttagtggtccgggatgtgaacacccttcagatccttcagctgtacacgtgcctagaccagatccagcacatcgagtggtcggcagactcgctcttcatcctgtgcgccatgtacaagcgagggctggtgcaggtctggtctttagagcagcccgaatggcactgcaaaatagacgagggctcagccgggctggtggcctcgtgctggagcccggacgggcgccacattctcaacaccacggaattccatctgcggataaccgtctggtccttgtgcacaaaatccgtgtcttacatcaaatacccgaaagcttgtctgcagggaatcaccttcaccagggacggccgctacatggcgctggcagaacggcgcgactgcaaagattacgtgagcatcttcgtctgcagtgattggcagctcctgcggtacaagattctgctgtactcatt

SEQ ID NO: 199683 - DNA, 940 bp, Homo sapiens
  Payload ID: 19398
  Gene Name: WD repeat containing, antisense to TP73
  ENST ID: ENST00000424367
  CDS Start-End: 28-940
gggtggcgcccgcggcaggcggcggccatgaacttctccgaggtattcaagctctccagcttactctgcaagttctccccggacggcaagtacctggcttcctgtgtccagtaccggttagtggtccgggatgtgaacacccttcagatccttcagctgtacacgtgcctagaccagatccagcacatcgagtggtcggcagactcgctcttcatcctgtgcgccatgtacaagcgagggctggtgcaggtctggtctttagagcagcccgaatggcactgcaaaatagacgagggctcagccgggctggtggcctcgtgctggagcccggacgggcgccacattctcaacaccacggaattccatctgcggataaccgtctggtccttgtgcacaaaatccgtgtcttacatcaaatacccgaaagcttgtctgcagggaatcaccttcaccagggacggccgctacatggcgctggcagaacggcgcgactgcaaagattacgtgagcatcttcgtctgcagtgattggcagctcctgcggcattttgatacggacacccaggatctcacagggattgagtgggccccaaacggctgtgtgctggcagtgtgggacacctgcttggaggtgcgcatccttaatcacgtgacttggaaaatgatcacggagtttgggcatcctgcagccattaatgatcccaagatagtggtgtataaggaggccgagaagagcccacagctgggactgggctgcctctccttcccgccgccccgggccggggccggccctctcccgagctcagagagtaaatatgagatcgcctctgtcccagtctccttacagacactgaaacctgttaccgacagagcaaacccgaaaatcggcataggaatgctggcatttagtcctgacagctacttcctggcgacaaggaacg

SEQ ID NO: 199684 - DNA, 779 bp, Homo sapiens
  Payload ID: 19398
  Gene Name: WD repeat containing, antisense to TP73
  ENST ID: ENST00000465916
  CDS Start-End: 179-779
tccccgatcgctctcccctcacctcccagcttcggagctgcgagcccaggcttcctgtgtccagtaccggttagtggtccgggatgtgaacacccttcagatccttcagctgtacacgtgcctagaccagatccagcacatcgagtggtcggcagactcgctcttcatcctgtgcgccatgtacaagcgagggctggtgcaggtctggtctttagagcagcccgaatggcactgcaaaatagacgagggctcagccgggctggtggcctcgtgctggagcccggacgggcgccacattctcaacaccacggaattccatctgcggataaccgtctggtccttgtgcacaaaatccgtgtcttacatcaaatacccgaaagcttgtctgcagggaatcaccttcaccagggacggccgctacatggcgctggcagaacggcgcgactgcaaagattacgtgagcatcttcgtctgcagtgattggcagctcctgcggcattttgatacggacacccaggatctcacagggattgagtgggccccaaacggctgtgtgctggcagtgtgggacacctgcttggagtacaagattctgctgtactcattggatggccggttgttgtccacgtacagcgcttacgagtggtccctgggcatcaagtctgtggcctggagccccagcagtcagttcctggcagttgggagctatgatggaaaggtgcgcatccttaatcacgtgacttggaaaatgatcacggagtttgggcatcctgcagcca

SEQ ID NO: 199685 - DNA, 2722 bp, Homo sapiens
  Payload ID: 19399
  Gene Name: WD repeat domain 1
  Uniprot ID: O75083
  ENST ID: ENST00000382451
  CDS Start-End: 284-1684
ccgcagccgccgagccgagcgcttgactatatatggtcaaagctgggggcgagccgcgcgcgggaccgcgcttccgggttcggggcgtccgcaaccacagcgcgcagggcaggcgcgagctggcctctgagccccggcctcggaccgcccactccactcccggcacgcccggtgccgccttccggctccagtccccgggctcggcctcggcgaggtgtaattcgcagcgcgggccggccccggaggctctcggcgagcgcggcgcggtaacaagtgggcgaggatgccgtacgagatcaagaaggtgttcgccagcctcccgcaggtggagaggggcgtctccaagatcatcggcggcgaccctaagggcaacaattttctgtacaccaatggaaagtgcgtcatcctaaggaacatcgacgaccacagccgctttgtcaactgtgtgcgattctctcctgatgggaacagatttgccacagccagtgctgacggccagatatacatctatgacgggaagactggggagaaggtgtgcgcgctgggcggaagcaaggcccacgacggtgggatttacgcaattagttggagtcccgacagcacccatttgctttctgcttctggggacaaaacttccaagatttgggacgtcagcgtgaactccgtggtcagcacatttcccatgggctccacggttctggaccagcagctgggctgcctatggcagaaggaccacctgctcagtgtctccctgtccgggtacatcaactatctggacagaaacaaccccagcaagcccctgcacgtcatcaagggtcacagtaaatcgatccagtgtctgacggtgcataaaaacggcggcaagtcctacatttactctgggagccacgacggacacattaattactgggattcagagacgggggagaacgactccttcgctgggaaaggccacacgaaccaggtgtccaggatgaccgtggatgagtcggggcagctcatcagctgcagcatggacgacaccgtgcggtacaccagcctcatgctgcgggactacagcggacaaggagttgtgaaactggacgttcagccaaagtgcgtagccgtcggccccgggggatacgccgtggtcgtgtgcattggacagattgtcctgctgaaggatcagaggaagtgcttcagcatcgacaaccccggctacgagcccgaagttgtggcagtgcaccccggcggggacacggtggcaattgggggtgtggacggcaacgtccgcctgtattccatcctgggcaccacgctgaaggatgagggcaagctcctagaggccaagggccccgtgaccgacgtggcctactcccacgacggcgccttcctcgcggtgtgcgacgccagcaaggtggtcacagtgttcagcgttgctgacggctactcggagaacaatgttttttatggacaccatgcaaaaatcgtctgcctggcctggtccccagacaatgaacactttgcctccggtggcatggacatgatggtgtatgtttggaccctgagtgacccggaaaccagagtcaagatccaagatgcacaccggctgcaccatgtcagcagcctggcctggctggacgagcacacgctggtcacgacctcccatgatgcctctgtcaaggagtggacaatcacctactgaggagccccacccccgcctctggatggaccgaatcagggactagagtttaactgcagcggaacatgtcatttctctatttctgtgacgcgcccccatgcccccaccccaccacaagaggcaggagggcccagtcatgaccctcgtctctgcagggtgtctgtacacgttcttctgaaagctttagacagtaacagtttgcacatgaaaaataaagcgagcacctaaacaatgtgtggagcataactaaaacccacagcccaaccaaaccttgagaatgcgaaacattccagaggcagtagcctccaaagcacacagagcccctggccccgccgcggctctcactatctgtcaggggaggttgtacaggtgaatgagccggggggctcatgttcctgcctgcagaacatttctgtactagtgagaagagggaatatgcattgcagttcagcaaagccggaattctgtgttgaacagatgtctgtctccctagtgtgtgactcacaccttgtggctgccttcagagcgccacctccagatcagatggggacacacaacccctggatatgtttcattgtcagattttgtgcttgattttaagaatggaattgtgggtatctttcctttttttttaatgtatcttaactgttgcctgtcagtgtttacaaactagtgcgttgacggcaccgtgtccaagtttttagaacccttgttagccagaccgaggtgtcctggtcaccgtttcaccatcatgctttgatgttcccctgtctttccctcttctgctctcaagagcaaaggttaatttaaggacaaagatgaagtcactgtaaactaatctgtcattgtttttaccttccttttctttttcagtgcagaaattaaaagtaagtataaagcaccgtgattgggagtgtttttgcgtgtgtcggaatcactggtaaatgttggctgagaacaatccctccccttgcacttgtgaaaacactttgagcgctttaagagattagcctgagaaataattaaatatcttttctcttc

SEQ ID NO: 199686 - DNA, 3142 bp, Homo sapiens
  Payload ID: 19399
  Gene Name: WD repeat domain 1
  Uniprot ID: O75083
  ENST ID: ENST00000382452
  CDS Start-End: 284-2104
ccgcagccgccgagccgagcgcttgactatatatggtcaaagctgggggcgagccgcgcgcgggaccgcgcttccgggttcggggcgtccgcaaccacagcgcgcagggcaggcgcgagctggcctctgagccccggcctcggaccgcccactccactcccggcacgcccggtgccgccttccggctccagtccccgggctcggcctcggcgaggtgtaattcgcagcgcgggccggccccggaggctctcggcgagcgcggcgcggtaacaagtgggcgaggatgccgtacgagatcaagaaggtgttcgccagcctcccgcaggtggagaggggcgtctccaagatcatcggcggcgaccctaagggcaacaattttctgtacaccaatggaaagtgcgtcatcctaaggaacatcgacaacccagcccttgctgacatctacacagagcacgcccatcaggtggtggtggccaagtatgcgcccagcggattctacattgcctccggagatgtgtctgggaagctgaggatctgggataccacgcagaaggagcacctgttgaagtatgagtaccagcctttcgctgggaagatcaaagacattgcttggactgaagacagtaagaggatcgccgtggtcggggaaggaagggagaagtttggagcagtcttcctctgggatagtggctcttctgtgggcgagattacaggacacaacaaagtcatcaacagcgtggacatcaagcagagccggccataccggctggccacgggaagcgatgataactgcgcggcattctttgagggacccccattcaagttcaagttcacaattggcgaccacagccgctttgtcaactgtgtgcgattctctcctgatgggaacagatttgccacagccagtgctgacggccagatatacatctatgacgggaagactggggagaaggtgtgcgcgctgggcggaagcaaggcccacgacggtgggatttacgcaattagttggagtcccgacagcacccatttgctttctgcttctggggacaaaacttccaagatttgggacgtcagcgtgaactccgtggtcagcacatttcccatgggctccacggttctggaccagcagctgggctgcctatggcagaaggaccacctgctcagtgtctccctgtccgggtacatcaactatctggacagaaacaaccccagcaagcccctgcacgtcatcaagggtcacagtaaatcgatccagtgtctgacggtgcataaaaacggcggcaagtcctacatttactctgggagccacgacggacacattaattactgggattcagagacgggggagaacgactccttcgctgggaaaggccacacgaaccaggtgtccaggatgaccgtggatgagtcggggcagctcatcagctgcagcatggacgacaccgtgcggtacaccagcctcatgctgcgggactacagcggacaaggagttgtgaaactggacgttcagccaaagtgcgtagccgtcggccccgggggatacgccgtggtcgtgtgcattggacagattgtcctgctgaaggatcagaggaagtgcttcagcatcgacaaccccggctacgagcccgaagttgtggcagtgcaccccggcggggacacggtggcaattgggggtgtggacggcaacgtccgcctgtattccatcctgggcaccacgctgaaggatgagggcaagctcctagaggccaagggccccgtgaccgacgtggcctactcccacgacggcgccttcctcgcggtgtgcgacgccagcaaggtggtcacagtgttcagcgttgctgacggctactcggagaacaatgttttttatggacaccatgcaaaaatcgtctgcctggcctggtccccagacaatgaacactttgcctccggtggcatggacatgatggtgtatgtttggaccctgagtgacccggaaaccagagtcaagatccaagatgcacaccggctgcaccatgtcagcagcctggcctggctggacgagcacacgctggtcacgacctcccatgatgcctctgtcaaggagtggacaatcacctactgaggagccccacccccgcctctggatggaccgaatcagggactagagtttaactgcagcggaacatgtcatttctctatttctgtgacgcgcccccatgcccccaccccaccacaagaggcaggagggcccagtcatgaccctcgtctctgcagggtgtctgtacacgttcttctgaaagctttagacagtaacagtttgcacatgaaaaataaagcgagcacctaaacaatgtgtggagcataactaaaacccacagcccaaccaaaccttgagaatgcgaaacattccagaggcagtagcctccaaagcacacagagcccctggccccgccgcggctctcactatctgtcaggggaggttgtacaggtgaatgagccggggggctcatgttcctgcctgcagaacatttctgtactagtgagaagagggaatatgcattgcagttcagcaaagccggaattctgtgttgaacagatgtctgtctccctagtgtgtgactcacaccttgtggctgccttcagagcgccacctccagatcagatggggacacacaacccctggatatgtttcattgtcagattttgtgcttgattttaagaatggaattgtgggtatctttcctttttttttaatgtatcttaactgttgcctgtcagtgtttacaaactagtgcgttgacggcaccgtgtccaagtttttagaacccttgttagccagaccgaggtgtcctggtcaccgtttcaccatcatgctttgatgttcccctgtctttccctcttctgctctcaagagcaaaggttaatttaaggacaaagatgaagtcactgtaaactaatctgtcattgtttttaccttccttttctttttcagtgcagaaattaaaagtaagtataaagcaccgtgattgggagtgtttttgcgtgtgtcggaatcactggtaaatgttggctgagaacaatccctccccttgcacttgtgaaaacactttgagcgctttaagagattagcctgagaaataattaaatatcttttctcttc

SEQ ID NO: 199687 - DNA, 812 bp, Homo sapiens
  Payload ID: 19399
  Gene Name: WD repeat domain 1
  ENST ID: ENST00000508079
  CDS Start-End: 78-812
agtcaacaggtgaccggccgagaccggtccggggctccttctcccttctgtccccgccgtccccgccctgccctgacatgccccgccgcatttgtgtctccgcagagaaggtgttcgccagcctcccgcaggtggagaggggcgtctccaagatcatcggcggcgaccctaagggcaacaattttctgtacaccaatggaaagtgcgtcatcctaaggaacatcgacaacccagcccttgctgacatctacacagagcacgcccatcaggtggtggtggccaagtatgcgcccagcggattctacattgcctccggagatgtgtctgggaagctgaggatctgggataccacgcagaaggagcacctgttgaagtatgagtaccagcctttcgctgggaagatcaaagacattgcttggactgaagacagtaagaggatcgccgtggtcggggaaggaagggagaagtttggagcagtcttcctctgggatagtggctcttctgtgggcgagattacaggacacaacaaagtcatcaacagcgtggacatcaagcagagccggccataccggctggccacgggaagcgatgataactgcgcggcattctttgagggacccccattcaagttcaagttcacaattggcgaccacagccgctttgtcaactgtgtgcgattctctcctgatgggaacagatttgccacagccagtgctgacggccagatatacatctatgacgggaagactggggagaaggtgtgcgcgctgggcggaagcaaggcccacgacggtgggatttacgcagtgagt

SEQ ID NO: 199688 - DNA, 1691 bp, Homo sapiens
  Payload ID: 19399
  Gene Name: WD repeat domain 1
  Uniprot ID: O75083
  ENST ID: ENST00000502702
  CDS Start-End: 62-1462
cgcagcgcgggccggccccggaggctctcggcgagcgcggcgcggtaacaagtgggcgaggatgccgtacgagatcaagaaggtgttcgccagcctcccgcaggtggagaggggcgtctccaagatcatcggcggcgaccctaagggcaacaattttctgtacaccaatggaaagtgcgtcatcctaaggaacatcgacgaccacagccgctttgtcaactgtgtgcgattctctcctgatgggaacagatttgccacagccagtgctgacggccagatatacatctatgacgggaagactggggagaaggtgtgcgcgctgggcggaagcaaggcccacgacggtgggatttacgcaattagttggagtcccgacagcacccatttgctttctgcttctggggacaaaacttccaagatttgggacgtcagcgtgaactccgtggtcagcacatttcccatgggctccacggttctggaccagcagctgggctgcctatggcagaaggaccacctgctcagtgtctccctgtccgggtacatcaactatctggacagaaacaaccccagcaagcccctgcacgtcatcaagggtcacagtaaatcgatccagtgtctgacggtgcataaaaacggcggcaagtcctacatttactctgggagccacgacggacacattaattactgggattcagagacgggggagaacgactccttcgctgggaaaggccacacgaaccaggtgtccaggatgaccgtggatgagtcggggcagctcatcagctgcagcatggacgacaccgtgcggtacaccagcctcatgctgcgggactacagcggacaaggagttgtgaaactggacgttcagccaaagtgcgtagccgtcggccccgggggatacgccgtggtcgtgtgcattggacagattgtcctgctgaaggatcagaggaagtgcttcagcatcgacaaccccggctacgagcccgaagttgtggcagtgcaccccggcggggacacggtggcaattgggggtgtggacggcaacgtccgcctgtattccatcctgggcaccacgctgaaggatgagggcaagctcctagaggccaagggccccgtgaccgacgtggcctactcccacgacggcgccttcctcgcggtgtgcgacgccagcaaggtggtcacagtgttcagcgttgctgacggctactcggagaacaatgttttttatggacaccatgcaaaaatcgtctgcctggcctggtccccagacaatgaacactttgcctccggtggcatggacatgatggtgtatgtttggaccctgagtgacccggaaaccagagtcaagatccaagatgcacaccggctgcaccatgtcagcagcctggcctggctggacgagcacacgctggtcacgacctcccatgatgcctctgtcaaggagtggacaatcacctactgaggagccccacccccgcctctggatggaccgaatcagggactagagtttaactgcagcggaacatgtcatttctctatttctgtgacgcgcccccatgcccccaccccaccacaagaggcaggagggcccagtcatgaccctcgtctctgcagggtgtctgtacacgttcttctgaaagctttagacagtaacagtttgcacatgaaaaataaagcgagcacctaaacaa

SEQ ID NO: 199689 - DNA, 3054 bp, Homo sapiens
  Payload ID: 19399
  Gene Name: WD repeat domain 1
  Uniprot ID: O75083
  ENST ID: ENST00000499869
  CDS Start-End: 195-2015
cgcaaccacagcgcgcagggcaggcgcgagctggcctctgagccccggcctcggaccgcccactccactcccggcacgcccggtgccgccttccggctccagtccccgggctcggcctcggcgaggtgtaattcgcagcgcgggccggccccggaggctctcggcgagcgcggcgcggtaacaagtgggcgaggatgccgtacgagatcaagaaggtgttcgccagcctcccgcaggtggagaggggcgtctccaagatcatcggcggcgaccctaagggcaacaattttctgtacaccaatggaaagtgcgtcatcctaaggaacatcgacaacccagcccttgctgacatctacacagagcacgcccatcaggtggtggtggccaagtatgcgcccagcggattctacattgcctccggagatgtgtctgggaagctgaggatctgggataccacgcagaaggagcacctgttgaagtatgagtaccagcctttcgctgggaagatcaaagacattgcttggactgaagacagtaagaggatcgccgtggtcggggaaggaagggagaagtttggagcagtcttcctctgggatagtggctcttctgtgggcgagattacaggacacaacaaagtcatcaacagcgtggacatcaagcagagccggccataccggctggccacgggaagcgatgataactgcgcggcattctttgagggacccccattcaagttcaagttcacaattggcgaccacagccgctttgtcaactgtgtgcgattctctcctgatgggaacagatttgccacagccagtgctgacggccagatatacatctatgacgggaagactggggagaaggtgtgcgcgctgggcggaagcaaggcccacgacggtgggatttacgcaattagttggagtcccgacagcacccatttgctttctgcttctggggacaaaacttccaagatttgggacgtcagcgtgaactccgtggtcagcacatttcccatgggctccacggttctggaccagcagctgggctgcctatggcagaaggaccacctgctcagtgtctccctgtccgggtacatcaactatctggacagaaacaaccccagcaagcccctgcacgtcatcaagggtcacagtaaatcgatccagtgtctgacggtgcataaaaacggcggcaagtcctacatttactctgggagccacgacggacacattaattactgggattcagagacgggggagaacgactccttcgctgggaaaggccacacgaaccaggtgtccaggatgaccgtggatgagtcggggcagctcatcagctgcagcatggacgacaccgtgcggtacaccagcctcatgctgcgggactacagcggacaaggagttgtgaaactggacgttcagccaaagtgcgtagccgtcggccccgggggatacgccgtggtcgtgtgcattggacagattgtcctgctgaaggatcagaggaagtgcttcagcatcgacaaccccggctacgagcccgaagttgtggcagtgcaccccggcggggacacggtggcaattgggggtgtggacggcaacgtccgcctgtattccatcctgggcaccacgctgaaggatgagggcaagctcctagaggccaagggccccgtgaccgacgtggcctactcccacgacggcgccttcctcgcggtgtgcgacgccagcaaggtggtcacagtgttcagcgttgctgacggctactcggagaacaatgttttttatggacaccatgcaaaaatcgtctgcctggcctggtccccagacaatgaacactttgcctccggtggcatggacatgatggtgtatgtttggaccctgagtgacccggaaaccagagtcaagatccaagatgcacaccggctgcaccatgtcagcagcctggcctggctggacgagcacacgctggtcacgacctcccatgatgcctctgtcaaggagtggacaatcacctactgaggagccccacccccgcctctggatggaccgaatcagggactagagtttaactgcagcggaacatgtcatttctctatttctgtgacgcgcccccatgcccccaccccaccacaagaggcaggagggcccagtcatgaccctcgtctctgcagggtgtctgtacacgttcttctgaaagctttagacagtaacagtttgcacatgaaaaataaagcgagcacctaaacaatgtgtggagcataactaaaacccacagcccaaccaaaccttgagaatgcgaaacattccagaggcagtagcctccaaagcacacagagcccctggccccgccgcggctctcactatctgtcaggggaggttgtacaggtgaatgagccggggggctcatgttcctgcctgcagaacatttctgtactagtgagaagagggaatatgcattgcagttcagcaaagccggaattctgtgttgaacagatgtctgtctccctagtgtgtgactcacaccttgtggctgccttcagagcgccacctccagatcagatggggacacacaacccctggatatgtttcattgtcagattttgtgcttgattttaagaatggaattgtgggtatctttcctttttttttaatgtatcttaactgttgcctgtcagtgtttacaaactagtgcgttgacggcaccgtgtccaagtttttagaacccttgttagccagaccgaggtgtcctggtcaccgtttcaccatcatgctttgatgttcccctgtctttccctcttctgctctcaagagcaaaggttaatttaaggacaaagatgaagtcactgtaaactaatctgtcattgtttttaccttccttttctttttcagtgcagaaattaaaagtaagtataaagcaccgtgattgggagtgtttttgcgtgtgtcggaatcactggtaaatgttggctgagaacaatccctccccttgcacttgtgaaaacactttgagcgctttaagagattagcctgagaaataattaaatatcttttctcttca

SEQ ID NO: 199690 - DNA, 4732 bp, Homo sapiens
  Payload ID: 19400
  Gene Name: WD repeat domain 11
  Uniprot ID: Q9BZH6
  ENST ID: ENST00000263461
  CDS Start-End: 247-3921
agcacaaccgcctaagcggcggaactctggagagtgcggaacctaggatcctaggaaactgaaggcaacggaacctgggggcgatggaatccgggagcggtggaacccggagcctgtagaacttgaatctagaggaacctgacagcggcgccgagggggccacccggactctgtttggaacggaagcacagtgtccgccgcttcctggttgcgggtcagcgcccaggtcctgggctggccgccgggatgttgccctacacagtgaacttcaaggtgtcggcgcgcaccctcacgggggccctcaacgcccacaacaaggcggcggtggactggggctggcaaggtttaattgcttatggatgtcattcacttgtggtagtgattgattccattactgcccaaactcttcaagttttagaaaagcataaagctgatgttgtaaaggttaaatgggccagggaaaactatcaccataacattggctcaccatattgcttacggttagcttctgctgatgtcaatgggaagatcatcgtctgggatgtagcagcaggagtagctcagtgtgagatccaagagcatgccaagcctatccaggatgttcagtggttgtggaatcaagatgcttcccgcgatttactgcttgctatccacccgccaaattacattgtgctctggaatgccgacactggcaccaaactatggaagaagagctatgcagataacattctttctttttcttttgacccttttgatccctcacatttaactttgcttaccagcgagggtattgttttcatctcagacttctccccatccaagcctccctcaggccctgggaaaaaagtttacatatccagcccacactctagcccagctcataacaagctggccacagccacaggtgccaagaaagctctaaataaagtaaaaattttaatcactcaagagaaacctagtgctgaattcataactctcaatgattgccttcagttggcatacctgccttcaaaaaggaatcacatgttgttgctctatcctcgagagattttaatccttgaccttgaggtgaatcagacggtgggtgtgattgcaatagaacgcacaggagttccatttttacaggtaataccctgctttcagcgtgatggtttattttgtctacatgaaaatggttgtataactttacgtgttcgaagatcttataataacatttttaccacttcaaatgaggaaccagatccagatccagttcaggagcttacctatgatttacgaagccagtgtgatgcaatcagggtgacaaaaaccgtccgtcccttcagtatggtgtgctgtcctgtcaatgagaatgcagccgccctcgtagtgagtgatggcagggtcatgatatgggaactcaagtctgcagtttgtaatcgaaattcacggaacagtagttctggtgtgtcacctttatattcaccagtgtctttctgtggaattcctgtaggagtgctacagaataaactcccagacctttccttagataacatgattgggcaaagtgcaattgctggggaagaacatcccagaggttcaattctgcgggaagtgcacctcaagttcctgctgacgggactgctttcaggactgcccgcaccacagtttgctattcgtatgtgtccaccgttgaccacaaaaaacatcaagatgtatcagccactgctggctgttggtacaagtaatggttctgtcctggtgtaccatctcaccagtggtctgctacacaaagagttaagcatccactcatgtgaagtcaagggtattgaatggacaagtttgactagttttctttcttttgctacctcaacaccaaacaatatgggattagtgagaaatgaacttcaactggttgatcttccaacaggtaggagcattgcttttcgtggtgaaagaggcaatgatgaatctgccatcgaaatgattaaagtatctcatttgaagcagtatttggcagtcgtattcagagataaacccctggagctatgggatgttaggacttgtacccttcttagagagatgtccaaaaacttccctacaataactgctttggagtggtcaccatctcacaacttgaagagcctgagaaagaagcaacttgcaactcgagaggccatggcccgccagaccgtagtctcagacacagagctgagtattgttgaatcatctgtgatcagcttgctgcaggaggcagaaagtaaatctgaacttagtcagaacatctctgcccgggaacattttgtatttaccgatattgatggccaagtgtatcatctcactgttgaaggaaactcagtaaaagacagtgctcggattccaccagatggaagtatgggtagtattacctgcatcgcttggaaaggtgatacattagtgcttggagatatggatggaaatttaaatttctgggacttgaaaggcagagtatccagaggaatacccacacaccgaagttgggtgaggaagattcgttttgctcctggtaaaggaaatcaaaaattaatagcaatgtacaatgatggagctgaagtgtgggatactaaagaggttcagatggtgagcagtttaagaagtggcagaaatgtgacctttcgtatattggatgtggactggtgtacgtcagataaagtgatcttggcctcagatgatgggtgcatcagagtcctagagatgtctatgaagtctgcgtgctttagaatggatgaacaagagttaaccgagcctgtgtggtgcccctatctccttgttccaagggcctctcttgccttgaaagccttcttattacaccagccttggaatggacagtattctttggacatttctcatgttgactatccagaaaatgaagaaataaagaatctcctccaagaacagttgaattcattgtctaatgacataaagaaactgttgcttgatccagaattcactctcttgcagaggtgcctgcttgtttcaaggctctatggtgatgaatcggagctgcacttctggactgtcgctgcccactacctgcacagcttatcccaggaaaagtcagccagcacaacagctcctaaagaagctgctcctcgagacaaactgagcaacccactggatatatgctatgacgtgctctgtgaaaatgcctactttcagaaatttcagctagaaagggttaatctgcaggaagtgaaacggtcaacttatgatcatacaaggaaatgtacagaccagctactgctcttgggtcaaacagacagagctgtgcagttgctgttggaaacaagtgcagataaccagcattattactgtgattcactgaaagcctgtttagtcactactgtcacctcgtcaggcccctctcagagcaccattaagttggtggcaacgaatatgattgccaatggcaaattggcagagggcgttcagttgctctgcctgatagataaggctgcagacgcctgccgctacctgcagacatacggcgagtggaatcgggctgcatggctggcaaaagtccgtttgaatcctgaggagtgtgccgatgttttaaggcggtgggttgaccacctttgttctccacaagtcaatcagaaatcaaaggctctcctggttctcctctctctgggctgcttttttagcgtggcagagacgcttcacagcatgagatactttgatagagcagccttatttgtggaagcttgcctcaagtatggagcatttgaagtcactgaggacacagagaaactcatcactgctatatatgcagattatgcccggagtttgaagaacctcggttttaagcagggagcagttctctttgcttcaaaagccggagcagctggcaaagacttattgaatgagcttgagtcccccaaggaagaacccattgaagagtgacagcttaataaatgccagggaatctgacctggaaggcagatgggagggggctggtctggctgtggccaccgtcacagtccaggatgaagaggagtacagggtcctgtgagctgtttgaccactgttctaagactatgtgtgcccaaaagcacataagcatctatgttgagagtaagtttgtatcctgcgttggtctcagaaagaacgtgaatgcttaagattttgaaagtacataatattttatactttgggagagagctttaagagtccctggaaatactttttaatttttttaacttaaaattcaagagactgaatcacttttctcattgattaaatgtaaagattattgagaaacctatagtaaatgaaatttgtgagatgttttctcaaatatatgctgtgcctgtacttatatacagtctttcaagagagatacaaacaaggcagaaacatttaaactagtattaaaggtagtttaccaaagcattttttgttttcttaccttgaaaacacagaaccgttaattccttggtttaagcagttgctaagttttgtaattttaggctcagaggaccataggaggttttaagatttatgtttagtccgataggtgaggtctttgatattttgaattttaactccttttatgatacatcacagtaacctcatttttgaagtctttctttgtactttaatgttctctctgttctaatagttgaagtatgagatgtaactattataaactgttgctgaaaacataaatgtctgtaacttacaaacatgataaataaattaaaaattccatcca

SEQ ID NO: 199691 - DNA, 4954 bp, Homo sapiens
  Payload ID: 19400
  Gene Name: WD repeat domain 11
  ENST ID: ENST00000497136
  CDS Start-End: 600-1199
ataaagctgatgttgtaaaggttaaatgggccagggaaaactatcaccataacattggctcaccatattgcttacggttagcttctgctgatgtcaatgggaagatcatcgtctgggatgtagcagcaggagtagctcagtgtgagatccaagagcatgccaagcctatccaggatgttcagtggttgtggaatcaagatgcttcccgcgatttactgcttgctatccacccgccaaattacattgtgctctggaatgccgacactggcaccaaactatggaagaagagctatgcagataacattctttctttttcttttgacccttttgatccctcacatttaactttgcttaccagcgagggtattgttttcatctcagacttctccccatccaagcctccctcaggccctgggaaaaaagtttacatatccagcccacactctagcccagctcataacaagctggccacagccacaggtgccaagaaagctctaaataaagtaaaaattttaatcactcaagagaaacctagtgctgaattcataactctcaatgattgccttcagttggcatacctgccttcaaaaaggaatcacatgttgttgctctatcctcgagagattttaatccttgaccttgaggtgaatcagacggtgggtgtgattgcaatagaacgcacaggagttccatttttacaggtaataccctgctttcagcgtgatggtttattttgtctacatgaaaatggttgtataactttacgtgttcgaagatcttataataacatttttaccacttcaaatgaggaaccagatccagatccagttcaggagcttacctatgatttacgaagccagtgtgatgcaatcagggtgacaaaaaccgtccgtcccttcagtatggtgtgctgtcctgtcaatgagaatgcagccgccctcgtagtgagtgatggcagggtcatgatatgggaactcaagtctgcagtttgtaatcgaaattcacggaacagggcaaagtgcaattgctggggaagaacatcccagaggttcaattctgcgggaagtgcacctcaagttcctgctgacgggactgctttcaggactgcccgcaccacagtttgctattcgtatgtgtccaccgttgaccacaaaaaacatcaagatgtatcagccactgctggctgttggtacaagtaatggttctgtcctggtgtaccatctcaccagtggtctgctacacaaagagttaagcatccactcatgtgaagtcaagggtattgaatggacaagtttgactagttttctttcttttgctacctcaacaccaaacaatatgggattagtgagaaatgaacttcaactggttgatcttccaacaggtaggagcattgcttttcgtggtgaaagaggcaatgatgaatctgccatcgaaatgattaaagtatctcatttgaagcagtatttggcagtcgtattcagagataaacccctggagctatgggatgttaggacttgtacccttcttagagagatgtccaaaaacttccctacaataactgctttggagtggtcaccatctcacaacttgaagagcctgagaaagaagcaacttgcaactcgagaggccatggcccgccagaccgtagtctcagacacagagctgagtattgttgaatcatctgtgatcagcttgctgcaggaggcagaaagtaaatctgaacttagtcagaacatctctgcccgggaacattttgtatttaccgatattgatggccaagtgtatcatctcactgttgaaggaaactcagtaaaagacagtgctcggattccaccagatggaagtatgggtagtattacctgcatcgcttggaaaggtgatacattagtgcttggagatatggatggaaatttaaatttctgggacttgaaaggcagagtatccagaggaatacccacacaccgaagttgggtgaggaagattcgttttgctcctggtaaaggaaatcaaaaattaatagcaatgtacaatgatggagctgaagtgtgggatactaaagaggttcagatggtgagcagtttaagaagtggcagaaatgtgacctttcgtatattggatgtggactggtgtacgtcagataaagtgatcttggcctcagatgatgggtgcatcagagtcctagagatgtctatgaagtctgcgtgctttagaatggatgaacaagagttaaccgagcctgtgtggtgcccctatctccttgttccaagggcctctcttgccttgaaagccttcttattacaccagccttggaatggacagtattctttggacatttctcatgttgactatccagaaaatgaagaaataaagaatctcctccaagaacagttgaattcattgtctaatgacataaagaaactgttgcttgatccagaattcactctcttgcagaggtgcctgcttgtttcaaggctctatggtgatgaatcggagctgcacttctggactgtcgctgcccactacctgcacagcttatcccaggaaaagtcagccagcacaacagctcctaaagaagctgctcctcgagacaaactgagcaacccactggatatatgctatgacgtgctctgtgaaaatgcctactttcagaaatttcagctagaaagggttaatctgcaggaagtgaaacggtcaacttatgatcatacaaggaaatgtacagaccagctactgctcttgggtcaaacagacagagctgtgcagttgctgttggaaacaagtgcagataaccagcattattactgtgattcactgaaagcctgtttagtcactactgtcacctcgtcaggcccctctcagagcaccattaagttggtggcaacgaatatgattgccaatggcaaattggcagagggcgttcagttgctctgcctgatagataaggctgcagacgcctgccgctacctgcagacatacggcgagtggaatcgggctgcatggctggcaaaagtccgtttgaatcctgaggagtgtgccgatgttttaaggcggtgggttgaccacctttgttctccacaagtcaatcagaaatcaaaggctctcctggttctcctctctctgggctgcttttttagcgtggcagagacgcttcacaggtaaaccgagagttcacatgggctgctcaggcctgcccgtgagcagtcacttcatgttctctcgcggttctagcaggtcatggtactcgatgtgtaaagtgaaaggagaagtatacatttcaggtttgtcaaaaaacccaaaggagaatggaactgtccgtattcattacatcttcattcggtctaggagctatgctagtttcctactaatatgctgatcagacttaacaggcacctagtaaaagggaatttaaaagtcttcagagaattggggtccattcagctttgactagagcaactgagaggaggcccagagagcagggggagaggcgacagaaggcatggtgaggtggagacatcccgtctgaaaatctggaagaggaacaaccatcactaattgtggagcatttcatttattcaaaactaagggaggtagattacggaaatatgacaaaagattacttgtcaactctggacaggggtacatgggcacttgtcatatctctgtagatttttgtgtatttaaactatttcacaattttttaaagtattaattttaaaaagcttgtgtttggagatgtgagtattcttccctccttttttcaacaaactagggcttagaaaagtgcttgtatcttaatgcagtatgcaggtttccagggaaaatgtgtaaatgtctttatacccttcgatgctgctgcccaccagtgatgtaaatcacaaagcataactcttgttttgttctgttgagcagcatgagatactttgatagagcagccttatttgtggaagcttgcctcaagtatggagcatttgaagtcactgaggacacagagaaactcatcactgctatatatgcagattatgcccggagtttgaagaacctcggttttaagcagggagcagttctctttgcttcaaaagccggagcagctggcaaagacttattgaatgagcttgagtcccccaaggaagaacccattgaagagtgacagcttaataaatgccagggaatctgacctggaaggcagatgggagggggctggtctggctgtggccaccgtcacagtccaggatgaagaggagtacagggtcctgtgagctgtttgaccactgttctaagactatgtgtgcccaaaagcacataagcatctatgttgagagtaagtttgtatcctgcgttggtctcagaaagaacgtgaatgcttaagattttgaaagtacataatattttatactttgggagagagctttaagagtccctggaaatactttttaatttttttaacttaaaattcaagagactgaatcacttttctcattgattaaatgtaaagattattgagaaacctatagtaaatgaaatttgtgagatgttttctcaaatatatgctgtgcctgtacttatatacagtctttcaagagagatacaaacaaggcagaaacatttaaactagtattaaaggtagtttaccaaagcattttttgttttcttaccttgaaaacacagaaccgttaattccttggtttaagcagttgctaagttttgtaattttaggctcagaggaccataggaggttttaagatttatgtttagtccgataggtgaggtctttgatattttgaattttaactccttttatgatacatcacagtaacctcatttttgaagtctttctttgtactttaatgttctctctgttctaatagttgaagtatgagatgtaactattataaactgttgctgaaaacataaatgtctgtaacttacaaacatgataaataaattaaaaattcca

SEQ ID NO: 199692 - DNA, 1781 bp, Homo sapiens
  Payload ID: 19400
  Gene Name: WD repeat domain 11
  ENST ID: ENST00000604585
  CDS Start-End: 846-1781
aacaaggcggcggtggactggtgaggacgccgagcttccaggtcgccaggatcggccaggaatgtgtgagggggaagggggaaggacaagaggtttcaccccctggggctggcaaggtttaattgcttatggatgtcattcacttgtggtagtgattgattccattactgcccaaactcttcaagttttagaaaagcataaagctgatgttgtaaaggtccaagtttcagtctggtattatattcccatcgactgaagaatttactgttaaatgggccagggaaaactatcaccataacattggctcaccatattgcttacggttagcttctgctgatgtcaatgggaagatcatcgtctgggatgtagcagcaggagtagctcagtgtgagatccaagagcatgccaagcctatccaggatgttcagtggttgtggaatcaagatgcttcccgcgatttactgcttgctatccacccgccaaattacattgtgctctggaatgccgacactggcaccaaactatggaagaagagctatgcagataacattctttctttttcttttgacccttttgatccctcacatttaactttgcttaccagcgagggtattgttttcatctcagacttctccccatccaagcctccctcaggccctgggaaaaaagtttacatatccagcccacactctagcccagctcataacaagctggccacagccacaggtgccaagaaagctctaaataaagtaaaaattttaatcactcaagagaaacctagtgctgaattcataactctcaatgattgccttcagttggcatacctgccttcaaaaaggaatcacatgttgttgctctatcctcgagagattttaatccttgaccttgaggtgaatcagacggtgggtgtgattgcaatagaacgcacaggagttccatttttacaggtaataccctgctttcagcgtgatggtttattttgtctacatgaaaatggttgtataactttacgtgttcgaagatcttataataacatttttaccacttcaaatgaggaaccagatccagatccagttcaggagcttacctatgatttacgaagccagtgtgatgcaatcagggtgacaaaaaccgtccgtcccttcagtatggtgtgctgtcctgtcaatgagaatgcagccgccctcgtagtgagtgatggcagggtcatgatatgggaactcaagtctgcagtttgtaatcgaaattcacggaacagtagttctggtgtgtcacctttatattcaccagtgtctttctgtggaattcctgtaggagtgctacagaataaactcccagacctttccttagataacatgattgggcaaagtgcaattgctggggaagaacatcccagaggttcaattctgcgggaagtgcacctcaagttcctgctgacgggactgctttcaggactgcccgcaccacagtttgctattcgtatgtgtccaccgttgaccacaaaaaacatcaagatgtatcagccactgctggctgttggtacaagtaatggttctgtcctggtgtaccatctcaccagtggtctgctacacaaagagttaagcatccactcatgtgaagtcaagggtattgaatggacaagtttgactagttttctttcttttgctacctcaacaccaaacaatatgggattagtgagaaatgaacttcaactggttgatcttccaacaggtaggagcattgcttttcgtggtgaaagaggcaatgatgaatctgccatc

SEQ ID NO: 199693 - DNA, 3010 bp, Homo sapiens
  Payload ID: 19400
  Gene Name: WD repeat domain 11
  ENST ID: ENST00000605543
  CDS Start-End: 60-347
acagtgtccgccgcttcctggttgcgggtcagcgcccaggtcctgggctggccgccgggatgttgccctacacagtgaacttcaaggtgtcggcgcgcaccctcacgggggccctcaacgcccacaacaaggcggcggtggactggggctggcaaggtttaattgcttatggatgtcattcacttgtggtagtgattgattccattactgcccaaactcttcaagttcctgctgacgggactgctttcaggactgcccgcaccacagtttgctattcgtatgtgtccaccgttgaccacaaaaaacatcaagatgtatcagccactgctggctgttggtacaagtaatggttctgtcctggtgtaccatctcaccagtggtctgctacacaaagagttaagcatccactcatgtgaagtcaagggtattgaatggacaagtttgactagttttctttcttttgctacctcaacaccaaacaatatgggattagtgagaaatgaacttcaactggttgatcttccaacaggtaggagcattgcttttcgtggtgaaagaggcaatgatgaatctgccatcgaaatgattaaagtatctcatttgaagcagtatttggcagtcgtattcagagataaacccctggagctatgggatgttaggacttgtacccttcttagagagatgtccaaaaacttccctacaataactgctttggagtggtcaccatctcacaacttgaagagcctgagaaagaagcaacttgcaactcgagaggccatggcccgccagaccgtagtctcagacacagagctgagtattgttgaatcatctgtgatcagcttgctgcaggaggcagaaagtaaatctgaacttagtcagaacatctctgcccgggaacattttgtatttaccgatattgatggccaagtgtatcatctcactgttgaaggaaactcagtaaaagacagtgctcggattccaccagatggaagtatgggtagtattacctgcatcgcttggaaaggtgatacattagtgcttggagatatggatggaaatttaaatttctgggacttgaaaggcagagtatccagaggaatacccacacaccgaagttgggtgaggaagattcgttttgctcctggtaaaggaaatcaaaaattaatagcaatgtacaatgatggagctgaagtgtgggatactaaagaggttcagatggtgagcagtttaagaagtggcagaaatgtgacctttcgtatattggatgtggactggtgtacgtcagataaagtgatcttggcctcagatgatgggtgcatcagagtcctagagatgtctatgaagtctgcgtgctttagaatggatgaacaagagttaaccgagcctgtgtggtgcccctatctccttgttccaagggcctctcttgccttgaaagccttcttattacaccagccttggaatggacagtattctttggacatttctcatgttgactatccagaaaatgaagaaataaagaatctcctccaagaacagttgaattcattgtctaatgacataaagaaactgttgcttgatccagaattcactctcttgcagaggtgcctgcttgtttcaaggctctatggtgatgaatcggagctgcacttctggactgtcgctgcccactacctgcacagcttatcccaggaaaagtcagccagcacaacagctcctaaagaagctgctcctcgagacaaactgagcaacccactggatatatgctatgacgtgctctgtgaaaatgcctactttcagaaatttcagctagaaagggttaatctgcaggaagtgaaacggtcaacttatgatcatacaaggaaatgtacagaccagctactgctcttgggtcaaacagacagagctgtgcagttgctgttggaaacaagtgcagataaccagcattattactgtgattcactgaaagcctgtttagtcactactgtcacctcgtcaggcccctctcagagcaccattaagttggtggcaacgaatatgattgccaatggcaaattggcagagggcgttcagttgctctgcctgatagataaggctgcagacgcctgccgctacctgcagacatacggcgagtggaatcgggctgcatggctggcaaaagtccgtttgaatcctgaggagtgtgccgatgttttaaggcggtgggttgaccacctttgttctccacaagtcaatcagaaatcaaaggctctcctggttctcctctctctgggctgcttttttagcgtggcagagacgcttcacagcatgagatactttgatagagcagccttatttgtggaagcttgcctcaagtatggagcatttgaagtcactgaggacacagagaaactcatcactgctatatatgcagattatgcccggagtttgaagaacctcggttttaagcagggagcagttctctttgcttcaaaagccggagcagctggcaaagacttattgaatgagcttgagtcccccaaggaagaacccattgaagagtgacagcttaataaatgccagggaatctgacctggaaggcagatgggagggggctggtctggctgtggccaccgtcacagtccaggatgaagaggagtacagggtcctgtgagctgtttgaccactgttctaagactatgtgtgcccaaaagcacataagcatctatgttgagagtaagtttgtatcctgcgttggtctcagaaagaacgtgaatgcttaagattttgaaagtacataatattttatactttgggagagagctttaagagtccctggaaatactttttaatttttttaacttaaaattcaagagactgaatcacttttctcattgattaaatgtaaagattattgagaaacctatagtaaatgaaatttgtgagatgttttctcaaatatatgctgtgcctgtacttatatacagtctttcaagagagatacaaacaaggcagaaacatttaaactagtatt

SEQ ID NO: 199694 - DNA, 8100 bp, Homo sapiens
  Payload ID: 19401
  Gene Name: WD repeat domain 12
  Uniprot ID: Q9GZL7
  ENST ID: ENST00000261015
  CDS Start-End: 751-2022
atcggccaccgtcgaccgtttcctctctcatccgttcttttctttgtatttccgcctctcgcctctctctaaaagccgcagttagaggcgagatttaggaaaaacctctgccgagtgagcctctggttgggaatatgtatgagaaaaaaaaactggcaaggcgttagtcaagcaaagctgaaggcagaggaaatttgatatctggctggagtctagaggatttaatgcaaataagatactctgagggcagcgtggcaaaaaaagactacaattcccggtggtcacagcgtttgagaagcgatgctttctgagacttgtagtaactaggagctgtgtttgaactatccaggctcaggacagcctcttgaaaaaaaattttttattaataaagcggatttgagtgggatctttttcctaatcgattacgggcccacacgtatgggaagaattctaacaatgattaaagggacatgctacctttacgactatccttttctaatcgatgactcctaaatctaggagtaggtagtcgatgtttgtggtctgggcgtctgtagaagggcaacctcgtgctttctgcagaggagaccggagggcagaaggcagagtccaggcttagactgcagttcctcgcttacctgtgcagtctaattttgagctgcctctttgtagtcttaaaaggcaggagcttcgtgttgtgggtctgctaacccgtacgtttccgtgggcaagtcgtgtgtactcctcgccatggctcagctccaaacacgcttctacactgataacaagaaatatgccgtagatgatgttcccttctcaatccctgctgcctctgaaattgccgaccttagtaacatcatcaataaactactaaaggacaaaaatgagttccacaaacatgtggagtttgatttccttattaagggccagtttctgcgaatgcccttggacaaacacatggaaatggagaacatctcatcagaagaagttgtggaaatagaatacgtggagaagtatactgcaccccagccagagcaatgcatgttccatgatgactggatcagttcaattaaaggggcagaggaatggatcttgactggttcttatgataagacttctcggatctggtccttggaaggaaagtcaataatgacaattgtgggacatacggatgttgtaaaagatgtggcctgggtgaaaaaagatagtttgtcctgcttattattgagtgcttctatggatcagactattctcttatgggagtggaatgtagagagaaacaaagtgaaagccctacactgctgtagaggtcatgctggaagtgtagattctatagctgttgatggctcaggaactaaattttgcagtggctcctgggataagatgctaaagatctggtctacagtccctacagatgaagaagatgaaatggaggagtccacaaatcgaccaagaaagaaacagaagacagaacagttgggactaacaaggactcccatagtgaccctctctggccacatggaggcagtttcctcagttctgtggtcagatgctgaagaaatctgcagtgcatcttgggaccatacaattagagtgtgggatgttgagtctggcagtcttaagtcaactttgacaggaaataaagtgtttaattgtatttcctattctccactttgtaaacgtttagcatctggaagcacagataggcatatcagactgtgggatccccgaactaaagatggttctttggtgtcgctgtccctaacgtcacatactggttgggtgacatcagtaaaatggtctcctacccatgaacagcagctgatttcaggatctttagataacattgttaagctgtgggatacaagaagttgtaaggctcctctctatgatctggctgctcatgaagacaaagttctgagtgtagactggacagacacagggctacttctgagtggaggagcagacaataaattgtattcctacagatattcacctaccacttcccatgttggggcatgaaagtgaacaataatttgactatagagattatttctgtaaatgaaattggtagagaaccatgaaattacatagatgcagatgcagaaagcagccttttgaagtttatataatgttttcacccttcataacagctaacgtatcactttttcttattttgtatttataataagataggttgtgtttataaaatacaaactgtggcatacattctctatacaaacttgaaattaaactgagttttacatttctctttaaaggtattggtttgaattcagatttgcttttttatttttatttgttttttttttttttgagatggagtcttgctctgttgcctaggctggagtgcagtggcgcaatctcaactcactgcaacctccgcttcctaggttcaatcgattctcctgtctcaacctcccaagtagctgggattacaggcacacatcacgatgtcctgctaatttttgtatttttagtagagacggggttttgccatgttggccaggctggtcttgaactcctgacctcaggtgatctgcccacctcagcctcccaaagtgagccactgtgcctggccgaattaagatttgtttttgaaatgctgtaaaaggttatattggaaatccagtaattgattgttgagatttttatttctgttagagacttagatttttttaagttagctattttaaaaaagcattcaaaaagattaatgaaaattgtaatagagaaaaagttagaaattcagttccttttggcagaataaatgttcaagaaaattaggctgtgagggtactcagaacattaaaaaaaatgtaggctgggcatggtggctcacacctgtaatcccagcacattgggaggccgaggcaggtggatcacctgaggtcaggagtttgagaccaccctggccaacatgtcaaaaccctgtctctgctaaaactacaaaaattagctgggcatggtggcgaccgcctgtaatcccaactacttgggaggctaaggcaggagaattgcttgaacccgggaggcaggggttgtagtgagctgagattgtgccactgcactccagcctgggtgacagtgcaagactctgtctcaacaacaacgataacaaaatattgattcggcagggcacggtggctcatgcttgtaatcccagcattttgggtggccaaggcaggcggctcacctgaggtcaggggttcgagaccagcctgaccaacatggtgaaactttgtctctactaaaaaaaaaaaaatccaaaacaaattagccgggtgtggtggcacactcctgtggtcccaagtacttgggaggctgaggcaggagaattggttgaacccaggaggtggaggttgcagtgagctgagatcataccactgtgctccagcctgggcagcagagccagactctatctcaaaataaagacaagtagattgccaatttttgaagaattcatcaagatattttaaggaaggcactttatattaaatatatgtcagatcctttagaaattgcatacagttggttgggcacggtggctcacgcctgtaatcccagcactttgggaggctgaggcgggcggattgcctgagctcaggagttcgaaaccagcctgggcaacacagtgaaacctcgtctctaataaaatacaaaaaattagctgggcgtggcagcatgtgcctgtagtcccagctactccggaggctgaggcaggcaaattgcttgaacccgagaggcagaggttgcagtgagctgagattgtgccactgcatttcagcctgggcaacagagcaagactctgtctcaaaaaaaaataaaaaattgcattgcatacagttttcactgtaaccctaatctttcctcatgtgtagattagaataaattttttagacaaaacctttcatcagtattaaacattctacagattttatgatatcattagcatttatctttatgcatgtgttatataaaaatatttaaagtaaatgtattttttaaatgttatttccattattaatggattgatactccttaagtagagcattcacaaccttttagtaatatttgggaaatatgtttggtctcattattagatggtattacatctcaaatgatgttcctgttgcagaagtctgcgaaacaatatctaaacttggctgcagttgagagctaaacagtgtattgaaccagttaggagtttagttctctgtagaaaaccagaggcagtccagggctgatgtaggttttgttccacattctttaggatcctaggctccctccatccctggtatgtggtcctcattttcatatagaccaagagctagagctccagttaccatttcttaaagtatattttaatgccaaatagtgaataaaggtggccagaaaattcatgcacagaatccttctttttctcattttgtgctgattggtataaattttattgtatttgtagtctctggaaatcttctaactttgagaggacaaagatgaattcctagtcctgttttggatggtcttcaaatgatccttaagggcagttatttaaaatgtctttcttaactcacccaacctaggctgaccgaatgtagtctgtataaactagatggttaaagataaagaagcctatatatcagatgcatagacaaagaataaaatggcatccagaactggtccccacctattcccaatcctggttccacagcagaatacattcatagttcaggcattcttccttgagatagatataatgtaagtgaccaagtctcttggacaagtattgtctctgatcaatccctgccaaactcctttccttggttaactcaagtggttagatcttactccctgaacagaaggaatatgagaggtcaatacatgcctagactattcagtcctctgatattgctccacaccctttccctcaaaagccatgagacctttcaatggtcccagttcctctaccagaacaccagagatgcctgctttacatggacttatatattcccaagaatcacttggataaatgagtggtgctgctttcccgtggttggggaaaagctaggaacctgacaatgcagtgctcagaacctgctgaccggtactagttatgctgtcttgccatagtagtgcagttctttaaaatgttgatacttgctctcttatcaaaggttggtttttttgtttttttgtcaagacagggtctcactatgtcacccatactggagtacaatggtgtaatcttggcttactgcaacctccaccttctgggctcaagctggcctctcacctcagccttccaagtagctgggaccacacccagtcaattttttattttttattttttaatttatttttattattactttttttgtagagagagggtttcgccatgtagcccatgctggtcttgaactcctgggctcaagctgtctgcccacctggacctcccaaagtgctgagattacaggcatgagccaccgcacccagcccaaataaagttttaagaaattacttggccaggcatagtggggcctttgtagaaaaacatagcttttctatgagaagatgatcaatattttcttttcctttgaatttggaattaccattttggaactgttgtcaacaatgcataataatatatcagaatgcttcctagtatattattggagaaagaacaaacaaaagtttaaattgatataaaatgcatataatggaacaagcaaccctgcaaaaaaaaaaatatatatatatatataccatctgggaatttctgataataacattgaaatctgttcacacagtctaaaattcttttgatgtatcgtagttttgaaaaaaaggtaacagtttactatatataacaaatataaggaaaatattaaattttttgaaagatactagtttttatttttgttcattttttagagacagggtctcactatgttgcccaagctagagtgcagcggcccgattatagctcactgcagcctctaactcccggactcaagggatcctcccacctcatcctcctaactaggaccacaggcgcatgtcaccacatctggctgattttaaaatttttttgtggagacagtcttgctgtgttgcccaggctggttatgaactcttggcctcaggcagtcctcatgcctcagcctccctaagtgctcggattataggcatgccactgtgcctggccaaaaatacagattttttaatagatattactatggctcctattcttaaaggaaaaaatatgacattttaagactatatgcaagggatattccaataatatcttttttatttaaaaagccactaattagaatcagatttcattaggcaagtgaaatccagattttactagccagaaactgccaggtgtagaaacagcaagaacattttagtcacttcattgttgacatttttgactatcatagattaagtatcaaacacaataacagtattttgttatatgaaccaaatatatctctttttacgagacatagtctagctctgccatccaggctcaactcctgggttcaagggatcctcctgccccagcttcctgagtacgtacctgggagtacaattgcatgctgccacacccagctattttttttatttttgtggagatggcgtcttgctatgttgcccaggctggactccaactcctgacctcaagcaatcatctcaccttggcctcaaaagtgctaagattacaggcatgagccactgcatccagcctgaaccaaatatatctttattataacttaggagagaaacgtttttggctggttagttttacagaattaaacctaatggttgttctaatagcagttccaatgatttgcagatttgaggaagtaaattattttcttacagtgtccataaaagtaacaatgaaactatatcctaccataataatcctctataggtaataaattatttgcattttataggagagaaaaatatatgttaaagtttttgaacagtcacacaggcaggaaataaatggcagtgaatttgaacttggacttatcttggacaagctcttaactggtatatattttgtcaatcttatgtcgtgcacaagaatgatgtttttataaatggaaagaatgagtgtggaagtgtcttcacttgcctaacagaaaggttatatgtggctgggcgccgtggctaacgcctgtaatcccaacattttgggaggctgaggtgggcatatcatctgaggtcgggagttcaagaatagcctgaccaacatggagaaaccccgtctctactaaaaatacaaaattagccagtcatagtggcacatgcctgtaatcccagctacttggaaggctgaggcagaagaattgcttgaacccaggaggtggaggttgtggtgagccaagatcgcgccattgcactccatcctgggcaacaagagcgaaactccgtctcaaaaaaaaaaaaaaaaaaagtaatacataaatttaagtgacatttgtgggtactaaattacaataatatgttcagctttgcatttttttgcctttaaaattaatttcaattttagcgtgccactaaacgtattactgtaatagtatataaatgtataaagatcaatttctgtatattctaataggaattgtatataagcaaaaatgaattttagaaattatcctattattcatgtaattatgtcattcatgttatttaaaggaaaccacaatgcagacaggttaagtacctagtgtgaaggtatgtaaccaattaatggagctgtgcgacatacatctgagtaataaagactacagagaaagtatcttgttaggtactatctgatacaaagtttagaaacatgtcaaacaattctatgtatagttggtgaaagtgtaataacatggctgagacttaataccagatgaagttcagtggtttcagggggaggaaataatttttaaaacgatgtcgataacacttcacatttaaaatcatcataataattctaattctagaattgtgtctaattctaatactgtttctagctttgcttgaataaacagaaatgtagtagggaagaga

SEQ ID NO: 199695 - DNA, 2124 bp, Homo sapiens
  Payload ID: 19402
  Gene Name: WD repeat domain 13
  Uniprot ID: Q9H1Z4
  ENST ID: ENST00000218056
  CDS Start-End: 506-1963
ctttctgatagcaggcagccatcttgcctggagcctgagaaagggaggagagacagaaggaaccggcgacagtggtctcagggccgctccggggggcctcaagaaccggaggcagccccggaggtggtccccgatcccgggctatgctcttggatctgagaagggaaggcggagggcggcggggacaagatgggtggagaatgtcaagcaaggaatgctaggcgggggaggggcgttgctatggcgactggggaggggcggtgtctgttctgaatcgctgtgtgtcacccgggcgctgcccaggaagggcagggctggggtgatgaccatggtaacacccgggggggagttcgtgacatctccggcgcggagggactcgatgtctatggcaatggtcgcctggtggaagggacggaactagatcccttcgctcgggacgctcacattccaggcccttgtcctgcaggctgccgcgggcggacacgccagaggaggaggccggggaatggccgcggtgtggcagcaagtcttagcagtggacgcgaggtacaacgcgtaccgcacaccaacgtttccacagtttcggacgcagtatatccgccggcgcagccagctgctgcgggagaatgccaaggctgggcaccccccagcgctgcgtcggcagtacctgaggcttcgggggcagctgctgggccagcgctacgggcccctctccgagccaggcagtgctcgtgcctatagcaacagcatcgtccgcagtagccgcactactcttgaccgcatggaggactttgaggatgatcctcgggccctgggggcccgtgggcaccgtcgttctgtcagcagaggctcctaccagctgcaggcgcagatgaaccgtgccgtctatgaggacaggccccctggcagcgtggtgcccacgtcagcagcagaggcaagtcgggccatggccggggacacgtcactgagcgagaactatgcctttgcgggcatgtatcatgtttttgaccagcacgtggatgaggcagtcccaagggtgcgcttcgccaatgatgaccgacaccgcctggcctgctgctcactcgacggcagcatctccctgtgccagctggtgcctgccccacccacagtgcttcgcgtgctacggggccacacccgtggtgtctccgacttcgcctggtccctctccaatgacatcctcgtgtccacctcactggatgccaccatgcgcatctgggcctctgaggatggtcgctgcatccgagagatccctgaccccgatagcgctgaactgctctgctgcaccttccagcctgtcaacaacaacctcactgtggtggggaacgccaagcacaacgtgcatgtcatgaacatctccacaggcaagaaagtgaaggggggctccagcaagctgacaggccgtgtccttgctctgtcctttgatgcccctggccggctgctctgggcgggtgatgaccgtggcagtgtcttctctttcctctttgatatggccacagggaagctgaccaaagccaagcgtttggtggtgcatgaggggagccctgtgaccagcatctcagcccggtcctgggtcagccgcgaggcccgggatccctcactgctcatcaatgcttgcctcaacaagttgctgctctacagggtggtagacaacgaggggaccctgcagctgaagagaagcttccccatcgagcagagctcacatcctgtgcgcagcatcttctgtcccctcatgtccttccgccagggggcctgcgtggtgacgggcagtgaggacatgtgcgtgcacttctttgatgtggagcgggcggccaaggctgctgtcaacaagctgcagggccacagtgcacctgtgcttgatgtcagcttcaactgcgacgagagcctactggcctccagtgacgccagcggcatggtcatcgtctggaggcgggagcagaagtagggtcctgtcggccctgctgctgtcctccatcccacccctcttactccagcctcgtgttgtaaataaagtttcggtggtcatgctgagggccggctcccagctctgccggggacggacagggcagagggcagcgggcagctccaggaacacggtggaacggg

SEQ ID NO: 199696 - DNA, 5469 bp, Homo sapiens
  Payload ID: 19402
  Gene Name: WD repeat domain 13
  Uniprot ID: Q9H1Z4
  ENST ID: ENST00000376729
  CDS Start-End: 177-1634
tgggctcggcagttctttctgatagcaggcagccatcttgcctggagcctgagaaagggaggagagacagaaggaaccggcgacagtggtctcagggccgctccggggggcctcaagaaccggaggcagccccggaggctgccgcgggcggacacgccagaggaggaggccggggaatggccgcggtgtggcagcaagtcttagcagtggacgcgaggtacaacgcgtaccgcacaccaacgtttccacagtttcggacgcagtatatccgccggcgcagccagctgctgcgggagaatgccaaggctgggcaccccccagcgctgcgtcggcagtacctgaggcttcgggggcagctgctgggccagcgctacgggcccctctccgagccaggcagtgctcgtgcctatagcaacagcatcgtccgcagtagccgcactactcttgaccgcatggaggactttgaggatgatcctcgggccctgggggcccgtgggcaccgtcgttctgtcagcagaggctcctaccagctgcaggcgcagatgaaccgtgccgtctatgaggacaggccccctggcagcgtggtgcccacgtcagcagcagaggcaagtcgggccatggccggggacacgtcactgagcgagaactatgcctttgcgggcatgtatcatgtttttgaccagcacgtggatgaggcagtcccaagggtgcgcttcgccaatgatgaccgacaccgcctggcctgctgctcactcgacggcagcatctccctgtgccagctggtgcctgccccacccacagtgcttcgcgtgctacggggccacacccgtggtgtctccgacttcgcctggtccctctccaatgacatcctcgtgtccacctcactggatgccaccatgcgcatctgggcctctgaggatggtcgctgcatccgagagatccctgaccccgatagcgctgaactgctctgctgcaccttccagcctgtcaacaacaacctcactgtggtggggaacgccaagcacaacgtgcatgtcatgaacatctccacaggcaagaaagtgaaggggggctccagcaagctgacaggccgtgtccttgctctgtcctttgatgcccctggccggctgctctgggcgggtgatgaccgtggcagtgtcttctctttcctctttgatatggccacagggaagctgaccaaagccaagcgtttggtggtgcatgaggggagccctgtgaccagcatctcagcccggtcctgggtcagccgcgaggcccgggatccctcactgctcatcaatgcttgcctcaacaagttgctgctctacagggtggtagacaacgaggggaccctgcagctgaagagaagcttccccatcgagcagagctcacatcctgtgcgcagcatcttctgtcccctcatgtccttccgccagggggcctgcgtggtgacgggcagtgaggacatgtgcgtgcacttctttgatgtggagcgggcggccaaggctgctgtcaacaagctgcagggccacagtgcacctgtgcttgatgtcagcttcaactgcgacgagagcctactggcctccagtgacgccagcggcatggtcatcgtctggaggcgggagcagaagtagggtcctgtcggccctgctgctgtcctccatcccacccctcttactccagcctcgtgttgtaaataaagtttcggtggtcatgctgagggccggctcccagctctgccggggacggacagggcagagggcagcgggcagctccaggaacacggtggaacggggttcattgactcatttgtgcattcatgcatcgacggattcattcattccacaagcattgattgaatgtctgctgggttacaggccctgccttaactgttttacacacttatgcattcgatagacattagtgagccctgaccgtgtgccaggaactgttctaggcactggggatactgctctgacctaaactgatggaaatgcctgccttcattgggcttgcatcatagcggagacagtagataaaaacatggaacaggccagctaatgatgagtggtatgaagaaaataaagcaaggatgggagacagagctgcagaagttgggggagtgggctctttatggtgacagcatcagggaagatgatcctgacagggtgacttttttgtttttgagacagggtctcactctgtcacccaggttggaatgcagtggcatgaccatagctcactgcagcctcaacctccagggctcaagtgatcctcacttaagcctcccaagtagctgggactacaggtgtgtgccaccacactcgggtaatttttgtatttttagtagagacggggtctcgccatgttgctcaggctggtcttgaactcctgggctcaagcgatccactcgcctcagcctcccaaagtgctgggattacaggcatgaaccaccacgcctggctcagggtgacatttaaagacctgaatgaagtgagtgggagtcatagtgtagggggagaacattccaggcagagagaaagccagcctaaaggcactgaggctggagcgctccagaaggatcattgtgtatgccagagtcttgctggaccagagtgtgacagtacatgaggtcagacaggccagatgcttcatgggccacagttaggactttggctttttttctgagtgggggtgaccagaaggtgtcaagcagaggaggaacatgatctgacttggtcatagaggctccctctggctgctgaaggggacagattgggggtgggggtagaagcaggggacccagcaggagacccctctgagcgcagtgatggggacttgcaccagggtagtgacagtggaggagttggcgggggaatgttgggtcggacccccagggggttcactatgttaggctgcaggactctgctgcctcctcagggggcgatattcccaacccttctgtgcattgtgttgtttattaaaagcagggagcagaggtgttgagtcctggagccccaagctggtgcaggagcaacgggaagttaaggctgacctggggcctcctgctgtgtggcggaatctccatccctcagaccacccctgtctcctcccagccccatccagggtacaaattccagccctggaacagctcagagaccaaaaagtgatgttaagtatttgaggggagccccaagagaggagaaaaagctttgagtattgatgggggtaaataaccaaaatcacttatcagtggcctgcgtcaccagaaaatgtcaaagttacctgaagcagcaaagaggctcttgctccggcccctcccttccttctcagctccatttgttgccacatatgcgttgactggaactgcgactgacatcttgggaccttagggtcagtccacagcgtggtagagactccagcttggcccagcattgctgagctgctgaactcgcaccaacagtcttgttggagggaaataatctcccgtttgttcagtccagttatttgacagtgtggttacttgcaccccaagcatttctaactggcacttccatctaatagacctcagggtacatggtggtgagatagggacatcagtgagctggattgttcccatggtaaaggtcatgtatgtgtgtgtgtgtcatggtcctcaataccagccccaagcccagtgatttgctaggaggactcccaagactcagtatgtggttgtattcatggctacgattgacttattacaacaaaaagatatggagcaaaatcagcaaaaagaaatggtgtgcaggaccaactcccagagagacccaggcacaagtttccagggcttctctctcattggagtcacacaagatgtgctcggttcacagtaatgggttgtgacaatacatgcgaaatgttgctgaccaaggaagctcaattagagactcagcacccagaggttttttttgttgttgttgttgttttggtttttttttggcgggggggggggggtcttgctctgacgcccaggctggaatgcagtggcatgatcttggctcactgcagcctccacctcctgggttcaagcgatcctcgggcctcagcttcccgaatagctggaactacaggcgcgcaccagcaagctcggctaatttttgtatttttagtagggatggggtttcaccatgttggccaggctgatcttgaactcctgacctcaagtgatcctcccacctcagcctcccaaactgctgggattacaggcgtgagcacctggctggtatcaagtttttattggggcatggtcacataggcaccccctgcctggcacctacccaaatcccaggctcccaaaaggaaagcaggggctcagcataaaccacctttttttttttttttttaattgagacggagtctcgctttgtcgccaggctggagtgcagtggcgtgatctcggcttactgtaacctccgcctcctgggttcaagcaattctcctgcctcagcttcctgaatagctgggactacaggcgcctgccaccaccacgcccagctaatttttgtatttttagtagagacggggtttcaccatattggccaggctggtctccatctcttgaccttgtgatccgcctgcctcgacctcccaaagtgctgggattacaggcatgagccaccgctcctggcccacttttttatacaaacagcttaggtagagtaagccattcttttttttctttctttctttttttttttttttgagacagggtctcactttgttgcccaggctggagtgcagtggctcaaacatggttcgctgcagcctcaacctcccaggctcaagcggtcctgctgcctcatcctccaaagtagctgggaccacagacatgcaccaccatgaccccagctgatttttgcagagatgggttttgccatgttgcccaggctggccttgaactcctgggctcaagtgatcctctcaccttggcctaccaaagtgctggcgttacaggtgtgagccaccacacccggcccgagtgagccattcttatctcttagggaatggtgggaaccctcctggagtctatgttcttagacaccacccaagggccaaccttgaagcaggcctttccaaggatcgcagttgaggcctgctctgttactgtttttctgcacagtgtgcaacaccacacagatgcccagtttctaccaaggtctgtggatggcaggataattttgaggaacctcctttttcgctaacactttcttcttttgtttacactcttcacattgtctattgagtctggattcaagatgattgattgtgaatattgttgtgcatgattttgggggtttcctccttgtgaaattttgaggtggcagatttgacattctactttaaactcatcttggtggcacttttcttgactcaccacctaagggggaataaataatgaagaaagaataaaaatagtgttatcagtca

SEQ ID NO: 199697 - DNA, 437 bp, Homo sapiens
  Payload ID: 19402
  Gene Name: WD repeat domain 13
  ENST ID: ENST00000470124
  CDS Start-End: 115-437
ctatctaccaaggagcctgttgtgagacagttttctccccacctcctgaggttctggtggggtttgaggctttctacccctcacctctgggctatagaactgcttagctgcagcatgaaattagctcctcagcaacaaggtgtcctgccacctggtgtgtggtcatctcgcccctttcatttcggtgttgcccggcacaagggacatgaaccagaatctgtggatgttcttgctttcgtggtccacgctgccgcgggcggacacgccagaggaggaggccggggaatggccgcggtgtggcagcaagtcttagcagtggacgcgaggtacaacgcgtaccgcacaccaacgtttccacagtttcggacgcagtatatccgccggcgcagccagctgctgcgggagaatgccaaggctgggcaccccccagcgctgcg

SEQ ID NO: 199698 - DNA, 936 bp, Homo sapiens
  Payload ID: 19402
  Gene Name: WD repeat domain 13
  ENST ID: ENST00000486125
  CDS Start-End: 483-614
ttgcctggagcctgagaaagggaggagagacagaaggaaccggcgacagtggtctcagggccgctccggggggcctcaagaaccggaggcagccccggaggtggtccccgatcccgggctatgctcttggatctgagaagggaaggcggagggcggcggggacaagatgggtggagaatgtcaagcaaggaatgctaggcgggggaggggcgttgctatggcgactggggaggggcggtgtctgttctgaatcgctgtgtgtcacccgggcgctgcccaggaagggcagggctggggtgatgaccatggtaacacccgggggggagttcgtgacatctccggcgcggagggactcgatgtctatggcaatggtcgcctggtggaagggacggaactagatcccttcgctcgggacgctcacattccaggcccttgtcctgcaggctgccgcgggcggacacgccagaggaggaggccggggaatggccgcggtgtggcagcaagtcttagcagtggacgcgagtttcggacgcagtatatccgccggcgcagccagctgctgcgggagaatgccaaggctgggcaccccccagcgctgcgtcggcagtacctgaggcttcgggggcagctgctgggccagcgctacgggcccctctccgagccaggcagtgctcgtgcctatagcaacagcatcgtccgcagtagccgcactactcttgaccgcatggaggactttgaggatgatcctcgggccctgggggcccgtgggcaccgtcgttctgtcagcagaggctcctaccagctgcaggcgcagatgaaccgtgccgtctatgaggacaggccccctggcagcgtggtgcccacgtcagcagcagaggcaagtcgggccatggccggggacacgtcactgagcgagaactatgcctttgcgggcat

SEQ ID NO: 199699 - DNA, 562 bp, Homo sapiens
  Payload ID: 19402
  Gene Name: WD repeat domain 13
  ENST ID: ENST00000482760
  CDS Start-End: 1-562
ctgctctgctgcaccttccagcctgtcaacaacaacctcactgtggtcaggctccaggacacccactcaccaagggtggggaacgccaagcacaacgtgcatgtcatgaacatctccacaggcaagaaagtgaaggggggctccagcaagctgacaggccgtgtccttgctctgtcctttgatgcccctggccggctgctctgggcgggtgatgaccgtggcagtgtcttctctttcctctttgatatggccacagggaagctgaccaaagccaagcgtttggtggtgcatgaggggagccctgtgaccagcatctcagcccggtcctgggtcagccgcgaggcccgggatccctcactgctcatcaatgcttgcctcaacaagttgctgctctacagggtggtagacaacgaggggaccctgcagctgaagagaagcttccccatcgagcagagctcacatcctgtgcgcagcatcttctgtcccctcatgtccttccgccagggggcctgcgtggtgacgggcagtgaggacatgtgcgtgcacttctttgatgtggagc

SEQ ID NO: 199700 - DNA, 859 bp, Homo sapiens
  Payload ID: 19402
  Gene Name: WD repeat domain 13
  ENST ID: ENST00000498631
  CDS Start-End: 148-279
cagccatcttgcctggagcctgagaaagggaggagagacagaaggaaccggcgacagtggtctcagggccgctccggggggcctcaagaaccggaggcagccccggaggctgccgcgggcggacacgccagaggaggaggccggggaatggccgcggtgtggcagcaagtcttagcagtggacgcgagtttcggacgcagtatatccgccggcgcagccagctgctgcgggagaatgccaaggctgggcaccccccagcgctgcgtcggcagtacctgaggcttcgggggcagctgctgggccagcgctacgggcccctctccgagccaggcagtgctcgtgcctatagcaacagcatcgtccgcagtagccgcactactcttgaccgcatggaggactttgaggatgatcctcgggccctgggggcccgtgggcaccgtcgttctgtcagcagaggctcctaccagctgcaggcgcagatgaaccgtgccgtctatgaggacaggccccctggcagcgtggtgcccacgtcagcagcagaggcaagtcgggccatggccggggacacgtcactgagcgagaactatgcctttgcgggcatgtatcatgtttttgaccagcacgtggatgaggcagtcccaagggtgcgcttcgccaatgatgaccgacaccgcctggcctgctgctcactcgacggcagcatctccctgtgccagctggtgcctgccccacccacagtgcttcgcgtgctacggggccacacccgtggtgtctccgacttcgcctggtccctctccaatgacatcctcgtgtccacctcactggatgccaccatgcgcatctgggcctctgaggatgg

SEQ ID NO: 199701 - DNA, 4705 bp, Homo sapiens
  Payload ID: 19403
  Gene Name: WD repeat domain 17
  Uniprot ID: Q8IZU2
  ENST ID: ENST00000280190
  CDS Start-End: 157-4125
gcggggagggtccgcgcgttggtggtgctcgcctcgcagctgcgcccgccggcttcagcaccttccgctgtccgccgctgcagccgcctcctcctccaggtgctgactattctgatgccgagtttccaattgccttgattaaagtagaaacattctatggcttggatgacttacatttcaaattggtttgagcaagatgattggtatgaaggactacaaagagcaaacatgtcccaggtaaggcaagtgggattgctggctgctggatgtcagccatggaacaaggatgtatgtgctgccagtggagacaggtttgcatattgtgcgaccctggctatctatatttatcagttggatcaccgttataatgaattcaaacttcacgcaattatgtctgaacataaaaaaacaatcacagcaatttcttggtgtccacataatcctgatctgtttgcaagtggcagtactgataatttagtgatcatttggaatgttgcagaacaaaaagtcattgctaaactcgacagtacaaaagggatccctgcttctcttagttggtgctggaatgcagaggatgtggtggcatttgtttcccacagaggcccactgttcatttggaccatctcaggaccagatagtggagtgattgtacacaaagatgctcatagcttcttgtctgatatctgtatgttcagatggcatacacaccaaaaggggaaagttgtgtttggtcatattgatggaagtctatcaatttttcatccaggtaataaaaatcagaaacatgttttgagaccagaatctcttgaagggacagatgaagaggatccagttacggccttggaatgggacccactatctactgattatcttctagtggttaatttgcattatggaattcgcctggtagattctgaatcactttcttgcataacaacatttaatcttcccagtgcagcagcttctgtacagtgcttagcctgggttcccagtgctcctgggatgtttataactggagattctcaagtgggtgttttacgcatttggaatgtttcaagaacaacacctattgataatcttaaattaaagaaaacaggatttcactgcttacatgtacttaattctcctccaagaaaaaagttttcagtccaatctccaaccaaaaatcattatacatcctcaacaagcgaagcagttccacccccaactttaacacagaatcaagcattttctcttcctcctggtcatgcagtgtgttgtttcttggatggtggagttggactttatgatatgggagctaagaagtgggattttcttagagacttgggacatgtggaaactatctttgactgcaaattcaaacctgacgatcctaatcttttagcaacagcttcatttgatggcactataaaagtctgggatataaacacattaacagcagtgtacacatccccgggtaatgaaggtgttatttattccctttcttgggctccaggtggtttaaattgtattgctgggggaacttcccgaaatggtgcttttatttggaatgttcaaaagggcaaaattatacaacgatttaatgagcatggaacaaatggaatattctgcattgcctggagtcataaagattctaaaagaatagcaacctgcagcagtgatggtttctgtattattcgaacaattgatggtaaagtgctacacaaatataaacatccagctgcagtgtttggttgtgattggagccaaaacaataaagacatgatagccactggctgtgaagacacaaatgttcgtgtttattatgtagccaccagctcagatcaaccattgaaagtatttagtgggcatacagcaaaagtgtttcatgttaaatggtctcctctgagagagggaattctttgcagtggttctgatgatggtaccgttcgaatctgggattatactcaggatgcttgcatcaatattcttaatggacacactgcacctgtgagaggattaatgtggaatactgagattccatatctgctcatatctggcagctgggactatactataaaagtatgggacactcgagaaggaacttgtgtggatactgtgtatgatcacggtgcagatgtatatggtttaacctgccatcccagtcgccccttcactatggcctcttgctcccgtgactctacagtgagactctggtcattaacagccttagtcactcctgtacaaataaatattctggcagacagatcttgggaagaaattattgggaacactgattatgctatagaaccaggcactcctcctctactgtgtggtaaagtgtcaagagatattagacaggaaatagaaaaactaactgctaattctcaagtgaaaaaactaagatggttctcagaatgtttatctcctccaggtggcagtgacaatttatggaacttggttgctgtgataaaaggacaggatgatagcttacttcctcagaactactgcaaaggaataatgcacttgaaacatctgattaaatttagaacatctgaagctcaagaactaacaacagtcaagatgtctaaatttggtggtggtattggtgtacctgctaaagaggaaagactgaaggaagctgctgaaatccacttgagattaggacaaattcagagatactgtgaacttatggttgaacttggagagtgggacaaagccctgtcaattgcaccaggagtctctgtgaaatactggaagaagttaatgcagaggagagctgaccaattaatccaggaagataaggatgatgtcattccatactgcatagccattggtgatgtgaaaaagctagtccattttttcatgtcaagaggtcagcttaaagaagctctgcttgttgcacaggctgcttgtgaaggaaatatgcagcccttacatgtttccgtgcctaaaggagcttcatattctgatgatatctacaaggaagactttaatgaactcctgcacaaagtcagtaaagaactggcagaatggtattttcaagatggtcgagcagtactagccgcatgttgccatcttgccatagataatattgagcttgctatggcatacctgattcgcggaaatgaactggagttggcagtctgtgtgggcacagtactaggagagtctgcagcaccagcaacccactatgccttagaattactggcgagaaagtgcatgatgatttcagtatgctttccatgtgttggatacagtgtccccttttgttacgttaacaggaatttggcagctgatcttcttctgatgattcctgataatgaactacatttaataaaactctgtgctttctacccaggatgtactgaagagataaatgaccttcatgataagtgtaagctacccacagtggaagaatgtatgcagttagctgagacagcccgtgcagatgacaatatatttgaaactgtaaaatattacttgttaagtcaagaacctgaaaaagcccttcctattggtattagctttgttaaagaatacatcagtagctcagactggactttggataccatataccctgttcttgacctactgagctatattcgtactgaaaaattactcttgcatacgtgtactgaagctcgaaatgagttgctgatattatgtggttacattggtgcattactggctatcagaagacagtaccaaagcattgttccagcactttatgagtacacaagtcagctattaaaacgtcgggaggtgtcagtacctttaaaaattgaatatctttctgaggaattggatgcatggagagcttgcacacagtccaccaacagatcattagaagactctccgtatacacccccttctgattcacaaagaatgatttatgcaactttattaaagagactaaaagaagagtcactgaaaggaattattggaccagattatgtgactggatcaaatcttccaagtcattctgatattcacatttcttgtcttacgggattaaaaatccagggccctgtgtttttccttgaagacgggaaatctgctatctccttgaatgatgctttgatgtgggcaaaggtgaatccattctcacctttagggactggaatacgactcaatccattctgatagaagatttttgtccatgcttgatttttttttttaaagaaaaactttcatgggttagcattaccttaatctttgttgctcaagtgccagaggttgggagaaggattgcaggttgggagaggtgggaaatagcagtgaattttagtcattaacttcaaaatatatatatatatataatttaaaggaaaaataggtgcctcctttataaacagtaatagctacgtttgggaaggaggaaacatttaaattataaaggactgaataatctaaaaagcatataaaagtttcacacagcataaaagataccaaaatatcatatggttgaaatattgaaacatattaaattgtgcaacacctagaatagtgctagacatacagtaagtacttaatggatatttgaatgattgaatatcttgaaatgttgaaatgtaaggtgtgcacagtgatcttcaacttaacaaacacttacgttctcctttataaaatgcatagtaaaccactaacgttagctgttttaataaaagttttcagttataagtttagtaaatattaataaatggatacacattcaaaatacttt

SEQ ID NO: 199702 - DNA, 4119 bp, Homo sapiens
  Payload ID: 19403
  Gene Name: WD repeat domain 17
  ENST ID: ENST00000507824
  CDS Start-End: 36-3929
gtttccaattgccttgattaaagtagaaacattctatggcttggatgacttacatttcaaattggtttgagcaagatgattggtatgaaggactacaaagagcaaacatgtcccaggtaaggcaagtgggattgctggctgctggatgtcagccatggaacaaggatgtatgtgctgccagtggagacaggtttgcatattgtgcgaccctggctatctatatttatcagttggatcaccgttataatgaattcaaacttcacgcaattatgtctgaacataaaaaaacaatcacagcaatttcttggtgtccacataatcctgatctgtttgcaagtggcagtactgataatttagtgatcatttggaatgttgcagaacaaaaagtcattgctaaactcgacagtacaaaagggatccctgcttctcttagttggtgctggaatgcagaggatgtggtggcatttgtttcccacagaggcccactgttcatttggaccatctcaggaccagatagtggagtgattgtacacaaagatgctcatagcttcttgtctgatatctgtatgttcagatggcatacacaccaaaaggggaaagttgtgtttggtcatattgatggaagtctatcaatttttcatccagatgaagaggatccagttacggccttggaatgggacccactatctactgattatcttctagtggttaatttgcattatggaattcgcctggtagattctgaatcactttcttgcataacaacatttaatcttcccagtgcagcagcttctgtacagtgcttagcctgggttcccagtgctcctgggatgtttataactggagattctcaagtgggtgttttacgcatttggaatgtttcaagaacaacacctattgataatcttaaattaaagaaaacaggatttcactgcttacatgtacttaattctcctccaagaaaaaagttttcagtccaatctccaaccaaaaatcattatacatcctcaacaagcgaagcagttccacccccaactttaacacagaatcaagcattttctcttcctcctggtcatgcagtgtgttgtttcttggatggtggagttggactttatgatatgggagctaagaagtgggattttcttagagacttgggacatgtggaaactatctttgactgcaaattcaaacctgacgatcctaatcttttagcaacagcttcatttgatggcactataaaagtctgggatataaacacattaacagcagtgtacacatccccgggtaatgaaggtgttatttattccctttcttgggctccaggtggtttaaattgtattgctgggggaacttcccgaaatggtgcttttatttggaatgttcaaaagggcaaaattatacaacgatttaatgagcatggaacaaatggaatattctgcattgcctggagtcataaagattctaaaagaatagcaacctgcagcagtgatggtttctgtattattcgaacaattgatggtaaagtgctacacaaatataaacatccagctgcagtgtttggttgtgattggagccaaaacaataaagacatgatagccactggctgtgaagacacaaatgttcgtgtttattatgtagccaccagctcagatcaaccattgaaagtatttagtgggcatacagcaaaagtgtttcatgttaaatggtctcctctgagagagggaattctttgcagtggttctgatgatggtaccgttcgaatctgggattatactcaggatgcttgcatcaatattcttaatggacacactgcacctgtgagaggattaatgtggaatactgagattccatatctgctcatatctggcagctgggactatactataaaagtatgggacactcgagaaggaacttgtgtggatactgtgtatgatcacggtgcagatgtatatggtttaacctgccatcccagtcgccccttcactatggcctcttgctcccgtgactctacagtgagactctggtcattaacagccttagtcactcctgtacaaataaatattctggcagacagatcttgggaagaaattattgggaacactgattatgctatagaaccaggcactcctcctctactgtgtggtaaagtgtcaagagatattagacaggaaatagaaaaactaactgctaattctcaagtgaaaaaactaagatggttctcagaatgtttatctcctccaggtggcagtgacaatttatggaacttggttgctgtgataaaaggacaggatgatagcttacttcctcagaactactgcaaaggaataatgcacttgaaacatctgattaaatttagaacatctgaagctcaagaactaacaacagtcaagatgtctaaatttggtggtggtattggtgtacctgctaaagaggaaagactgaaggaagctgctgaaatccacttgagattaggacaaattcagagatactgtgaacttatggttgaacttggagagtgggacaaagccctgtcaattgcaccaggagtctctgtgaaatactggaagaagttaatgcagaggagagctgaccaattaatccaggaagataaggatgatgtcattccatactgcatagccattggtgatgtgaaaaagctagtccattttttcatgtcaagaggtcagcttaaagaagctctgcttgttgcacaggctgcttgtgaaggaaatatgcagcccttacatgtttccgtgcctaaaggagcttcatattctgatgatatctacaaggaagactttaatgaactcctgcacaaagtcagtaaagaactggcagaatggtattttcaagatggtcgagcagtactagccgcatgttgccatcttgccatagataatattgagcttgctatggcatacctgattcgcggaaatgaactggagttggcagtctgtgtgggcacagtactaggagagtctgcagcaccagcaacccactatgccttagaattactggcgagaaagtgcatgatgatttcagtatgctttccatgtgttggatacaggaatttggcagctgatcttcttctgatgattcctgataatgaactacatttaataaaactctgtgctttctacccaggatgtactgaagagataaatgaccttcatgataagtgtaagctacccacagtggaagaatgtatgcagttagctgagacagcccgtgcagatgacaatatatttgaaactgtaaaatattacttgttaagtcaagaacctgaaaaagcccttcctattggtattagctttgttaaagaatacatcagtagctcagactggactttggataccatataccctgttcttgacctactgagctatattcgtactgaaaaattactcttgcatacgtgtactgaagctcgaaatgagttgctgatattatgtggttacattggtgcattactggctatcagaagacagtaccaaagcattgttccagcactttatgagtacacaagtcagctattaaaacgtcgggaggtgtcagtacctttaaaaattgaatatctttctgaggaattggatgcatggagagcttgcacacagtccaccaacagatcattagaagactctccgtatacacccccttctgattcacaaagaatgatttatgcaactttattaaagagactaaaagaagagtcactgaaaggaattattggaccagattatgtgactggatcaaatcttccaagtcattctgatattcacatttcttgtcttacgggattaaaaatccagggccctgtgtttttccttgaagacgggaaatctgctatctccttgaatgatgctttgatgtgggcaaaggtgaatccattctcacctttagggactggaatacgactcaatccattctgatagaagatttttgtccatgcttgatttttttttttaaagaaaaactttcatgggttagcattaccttaatctttgttgctcaagtgccagaggttgggagaaggattgcaggttgggagaggtgggaaatagcagtgaattttagtcattaacttcaaaatatatatatatatataatttaaaggaaaaa

SEQ ID NO: 199703 - DNA, 4294 bp, Homo sapiens
  Payload ID: 19403
  Gene Name: WD repeat domain 17
  Uniprot ID: Q8IZU2
  ENST ID: ENST00000508596
  CDS Start-End: 253-4104
gcctctggggcagaccctggagatcgggctcgcggcgccttccatcgtggctccgcgctggggcttgcggagcacgcttcccgcccctcggagcccgcgggcccggccgccccgcccccgggcgccctgagcgagcaggcggggagggcggggagggtccgcgcgttggtggtgctcgcctcgcagctgcgcccgccggcttcagcaccttccgctgtccgccgctgcagccgcctcctcctccaggcaaacatgtcccaggtaaggcaagtgggattgctggctgctggatgtcagccatggaacaaggatgtatgtgctgccagtggagacaggtttgcatattgtgcgaccctggctatctatatttatcagttggatcaccgttataatgaattcaaacttcacgcaattatgtctgaacataaaaaaacaatcacagcaatttcttggtgtccacataatcctgatctgtttgcaagtggcagtactgataatttagtgatcatttggaatgttgcagaacaaaaagtcattgctaaactcgacagtacaaaagggatccctgcttctcttagttggtgctggaatgcagaggatgtggtggcatttgtttcccacagaggcccactgttcatttggaccatctcaggaccagatagtggagtgattgtacacaaagatgctcatagcttcttgtctgatatctgtatgttcagatggcatacacaccaaaaggggaaagttgtgtttggtcatattgatggaagtctatcaatttttcatccaggtaataaaaatcagaaacatgttttgagaccagaatctcttgaagggacagatgaagaggatccagttacggccttggaatgggacccactatctactgattatcttctagtggttaatttgcattatggaattcgcctggtagattctgaatcactttcttgcataacaacatttaatcttcccagtgcagcagcttctgtacagtgcttagcctgggttcccagtgctcctgggatgtttataactggagattctcaagtgggtgttttacgcatttggaatgtttcaagaacaacacctattgataatcttaaattaaagaaaacaggatttcactgcttacatgtacttaattctcctccaagaaaaaagttttcagtccaatctccaaccaaaaatcattatacatcctcaacaagcgaagcagttccacccccaactttaacacagaatcaagcattttctcttcctcctggtcatgcagtgtgttgtttcttggatggtggagttggactttatgatatgggagctaagaagtgggattttcttagagacttgggacatgtggaaactatctttgactgcaaattcaaacctgacgatcctaatcttttagcaacagcttcatttgatggcactataaaagtctgggatataaacacattaacagcagtgtacacatccccgggtaatgaaggtgttatttattccctttcttgggctccaggtggtttaaattgtattgctgggggaacttcccgaaatggtgcttttatttggaatgttcaaaagggcaaaattatacaacgatttaatgagcatggaacaaatggaatattctgcattgcctggagtcataaagattctaaaagaatagcaacctgcagcagtgatggtttctgtattattcgaacaattgatggtaaagtgctacacaaatataaacatccagctgcagtgtttggttgtgattggagccaaaacaataaagacatgatagccactggctgtgaagacacaaatgttcgtgtttattatgtagccaccagctcagatcaaccattgaaagtatttagtgggcatacagcaaaagtgtttcatgttaaatggtctcctctgagagagggaattctttgcagtggttctgatgatggtaccgttcgaatctgggattatactcaggatgcttgcatcaatattcttaatggacacactgcacctgtgagaggattaatgtggaatactgagattccatatctgctcatatctggcagctgggactatactataaaagtatgggacactcgagaaggaacttgtgtggatactgtgtatgatcacggtgcagatgtatatggtttaacctgccatcccagtcgccccttcactatggcctcttgctcccgtgactctacagtgagactctggtcattaacagccttagtcactcctgtacaaataaatattctggcagacagatcttgggaagaaattattgggaacactgattatgctatagaaccaggcactcctcctctactgtgtggtaaagtgtcaagagatattagacaggaaatagaaaaactaactgctaattctcaagtgaaaaaactaagatggttctcagaatgtttatctcctccaggtggcagtgacaatttatggaacttggttgctgtgataaaaggacaggatgatagcttacttcctcagaactactgcaaaggaataatgcacttgaaacatctgattaaatttagaacatctgaagctcaagaactaacaacagtcaagatgtctaaatttggtggtggtattggtgtacctgctaaagaggaaagactgaaggaagctgctgaaatccacttgagattaggacaaattcagagatactgtgaacttatggttgaacttggagagtgggacaaagccctgtcaattgcaccaggagtctctgtgaaatactggaagaagttaatgcagaggagagctgaccaattaatccaggaagataaggatgatgtcattccatactgcatagccattggtgatgtgaaaaagctagtccattttttcatgtcaagaggtcagcttaaagaagctctgcttgttgcacaggctgcttgtgaaggaaatatgcagcccttacatgtttccgtgcctaaaggagcttcatattctgatgatatctacaaggaagactttaatgaactcctgcacaaagtcagtaaagaactggcagaatggtattttcaagatggtcgagcagtactagccgcatgttgccatcttgccatagataatattgagcttgctatggcatacctgattcgcggaaatgaactggagttggcagtctgtgtgggcacagtactaggagagtctgcagcaccagcaacccactatgccttagaattactggcgagaaagtgcatgatgatttcagtatggaatttggcagctgatcttcttctgatgattcctgataatgaactacatttaataaaactctgtgctttctacccaggatgtactgaagagataaatgaccttcatgataagtgtaagctacccacagtggaagaatgtatgcagttagctgagacagcccgtgcagatgacaatatatttgaaactgtaaaatattacttgttaagtcaagaacctgaaaaagcccttcctattggtattagctttgttaaagaatacatcagtagctcagactggactttggataccatataccctgttcttgacctactgagctatattcgtactgaaaaattactcttgcatacgtgtactgaagctcgaaatgagttgctgatattatgtggttacattggtgcattactggctatcagaagacagtaccaaagcattgttccagcactttatgagtacacaagtcagctattaaaacgtcgggaggtgtcagtacctttaaaaattgaatatctttctgaggaattggatgcatggagagcttgcacacagtccaccaacagatcattagaagactctccgtatacacccccttctgattcacaaagaatgatttatgcaactttattaaagagactaaaagaagagtcactgaaaggaattattggaccagattatgtgactggatcaaatcttccaagtcattctgatattcacatttcttgtcttacgggattaaaaatccagggccctgtgtttttccttgaagacgggaaatctgctatctccttgaatgatgctttgatgtgggcaaaggtgaatccattctcacctttagggactggaatacgactcaatccattctgatagaagatttttgtccatgcttgatttttttttttaaagaaaaactttcatgggttagcattaccttaatctttgttgctcaagtgccagaggttgggagaaggattgcaggttgggagaggtgggaaatagcagtgaattttagtcattaacttcaaaatatatatatatatataatttaaaggaaaaa

SEQ ID NO: 199704 - DNA, 677 bp, Homo sapiens
  Payload ID: 19403
  Gene Name: WD repeat domain 17
  ENST ID: ENST00000505894
  CDS Start-End: 1-677
ggatccctgcttctcttagttggtgctggaatgcagaggatgtggtggcatttgtttcccacagaggcccactgttcatttggaccatctcaggaccagatagtggagtgattgtacacaaagatgctcatagcttcttgtctgatatctgtatgttcagatggcatacacaccaaaaggggaaagttgtgtttggtcatattgatggaagtctatcaatttttcatccagtttcagtccaatctccaaccaaaaatcattatacatcctcaacaagcgaagcagttccacccccaactttaacacagaatcaagcattttctcttcctcctggtcatgcagtgtgttgtttcttggatggtggagttggactttatgatatgggagctaagaagtgggattttcttagagacttgggacatgtggaaactatctttgactgcaaattcaaacctgacgatcctaatcttttagcaacagcttcatttgatggcactataaaagtctgggatataaacacattaacagcagtgtacacatccccgggtaatgaaggtgttatttattccctttcttgggctccaggtggtttaaattgtattgctgggggaacttcccgaaatggtgcttttatttggaatgttcaaaagggcaaaattatacaacgatttaatgag

SEQ ID NO: 199705 - DNA, 4911 bp, Homo sapiens
  Payload ID: 19403
  Gene Name: WD repeat domain 17
  ENST ID: ENST00000443118
  CDS Start-End: 1-1672
atggaacttggttgctgtgataaaaggacaggatgatagcttacttcctcagaactactgcaaaggaataatgcacttgaaacatctgattaaatttagaacatctgaagctcaagaactaacaacagtcaagatgtctaaatttggtggtggtattggtgtacctgctaaagaggaaagactgaaggaagctgctgaaatccacttgagattaggacaaattcagagatactgtgaacttatggttgaacttggagagtgggacaaagccctgtcaattgcaccaggagtctctgtgaaatactggaagaagttaatgcagaggagagctgaccaattaatccaggaagataaggatgatgtcattccatactgcatagccattggtgatgtgaaaaagctagtccattttttcatgtcaagaggtcagcttaaagaagctctgcttgttgcacaggctgcttgtgaaggaaatatgcagcccttacatgtttccgtgcctaaaggagcttcatattctgatgatatctacaaggaagactttaatgaactcctgcacaaagtcagtaaagaactggcagaatggtattttcaagatggtcgagcagtactagccgcatgttgccatcttgccatagataatattgagcttgctatggcatacctgattcgcggaaatgaactggagttggcagtctgtgtgggcacagtactaggagagtctgcagcaccagcaacccactatgccttagaattactggcgagaaagtgcatgatgatttcagtatgctttccatgtgttggatacaggaatttggcagctgatcttcttctgatgattcctgataatgaactacatttaataaaactctgtgctttctacccaggatgtactgaagagataaatgaccttcatgataagtgtaagctacccacagtggaagaatgtatgcagttagctgagacagcccgtgcagatgacaatatatttgaaactgtaaaatattacttgttaagtcaagaacctgaaaaagcccttcctattggtattagctttgttaaagaatacatcagtagctcagactggactttggataccatataccctgttcttgacctactgagctatattcgtactgaaaaattactcttgcatacgtgtactgaagctcgaaatgagttgctgatattatgtggttacattggtgcattactggctatcagaagacagtaccaaagcattgttccagcactttatgagtacacaagtcagctattaaaacgtcgggaggtgtcagtacctttaaaaattgaatatctttctgaggaattggatgcatggagagcttgcacacagtccaccaacagatcattagaagactctccgtatacacccccttctgattcacaaagaatgatttatgcaactttattaaagagactaaaagaagagtcactgaaaggaattattggaccagattatgtgactggatcaaatcttccaagtcattctgatattcacatttcttgtcttacgggattaaaaatccagggccctgtgtttttccttgaagacgggaaatctgctatctccttgaatgatgctttgatgtgggcaaaggtgaatccattctcacctttagggactggaatacgactcaatccattctgatagaagatttttgtccatgcttgatttttttttttaaagaaaaactttcatgggttagcattaccttaatctttgttgctcaagtgccagaggttgggagaaggattgcaggttgggagaggtgggaaatagcagtgaattttagtcattaacttcaaaatatatatatatatataatttaaaggaaaaataggtgcctcctttataaacagtaatagctacgtttgggaaggaggaaacatttaaattataaaggactgaataatctaaaaagcatataaaagtttcacacagcataaaagataccaaaatatcatatggttgaaatattgaaacatattaaattgtgcaacacctagaatagtgctagacatacagtaagtacttaatggatatttgaatgattgaatatcttgaaatgttgaaatgtaaggtgtgcacagtgatcttcaacttaacaaacacttacgttctcctttataaaatgcatagtaaaccactaacgttagctgttttaataaaagttttcagttataagtttagtaaatattaataaatggatacacattcaaaatacttttaaaaaaaagaaaatgttaccagtttttttatctgaagtttaactgtcccattgtaaaggtgtaagttatataggcttgaaaaaaattggcgggtaaaaatcacaaaatgcagtcgaatatatatatgaaaacttgcattaggtgataaagtgactattttaagagattcagcatgcatggatattagttttgattaatgtgtacaataatttacacagtatactctagtcaatttatgttaactttatttaaaacacaatttatttggccgggcacggtggctcacacctgtaatctcagcactttggcaggccaaggcaggtggatcacctgaggtcaggagttcatgaccagcctggccagcatggtaaaaccctgtctccactaaaaatacaaaaattagccaggcatggtggcgggcacctgtaatcccagttacttgggaagctgaggcaggagaatcccttgaacctgggaggcagaggttccagtgagccaagatcgcaccactgcactccagcctgggcaacaaagagcgaaactctgtctcaaaaaacaaaccaacaaaaaccacaattgatttgatgaaaattagttttaagtaaatgtttgtaaatagatattggttgaatttttggatatattatgttgatttaacttttaaaatgttgtttaaaagtgtgaagctatgaaaagcctgataatgtgactacagatatttcagttggactagaattctgactttgaaacttattaaattaatgcatactggaagtactttgatactcaagttgtttcacaagatttataatatagatggttttgtttgactaaagaataatctcatataactagaatacttgtggcttttattatctttaaacttgttgcatttaaaatatttttaaaaccttcttaacaaaacttcttaaaactggaaaaaatatatattatgtatctatgtatcatatttatcacatgaccacttttgattccttaaaaagacattacaggcttaaattccattttattaaaaaaaaaaaattgcctgtaatcccagcacttcaggaggccgagatgggcagatcttgaggtcggtagatggagaccatcctggccaacatggtgaaaccctgtctctactaaaaatacaaaaattagctgggtgtggtggtgtgtacctgtagtcccagctacccaggaagctaaggcaggagaatcgcttgaatccaggaggcggaggttgcagtgagctgagatcgcactactgcactccagcctgggcgacagagcaagaccaccatctccaaaaattatatatataaaaataattaatattatagaagagaatatacacaactcagagatgcaatggataatataaaaagagtacctgagatgtatttttttaaactcttagagatatctgtaactcaaatttttcttaggtgaggaggattattaactggcacatatgtactaaaaacccctcacttaaaaatggcagtctcaatcctactgtcattctttttattttaaaataaataaataagcctatctttttgtgcttacatacttaaaaggatatcattaagtatataaacaatcattacttctgtatttttaatgaatgcaggaaaataatatttttatgtataaaagatgaagaaaaaattttgcaagtctttaagcacataaatacaacagaatagccacccaatttctgtctgaaatctaaattggatggatttgaccatcattctattatctttgatttctacaatgtctatatcttattacctataactattaatttttcatagaattataaatgtcatttgactatgtcaatctgtatatattgtaccttaatatgaaaaacaaattttttaattcataaaagtatttttattagatttcatatgcatgaaacccaagcaaattatatgaatttattttactatttgaaaatgttcatattaccaataatgtggacaaattactttgcaggtttaaatatgcctctgtaaaggaagagtctcattagacaatgatttttaaagcattggaaaaatattttgcctgtaaaagttagtaactaggtggttcacaaaattacaacatcaaaatagttacatcttgtgaaaatatatgatttttatgtcaatcaagacaaatgaaatatatatgtatgtgtatatatatacatgtatgtatgaaatatatatatgtgcgtgtgtgtgtgtatatatatatatatatatatatatttctatgaaattgtccagatgtgttcaggaacatgattgcattagagcaatgactgtattttgttgtccttataacatttatattatttcagttttaagtcaaaaggtattctgaatataataaaagcctcacaaattatttgtaaaatttagtagttcatatttagtatatcagtaatatagaagacatctttatagtcaactcttaattaatgcttattgtaccaaatctttgagatatttgtacataaatgaaatatgtactttcatgctaaaattatatatcatgactgtgctataatttggcatgtcattatctagatttatatgtatgtacgtatttcaggtccttgaaattttaataaatattacagttaaatcctgatat

SEQ ID NO: 199706 - DNA, 466 bp, Homo sapiens
  Payload ID: 19403
  Gene Name: WD repeat domain 17
  ENST ID: ENST00000513261
  CDS Start-End: 11-316
gaaacattctatggcttggatgacttacatttcaaattggtttgagcaagatgattggtatgaaggactacaaagagcaaacatgtcccaggtaaggcaagtgggattgctggctgctggatgtcagccatggaacaaggatgtatgtgctgccagtggagacaggtttgcatattgtgcgaccctggctatctatatttatcagggatccctgcttctcttagttggtgctggaatgcagaggatgtggtggcatttgtttcccacagaggcccactgttcatttggaccatctcaggaccagatagtggagtgattgtacacaaagatgctcatagcttcttgtctgatatctgtatgttcagatggcatacacaccaaaaggggaaagttgtgtttggtcatattgatggaagtctatcaatttttcatccaggtaataaaaatcagaaacatgttttgagac

SEQ ID NO: 199707 - DNA, 1501 bp, Homo sapiens
  Payload ID: 19404
  Gene Name: WD repeat domain 18
  ENST ID: ENST00000251289
  CDS Start-End: 1-1289
cggcgcccatggaggtggccgtgtgtacggactcggcggccccgatgtggagctgcatcgtgtgggaacttcactcgggcgccaacctgctcacctaccgcggcggccaggcgggaccccgcggcctggcgctgctcaatggcgagtatctgctggcggcgcagctgggcaagaattacatcagcgcctgggagctccagcggaaggaccagctccagcagaagatcatgtgccccgggcctgtcacctgtctgactgcatcacccaatggtctctacgtcctggcaggagttgcagaaagcatccacctgtgggaggtctccaccgggaaccttctggtcatcctgagtcgacactaccaggacgtctcctgccttcagttcacaggggacagcagccacttcatctcagggggcaaggactgcctggtgctggtttggagcctctgcagcgtgctgcaggccgacccctccaggattccggcgcccaggcacgtctggtctcaccacgcgctccccatcacggacctgcactgcggctttgggggccccctggcccgggtggccacctcctcactggaccagacggtgaagctatgggaggtctcctcgggggagctgctgctctccgtcctctttgacgtgtccatcatggcagtgaccatggacctggctgagcaccatatgttctgcgggggcagtgagggctccatcttccaggtcgacctcttcacctggcccggacagagggagaggagcttccacccagagcaggacgccgggaaggtcttcaaagggaaccaggtgacttgcctgtcagtgtccactgacggcagcgtgctgctctcaggctcccacgacgagaccgtgcgcctctgggacgtgcagagcaagcagtgcatccggacggtggccctcaaaggcccagtcaccaatgccgccatcctgctggcgcccgtcagcatgctgagctcagacttcaggcccagcctgccgctgccccacttcaacaagcacctgctgggcgccgagcacggggacgagccgcgccacgggggcctcactctgcgcctgggcctccaccagcagggctcggagcccagctacctggaccgcacggagcagctgcaggccgtcctgtgcagcaccatggagaagagcgtgctcggcggccaggaccagctgcgcgtccgtgtgacggagctggaggacgaggtgcgcaacctgcgcaagatcaatcgggacctgttcgacttctccacgcgcttcatcacgcggccggccaagtgaggcccggagaccccggcccgaggcgcccaggcctgagccccatgcctcccagcaaccagggcccgcgggtgtggcccccaccagcccaggcctggactctcctcagttctgtgtcgtgttcgggtttttcctctgtgactgggccgtcttggtgtctcgtggcacgcgtcacagtggtgctagtctgtttttaacaaaagaggatgaaaagc

SEQ ID NO: 199708 - DNA, 1465 bp, Homo sapiens
  Payload ID: 19404
  Gene Name: WD repeat domain 18
  ENST ID: ENST00000587001
  CDS Start-End: 23-1252
ccggggcggtggggaaggcaagatggcggcgcccatggaggtggccgtgtgtacggactcggcggccccgatgtggagctgcatcgtgtgggaacttcactcgggcgccaacctgctcacctaccgcggcggccaggcgggaccccgcggcctggcgctgctcaatggcgagtatctgctggcggcgcagctgggcaagaattacatcagcgcctgggagctccagcggaaggaccagctccagcagaagatcatgtgccccgggcctgtcacctgtctgactgcatcacccaatggtctctacgtcctggcaggagttgcagaaagcatccacctgtgggaggtctccaccgggaaccttctggtcatcctgagtcgacactaccaggacgtctcctgccttcagttcacaggggacagcagccacttcatctcagggggcaaggactgcctggtgctggtttggagcctctgcagcgtgctgcaggccgacccctccaggattccggcgcccaggcacgtctggtctcaccacgcgctccccatcacggacctgcactgcggctttgggggccccctggcccgggtggccacctcctcactggaccagacggtgaagctatgggaggtctcctcgggggagctgctgctctccgtcctctttgacgtgtccatcatggcagtgaccatggacctggctgagcaccatatgttctgcgggggcagtgagggctccatcttccaggtcgacctcttcacctggcccggacagagggagaggagcttccacccagagcaggacgccgggaaggtcttcaaagggcacaggaaccaggtgacttgcctgtcagtgtccactgacggcagcgtgctgctctcaggctcccacgacgagaccgtgcgcctctgggacgtgcagagcaagcagtgcatccggacggtggccctcaaaggcccagtcaccaatgccgccatcctgctggcgcccgtcagcatgctgagctcagacttcaggcccagcctgccgctgccccacttcaacaagcacctgctgggcgccgagcacggggacgagccgcgccacgggggcctcactctgcgcctgggcctccaccagcagagcgtgctcggcggccaggaccagctgcgcgtccgtgtgacggagctggaggacgaggtgcgcaacctgcgcaagatcaatcgggacctgttcgacttctccacgcgcttcatcacgcggccggccaagtgaggcccggagaccccggcccgaggcgcccaggcctgagccccatgcctcccagcaaccagggcccgcgggtgtggcccccaccagcccaggcctggactctcctcagttctgtgtcgtgttcgggtttttcctctgtgactgggccgtcttggtgtctcgtggcacgcgtcacagtggtgctagtctgtttttaacaaaagaggatgaaaagcc

SEQ ID NO: 199709 - DNA, 1083 bp, Homo sapiens
  Payload ID: 19404
  Gene Name: WD repeat domain 18
  ENST ID: ENST00000590397
  CDS Start-End: 10-468
gaaggcaagatggcggcgcccatggaggtggccgtgtgtacggactcggcggccccgatgtggagctgcatcgtgtgggaacttcactcgggcgccaacctgctcacctaccgcggcggccaggcgggaccccgcggcctggcgctgctcaatggcgagtatctgctggcggcgcagctgggcaagaattacatcagcgcctgggagctccagcggaaggaccagctccagcagaagatcatgtgccccgggcctgtcacctgtctgactgcatcacccaatggtctctacgtcctggcaggagttgcagaaagcatccacctgtgggaggtctccaccgggaaccttctggtcatcctgagtcgacactaccaggacgtctcctgccttcagttcacaggggacagcagccacttcatctcagggggcaaggactgcctggtgctggtttggagcctctgcaggtagcgccttgcgcactcaggcctgcacctggaactgcacccgggctcaggcggggagaggaggcgccaaggcccctggcgggaaggggcttctctcttgggggctggagtgcagaggacggagtgatcatcccaggggtcctggctgcccacactggggtctggtttgttctgggggccgtgggggcccagccttgagtttactcagcgtgctgcaggccgacccctccaggattccggcgcccaggcacgtctggtctcaccacgcgctccccatcacggacctgcactgcggctttgggggccccctggcccgggtggccacctcctcactggaccagacggtgaagctatgggaggtctcctcgggggagctgctgctctccgtcctctttgacgtgtccatcatggcagtgaccatggacctggctgagcaccatatgttctgcgggggcagtgagggctccatcttccaggtcgacctcttcacctggcccggacagagggagaggagcttccacccagagcaggacgccgggaaggtcttcaaagggcacaggaaccaggtgacttgcctgtcagtgtccactgacggcagcgtgctgctctcaggctccca

SEQ ID NO: 199710 - DNA, 1498 bp, Homo sapiens
  Payload ID: 19404
  Gene Name: WD repeat domain 18
  ENST ID: ENST00000591985
  CDS Start-End: 1-806
cggcgcccatggaggtggccgtgtgtacggactcggcggccccgatgtggagctgcatcgtgtgggaacttcactcgggcgccaacctgctcacctaccgcggcggccaggcgggaccccgcggcctggcgctgctcaatggcgagtatctgctggcggcgcagctgggcaagaattacatcagcgcctgggagctccagcggaaggaccagctccagcagaagatcatgtgccccgggcctgtcacctgtctgactgcatcacccaatggtctctacgtcctggcaggagttgcagaaagcatccacctgtgggaggtctccaccgggaaccttctggtcatcctgagtcgacactaccaggacgtctcctgccttcagttcacaggggacagcagccacttcatctcagggggcaaggactgcctggtgctggtttggagcctctgcagcgtgctgcaggccgacccctccaggattccggcgcccaggcacgtctggtctcaccacgcgctccccatcacggacctgcactgcggctttgggggccccctggcccgggtggccacctcctcactggaccagacggtgaagctatgggaggtctcctcgggggagctgctgctctccgtcctctttgacgtgtccatcatggcagtgaccatggacctggctgagcaccatatgttctgcgggggcagtgagggctccatcttccaggtcgacctcttcacctggcccggacagagggagaggagcttccacccagagcaggacgccgggaaggtcttcaaagggcacaggtgacttgcctgtcagtgtccactgacggcagcgtgctgctctcaggctcccacgacgagaccgtgcgcctctgggacgtgcagagcaagcagtgcatccggacggtggccctcaaaggcccagtcaccaatgccgccatcctgctggcgcccgtcagcatgctgagctcagacttcaggcccagcctgccgctgccccacttcaacaagcacctgctgggcgccgagcacggggacgagccgcgccacgggggcctcactctgcgcctgggcctccaccagcagggctcggagcccagctacctggaccgcacggagcagctgcaggccgtcctgtgcagcaccatggagaagagcgtgctcggcggccaggaccagctgcgcgtccgtgtgacggagctggaggacgaggtgcgcaacctgcgcaagatcaatcgggacctgttcgacttctccacgcgcttcatcacgcggccggccaagtgaggcccggagaccccggcccgaggcgcccaggcctgagccccatgcctcccagcaaccagggcccgcgggtgtggcccccaccagcccaggcctggactctcctcagttctgtgtcgtgttcgggtttttcctctgtgactgggccgtcttggtgtctcgtggcacgcgtcacagtggtgctagtctgtttttaacaaaagaggatgaaaa

SEQ ID NO: 199711 - DNA, 1397 bp, Homo sapiens
  Payload ID: 19404
  Gene Name: WD repeat domain 18
  ENST ID: ENST00000607440
  CDS Start-End: 1-1184
cggcgcccatggaggtggccgtgtgtacggactcggcggccccgatgtggagctgcatcgtgtgggaacttcactcgggcgccaacctgctcacctaccgcggcggccaggcgggaccccgcggcctggcgctgctcaatggcgagtatctgctggcggcgcagctgggcaagaattacatcagcgcctgggagctccagcggaaggtctccaccgggaaccttctggtcatcctgagtcgacactaccaggacgtctcctgccttcagttcacaggggacagcagccacttcatctcagggggcaaggactgcctggtgctggtttggagcctctgcagcgtgctgcaggccgacccctccaggattccggcgcccaggcacgtctggtctcaccacgcgctccccatcacggacctgcactgcggctttgggggccccctggcccgggtggccacctcctcactggaccagacggtgaagctatgggaggtctcctcgggggagctgctgctctccgtcctctttgacgtgtccatcatggcagtgaccatggacctggctgagcaccatatgttctgcgggggcagtgagggctccatcttccaggtcgacctcttcacctggcccggacagagggagaggagcttccacccagagcaggacgccgggaaggtcttcaaagggcacaggaaccaggtgacttgcctgtcagtgtccactgacggcagcgtgctgctctcaggctcccacgacgagaccgtgcgcctctgggacgtgcagagcaagcagtgcatccggacggtggccctcaaaggcccagtcaccaatgccgccatcctgctggcgcccgtcagcatgctgagctcagacttcaggcccagcctgccgctgccccacttcaacaagcacctgctgggcgccgagcacggggacgagccgcgccacgggggcctcactctgcgcctgggcctccaccagcagggctcggagcccagctacctggaccgcacggagcagctgcaggccgtcctgtgcagcaccatggagaagagcgtgctcggcggccaggaccagctgcgcgtccgtgtgacggagctggaggacgaggtgcgcaacctgcgcaagatcaatcgggacctgttcgacttctccacgcgcttcatcacgcggccggccaagtgaggcccggagaccccggcccgaggcgcccaggcctgagccccatgcctcccagcaaccagggcccgcgggtgtggcccccaccagcccaggcctggactctcctcagttctgtgtcgtgttcgggtttttcctctgtgactgggccgtcttggtgtctcgtggcacgcgtcacagtggtgctagtctgtttttaacaaaagaggatgaaaagcc

SEQ ID NO: 199712 - DNA, 678 bp, Homo sapiens
  Payload ID: 19404
  Gene Name: WD repeat domain 18
  ENST ID: ENST00000590354
  CDS Start-End: 1-145
caaagggcacaggaaccaggtgacttgcctgtcagtgtccactgacggcagcgtgctgctctcaggctcccacgacgagaccgtgcgcctctgggacgtgcagagcaagcagtgcatccggacggtggccctcaaagcatgctgagctcagacttcaggcccagcctgccgctgccccacttcaacaagcacctgctgggcgccgagcacggggacgagccgcgccacgggggcctcactctgcgcctgggcctccaccagcagggctcggagcccagctacctggaccgcacggagcagctgcaggccgtcctgtgcagcaccatggagaagagcgtgctcggcggccaggaccagctgcgcgtccgtgtgacggagctggaggacgaggtgcgcaacctgcgcaagatcaatcgggacctgttcgacttctccacgcgcttcatcacgcggccggccaagtgaggcccggagaccccggcccgaggcgcccaggcctgagccccatgcctcccagcaaccagggcccgcgggtgtggcccccaccagcccaggcctggactctcctcagttctgtgtcgtgttcgggtttttcctctgtgactgggccgtcttggtgtctcgtggcacgcgtcacagtggtgctagtctgtttttaacaaaagaggatgaaaagcc

SEQ ID NO: 199713 - DNA, 1608 bp, Homo sapiens
  Payload ID: 19404
  Gene Name: WD repeat domain 18
  Uniprot ID: Q9BV38
  ENST ID: ENST00000585809
  CDS Start-End: 84-1382
ggggccgccgctctggcccgcgtggggcagtcgtccgcgtctcgctcatgatgacgcacgtccggggcggtggggaaggcaagatggcggcgcccatggaggtggccgtgtgtacggactcggcggccccgatgtggagctgcatcgtgtgggaacttcactcgggcgccaacctgctcacctaccgcggcggccaggcgggaccccgcggcctggcgctgctcaatggcgagtatctgctggcggcgcagctgggcaagaattacatcagcgcctgggagctccagcggaaggaccagctccagcagaagatcatgtgccccgggcctgtcacctgtctgactgcatcacccaatggtctctacgtcctggcaggagttgcagaaagcatccacctgtgggaggtctccaccgggaaccttctggtcatcctgagtcgacactaccaggacgtctcctgccttcagttcacaggggacagcagccacttcatctcagggggcaaggactgcctggtgctggtttggagcctctgcagcgtgctgcaggccgacccctccaggattccggcgcccaggcacgtctggtctcaccacgcgctccccatcacggacctgcactgcggctttgggggccccctggcccgggtggccacctcctcactggaccagacggtgaagctatgggaggtctcctcgggggagctgctgctctccgtcctctttgacgtgtccatcatggcagtgaccatggacctggctgagcaccatatgttctgcgggggcagtgagggctccatcttccaggtcgacctcttcacctggcccggacagagggagaggagcttccacccagagcaggacgccgggaaggtcttcaaagggcacaggaaccaggtgacttgcctgtcagtgtccactgacggcagcgtgctgctctcaggctcccacgacgagaccgtgcgcctctgggacgtgcagagcaagcagtgcatccggacggtggccctcaaaggcccagtcaccaatgccgccatcctgctggcgcccgtcagcatgctgagctcagacttcaggcccagcctgccgctgccccacttcaacaagcacctgctgggcgccgagcacggggacgagccgcgccacgggggcctcactctgcgcctgggcctccaccagcagggctcggagcccagctacctggaccgcacggagcagctgcaggccgtcctgtgcagcaccatggagaagagcgtgctcggcggccaggaccagctgcgcgtccgtgtgacggagctggaggacgaggtgcgcaacctgcgcaagatcaatcgggacctgttcgacttctccacgcgcttcatcacgcggccggccaagtgaggcccggagaccccggcccgaggcgcccaggcctgagccccatgcctcccagcaaccagggcccgcgggtgtggcccccaccagcccaggcctggactctcctcagttctgtgtcgtgttcgggtttttcctctgtgactgggccgtcttggtgtctcgtggcacgcgtcacagtggtgctagtctgtttttaacaaaagaggatgaaaagcccctcctctccggc

SEQ ID NO: 199714 - DNA, 577 bp, Homo sapiens
  Payload ID: 19404
  Gene Name: WD repeat domain 18
  ENST ID: ENST00000591997
  CDS Start-End: 1-435
gtgtgtacggactcggcggccccgatgtggagctgcatcgtgtgggaacttcactcgggcgccaacctgctcacctaccgcggcggccaggcgggaccccgcggcctggcgctgctcaatggcgagtatctgctggcggcgcagctgggcaagaattacatcagcgcctgggagctccagcggaaggaccagctccagcagaagatcatgtgccccgggcctgtcacctgtctgactgcatcacccaatggtctctacgtcctggcaggagttgcagaaagcatccacctgtgggaggtctccaccgggaaccttctggtcatcctgagtcgacactaccaggacgtctcctgccttcagttcacaggggacagcagccacttcatctcagggggcaaggactgcctggtgctggtttggagcctctgcaggtagcgccttgcgcactcaggagggtggtaagggctacatagcaaggagtgtgcttaatgtgcctgagctgtgcacctagaaatggccaagatggcaggtttcatgttatgactattttcccacaataaaacattttttaaaagtc

SEQ ID NO: 199715 - DNA, 4520 bp, Homo sapiens
  Payload ID: 19405
  Gene Name: WD repeat domain 19
  Uniprot ID: Q8NEZ3
  ENST ID: ENST00000399820
  CDS Start-End: 155-4183
ggcccggcccctcgaggcaccgcctttcaattagcactcgctgattggtcgctgctcgcgcggtctcctgggtgacgggaacgcggtagcctgcttggtggagaccgggtgcgcctgcgtacttcatagttcgcgtagcggctcgagcgtggagatgaagcgtattttctcactgctagaaaagacttggcttggcgcaccaatacagtttgcctggcaaaaaacatcaggaaactaccttgcagtaacaggagctgattatattgtgaaaatctttgatcgccatggtcaaaaaagaagtgaaattaacttacctggtaactgtgttgccatggattgggataaagatggagatgtcctagcagtgattgctgagaaatctagctgcatttatctttgggatgccaacacaaataagaccagccagttagacaatggcatgagggatcaaatgtctttccttctttggtcaaaagttggaagtttcctggctgttggaactgttaaaggaaatttgcttatttataatcatcagacatctcgaaagattcctgtccttggaaaacatactaagagaatcacttgtggatgttggaatgcagaaaatctgcttgctttaggtggtgaagataaaatgattacagttagtaatcaggaaggtgacacgataagacagacacaagtgagatcagagcctagcaacatgcagtttttcttgatgaagatggatgaccgaacctctgctgctgaaagcatgataagtgtggtgcttggcaagaaaactttgttttttttaaatctgaatgaaccagataacccagctgatcttgaatttcagcaggactttggcaacattgtctgctataattggtatggtgatggccgcatcatgattggtttttcatgtggacattttgtggtcatttctactcatactggagagcttggtcaagagatatttcaggctcgtaaccataaagataatctaaccagcattgcagtatcacagactcttaacaaagttgctacatgtggagataactgcattaaaatccaagacttggttgacttaaaagacatgtatgttatactcaacctggatgaggaaaataaaggattgggtaccttgtcctggactgatgatggccagttgctagcactctctacccaaaggggctcacttcatgttttcctgaccaagcttcccatacttggggatgcctgcagcacaaggattgcctatctcacctccctccttgaagtcaccgtagccaaccctgttgaaggagagctaccaatcacagtttctgttgatgtggaacccaactttgtggcagtaggtctttatcatctggctgtaggaatgaataatcgagcttggttttatgtccttggagaaaatgctgtgaaaaaattgaaagatatggagtatctgggaacagtagccagtatttgccttcattctgactatgctgctgcactttttgaaggcaaagtccagttacatttgatagaaagcgaaatcttggatgctcaagaagaacgtgagactcggcttttcccagcagtggatgataagtgccgtatcttatgccatgccttaactagtgatttcctcatctatggtacagatactggtgtcgttcagtatttctacattgaagactggcaattcgttaatgattatcgacatcctgtcagtgtgaaaaagatttttcccgacccaaatgggaccagattagttttcattgatgaaaaaagtgatggatttgtttactgtccagtcaatgacgctacctatgagattccagatttttcaccaaccattaaaggtgttctttgggaaaactggccaatggataaaggtgtatttattgcttatgatgatgataaggtgtacacttatgtctttcacaaggacactatacaaggagccaaggttattttggctggtagcaccaaagttccttttgctcataaacctttgctgctatataatggagagctgacctgccaaacacagagtggaaaagtaaacaacatctaccttagcacccatggctttctcagcaacttaaaagatacggggcctgacgaactgagaccaatgctggcacagaatttaatgctaaagaggttttctgatgcttgggaaatgtgcaggattctgaatgatgaggctgcctggaatgagttggccagagcttgtctacatcacatggaagtggagtttgcaatccgtgtttatcggagaattggaaatgttggcatagtgatgtccttggaacaaataaagggaatagaggactacaatcttttggcaggacaccttgccatgtttaccaacgattataacctggctcaggacttgtaccttgcatccagctgtcctattgctgccctggagatgagaagggatttacagcattgggacagtgctctacaactggcaaagcatttggccccagaccagataccttttatatcaaaagaatatgctattcagcttgaattcgcgggtgattatgtaaatgctttggctcattatgagaaaggaataacaggtgataataaggaacatgatgaagcttgtctggctggagtggcccagatgtccataagaatgggagacatacgtcgaggggttaaccaagccctcaagcatcccagcagggtccttaaaagagactgtggagccatattggagaatatgaagcaattttcagaagcggcccaactgtatgaaaaaggtctctactacgataaagcagcatctgtttacatccgctctaagaattgggcaaaagttggtgatcttctgccccacgtttcttctcctaagatccatttgcagtatgccaaagccaaggaagcagatggaagatacaaagaagctgttgtagcttatgaaaatgcaaaacagtggcaaagtgtaatccgcatctatctggatcacctcaataatcctgaaaaagctgtcaatattgttagagagacccagtctctggatggagccaaaatggtagccaggttttttctacagcttggtgactatgggtctgccatccagtttcttgtcatgtccaaatgcaacaatgaagctttcacactggctcagcaacacaacaaaatggaaatctatgcagatattattggttctgaagacactactaatgaagactatcaaagcattgccttatactttgaaggagaaaagagatatcttcaggctggaaaattcttcttgctgtgtggccaatattcacgagcacttaaacacttcctgaaatgcccaagctcggaagataatgtggcaatagaaatggcaattgaaactgttggtcaggccaaagatgaactgctgaccaatcagctgatagaccatctcctgggggagaacgatggcatgcctaaggatgccaagtacctgttccgcttgtacatggctctgaagcaataccgagaagctgcccagactgccatcatcattgccagagaagagcagtctgcaggcaactaccggaatgcacacgatgttctcttcagtatgtatgcagaactgaaatcccagaagatcaaaattccctccgagatggccaccaacctcatgattctgcacagctatatactagtaaagattcatgttaaaaatggagatcacatgaaaggggctcgcatgctcattcgggtggccaacaacatcagcaaatttccatcacacattgtacccatcctgacgtcaactgtgattgagtgtcacagggcaggcctgaagaactctgctttcagcttcgcagctatgttgatgaggcctgaataccgcagcaaaatagatgccaaatacaaaaagaagatcgagggaatggtcaggagacccgatatatctgagatagaagaggccacgactccatgtccattctgcaaatttcttctcccagagtgtgaactcctctgtcctggatgtaaaaacagtatcccatattgcattgcaacaggtcgacacatgttgaaagatgactggacggtgtgtccacattgtgacttccctgctctatactcagaattgaagatcatgctaaacactgaaagcacatgtcctatgtgttcagaaagattaaacgctgctcagctgaaaaagatttcagactgtacccagtacctgcgaacggaggaggaactgtgattggcacgtgcagatacaatgctcctgagaagacagcattttccacaggaggctgtttcctcccctggtggatttaagagacggtcctttctggatacagagaaatgaaacaacggtgacctctccaggtcggcactttccacttctgtacggtggcaaaacgatgacatgtaaccttgctgtttattgtactttgtatattatttcctcttcaaagtctttcttacacactctatcctctgcactgttaatagtaacctatgacataattgtaaatattcagctttttgctaacttttgtattttgaaaaactttaaaataaaattgttgactaga

SEQ ID NO: 199716 - DNA, 571 bp, Homo sapiens
  Payload ID: 19405
  Gene Name: WD repeat domain 19
  ENST ID: ENST00000507228
  CDS Start-End: 1-407
ataaacctttgctgctatataatggagagctgacctgccaaacacagagtggaaaagtaaacaacatctaccttagcacccatggctttctcagcaacttaaaagatacggggcctgacgaactgagaccaatgctggcacagaatttaatgctaaagaggttttctgatgcttgggaaatgtgcaggattctgaatgatgaggctgcctggaatgagttggccagagcttgtctacatcacatggaagtggagtttgcaatccgtgtttatcggagaattggaaatgttggcatagtgatgtccttggaacaaataaaggacaccttgccatgtttaccaacgattataacctggctcaggacttgtaccttgcatccagctgtcctattgctgccctggagatgagaagggatttacagcattgggacagtgctctacaactggcaaagcatttggccccagaccagataccttttatatcaaaagaatatgctattcagcttgaattcgcgggtgattatgtaaatgctttggctcattatgagaaaggaataacaggtgataataag

SEQ ID NO: 199717 - DNA, 429 bp, Homo sapiens
  Payload ID: 19405
  Gene Name: WD repeat domain 19
  ENST ID: ENST00000512112
  CDS Start-End: 302-429
atagttcgcgtagcggctcgagcgtggagatgaagagctgattatattgtgaaaatctttgatcgccatggtcaaaaaagaagtgaaattaacttacctggtaactgtgttgccatggattgggataaagatggagatgtcctagcagtgattgctgagaaatctagctgcatttatctttgggatgccaacacaaataagaccagccagttagacaatggcatgaggaaaacatactaagagaatcacttgtggatgttggaatgcagaaaatctgcttgctttaggtggtgaagataaaatgattacagttagtaatcaggaaggtgacacgataagacagacacaagtgagatcagagcctagcaacatgcagtttttcttgatgaagatggatgaccgaacctctgctgctgaaagcatggtaag

SEQ ID NO: 199718 - DNA, 2513 bp, Homo sapiens
  Payload ID: 19405
  Gene Name: WD repeat domain 19
  ENST ID: ENST00000506503
  CDS Start-End: 11-1456
gagcgtggagatgaagcgtattttctcactgctagaaaagacttggcttggcgcaccaatacagtttgcctggcaaaaaacatcaggaaactaccttgcagtaacaggagctgattatattgtgaaaatctttgatcgccatggtcaaaaaagaagtgaaattaacttacctggtaactgtgttgccatggattgggataaagatggagatgtcctagcagtgattgctgagaaatctagctgcatttatctttgggatgccaacacaaataagaccagccagttagacaatggcatgagggatcaaatgtctttccttctttggtcaaaagttggaagtttcctggctgttggaactgttaaaggaaatttgcttatttataatcatcagacatctcgaaagattcctgtccttggaaaacatactaagagaatcacttgtggatgttggaatgcagaaaatctgcttgctttaggtggtgaagataaaatgattacagttagtaatcaggaaggtgacacgataagacagacacaagtgagatcagagcctagcaacatgcagtttttcttgatgaagatggatgaccgaacctctgctgctgaaagcatgataagtgtggtgcttggcaagaaaactttgttttttttaaatctgaatgaaccagataacccagctgatcttgaatttcagcaggactttggcaacattgtctgctataattggtatggtgatggccgcatcatgattggtttttcatgtggacattttgtggtcatttctactcatactggagagcttggtcaagagatatttcaggctcgtaaccataaagataatctaaccagcattgcagtatcacagactcttaacaaagttgctacatgtggagataactgcattaaaatccaagacttggttgacttaaaagacatgtatgttatactcaacctggatgaggaaaataaaggattgggtaccttgtcctggactgatgatggccagttgctagcactctctacccaaaggggctcacttcatgttttcctgaccaagcttcccatacttggggatgcctgcagcacaaggattgcctatctcacctccctccttgaagtcaccgtagccaaccctgttgaaggagagctaccaatcacagtttctgttgatgtggaacccaactttgtggcagtaggtctttatcatctggctgtaggaatgaataatcgagcttggttttatgtccttggagaaaatgctgtgaaaaaattgaaagatatggagtatctgggaacagtagccagtatttgccttcattctgactatgctgctgcactttttgaaggcaaagtccagttacatttgaaagcgaaatcttggatgctcaagaagaacgtgagactcggcttttcccagcagtggatgataagtgccgtatcttatgccatgccttaactagtgatttcctcatctatggtacagatgtatgtattgccttcttttttagagaacactgggaatttttaatttttattttgtgatctcagtcattctcttttcctaccagtcttttttctatattgaatccaatacaattaatgaagttatctgtgattaattatatacattcatgtgtctctttgcagtggggatacattctgagaaacgtgtcattgggcaatttcatcattgtgtggatgtcatagagtgtgcttacaggaacctagatggtacagcccactgcacacctagcctgtgtggtagagcctattgctcctaggctacaaaccagtacagcatgtgactgtactgaatactataggtaattgtaacacaatgctatctagacatagacaaggtacagtatatgtgtgatataaaatatttaaaatggcatgcctgtatagggcacttaccatgacaggagcttgcaggactggaaatggctctgggtgagtgagtgagtgagtggtgagtgaacgtgaaggcctgcagcattactgtacactaccatagatttttatcaacactgtacacttagggacactaaacttatttaaacattttttcttcaaaaataaattaaccttagctcactgtaactttataagctttatatttaaaaaaactttttgactcttttgtagtaacacttagcttaaaacacaaacacattgtacagttacacaaaatattttcttaaaaaatattttattatatcctattctataagcttttccttgtttttcactttttttaacttttaaactttttataaaaactaagacacaaacacacacattagtgcaggcctgcatagcatcaggatcatcagtatcactgtctcccacctccgcatcttgtcccactgaaaggtcttcagcgggaataacatgcatggagctgtcatctcctgtgataacaatgccttcttctggatacctcctgaaggacctggttgagcctgttttacagttaacttttttttaataaatagaagtgcactccaaaa

SEQ ID NO: 199719 - DNA, 862 bp, Homo sapiens
  Payload ID: 19405
  Gene Name: WD repeat domain 19
  ENST ID: ENST00000503697
  CDS Start-End: 55-354
gagaccgggtgcgcctgcgtacttcatagttcgcgtagcggctcgagcgtggagatgaagcgtattttctcactgctagaaaagacttggcttggcgcaccaatacagtttgcctggcaaaaaacatcaggaaactaccttgcagtaacaggagctgattatattgtgaaaatctttgatcgccatggtcaaaaaagaagtgaaattaacttacctggtaactgtgttgccatggattgggataaagatggagatgtcctagcagtgattgctgagaaatctagctgcatttatctttgggatgccaacacaaataagaccagccagttagacaatggcatgagacacaagtgagatcagagcctagcaacatgcagtttttcttgatgaagatggatgaccgaacctctgctgctgaaagcatgataagtgtggtgcttggcaagaaaactttgttttttttaaatctgaatgaaccagataacccagctgatcttgaatttcagcaggactttggcaacattgtctgctataattggtatggtgatggccgcatcatgattggtttttcatgtggacattttgtggtcatttctactcatactggagagcttggtcaagagatatttcaggctcgtaaccataaagataatctaaccagcattgcagtatcacagactcttaacaaagttgctacatgtggagataactgcattaaaatccaagacttggttgacttaaaagacatgtatgttatactcaacctggatgaggaaaataaaggattgggtaccttgtcctggactgatgatggccagttgctagcactctctacccaaaggggctcacttcatgttttcct

SEQ ID NO: 199720 - DNA, 4249 bp, Homo sapiens
  Payload ID: 19405
  Gene Name: WD repeat domain 19
  ENST ID: ENST00000506869
  CDS Start-End: 30-332
atagttcgcgtagcggctcgagcgtggagatgaagcgtattttctcactgctagaaaagacttggcttggcgcaccaatacagtttgcctggcaaaaaacatcaggaaactaccttgcagtaacaggagctgattatattgtgaaaatctttgatcgccatggtcaaaaaagaagtgaaattaacttacctggtaactgtgttgccatggattgggataaagatggagatgtcctagcagtgattgctgagaaatctagctgcatttatctttgggatgccaacacaaataagaccagccagttagacaatggcatgaggaaaacatactaagagaatcacttgtggatgttggaatgcagaaaatctgcttgctttaggtggtgaagataaaatgattacagttagtaatcaggaaggtgacacgataagacagacacaagtgagatcagagcctagcaacatgcagtttttcttgatgaagatggatgaccgaacctctgctgctgaaagcatgataagtgtggtgcttggcaagaaaactttgttttttttaaatctgaatgaaccagataacccagctgatcttgaatttcagcaggactttggcaacattgtctgctataattggtatggtgatggccgcatcatgattggtttttcatgtggacattttgtggtcatttctactcatactggagagcttggtcaagagatatttcaggctcgtaaccataaagataatctaaccagcattgcagtatcacagactcttaacaaagttgctacatgtggagataactgcattaaaatccaagacttggttgacttaaaagacatgtatgttatactcaacctggatgaggaaaataaaggattgggtaccttgtcctggactgatgatggccagttgctagcactctctacccaaaggggctcacttcatgttttcctgaccaagcttcccatacttggggatgcctgcagcacaaggattgcctatctcacctccctccttgaagtcaccgtagccaaccctgttgaaggagagctaccaatcacagtttctgttgatgtggaacccaactttgtggcagtaggtctttatcatctggctgtaggaatgaataatcgagcttggttttatgtccttggagaaaatgctgtgaaaaaattgaaagatatggagtatctgggaacagtagccagtatttgccttcattctgactatgctgctgcactttttgaaggcaaagtccagttacatttgatagaaagcgaaatcttggatgctcaagaagaacgtgagactcggcttttcccagcagtggatgataagtgccgtatcttatgccatgccttaactagtgatttcctcatctatggtacagatactggtgtcgttcagtatttctacattgaagactggcaattcgttaatgattatcgacatcctgtcagtgtgaaaaagatttttcccgacccaaatgggaccagattagttttcattgatgaaaaaagtgatggatttgtttactgtccagtcaatgacgctacctatgagattccagatttttcaccaaccattaaaggtgttctttgggaaaactggccaatggataaaggtgtatttattgcttatgatgatgataaggtgtacacttatgtctttcacaaggacactatacaaggagccaaggttattttggctggtagcaccaaagttccttttgctcataaacctttgctgctatataatggagagctgacctgccaaacacagagtggaaaagtaaacaacatctaccttagcacccatggctttctcagcaacttaaaagatacggggcctgacgaactgagaccaatgctggcacagaatttaatgctaaagaggttttctgatgcttgggaaatgtgcaggattctgaatgatgaggctgcctggaatgagttggccagagcttgtctacatcacatggaagtggagtttgcaatccgtgtttatcggagaattggaaatgttggcatagtgatgtccttggaacaaataaagggaatagaggactacaatcttttggcaggacaccttgccatgtttaccaacgattataacctggctcaggacttgtaccttgcatccagctgtcctattgctgccctggagatgagaagggatttacagcattgggacagtgctctacaactggcaaagcatttggccccagaccagataccttttatatcaaaagaatatgctattcagcttgaattcgcgggtgattatgtaaatgctttggctcattatgagaaaggaataacaggtgataataaggaacatgatgaagcttgtctggctggagtggcccagatgtccataagaatgggagacatacgtcgaggggttaaccaagccctcaagcatcccagcagggtccttaaaagagactgtggagccatattggagaatatgaagcaattttcagaagcggcccaactgtatgaaaaaggtctctactacgataaagcagcatctgtttacatccgctctaagaattgggcaaaagttggtgatcttctgccccacgtttcttctcctaagatccatttgcagtatgccaaagccaaggaagcagatggaagatacaaagaagctgttgtagcttatgaaaatgcaaaacagtggcaaagtgtaatccgcatctatctggatcacctcaataatcctgaaaaagctgtcaatattgttagagagacccagtctctggatggagccaaaatggtagccaggttttttctacagcttggtgactatgggtctgccatccagtttcttgtcatgtccaaatgcaacaatgaagctttcacactggctcagcaacacaacaaaatggaaatctatgcagatattattggttctgaagacactactaatgaagactatcaaagcattgccttatactttgaaggagaaaagagatatcttcaggctggaaaattcttcttgctgtgtggccaatattcacgagcacttaaacacttcctgaaatgcccaagctcggaagataatgtggcaatagaaatggcaattgaaactgttggtcaggccaaagatgaactgctgaccaatcagctgatagaccatctcctgggggagaacgatggcatgcctaaggatgccaagtacctgttccgcttgtacatggctctgaagcaataccgagaagctgcccagactgccatcatcattgccagagaagagcagtctgcaggcaactaccggaatgcacacgatgttctcttcagtatgtatgcagaactgaaatcccagaagatcaaaattccctccgagatggccaccaacctcatgattctgcacagctatatactagtaaagattcatgttaaaaatggagatcacatgaaaggggctcgcatgctcattcgggtggccaacaacatcagcaaatttccatcacacattgtacccatcctgacgtcaactgtgattgagtgtcacagggcaggcctgaagaactctgctttcagcttcgcagctatgttgatgaggcctgaataccgcagcaaaatagatgccaaatacaaaaagaagatcgagggaatggtcaggagacccgatatatctgagatagaagaggccacgactccatgtccattctgcaaatttcttctcccagagtgtgaactcctctgtcctggatgtaaaaacagtatcccatattgcattgcaacaggtcgacacatgttgaaagatgactggacggtgtgtccacattgtgacttccctgctctatactcagaattgaagatcatgctaaacactgaaagcacatgtcctatgtgttcagaaagattaaacgctgctcagctgaaaaagatttcagactgtacccagtacctgcgaacggaggaggaactgtgattggcacgtgcagatacaatgctcctgagaagacagcattttccacaggaggctgtttcctcccctggtggatttaagagacggtcctttctggatacagagaaatgaaacaacggtgacctctccaggtcggcactttccacttctgtacggtggcaaaacgatgacatgtaaccttgctgtttattgtactttgtatattatttcctcttcaaagtctttcttacacactctatcctctgcactgttaatagtaacctatgacataattgtaaatattcagctttttgctaacttttgtattttg

SEQ ID NO: 199721 - DNA, 573 bp, Homo sapiens
  Payload ID: 19405
  Gene Name: WD repeat domain 19
  ENST ID: ENST00000505055
  CDS Start-End: 30-266
atagttcgcgtagcggctcgagcgtggagatgaagcgtattttctcactgctagaaaagacttggcttggcgcaccaatacagtttgcctggcaaaaaacatcaggaaactaccttgcagtaacaggtaactgtgttgccatggattgggataaagatggagatgtcctagcagtgattgctgagaaatctagctgcatttatctttgggatgccaacacaaataagaccagccagttagacaatggcatgaggaaaacatactaagagaatcacttgtggatgttggaatgcagaaaatctgcttgctttaggtggtgaagataaaatgattacagttagtaatcaggaaggtgacacgataagacagacacaagtgagatcagagcctagcaacatgcagtttttcttgatgaagatggatgaccgaacctctgctgctgaaagcatgataagtgtggtgcttggcaagaaaactttgttttttttaaatctgaatgaaccagataacccagctgatcttgaatttcagcaggactttggcaacattgtctgctataattggtatggtgat

SEQ ID NO: 199722 - DNA, 540 bp, Homo sapiens
  Payload ID: 19405
  Gene Name: WD repeat domain 19
  ENST ID: ENST00000509560
  CDS Start-End: 115-540
atagttcgcgtagcggctcgagcgtggagatgaagagctgattatattgtgaaaatctttgatcgccatggtcaaaaaagaagtgaaattaacttacctggtaactgtgttgccatggattgggataaagatggagatgtcctagcagtgattgctgagaaatctagctgcatttatctttgggatgccaacacaaataagaccagccagttagacaatggcatgagggatcaaatgtctttccttctttggtcaaaagttggaagtttcctggctgttggaactgttaaaggaaatttgcttatttataatcatcagacatctcgaaagattcctgtccttggaaaacatactaagagaatcacttgtggatgttggaatgcagaaaatctgcttgctttaggtggtgaagataaaatgattacagttagtaatcaggaaggtgacacgataagacagacacaagtgagatcagagcctagcaacatgcagtttttcttgatgaagatggatgaccgaacctctgctgctgaaagcatg

SEQ ID NO: 199723 - DNA, 2198 bp, Homo sapiens
  Payload ID: 19406
  Gene Name: WD repeat domain 20
  Uniprot ID: Q8TBZ3
  ENST ID: ENST00000299135
  CDS Start-End: 14-274
gctgctttccaagatggcgacggagggaggagggaaggagatgaacgagattaagacccaattcaccacccgggaaggtctgtacaagctgctgccgcactcggagtacagccggcccaaccgggtgcccttcaactcgcagggatccaaccctgtccgcgtctccttcgtaaacctcaacgaccagtctggcaacggcgaccgcctctgcttcaatgtgggccgggagctgtacttctatatctacaagggggtccgcaagacaatcccatgagagactaatagacaagtcacgagttacctgtgtcaaatgggttcccggttcggaaagccttttcctagtagcccactcgagtgggaacatgtacttatataatgtggagcacacttgtggcaccacagccccccactaccagcttctgaagcagggagagagctttgccgtgcacacttgcaagagcaaatccacgaggaaccctctccttaagtggacggtgggcgagggggccctcaacgagtttgctttctccccagatggcaagttcttagcgtgcgtgagccaggacgggtttctgcgggtgttcaactttgactcagtggagctgcacggtacgatgaaaagctactttgggggcttgctgtgtgtgtgctggagcccggatggcaagtacatcgtgacaggtggggaggacgacttggtgacagtctggtcctttgtagactgccgagtaatagccagaggccacgggcacaagtcctgggtcagtgttgtagcgtttgacccttataccactagtgtagaagaaggtgaccctatggagtttagtggcagcgatgaggacttccaagaccttcttcattttggcagagatcgagcaaatagtacacagtccaggctctccaaacggaactctacagacagccgccccgtaagtgtcacgtatcggtttggttccgtgggccaggacacacagctctgtttatgggaccttacagaagatatccttttccctcaccaacccctctcaagagcaaggacacacacaaatgtcatgaatgccacgagtcctcctgctggaagcaatgggaacagtgttacaacacccgggaactctgtgccgcctcctctgccacggtccaacagccttccacattcagcagtctcaaatgctggcagcaaaagcagtgtcatggacggggccattgcttctggggtcagcaaatttgcaacactttcactacatgaccggaaggagaggcaccacgagaaagatcacaagcgaaatcatagcatgggacacatttctagcaagagcagtgacaaactgaatctagttaccaaaaccaaaacggaccctgctaaaactctgggaacgcccctgtgtcctcgaatggaagatgttcccttgttagagccgctgatatgtaaaaagatagcacatgagagactgactgtactaatatttcttgaagactgtatagtcactgcttgtcaggagggatttatttgcacatggggaaggcctggtaaagtggtaagttttaatccttaatgctgcaccagatctagaacttgaataggtagtgacttttttctttttcgtgggaggggtggggtgtacaatgaatgtgaatgacacttcttattcttaatgtaaatctcaatgcatcagagccataattttggatactgcatgccatgtaattctgaatcatttgataatttaccttagagcatttaaaaaaatataatcaaactaattgccagccaagtcagtcatcctcctgggagtatatagagtcccaaggttagcgctcctgtattagactatttcaattttaggaaaatcatgaccatgtggggaaacaatgactttaaaatgctgaaattaaaatttatgctttaactggaatattttttgcttaactactcaattagaatattgtacacctgatcaatgtgtgttcagcacagatggccatgaattgtcatttatagtccaattttttatcttaatcataaaatgtttaggaatctatgaaatttaactttaggaacaaaacgtttagcagggttgattgatattatttttacattgttctggcaatccacagaaagagaagagccttaatttttaaaacccattttagtcattttatgacaattaaagttgtttaataaacatcttttttcaaag

SEQ ID NO: 199724 - DNA, 3060 bp, Homo sapiens
  Payload ID: 19406
  Gene Name: WD repeat domain 20
  Uniprot ID: Q8TBZ3
  ENST ID: ENST00000322340
  CDS Start-End: 50-637
ggtgggcgtgatccgggcacttagggcaggatgaacgctgctttccaagatggcgacggagggaggagggaaggagatgaacgagattaagacccaattcaccacccgggaaggtctgtacaagctgctgccgcactcggagtacagccggcccaaccgggtgcccttcaactcgcagggatccaaccctgtccgcgtctccttcgtaaacctcaacgaccagtctggcaacggcgaccgcctctgcttcaatgtgggccgggagctgtacttctatatctacaagggggtccgcaaggctgctgacttgagtaaaccaatagataaaaggatatacaaaggaacacagcctacttgtcatgacttcaaccacctaacagccacagcagaaagtgtctctctcctagtgggcttttccgcaggccaagtccagcttatagacccaatcaaaaaagaaactagcaaactttttaatgaggaaaactcttgtcagcacttgtggaaggtggattggaatgaagaaagacagaatgaaggtagcaagaccagtgaggaggctctagtaactgtccagccggcagagcacttctgcaggcaggaggacaggatgcaaggtgttctccaagaccagaactaaaagtgcccaacagcttgagaagagggcactggagagaggggcagggaagcgcccttctcctcggctgtgcttctgagtaatggctcccgcagacctggggagggcctggggaggggtggccgcggtggttcctgatatcaggtgtgtaaggtgcaatgcgtgctgctaaccctaggagaaatttggggaaaatatttgtagttttctcgccaaactttgagcttcctcattgaaatttttcagtctttcagcctaaacgttattatgagcaagaatatcttttctaacctaatctgtggaataaaacacagcatttggcaagaagaggctgttaaatactcagtcagcatcactgttccagcgtgtaccaaaccacagagatgaaaggctcagacgaaagtcaggtgcacgctgcgtggctggagaatcccgctcccacccggcaagggggcgagctggtccctgggcggtgtcagacaccttctgaaggtgccaggccagggccaggggagcttcaactcgccctccttgggttggcctttttcaccagaattcaagaagccagatttgtgctgtgactgcgatggggcaggcttctaaacactactggtggccctggagcctttctctgaggcttttttcttattcagaaggagaattaaaaattcccccagcggcctggagaagggaacctttggaaaagcttgccttcttttaaaagcaaatgcatgtgcaggagtagacactttacaaataaccagtagccttggggtcgaaatttgcttaaatcatggtaaaggatctcatttctcttttgtgctgattgaaccttctagcagtttggaagtgttttcctgtgaacccttagctggggactgagggtaaatgccttaaaaatggaggcatggaaaatcagaaaggagctatcacaatcattcttttctcaaaggcgttcaggaattctgaggaagaaatgcagtgacaggatgggattttaggggcaaggacaccgtccgggcggggcccagggctctccactggctgacttcacccccagggcccagctggcacgtggccaggcagccatttctccccagttcctccacttcctggggttcattttaaataataaattgtaaagtatgaaatgagtgctgaagttgcctgcatacaaggtcctcatcacctctcgcctgggagggagacgttttctttctttgttgagcgagctcaaagtgtgaggcggagaaaacctaggggttgggggcggctggagaagggatccacggaaacccaagcgccacatcatgcgtgtctgactgcccacggaagaactagaagcagttcaccagtggattttctggggaacgattcatggaacacagcgtctggcgtccagctttgtgggtgagggcatggcgggggatccggtggccctgccctgcctccggtgccggtggatgggggagggactggcctctgactgcggggttgcaccatggcggcggtcggtgtgcccttggctgaggtttcgttccttagcagtgagaacctccacatgcgtgggtaggggtcgggtgacctggagacgcctcctccggtctggtctgggtgacaaaggtgaaggtttatagtctaccaccctggcagcagcctgcagggcccccccttgtctggagcacacccttcgccacgggctgattgggactgtcgggtgttgctttaagttaacaaggtgcacatcacagcgaccccaagtgatgtcccaaagggaggagacattagtctggccgaagtgaagtctgtggctttatatgtaaaagcactcgtatgcaactgttacctttgaaactcagatcctagttacgaactataagaacgtgcccctccagtagagggagactgtctcactgatgttgatttctttattcatttccgcatctgttacacgaacttcgtgtcataaattgctatcctttcatttgaaagtgtaaaaaatttcctgcatttttatcatttctgtatacttgagtttattagagattgttatgttaggcgacactgtataaaattgtatggatattttgagtgaaaatcaaaagtaaaattcacatgtatttccttttttatattttcatccaatttcttgacaacttgaataaatttcataaagagccttcctaacatgaaatattggtaaattaaattctttactgttgcaataattaatgaaactttagtatcagtattgttttataattttaaggaaatcatgtttgtttcactgctttgtttttttttttagctgttgccttgtcactgtcacagctaacaagacttactacatacttgatattctgaagtactgtggggctgtcctctgtatactgacattaaataaacgtgtgtgagtgaactgtaaa

SEQ ID NO: 199725 - DNA, 2616 bp, Homo sapiens
  Payload ID: 19406
  Gene Name: WD repeat domain 20
  Uniprot ID: Q8TBZ3
  ENST ID: ENST00000335263
  CDS Start-End: 81-1826
gaagagggagcaccaggaacagcgcctgcgcggtgggcgtgatccgggcacttagggcaggatgaacgctgctttccaagatggcgacggagggaggagggaaggagatgaacgagattaagacccaattcaccacccgggaaggtctgtacaagctgctgccgcactcggagtacagccggcccaaccgggtgcccttcaactcgcagggatccaaccctgtccgcgtctccttcgtaaacctcaacgaccagtctggcaacggcgaccgcctctgcttcaatgtgggccgggagctgtacttctatatctacaagggggtccgcaaggctgctgacttgagtaaaccaatagataaaaggatatacaaaggaacacagcctacttgtcatgacttcaaccacctaacagccacagcagaaagtgtctctctcctagtgggcttttccgcaggccaagtccagcttatagacccaatcaaaaaagaaactagcaaactttttaatgaggaaagactaatagacaagtcacgagttacctgtgtcaaatgggttcccggttcggaaagccttttcctagtagcccactcgagtgggaacatgtacttatataatgtggagcacacttgtggcaccacagccccccactaccagcttctgaagcagggagagagctttgccgtgcacacttgcaagagcaaatccacgaggaaccctctccttaagtggacggtgggcgagggggccctcaacgagtttgctttctccccagatggcaagttcttagcgtgcgtgagccaggacgggtttctgcgggtgttcaactttgactcagtggagctgcacggtacgatgaaaagctactttgggggcttgctgtgtgtgtgctggagcccggatggcaagtacatcgtgacaggtggggaggacgacttggtgacagtctggtcctttgtagactgccgagtaatagccagaggccacgggcacaagtcctgggtcagtgttgtagcgtttgacccttataccactagtgtagaagaaggtgaccctatggagtttagtggcagcgatgaggacttccaagaccttcttcattttggcagagatcgagcaaatagtacacagtccaggctctccaaacggaactctacagacagccgccccgtaagtgtcacgtatcggtttggttccgtgggccaggacacacagctctgtttatgggaccttacagaagatatccttttccctcaccaacccctctcaagagcaaggacacacacaaatgtcatgaatgccacgagtcctcctgctggaagcaatgggaacagtgttacaacacccgggaactctgtgccgcctcctctgccacggtccaacagccttccacattcagcagtctcaaatgctggcagcaaaagcagtgtcatggacggggccattgcttctggggtcagcaaatttgcaacactttcactacatgaccggaaggagaggcaccacgagaaagatcacaagcgaaatcatagcatgggacacatttctagcaagagcagtgacaaactgaatctagttaccaaaaccaaaacggaccctgctaaaactctgggaacgcccctgtgtcctcgaatggaagatgttcccttgttagagccgctgatatgtaaaaagatagcacatgagagactgactgtactaatatttcttgaagactgtatagtcactgcttgtcaggagggatttatttgcacatggggaaggcctggtaaagtgggctcattgtcatccccaagccaggccagttctccaggtggaactgtagtgtagcgacctcactgctgcgcgcacagtctcccgggacttggactcgagggagtgacgaggaggagctccgagctgcgcctgagccgtgccagccggcggacctcaggcggtggacgtcggcgatagccgtgtggacggtgaccggctcactctgcggcgccgtgctcccgctgctcacccaaagaagttgtttccattttaaaccggtcttttggggctgcagtaaaaaataagaaatggagttttcttgctttttactctaaaattcaatgtaattaaatttcatatatatataatatatacatatatacatagtgtaaaataaaatgtttcttggacaagaaatcccctgaaattcagctgttatagtgcttcactgtttttgcactgatttttctataccttaggtggtcagaagacaaccttgaatgcactcatagagaaaactgttactttctgacgtaatgtaattcaggaagacagacgctgcaatcacagattttaaaaaattgtttgcacttaaaaatagttgaatgctggtggaaagttactttgcagatgggtgtaaggactcatggccctctgaggtgcggcgtgaagatgccctttttacccgttgacgtttattttacgtaaaataaactgttgtttccaatgcaatcaactctgtattatatgtataaatattgtaattctgcaattggggaaaatagttacttcactagtaattttcatcatttaagagtgatatttctaattcacaaaagttaatattaaaactatcttgaatata

SEQ ID NO: 199726 - DNA, 2391 bp, Homo sapiens
  Payload ID: 19406
  Gene Name: WD repeat domain 20
  Uniprot ID: Q8TBZ3
  ENST ID: ENST00000342702
  CDS Start-End: 32-1741
acttagggcaggatgaacgctgctttccaagatggcgacggagggaggagggaaggagatgaacgagattaagacccaattcaccacccgggaaggtctgtacaagctgctgccgcactcggagtacagccggcccaaccgggtgcccttcaactcgcagggatccaaccctgtccgcgtctccttcgtaaacctcaacgaccagtctggcaacggcgaccgcctctgcttcaatgtgggccgggagctgtacttctatatctacaagggggtccgcaaggctgctgacttgagtaaaccaatagataaaaggatatacaaaggaacacagcctacttgtcatgacttcaaccacctaacagccacagcagaaagtgtctctctcctagtgggcttttccgcaggccaagtccagcttatagacccaatcaaaaaagaaactagcaaactttttaatgaggaaagactaatagacaagtcacgagttacctgtgtcaaatgggttcccggttcggaaagccttttcctagtagcccactcgagtgggaacatgtacttatataatgtggagcacacttgtggcaccacagccccccactaccagcttctgaagcagggagagagctttgccgtgcacacttgcaagagcaaatccacgaggaaccctctccttaagtggacggtgggcgagggggccctcaacgagtttgctttctccccagatggcaagttcttagcgtgcgtgagccaggacgggtttctgcgggtgttcaactttgactcagtggagctgcacggtacgatgaaaagctactttgggggcttgctgtgtgtgtgctggagcccggatggcaagtacatcgtgacaggtggggaggacgacttggtgacagtctggtcctttgtagactgccgagtaatagccagaggccacgggcacaagtcctgggtcagtgttgtagcgtttgacccttataccactagtgtagaagaaggtgaccctatggagtttagtggcagcgatgaggacttccaagaccttcttcattttggcagagatcgagcaaatagtacacagtccaggctctccaaacggaactctacagacagccgccccgtaagtgtcacgtatcggtttggttccgtgggccaggacacacagctctgtttatgggaccttacagaagatatccttttccctcaccaacccctctcaagagcaaggacacacacaaatgtcatgaatgccacgagtcctcctgctggaagcaatgggaacagtgttacaacacccgggaactctgtgccgcctcctctgccacggtccaacagccttccacattcagcagtctcaaatgctggcagcaaaagcagtgtcatggacggggccattgcttctggggtcagcaaatttgcaacactttcactacatgaccggaaggagaggcaccacgagaaagatcacaagcgaaatcatagcatgggacacatttctagcaagagcagtgacaaactgaatctagttaccaaaaccaaaacggaccctgctaaaactctgggaacgcccctgtgtcctcgaatggaagatgttcccttgttagagccgctgatatgtaaaaagatagcacatgagagactgactgtactaatatttcttgaagactgtatagtcactgcttgtcaggagggatttatttgcacatggggaaggcctggtaaagtggtaagttttaatccttaatgctgcaccagatctagaacttgaataggtagtgacttttttctttttcgtgggaggggtggggtgtacaatgaatgtgaatgacacttcttattcttaatgtaaatctcaatgcatcagagccataattttggatactgcatgccatgtaattctgaatcatttgataatttaccttagagcatttaaaaaaatataatcaaactaattgccagccaagtcagtcatcctcctgggagtatatagagtcccaaggttagcgctcctgtattagactatttcaattttaggaaaatcatgaccatgtggggaaacaatgactttaaaatgctgaaattaaaatttatgctttaactggaatattttttgcttaactactcaattagaatattgtacacctgatcaatgtgtgttcagcacagatggccatgaattgtcatttatagtccaattttttatcttaatcataaaatgtttaggaatctatgaaatttaactttaggaacaaaacgtttagcagggttgattgatattatttttacattgttctggcaatccacagaaagagaagagccttaatttttaaaacccattttagtcattttatgacaattaaagttgtttaataaacatcttttttcaaagaagca

SEQ ID NO: 199727 - DNA, 2695 bp, Homo sapiens
  Payload ID: 19406
  Gene Name: WD repeat domain 20
  ENST ID: ENST00000424963
  CDS Start-End: 73-1911
agcaccaggaacagcgcctgcgcggtgggcgtgatccgggcacttagggcaggatgaacgctgctttccaagatggcgacggagggaggagggaaggagatgaacgagattaagacccaattcaccacccgggaaggtctgtacaagctgctgccgcactcggagtacagccggcccaaccgggtgcccttcaactcgcagggatccaaccctgtccgcgtctccttcgtaaacctcaacgaccagtctggcaacggcgaccgcctctgcttcaatgtgggccgggagctgtacttctatatctacaagggggtccgcaaggctgctgacttgagtaaaccaatagataaaaggatatacaaaggaacacagcctacttgtcatgacttcaaccacctaacagccacagcagaaagtgtctctctcctagtgggcttttccgcaggccaagtccagcttatagacccaatcaaaaaagaaactagcaaactttttaatgaggaaaactcttgtcagcacttgtggaaggtggattggaatgaagaaagacagaatgaaggtagcaagaccagtgaggaggctctagtaactgtccagagactaatagacaagtcacgagttacctgtgtcaaatgggttcccggttcggaaagccttttcctagtagcccactcgagtgggaacatgtacttatataatgtggagcacacttgtggcaccacagccccccactaccagcttctgaagcagggagagagctttgccgtgcacacttgcaagagcaaatccacgaggaaccctctccttaagtggacggtgggcgagggggccctcaacgagtttgctttctccccagatggcaagttcttagcgtgcgtgagccaggacgggtttctgcgggtgttcaactttgactcagtggagctgcacggtacgatgaaaagctactttgggggcttgctgtgtgtgtgctggagcccggatggcaagtacatcgtgacaggtggggaggacgacttggtgacagtctggtcctttgtagactgccgagtaatagccagaggccacgggcacaagtcctgggtcagtgttgtagcgtttgacccttataccactagtgtagaagaaggtgaccctatggagtttagtggcagcgatgaggacttccaagaccttcttcattttggcagagatcgagcaaatagtacacagtccaggctctccaaacggaactctacagacagccgccccgtaagtgtcacgtatcggtttggttccgtgggccaggacacacagctctgtttatgggaccttacagaagatatccttttccctcaccaacccctctcaagagcaaggacacacacaaatgtcatgaatgccacgagtcctcctgctggaagcaatgggaacagtgttacaacacccgggaactctgtgccgcctcctctgccacggtccaacagccttccacattcagcagtctcaaatgctggcagcaaaagcagtgtcatggacggggccattgcttctggggtcagcaaatttgcaacactttcactacatgaccggaaggagaggcaccacgagaaagatcacaagcgaaatcatagcatgggacacatttctagcaagagcagtgacaaactgaatctagttaccaaaaccaaaacggaccctgctaaaactctgggaacgcccctgtgtcctcgaatggaagatgttcccttgttagagccgctgatatgtaaaaagatagcacatgagagactgactgtactaatatttcttgaagactgtatagtcactgcttgtcaggagggatttatttgcacatggggaaggcctggtaaagtgggctcattgtcatccccaagccaggccagttctccaggtggaactgtagtgtagcgacctcactgctgcgcgcacagtctcccgggacttggactcgagggagtgacgaggaggagctccgagctgcgcctgagccgtgccagccggcggacctcaggcggtggacgtcggcgatagccgtgtggacggtgaccggctcactctgcggcgccgtgctcccgctgctcacccaaagaagttgtttccattttaaaccggtcttttggggctgcagtaaaaaataagaaatggagttttcttgctttttactctaaaattcaatgtaattaaatttcatatatatataatatatacatatatacatagtgtaaaataaaatgtttcttggacaagaaatcccctgaaattcagctgttatagtgcttcactgtttttgcactgatttttctataccttaggtggtcagaagacaaccttgaatgcactcatagagaaaactgttactttctgacgtaatgtaattcaggaagacagacgctgcaatcacagattttaaaaaattgtttgcacttaaaaatagttgaatgctggtggaaagttactttgcagatgggtgtaaggactcatggccctctgaggtgcggcgtgaagatgccctttttacccgttgacgtttattttacgtaaaataaactgttgtttccaatgcaatcaactctgtattatatgtataaatattgtaattctgcaattggggaaaatagttacttcactagtaattttcatcatttaagagtgatatttctaattcacaaaagttaatattaaaactatcttg

SEQ ID NO: 199728 - DNA, 2067 bp, Homo sapiens
  Payload ID: 19406
  Gene Name: WD repeat domain 20
  Uniprot ID: Q8TBZ3
  ENST ID: ENST00000454394
  CDS Start-End: 11-1813
gctttccaagatggcgacggagggaggagggaaggagatgaacgagattaagacccaattcaccacccgggaaggtctgtacaagctgctgccgcactcggagtacagccggcccaaccgggtgcccttcaactcgcagggatccaaccctgtccgcgtctccttcgtaaacctcaacgaccagtctggcaacggcgaccgcctctgcttcaatgtgggccgggagctgtacttctatatctacaagggggtccgcaaggctgctgacttgagtaaaccaatagataaaaggatatacaaaggaacacagcctacttgtcatgacttcaaccacctaacagccacagcagaaagtgtctctctcctagtgggcttttccgcaggccaagtccagcttatagacccaatcaaaaaagaaactagcaaactttttaatgaggaaaactcttgtcagcacttgtggaaggtggattggaatgaagaaagacagaatgaaggtagcaagaccagtgaggaggctctagtaactgtccagagactaatagacaagtcacgagttacctgtgtcaaatgggttcccggttcggaaagccttttcctagtagcccactcgagtgggaacatgtacttatataatgtggagcacacttgtggcaccacagccccccactaccagcttctgaagcagggagagagctttgccgtgcacacttgcaagagcaaatccacgaggaaccctctccttaagtggacggtgggcgagggggccctcaacgagtttgctttctccccagatggcaagttcttagcgtgcgtgagccaggacgggtttctgcgggtgttcaactttgactcagtggagctgcacggtacgatgaaaagctactttgggggcttgctgtgtgtgtgctggagcccggatggcaagtacatcgtgacaggtggggaggacgacttggtgacagtctggtcctttgtagactgccgagtaatagccagaggccacgggcacaagtcctgggtcagtgttgtagcgtttgacccttataccactagtgtagaagaaggtgaccctatggagtttagtggcagcgatgaggacttccaagaccttcttcattttggcagagatcgagcaaatagtacacagtccaggctctccaaacggaactctacagacagccgccccgtaagtgtcacgtatcggtttggttccgtgggccaggacacacagctctgtttatgggaccttacagaagatatccttttccctcaccaacccctctcaagagcaaggacacacacaaatgtcatgaatgccacgagtcctcctgctggaagcaatgggaacagtgttacaacacccgggaactctgtgccgcctcctctgccacggtccaacagccttccacattcagcagtctcaaatgctggcagcaaaagcagtgtcatggacggggccattgcttctggggtcagcaaatttgcaacactttcactacatgaccggaaggagaggcaccacgagaaagatcacaagcgaaatcatagcatgggacacatttctagcaagagcagtgacaaactgaatctagttaccaaaaccaaaacggaccctgctaaaactctgggaacgcccctgtgtcctcgaatggaagatgttcccttgttagagccgctgatatgtaaaaagatagcacatgagagactgactgtactaatatttcttgaagactgtatagtcactgcttgtcaggagggatttatttgcacatggggaaggcctggtaaagtggtaagttttaatccttaatgctgcaccagatctagaacttgaataggtagtgacttttttctttttcgtgggaggggtggggtgtacaatgaatgtgaatgacacttcttattcttaatgtaaatctcaatgcatcagagccataattttggatactgcatgccatgtaattctgaatcatttgataatttaccttagagcatttaaaaaaatataatcaaactaattgccagccaagtcagtcatcctcctgggagtatatagagtcccaa

SEQ ID NO: 199729 - DNA, 2382 bp, Homo sapiens
  Payload ID: 19406
  Gene Name: WD repeat domain 20
  Uniprot ID: Q8TBZ3
  ENST ID: ENST00000556807
  CDS Start-End: 32-1594
acttagggcaggatgaacgctgctttccaagatggcgacggagggaggagggaaggagatgaacgagattaagacccaattcaccacccgggaaggtctgtacaagctgctgccgcactcggagtacagccggcccaaccgggtgcccttcaactcgcagggatccaaccctgtccgcgtctccttcgtaaacctcaacgaccagtctggcaacggcgaccgcctctgcttcaatgtgggccgggagctgtacttctatatctacaagggggtccgcaagagactaatagacaagtcacgagttacctgtgtcaaatgggttcccggttcggaaagccttttcctagtagcccactcgagtgggaacatgtacttatataatgtggagcacacttgtggcaccacagccccccactaccagcttctgaagcagggagagagctttgccgtgcacacttgcaagagcaaatccacgaggaaccctctccttaagtggacggtgggcgagggggccctcaacgagtttgctttctccccagatggcaagttcttagcgtgcgtgagccaggacgggtttctgcgggtgttcaactttgactcagtggagctgcacggtacgatgaaaagctactttgggggcttgctgtgtgtgtgctggagcccggatggcaagtacatcgtgacaggtggggaggacgacttggtgacagtctggtcctttgtagactgccgagtaatagccagaggccacgggcacaagtcctgggtcagtgttgtagcgtttgacccttataccactagtgtagaagaaggtgaccctatggagtttagtggcagcgatgaggacttccaagaccttcttcattttggcagagatcgagcaaatagtacacagtccaggctctccaaacggaactctacagacagccgccccgtaagtgtcacgtatcggtttggttccgtgggccaggacacacagctctgtttatgggaccttacagaagatatccttttccctcaccaacccctctcaagagcaaggacacacacaaatgtcatgaatgccacgagtcctcctgctggaagcaatgggaacagtgttacaacacccgggaactctgtgccgcctcctctgccacggtccaacagccttccacattcagcagtctcaaatgctggcagcaaaagcagtgtcatggacggggccattgcttctggggtcagcaaatttgcaacactttcactacatgaccggaaggagaggcaccacgagaaagatcacaagcgaaatcatagcatgggacacatttctagcaagagcagtgacaaactgaatctagttaccaaaaccaaaacggaccctgctaaaactctgggaacgcccctgtgtcctcgaatggaagatgttcccttgttagagccgctgatatgtaaaaagatagcacatgagagactgactgtactaatatttcttgaagactgtatagtcactgcttgtcaggagggatttatttgcacatggggaaggcctggtaaagtgggctcattgtcatccccaagccaggccagttctccaggtggaactgtagtgtagcgacctcactgctgcgcgcacagtctcccgggacttggactcgagggagtgacgaggaggagctccgagctgcgcctgagccgtgccagccggcggacctcaggcggtggacgtcggcgatagccgtgtggacggtgaccggctcactctgcggcgccgtgctcccgctgctcacccaaagaagttgtttccattttaaaccggtcttttggggctgcagtaaaaaataagaaatggagttttcttgctttttactctaaaattcaatgtaattaaatttcatatatatataatatatacatatatacatagtgtaaaataaaatgtttcttggacaagaaatcccctgaaattcagctgttatagtgcttcactgtttttgcactgatttttctataccttaggtggtcagaagacaaccttgaatgcactcatagagaaaactgttactttctgacgtaatgtaattcaggaagacagacgctgcaatcacagattttaaaaaattgtttgcacttaaaaatagttgaatgctggtggaaagttactttgcagatgggtgtaaggactcatggccctctgaggtgcggcgtgaagatgccctttttacccgttgacgtttattttacgtaaaataaactgttgtttccaatgcaatcaactctgtattatatgtataaatattgtaattctgcaattggggaaaatagttacttcactagtaattttcatcatttaagagtgatatttctaattcacaaaagttaatattaaaactatcttgaata

SEQ ID NO: 199730 - DNA, 2117 bp, Homo sapiens
  Payload ID: 19406
  Gene Name: WD repeat domain 20
  Uniprot ID: Q8TBZ3
  ENST ID: ENST00000556511
  CDS Start-End: 1-1527
atggcgacggagggaggagggaaggagatgaacgagattaagacccaattcaccacccgggaaggtctgtacaagctgctgccgcactcggagtacagccggcccaaccgggtgcccttcaactcgcagggatccaaccctgtccgcgtctccttcgtaaacctcaacgaccagtctggcaacggcgaccgcctctgcttcaatgtgggccgggagctgtacttctatatctacaagggggtccgcaagagactaatagacaagtcacgagttacctgtgtcaaatgggttcccggttcggaaagccttttcctagtagcccactcgagtgggaacatgtacttatataatgtggagcacacttgtggcaccacagccccccactaccagcttctgaagcagggagagagctttgccgtgcacacttgcaagagcaaatccacgaggaaccctctccttaagtggacggtgggcgagggggccctcaacgagtttgctttctccccagatggcaagttcttagcgtgcgtgagccaggacgggtttctgcgggtgttcaactttgactcagtggagctgcacggtacgatgaaaagctactttgggggcttgctgtgtgtgtgctggagcccggatggcaagtacatcgtgacaggtggggaggacgacttggtgacagtctggtcctttgtagactgccgagtaatagccagaggccacgggcacaagtcctgggtcagtgttgtagcgtttgacccttataccactagtgtagaagaaggtgaccctatggagtttagtggcagcgatgaggacttccaagaccttcttcattttggcagagatcgagcaaatagtacacagtccaggctctccaaacggaactctacagacagccgccccgtaagtgtcacgtatcggtttggttccgtgggccaggacacacagctctgtttatgggaccttacagaagatatccttttccctcaccaacccctctcaagagcaaggacacacacaaatgtcatgaatgccacgagtcctcctgctggaagcaatgggaacagtgttacaacacccgggaactctgtgccgcctcctctgccacggtccaacagccttccacattcagcagtctcaaatgctggcagcaaaagcagtgtcatggacggggccattgcttctggggtcagcaaatttgcaacactttcactacatgaccggaaggagaggcaccacgagaaagatcacaagcgaaatcatagcatgggacacatttctagcaagagcagtgacaaactgaatctagttaccaaaaccaaaacggaccctgctaaaactctgggaacgcccctgtgtcctcgaatggaagatgttcccttgttagagccgctgatatgtaaaaagatagcacatgagagactgactgtactaatatttcttgaagactgtatagtcactgcttgtcaggagggatttatttgcacatggggaaggcctggtaaagtggtaagttttaatccttaatgctgcaccagatctagaacttgaataggtagtgacttttttctttttcgtgggaggggtggggtgtacaatgaatgtgaatgacacttcttattcttaatgtaaatctcaatgcatcagagccataattttggatactgcatgccatgtaattctgaatcatttgataatttaccttagagcatttaaaaaaatataatcaaactaattgccagccaagtcagtcatcctcctgggagtatatagagtcccaaggttagcgctcctgtattagactatttcaattttaggaaaatcatgaccatgtggggaaacaatgactttaaaatgctgaaattaaaatttatgctttaactggaatattttttgcttaactactcaattagaatattgtacacctgatcaatgtgtgttcagcacagatggccatgaattgtcatttatagtccaattttttatcttaatcataaaatgtttaggaatctatgaaatttaactttaggaacaaaacgtttagcagggttgattgatattatttttacattgttctggcaatccacagaaagagaagagccttaatttttaaaacc

SEQ ID NO: 199731 - DNA, 2175 bp, Homo sapiens
  Payload ID: 19406
  Gene Name: WD repeat domain 20
  Uniprot ID: Q8TBZ3
  ENST ID: ENST00000555879
  CDS Start-End: 32-292
acttagggcaggatgaacgctgctttccaagatggcgacggagggaggagggaaggagatgaacgagattaagacccaattcaccacccgggaaggtctgtacaagctgctgccgcactcggagtacagccggcccaaccgggtgcccttcaactcgcagggatccaaccctgtccgcgtctccttcgtaaacctcaacgaccagtctggcaacggcgaccgcctctgcttcaatgtgggccgggagctgtacttctatatctacaagggggtccgcaagacaatcccatgaggttggtagaacagagattctcatctccgttttaactgaggctgctgacttgagtaaaccaatagataaaaggatatacaaaggaacacagcctacttgtcatgacttcaaccacctaacagccacagcagaaagtgtctctctcctagtgggcttttccgcaggccaagtccagcttatagacccaatcaaaaaagaaactagcaaactttttaatgaggaaatggcaagttcttagcgtgcgtgagccaggacgggtttctgcgggtgttcaactttgactcagtggagctgcacggtacgatgaaaagctactttgggggcttgctgtgtgtgtgctggagcccggatggcaagtacatcgtgacaggtggggaggacgacttggtgacagtctggtcctttgtagactgccgagtaatagccagaggccacgggcacaagtcctgggtcagtgttgtagcgtttgacccttataccactagtgtagaagaaggtgaccctatggagtttagtggcagcgatgaggacttccaagaccttcttcattttggcagagatcgagcaaatagtacacagtccaggctctccaaacggaactctacagacagccgccccgtaagtgtcacgtatcggtttggttccgtgggccaggacacacagctctgtttatgggaccttacagaagatatccttttccctcaccaacccctctcaagagcaaggacacacacaaatgtcatgaatgccacgagtcctcctgctggaagcaatgggaacagtgttacaacacccgggaactctgtgccgcctcctctgccacggtccaacagccttccacattcagcagtctcaaatgctggcagcaaaagcagtgtcatggacggggccattgcttctggggtcagcaaatttgcaacactttcactacatgaccggaaggagaggcaccacgagaaagatcacaagcgaaatcatagcatgggacacatttctagcaagagcagtgacaaactgaatctagttaccaaaaccaaaacggaccctgctaaaactctgggaacgcccctgtgtcctcgaatggaagatgttcccttgttagagccgctgatatgtaaaaagatagcacatgagagactgactgtactaatatttcttgaagactgtatagtcactgcttgtcaggagggatttatttgcacatggggaaggcctggtaaagtggtaagttttaatccttaatgctgcaccagatctagaacttgaataggtagtgacttttttctttttcgtgggaggggtggggtgtacaatgaatgtgaatgacacttcttattcttaatgtaaatctcaatgcatcagagccataattttggatactgcatgccatgtaattctgaatcatttgataatttaccttagagcatttaaaaaaatataatcaaactaattgccagccaagtcagtcatcctcctgggagtatatagagtcccaaggttagcgctcctgtattagactatttcaattttaggaaaatcatgaccatgtggggaaacaatgactttaaaatgctgaaattaaaatttatgctttaactggaatattttttgcttaactactcaattagaatattgtacacctgatcaatgtgtgttcagcacagatggccatgaattgtcatttatagtccaattttttatcttaatcataaaatgtttaggaatctatgaaatttaactttaggaacaaaacgtttagcagggttgattgatattatttttacattgttctggcaatccacagaaagagaagagccttaatttttaaaacccattttagtcattttatgacaattaaagttgtttaataaacatcttttttc

SEQ ID NO: 199732 - DNA, 785 bp, Homo sapiens
  Payload ID: 19406
  Gene Name: WD repeat domain 20
  ENST ID: ENST00000556094
  CDS Start-End: 10-81
ctttccaagatggcgacggagggaggagggaaggagatgaacgagattaagacccaattcaccacccgggaaggctgctgacttgagtaaaccaatagataaaaggatatacaaaggaacacagcctacttgtcatgacttcaaccacctaacagccacagcagaaagtgtctctctcctagtgggcttttccgcaggccaagtccagcttatagacccaatcaaaaaagaaactagcaaactttttaatgaggaaggctcattgtcatccccaagccaggccagttctccaggtggaactgtagtgtagcgacctcactgctgcgcgcacagtctcccgggacttggactcgagggagtgacgaggaggagctccgagctgcgcctgagccgtgccagccggcggacctcaggcggtggacgtcggcgatagccgtgtggacggtgaccggctcactctgcggcgccgtgctcccgctgctcacccaaagaagttgtttccattttaaaccggtcttttggggctgcagtaaaaaataagaaatggagttttcttgctttttactctaaaattcaatgtaattaaatttcatatatatataatatatacatatatacatagtgtaaaataaaatgtttcttggacaagaaatcccctgaaattcagctgttatagtgcttcactgtttttgcactgatttttctataccttaggtggtcagaagacaaccttgaatgcactcatagagaaaactgttactttctgacgtaatgtaattcaggaa

SEQ ID NO: 199733 - DNA, 422 bp, Homo sapiens
  Payload ID: 19406
  Gene Name: WD repeat domain 20
  ENST ID: ENST00000559478
  CDS Start-End: 1-217
cttgagtaaaccaatagataaaaggatatacaaaggaacacagcctacttgtcatgacttcaaccacctaacagccacagcagaaagtgtctctctcctagtgggcttttccgcaggccaagtccagcttatagacccaatcaaaaaagaaactagcaaactttttaatgaggaagcttttgaggggaggtatgctacattttcaccatttgtatgaatgcagccacggaaaacttcacatcagctcagccctcggtttagttttcttcggaggagacattagttacagcttgagttctcagcctgccccactcgaaggcgccagcagggactctggatcacggggccatgaactatggagtgagtcttctagaaagagaaataataaaagacactaagacttgctgttctaaatgaaagaa

SEQ ID NO: 199734 - DNA, 586 bp, Homo sapiens
  Payload ID: 19406
  Gene Name: WD repeat domain 20
  ENST ID: ENST00000558567
  CDS Start-End: 28-558
agggcaggatgaacgctgctttccaagatggcgacggagggaggagggaaggagatgaacgagattaagacccaattcaccacccgggaaggtctgtacaagctgctgccgcactcggagtacagccggcccaaccgggtgcccttcaactcgcagggatccaaccctgtccgcgtctccttcgtaaacctcaacgaccagtctggcaacggcgaccgcctctgcttcaatgtgggccgggagctgtacttctatatctacaagggggtccgcaaggctgctgacttgagtaaaccaatagataaaaggatatacaaaggaacacagcctacttgtcatgacttcaaccacctaacagccacagcagaaagtgtctctctcctagtgggcttttccgcaggccaagtccagcttatagacccaatcaaaaaagaaactagcaaactttttaatgaggaaagacgggatttcaccatgttggccaggctagtctggaactcctggcttcaagtgatccacccacctcagcttcccaaagtgctggaattacaggcgtgagccaccacgcctggccaacacagaggtc

SEQ ID NO: 199735 - DNA, 532 bp, Homo sapiens
  Payload ID: 19406
  Gene Name: WD repeat domain 20
  ENST ID: ENST00000558854
  CDS Start-End: 333-532
aaaacaacaaaaaacagttgtaaggagtccatggcacagaaagtttaagcaccctgatttaggctgctgacttgagtaaaccaatagataaaaggatatacaaaggaacacagcctacttgtcatgacttcaaccacctaacagccacagcagaaagtgtctctctcctagtgggcttttccgcaggccaagtccagcttatagacccaatcaaaaaagaaactagcaaactttttaatgaggaaagactaatagacaagtcacgagttacctgtgtcaaatgggttcccggttcggaaagccttttcctagtagcccactcgagtgggaacatgtacttatataatgtggagcacacttgtggcaccacagccccccactaccagcttctgaagcagggagagagctttgccgtgcacacttgcaagagcaaatccacgaggaaccctctccttaagtggacggtgggcgagggggccctcaacgagtttgctttctccccagatggcaagttcttagcgtgcgtgagcca

SEQ ID NO: 199736 - DNA, 2763 bp, Homo sapiens
  Payload ID: 19407
  Gene Name: WD repeat domain 24
  Uniprot ID: Q96S15
  ENST ID: ENST00000248142
  CDS Start-End: 1-2763
atgggtaagaagaggaccacttccggcgagggacgggaaagacagcggcttccggcgcggcggttccggacaaccagccccgccgccctcagggctgacagtgtggacggcgggagtctcctcgctcccctgctgggattgactgaccgagcgtttagtgactgcccagatctggctgatggggccatggagaagatgtcccgtgtgaccacagccctgggtggcagcgtgctgacaggccgcaccatgcactgccacctggatgctcccgccaatgccatcagtgtgtgccgcgacgcagcccaggtggtcgtggcaggccgtagcatcttcaagatctatgccatcgaggaggaacagttcgtggaaaagctgaacctgcgtgtggggcgcaagccttcgcttaacctgagctgtgctgacgtggtctggcaccagatggatgagaacctgctggccacagcagccaccaatggcgtggtggtcacgtggaacctgggccggccatcccgcaacaagcaggaccagctgttcacagaacacaagcgcacggtaaacaaagtctgcttccaccccaccgaagcccacgtgctgctcagtggctcccaggatggcttcatgaagtgctttgacctccgcagaaaggactctgtcagcaccttctcgggtgaggccacagaggcagggccacgggagtgggcgatggctgggtgcgttcctattctcccagtgctcagctgccgcatcctgaggctgcaccacagctttgctcatggaccgatgcaggatgcagaatctacggcaaatgacgcccgggaatcttggggatgtccactctaccctctgggcctctgttctgggccacaggcaggccagtcggagagcgtgcgggacgtgcagttcagtatccgggactacttcaccttcgcctccacctttgagaacggcaatgtgcagctctgggacatccggcgtcccgaccggtgcgagaggatgttcacagcccacaacggacccgtcttctgctgcgactggcaccccgaggacaggggctggttggccactggagggcgcgacaagatggtgaaggtctgggacatgaccacgcaccgtgccaaggagatgcactgtgtgcagaccatcgcctcggtggcccgtgtgaagtggcggccagagtgccgccaccacctggccacgtgctccatgatggtggaccacaacatctatgtttgggacgtgcgccggcccttcgtgccagctgccatgtttgaggaacaccgagacgtcaccacgggaattgcctggcgccacccccacgacccctccttcctgctgtctggctccaaggacagctcgctgtgccagcacctgttccgcgacgccagccagcccgtcgagcgcgccaaccctgagggcctctgctacggcctcttcggggacctggccttcgccgccaaggagagcctcgtggctgccgagtcggggcgcaagccctacactggcgaccggcgccaccccatcttctttaagcgcaagctggaccctgccgagcccttcgcaggcctcgcctccagtgccctcagtgtctttgagacggagccaggtggcggcggcatgcgctggtttgtggacacagctgagcgttatgcgctggctggccggccactggccgagctctgtgaccacaacgcaaaggtggctcgagagcttggccgcaaccaggtggcgcaaacgtggaccatgctgcggatcatctactgcagccctggcctagtgcccactgcaaacctcaaccacagtgtgggcaagggtggctcctgtggcctcccgctcatgaacagtttcaacctgaaggatatggccccagggttgggcagtgagacgcggctggaccgcagcaaaggagatgcacggagcgacacagttctgctcgactcctcggccacactcatcaccaatgaggataacgaggaaaccgagggcagcgacgtacctgccgactacctgctgggtgacgtggaaggtgaggaggacgagctgtacctgctggatccggaacacgcgcaccccgaggaccctgagtgcgtgctgccgcaggaggcctttccgctgcgccacgagatcgtggacacgcctcccgggcccgagcacctgcaggacaaggccgactccccgcacgtgagcggcagcgaggcggatgtggcctccctggcccccgtggactcctccttctcgctcctgtctgtctcacacgcgctctacgacagccgcctgccgcccgacttcttcggcgtgctggtgcgcgacatgctgcacttctacgctgagcagggcgacgtgcagatggctgtgtctgtgctcatcgtcctgggtgaacgggtgcgcaaggacatcgacgagcagacccaggagcactggtacacttcctacatcgacctgctgcagcgcttccgcctctggaacgtgtccaacgaggtggtcaagctgagcaccagccgcgccgtcagctgcctcaaccaggcctccaccaccctgcacgtcaactgcagccactgcaagcggcccatgagcagccggggctgggtctgcgacaggtgccaccgctgcgccagcatgtgtgccgtctgccaccacgtagtcaagggtctcttcgtgtggtgccagggctgcagccacggcggccacctgcagcacatcatgaagtggctggaaggcagctcccactgtcccgcaggctgcggccacctctgcgagtactcctga

SEQ ID NO: 199737 - DNA, 3245 bp, Homo sapiens
  Payload ID: 19407
  Gene Name: WD repeat domain 24
  Uniprot ID: Q96S15
  ENST ID: ENST00000293883
  CDS Start-End: 761-3133
gcggcttccggcgcggcggttccggacaaccgtgcgcttttagtaaaagattggggttcgcgcgggggagaagggctgccccgggccctctggttctcgtcccgcagcgtccgctcccccgcgccactgcgccgctcccaggaaccctgtactccggggtcgccggcttctctcctgcctccggtcccgccagacacctcgagctccttaagtagctcggtccttgacgtccctctgggcccttcccgcgtctatcgcctgagtccccgggcccctctagccctctgttccctcccctcttttgttcctccctagagccccgccgccctcagggctgacagtgtggacggcgggagtctcctcgctcccctgctgggattgactgaccgagcgtttagtgactgcccagatctggctgatgggggtaccgagaggtggcctgggccgggaatgtccagctagagtcttccgtggaagtcagacatgaaactgacaggcctaagggaagctaggaagtcccctcaccgctcagccagggtgatgggctggactgacagactccagtgaatttgagcttgcctgtcaggctgattggctgatagacagccctggattggctcactaagactgaccagcccgggaccaagcagttctggggtcccaacctgggtggaaggtctgaactgatgacccacccaggctgaccaggccagcccacctcactgacctcctgacccctgacctcatcacctgtgcagccatggagaagatgtcccgtgtgaccacagccctgggtggcagcgtgctgacaggccgcaccatgcactgccacctggatgctcccgccaatgccatcagtgtgtgccgcgacgcagcccaggtggtcgtggcaggccgtagcatcttcaagatctatgccatcgaggaggaacagttcgtggaaaagctgaacctgcgtgtggggcgcaagccttcgcttaacctgagctgtgctgacgtggtctggcaccagatggatgagaacctgctggccacagcagccaccaatggcgtggtggtcacgtggaacctgggccggccatcccgcaacaagcaggaccagctgttcacagaacacaagcgcacggtaaacaaagtctgcttccaccccaccgaagcccacgtgctgctcagtggctcccaggatggcttcatgaagtgctttgacctccgcagaaaggactctgtcagcaccttctcgggccagtcggagagcgtgcgggacgtgcagttcagtatccgggactacttcaccttcgcctccacctttgagaacggcaatgtgcagctctgggacatccggcgtcccgaccggtgcgagaggatgttcacagcccacaacggacccgtcttctgctgcgactggcaccccgaggacaggggctggttggccactggagggcgcgacaagatggtgaaggtctgggacatgaccacgcaccgtgccaaggagatgcactgtgtgcagaccatcgcctcggtggcccgtgtgaagtggcggccagagtgccgccaccacctggccacgtgctccatgatggtggaccacaacatctatgtttgggacgtgcgccggcccttcgtgccagctgccatgtttgaggaacaccgagacgtcaccacgggaattgcctggcgccacccccacgacccctccttcctgctgtctggctccaaggacagctcgctgtgccagcacctgttccgcgacgccagccagcccgtcgagcgcgccaaccctgagggcctctgctacggcctcttcggggacctggccttcgccgccaaggagagcctcgtggctgccgagtcggggcgcaagccctacactggcgaccggcgccaccccatcttctttaagcgcaagctggaccctgccgagcccttcgcaggcctcgcctccagtgccctcagtgtctttgagacggagccaggtggcggcggcatgcgctggtttgtggacacagctgagcgttatgcgctggctggccggccactggccgagctctgtgaccacaacgcaaaggtggctcgagagcttggccgcaaccaggtggcgcaaacgtggaccatgctgcggatcatctactgcagccctggcctagtgcccactgcaaacctcaaccacagtgtgggcaagggtggctcctgtggcctcccgctcatgaacagtttcaacctgaaggatatggccccagggttgggcagtgagacgcggctggaccgcagcaaaggagatgcacggagcgacacagttctgctcgactcctcggccacactcatcaccaatgaggataacgaggaaaccgagggcagcgacgtacctgccgactacctgctgggtgacgtggaaggtgaggaggacgagctgtacctgctggatccggaacacgcgcaccccgaggaccctgagtgcgtgctgccgcaggaggcctttccgctgcgccacgagatcgtggacacgcctcccgggcccgagcacctgcaggacaaggccgactccccgcacgtgagcggcagcgaggcggatgtggcctccctggcccccgtggactcctccttctcgctcctgtctgtctcacacgcgctctacgacagccgcctgccgcccgacttcttcggcgtgctggtgcgcgacatgctgcacttctacgctgagcagggcgacgtgcagatggctgtgtctgtgctcatcgtcctgggtgaacgggtgcgcaaggacatcgacgagcagacccaggagcactggtacacttcctacatcgacctgctgcagcgcttccgcctctggaacgtgtccaacgaggtggtcaagctgagcaccagccgcgccgtcagctgcctcaaccaggcctccaccaccctgcacgtcaactgcagccactgcaagcggcccatgagcagccggggctgggtctgcgacaggtgccaccgctgcgccagcatgtgtgccgtctgccaccacgtagtcaagggtctcttcgtgtggtgccagggctgcagccacggcggccacctgcagcacatcatgaagtggctggaaggcagctcccactgtcccgcaggctgcggccacctctgcgagtactcctgacggggcatctgctgggcttgcccgggcggccgcgtgcagaaccccgcctggtcttgtgcccgagacgggcggaggctggaacttgagacctcaataaaggaagtagagccgc

SEQ ID NO: 199738 - DNA, 2123 bp, Homo sapiens
  Payload ID: 19408
  Gene Name: WD repeat domain 25
  Uniprot ID: Q64LD2
  ENST ID: ENST00000335290
  CDS Start-End: 227-1861
cggtgcgtgtggtgagcggcgggccccgggctggaggggccgggactgggcagcgcctaaagcgccccgtgccgcttaacgcggtctctcatagccgctcgccttcctttcacttcctgttccttcagaaagcgctgtgccttggaccaaccttacttcttactattgacagctcagctaactcctattcatccttcaaaacccatctctggtggtttggctttgaatgacagcaagaactctgtctttaatggcttcattggtagcgtatgatgattcggactcggaggctgagacagagcatgcaggaagttttaatgctaccggccagcagaaagacacttctggtgtggccagaccacctgggcaggattttgcatctggtacactggatgtgcccaaagcaggggcacagcccacaaagcatggctcctgtgaagacccagggggctatcgccttccattggctcagcttgggagaagcgattggggatcttgccccagccagaggctacagtggcccgggaaggagcctcaagtcaccttccccatcaaagagccttcttgttcttctctgtggacgagccatgttccagccagccacatgcccctggcagctgcccgctttaagcaagtaaaactctccaggaactttcccaagtcatctttccatgctcaaagtgagtctgaaaccgtaggtaaaaatggcagctcttttcagaagaaaaaatgtgaggactgtgtggtaccctatactcccagaagactaagacagcggcaggcattaagcacggagacaggcaagggtaaagacgtggagccacaggggccccctgcagggcgtgccccagcccctctctacgtgggcccgggagtgtctgagtttattcagccatatttgaatagccattataaagaaaccacagttccccggaaagtgcttttccacctgagaggccacaggggccctgtcaacaccattcagtggtgtccagtcctttctaagagccacatgcttctctccacttctatggataaaactttcaaggtatggaacgccgtggactccgggcactgcctgcagacctactccctgcacacagaggcagtgcgggccgcccggtgggctccctgtggccggcgcatcctcagtggtggctttgacttcgcgctgcacctaacagaccttgaaacaggaacccagctatttagtggtcgaagtgactttagaatcactaccttgaaattccatccaaaagaccacaacatctttttatgtggaggcttcagctctgaaatgaaagcttgggatataaggactggcaaggtgatgagaagctacaaggcgaccatccagcagaccttggacatcctgttcctccgggaaggctccgagttcctgagcagcacagacgcttccacccgggactcagctgaccgcaccattattgcctgggatttccggacctctgccaaaatctccaaccagattttccacgagaggttcacctgccccagcctcgccttgcacccgagagagcccgtgttcctggcacagaccaatggcaactacctggcccttttctccactgtgtggccctaccggatgagcagacggcggcgctatgaagggcacaaggtggagggctactcagtgggctgcgagtgctccccaggcggtgacttgctggtgacgggcagcgccgatggccgggtcctgatgtacagcttccgcacagccagccgagcatgcacactgcaggggcacacacaggcctgtgtcggcaccacctatcaccccgtgctgccctccgtcctcgccacctgctcctggggaggggacatgaagatctggcactgagctttttgtcactgaaccttcccgatgccagctgggctcttggactcccctcttcctcaagggtagatgagaggaacgagcacagaggttggctgtgggtcctgggtaccaccttctgagcctcagtttcctcatctgtaaagtggggagaaaagtctgtttgcctcaggagtgtgaggactacactagtgaaagcgcctggcgggcagccggcgatgcccaataaatgtgtgttttgctgtttgttaagtgatttcagcaa

SEQ ID NO: 199739 - DNA, 1969 bp, Homo sapiens
  Payload ID: 19408
  Gene Name: WD repeat domain 25
  Uniprot ID: Q64LD2
  ENST ID: ENST00000402312
  CDS Start-End: 73-1707
cgtgactggatggtagtgtgctggccggtctgcctccgggagaaccgagcgcttccggtggtttggctttgaatgacagcaagaactctgtctttaatggcttcattggtagcgtatgatgattcggactcggaggctgagacagagcatgcaggaagttttaatgctaccggccagcagaaagacacttctggtgtggccagaccacctgggcaggattttgcatctggtacactggatgtgcccaaagcaggggcacagcccacaaagcatggctcctgtgaagacccagggggctatcgccttccattggctcagcttgggagaagcgattggggatcttgccccagccagaggctacagtggcccgggaaggagcctcaagtcaccttccccatcaaagagccttcttgttcttctctgtggacgagccatgttccagccagccacatgcccctggcagctgcccgctttaagcaagtaaaactctccaggaactttcccaagtcatctttccatgctcaaagtgagtctgaaaccgtaggtaaaaatggcagctcttttcagaagaaaaaatgtgaggactgtgtggtaccctatactcccagaagactaagacagcggcaggcattaagcacggagacaggcaagggtaaagacgtggagccacaggggccccctgcagggcgtgccccagcccctctctacgtgggcccgggagtgtctgagtttattcagccatatttgaatagccattataaagaaaccacagttccccggaaagtgcttttccacctgagaggccacaggggccctgtcaacaccattcagtggtgtccagtcctttctaagagccacatgcttctctccacttctatggataaaactttcaaggtatggaacgccgtggactccgggcactgcctgcagacctactccctgcacacagaggcagtgcgggccgcccggtgggctccctgtggccggcgcatcctcagtggtggctttgacttcgcgctgcacctaacagaccttgaaacaggaacccagctatttagtggtcgaagtgactttagaatcactaccttgaaattccatccaaaagaccacaacatctttttatgtggaggcttcagctctgaaatgaaagcttgggatataaggactggcaaggtgatgagaagctacaaggcgaccatccagcagaccttggacatcctgttcctccgggaaggctccgagttcctgagcagcacagacgcttccacccgggactcagctgaccgcaccattattgcctgggatttccggacctctgccaaaatctccaaccagattttccacgagaggttcacctgccccagcctcgccttgcacccgagagagcccgtgttcctggcacagaccaatggcaactacctggcccttttctccactgtgtggccctaccggatgagcagacggcggcgctatgaagggcacaaggtggagggctactcagtgggctgcgagtgctccccaggcggtgacttgctggtgacgggcagcgccgatggccgggtcctgatgtacagcttccgcacagccagccgagcatgcacactgcaggggcacacacaggcctgtgtcggcaccacctatcaccccgtgctgccctccgtcctcgccacctgctcctggggaggggacatgaagatctggcactgagctttttgtcactgaaccttcccgatgccagctgggctcttggactcccctcttcctcaagggtagatgagaggaacgagcacagaggttggctgtgggtcctgggtaccaccttctgagcctcagtttcctcatctgtaaagtggggagaaaagtctgtttgcctcaggagtgtgaggactacactagtgaaagcgcctggcgggcagccggcgatgcccaataaatgtgtgttttgctgtttgttaagtgatttcagcaa

SEQ ID NO: 199740 - DNA, 1214 bp, Homo sapiens
  Payload ID: 19408
  Gene Name: WD repeat domain 25
  Uniprot ID: Q64LD2
  ENST ID: ENST00000542471
  CDS Start-End: 102-965
gagggaggaggtgagagtgattagtgggagaagaaaagcaggcccaggaccaagccctggggactggggacatcctcggtgaccctgtggagcattgagccatgccagctctgtgcctggtgctgtgctggtttcaagggctgttgggagaggtatggaacgccgtggactccgggcactgcctgcagacctactccctgcacacagaggcagtgcgggccgcccggtgggctccctgtggccggcgcatcctcagtggtggctttgacttcgcgctgcacctaacagaccttgaaacaggaacccagctatttagtggtcgaagtgactttagaatcactaccttgaaattccatccaaaagaccacaacatctttttatgtggaggcttcagctctgaaatgaaagcttgggatataaggactggcaaggtgatgagaagctacaaggcgaccatccagcagaccttggacatcctgttcctccgggaaggctccgagttcctgagcagcacagacgcttccacccgggactcagctgaccgcaccattattgcctgggatttccggacctctgccaaaatctccaaccagattttccacgagaggttcacctgccccagcctcgccttgcacccgagagagcccgtgttcctggcacagaccaatggcaactacctggcccttttctccactgtgtggccctaccggatgagcagacggcggcgctatgaagggcacaaggtggagggctactcagtgggctgcgagtgctccccaggcggtgacttgctggtgacgggcagcgccgatggccgggtcctgatgtacagcttccgcacagccagccgagcatgcacactgcaggggcacacacaggcctgtgtcggcaccacctatcaccccgtgctgccctccgtcctcgccacctgctcctggggaggggacatgaagatctggcactgagctttttgtcactgaaccttcccgatgccagctgggctcttggactcccctcttcctcaagggtagatgagaggaacgagcacagaggttggctgtgggtcctgggtaccaccttctgagcctcagtttcctcatctgtaaagtggggagaaaagtctgtttgcctcaggagtgtgaggactacactagtgaaagcgcctggcgggcagccggcgatgcccaataaatgtgtgttttgctgtttgttaa

SEQ ID NO: 199741 - DNA, 1952 bp, Homo sapiens
  Payload ID: 19408
  Gene Name: WD repeat domain 25
  Uniprot ID: Q64LD2
  ENST ID: ENST00000554998
  CDS Start-End: 88-1722
tcggaacgtgactggatggtagtgtgctggccggtctgcctccgggagaaccgagcgcttccggtgcgtgtggtggtttggctttgaatgacagcaagaactctgtctttaatggcttcattggtagcgtatgatgattcggactcggaggctgagacagagcatgcaggaagttttaatgctaccggccagcagaaagacacttctggtgtggccagaccacctgggcaggattttgcatctggtacactggatgtgcccaaagcaggggcacagcccacaaagcatggctcctgtgaagacccagggggctatcgccttccattggctcagcttgggagaagcgattggggatcttgccccagccagaggctacagtggcccgggaaggagcctcaagtcaccttccccatcaaagagccttcttgttcttctctgtggacgagccatgttccagccagccacatgcccctggcagctgcccgctttaagcaagtaaaactctccaggaactttcccaagtcatctttccatgctcaaagtgagtctgaaaccgtaggtaaaaatggcagctcttttcagaagaaaaaatgtgaggactgtgtggtaccctatactcccagaagactaagacagcggcaggcattaagcacggagacaggcaagggtaaagacgtggagccacaggggccccctgcagggcgtgccccagcccctctctacgtgggcccgggagtgtctgagtttattcagccatatttgaatagccattataaagaaaccacagttccccggaaagtgcttttccacctgagaggccacaggggccctgtcaacaccattcagtggtgtccagtcctttctaagagccacatgcttctctccacttctatggataaaactttcaaggtatggaacgccgtggactccgggcactgcctgcagacctactccctgcacacagaggcagtgcgggccgcccggtgggctccctgtggccggcgcatcctcagtggtggctttgacttcgcgctgcacctaacagaccttgaaacaggaacccagctatttagtggtcgaagtgactttagaatcactaccttgaaattccatccaaaagaccacaacatctttttatgtggaggcttcagctctgaaatgaaagcttgggatataaggactggcaaggtgatgagaagctacaaggcgaccatccagcagaccttggacatcctgttcctccgggaaggctccgagttcctgagcagcacagacgcttccacccgggactcagctgaccgcaccattattgcctgggatttccggacctctgccaaaatctccaaccagattttccacgagaggttcacctgccccagcctcgccttgcacccgagagagcccgtgttcctggcacagaccaatggcaactacctggcccttttctccactgtgtggccctaccggatgagcagacggcggcgctatgaagggcacaaggtggagggctactcagtgggctgcgagtgctccccaggcggtgacttgctggtgacgggcagcgccgatggccgggtcctgatgtacagcttccgcacagccagccgagcatgcacactgcaggggcacacacaggcctgtgtcggcaccacctatcaccccgtgctgccctccgtcctcgccacctgctcctggggaggggacatgaagatctggcactgagctttttgtcactgaaccttcccgatgccagctgggctcttggactcccctcttcctcaagggtagatgagaggaacgagcacagaggttggctgtgggtcctgggtaccaccttctgagcctcagtttcctcatctgtaaagtggggagaaaagtctgtttgcctcaggagtgtgaggactacactagtgaaagcgcctggcgggcagccggcgatgcccaataaatgt

SEQ ID NO: 199742 - DNA, 2055 bp, Homo sapiens
  Payload ID: 19408
  Gene Name: WD repeat domain 25
  ENST ID: ENST00000554175
  CDS Start-End: 180-1004
gggcagcgcctaaagcgccccgtgccgcttaacgcggtctctcatagccgctcgccttcctttcacttcctgttccttcagaaagcgctgtgccttggaccaaccttacttcttactattgacagctcagctaactcctattcatccttcaaaacccatctctggtggtttggctttgaatgacagcaagaactctgtctttaatggcttcattggtagcgtatgatgattcggactcggaggctgagacagagcatgcaggaagttttaatgctaccggccagcagaaagacacttctggtgtggccagaccacctgggcaggattttgcatctggtacactggatgtgcccaaagcaggggcacagcccacaaagcatggctcctgtgaagacccagggggctatcgccttccattggctcagcttgggagaagcgattggggatcttgccccagccagaggctacagtggcccgggaaggagcctcaagtcaccttccccatcaaagagccttcttgttcttctctgtggacgagccatgttccagccagccacatgcccctggcagctgcccgctttaagcaagtaaaactctccaggaactttcccaagtcatctttccatgctcaaagtgagtctgaaaccgtaggtaaaaatggcagctcttttcagaagaaaaaatgtgaggactgtgtggtaccctatactcccagaagactaagacagcggcaggcattaagcacggagacaggcaagggtaaagacgtggagccacaggggccccctgcagggcgtgccccagcccctctctacgtgggcccgggagtgtctgagtttattcagccatatttgaatagccattataaagaaaccacagttccccggaaagtgcttttccacctgagaggccacaggggccctgtcaacaccattcagtggtgtccagtcctttctaagagccacatgcttctctccacttctatggataaaactttcaagtaatgaagcagtagttctggcagactaaccctcccacagctaacaactataaactgtacaacagcaacaacaacaaaactacctgaaggtattggagagcaaaaaaaagcaggcagagactggacagacgtctaccctccaaagaaggaaatggtactggatgagtttctgacttttatgattttgtctgtttgttttgcctaagcataggctccagtctgtgccagacaggctgctaaaaatttgtatagaaaatctgtagtgttactggcttgaagaaccagaggacagagtttggggtaaccacagcagctggaaagtggctataaactctacccaaatctttgaatgcagactctaagcagctcaactaaggcaaagagaactgaatagaaatttctgctgctgcacaccgcaagggaaacagagtttgaaatttgagtagagccaggttagctgcgtgtttttttttttaaatcaatattcttcagaggagcataaaagaatttagagataacatacattttgtaatgttcagtattccacccaaaattcctagataaagcaagaaacaggaagagggggcctatattcaagagaaaggccatcaaaggagcttattgccaagatgatcccaatgttgaaattagcagacaagtattttaaaacagttattatagatgtgctgaaggacacaaaggaaaatatcctcgcaacaagtaaaacaacggggaatctcagtagagaaatagaagctacaagaaaaacaagtgttaaattctggaactgaaaaatacagtatctgaaatgaataattcaccatttcgattccataacagagggaaatgacagagccagtggacttggagatagatcaacagaaagtattcagccttaaaacagagaaaaatgatggaggagaagaaggacagatactcagagaactgtggacaatatcagaaaatctattatacaagtaattgagctccagaagagaggagggagagaatggggaagaaaaaaatattttcaataaataatatcaggaaatgcc

SEQ ID NO: 199743 - DNA, 1751 bp, Homo sapiens
  Payload ID: 19408
  Gene Name: WD repeat domain 25
  ENST ID: ENST00000557710
  CDS Start-End: 16-885
gtggtttggctttgaatgacagcaagaactctgtctttaatggcttcattggtagcgtatgatgattcggactcggaggctgagacagagcatgcaggaagttttaatgctaccggccagcagaaagacacttctggtgtggccagaccacctgggcaggattttgcatctggtacactggatgtgcccaaagcaggggcacagcccacaaagcatggctcctgtgaagacccagggggctatcgccttccattggctcagcttgggagaagcgattggggatcttgccccagccagaggctacagtggcccgggaaggagcctcaagtcaccttccccatcaaagagccttcttgttcttctctgtggacgagccatgttccagccagccacatgcccctggcagctgcccgctttaagcaagtaaaactctccaggaactttcccaagtcatctttccatgctcaaagtgagtctgaaaccgtaggtaaaaatggcagctcttttcagaagaaaaaatgtgaggactgtgtggtaccctatactcccagaagactaagacagcggcaggcattaagcacggagacaggcaagggtaaagacgtggagccacaggggccccctgcagggcgtgccccagcccctctctacgtgggcccgggagtgtctgagtttattcagccatatttgaatagccattataaagaaaccacagttccccggaaagtgcttttccacctgagaggccacaggggccctgtcaacaccattcagtggtgtccagtcctttctaagagccacatgcttctctccacttctatggataaaactttcaaggaacccagctatttagtggtcgaagtgactttagaatcactaccttgaaattccatccaaaagaccacaacatctttttatgtggaggcttcagctctgaaatgaaagcttgggatataaggactggcaaggtgatgagaagctacaaggcgaccatccagcagaccttggacatcctgttcctccgggaaggctccgagttcctgagcagcacagacgcttccacccgggactcagctgaccgcaccattattgcctgggatttccggacctctgccaaaatctccaaccagattttccacgagaggttcacctgccccagcctcgccttgcacccgagagagcccgtgttcctggcacagaccaatggcaactacctggcccttttctccactgtgtggccctaccggatgagcagacggcggcgctatgaagggcacaaggtggagggctactcagtgggctgcgagtgctccccaggcggtgacttgctggtgacgggcagcgccgatggccgggtcctgatgtacagcttccgcacagccagccgagcatgcacactgcaggggcacacacaggcctgtgtcggcaccacctatcaccccgtgctgccctccgtcctcgccacctgctcctggggaggggacatgaagatctggcactgagctttttgtcactgaaccttcccgatgccagctgggctcttggactcccctcttcctcaagggtagatgagaggaacgagcacagaggttggctgtgggtcctgggtaccaccttctgagcctcagtttcctcatctgtaaagtggggagaaaagtctgtttgcctcaggagtgtgaggactacactagtgaaagcgcctggcgggcagccggcgatgcccaataaatgtgtgttttgctgtttgttaa

SEQ ID NO: 199744 - DNA, 652 bp, Homo sapiens
  Payload ID: 19408
  Gene Name: WD repeat domain 25
  ENST ID: ENST00000555201
  CDS Start-End: 1-365
gcagcacagacgcttccacccgggactcagctgaccgcaccattattgcctgggatttccggacctctgccaaaatctccaaccagattttccacgagaggttcacctgccccagcctcgccttgcacccgagagagcccgtgttcctggcacagaccaatggcaactacctggcccttttctccactgtgtggccctaccggatgagcagacggcggcgctatgaagggcacaaggtacttctgtccttgtcccccaggcgaatgctgagccccagccccaagcctcctggcagtcctggacatgggccctggggtgcatggagcctctgtctgggtggatcctgctttctgtttcctgggtgagcgcatgccatgtggctcactgtctcttcaagtccctgaaccacatctggtcctcaccccaggccccacgtactgggcaggaagcagtagttggctcacacagacaggtctcagaagtggggggcaggaacaggacaaaatggtcatgggtgtcatttctgcatccttccctttcctcactgaggccaagccttgctggggtggaaggggctgggtgcttagtgactgtcactgaggccagacccctcagctgggctggagctggtcccgctggatctgctgaactg

SEQ ID NO: 199745 - DNA, 784 bp, Homo sapiens
  Payload ID: 19409
  Gene Name: WD repeat domain 26
  ENST ID: ENST00000445239
  CDS Start-End: 408-784
gagtggaagtcaggaaaggctcccctgaggaggtttgaaatgagctgagtcttgaaagactgactggcatcagacaggtgaagaaaagacgggagagtgtagtcaaagactctcaaggagaaatgagccagtacatttggcggacagtagacaggtccctgaagaggagcaataagagatgaagccaaaaagaaagactgaaagcaacctgtggaaaactacttcagagaaagactttaaatttctgagaaaatctttatacatattgagtatagatgctatcaaccacatacatgaaaataattgtttggggataatgcacaccatttgccaatgattaagattcagcccagtctttgttgctgcatttctacattcacataaattgccagactgttgatctcctcatgcaagagtcaggatgtcgtttagaacatccttctgctaccaaattccgaaatcatgtcatggaaggagactgggataaggcagaaaatgacctgaatgaactaaagcctttagtgcattctcctcatgctattgtggtaagaggcgcacttgaaatctctcaaacgttgttgggaataattgtgaggatgaagtttttgctgctgcagcagaagtacctagaatacctggaggatggcaaggtcctggaggcacttcaagttctacgctgtgaattgacgccgctgaaatacaatacagagcgcattcatgttcttagtgggtatctgatgtgtagccatgcagaagacctacgtgcaaaagcagaatgggaagg

SEQ ID NO: 199746 - DNA, 6872 bp, Homo sapiens
  Payload ID: 19409
  Gene Name: WD repeat domain 26
  Uniprot ID: Q9H7D7
  ENST ID: ENST00000414423
  CDS Start-End: 195-2180
cggagggagtaggagagcccggggcttcggcaggcagagcaggcctctcccctccgtcctcgtcgtcctcgtcctcctcctcctcctcctcctccgtggtggtagtggtgggacttcccccggctgctgcccctcccgccgccgctgctgtcccccaccgaagtagcggccacagcctggtcagcggcagcatcatgcaggccaatggggcaggaggaggaggaggaggtggcggcggcggcggtggaggaggagggggcggcgggggccagggacagaccccggaactcgcctgcttgtcggcccagaacggggagtcgtccccctcgtcgtcgtcgtccgcgggggacctggcccacgccaatgggctcctgccttccgccccctccgccgccagcaacaatagcaacagcctgaatgtcaataacggggttcccggcggggcggccgccgcatcctcagccaccgtcgcagctgcctccgccaccaccgccgcctcctcttccttggccaccccagaactgggcagcagcctcaagaagaagaagcggctctcccagtcagatgaggatgtcattaggctaataggacagcacttgaatggcttagggctcaaccagactgttgatctcctcatgcaagagtcaggatgtcgtttagaacatccttctgctaccaaattccgaaatcatgtcatggaaggagactgggataaggcagaaaatgacctgaatgaactaaagcctttagtgcattctcctcatgctattgtggtaagaggcgcacttgaaatctctcaaacgttgttgggaataattgtgaggatgaagtttttgctgctgcagcagaagtacctagaatacctggaggatggcaaggtcctggaggcacttcaagttctacgctgtgaattgacgccgctgaaatacaatacagagcgcattcatgttcttagtgggtatctgatgtgtagccatgcagaagacctacgtgcaaaagcagaatgggaaggcaaagggacagcttcccgatctaaactattggataaacttcagacctatttaccaccatcagtgatgcttcccccacggcgtttacagactctcctgcggcaggcggtggaactacaaagggatcggtgcctatatcacaataccaaacttgataataatctagattctgtgtctctgcttatagaccatgtttgtagtaggaggcagttcccatgttatacgcagcagatacttacggagcattgtaatgaagtgtggttctgtaaattctctaatgatggcactaaactagcaacaggatcaaaagatacaacagttatcatatggcaagttgatccggatacacacctgctaaaactgcttaaaacattagaaggacatgcttatggcgtttcttatattgcatggagtccagatgacaactatcttgttgcttgtggcccagatgactgctctgagctttggctttggaatgtacaaacaggagaactaaggacaaaaatgagccagtctcatgaagacagtttgacaagtgtggcttggaatccagatgggaagcgctttgtgactggaggtcagcgtgggcagttctatcagtgtgacttagatggtaatctccttgactcctgggaaggggtaagagtgcaatgcctttggtgcttgagtgatggaaagactgttctggcatcagatacacaccagcgaattcggggctataacttcgaggaccttacagataggaacatagtacaagaagatcatcctattatgtcttttactatttcaaaaaatggccgattagctttgttaaatgtagcaactcagggagttcatttatgggacttgcaagacagagttttagtaagaaagtatcaaggtgttacacaagggttttatacaattcattcatgttttggaggccataatgaagacttcatcgctagtggcagtgaagatcacaaggtttacatctggcacaaacgtagtgaactgccaattgcggagctgacagggcacacacgtacagtaaactgtgtgagctggaacccacagattccatccatgatggccagcgcctcagatgatggcactgttagaatatggggaccagcaccttttatagaccaccagaatattgaagaggaatgcagtagcatggatagttgatggtgaatttggagcagacgacttctgtttaacttaaaattagtcgtattttaatggcttgggatttggtgcaaacaaacatgattgatagctggacagacatgctcgtcatgaaaaaagaaccatttctgaagcccgattggggccaaacatttacaccttgcttcatagtaaccagttgagatgaagcacgtcgttagaacgttgttggacaccatgttgaattattcccccatcggttgtgaagaactgtgctacattcaggcttacccattgaactcagtatatatatttttttccttcctgtcttttgtctggcaggataccattcttgttgctcttctgtgtaatgaagtttaaatgcttgtttggaaaactttatttaacagtttagaaggcttgatagaaagagtgcattagtctgaagagtatacattggataggaaagaatttccttcttttgtttctccaaatctttccgccttatttagcttgagatctttgcagcttggttcatggattctagccttgcccgttgcgcagtatatactgatccagatgataaaccagtgaactatgtcaaaagcactctcaatattacatttgacaaaaagttttgtacttttcacatagcttgttgccccgtaaaagggttaacagcacaattttttaaaaataaattaagaagtatttataggattaaagtgacttcatttgtatacatttggaatctaaaccagcttaaaaacagtttcctcaatgacttagatacacagtataactgatgctcttctggaataccacatgagacatggtcagaaacagtgcttggaaggacattacacaagaaattcagagtaatgctttgaagatttccccccttttgttttattcctgaaggaacatcagtacccgatcttgaagaaattcaagattcaaaaagaattttaaatacaccaacatgagacatcagtagtcagttggttttcagtaaagcttgttccaagttgttctcaacttaggaagtaattttggtgtgatctagcaaaagagtaggaatcagcgatacaaccactttggaagtttatagtataattgaaattattagaagaattcagcaggttacagacatacttaaactgggattaaaacctcatagtcatttttcttaattgcccttaatattttgacatatagggatacataaatttaaagaatattttttctcagttttttcagatattgccatactgaacctcattctaaactggtgctgtggatagtctttccctctcccctcctgttttagtttaaggaaaggtttccttcatggaaaagcacttttaattttgagaatttcacatttaaaataagccaaaagcctgatgttcacattgtgcttttaaactccgtaacagctgaatacaacataacatagtctcccttgaaattccctccctttttcagtagaggataaatagggtgactccagctgttggaatgagaatggggatacccccaaaataagattctggtgaagaaaaagtcttgtactaagttcccctttaggtgtagccaagtctataatataattatgatcatgaatagactccagaatccacaaagagaagagggcttggatgtcaaaaattcttccattgtggggtaggtggtcggggatgggagaaagggaaaagtcagggaaggggagaagaaagaaaaacacatttggccttaaaatagcatgcattctcccagaagcccatagtaaagaaaatgacagatcgtggtcagcagactcttatcaaattggtatgtaaaagatttcttcaagctccattttgcagagaccaccacttagagaatcaaaaaattcctgttttgatacttctaagttaaaatatatgttacagtttatctggtacttcatttttcttaactaaaattactttttactttaagcttgaataaaaatcttcattggtaactgtatgtaattaagtggcaacttctctttacctcagtatagttaaaaaccattcatattttaagtgattcatgtataccctgaagccgttaatacaccccagtctctatggtaacatcactaaatgtgggcatagaaactccacagctgtttacaaatttggttacagtgtgctacggtgcatttgtaacactcagatttgtgcccattcaggggcaatttggcactcagattctactctacttcacctaaccacccctagatctgagttttcagagtgcttctgaagtacagtttaaaaacactttttaaaaagtggagtaaaagtgaggcacattttacaagaacataactcctattaaaacggagtaacaactatgcaaaggtttctatagcagctaggtgagtttgttttccgggtctgtcttaactggcagcttcctgtacatactggtacttatttgctgtaaacgtctgtttcatacatttgccatgcagtgactgtgctcgaaaggtgaaatcaatggtaaagaagcctaggattttatggtatgagaaactgatcgcaggattttctgatccatagctattaattgaaaacttctgatagtgctgtaggctctatagtaggcttaagagtgagtcttatactatgaagccagccacaagatactaacaaatgtataaattgaaaagtaccaatactttttgcacatagatcaaaatagagtggagaatttgggctccaaaaatcaggttagtaggctcatttccatgtgcttaaaaatgtttttgttgttatgcattgattaagggctagagcaaatataaaattaaatgtctttttcctccaaataattggttattaatggtaaaatgttggacttggggattactgagattagtatgtgggtagtaaagaattggagtgggagttagtggggagggatgacaaagcttcagctttggtttttgtatttttttagtcttcataacagctacatttctgttgctcttattggccagataaatgtgttatattaaaccaggtaagtattttaaacagagaacattttatttgcatatatccctacaaattggcccattttattgggtggggggataaaaaagggattccctaactttaaataatcagaatatcctgcaattgaaaggagaaaaaaatccaattttgtcagtattttcttagtctgaaaaaaacagcagtagtaatctggtgaatgttattattaggagtgttctgcctctacagtggcatattccatgacattaatagaaaacccttctttcccacccctccccatcttgacattttcttttttaggatgttggttcctgcaaacaagaactgaccctatcacctctgcctcacagtgggtaaatatatcatacatctcttgaaagggaaaatatccatgtcagtttctttcacagtagaagaatggctgcttttgaatggggaggaaagaagacatttttcttaatatcctttttgtcccatctctaaaatgtataaatattttgatttggttttactttaatttctcattcataatttcgcaactgtccttttgggttgccctccaacacattacttccatttcagaaaccatatctgatttaatataaactgctaacttaagaagaggtgaatttgcatttacacttagacactttctaaaaacagggtgaacttaattgaaatttttcagtgttgttaagctattgttatagtagctgccctatagttacaaaaataaaaactataaaaacccatcccctatctacttaatccagatagcctggatttaacaaaaccaatagtataaaaatgtgtgtgtgtgttctgtgtgtgtgtgagagagagagtacttgattcattaaaaagtcctggaaacagctgttctaggatcttgtcatttttactgaaagtctcgtgcacatgtgaagtgccctctgagtttaaggtttggttaatactggtatatttttataagattgaaattgtgtccccatctttaacttaaacattttcattatcagggtcaatgtgctagaactgaattgtaacatttttaggcacagatggaaaaaaatgttattggctccttgaaaatgtgtgtgtgtggcgaggggaatagatccacaaaagcatgtatgtacttacaaaccaagctgtagagatcaagaaaagaacttaagtgttgatctcaagatttctaaattgtcaagatttacatggcattgtggtggaactagttaacacttagagcttttggtatgtaataactatttgctatggactgattaaatgtttcaaaagattgtgttcttcaattttggtgggttttgatttttgtttttttaactgcctctcagattatatttacttagtttaaatttctttgctttattcattaaagtataaaaacttcaggtctctgatatttattttcacttgtttactaattatttacaaaacaccctttgttgacttttattttataaatgtgtaatgtattaaacgtctttaaatttttgttcaactgaaactacattaactttgatttgctttactgggatttttttttaaagacactttttccatgtcagtgcgcagcacttaaccagtcgtttgtattccctttctttcaatccaataaacagaatgaatacctaaataa

SEQ ID NO: 199747 - DNA, 2867 bp, Homo sapiens
  Payload ID: 19409
  Gene Name: WD repeat domain 26
  ENST ID: ENST00000486652
  CDS Start-End: 1-627
ggaggaggaggtggcggcggcggcggtggaggaggagggggcggcgggggccagggacagaccccggaactcgcctgcttgtcggcccagaacggggagtcgtccccctcgtcgtcgtcgtccgcgggggacctggcccacgccaatgggctcctgccttccgccccctccgccgccagcaacaatagcaacagcctgaatgtcaataacggggttcccggcggggcggccgccgcatcctcagccaccgtcgcagctgcctccgccaccaccgccgcctcctcttccttggccaccccagaactgggcagcagcctcaagaagaagaagcggctctcccagtcagatgaggatgtcattaggctaataggacagcacttgaatggcttagggctcaaccagactgttgatctcctcatgcaagagtcaggatgtcgtttagaacatccttctgctaccaaattccgaaatcatgtcatggaaggagactgggataaggcagaaaatgacctgaatgaactaaagcctttagtgcattctcctcatgctattgtggcacaaacattttctgaaacttccatcaacttttttcccctgactgctgctttctgtcatgtcagaggatgaagtttttgctgctgcagcagaagtacctagaatacctggaggatggcaaggtcctggaggcacttcaagttctacgctgtgaattgacgccgctgaaatacaatacagagcgcattcatgttcttagtgggtatctgatgtgtagccatgcagaagacctacgtgcaaaagcagaatgggaaggcaaagggacagcttcccgatctaaactattggataaacttcagacctatttaccaccatcagtgatgcttcccccacggcgtttacagactctcctgcggcaggcggtggaactacaaagggatcggtgcctatatcacaataccaaacttgataataatctagattctgtgtctctgcttatagaccatgtttgtagtagactggtgaattgacaaaatgtaattctaaattattgattgggaaaagaagcaaggaagaccgtgtttcaagatacacttaaaggaggcagttcccatgttatacgcagcagatacttacggagcattgtaatgaagtgtggttctgtaaattctctaatgatggcactaaactagcaacaggatcaaaagatacaacagttatcatatggcaagttgatccggatacacacctgctaaaactgcttaaaacattagaaggacatgcttatggcgtttcttatattgcatggagtccagatgacaactatcttgttgcttgtggcccagatgactgctctgagctttggctttggaatgtacaagaaaactatccccatgtaccttttattattacaccaagggcagctattatctctcagatcctgtttctaatccatgaacaaaatggaatcaagactagattaaatgacaggagaactaaggacaaaaatgagccagtctcatgaagacagtttgacaagtgtggcttggaatccagatgggaagcgctttgtgactggaggtcagcgtgggcagttctatcagtgtgacttagatggtaatctccttgactcctgggaaggggtaagagtgcaatgcctttggtgcttgagtgatggaaagactgttctggcatcagatacacaccagcgaattcggggctataacttcgaggaccttacagataggaacatagtacaagaagatcatcctattatgtcttttactatttcaaaaaatggccgattagctttgttaaatgtagcaactcagggagttcatttatgggacttgcaagacagagttttagtaagaaagtatcaaggtgttacacaagggttttatacaattcattcatgttttggaggccataatgaagacttcatcgctagtggcagtgaagatcacaaggtttacatctggcacaaacgtagtgaactgccaattgcggagctgacagggcacacacgtacagtaaactgtgtgagctggaacccacagattccatccatgatggccagcgcctcagatgatggcactgttagaatatggggaccagcaccttttatagaccaccagaatattgaagaggaatgcagtagcatggatagttgatggtgaatttggagcagacgacttctgtttaacttaaaattagtcgtattttaatggcttgggatttggtgcaaacaaacatgattgatagctggacagacatgctcgtcatgaaaaaagaaccatttctgaagcccgattggggccaaacatttacaccttgcttcatagtaaccagttgagatgaagcacgtcgttagaacgttgttggacaccatgttgaattattcccccatcggttgtgaagaactgtgctacattcaggcttacccattgaactcagtatatatatttttttccttcctgtcttttgtctggcaggataccattcttgttgctcttctgtgtaatgaagtttaaatgcttgtttggaaaactttatttaacagtttagaaggcttgatagaaagagtgcattagtctgaagagtatacattggataggaaagaatttccttcttttgtttctccaaatctttccgccttatttagcttgagatctttgcagcttggttcatggattctagccttgcccgttgcgcagtatatactgatccagatgataaaccagtgaactatgtcaaaagcactctcaatattacatttgacaaaaagttttgtacttttcacatagcttgttgccccgtaaaagggttaacagcacaattttttaaaaataaattaagaagtatttatagga

SEQ ID NO: 199748 - DNA, 1725 bp, Homo sapiens
  Payload ID: 19409
  Gene Name: WD repeat domain 26
  ENST ID: ENST00000480676
  CDS Start-End: 1-886
cactaaactagcaacaggatcaaaagatacaacagttatcatatggcaagttgatccggatacacacctgctaaaactgcttaaaacattagaaggacatgcttatggcgtttcttatattgcatggagtccagatgacaactatcttgttgcttgtggcccagatgactgctctgagctttggctttggaatgtacaaacaggagaactaaggacaaaaatgagccagtctcatgaagacagtttgacaagtgtggcttggaatccagatgggaagcgctttgtgactggaggtcagcgtgggcagttctatcagtgtgacttagatggtaatctccttgactcctgggaaggggtaagagtgcaatgcctttggtgcttgagtgatggaaagactgttctggcatcagatacacaccagcgaattcggggctataacttcgaggaccttacagataggaacatagtacaagaagatcatcctattatgtcttttactatttcaaaaaatggccgattagctttgttaaatgtagcaactcagggagttcatttatgggacttgcaagacagagttttagtaagaaagtatcaaggtgttacacaagggttttatacaattcattcatgttttggaggccataatgaagacttcatcgctagtggcagtgaagatcacaaggtttacatctggcacaaacgtagtgaactgccaattgcggagctgacagggcacacacgtacagtaaactgtgtgagctggaacccacagattccatccatgatggccagcgcctcagatgatggcactgttagaatatggggaccagcaccttttatagaccaccagaatattgaagaggaatgcagtagcatggatagttgatggatgttggttcctgcaaacaagaactgaccctatcacctctgcctcacagtgggtaaatatatcatacatctcttgaaagggaaaatatccatgtcagtttctttcacagtagaagaatggctgcttttgaatggggaggaaagaagacatttttcttaatatcctttttgtcccatctctaaaatgtataaatattttgatttggttttactttaatttctcattcataatttcgcaactgtccttttgggttgccctccaacacattacttccatttcagaaaccatatctgatttaatataaactgctaacttaagaagaggtgaatttgcatttacacttagacactttctaaaaacagggtgaacttaattgaaatttttcagtgttgttaagctattgttatagtagctgccctatagttacaaaaataaaaactataaaaacccatcccctatctacttaatccagatagcctggatttaacaaaaccaatagtataaaaatgtgtgtgtgtgttctgtgtgtgtgtgagagagagagtacttgattcattaaaaagtcctggaaacagctgttctaggatcttgtcatttttactgaaagtctcgtgcacatgtgaagtgccctctgagtttaaggtttggttaatactggtatatttttataagattgaaattgtgtccccatctttaacttaaacattttcattatcagggtcaatgtgctagaactgaattgtaacatttttaggcacagatggaaaaaaatgttattggctccttgaaaatgtgtgtgtgtggcgaggggaatagatccacaaaagcatgtatgt

SEQ ID NO: 199749 - DNA, 2465 bp, Homo sapiens
  Payload ID: 19410
  Gene Name: WD repeat domain 27
  Uniprot ID: A2RRH5
  ENST ID: ENST00000423258
  CDS Start-End: 44-2236
ctgagcgcatgtggagttcggaggaaaagggctcagattgaagatggaaaatccccaagacattttctcaagtaatggtggctgtctaagtgatatagttatagaaaaatacctggttgaatccaaggagtctgtgtctcatgttcagcttgcttgcagcatgcaggactgtgctttccctttggatggaactgaactttgtatatggaacactaaggatccttctcatcagcttctaatcctacgaggacaccatcagccaattactgctatggcttttggaaataaagtgaacccacttctaatctgctcagcatcactggattatgttataatgtggaacctggatgaatgtagagagaaagtacttcaagcatatcctcttctcagtttattcattgatgcagaaagcaggcagctggtcaccgggtgtgctgacggccagctttggatcttcagtttgatggatggacaccattatcgtcgtgtggcacgggttgacctaaggaagaagacagagactttctccacaagaagggttaagtctgggctgtgcagccagccagaagaaagccagcttccctctacaagtgctctgggaaaaggagagcaggttgaagtaacatttcctgtactgagacttgcaccctgtgatctctcactcatcccaaattctgcatgtggatgtctttcttctgagaacacccgatgtgtgtggatcggaagctcagtgggcttattcgtatttaacctggcaaacctggaagtggaagctgctttgtattacaaggatttccagagcctcagcatcctgctggccggatcgtgtgccctgaggaaccgcactgcggatcaaaaggtgctgtgcttgctggcctccctctttggcgggaagattgccgtgttggagatcaacccggccgcgctagtcagggctcagcagtgccccagcatggggcagagcctctcggtgccagccagctcctgtgtcctaccgacctctccactgtatctgggaattgccaaggagaagagtaccaaggctgctagtgaacagcgacgtgctgcacggaacgtcatgaaggaccaacgcctggttttccatagtaaagttaggtcatctggttatgcgtcagcaccacatgtaactatgttttcaccaaagaccaacatcaagagtgaggggaaaggatcttcaaggagcaggagcagctgcgcacgggaggcataccccgtggagtgcgctgtgcccaccaagcccggcccccaggtcgctgccgcccccacctgcacacgtgtatgctgcatccagtactcaggagatgggcagtggctggcctgtgggttggccaaccatctgttactcgtttttgatgccagcctgactgggacacctgctgtgttttcaggtcacgacggggcagtgaatgccgtgtgctggagccaggaccggaggtggctgctctctgcggcccgggacgggaccctgcgaatgtggtcggctcgtggggcagagctcgcactgcttctgggcaaagacatgttttctaaacctatacagtctgcacagttctattatatagatgcctttatattgttatcttctggccctgaatttcagctactgaggtatcacattgacacttgcaaagatgagattaagagatataaacagaagagcaagtccaagctgatttgcaggctctccacgacgggtgcagtagacatgaccagtttatcggcagtcaacgacttttattcccacatcgtactcgcagctggccggaacaggaccgtggaagtgtttgacctcaacgccggctgcagtgcagcggtgatagcggaagcccactcacggcctgtccatcaaatctgccaaaataaaggttcatcatttacaacccaacagcctcaggcttataaccttttcctgaccacggccattggcgatgggatgagactgtgggacctgagaaccctgaggtgtgagcgccactttgaagggcatccaacccgcggctatccatgtggaatcgctttcagtccttgtggacgattcgcggcttgtggggccgaggacagacacgcttacgtgtatgaaatgggctcaagcacgttttctcaccggctggctgggcacacagacactgtcactggagtggccttcaacccatcagcgccccagcttgccacagctaccttggatggtaaactccagctctttctagctgagtaaccactgacctgtgagctgggtccaggaatgctgtgaggaacaacttaaaagtaagaagtagtggttcatccatcagggggccagaagcagcaactgtttttcatattttgagacttgcctcagatttcccccgtttgcaagctcctcccctctgtgtgtgccatgtcagagttttatgtctttctgctcctcaaaagggatccccttcattgggaaaatggaaatggcg

SEQ ID NO: 199750 - DNA, 683 bp, Homo sapiens
  Payload ID: 19410
  Gene Name: WD repeat domain 27
  ENST ID: ENST00000441385
  CDS Start-End: 1-587
tggaagtggaagctgctttgtattacaaggatttccagagcctcagcatcctgctggccggatcgtgtgccctgaggaaccgcactgcggatcaaaaggtgctgtgcttgctggcctccctctttggcgggaagattgccgtgttggagatcaacccggccgcgctagtcagggctcagcagtgccccagcatggggcagagcctctcggtgccagccagctcctgtgtcctaccgacctctccactgtatctgggaattgccaaggagaagagtaccaaggctgctagtgaacagcgacgtgctgcacggaacgtcatgaaggaccaacgcctggttttccatagtaaagttaggtcatctggttatgcgtcagcaccacatgtaactatgttttcaccaaagaccaacatcaagagtgaggggaaaggatcttcaaggagcaggagcagctgcgcacgggaggcataccccgtggagtgcgctgtgcccaccaagcccggcccccaggtcgctgccgcccccacctgcacacgtgtatgctgcatccagtactcaggtgcgccacgtcctgcgggagctgggtagcatttcattgtaagagtctttgattctgcccactgtaaacatttttctattgtatcataattgtaaatatatttttaaaaaccttggttacttgaa

SEQ ID NO: 199751 - DNA, 3178 bp, Homo sapiens
  Payload ID: 19410
  Gene Name: WD repeat domain 27
  Uniprot ID: A2RRH5
  ENST ID: ENST00000448612
  CDS Start-End: 111-2798
aggggaattcggggcacaagtcgggccggagcatccgggcggccgcttgagatcggcgctttgagaactgagcgcatgtggagttcggaggaaaagggctcagattgaagatggaaaatccccaagacattttctcaagtaatggtggctgtctaagtgatatagttatagaaaaatacctggttgaatccaaggagtctgtgtctcatgttcagcttgcttgcagcatgcaggactgtgctttccctttggatggaactgaactttgtatatggaacactaaggatccttctcatcagcttctaatcctacgaggacaccatcagccaattactgctatggcttttggaaataaagtgaacccacttctaatctgctcagcatcactggattatgttataatgtggaacctggatgaatgtagagagaaagtacttcaagggctggtccctcgagggactgtcatgggctcgcttttgggaaaggtgctgtgtttacagttgagcctggatgatcatgttgttgccgtgtgtgctggaaacaaaatattcatgctggatattgagcagcgattttctgtgacatacatagaacgtcctgatgttaataaccgccacaaagtcccaccaccgaccttcctgcacacattctctcagactcaggctgttcgggccgagctgcagggccacctgggcccggtgactgcggtggagttctgtccctggcgagcaggcaccctcatctcggcgtctgaggacagaggctttaaggtctgggaccattgtacaggatcattaatatacagttcatctgtgttatcagcatatcctcttctcagtttattcattgatgcagaaagcaggcagctggtcaccgggtgtgctgacggccagctttggatcttcagtttgatggatggacaccattatcgtcgtgtggcacgggttgacctaaggaagaagacagagactttctccacaagaagggttaagtctgggctgtgcagccagccagaagaaagccagcttccctctacaagtgctctgggaaaaggagagcaggttgaagtaacatttcctgtactgagacttgcaccctgtgatctctcactcatcccaaattctgcatgtggatgtctttcttctgagaacacccgatgtgtgtggatcggaagctcagtgggcttattcgtatttaacctggcaaacctggaagtggaagctgctttgtattacaaggatttccagagcctcagcatcctgctggccggatcgtgtgccctgaggaaccgcactgcggatcaaaaggtgctgtgcttgctggcctccctctttggcgggaagattgccgtgttggagatcaacccggccgcgctagtcagggctcagcagtgccccagcatggggcagagcctctcggtgccagccagctcctgtgtcctaccgacctctccactgtatctgggaattgccaaggagaagagtaccaaggctgctagtgaacagcgacgtgctgcacggaacgtcatgaaggaccaacgcctggttttccatagtaaagttaggtcatctggttatgcgtcagcaccacatgtaactatgttttcaccaaagaccaacatcaagagtgaggggaaaggatcttcaaggagcaggagcagctgcgcacgggaggcataccccgtggagtgcgctgtgcccaccaagcccggcccccaggtcgctgccgcccccacctgcacacgtgtatgctgcatccagtactcaggagatgggcagtggctggcctgtgggttggccaaccatctgttactcgtttttgatgccagcctgactgggacacctgctgtgttttcaggtcacgacggggcagtgaatgccgtgtgctggagccaggaccggaggtggctgctctctgcggcccgggacgggaccctgcgaatgtggtcggctcgtggggcagagctcgcactgcttctgggcaaagacatgttttctaaacctatacagtctgcacagttctattatatagatgcctttatattgttatcttctggccctgaatttcagctactgaggtatcacattgacacttgcaaagatgagattaagagatataaacagaagagcaagtccaagctgatttgcaggctctccacgacgggtgcagtagacatgaccagtttatcggcagtcaacgacttttattcccacatcgtactcgcagctggccggaacaggaccgtggaagtgtttgacctcaacgccggctgcagtgcagcggtgatagcggaagcccactcacggcctgtccatcaaatctgccaaaataaaggttcatcatttacaacccaacagcctcaggcttataaccttttcctgaccacggccattggcgatgggatgagactgtgggacctgagaaccctgaggtgtgagcgccactttgaagggcatccaacccgcggctatccatgtggaatcgctttcagtccttgtggacgattcgcggcttgtggggccgaggacagacacgcttacgtgtatgaaatgggctcaagcacgttttctcaccggctggctgggcacacagacactgtcactggagtggccttcaacccatcagcgccccagatggagtctcgctctgtcgcccacgctggagtgcagtggcacgatctcggttcactgcaacctccgccttccaggttcaagcaattcttctgcctcagcctcccgagtagctgggattacagcttgccacagctaccttggatggtaaactccagctctttctagctgagtaaccactgacctgtgagctgggtccaggaatgctgtgaggaacaacttaaaagtaagaagtagtggttcatccatcagggggccagaagcagcaactgtttttcatattttgagacttgcctcagatttcccccgtttgcaagctcctcccctctgtgtgtgccatgtcagagttttatgtctttctgctcctcaaaagggatccccttcattgggaaaatggaaatggcgtccagtacttctgcacagaatttggtaaagttaaaacaaaatatctttcaataaaacataatatagtatttgtttgataattagagttggaagaaaaaagagagaatttcttttgggcagtgaaaataaagcagttaacagtc

SEQ ID NO: 199752 - DNA, 951 bp, Homo sapiens
  Payload ID: 19410
  Gene Name: WD repeat domain 27
  ENST ID: ENST00000474018
  CDS Start-End: 688-951
cgaggggcggcgggctagtaaccatagcggctcgcgtgggtcggctggcaagtaaccatagcggcgagcgtggggcggagtgtggctcggtagtcctctgcgtgccctcctgggagctgggtgctgtgagtcctcccctagcgggctggtctcggcgcggagtcggcgccgaacccgagctgctgctctggggcgtgtgcctagggcgcagggctggagcgcgggggctgcgcggttgctcgcggctccgctgaggtctctaggaaagggggcgatttgagggttccgccgtgaccgcttccaacggcggacacgcgcgctctggaccagagccgttgcccgctgtctcgtcacccgaagcctcctcctgacgccgtgctagtgcgagggtctccaggggaattcggggcacaagtcgggccggagcatccgggcggccgcttgagatcggcgctttgagaactgagcgcatgtggagttcggaggaaaagggctcagttgtggaagctgatcgaggaagcctaagcaggctctgtgaagtgggaatagtggtatttgagtcaaggtttgcttaactggaaagcccgtgagaagaatggagcagttgagaatgtggaagctccagagttttcggcaatttctcttcttttttcttgggatgaggagaggtgaataaatagattgaagatggaaaatccccaagacattttctcaagtaatggtggctgtctaagtgatatagttatagaaaaatacctggttgaatccaaggagtctgtgtctcatgttcagcttgcttgcagcatgcaggactgtgctttccctttggatggaactgaactttgtatatggaacactaaggatccttctcatcagcttctaatcctacgaggacaccatcagccaattactgctatggcttttggaaataaagtgaacccacttctaatc

SEQ ID NO: 199753 - DNA, 9974 bp, Homo sapiens
  Payload ID: 19411
  Gene Name: WD repeat domain 3
  Uniprot ID: Q9UNX4
  ENST ID: ENST00000349139
  CDS Start-End: 48-2879
ctcgtggaggctgagattgcttcacctgtggtatcagacatcacaacatggggctcaccaagcagtacctacgctatgttgctagtgcggtctttggcgttatcggcagccaaaaaggtaatattgtctttgtgacacttcgtggtgagaaaggacgttatgtggcagtaccagcttgtgaacacgttttcatctgggacttaaggaaaggagagaagattcttatccttcaggggcttaaacaagaagttacttgcttatgcccctccccagatgggctacacttagctgttgggtatgaggatgggtcgatccgaatcttcagtctcctgagtggggaaggaaatgtgaccttcaatggtcacaaagcagctatcactaccttgaagtatgatcagctaggaggcagactggcatctgggtccaaggacacagatattattgtatgggatgtgatcaatgaaagtggtctgtaccgtctaaaggggcacaaggatgccatcacacaagcattgtttctacgagaaaagaacctgctagttactagtgggaaagataccatggtgaaatggtgggaccttgatactcagcactgctttaaaacaatggttggccaccggactgaggtatgggggttggttctgttgtcagaagaaaagcgactcatcactggggcctcagacagtgaactgagggtatgggacatagcttatctgcaagagattgaagacccggaagaaccagaccccaagaaaatcaaaggatcttctcctggaatacaagatactcttgaggcagaggatggtgcctttgagacggatgaagcccctgaggatcgaatcctttcatgcagaaaagctggttccataatgcgggaaggaagagacagagttgtaaaccttgcagtcgacaagacaggcaggattcttgcttgccatggaactgactctgtgctagaattgttttgtatcctttccaaaaaggaaattcagaagaaaatggataagaagatgaagaaagctagaaagaaagcaaaattacattctagcaaaggagaggaggaagatcctgaggttaatgttgaaatgagtctgcaagatgaaatccagcgggtgactaatataaaaacttctgccaaaatcaagtcctttgacttgattcattcacctcacggagagttaaaggctgtcttcctgctgcagaacaacctggtggaattgtattcactgaatccatccttgcctactcctcagcctgtcaggacaagcagaatcactattgggggtcatcgcagtgatgtgcggactttgtcattcagctcagacaatattgctgttctttcagctgcagctgattccattaaaatatggaacaggtctacactgcagtgtattcgcacaatgacctgtgaatatgcactttgctcattctttgtacctggtgatagacaggtagtcataggaacaaagacagggaagctgcagctttatgacttggcttcagggaatctgctggagacaatagatgcacatgatggagctttgtggtccatgtccctctctccagatcagcgtggctttgtgacaggtggtgcagataaatctgtcaaattctgggattttgagttagtgaaagatgaaaatagtacccaaaagagactttctgtgaagcaaacccgaactttgcaactagatgaagatgttctgtgtgtcagttactctcccaatcaaaagctattggctgtgtctttgctggactgtactgtgaaaattttctacgttgatactttaaagttttttctgtcactgtatggacacaaactgcctgttatatgcatggacatctctcatgatggagcactcatagcaactggctccgctgataggaatgtgaaaatctggggtttggactttggggactgccacaagtctctctttgcacatgatgacagtgtgatgtacctacagtttgtacccaagtctcacctcttcttcactgccggaaaagatcataagattaaacagtgggatgcagacaaatttgaacacatacagactctggagggtcatcaccaggaaatatggtgtttggctgtaagccccagtggagactatgttgtatcatcgtcccatgacaaatctctgagactttgggagagaacaagggagcctcttattcttgaggaagaaagggagatggaaagagaagcagaatatgaggagagtgtggccaaagaagaccaaccagcagttccaggagagactcaaggtgacagttactttactggaaagaaaactattgaaacagtgaaagcagctgagaggattatggaggctattgagttgtaccgagaagaaactgcaaaaatgaaggaacacaaagccatttgtaaagctgcagggaaagaggttccacttcccagcaaccccatcctaatggcttatggcagtatctcaccttcagcttatgtattagagatttttaaagggatcaagtcgagtgagctggaagaatctctacttgtgctgcctttctcttatgtcccagacattcttaaactctttaacgaattcattcagctgggctctgatgttgaacttatatgccggtgcctcttcttcctccttaggattcactttggacagatcactagcaatcaaatgcttgtgccagtgatagaaaaattaagggaaacaactatttcaaaagtcagccaagtccgggatgttatcggcttcaatatggctggtcttgattatctcaagagggaatgcgaggcaaaaagtgaagttatgttttttgctgatgctactagccacttggaagagaagaagaggaagaggaaaaagagggagaagttgattctaacgttgacttagaactgaaatgtggtatctttttttttttcaactttttcctttaaaggactcctaaactaagcacagaagagttggcgtcatcttaaaaataccaaataacagaagatcgcattgcagatgatatcaggatgtggtttccagctttgcctgagggaattccaacatgagattatgggctggctccatttcttggacttaaaatgcattattagtttaaaaatctttctgtgctctcaaagcttgagccttgcagctcaagcttgttgttccctttatattctagcagggaataaataattgttttaattaggtatttgtttcattggagttgaaattaacatttcaaaagtttttcgtatttttttatggcagatgatttgtcatttatttatattaggttttactgcctattgagacaaccaggtgcataattgattgccctttggccataaaaatgcagtgtcatggatcttagagctaaaaaggactgtaaaaattacccagaacagcgtcctcagacttaaccttctgcaagttatgtctgtatataagaagattctaattgctaactgtttatacttttctgaataaaatagttgtttctaattaaaaagtagccaagctaagatgcctggctgggcttctgaggaattaatacactcgtgtgtgtgtgtgtgtgtgtgtgtgtgtgtgtgtgtgtatgtgtatgtgtatgtacacatacatatatatagttgacacttgaaaaatgcaggtggtaggggcactgacccacccctacgccccgcacagtcaaaaatctgcatataacttttgattccccaaagtcttaagtactagtagcctgttattgactgggagcctgactgatgtattatatatattgtatactgtattcttaaagtaagctagagaaaagaaaatgttacttagaaaatcataaggaagagaaaatatatttactgtgtttatcaatactataagtgtatgtcatctgtttataaaatgaattgtctgtctggattggcaggcaaccacagccgcagacctcaatctgtggtacttatcaagcatcagctttttcttgtaatgtcatgacttttctctgctttttgggagcactgtgatatgcagtttactggggcgatgagttgttcatgcacaggtgattagtgtcacagcattttaagtgcatacgcacaacacttgagctcactgcatagcaacaggaggtggctgtgaaattatttcagtaacatactgtgtattacagttcattttatgcagctatgatttaatactgcatctttacattattttacatttctcccaaaactgtgaattgcaccatgtatgatctgtatttgtgtgtgttaatgttgataatagatttgcgtgtattttatggcagtaaatgataaaatagtctagtatctacatatattttgtgcattcatgatataactacttttttcctaatttttttcatctgaaacttttctcattgtttcagatctccaaaaatttttccaatatatttattgaaaatatctgggctgcgtgcagtggctcacgcctgtaatcccaccactgtgggaggccgaggcaggcggatcacaaggtcaggagttccagaccagcctggccaacatggtgaaacctcatctctactaaaaatacaaaaaactagctgggcgtggtggcaggcgcttgtaatcccagctactcaggaggctgagacaggagaatcacttgaacccggcaggcggagattgcagttagccaagacagtgccaccagcattccagcctgggcaacacagtgagactccatctccaaaataataatagtaaaaaaaaatctgtataacagtggagccaagtggttaaaacccatgttcaacggattgtctactgtatatcttcatggtaaggatttggggaatgttctaggaaaagatattgacagatacctctgggtctgggcttttcttttggggaagtttataaatgactaaatcatacttcttgttacaggcctgtttagatgttctgtatcttcttgagacagttttgctttttatcttttttgttgttgttaatcccaaagatttaaaactatggtttctgtctgaatttggtcattgcaaccaagttactgtgttgtggggccaccattttcttctaggctcagatatgcagtccttgtggcttgccgatttgtgtcccaaaccacaagtcttaatgttcttgagcataacacaatcactgaagtgagtaagggatgcagtggtgttatttgttgggcagaataaataagtgaattttggcatagagtttctgaaggcataactatgaaggcaagagaataggcaggcaggataatgcattctaggtgctttccaaggagtcagtgttgtttaggcagctattcctgccaccagggagaggagttaattcttgaaaaaaaatttaattttttatgagaacagaagttgattcaatatccttcttagagttgctcatcagaacataaatgtcactttctagtaacatttttgatggtttccaaaccaaaacaagttccaggagggcattcgagatgtatacatcatcaataattactcttatgttaaaagttgctgttttcccgtagctttgccaccatttataactcaaaagcctgatagtgctagggaatgtaaagatgtttctgtctgctaagtgttatactaatcgaagagaaggagaacttttatgataaagtgacatgtacagaacctagccaagttacaatttttggtcaaaatacttgaaactctttaactctaaaagtttaaggtcaataggtgcattataaagtaaattttaagccaggcaaatttctagtcattaagtcagtattcattgccttagtcagccattggctgtatataatccttaatataaaaaccatctaatgactaatatctcttgcatattgtgaagtaagttacctatagaaattctgtagtaccataaagaaaagccttttgagattgcagtgagctgagattgtgccactgcactccagtctgggcaacagagccagactccattgaaaaaaaaaaaaaaggctcttgaatgatgtattgggagtaaaacatttaggcttatttttaaaaatgtatatatccatccacttagagaaaatatgcttaaaaattttgaaattcactggctggaagctaggtgctttgtatatttggtattaaattgtttctcaatggcaaatgtcataaattatatctcattctaaagatatctagcaaatctccagcagagatctaggacagtgcccaggaaagcaatggtatctgttggtaggtacaggactgtatataggactctattcacttagctgtaaatgatgagcctgctcaatgcagccttttcaggccagattagtcttcagaaagagagggaggttgtgagcagaagcttaatgaagaaaccacattggcttacagttactgtctgcaatccacccccattcctcacaatttaagctcctaagtttgagatggggctaaggttcttaaaggtagtatcaccatatattcaagtcctttctctttatttctgaggtttttgggatccaagcagccctggtatgtttttagaacacagtacacattgtgtaacagtcactgagcccaactcttacatagggcctggcagtgttgcccttgtgtatcccttccccttgagtatggggtcggacctagtgactggcttctagtgaacagaatacagtaaatataatgggatgtgtcttccaagattagggtataaagcactgaattctaccttgcatgagcattacattttataatatatataaagaagcaactagtatagttatttaaacaaatattttctttttttttttttttgagacagagtctcgctctgtctcccaggctggagtgcagtggcacgatcttggctcactgcaagctccgcttcctgggttcacgccattctcctgcctcagcctccagagtagctgggactacaggcacccgccaccacacttggctgattttttctattgtttagtagagacggggtttcaccaagttagccaggatggtctcgatctcctgaccttgtgatccacccacctcggcctcccaaagtgctgggattacaggtgtgagccaccgggcccggcctaaacaaatattttcattcattcaggccaggtggcttataggtttctgactataagaagaggggaagaaacctggggtctaatacctcaaatttgaatgcttgacaatcaaattcccatttattacttactgtacctaatgtggagaaactttacgagacatgaagactccaagtgtggaggaataaattgtagaagttctctggaccattggattttcttttccctggggaaagtcttttggtcgtttatcataattgctgcttgttaaaacaggtaaaatacttgttaagggctgtgcttttcatgactaaattatttgcatatataaacctaaataacattttagaatcatagaatttcttctctggcaacatcagttcaattttaggtaactgtctatccaatgcaaattctgcatgctcaggcttgggggttagaggatggatatgccaatgtctagaatgtcttctgttctccctagtgtacatttctctcctaactgtgactggctttctataaggagccatcagtatggtcaagccccaaaccatatctacatcagatttcatgctttttttttttttttttggtggggagagggacagatcattgttgacactgtaagtaagtagataaaagatctgataagattttttgccctttatctgtgtctgacaggttctctctaatctataagcagggaaatagaaaatttattataaatacaaatgatttcattgctatgatcagcagcagtgactcaggtatttgcatctaataacctgtgtggagagggtaagggcacttgatttagttaccagaggaaaaaactagttctttggctagtttccttctgtcacaatggaaaaaccctgtcattactcaaaggaagagaaaaagggaggggaggaaggtgagaggaagggagagagactttcccagtgaggactttcctttcctattttatattttgctccattgtacttactgccatcattgtttatggtttacttactttatgtattgtctgtcctcccactggaatgtaagctacataaaggcaggcgtttcggcatctttgaaagcataaatgaacaaatgaactaaacttcatttattgacatcagtgctatctgacacaagttcctttaactttctccttcacctcggaatatctgaatcatcagctatcttcagcttctcccttgccaagactaacccttcagctctgttttttattattcttttgccctgttttggatattgcagtttcaatcacttctactcattcatatttttaatatatatcttctgctccactctcttcagcctacaaacatgtaggtctacattaaactgaaaatccttcctatattctgttgcatccttgagtaacatattctcttgctctttcctttaataaattttcttgaaagaatatccataactaatgtttctgctttcttaatacagtcattctttaccttttgcaatttagtttttatcccaaccaaatttaacactttaaatctgaattttctttgacatctcaatagcatccgtcaattgtgtccgtcttttccttgaaattcttcctaaggcttttgaagtatttcaccattttctaattgctgcttttgtctccactggctcttcttcctcctgctccctaaaccgactccagatttctgttccttgcccatacattcagccatcacctctgtgtaaacgatgcttaaaattattatatctccaattctgacttctcagttgagatctaatattacatatacatgattcattacctcagcccaaaactttgaagttgaactcgatgtcctctttcttccatccatcaatggcttctacctcagattttgcagtttccttcccccaccatgtctttcattcatgtccctcttttatgttgactgttcccccactcccagttcttgtcctcacacatggcccattcaggtagacttctaatggtacttttacacatccagttgttcccctttgacatgtcctgcacaataaccctggattcatcttaataaagatatgctgatcatgtcacccacagggtcaggaatctgcagtggttcactgctgcttaaataataaaattcaagccaaggatttaagatctttcataacttgactccaacctactttcccactatattcctaatactcaagcttttggcaagttgaactccctgccaatcatcccaaacacctggagctttcctgttgccatggttttgttcattatttttacttaaagttcccgtcaatcaagttttcacattctataagatccagctcaaaaatcaaataaatagagaactgtaacacaagcagcacacaattcatgccactggagaaagtacaaaatagaaataaaatgtgaagactttatttctgctacaaattatataataccttttaagacagagtccaattatccatttttatatatgataaactattttatacagtaccttggaggtaataggttcttgatatctatctaatatctgtttggctgaagacactgataaggaggaatgcatgcataattcagtgaatacccaacctttataataataaggtatttcctatccttccataaaattataatttttttgtgatagatacttgctgttttattattctgtctgatattccgtagatagccaataacatttacatttattcaatctgaagttactgcacatatactatgtgtcaggtatttttttagatttggctaggtgctttcaaagatgaatgaagatgctctttgtcttaataaatttaactctgattttgaagatagaattaataaagtagagatgcattttgacttcc

SEQ ID NO: 199754 - DNA, 1035 bp, Homo sapiens
  Payload ID: 19411
  Gene Name: WD repeat domain 3
  ENST ID: ENST00000369441
  CDS Start-End: 96-218
ggacccggaaggggcaggtcttgtgggcgggtccaatcggctgggagcctcgtggaggctgagattgcttcacctgtggtatcagacatcacaacatggggctcaccaagcagtacctacgctatgttgctagtgcggtctttggcgttatcggcagccaaaaaggtctagctagccaagcatcaagttcctttgtgttcttcgccactgaattctgaaaaccacaatgaaataggagcttatttcttagatgtctatttgttggaatatttacagattcttatccttcaggggcttaaacaagaagttacttgcttatgcccctccccagatgggctacacttagctgttgggtatgaggatgggtcgatccgaatcttcagtctcctgagtggggaaggaaatgtgaccttcaatggtcacaaagcagctatcactaccttgaagtatgatcagctaggaggcagactggcatctgggtccaaggacacagatattattgtatgggatgtgatcaatgaaagtggtctgtaccgtctaaaggggcacaaggatgccatcacacaagcattgtttctacgagaaaagaacctgctagttactagtgggaaagataccatggtgaaatggtgggaccttgatactcagcactgctttaaaacaatggttggccaccggactgaggtatgggggttggttctgttgtcagaagaaaagcgactcatcactggggcctcagacagtgaactgagggtatgggacatagcttatctgcaagagattgaagacccggaagaaccagaccccaagaaaatcaaaggatcttctcctggaatacaagatactcttgaggcagaggatggtgcctttgagacggatgaagcccctgaggatcgaatcctttcatgcagaaaagctggttccataatgcgggaaggaagagacagagttgtaaaccttgcagtcgacaagacaggcaggattcttgcttgccatggaactgactctgtgctagaattgttttgtatcctttcc

SEQ ID NO: 199755 - DNA, 4862 bp, Homo sapiens
  Payload ID: 19412
  Gene Name: WD repeat domain 31
  Uniprot ID: Q8NA23
  ENST ID: ENST00000341761
  CDS Start-End: 235-1335
acccccaggctccgcgttcccgccggccccagctccagccccgcagcccaccgtgcaaacatgcttagacagagaagagattaacttcagtggcttcccactaattacagagattaagaagtggctgcctgaactattttccaaaggatacacattacaaattattgaatagggcagctaaccaagaagatcctattggtttggggggaacacaacttccagcagccacaagggatgctgctactcaggtgccaactgaaacaagctcctccacagaaggtttcgtttaggttttgtgtcgtgatggggaaacagcaaagcaaactcaaacacagcacttataaatacgggcctgatgaaattatagaagagagaattcaaactaaagcttttcaagagtatagcccagctcacatggataccgtctctgtcgtggctgctttgaactcagacctttgtgtctctggagggaaagataagacagttgtggcctataattggaaaactggaaatgtggtgaaaaggttcaaaggacatgaacatgagatcaccaaggtagcctgtattcccaaatccagccagttcttcagtgcctctcgtgacaggatggtcatgatgtgggacttgcacggttcctcacaaccaaggcagcaattgtgtggccatgccatggtggtcaccggattggctgtgagtccagactcatcacagctgtgcactggctctcgggacaacaccctgcttctgtgggatgtggtgacaggacagagtgtggaaagagcatctgtctccaggaacgtggtcactcacctgtgctgggtccccagagaaccatacatactacagacctctgaagataaaaccctcagattatgggacagtcgggggctgcaggtagctcatatgtttcctgcaaagcagcacattcagacctactgtgaagtcagtgtggatggacacaagtgtatctcctgcagcaatggctttggaggagaaggctgtgaagccacgttgtgggacctaagacagactcgaaacagaatatgtgagtataaggggcatttccagactgtcgcatcctgcgtctttctaccaagagcattggccttgatgcctttaattgctacctcatcacatgattgcaaggtgaagatttggaaccaagatactggagcctgccttttcaccttgtctctggatggatcaggacccttgacttctctggctgttggtgacgccatctccttattgtgtgcaagttttaacagaggaattcacttactcagaatggaccacagccaagggctggaactgcaggaagtggcagcattctgaggccaagagacactcactggacaatatcaaaccatggctcctcctcagcatggctttgtgtctttcccagttatcttgaggggagtgggatgtagggctggtattctttgcttaggttcatttacaagatgtatcagtgttgtaagtccaataatttaagtccagtgattcaaaatcaggtatagagtccagaaacatggactacacataaggttctctatttaagttaaatacaaatgcaactttttagtgagcttttaggactactcttcaaaaaaagtgtattgctcagaatgatgacctgtaaatgtaagagtggcaggcctctgtctgtgaaagtcagaacacagggctcgagcctctggaactgaccctttgcaagtctttacaaaagaaaaaaggcagtggggagagagagtgttttggttacatcagaaataattgagatgggaaagaatagtgcagctccatagaggagacggactgtagacaatgagattaagcttcaatcactgctcctcagcaatgtgaagaatcaaagtcagggcaagaaagcgaaagcttggacttctattcaaagtggcagcagagtgggagggcggtacccttctagcccagtgctgctgagcttgtgtgaaaatcagacctgagatggcttgaagcagccaagaaccacatgggcattgcccagaattacaggagttagcacaccagctctacagataagaaaacattgaaattcaaagattaaggccaaaaatatctcacttgcaattttaatattttcatttggatttatataaatgaaacatatatatgttttggaatggccagagtgaggcaaaggggatccctgaaataacattagaacatacaggaaaaacgaggcaggcagatcactttaggtcaggagttcaagaccagcctgtacgtgcgtgcctgtagtcccagctactcgggaggctgagatgggagaatcacttgaacctgggaggcagagtttgcagtgagctgagattgtgccactgcactccagtctgtgtgacagaatgagaccttgtcttgaaaaaaaaaaaaacaaaaaaccacatacaggaaaaaagagagggatggagtcaactgtgccccagacattaagcccccttcagtgaggaggggcaaggtgctcaggcctgcctgtgtggcccccaggagtcagacctcagcctcatgctcactggtccattttcctccagggaaaatggagttctttctgccttcagagatgcccacacataaggcacatgaggctgttggtgacaccatcaccaacactggagattccctttctgacaagtcccagccaaagaaagattttgcatttgtcttctctgtcctctgcttgtctctgataccagtgactgacagccaccttccttcttccctctcttggtgtgatcatggctaactgcagcctcaatcaccagggctcaatcaatcctccctccttagcctcctgagtagctgggactgcaggcatgcaccaccacacctggctaattttttgtgtgtttgtgtggtctaaaactcctgggctcaagtgatccatctgcctcggcctccttaagtgttgagattacaggtatgagccaccacatccagctgagagtctgttcttaagctagtacaaagagtcagacccgactttgaatctccacttctccatttagctggatgatcttgggcaagttataaaatctgtttcctcttcactttataacgtgggtttcatgatcatacctcgccacagggctgttctgaagactggacatagctattttaaatgccaggaaaggccaggcgcagtggctcaaacctgtaatcccagcactttgggaggccgaggcaggaggatcacctgaggtcaggagtttgagaccagcctgaccaacatggagaaaccccgtctctactaaaaatacaaaaattagccaggcgtggtggtgcatgcctgtaatcccagctacctggggagcctgaggcgggagaatcgcttgaacccaggaggcggaggttgcggtgagccgagattgtgccattgcactccagcctgggcaacaagagcgaaactccatctcaataaataaataaataagtaaatgccaggaaaggtggtgacaaatggtagccataattatttattgtcctctctgtccagactaaatgttcccttttccatattaaacatttaccattctgccggacgcgttggctcatgcctgtaatcccagcactttgtgaggcctaggcgggcagatcacaaggtcaagagatcgagaccatcctggccaatatggtgaaaccccgtctctactaaaaatacaaaaattagctgggtgtggtggtgcccgcctgtagtcccagctactcaggaggctgaggcaggagaatcgcttcaaccggggaggcagaggttgcagtgagctgagattgtgccattgcactccagcctaggcaacagagagagactctatctcaaaataaaataaaataaaataaaataaaataaacgtttaccattccttgatccttttttttttttttttttttgagatggaatcttgctctgtcgcccaggctggagtgcagtggtgcaatctcggctcgctgcaagctccgcctcccgggttgacgccattctcctgcctcagcctcccgaatagctgggactacaggcgcccgccatcacgcccggctaatttttttgtgtttttagtagagacgggatttcaccgtgttagccaggatggtctcaatctcctgacctcgtgatccgcccgcctaagtgctgggattacaggcgtgagccactgcgcccggcctccttcatccattcttagatcttatcctctaaacctttagtcatcgtttcactctcctttgattccttgttatgggtctttcaactctggaaagacaaagagatagtgggagaggaagcccggtcactgagcatctacagagggctaaatatatttattctcatttgttattcccaatattctctgtattgtgatttccatttcacagatgaggaagctgagggctagaaacatgcagtactttgcccaaagtcacacacatattaagaagagctgaggtatgaatctgggtctgcctgactcaaagcccaaacgctttcctttgcatcgtgtcacaaagtcatagaccatgacattgtttgtatcttcaagaccagttattaactttctggctccaaggagatcccctgcccaagtgcctaggggcagtagacagctgtctcagggacagtcgtagcatgtgctggattattagtgcagcagctgacactttttcccagaagggagagaggcagcaagtcagaaagttcacgggaatgagttgggagggggtcccagggaagggggacaggctgccaggagaaggaaagtacacgggagaaaatagtggggctctgatgagttagtagggttctgttaccaataaaattgtttccataaactgta

SEQ ID NO: 199756 - DNA, 4878 bp, Homo sapiens
  Payload ID: 19412
  Gene Name: WD repeat domain 31
  Uniprot ID: Q8NA23
  ENST ID: ENST00000374193
  CDS Start-End: 248-1351
ggaggctgttcccacccccaggctccgcgttcccgccggccccagctccagccccgcagcccaccgtgcaaacatgcttagacagagaagagattaacttcagtggcttcccactaattacagagattaagaagtggctgcctgaactattttccaaaggatacacattacaaattattgaatagggcagctaaccaagaagatcctattggtttggggggaacacaacttccagcagccacaagggatgctgctactcaggtgccaactgaaacaagctcctccacagaaggtttcgtttaggttttgtgtcgtgatggggaaacagcaaagcaaactcaaacacagcacttataaatacggcaggcctgatgaaattatagaagagagaattcaaactaaagcttttcaagagtatagcccagctcacatggataccgtctctgtcgtggctgctttgaactcagacctttgtgtctctggagggaaagataagacagttgtggcctataattggaaaactggaaatgtggtgaaaaggttcaaaggacatgaacatgagatcaccaaggtagcctgtattcccaaatccagccagttcttcagtgcctctcgtgacaggatggtcatgatgtgggacttgcacggttcctcacaaccaaggcagcaattgtgtggccatgccatggtggtcaccggattggctgtgagtccagactcatcacagctgtgcactggctctcgggacaacaccctgcttctgtgggatgtggtgacaggacagagtgtggaaagagcatctgtctccaggaacgtggtcactcacctgtgctgggtccccagagaaccatacatactacagacctctgaagataaaaccctcagattatgggacagtcgggggctgcaggtagctcatatgtttcctgcaaagcagcacattcagacctactgtgaagtcagtgtggatggacacaagtgtatctcctgcagcaatggctttggaggagaaggctgtgaagccacgttgtgggacctaagacagactcgaaacagaatatgtgagtataaggggcatttccagactgtcgcatcctgcgtctttctaccaagagcattggccttgatgcctttaattgctacctcatcacatgattgcaaggtgaagatttggaaccaagatactggagcctgccttttcaccttgtctctggatggatcaggacccttgacttctctggctgttggtgacgccatctccttattgtgtgcaagttttaacagaggaattcacttactcagaatggaccacagccaagggctggaactgcaggaagtggcagcattctgaggccaagagacactcactggacaatatcaaaccatggctcctcctcagcatggctttgtgtctttcccagttatcttgaggggagtgggatgtagggctggtattctttgcttaggttcatttacaagatgtatcagtgttgtaagtccaataatttaagtccagtgattcaaaatcaggtatagagtccagaaacatggactacacataaggttctctatttaagttaaatacaaatgcaactttttagtgagcttttaggactactcttcaaaaaaagtgtattgctcagaatgatgacctgtaaatgtaagagtggcaggcctctgtctgtgaaagtcagaacacagggctcgagcctctggaactgaccctttgcaagtctttacaaaagaaaaaaggcagtggggagagagagtgttttggttacatcagaaataattgagatgggaaagaatagtgcagctccatagaggagacggactgtagacaatgagattaagcttcaatcactgctcctcagcaatgtgaagaatcaaagtcagggcaagaaagcgaaagcttggacttctattcaaagtggcagcagagtgggagggcggtacccttctagcccagtgctgctgagcttgtgtgaaaatcagacctgagatggcttgaagcagccaagaaccacatgggcattgcccagaattacaggagttagcacaccagctctacagataagaaaacattgaaattcaaagattaaggccaaaaatatctcacttgcaattttaatattttcatttggatttatataaatgaaacatatatatgttttggaatggccagagtgaggcaaaggggatccctgaaataacattagaacatacaggaaaaacgaggcaggcagatcactttaggtcaggagttcaagaccagcctgtacgtgcgtgcctgtagtcccagctactcgggaggctgagatgggagaatcacttgaacctgggaggcagagtttgcagtgagctgagattgtgccactgcactccagtctgtgtgacagaatgagaccttgtcttgaaaaaaaaaaaaacaaaaaaccacatacaggaaaaaagagagggatggagtcaactgtgccccagacattaagcccccttcagtgaggaggggcaaggtgctcaggcctgcctgtgtggcccccaggagtcagacctcagcctcatgctcactggtccattttcctccagggaaaatggagttctttctgccttcagagatgcccacacataaggcacatgaggctgttggtgacaccatcaccaacactggagattccctttctgacaagtcccagccaaagaaagattttgcatttgtcttctctgtcctctgcttgtctctgataccagtgactgacagccaccttccttcttccctctcttggtgtgatcatggctaactgcagcctcaatcaccagggctcaatcaatcctccctccttagcctcctgagtagctgggactgcaggcatgcaccaccacacctggctaattttttgtgtgtttgtgtggtctaaaactcctgggctcaagtgatccatctgcctcggcctccttaagtgttgagattacaggtatgagccaccacatccagctgagagtctgttcttaagctagtacaaagagtcagacccgactttgaatctccacttctccatttagctggatgatcttgggcaagttataaaatctgtttcctcttcactttataacgtgggtttcatgatcatacctcgccacagggctgttctgaagactggacatagctattttaaatgccaggaaaggccaggcgcagtggctcaaacctgtaatcccagcactttgggaggccgaggcaggaggatcacctgaggtcaggagtttgagaccagcctgaccaacatggagaaaccccgtctctactaaaaatacaaaaattagccaggcgtggtggtgcatgcctgtaatcccagctacctggggagcctgaggcgggagaatcgcttgaacccaggaggcggaggttgcggtgagccgagattgtgccattgcactccagcctgggcaacaagagcgaaactccatctcaataaataaataaataagtaaatgccaggaaaggtggtgacaaatggtagccataattatttattgtcctctctgtccagactaaatgttcccttttccatattaaacatttaccattctgccggacgcgttggctcatgcctgtaatcccagcactttgtgaggcctaggcgggcagatcacaaggtcaagagatcgagaccatcctggccaatatggtgaaaccccgtctctactaaaaatacaaaaattagctgggtgtggtggtgcccgcctgtagtcccagctactcaggaggctgaggcaggagaatcgcttcaaccggggaggcagaggttgcagtgagctgagattgtgccattgcactccagcctaggcaacagagagagactctatctcaaaataaaataaaataaaataaaataaaataaacgtttaccattccttgatccttttttttttttttttttttgagatggaatcttgctctgtcgcccaggctggagtgcagtggtgcaatctcggctcgctgcaagctccgcctcccgggttgacgccattctcctgcctcagcctcccgaatagctgggactacaggcgcccgccatcacgcccggctaatttttttgtgtttttagtagagacgggatttcaccgtgttagccaggatggtctcaatctcctgacctcgtgatccgcccgcctaagtgctgggattacaggcgtgagccactgcgcccggcctccttcatccattcttagatcttatcctctaaacctttagtcatcgtttcactctcctttgattccttgttatgggtctttcaactctggaaagacaaagagatagtgggagaggaagcccggtcactgagcatctacagagggctaaatatatttattctcatttgttattcccaatattctctgtattgtgatttccatttcacagatgaggaagctgagggctagaaacatgcagtactttgcccaaagtcacacacatattaagaagagctgaggtatgaatctgggtctgcctgactcaaagcccaaacgctttcctttgcatcgtgtcacaaagtcatagaccatgacattgtttgtatcttcaagaccagttattaactttctggctccaaggagatcccctgcccaagtgcctaggggcagtagacagctgtctcagggacagtcgtagcatgtgctggattattagtgcagcagctgacactttttcccagaagggagagaggcagcaagtcagaaagttcacgggaatgagttgggagggggtcccagggaagggggacaggctgccaggagaaggaaagtacacgggagaaaatagtggggctctgatgagttagtagggttctgttaccaataaaattgtttccataaactgta

SEQ ID NO: 199757 - DNA, 3101 bp, Homo sapiens
  Payload ID: 19412
  Gene Name: WD repeat domain 31
  Uniprot ID: Q8NA23
  ENST ID: ENST00000374195
  CDS Start-End: 238-1338
cccacccccaggctccgcgttcccgccggccccagctccagccccgcagcccaccgtgcaaacatgcttagacagagaagagattaacttcagtggcttcccactaattacagagattaagaagtggctgcctgaactattttccaaaggatacacattacaaattattgaatagggcagctaaccaagaagatcctattggtttggggggaacacaacttccagcagccacaagggatgctgctactcaggtgccaactgaaacaagctcctccacagaaggtttcgtttaggttttgtgtcgtgatggggaaacagcaaagcaaactcaaacacagcacttataaatacgggcctgatgaaattatagaagagagaattcaaactaaagcttttcaagagtatagcccagctcacatggataccgtctctgtcgtggctgctttgaactcagacctttgtgtctctggagggaaagataagacagttgtggcctataattggaaaactggaaatgtggtgaaaaggttcaaaggacatgaacatgagatcaccaaggtagcctgtattcccaaatccagccagttcttcagtgcctctcgtgacaggatggtcatgatgtgggacttgcacggttcctcacaaccaaggcagcaattgtgtggccatgccatggtggtcaccggattggctgtgagtccagactcatcacagctgtgcactggctctcgggacaacaccctgcttctgtgggatgtggtgacaggacagagtgtggaaagagcatctgtctccaggaacgtggtcactcacctgtgctgggtccccagagaaccatacatactacagacctctgaagataaaaccctcagattatgggacagtcgggggctgcaggtagctcatatgtttcctgcaaagcagcacattcagacctactgtgaagtcagtgtggatggacacaagtgtatctcctgcagcaatggctttggaggagaaggctgtgaagccacgttgtgggacctaagacagactcgaaacagaatatgtgagtataaggggcatttccagactgtcgcatcctgcgtctttctaccaagagcattggccttgatgcctttaattgctacctcatcacatgattgcaaggtgaagatttggaaccaagatactggagcctgccttttcaccttgtctctggatggatcaggacccttgacttctctggctgttggtgacgccatctccttattgtgtgcaagttttaacagaggaattcacttactcagaatggaccacagccaagggctggaactgcaggaagtggcagcattctgaggccaagagacactcactggacaatatcaaaccatggctcctcctcagcatggctttgtgtctttcccagttatcttgaggggagtgggatgtagggctggtattctttgcttaggttcatttacaagatgtatcagtgttgtaagtccaataatttaagtccagtgattcaaaatcaggtatagagtccagaaacatggactacacataaggttctctatttaagttaaatacaaatgcaactttttagtgagcttttaggactactcttcaaaaaaagtgtattgctcagaatgatgacctgtaaatgtaagagtggcaggcctctgtctgtgaaagtcagaacacagggctcgagcctctggaactgaccctttgcaagtctttacaaaagaaaaaaggcagtggggagagagagtgttttggttacatcagaaataattgagatgggaaagaatagtgcagctccatagaggagacggactgtagacaatgagattaagcttcaatcactgctcctcagcaatgtgaagaatcaaagtcagggcaagaaagcgaaagcttggacttctattcaaagtggcagcagagtgggagggcggtacccttctagcccagtgctgctgagcttgtgtgaaaatcagacctgagatggcttgaagcagccaagaaccacatgggcattgcccagaattacaggagttagcacaccagctctacagataagaaaacattgaaattcaaagattaaggccaaaaatatctcacttgcaattttaatattttcatttggatttatataaatgaaacatatatatgttttggaatggccagagtgaggcaaaggggatccctgaagcgggagaatcgcttgaacccaggaggcggaggttgcggtgagccgagattgtgccattgcactccagcctgggcaacaagagcgaaactccatctcaataaataaataaataagtaaatgccaggaaaggtggtgacaaatggtagccataattatttattgtcctctctgtccagactaaatgttcccttttccatattaaacatttaccattctggcgtgagccactgcgcccggcctccttcatccattcttagatcttatcctctaaacctttagtcatcgtttcactctcctttgattccttgttatgggtctttcaactctggaaagacaaagagatagtgggagaggaagcccggtcactgagcatctacagagggctaaatatatttattctcatttgttattcccaatattctctgtattgtgatttccatttcacagatgaggaagctgagggctagaaacatgcagtactttgcccaaagtcacacacatattaagaagagctgaggtatgaatctgggtctgcctgactcaaagcccaaacgctttcctttgcatcgtgtcacaaagtcatagaccatgacattgtttgtatcttcaagaccagttattaactttctggctccaaggagatcccctgcccaagtgcctaggggcagtagacagctgtctcagggacagtcgtagcatgtgctggattattagtgcagcagctgacactttttcccagaagggagagaggcagcaagtcagaaagttcacgggaatgagttgggagggggtcccagggaagggggacaggctgccaggagaaggaaagtacacgggagaaaatagtggggctctgatgagttagtagggttctgttaccaataaaattgtttccataaactgt

SEQ ID NO: 199758 - DNA, 533 bp, Homo sapiens
  Payload ID: 19412
  Gene Name: WD repeat domain 31
  ENST ID: ENST00000465979
  CDS Start-End: 111-533
aggcgcgggagggctcggaggctgttcccacccccaggctccgcgttcccgccggccccagctccagccccgcagcccaccgggaacacaacttccagcagccacaagggatgctgctactcaggtgccaactgaaacaagctcctccacagaagacagttgtggcctataattggaaaactggaaatgtggtgaaaaggttcaaaggacatgaacatgagatcaccaaggtagcctgtattcccaaatccagccagttcttcagtgcctctcgtgacaggatggtcatgatgtgggacttgcacggttcctcacaaccaaggcagcaattgtgtggccatgccatggtggtcaccggattggctgtgagtccagactcatcacagctgtgcactggctctcgggacaacaccctgcttctgtgggatgtggtgacaggacagagtgtggaaagagcatctgtctccaggaacgtggtcactcacctgtgctgggtccccagagaaccatacatactacagacctctgaagat

SEQ ID NO: 199759 - DNA, 2255 bp, Homo sapiens
  Payload ID: 19412
  Gene Name: WD repeat domain 31
  ENST ID: ENST00000465205
  CDS Start-End: 220-375
gttcccgccggccccagctccagccccgcagcccaccgtgcaaacatgcttagacagagaagagattaacttcagtggcttcccactaattacagagattaagaagtggctgcctgaactattttccaaaggatacacattacaaattattgaatagggcagctaaccaagaagatcctattggtttggggggaacacaacttccagcagccacaagggatgctgctactcaggtgccaactgaaacaagctcctccacagaaggtttcgtttaggttttgtgtcgtgatggggaaacagcaaagcaaactcaaacacagcacttataaatacggacagttgtggcctataattggaaaactggaaatgtggtgaaaaggttcaaaggacatgaacatgagatcaccaaggtagcctgtattcccaaatccagccagttcttcagtgcctctcgtgacaggatggtcatgatgtgggacttgcacggttcctcacaaccaaggcagcaattgtgtggccatgccatggtggtcaccggattggctgtgagtccagactcatcacagctgtgcactggctctcgggacaacaccctgcttctgtgggatgtggtgacaggacagagtgtggaaagagcatctgtctccaggaacgtggtcactcacctgtgctgggtccccagagaaccatacatactacagacctctgaagataaaaccctcagattatgggacagtcgggggctgcaggtagctcatatgtttcctgcaaagcagcacattcagacctactgtgaagtcagtgtggatggacacaagtgtatctcctgcagcaatggctttggaggagaaggctgtgaagccacgttgtgggacctaagacagactcgaaacagaatatgtgagtataaggggcatttccagactgtcgcatcctgcgtctttctaccaagagcattggccttgatgcctttaattgctacctcatcacatgattgcaaggtgaagatttggaaccaagatactggagcctgccttttcaccttgtctctggatggatcaggacccttgacttctctggctgttggtgacgccatctccttattgtgtgcaagttttaacagaggaattcacttactcagaatggaccacagccaagggctggaactgcaggaagtggcagcattctgaggccaagagacactcactggacaatatcaaaccatggctcctcctcagcatggctttgtgtctttcccagttatcttgaggggagtgggatgtagggctggtattctttgcttaggttcatttacaagatgtatcagtgttgtaagtccaataatttaagtccagtgattcaaaatcaggtatagagtccagaaacatggactacacataaggttctctatttaagttaaatacaaatgcaactttttagtgagcttttaggactactcttcaaaaaaagtgtattgctcagaatgatgacctgtaaatgtaagagtggcaggcctctgtctgtgaaagtcagaacacagggctcgagcctctggaactgaccctttgcaagtctttacaaaagaaaaaaggcagtggggagagagagtgttttggttacatcagaaataattgagatgggaaagaatagtgcagctccatagaggagacggactgtagacaatgagattaagcttcaatcactgctcctcagcaatgtgaagaatcaaagtcagggcaagaaagcgaaagcttggacttctattcaaagtggcagcagagtgggagggcggtacccttctagcccagtgctgctgagcttgtgtgaaaatcagacctgagatggcttgaagcagccaagaaccacatgggcattgcccagaattacaggagttagcacaccagctctacagataagaaaacattgaaattcaaagattaaggccaaaaatatctcacttgcaattttaatattttcatttggatttatataaatgaaacatatatatgttttggaatggccagagtgaggcaaaggggatccctgaaataacattagaacatacaggaaaaacgaggcaggcagatcactttaggtcaggagttcaagaccagcctgtacgtgcgtgcctgtagtcccagctactcgggaggctgagatgggagaatcacttgaacctgggaggcagagtttgcagtgagctgagattgtgccactgcactccagtctgtgtgacagaatgagaccttgtcttg

SEQ ID NO: 199760 - DNA, 9471 bp, Homo sapiens
  Payload ID: 19413
  Gene Name: WD repeat domain 33
  Uniprot ID: Q9C0J8
  ENST ID: ENST00000322313
  CDS Start-End: 160-4170
ggggaagatggcggctgctcctttggaggagcgggattgagaggatcggggtggggagaccaaacaagagagacatttctggctctgaaggcgaacgcttcgctggccatttaggagctctgctcaaagccagacgtatcctagaaggaaaacatcaccatggctacagaaattggttctcctcctcgttttttccatatgccaaggttccagcaccaggcacctcgacagctgttttataagcgacctgattttgcacaacagcaagcaatgcaacagcttacttttgatggaaaacgaatgagaaaagctgtgaaccgaaaaaccatagactacaatccatctgtaattaagtatttggagaacagaatatggcaaagagaccagagagatatgcgggcaattcagcctgatgcaggttattacaatgatctggtcccacctataggaatgttgaataatcctatgaatgcagtaacaacaaaatttgttcggacatcaacaaataaagtaaagtgtcctgtatttgttgttaggtggactccagaaggaagacgcttggtcactggagcttctagtggggagtttaccctgtggaatggactcactttcaattttgaaacaatattacaggctcacgacagcccagtgagggccatgacgtggtcacataatgacatgtggatgttgacagcagaccacggaggatatgtgaaatattggcagtcgaacatgaacaacgtcaagatgttccaggcacataaggaggcgattagagaggccagtttctcacccacggataataaatttgctacatgctctgatgacggcactgttagaatctgggactttcttcgttgccatgaggaaagaattctccgagggcatggtgctgatgtgaaatgtgtagactggcatccaaccaaagggttagttgtttcaggaagtaaagatagtcaacagccaatcaagttctgggatcccaagactgggcagagtcttgcaacacttcatgcccataaaaacacagtaatggaagtgaaattaaacctcaatggcaattggctactcacagcatcacgtgatcatctctgtaaactttttgatatcagaaacctaaaagaagagcttcaagtcttccgaggtcataagaaagaagccacagctgtggcctggcatcctgttcatgaaggactttttgccagtggagggtctgatggttctttgttattctggcatgttggggtagagaaggaagtgggtgggatggagatggctcacgaagggatgatctggagtctggcttggcatcctcttgggcatattctctgctcaggctcaaatgaccatactagcaaattctggactcgaaaccgaccaggtgataaaatgcgagatcgatataatctaaaccttttacctggaatgtctgaagatggagtagaatatgatgacctcgaacctaatagcctggcagtaattccaggaatgggaataccagaacaactaaaattagctatggaacaagaacagatggggaaagatgaatcaaatgaaattgaaatgacaattccaggtttagattggggaatggaggaagtgatgcaaaaggatcagaaaaaagtacctcagaagaaagttccttatgcaaaacccattcctgctcagttccagcaggcttggatgcaaaataaagttccaattcctgctccaaatgaggtgctgaatgacagaaaagaagacattaaattggaagagaagaaaaaaacacaagcagaaattgagcaagaaatggctacattacaatatactaacccacaacttctggagcaacttaaaattgaaagacttgcacagaaacaagttgagcaaattcagcctcctccctcatctggcacccctctcctcggaccccagccttttccaggacaaggtccaatgtctcagattcctcaaggttttcaacagccccatccatctcagcagatgccaatgaacatggctcaaatggggcctccaggtccacagggacagtttaggcctcctggaccccagggacaaatgggaccacaaggtcctccactgcatcagggaggtggggggccacaaggattcatgggaccacaggggccccagggcccgccccaggggttgccacggcctcaggacatgcatgggccccaaggaatgcagaggcatcctggacctcatggccctttgggacctcaagggccacctggaccacaaggtagttctggtcctcaaggtcatatgggtcctcagggtccacctggcccacagggtcacataggcccccaaggcccgcctggccctcagggtcacttgggcccacaggggcctccgggtactcaaggtatgcagggaccacctggtcccagaggaatgcaagggcctcctcatcctcatgggatccaaggcggaccagggtctcaagggatccaaggtcctgtgtctcagggacctctgatgggattgaatccaagaggaatgcaggggcctccaggcccccgggagaaccagggtcctgctccccaagggatgattatgggccacccgcctcaagagatgagaggacctcaccctccaggtggactactgggacacggccctcaggaaatgagaggtcctcaggagatccgaggcatgcaggggcctccaccccaaggatcaatgctgggacctccccaggaattgcgagggcctccaggctcacaaagtcagcaggggccgccccagggctctttaggacctccaccccagggtggcatgcaaggaccccccggacctcagggacagcagaacccagcaagagggccacatccatctcaagggccaataccattccagcaacagaaaacgcctctgctaggtgatgggccccgggcccccttcaaccaggaaggacagagcacaggccccccacccctgataccaggcctagggcagcagggagcacaaggtcgcattccccctctgaaccccggacaaggacctggccccaacaaaggtgactcccgcggccctccaaaccatcacatgggcccgatgtcagagaggcggcatgagcagagcggcgggcctgagcatgggcccgagagggggcctttccggggtggccaggactgcaggggtccccctgataggcgtggccctcacccagacttccccgatgacttcagcagaccagatgacttccaccctgacaagcgctttggccaccggttacgtgaatttgaggggcgaggaggacctttaccgcaagaagagaagtggaggcgagggggccctgggcctccgtttccccctgatcacagggaattcagcgagggggatggccggggtgcagcccgaggccctccgggggcatgggaaggccgcaggcccggagatgaacgtttcccccgggatcccgaggacccacgttttcgagggcgcagagaagaaagtttcagaagaggagccccgccgaggcatgagggccgtgctccccccagaggaagggatggttttcctggtcctgaagactttggtccagaggagaattttgatgcttctgaggaagcggcccgaggacgagatctcagaggtcgaggtcggggtaccccacgaggaggaaggaagggtttacttcccactcctgacgagttccctcgctttgaaggagggcggaagccagattcctgggatggaaacagagagcctgggccaggtcatgaacattttcgtgatactccccgccctgatcatccccctcacgacggtcattccccagccagcagagaacgctcctcttctctccaaggcatggacatggcatccctacctccccgaaagcgcccctggcatgatggcccaggcacttctgagcacagagagatggaggccccaggaggcccttctgaagaccgaggaggcaaaggccgagggggcccaggacctgctcagagagtgcccaaatctgggcgttccagctccttagacggagagcaccacgatggataccacagagatgaaccttttgggggccctccaggcagtggcaccccttctcgagggggccggagtggcagtaactggggtagagggagtaacatgaactctggcccgccgaggcgaggagcttcacggggtggtggaaggggtcggtagaagctggaactgagtaccctgaggcctctctggacagtatgtaagaacttcttgtggactcaccaagagaaacaaaaggaagcctgcaccattgtagccctgaactcttttctgggcacctgaatcccaggaaccctcaatgaggtcttcaagatgaagagactgctgccagctaccagcctggctggccctgtcctgtccaccctcattgccccaactcccatgttgttttgtgaagataaaagctgggatctttttcttttttttaagtctcacaagacatggggcatctccacaaatttaagttcctgtccatttggaaatttgtttctatgtgtacagtttgtcagagaaaaacaaagtttttgtatgaatacagaatgtgatttacgcaagaattgacagaaaactagttgtgaagtgcttgccttaaggaaacctttggtttccatcgcatcccatctgccaaggaatgcacggttgttgctgatgttcatgagcatattaaccactaggttatctaaattaatctcagctgtgaactttgtgtttttcaacacattctgtcacaccatttttgtgacagaaaaatacttgaaaattattctaatgtagtttgtagtaggttcaaatttttattcagacatgctctgacagatggaaaattgtactctgaagagaaaatgcaatcttctggatgtccaacgagggagcttccccttggaagcatctcctaagaatcacagtttaggtttgaatcgccttgttatgatgaggagaggaacttgatgttagtcagaaataaagtcacatgccctttagataacttgaaatcacacatggagttgataaggaatggaccaaaataggtcctcaaacaattttgcaacacttaattaagttttcctctcttcctcttccatactatgtggaaataccagtgttacggcagggcgtacttctaactcacagtaagccagatagatcttgtccatggcaaattccttgtttaaaataaacataccatttagcccagtttggattggaagccaaaaattcagtttgttatataccccatgatactttctatactgacctttattttggttttacatggaagcttttattaaaaggactgtcctatggccaccttaacatttcattacattggcagcttcagttttggcatcagtcaaatttatttggcaaatttagtggtgctggaagtttctttttttcttttccttttttgacagagtcttgctctgtcacccagccaggagtgcagtggtgcaatcacggctcacttcagctttgaccctgcctcagcctccctagtagctaggactacaggcatatgccaccatgcccagctaattttttgtgtgtgtgttttttgtagagatggagtttcaccactttgtctatgctggtttcaaactcctgggctcaagcggtccacctgctgtggcctcccaaagtgctgggattgcagatctgagccacagtacctggccgctggtgctggaagtttcaatggttgcttagaaaaggcatactgatatagtttaacaggatatgaaaatttaactggttctctatgaatgtaaaaaacagcaaaagctaattgatttctgtggagtgagaaaatgtcagccatatacactgcttttcagtgttagaatctagagactattttttttttaactttgaaattacagcttatttaatcagcgctccaccataaacatgctattaggaggctcaagattgctttaggttatgggtatttcttcactcacccccaactggtatagcttaaagagagagaaactgtaatcaaatttcatgaagctaaaaccggatccagagaccaaacccatatcaagattagactttttttccctgagattctagtggaaaaattttcattattttgggctttaactttagaaacatagtatctcagtaagcagataaccagatcacatttaaaaattttcattttaccttgaagctctactggacttgacagatcacattttgagagtgaattcatttaaacaataaacctctacattatacttattaaatatatatggcatttaaaaacatcactgtcagcatacatactagatgttgtgatttgaagcttataaaaagtagattttcaatgatgtttgatttgagaaaaaatttttgagacaaggtctcgctgttgcctaggctgtggtgcagtggtgtgatcacagttcactgcagcctcaacctcctgggctcaagtgatcttcccacctcagccccaccccaagtagctgggatcacagttgtgtgccaccatatctggcaaattttttgaagattttctgtggcgatggggtttaactgtgttgcccaggctggtcttgaactcctggcctcaagtgatcctcccgccttggcctcccaaaatgctgggattacaggtgtgagccaccagctgagaaatgttgaatttttaagtttttatttaagaaataaacattgtaaaacatcattataaaacccccaactattgcaagttctagagaaatttaaaactagaacagaaatttaggggactagaaagagcagccaatggcacaagtctttacaattaattaaaaaaataaatcattctgaagatactgcatttgctctctcacaagcagcctcctgaggtaggtaaccttgtttactgatggggaacaaggcagtgttctttaccaaatctcagggcgggtagcctgcaagcctacagtgtggatgttggccacttgtgtcacttcttgggacggggcttagggacctgacttacttaggaacataaattttggggttggaggaagcagcagtgctctactgcggcacgacagacaccctgttaaggcaacactgggatccagctcaggaaaagcattactttcaaattgtgcaagccaatgcacagaaaagtggtcctcaaacttggggaacgtagaatcacttggggagctttaaaaaggtcctgatgtctgggacctacttcccaggttctgactgcattgatctgaggtgtggctcttcaagtaactgatgtgcagtcaagcgcgaggaccactggcacacaatgtttaaattctaaatatattttacttcctagtgtattgctactgacaaaacgtagttttctggactcatcagaatgttaggctcataccttctggcaataaattaaggtagttaaaagtaactgctgaacctaaaatgaaggcagcagcaattagatataaaaaaatcttaagatcagcctgcaaattgtaaactagtttacaaagcaggctatacaatgaggaataattcgagcttgtagaaatccatggtttccaccagatacaggtattccggatctagaattatctttctatttgcaggatttccgaagagaccgttaagcatctacgcgccccttcctggatcccatgcttcttggggcaggaaatttcttttggtccgtcgctttcgtcgtgaaatacacaactaattttcctttcatgttataaggcaccatatttatgattttgttaactgaagaaaaaacccgagataaaccatcttaagtacttttaaaagtccagtggctgaattcggtgtttaatctgatacccttctggattcgctgacactggagagaataatttccaagtcttagtatagccaaaacaaaaaactaccgtcgctaagctacatctaccactggattttaaaatgacaaaacagcctgagaaaaatcacaagagcagctaactcgaagaaaaatcctttttctttactcagccgaacctaagaccacagttacttcgaaagcaacttctaataaccgtctcacatcctgtcaccagttcaatgacaaaatctcagttttcagagcgtgtgccaagtccagcacaaaaagctgacatcgaggagctcccaacgctgctgtcgcctccgctggcagcagccgctcccggattagactcgcaggctgttagggcagggccttcgccacgggcttccgcacagcggcgtgcagtcctcagctcggccggcgcggtctccgacggcgctggctccgcgtacttccccagcggcgagggcgcgaggtcctcacacgggcagcaccttggcgaggccggcgccgcggcccaggcgacccagtgcgaggcgcagcgcggtgccgccgccccagggcagcagcccaaccagcgcggccagcagcgcggccacctgcgcgcccgcgcccagcaccgtgagcagcgtgctgcgaaggcccagcgcggcgaacagcgtggcgcccagcgctgccatgtagagcagcgcgggccgggacggcgcttcttcgcagcgcagcaggcgtccgcacgccgcgccgccccgcagcagcgcgcttcccgccaacgccagcgccgagcccagtgaccagagcagcgcgaacttgcgcgcgcgcagcagcaacaccggtgcgtagagcgcggctaggccgaaacacagtgcagccagcagcaggcacccgccgcccgccgccagccgctgcccgcgcgtcacgctcgggaggcacgtcaggccggccgctgccgactccgcagggctccgcgcccacgtccagcgcaagcccgcgcggcccagccactcctccgccggccggtccccgggctcctccgccttctccgcggcgagcagcggctccgcggccgccgggccgccagctttcccctgcgccaggtactcctgcagctggcggtggaggtccgccatcttggacaaggcggtggcagaaaggaaaagctgcggctcacttccggccctccgctgaagcggttcggtcttcgggcggcaattggtcggcgacggcgaaaggggcagggcctgcggcgctcgcggaagtgccgcggtgcctgctctgcggacttttgtggtgtccccaagtaccgtggtcgcaggtgctgcctgtccgcttgcagtcgccctcccagcgcctgaccctcttccttgttcggagtaggcgcccttgcggtctggctaagtcctgccagcattaatagttggaaggcaggggtgggtgtggttctaaaggggcacaagaagtgacccttttgctgacggaaatgtcttatggcctcactgcgtctaccgtggcggtgatattgtgctagttttgcaacatggaggaatgggtaaagggtacacagaatctctcttgtttcttacaactgaacacaaacagtgatctcaaaataaaaatttaatttttaaaaaagttca

SEQ ID NO: 199761 - DNA, 3574 bp, Homo sapiens
  Payload ID: 19413
  Gene Name: WD repeat domain 33
  Uniprot ID: Q9C0J8
  ENST ID: ENST00000393006
  CDS Start-End: 184-957
agagcgtgcgttcggtggcccataggggaagatggcggctgctcctttggaggagcgggattgagaggatcggggtggggagaccaaacaagagagacatttctggctctgaaggcgaacgcttcgctggccatttaggagctctgctcaaagccagacgtatcctagaaggaaaacatcaccatggctacagaaattggttctcctcctcgttttttccatatgccaaggttccagcaccaggcacctcgacagctgttttataagcgacctgattttgcacaacagcaagcaatgcaacagcttacttttgatggaaaacgaatgagaaaagctgtgaaccgaaaaaccatagactacaatccatctgtaattaagtatttggagaacagaatatggcaaagagaccagagagatatgcgggcaattcagcctgatgcaggttattacaatgatctggtcccacctataggaatgttgaataatcctatgaatgcagtaacaacaaaatttgttcggacatcaacaaataaagtaaagtgtcctgtatttgttgttaggtggactccagaaggaagacgcttggtcactggagcttctagtggggagtttaccctgtggaatggactcactttcaattttgaaacaatattacaggctcacgacagcccagtgagggccatgacgtggtcacataatgacatgtggatgttgacagcagaccacggaggatatgtgaaatattggcagtcgaacatgaacaacgtcaagatgttccaggcacataaggaggcgattagagaggccagtttctcacccacggataataaatttgctacatgctctgatgacggcactgttagaatctgggactttcttcgttgccatgaggaaagaattctccgagatacatgttttcatcactgccgttgttacttcctttctgtcaagaggtgaataacagtaggtggacaaagtttagggagccacatttaccaacttctgtgaatatacccaagaagattctggcaaaacatagattcaaattacagttgatgctgtggatggctatgggttaactactcttctactttgacacggattatttgttgcttttatgtttctaaattctcaattaaaaagaagtgtatccttaatctggccaactgaaagtgaacttgttcattcacctctaccttgctttcaaaaggactgcttaccatggaagtgctccagaagaatcatttgaaacatcttttgttttccttcttggttctgcgttttcttccttaccaggggcttcagtcatggcttctctttattcttggcctgggttgtctgctggcactaatacatctattattaacgtagtgtaggtactggcctttctaatagtcttggtatttagtgccagactcccatcaatcttttgaatgtcttttctttttctttttgcacttttctagcttttcaagtgatgactatatactgcttttcttgactgtatatattgttactgaattgtgaatatctgcagaaatgtttactagagaacctgtgactgttgaataacatgtgcccgaacatacacacacacatatgtacacacacacctcagagtactctttcttacagcggactttgctgctgctttctgcatgtgtgggacactggtatctcccgtctcagacaaatggctgatgttctctatgatattggtgttaatatcaaagaattgaatgaatacaacagaattgaggttgaaaaatatttgattgccacattcctttaagcatctttgatgaatactctgcaaagtagcctttaaaaaaatgtaaattttttaaaaagtccacagaggagaatttgctggttagcacaaaacatactgcaaaattgcttctttctggttattataactgaagaatatagaagattgacacacattttatacaccctcaggcagtgttttggaataatattgtaccttttcaaattgttatcaattaactgtttttctccatttcataattctcaagatttttctaaatacagcctttaaatttgactcaaatggaaattgtgcactttcctgtttatacccttccccacgttattgtaaaagagtttaacagcagcctgatatgtaagtttcagcaaaacttatacctgtatatgtttttatttgactcaaaaattagatattttaccatatagtcataagaatttgctcactttgatgccagaagtacttaagaagttacacggcactaattttatgagttgtatgcctaatttcaatttctaacctatttgacagtttcttttaggtcagcctttgttggtcttccatgtaaatacaagttggtacaaatcaatagaaaccattttacctacataggcaaagtaaatgtgtgacttagagactgccagatttatggtgcatctacctttttatccatttgagcttgcttttttatgtttgtgtattggttgctcctgacactatacatttcaaaattttttataacttgaaaaacacttctgtgctaccactcagttctgatcaaatccttacattttgcaacactcatttctgaattttcagtaaagaaatacacattacaaattaaaggttaaaggcccctttacatgcccttccccagtctcctcttcctcccccggaagtgtccattctgctgaattcaggttcatcattgccagacaaatgtagtaagctagtgtttcacatttccaaaatcagccttctggcagacttggaagtactcttgagaaaagaagactcgtgaccaaattctcccacagatttgtaataatgtacatattgaaaggactgaaggctctcagactgggaaagaaacttacccattttaaaattcagcattgctcaacttacctgactgccggaccccttcacccatgattctatgcactgtattgttggaacatacattgtgaaaacactgccctgcctaggcataccccctttccagaattaactttccatttaattctatagtttttcactgatgtaactttctagactggacaacaaagatgactaatagtaatcactccaagttgatgttgactgttgggttgtggtgaaatcattttgcattaaaggaaggtaaaatactaataaattgcatattccttgaccagagcacagattacttatgcttcttaattttttaaaatcttaaatcctctgtccaactggagtatctggctatgggccatgggtactcatataccctttgtcttaaactgatctgttacattttatgttcttgtggctagaagtagcctgagtttgctgttaatgtttaacacattttcttgagtaacagttctgttaatattgtacaagatggtacttgaattctttgtttgccttttttcttcctgtattagaaaatcttggtgctttttataagttttgtataaaagaattttttttaagatttgttcataaaatggtctgatccaggaaaaataaaatgggaacatggacaccatttctgaccttcaaataaaacttattatgtat

SEQ ID NO: 199762 - DNA, 583 bp, Homo sapiens
  Payload ID: 19413
  Gene Name: WD repeat domain 33
  ENST ID: ENST00000408998
  CDS Start-End: 229-583
attttcgggctcggccgttgcgtgctttgggggcctggacgggcgcctgggcacaggttggaggaactgggagaatcgacctcggggcggctgttcgaggcaggttcgagacttatgggagggggctggaggctggaggccaaccgggaaaagcggccatggttagaactaaggccctgactgggagcggtggcgacgagaagactatcctagaaggaaaacatcaccatggctacagaaattggttctcctcctcgttttttccatatgccaaggttccagcaccaggcacctcgacagctgttttataagcgacctgattttgcacaacagcaagcaatgcaacagcttacttttgatggaaaacgaatgagaaaagctgtgaaccgaaaaaccatagactacaatccatctgtaattaagtatttggagaacagaatatggcaaagagaccagagagatatgcgggcaattcagcctgatgcaggttattacaatgatctggtcccacctataggaatgttgaataatcctatgaatgcagtaacaacaaaatttgttcggacatcaacaaataaagtaa

SEQ ID NO: 199763 - DNA, 3104 bp, Homo sapiens
  Payload ID: 19413
  Gene Name: WD repeat domain 33
  Uniprot ID: Q9C0J8
  ENST ID: ENST00000409658
  CDS Start-End: 184-1164
agagcgtgcgttcggtggcccataggggaagatggcggctgctcctttggaggagcgggattgagaggatcggggtggggagaccaaacaagagagacatttctggctctgaaggcgaacgcttcgctggccatttaggagctctgctcaaagccagacgtatcctagaaggaaaacatcaccatggctacagaaattggttctcctcctcgttttttccatatgccaaggttccagcaccaggcacctcgacagctgttttataagcgacctgattttgcacaacagcaagcaatgcaacagcttacttttgatggaaaacgaatgagaaaagctgtgaaccgaaaaaccatagactacaatccatctgtaattaagtatttggagaacagaatatggcaaagagaccagagagatatgcgggcaattcagcctgatgcaggttattacaatgatctggtcccacctataggaatgttgaataatcctatgaatgcagtaacaacaaaatttgttcggacatcaacaaataaagtaaagtgtcctgtatttgttgttaggtggactccagaaggaagacgcttggtcactggagcttctagtggggagtttaccctgtggaatggactcactttcaattttgaaacaatattacaggctcacgacagcccagtgagggccatgacgtggtcacataatgacatgtggatgttgacagcagaccacggaggatatgtgaaatattggcagtcgaacatgaacaacgtcaagatgttccaggcacataaggaggcgattagagaggccaggtttatacacaatataccattttctgtagtccctattgtcatggttaaattattctctaagtgtattctgggtgcagagatgcatgggctctgtcagtttctgggaaactttctgcaccctataaacacaatatttttctttgttttcacacattcaccattttgctggcacctttctgaagtagtgttgtcccggtatcagcctttgcaatatgttagagatgtactgtctgccgcattttgcactggttttctcttttcatttatgattaataatgtgtatacgttattcctttttattatctactgtgtaagacaagaatatttcattccaaataaagaattcagtctttaattatgcaactgaataaaatctaaagcctacagaaaacaacttcagaattcacacaaagtggaaaaaggcttaagtgaagacctggttggcttggttatgccacgacttccaaaggaaagtataggactaaaaccctcacagataactggatgtggcaaacattaacggagtaatgaatgggttcttcaagctttgcagctgtaagcagatcattgtcaagaagactctaggacttttcttctgattcactgttgataacatcacttatgcaaatgtatacaataagtggagtttaaaatattttcagtgagttgtatatttttacacatcagtgaggtatgtatagtaaaactgggggaaaaagttccaaatacaagcctgaagaattgctgcagcctcagaataaagctaagcagcattctttaaggttgtgccacccatgtgtgggaggaggttgacatctttatggaaacatcatccactgtagtcatttgttcatactttcagaatcttaacagaaattgttggatgaacatgcttctgctttgtagattttgccttagtgtcatgcccatacattgagtttacacagctggtccttcataggattccaaagttcaagggagtttttagagttagttgagaaacttgatgatctttcactgctgggaaaaactgactccttcttgcagcagattctttggctttacacacaagtctgaatgtccttattttaaagttttcctcaaaggtgcaacattcatggaatagcttgccaggaagatgtgaaacttttctacagacctttgaaatggatgagaaacattgtatgtagggatgtttagcaatcagtcttttaatagacagcccacattgtttcagcttatttcatgaagtgtctgaggcagaagctgatgataattttgggagcagtattcgtgtgtgatttaaaagactgcaggaatactgcaaaaatagaatccatttattttcaccacttaaggcagcttcatgtgatttcctcgtatcatagaaaatagagaaggaacatggatagcattagcactaataatacacacttgaagttctcagaatactgatgattgaaaactcaaacaactgctctgttgaagtcttcttttgatgagatgcctatgttagctgacgacattcactttaagggcttcttcactggattcttccctctcctgtttataatgcagcacagtgtttttatttttccctgtctgagaagcacagattatctgttaaatgctgacttctttcccctgctgtgtgtcttcatgtaacagtttctcacccacggataataaatttgctacatgctctgatgacggcactgttagaatctgggactttcttcgttgccatgaggaaagaattctccgaggtacgtgtactaacagtactgattggaatatttaaatagggaagacatttgtggttaaatcatcacaaaaccacaatactggcttacacctccattcaattttttttacatatacacaccgtctcaggctcttcaaaaaaacccagcactttctctgactcacagtcattttgtaggtttttactaccagtgttatctttgaatttttcagctgtaaattaaatacaagagtgcctcccccttacttgcttatctgtatgcatcttttagggctgtattccttttccttccttgtagccagggtacttgttcccaacatattgacactgtggtttgatttagatagccgtcattctcctggcagtccttttacaatatgaattaaccgacaagatagaggtatcaaagctacacttcttagtgttactatttttgaaagcagttggtttttcagtacaccacatttgtactacatggccggcttgttactaagttcgggtggcattgctgcttgtttacttttgttgat

SEQ ID NO: 199764 - DNA, 822 bp, Homo sapiens
  Payload ID: 19413
  Gene Name: WD repeat domain 33
  ENST ID: ENST00000436787
  CDS Start-End: 207-822
agtgcgtgatgaccccagagcgtgcgttcggtggcccataggggaagatggcggctgctcctttggaggagcgggattgagaggatcggggtggggagaccaaacaagagagacatttctggctctgaaggcgaacgcttcgctggccatttaggagctctgctcaaagccagacgaacagaatatggcaaagagaccagagagatatgcgggcaattcagcctgatgcaggttattacaatgatctggtcccacctataggaatgttgaataatcctatgaatgcagtaacaacaaaatttgttcggacatcaacaaataaagtaaagtgtcctgtatttgttgttaggtggactccagaaggaagacgcttggtcactggagcttctagtggggagtttaccctgtggaatggactcactttcaattttgaaacaatattacaggctcacgacagcccagtgagggccatgacgtggtcacataatgacatgtggatgttgacagcagaccacggaggatatgtgaaatattggcagtcgaacatgaacaacgtcaagatgttccaggcacataaggaggcgattagagaggccagtttctcacccacggataataaatttgctacatgctctgatgacggcactgttagaatctgggactttcttcgttgccatgaggaaagaattctccgagggcatggtgctgatgtgaaatgtgtagactggcatccaaccaaagggttagttgtttcaggaagtaaagatagtcaacagccaatcaagttctgggatcccaagactgggcagagtcttgcaacac

SEQ ID NO: 199765 - DNA, 1755 bp, Homo sapiens
  Payload ID: 19414
  Gene Name: WD repeat domain 34
  Uniprot ID: Q96EX3
  ENST ID: ENST00000372715
  CDS Start-End: 62-1672
ggcggcgtaggggcggaggtcgcgcctgagtgcgtccgcacgagagggcggaaccgtctccatggcaacccgcgcgcagccggggccactcagccaggcgggaagcgctggtgttgcggcgctggcgacagtcggggttgcgagcggcccggggccggggcggccagggccgctgcaggacgagaccctgggtgtggcgtccgtgccctcgcagtggagggccgtccagggcatccgctgggagacgaaaagttgccagacggccagcattgccactgccagtgcatccgcccaggccaggaatcatgtggacgcccaggtgcagacggaggcccccgtgcctgtcagcgtgcagcccccgtcccagtatgacatacccaggctcgcagcctttcttcggagagtggaggccatggtcatccgagagctgaacaagaattggcagagccacgcgtttgatggcttcgaggtgaactggaccgagcagcagcagatggtgtcttgtctgtataccctgggctacccgccagcccaagcgcagggtctgcatgtgaccagcatctcctggaactccactggctctgtggtggcctgtgcctacggccggctggaccatggggactggagcacgcttaagtccttcgtgtgtgcctggaacctggaccggcgagacctgcgtccccagcagccgtcggccgtggtggaggtccccagcgctgtcctgtgtctggccttccaccccacgcagccctcccacgtcgcaggagggctgtacagtggtgaggtgttggtgtgggacctgagccgtcttgaggacccgctgctgtggcgcacaggcctgacggatgacacccacacagaccctgtgtcccaggtggtgtggctgcccgagcctgggcacagccaccgcttccaggtgctgagtgtggccaccgacgggaaggtgctactctggcagggcatcggggtaggccagctgcagctcacagagggcttcgccctggtcatgcagcagctgccacggagcaccaagctcaagaagcatccccgcggggagaccgaggtgggcgccacggcagtggccttctccagctttgaccctaggctgttcattctgggcacggaaggcggcttcccgctcaagtgttccctggcagctggagaggcagccctcacgcggatgcccagctccgtgcccctgcgggccccagcacagtttaccttctccccccacggcggtcccatctactctgtgagctgttcccccttccacaggaatctcttcctgagcgctgggactgacgggcatgtccacctgtactccatgctgcaggcccctcccttgacttcgctgcagctctccctcaagtatctgtttgctgtgcgctggtccccagtgcggcccttggtttttgcagctgcctctgggaaaggtgacgtgcagctgtttgatctccagaaaagctcccagaaacccacagttttgatcaagcaaacccaggatgaaagccctgtctactgtctggagttcaacagccagcagactcagctcttggctgcgggcgatgcccagggcacagtgaaggtgtggcagctgagcacagagttcacggaacaagggccccgggaagctgaggacctggactgcctggcagcagaggtggcggcctgaggggtcccgggaggcgggtgcaagccttcgctgtgccgagccttgtgtttctgacgcaagccaaatgaagaaaagcaaagctt

SEQ ID NO: 199766 - DNA, 1039 bp, Homo sapiens
  Payload ID: 19414
  Gene Name: WD repeat domain 34
  ENST ID: ENST00000451652
  CDS Start-End: 1-819
ctcagccaggcgggaagcgctggtgttgcggcgctggcgacagtcggggttgcgagcggcccggggccggggcggccagggccgctgcaggacgagaccctgggtgtggcgtccgtgccctcgcagtggagggccgtccagggcatccgctgggagacgaaaagttgccagacggccagcattgccactgccagtgcatccgcccaggccaggaatcatgtggacgcccaggtgcagacggaggcccccgtgcctgtcagcgtgcagcccccgtcccagtatgacatacccaggctcgcagcctttcttcggagagtggaggccatggtcatccgagagctgaacaagaattggcagagccacgcgtttgatggcttcgaggtgaactggaccgagcagcagcagatggtgtcttgtctgtataccctgggctacccgccagcccaagcgcagggtctgcatgtgaccagcatctcctggaactccactggctctgtggtggcctgtgcctacggccggctggaccatggggactggagcacgcttaagtccttcgtgtgtgcctggaacctggaccggcgagacctgcgtccccagcagccgtcggccgtggtggaggtccccagcgctgtcctgtgtctggccttccaccccacgcagccctcccacgtcgcaggtgagctgcctgctgtgtccgcctcctctcctctcaggactcagcttcccgccctgcagagggcacaagggagctttccatgggccctttggcccggagacaggaaggcgggccctgaccctctcagtctggagcccaggtgaaggtctgcagtgagccctgaggggtggaactcgggggaggagtctggaagggggccagggtcggggccaggacagggggctgtggagaggccagaagaggcaggtgcccttgggaagccgtcagtggtagggggcaggcaacgctggagggagctgccaggtgcagggcaggggtgtccggcaaagctccctggggtacaacaggggagctgggggctag

SEQ ID NO: 199767 - DNA, 745 bp, Homo sapiens
  Payload ID: 19414
  Gene Name: WD repeat domain 34
  ENST ID: ENST00000419989
  CDS Start-End: 1-420
gctggtgttgcggcgctggcgacagtcggggttgcgagcggcccggggccggggcggccagggccgctgcaggacgagaccctgggtgtggcgtccgtgccctcgcagtggagggccgtccagggcatccgctgggagacgaaaagttgccagacggccagcattgccactgccagtgcatccgcccaggccaggaatcatgtggacgcccaggtgcagacggaggcccccgtgcctgtcagcgtgcagcccccgtcccagtatgacatacccaggctcgcagcctttcttcggagagtggaggccatggtcatccgagagctgaacaagaattggcagagccacgcgtttgatggcttcgaggtgaactggaccgagcagcagcagatggctggaccatggggactggagcacgcttaagtccttcgtgtgtgcctggaacctggaccggcgagacctgcgtccccagcagccgtcggccgtggtggaggtccccagcgctgtcctgtgtctggccttccaccccacgcagccctcccacgtcgcaggtgagctgcctgctgtgtccgcctcctctcctctcaggactcagcttcccgccctgcagagggcacaagggagctttccatgggccctttggcccggagacaggaaggcgggccctgaccctctcagtctggagcccaggtgaaggtctgcagtgagccctgaggggtggaactcgggggaggagtctggaaggggg

SEQ ID NO: 199768 - DNA, 6918 bp, Homo sapiens
  Payload ID: 19415
  Gene Name: WD repeat domain 35
  Uniprot ID: Q9P2L0
  ENST ID: ENST00000281405
  CDS Start-End: 108-3620
agggcgacgggagctttccggagctgctggtactcccgattggagacgtagaaccgttacttgtcgagggccttagcggccgccgtgaccctctcggggatcccacgatgttcttctacctgagcaagaaaatttccattcccaataacgtgaagctgcagtgtgtatcctggaacaaggaacaagggttcatagcatgcggtggtgaagatggattactgaaagttttgaaattagagacgcagacagatgatgcaaaattgaggggccttgcagcccccagtaacctttctatgaatcagactcttgaaggtcatagtggttctgttcaagttgtaacatggaatgagcagtatcagaagttgactaccagtgatgaaaacgggcttatcattgtgtggatgttatataaaggctcttggattgaggagatgatcaacaatcgaaataaatcagttgttcgcagtatgagctggaatgctgacggacagaagatctgcattgtatatgaagatggggctgtgatagttggttcagtggatggcaatcgtatttggggaaaagacctgaagggtatacagctatcccatgtaacatggtctgcggacagtaaagtcttactttttggaatggcaaatggggaaatacacatttacgataatcaaggaaattttatgataaaaatgaaactgagttgtttggtgaatgtcactggagctatcagcattgctggaattcattggtaccatggcacagaaggctacgtggagcctgattgcccttgccttgctgtttgctttgataatggaagatgccaaataatgagacatgagaatgaccaaaatcccgttttgattgacactggcatgtacgtagtaggcatccagtggaaccacatgggcagcgtgttagctgtggcaggcttccagaaggcagccatgcaggacaaagatgtgaacattgtgcagttttacactccgtttggtgagcatctgggtactttgaaagttcctggaaaggaaatatctgcactatcttgggaaggaggtggactgaaaattgcactagctgttgattcctttatatattttgcaaacattcgacctaattataagtggggttattgctcaaacactgtagtttatgcatataccagacctgatcgtccagaatattgtgttgtcttctgggatacgaaaaacaatgaaaaatatgttaaatatgtgaagggtctcatttctattactacctgtggagatttctgcattttggctacaaaagctgatgaaaatcatcctcagtttgtactagttctttgtaattctattggtacacccttggatcccaaatacattgatattgtaccattgtttgttgcaatgaccaaaacccatgtgatagcagcctcgaaagaagcattttatacctggcaatatcgtgtggcaaagaagctcacagcattggaaattaatcagatcacacggtctcgaaaagaagggagagaaagaatttatcatgttgatgataccccttctggatcaatggatggtgtgcttgattatagtaaaaccattcaaggcacaagggatccaatttgtgccataactgcatcagataagatattgattgtgggtcgtgaatctggcaccattcagagatacagtctacctaatgttggtttgattcaaaaatattcccttaattgtcgagcctaccagttatccttgaattgcaactctagccgtcttgctatcatagacatctcaggagttctgactttctttgacttggatgctcgagtaacggacagtacgggacagcaagtagttggagagttgttaaaattggaacgaagagatgtctgggatatgaagtgggccaaagataatcctgatttgtttgcaatgatggagaagacaagaatgtatgttttcagaaacttggatcctgaggaacccattcagacctctggatatatttgtaattttgaggatttagaaattaaatctgttcttttggatgagatattaaaggatccagaacatccaaacaaggattacctaattaactttgagattcggtctctgcgagatagccgagcactgattgagaaggttggaattaaagatgcatctcagttcatagaggacaatccacacccccgactttggcgcctactggctgaagcagctcttcagaaactggatctatacactgcagagcaagcatttgtgcgctgcaaagattaccaaggcattaagtttgtgaagcgcttgggcaaactactgagtgagtcaatgaaacaggctgaagttgttggctacttcggcaggtttgaagaggctgaaagaacgtatctcgagatggacagaagggatcttgctattggcctccggctgaaattgggggattggtttagagtactccagctcctgaaaactggatctggtgatgcagatgacagtctcctggaacaagccaacaatgccattggagactactttgctgatcgacaaaagtggttgaatgctgtacaatattatgtacaaggacggaaccaggaacgcttagctgaatgttactatatgttagaggattatgaagggttagagaaccttgccatttcacttccagaaaaccacaagttacttccagaaatagcacaaatgtttgtcagagttggaatgtgtgaacaagcagtgactgcatttttgaaatgtagtcaaccaaaggcagcagtagatacctgcgtacatctcaaccaatggaacaaagctgttgaattggctaaaaatcatagtatgaaagaaattggatctctgttagctaggtatgcatctcatttactggaaaagaataaaactcttgatgccatagaactctatcggaaagccaattacttttttgatgcagctaaactgatgtttaagattgcagatgaagaggcaaagaaaggaagtaaacctttacgtgtcaagaagctctatgtactgtcagccttacttatagagcaataccatgaacagatgaagaatgcccagcgaggaaaagttaaaggaaaaagttcagaggccacttctgccttggctggtttgctggaagaagaagttctgtctacaacagatcgtttcacagataatgcatggagaggggcagaggcttaccacttctttatacttgcacagaggcagctctatgagggatgtgtggacactgcactgaagacagctcttcacctgaaagactatgaagacatcatccctcctgtggagatctactctctgctagcactctgcgcatgcgccagcagagcctttgggacttgttcaaaagctttcattaaacttaaatctttagagaccctcagttcagaacagaaacagcagtatgaagaccttgctttagaaatcttcaccaaacatacttcaaaagataacagaaaacctgaattggacagccttatggaaggtggagaagggaaactgccaacatgcgttgccacaggaagcccaatcactgagtatcaattctggatgtgcagtgtatgcaaacacggtgtccttgctcaggaaataagccactacagcttctgccccttatgccatagtccagtgggataaaggaatgataaactgtatataactgtaaaatatatgtagcatatatacatggctatatgctgtatatgtaataaggtttatttctgtgagttttgtatgaaaatcagcctcattatttatagttgaatttttgcacaaaatatatgttaataaaataatttttatggcaatacaactgtgaaataataaggccgattttcatataaatgtatgaaaatcaaccatgttttctctcaccctctctcttttgtttatcttgtttttggttacatgataccatggaaatattccaaataaatttttttctcacagtgtcaaggtaactgaattcattaaaaaatcttgaagggagtagggagtgggggaagcatgggagtggggcaaagttgaatttagagaatttttataacccatgttacaaggaagttaaacaattgtaataatgaaatgagctttctctatagccatatttaattaaataagtgtcgaatgtcttctttattgtattttcagaagtgaggcgatggcattttaagacattttttacaatctgaattgtttctaatagccctattcttctattttaaaacctgtccttttagtctcatttaagagatggcatttggaatttacactttcatatgattgtgcagaaaacttgcctctatttataatgaagataacttaaacagaaatatccattttgtagttatagcttctgttgaaacattgtcactaagttggaccgtttatttacacaagtattgttgagggagtgattttttcttgatatgcgtctgttttcatttattattaatttgaaagataaacagttgtgatccataatggatcatttcttatgtcttttacatagctaataatgttctctgtttatttctcatgaattcccattttgtggctaaagaccagacctttgcactatttcatcaagattattttattgaggtttggcttacatatagtagaggcaatacatagagatacgcaactttgtttttgcagctacaatacactttctcaatctcatatgtttttgtcttgtagagacagagacaagttcagcatgttgcagattgggaatagtgagctatgagaagagatttagagcctagatgagcttaggatagagagtgggctcattggcctaaataaaaagagaagaccagaagtctttgaggtctctgtctctattcatgcgcctcgtggaaaattaccttggtacaatggtagcctctaaatagactgcctcgcaagctattccagaggtcatggaacagaaagccttataaaccaaataaaaattctcaaaatacattggtttattgaaccaatttgcaatacacagtgaggaacaaggagaaagcaatgatagattaacactgttagtgtaacgtgccagtggagtggaaagaccgcaacacctgaatcctgggttttgtaatgtttttatgtcctgactcacattctgtcacatacgctttcccctaatagtcgggttacaaaaaggaccagagtggccgcttgagccagatgactcaatcagatgaaatgtgcctgaggccaacgatgtacacttgctctatagaagggtgtcaggggcaagtacacttcaccacagcaatagcttgcctattagtctgctgagcagtcatgaattttattgtatttcttgggtaaggacaggccagaatgagtgtcaccagtgggtaattgaatcaacttctcacacatactgaaggctttatatgtctcatgcatacttagtgtatcatgaatatttggtatctttgtggcttttcatatttttagtgcttcatgaatatttggtatctcttgctcctttctatctgtggtcacacatacacgctctattaactttgcctaataagtctcctaggttactaacttacttacctaaatgtaacacaatgaattccagctttctcatttgttctataccagaatgggaaatttccccaaatcagaaaatcacatcctaacaaagaagtctgtctaagacagtacatctcctgttgaacttgcatctttccacaggactttctgtttttagggatgagactattctctgcttcatcaaggaaagagaaatgttcagggttgtagggatggcacacttattagttctgcctgtctgaaaggttcctgcaggacagtttggtcagagctgcaattcttagtccatggtctaatgcttgagtatctcttctttccctttcctgtctcaggaatcagctgagaattcattcgattgtcatgcctctagccccttactgtgatttgttggttgcactttcatttgctttagttctagaatcacctgttgactcctcagacttcacctaactttggaaactctcttttggaggcttctcatttccccctaattctgtgctgcctgagccctagaattttcccaccaacgaattattccaggtagatcctaagttgctggatctagttgatatttaaacaatatctagttgatatttctcattcagttggatccagaaaccagtatctctaaaaacaacctctcataccttgtggacctaattttgtgtgcgtgtgtgtgtgcgcgcatatgtatatagacaggcacatcttttttacttttgtaaaagcttatgcctctttggtatctatatctgtgaaagttttaatgatctgccataatgtcttggggacctttgtcttctgtgtaaatggtactagagaaaacacctatattatgagtcaatctagttggttttattcgacatgaaggaaatttccagataacaacactaacaaactctcccttgactagggggacaaagaaaagcaaaactgaccataaaaaacaattacctggtgagaagttgcataaacagaattaggtagtatattgaagacagcatcattaaacagttatgttgttctccttgcaaaaaacatgtactgacttcccgttgagtaatgccaagttgttttttttattataaaacttgcccttcattacatgtttcaaagtggtgtggtgggccaaaatattgaaatgatggaactgactgataaagctgtacaaataagcagtgtgcctaacaagcaacacagtaatgttgacatgcttaattcacaaatgctaatttcattataaattgttttgctaaaatacactttgaaactatttttctgtattccaagagctgagatcttagattttatgtagtattaagtgaaaaaatacgaaaataataaacattgaagaaaaaaataa

SEQ ID NO: 199769 - DNA, 6960 bp, Homo sapiens
  Payload ID: 19415
  Gene Name: WD repeat domain 35
  Uniprot ID: Q9P2L0
  ENST ID: ENST00000345530
  CDS Start-End: 117-3662
gcggttgccagggcgacgggagctttccggagctgctggtactcccgattggagacgtagaaccgttacttgtcgagggccttagcggccgccgtgaccctctcggggatcccacgatgttcttctacctgagcaagaaaatttccattcccaataacgtgaagctgcagtgtgtatcctggaacaaggaacaagggttcatagcatgcggtggtgaagatggattactgaaagttttgaaattagagacgcagacagatgatgcaaaattgaggggccttgcagcccccagtaacctttctatgaatcagactcttgaaggtcatagtggttctgttcaagttgtaacatggaatgagcagtatcagaagttgactaccagtgatgaaaacgggcttatcattgtgtggatgttatataaaggctcttggattgaggagatgatcaacaatcgaaataaatcagttgttcgcagtatgagctggaatgctgacggacagaagatctgcattgtatatgaagatggggctgtgatagttggttcagtggatggcaatcgtatttggggaaaagacctgaagggtatacagctatcccatgtaacatggtctgcggacagtaaagtcttactttttggaatggcaaatggggaaatacacatttacgataatcaaggaaattttatgataaaaatgaaactgagttgtttggtgaatgtcactggagctatcagcattgctggaattcattggtaccatggcacagaaggctacgtggagcctgattgcccttgccttgctgtttgctttgataatggaagatgccaaataatgagacatgagaatgaccaaaatcccgttttgattgacactggcatgtacgtagtaggcatccagtggaaccacatgggcagcgtgttagctgtggcaggcttccagaaggcagccatgcaggacaaagatgtgaacattgtgcagttttacactccgtttggtgagcatctgggtactttgaaagttcctggaaaggaaatatctgcactatcttgggaaggaggtggactgaaaattgcactagctgttgattcctttatatattttgcaaacattcgacctaattataagtggggttattgctcaaacactgtagtttatgcatataccagacctgatcgtccagaatattgtgttgtcttctgggatacgaaaaacaatgaaaaatatgttaaatatgtgaagggtctcatttctattactacctgtggagatttctgcattttggctacaaaagctgatgaaaatcatcctcaggaggagaacgagatggagacatttggtgcaacgtttgtactagttctttgtaattctattggtacacccttggatcccaaatacattgatattgtaccattgtttgttgcaatgaccaaaacccatgtgatagcagcctcgaaagaagcattttatacctggcaatatcgtgtggcaaagaagctcacagcattggaaattaatcagatcacacggtctcgaaaagaagggagagaaagaatttatcatgttgatgataccccttctggatcaatggatggtgtgcttgattatagtaaaaccattcaaggcacaagggatccaatttgtgccataactgcatcagataagatattgattgtgggtcgtgaatctggcaccattcagagatacagtctacctaatgttggtttgattcaaaaatattcccttaattgtcgagcctaccagttatccttgaattgcaactctagccgtcttgctatcatagacatctcaggagttctgactttctttgacttggatgctcgagtaacggacagtacgggacagcaagtagttggagagttgttaaaattggaacgaagagatgtctgggatatgaagtgggccaaagataatcctgatttgtttgcaatgatggagaagacaagaatgtatgttttcagaaacttggatcctgaggaacccattcagacctctggatatatttgtaattttgaggatttagaaattaaatctgttcttttggatgagatattaaaggatccagaacatccaaacaaggattacctaattaactttgagattcggtctctgcgagatagccgagcactgattgagaaggttggaattaaagatgcatctcagttcatagaggacaatccacacccccgactttggcgcctactggctgaagcagctcttcagaaactggatctatacactgcagagcaagcatttgtgcgctgcaaagattaccaaggcattaagtttgtgaagcgcttgggcaaactactgagtgagtcaatgaaacaggctgaagttgttggctacttcggcaggtttgaagaggctgaaagaacgtatctcgagatggacagaagggatcttgctattggcctccggctgaaattgggggattggtttagagtactccagctcctgaaaactggatctggtgatgcagatgacagtctcctggaacaagccaacaatgccattggagactactttgctgatcgacaaaagtggttgaatgctgtacaatattatgtacaaggacggaaccaggaacgcttagctgaatgttactatatgttagaggattatgaagggttagagaaccttgccatttcacttccagaaaaccacaagttacttccagaaatagcacaaatgtttgtcagagttggaatgtgtgaacaagcagtgactgcatttttgaaatgtagtcaaccaaaggcagcagtagatacctgcgtacatctcaaccaatggaacaaagctgttgaattggctaaaaatcatagtatgaaagaaattggatctctgttagctaggtatgcatctcatttactggaaaagaataaaactcttgatgccatagaactctatcggaaagccaattacttttttgatgcagctaaactgatgtttaagattgcagatgaagaggcaaagaaaggaagtaaacctttacgtgtcaagaagctctatgtactgtcagccttacttatagagcaataccatgaacagatgaagaatgcccagcgaggaaaagttaaaggaaaaagttcagaggccacttctgccttggctggtttgctggaagaagaagttctgtctacaacagatcgtttcacagataatgcatggagaggggcagaggcttaccacttctttatacttgcacagaggcagctctatgagggatgtgtggacactgcactgaagacagctcttcacctgaaagactatgaagacatcatccctcctgtggagatctactctctgctagcactctgcgcatgcgccagcagagcctttgggacttgttcaaaagctttcattaaacttaaatctttagagaccctcagttcagaacagaaacagcagtatgaagaccttgctttagaaatcttcaccaaacatacttcaaaagataacagaaaacctgaattggacagccttatggaaggtggagaagggaaactgccaacatgcgttgccacaggaagcccaatcactgagtatcaattctggatgtgcagtgtatgcaaacacggtgtccttgctcaggaaataagccactacagcttctgccccttatgccatagtccagtgggataaaggaatgataaactgtatataactgtaaaatatatgtagcatatatacatggctatatgctgtatatgtaataaggtttatttctgtgagttttgtatgaaaatcagcctcattatttatagttgaatttttgcacaaaatatatgttaataaaataatttttatggcaatacaactgtgaaataataaggccgattttcatataaatgtatgaaaatcaaccatgttttctctcaccctctctcttttgtttatcttgtttttggttacatgataccatggaaatattccaaataaatttttttctcacagtgtcaaggtaactgaattcattaaaaaatcttgaagggagtagggagtgggggaagcatgggagtggggcaaagttgaatttagagaatttttataacccatgttacaaggaagttaaacaattgtaataatgaaatgagctttctctatagccatatttaattaaataagtgtcgaatgtcttctttattgtattttcagaagtgaggcgatggcattttaagacattttttacaatctgaattgtttctaatagccctattcttctattttaaaacctgtccttttagtctcatttaagagatggcatttggaatttacactttcatatgattgtgcagaaaacttgcctctatttataatgaagataacttaaacagaaatatccattttgtagttatagcttctgttgaaacattgtcactaagttggaccgtttatttacacaagtattgttgagggagtgattttttcttgatatgcgtctgttttcatttattattaatttgaaagataaacagttgtgatccataatggatcatttcttatgtcttttacatagctaataatgttctctgtttatttctcatgaattcccattttgtggctaaagaccagacctttgcactatttcatcaagattattttattgaggtttggcttacatatagtagaggcaatacatagagatacgcaactttgtttttgcagctacaatacactttctcaatctcatatgtttttgtcttgtagagacagagacaagttcagcatgttgcagattgggaatagtgagctatgagaagagatttagagcctagatgagcttaggatagagagtgggctcattggcctaaataaaaagagaagaccagaagtctttgaggtctctgtctctattcatgcgcctcgtggaaaattaccttggtacaatggtagcctctaaatagactgcctcgcaagctattccagaggtcatggaacagaaagccttataaaccaaataaaaattctcaaaatacattggtttattgaaccaatttgcaatacacagtgaggaacaaggagaaagcaatgatagattaacactgttagtgtaacgtgccagtggagtggaaagaccgcaacacctgaatcctgggttttgtaatgtttttatgtcctgactcacattctgtcacatacgctttcccctaatagtcgggttacaaaaaggaccagagtggccgcttgagccagatgactcaatcagatgaaatgtgcctgaggccaacgatgtacacttgctctatagaagggtgtcaggggcaagtacacttcaccacagcaatagcttgcctattagtctgctgagcagtcatgaattttattgtatttcttgggtaaggacaggccagaatgagtgtcaccagtgggtaattgaatcaacttctcacacatactgaaggctttatatgtctcatgcatacttagtgtatcatgaatatttggtatctttgtggcttttcatatttttagtgcttcatgaatatttggtatctcttgctcctttctatctgtggtcacacatacacgctctattaactttgcctaataagtctcctaggttactaacttacttacctaaatgtaacacaatgaattccagctttctcatttgttctataccagaatgggaaatttccccaaatcagaaaatcacatcctaacaaagaagtctgtctaagacagtacatctcctgttgaacttgcatctttccacaggactttctgtttttagggatgagactattctctgcttcatcaaggaaagagaaatgttcagggttgtagggatggcacacttattagttctgcctgtctgaaaggttcctgcaggacagtttggtcagagctgcaattcttagtccatggtctaatgcttgagtatctcttctttccctttcctgtctcaggaatcagctgagaattcattcgattgtcatgcctctagccccttactgtgatttgttggttgcactttcatttgctttagttctagaatcacctgttgactcctcagacttcacctaactttggaaactctcttttggaggcttctcatttccccctaattctgtgctgcctgagccctagaattttcccaccaacgaattattccaggtagatcctaagttgctggatctagttgatatttaaacaatatctagttgatatttctcattcagttggatccagaaaccagtatctctaaaaacaacctctcataccttgtggacctaattttgtgtgcgtgtgtgtgtgcgcgcatatgtatatagacaggcacatcttttttacttttgtaaaagcttatgcctctttggtatctatatctgtgaaagttttaatgatctgccataatgtcttggggacctttgtcttctgtgtaaatggtactagagaaaacacctatattatgagtcaatctagttggttttattcgacatgaaggaaatttccagataacaacactaacaaactctcccttgactagggggacaaagaaaagcaaaactgaccataaaaaacaattacctggtgagaagttgcataaacagaattaggtagtatattgaagacagcatcattaaacagttatgttgttctccttgcaaaaaacatgtactgacttcccgttgagtaatgccaagttgttttttttattataaaacttgcccttcattacatgtttcaaagtggtgtggtgggccaaaatattgaaatgatggaactgactgataaagctgtacaaataagcagtgtgcctaacaagcaacacagtaatgttgacatgcttaattcacaaatgctaatttcattataaattgttttgctaaaatacactttgaaactatttttctgtattccaagagctgagatcttagattttatgtagtattaagtgaaaaaatacgaaaataataaacattgaagaaaaaaataa

SEQ ID NO: 199770 - DNA, 2788 bp, Homo sapiens
  Payload ID: 19415
  Gene Name: WD repeat domain 35
  ENST ID: ENST00000445063
  CDS Start-End: 1-752
agggtatacagctatcccatgtaacatggtctgcggacagtaaagtcttactttttggaatggcaaatggggaaatacacatttacgataatcaaggaaattttatgataaaaatgaaactgagttgtttggtgaatgtcactggagctatcagcattgctggaattcattggtaccatggcacagaaggctacgtggagcctgattgcccttgccttgctgtttgctttgataatggaagatgccaaataatgagacatgagaatgaccaaaatcccgttttgattgacactggcatgtacgtagtaggcatccagtggaaccacatgggcagcgtgttagctgtggcaggcttccagaaggcagccatgcaggacaaagatgtgaacattgtgcagttttacactccgtttggtgagcatctgggtactttgaaagttcctggaaaggaaatatctgcactatcttgggaaggaggtggactgaaaattgcactagctgttgattcctttatatattttgcaaacattcgacctaattataagtggggttattgctcaaacactgtagtttatgcatataccagacctgatcgtccagaatattgtgttgtcttctgggatacgaaaaacaatgaaaaatatgttaaatatgtgaagggtctcatttctattactacctgtggagatttctgcattttggctacaaaagctgatgaaaatcatcctcagtaccattgtttgttgcaatgaccaaaacccatgtgatagcagcctcgaaagaagcattttatacctggcaatatcgtgtggcaaagaagctcacagcattggaaattaatcagatcacacggtctcgaaaagaagggagagaaagaatttatcatgttgatgataccccttctggatcaatggatggtgtgcttgattatagtaaaaccattcaaggcacaagggatccaatttgtgccataactgcatcagataagatattgattgtgggtcgtgaatctggcaccattcagagatacagtctacctaatgttggtttgattcaaaaatattcccttaattgtcgagcctaccagttatccttgaattgcaactctagccgtcttgctatcatagacatctcaggagttctgactttctttgacttggatgctcgagtaacggacagtacgggacagcaagtagttggagagttgttaaaattggaacgaagagatgtctgggatatgaagtgggccaaagataatcctgatttgtttgcaatgatggagaagacaagaatgtatgttttcagaaacttggatcctgaggaacccattcagacctctggatatatttgtaattttgaggatttagaaattaaatctgttcttttggatgagatattaaaggatccagaacatccaaacaaggattacctaattaactttgagattcggtctctgcgagatagccgagcactgattgagaaggttggaattaaagatgcatctcagttcatagaggacaatccacacccccgactttggcgcctactggctgaagcagctcttcagaaactggatctatacactgcagagcaagcatttgtgcgctgcaaagattaccaaggcattaagtttgtgaagcgcttgggcaaactactgagtgagtcaatgaaacaggctgaagttgttggctacttcggcaggtttgaagaggctgaaagaacgtatctcgagatggacagaagggatcttgctattggcctccggctgaaattgggggattggtttagagtactccagctcctgaaaactggatctggtgatgcagatgacagtctcctggaacaagccaacaatgccattggagactactttgctgatcgacaaaagtggttgaatgctgtacaatattatgtacaaggacggaaccaggaacgcttagctgaatgttactatatgttagaggattatgaagggttagagaaccttgccatttcacttccagaaaaccacaagttacttccaattgcagatgaagaggcaaagaaaggaagtaaacctttacgtgtcaagaagctctatgtactgtcagccttacttatagagcaataccatgaacagatgaagaatgcccagcgaggaaaagttaaaggaaaaagttcagaggccacttctgccttggctggtttgctggaagaagaagttctgtctacaacagatcgtttcacagataatgcatggagaggggcagaggcttaccacttctttatacttgcacagaggcagctctatgagggatgtgtggacactgcactgaagacagtggagaagggaaactgccaacatgcgttgccacaggaagcccaatcactgagtatcaattctggatgtgcagtgtatgcaaacacggtgtccttgctcaggaaataagccactacagcttctgccccttatgccatagtccagtgggataaaggaatgataaactgtatataactgtaaaatatatgtagcatatatacatggctatatgctgtatatgtaataaggtttatttctgtgagttttgtatgaaaatcagcctcattatttatagttgaatttttgcacaaaatatatgttaataaaataatttttatggcaatacaactgtgaaataataaggccgattttcatataaatgtatgaaaatcaaccatgttttctctcaccctctctcttttgtttatcttgtttttggttacatgataccatggaaatattccaaataaatttttttctcacagtgtc

SEQ ID NO: 199771 - DNA, 3483 bp, Homo sapiens
  Payload ID: 19415
  Gene Name: WD repeat domain 35
  ENST ID: ENST00000414212
  CDS Start-End: 34-2655
agcggccgccgtgaccctctcggggatcccacgatgttcttctacctgagcaagaaaatttccattcccaataacgtgaagctgcagtgtgtatcctggaacaaggaacaagggttcatagcatgcggtggtgaagatggattactgaaagttttgaaattagagacgcagacagatgatgcaaaattgaggggccttgcagcccccagtaacctttctatgaatcagactcttgaaggtcatagtggttctgttcaagttgtaacatggaatgagcagtatcagaagttgactaccagtgatgaaaacgggcttatcattgtgtggatgttatataaaggctcttggattgaggagatgatcaacaatcgaaataaatcagttgttcgcagtatgagctggaatgctgacggacagaagatctgcattgtatatgaagatggggctgtgatagttggttcagtggatggcaatcgtatttggggaaaagacctgaagggtatacagctatcccatgtaacatggtctgcggacagtaaagtcttactttttggaatggcaaatggggaaatacacatttacgataatcaaggaaattttatgataaaaatgaaactgagttgtttggtgaatgtcactggagctatcagcattgctggaattcattggtaccatggcacagaaggctacgtggagcctgattgcccttgccttgctgtttgctttgataatggaagatgccaaataatgagacatgagaatgaccaaaatcccgttttgattgacactggcatgtacgtagtaggcatccagtggaaccacatgggcagcgtgttagctgtggcaggcttccagaaggcagccatgcaggacaaagatgtgaacattgtgcagttttacactccgtttggtgagcatctgggtactttgaaagttcctggaaaggaaatatctgcactatcttgggaaggaggtggactgaaaattgcactagctgttgattcctttatatattttgcaaacattcgacctaattataagtggggttattgctcaaacactgtagtttatgcatataccagacctgatcgtccagaatattgtgttgtcttctgggatacgaaaaacaatgaaaaatatgttaaatatgtgaagggtctcatttctattactacctgtggagatttctgcattttggctacaaaagctgatgaaaatcatcctcaggaggagaacgagatggagacatttggtgcaacgtttgtactagttctttgtaattctattggtacacccttggatcccaaatacattgatattgtaccattgtttgttgcaatgaccaaaacccatgtgatagcagcctcgaaagaagcattttatacctggcaatatcgtgtggcaaagaagctcacagcattggaaattaatcagatcacacggtctcgaaaagaagggagagaaagaatttatcatgttgatgataccccttctggatcaatggatggtgtgcttgattatagtaaaaccattcaaggcacaagggatccaatttgtgccataactgcatcagataagatattgattgtgggtcgtgaatctggcaccattcagagatacagtctacctaatgttggtttgattcaaaaatattcccttaattgtcgagcctaccagttatccttgaattgcaactctagccgtcttgctatcatagacatctcaggagttctgactttctttgacttggatgctcgagtaacggacagtacgggacagcaagtagttggagagttgttaaaattggaacgaagagatgtctgggatatgaagtgggccaaagataatcctgatttgtttgcaatgatggagaagacaagaatgtatgttttcagaaacttggatcctgaggaacccattcagacctctggatatatttgtaattttgaggatttagaaattaaatctgttcttttggatgagatattaaaggatccagaacatccaaacaaggattacctaattaactttgagattcggtctctgcgagatagccgagcactgattgagaaggttggaattaaagatgcatctcagttcatagaggacaatccacacccccgactttggcgcctactggctgaagcagctcttcagaaactggatctatacactgcagagcaagcatttgtgcgctgcaaagattaccaaggcattaagtttgtgaagcgcttgggcaaactactgagtgagtcaatgaaacaggctgaagttgttggctacttcggcaggtttgaagaggctgaaagaacgtatctcgagatggacagaagggatcttgctattggcctccggctgaaattgggggattggtttagagtactccagctcctgaaaactggatctggtgatgcagatgacagtctcctggaacaagccaacaatgccattggagactactttgctgatcgacaaaagtggttgaatgctgtacaatattatgtacaaggacggaaccaggaacgcttagctgaatgttactatatgttagaggattatgaagggttagagaaccttgccatttcacttccagaaaaccacaagttacttccagtaggaaatagcacaaatgtttgtcagagttggaatgtgtgaacaagcagtgactgcatttttgaaatgtagtcaaccaaaggcagcagtagatacctgcgtacatctcaaccaatggaacaaagctgttgaattggctaaaaatcatagtatgaaagaaattggatctctgttagctagattgcagatgaagaggcaaagaaaggaagtaaacctttacgtgtcaagaagctctatgtactgtcagccttacttatagagcaataccatgaacagatgaagaatgcccagcgaggaaaagttaaaggaaaaagttcagaggccacttctgccttggctggtttgctggaagaagaagttctgtctacaacagatcgtttcacagataatgcatggagaggggcagaggcttaccacttctttatacttgcacagaggcagctctatgagggatgtgtggacactgcactgaagacagctcttcacctgaaagactatgaagacatcatccctcctgtggagatctactctctgctagcactctgcgcatgcgccagcagagcctttgggacttgttcaaaagctttcattaaacttaaatctttagagaccctcagttcagaacagaaacagcagtatgaagaccttgctttagaaatcttcaccaaacatacttcaaaagataacagaaaacctgaattggacagccttatggaaggtggagaagggaaactgccaacatgcgttgccacaggaagcccaatcactgagtatcaattctggatgtgcagtgtatgcaaacacggtgtccttgctcaggaaataagccactacagcttctgccccttatgccatagtccagtgggataa

SEQ ID NO: 199772 - DNA, 1624 bp, Homo sapiens
  Payload ID: 19415
  Gene Name: WD repeat domain 35
  ENST ID: ENST00000453014
  CDS Start-End: 1-1221
aatcagatcacacggtctcgaaaagaagggagagaaagaatttatcatgttgatgataccccttctggatcaatggatggtgtgcttgattatagtaaaaccattcaaggcacaagggatccaatttgtgccataactgcatcagataagatattgattgtgggtcgtgaatctggcaccattcagagatacagtctacctaatgttggtttgattcaaaaatattcccttaattgtcgagcctaccagttatccttgaattgcaactctagccgtcttgctatcatagacatctcaggagttctgactttctttgacttggatgctcgagtaacggacagtacgggacagcaagtagttggagagttgttaaaattggaacgaagagatgtctgggatatgaagtgggccaaagataatcctgatttgtttgcaatgatggagaagacaagaatgtatgttttcagaaacttggatcctgaggaacccattcagacctctggatatatttgtaattttgaggatttagaaattaaatctgttcttttggatgagatattaaaggatccagaacatccaaacaaggattacctaattaactttgagattcggtctctgcgagatagccgagcactgattgagaaggttggaattaaagatgcatctcagttcatagaggacaatccacacccccgactttggcgcctactggctgaagcagctcttcagaaactggatctatacactgcagagcaagcatttgtgcgctgcaaagattaccaaggcattaagtttgtgaagcgcttgggcaaactactgagtgagtcaatgaaacaggctgaagttgttggctacttcggcaggtttgaagaggctgaaagaacgtatctcgagatggacagaagggatcttgctattggcctccggctgaaattgggggattggtttagagtactccagctcctgaaaactggatctggtgatgcagatgacagtctcctggaacaagccaacaatgccattggagactactttgctgatcgacaaaagtggttgaatgctgtacaatattatgtacaaggacggaaccaggaacgcttagctgaatgttactatatgttagaggattatgaagggttagagaaccttgccatttcacttccagaaaaccacaagttacttccagtaggtattgcaaattttagtttttggaattgttaggttactttataaaattttatgttatagtcaggaaatatctcccacaataaagaaaattaaaaatctataatgttacagtttcttagacatggaatgatgcttttaattataaagtaatatataaataatatagaatgcttgaaaatggaggaggaaaagtcagtcacattcttactactttaatatgatcacagtcttgtgtagtctgttaagatttataaagttactttttaaatgttagctgaatacatgaaatatttacagatgaaatgatatgttgctagggatttgcttcaaaataatctgaaattgtttgaaatttgctataacttaagtttaaaaagatagctcaacttttattatgttatattaacaataaagtatttcaagttaaaagagaaat

SEQ ID NO: 199773 - DNA, 7048 bp, Homo sapiens
  Payload ID: 19416
  Gene Name: WD repeat domain 36
  Uniprot ID: Q8NI36
  ENST ID: ENST00000506538
  CDS Start-End: 574-3429
tcaaggaatactgacttaatccaggaatcccaataacatttaatatttatcttccttttctgggaggaatctacacttatccaagttgcccaagtgagcagttccctccccacaagtaattagttctactccccagagggtctgtgagtgaatccctctgtcagttttgaaatgtcccattatagttttcatctgtaaatatgtcaatatgtatccaaaagatgaggatctttaaaaacgtaatcataatgctactatcatatgtaaaaatgaaacataattccttaatatcatcagatatccagtgtttaaatttttccagtctcatgtttttgtacatttttaaataatcacatgtttaaatcgtttccatctccaaggcgtcgacctcccctccattctcctgggcgtcgcgcttccctctttgtttcccgcccttgcggttctgtcggaacctaacgagcttccttccaccgcaaaagagctggagaacaatgctaggcaacgtgctggagaccttggccctcggaacccaagtcacgcctcccatgtgagctctggagggagaactttatgtgttgcactgagggcagtctccggaaacgcgattcgcagcgggcgccggaagcggtgttgtgtctgcagctctggcagaggactgttccactagacacgctgaagggactgggtacgtgttttccttcaggaccagagctgagaggagctgggatcgcggcggcaatggaacgggcctcagaaaggcgcacggccagcgcgctttttgcggggttccgggccttgggacttttcagcaacgacattccacacgtggtgcggttcagcgcgctcaagcgccggttctatgtaacaacctgcgtgggcaagagtttccacacctatgacgttcagaaacttagtctggttgcagtaagtaattctgttccacaggatatctgctgtatggcagctgatggcagattagtctttgctgcttatggaaatgttttctctgcatttgcccgtaataaagagatagtacatacctttaagggtcataaggcagaaatccatttcttgcaaccctttggagaccacattatctctgttgatactgatggcattcttattatttggcacatatattcagaagaagaatacctgcagttgacttttgataaatcagtatttaaaatttctgcaattttgcatccaagtacctacttgaataaaatacttctgggcagtgaacaaggaagcctgcagttgtggaatgtaaaatccaataaacttctatatacatttccaggatggaaagttggagtgacagctcttcagcaggcaccagccgtggatgttgttgctattggtcttatgtcaggtcaagttatcattcacaacattaaatttaatgaaacattaatgaagtttcgtcaagactggggacccattacttcaatttcatttcgcacagatggtcatccagtaatggcagctggaagcccatgtggccatattggactctgggatctagaagacaaaaaattaatcaaccaaatgagaaatgcacactctacagcaattgccggactgacatttctccatagagagccacttcttgtcacaaatggcgctgacaatgctcttaggatatggatatttgatggtcctacaggtgaaggccgacttttgagattcagaatgggtcatagtgctcctcttaccaatatcagatattatggacagaatggacagcagattctaagtgcaagtcaagatggaactcttcagtcattttccacggtacatgaaaaattcaataagagcttgggacatggattaataaataaaaagagagttaaacgtaaaggacttcagaataccatgtcagtgagacttccacccatcacaaagtttgcagcagaggaagctcgtgaaagtgactgggatggtatcattgcttgccatcaaggtaagctatcttgctcaacctggaattatcagaaatctacaataggcgcttactttctcaagccaaaagagttgaagaaagatgacataactgcaacagcagtggatataacttcttgtggaaactttgctgtaattggcctctcatcaggaactgtagatgtatataacatgcagtctggcatacatcgaggaagttttggcaaggatcaagctcacaagggatctgttagaggtgtcgcagtggatggattaaaccagttgacagttacaactggtagtgaaggattactcaaattctggaactttaaaaacaaaattttaatccattctgtgagcctcagttcatctccaaatatcatgttgctacatagggacagtggcattctgggactcgccttggatgacttctccattagtgttctggacatagaaactaggaagattgtcagagagttttctggacaccaaggccaaataaatgacatggcttttagtcctgatggtcgttggttaataagtgctgcgatggattgctctattaggacttgggaccttccttctgggtgccttatagactgctttttgttggactcggctcctctcaatgtttctatgtctcctactggagactttctggcaacttcccatgtggaccaccttggaatttatctatggtccaatatttccctgtattcagttgtttcattacggccacttcctgcagattatgtcccttcaatagtcatgcttcctggtacttgtcaaacccaagatgtagaagtatcagaagaaacagtagaaccaagtgatgaattgatagaatatgattcgccagaacagttgaatgagcaattggtgactctttcacttcttcctgaatcacgatggaaaaaccttcttaaccttgatgttattaagaaaaagaataaaccaaaggaaccacccaaagtacccaaatcagcaccatttttcattccaacaattcctggccttgtacccagatatgctgcacctgaacaaaataatgatccccagcagtctaaagtggtaaatcttggagttttggctcaaaaatcagatttctgcttgaaacttgaagaaggactggtaaataataagtatgacactgctctcaaccttctgaaagaatcaggcccatcaggaattgaaacagagctgcgaagcttgtctcctgattgtggtgggtccatagaagttatgcagagcttcttgaaaatgattgggatgatgctggacagaaagcgtgattttgagttagcccaggcataccttgcattgtttctaaagttacaccttaaaatgcttccttcagagccagtactcctagaagaaataacaaatttgtcatcccaggtggaagaaaactggacccatttgcaatcactcttcaatcaaagcatgtgtattttaaattatctcaaaagtgctttgttgtaaaaataaatttgtgactaaacaaagactttcatattaaatgggttcaattgaactcatttcttattttccaagtgtcaatgtgaaaagaaaataaatgctagcactactgactagtcagtatatctccactttaaatgctaaatactttcttgaaataaaatcgcacctcccggccaggcatgatggataatgcctgtaattccagcactttcagaggccaaagcgggaggattgcttgaagccaggaatttgagcccagcctgggcaacatagcaagcaagatcccatctctacaaaaagttaaaaaaataaattacacctgccttttgttttgaagacttaaagaatctgctcaaatgatttattttctgagtctcttcacattaacttttatatgatttttaaaaaattattacctgcttatattttttgagtatctgtttcatataaagagatgctgcatgttcactgtgaagtattgctgaattaaattgaaaatgtcagataaaactgatacatgatgtagttataaaaatgctgttatgaagaaaaaaggaatgcttttttcctcggtggcctttgataaaaatatgaatgattgactctcagagttggaggataaactaatcatcttctagcacagccctgttgtgttgcaggagaggaatcaggctaaagtctgctggtatttcagtgacagattaaaactttctaacagtggcctagtgctttctccattgtaatgtactgaaaggaagttgttcatggatcagaaatgtgggaggcccttccttgcccaaggcaagtcgctgtagatggttaaactgataccaaggataggtaagggaaattccaaattccattggaagatggccttttactgacactgcagacatgtagataacaatagtttaatgtcctctgaaaaggtaaaaattccataaatccttgcaaacaatttttagcaatattgtttattgctaccacagccaagaatgggtatttcaaagccagggttttttttattttgttttgttttgtttttttttttttttttttggctacacttttttgggggggaccttttaatttgggaagaaaatgctgagtatacttttctttcacaaccattgcaaacccaggtagccctggagttttctttttttctcatcatcattgttttgttttttttatggttcaagacttttgcaatacatgaattaaaaataagcagttctttaaagcatagcgctctaaaaactattcttagtttataccctcaaaagttgggtctttcatgaaacacagtggtttgaatatgaacaccagtagcattctcgttcgttgttagggtaagagagttttgtagaatgatctccaaaagaagcagtcctcaaaaggcatttaccagtgatatcttttaatattcatgtttttatttaatgatgtaagatagaattaataaactactaaggaaataagccaatgtggttattgtactcaatttcgtttttcttttagaaatgtgtattgacttattaaagccactgacagaaatgttaatcatgacttaagttctaatttaaaaaactattttcctctttcctaaatactatattctaaattggaatatggcaaaatcccaatatataattctatacctagtaaagattgtaaataactaaaacaaaatgataagagctgtgaactgaaattgtattgcttacagaaatcatgaaccgaattttcttctctttttaaagtgagcataaagacttaagtgtattgttaccagagatatatttagatagaatacatcattttggcaggtaatcttctagaacctttcatgtactgtttccatcaagggagggaaagaaatagaaaatataattttatctatattttccttaaaatatatcaatctgtgcacactctttcagttttttaattactcatgtaatatatgactacattttgcttgtgtgctttttgaaaaccatcttcagtcccaatatcctctgtagaagtaatagttttaactctcctagatcttcttttagagtgtttttatgagtgtttaatgtaggaatgtgtatatattatctacagccacaggaaatgtatagttacgatttttacatacgtgtatgtatattattgtacaacttgctatttctacttgggagttttttattttggtacattcacatttacctaatctcttgtgcactgtccaacagtactttgcctataatagacacttaaggaagttttccttctttttattcctttataattacaaacaatgctgaaaggaacatcatcctacatgagccctttttgtacatataaggctctctctgtggtatatgcttaggatttgaatttcaggccagagtataaccatttttaatttgaagagatacttccatttgggttccagaatggctgtatcaagttacagttcccctgagcaagatatgagcatctgcttccccatgtaattaatgacacttgctattggatttttgtaatttaattactctgaaaaaattattttggttttaaatcagaaatttctcactagtgaagatggacatatttttgtatgtttattttagaacatataaacatttgttaattttctttttcctctcatttttctattgaatgatttgtccttttatctcatggatttgttaggagttctcttgtattttctgtattttatgtctgttgccaatgttttctcctacttagccatttggctttaattttacatggtgtctgtttaaataaatgttttatatttgtatacaatcaaattgattaattttcatgacttatttcaggatataaagcaaattattttctaagacatttacagtgtatgttttcctatgtttacatgtgctcatttcacgtcatgtattttcctctacgacatgtttctgtgtgagtagttaacatgtagatctttagaattgatttttctgaagagtgaaacagcgctgcttccaatatctgttcaaaattcatttattgaaaagtccactcatatgtctgatttgaaatgctgtttcattatgtgttaaattctttcactgagctcttccatattcctagtaaatgatgcattactttggtatgttctcagatttgggtaaagccttcctcatgttctataaaaattggttaactgctggtgagcacatctcttgaagttttgatatgggttgcacaacatttataggactgatttggagagaccgacaataccgagtgcagtcctcccttggtatctagttccaggacccctgtggataccaaaatccaagcaatgccctgcagatcatgggacctatgcatatgaaaagtcggtccttgtatttgagggttttgcatccctcaaataccatatgttttatttgtgtttggttgaaaaaagtttgcatataagtgaaacttagcatttcaaacctgtgttgttcaaagatcatttgtatttctcttcaagaacaatgaatgtcttcattaaatcatcttttgtgggagagcttttggtttcatagattttcatatatatatatgatataataaacactttttgacattc

SEQ ID NO: 199774 - DNA, 3140 bp, Homo sapiens
  Payload ID: 19416
  Gene Name: WD repeat domain 36
  ENST ID: ENST00000513710
  CDS Start-End: 144-2831
ggaaacgcgattcgcagcgggcgccggaagcggtgttgtgtctgcagctctggcagaggactgttccactagacacgctgaagggactgggtacgtgttttccttcaggaccagagctgagaggagctgggatcgcggcggcaatggaacgggcctcagaaaggcgcacggccagcgcgctttttgcggggttccgggccttgggacttttcagcaacgacattccacacgtggtgcggttcagcgcgctcaagcgccggttctatgtaacaacctgcgtgggcaagagtttccacacctatgacgttcagaaacttagtctggttgcagtaagtaattctgttccacaggatatctgctgtatggcagctgatggcagattagtctttgctgcttatggaaatgttttctctgcatttgcccgtaataaagagatagtacatacctttaagggtcataaggcagaaatccatttcttgcaaccctttggagaccacattatctctgttgatactgatggcattcttattatttggcacatatattcagaagaagaatacctgcagttgacttttgataaatcagtatttaaaatttctgcaattttgcatccaagtacctacttgaataaaatacttctgggcagtgaacaaggaagcctgcagttgtggaatgtaaaatccaataaacttctatatacatttccaggatggaaagttggagtgacagctcttcagcaggcaccagccgtggatgttgttgctattggtcttatgtcaggtcaagttatcattcacaacattaaatttaatgaaacattaatgaagtttcgtcaagactggggacccattacttcaatttcatttcgcacagatggtcatccagtaatggcagctggaagcccatgtggccatattggactctgggatctagaagacaaaaaattaatcaaccaaatgagaaatgcacactctacagcaattgccggactgacatttctccatagagagccacttcttgtcacaaatggcgctgacaatgctcttaggatatggatatttgatggtcctacaggtgaaggccgacttttgagattcagaatgggtcatagtgctcctcttaccaatatcagatattatggacagaatggacagcagattctaagtgcaagtcaagatggaactcttcagtcattttccacggtacatgaaaaattcaataagagcttgggacatggattaataaataaaaagagagttaaacgtaaaggacttcagaataccatgtcagtgagacttccacccatcacaaagtttgcagcagaggaagctcgtgaaagtgactgggatggtatcattgcttgccatcaaggtaagctatcttgctcaacctggaattatcagaaatctacaataggcgcttactttctcaagccaaaagagttgaagaaagatgacataactgcaacagcagtggatataacttcttgtggaaactttgctgtaattggcctctcatcaggaactgtagatgtatataacatgcagtctggcatacatcgaggaagttttggcaaggatcaagctcacaagggatctgttagaggtgtcgcagtggatggattaaaccagttgacagttacaactggtagtgaaggattactcaaattctggaactttaaaaacaaaattttaatccattctgtgagcctcagttcatctccaaatatcatgttgctacatagggacagtggcattctgggactcgccttggatgacttctccattagtgttctggacatagaaactaggaagattgtcagagagttttctggacaccaaggccaaataaatgacatggcttttagtcctgatggtcgttggttaataagtgctgcgatggattgctctattaggacttgggaccttccttctgggtgccttatagactgctttttgttggactcggctcctctcaatgtttctatgtctcctactggagactttctggcaacttcccatgtggaccaccttggaatttatctatggtccaatatttccctgtattcagttgtttcattacggccacttcctgcagattatgtcccttcaatagtcatgcttcctggtacttgtcaaacccaagatgtagaagtatcagaagaaacagtagaaccaagtgatgaattgatagaatatgattcgccagaacagttgaatgagcaattggtgactctttcacttcttcctgaatcacgatggaaaaaccttcttaaccttgatgttattaagaaaaagaataaaccaaaggaaccacccaaagtacccaaatcagcaccatttttcattccaacaattcctggccttgtacccagatatgctgcacctgaacaaaataatgatccccagcagtctaaagtggtaaatcttggagttttggctcaaaaatcagatttctgcttgaaacttgaagaaggactggtaaataataagtatgacactgctctcaaccttctgaaagaatcaggcccatcaggaattgaaacagagctgcgaagcttgtctcctgattgtggtgggtccatagaagttatgcagagcttcttgaaaatgattgggatgatgctggacagaaagcgtgattttgagttagcccaggcataccttgcattgtttctaaagttacaccttaaaatgcttccttcagagccagtactcctagaagaaataacaaatttgtcatcccaggtggaagaaaactggacccatttgcaatcactcttcaatcaaagcatgtgtattttaaattatctcaaaagtgctttgttgtaaaaataaatttgtgactaaacaaagactttcatattaaatgggttcaattgaactcatttcttattttccaagtgtcaatgtgaaaagaaaataaatgctagcactactgactagtcagtatatctccactttaaatgctaaatactttcttgaaataaaatcgcacctcccggccaggcatgatggataatgcctgtaattccagcactttcagaggccaaagcgggaggattgcttgaagccaggaatttgagcccagcctgggcaacatagcaagcaagatcccatctctacaaaaagttaaaaaaa

SEQ ID NO: 199775 - DNA, 6592 bp, Homo sapiens
  Payload ID: 19416
  Gene Name: WD repeat domain 36
  Uniprot ID: Q8NI36
  ENST ID: ENST00000612402
  CDS Start-End: 118-2973
taacgagcttccttccaccgcaaaagagctggagaacaatgctaggcaacgtgctggagaccttggccctcggaacccaagtcacgcctcccatgtgagctctggagggagaactttatgtgttgcactgagggcagtctccggaaacgcgattcgcagcgggcgccggaagcggtgttgtgtctgcagctctggcagaggactgttccactagacacgctgaagggactgggtacgtgttttccttcaggaccagagctgagaggagctgggatcgcggcggcaatggaacgggcctcagaaaggcgcacggccagcgcgctttttgcggggttccgggccttgggacttttcagcaacgacattccacacgtggtgcggttcagcgcgctcaagcgccggttctatgtaacaacctgcgtgggcaagagtttccacacctatgacgttcagaaacttagtctggttgcagtaagtaattctgttccacaggatatctgctgtatggcagctgatggcagattagtctttgctgcttatggaaatgttttctctgcatttgcccgtaataaagagatagtacatacctttaagggtcataaggcagaaatccatttcttgcaaccctttggagaccacattatctctgttgatactgatggcattcttattatttggcacatatattcagaagaagaatacctgcagttgacttttgataaatcagtatttaaaatttctgcaattttgcatccaagtacctacttgaataaaatacttctgggcagtgaacaaggaagcctgcagttgtggaatgtaaaatccaataaacttctatatacatttccaggatggaaagttggagtgacagctcttcagcaggcaccagccgtggatgttgttgctattggtcttatgtcaggtcaagttatcattcacaacattaaatttaatgaaacattaatgaagtttcgtcaagactggggacccattacttcaatttcatttcgcacagatggtcatccagtaatggcagctggaagcccatgtggccatattggactctgggatctagaagacaaaaaattaatcaaccaaatgagaaatgcacactctacagcaattgccggactgacatttctccatagagagccacttcttgtcacaaatggcgctgacaatgctcttaggatatggatatttgatggtcctacaggtgaaggccgacttttgagattcagaatgggtcatagtgctcctcttaccaatatcagatattatggacagaatggacagcagattctaagtgcaagtcaagatggaactcttcagtcattttccacggtacatgaaaaattcaataagagcttgggacatggattaataaataaaaagagagttaaacgtaaaggacttcagaataccatgtcagtgagacttccacccatcacaaagtttgcagcagaggaagctcgtgaaagtgactgggatggtatcattgcttgccatcaaggtaagctatcttgctcaacctggaattatcagaaatctacaataggcgcttactttctcaagccaaaagagttgaagaaagatgacataactgcaacagcagtggatataacttcttgtggaaactttgctgtaattggcctctcatcaggaactgtagatgtatataacatgcagtctggcatacatcgaggaagttttggcaaggatcaagctcacaagggatctgttagaggtgtcgcagtggatggattaaaccagttgacagttacaactggtagtgaaggattactcaaattctggaactttaaaaacaaaattttaatccattctgtgagcctcagttcatctccaaatatcatgttgctacatagggacagtggcattctgggactcgccttggatgacttctccattagtgttctggacatagaaactaggaagattgtcagagagttttctggacaccaaggccaaataaatgacatggcttttagtcctgatggtcgttggttaataagtgctgcgatggattgctctattaggacttgggaccttccttctgggtgccttatagactgctttttgttggactcggctcctctcaatgtttctatgtctcctactggagactttctggcaacttcccatgtggaccaccttggaatttatctatggtccaatatttccctgtattcagttgtttcattacggccacttcctgcagattatgtcccttcaatagtcatgcttcctggtacttgtcaaacccaagatgtagaagtatcagaagaaacagtagaaccaagtgatgaattgatagaatatgattcgccagaacagttgaatgagcaattggtgactctttcacttcttcctgaatcacgatggaaaaaccttcttaaccttgatgttattaagaaaaagaataaaccaaaggaaccacccaaagtacccaaatcagcaccatttttcattccaacaattcctggccttgtacccagatatgctgcacctgaacaaaataatgatccccagcagtctaaagtggtaaatcttggagttttggctcaaaaatcagatttctgcttgaaacttgaagaaggactggtaaataataagtatgacactgctctcaaccttctgaaagaatcaggcccatcaggaattgaaacagagctgcgaagcttgtctcctgattgtggtgggtccatagaagttatgcagagcttcttgaaaatgattgggatgatgctggacagaaagcgtgattttgagttagcccaggcataccttgcattgtttctaaagttacaccttaaaatgcttccttcagagccagtactcctagaagaaataacaaatttgtcatcccaggtggaagaaaactggacccatttgcaatcactcttcaatcaaagcatgtgtattttaaattatctcaaaagtgctttgttgtaaaaataaatttgtgactaaacaaagactttcatattaaatgggttcaattgaactcatttcttattttccaagtgtcaatgtgaaaagaaaataaatgctagcactactgactagtcagtatatctccactttaaatgctaaatactttcttgaaataaaatcgcacctcccggccaggcatgatggataatgcctgtaattccagcactttcagaggccaaagcgggaggattgcttgaagccaggaatttgagcccagcctgggcaacatagcaagcaagatcccatctctacaaaaagttaaaaaaataaattacacctgccttttgttttgaagacttaaagaatctgctcaaatgatttattttctgagtctcttcacattaacttttatatgatttttaaaaaattattacctgcttatattttttgagtatctgtttcatataaagagatgctgcatgttcactgtgaagtattgctgaattaaattgaaaatgtcagataaaactgatacatgatgtagttataaaaatgctgttatgaagaaaaaaggaatgcttttttcctcggtggcctttgataaaaatatgaatgattgactctcagagttggaggataaactaatcatcttctagcacagccctgttgtgttgcaggagaggaatcaggctaaagtctgctggtatttcagtgacagattaaaactttctaacagtggcctagtgctttctccattgtaatgtactgaaaggaagttgttcatggatcagaaatgtgggaggcccttccttgcccaaggcaagtcgctgtagatggttaaactgataccaaggataggtaagggaaattccaaattccattggaagatggccttttactgacactgcagacatgtagataacaatagtttaatgtcctctgaaaaggtaaaaattccataaatccttgcaaacaatttttagcaatattgtttattgctaccacagccaagaatgggtatttcaaagccagggttttttttattttgttttgttttgtttttttttttttttttttggctacacttttttgggggggaccttttaatttgggaagaaaatgctgagtatacttttctttcacaaccattgcaaacccaggtagccctggagttttctttttttctcatcatcattgttttgttttttttatggttcaagacttttgcaatacatgaattaaaaataagcagttctttaaagcatagcgctctaaaaactattcttagtttataccctcaaaagttgggtctttcatgaaacacagtggtttgaatatgaacaccagtagcattctcgttcgttgttagggtaagagagttttgtagaatgatctccaaaagaagcagtcctcaaaaggcatttaccagtgatatcttttaatattcatgtttttatttaatgatgtaagatagaattaataaactactaaggaaataagccaatgtggttattgtactcaatttcgtttttcttttagaaatgtgtattgacttattaaagccactgacagaaatgttaatcatgacttaagttctaatttaaaaaactattttcctctttcctaaatactatattctaaattggaatatggcaaaatcccaatatataattctatacctagtaaagattgtaaataactaaaacaaaatgataagagctgtgaactgaaattgtattgcttacagaaatcatgaaccgaattttcttctctttttaaagtgagcataaagacttaagtgtattgttaccagagatatatttagatagaatacatcattttggcaggtaatcttctagaacctttcatgtactgtttccatcaagggagggaaagaaatagaaaatataattttatctatattttccttaaaatatatcaatctgtgcacactctttcagttttttaattactcatgtaatatatgactacattttgcttgtgtgctttttgaaaaccatcttcagtcccaatatcctctgtagaagtaatagttttaactctcctagatcttcttttagagtgtttttatgagtgtttaatgtaggaatgtgtatatattatctacagccacaggaaatgtatagttacgatttttacatacgtgtatgtatattattgtacaacttgctatttctacttgggagttttttattttggtacattcacatttacctaatctcttgtgcactgtccaacagtactttgcctataatagacacttaaggaagttttccttctttttattcctttataattacaaacaatgctgaaaggaacatcatcctacatgagccctttttgtacatataaggctctctctgtggtatatgcttaggatttgaatttcaggccagagtataaccatttttaatttgaagagatacttccatttgggttccagaatggctgtatcaagttacagttcccctgagcaagatatgagcatctgcttccccatgtaattaatgacacttgctattggatttttgtaatttaattactctgaaaaaattattttggttttaaatcagaaatttctcactagtgaagatggacatatttttgtatgtttattttagaacatataaacatttgttaattttctttttcctctcatttttctattgaatgatttgtccttttatctcatggatttgttaggagttctcttgtattttctgtattttatgtctgttgccaatgttttctcctacttagccatttggctttaattttacatggtgtctgtttaaataaatgttttatatttgtatacaatcaaattgattaattttcatgacttatttcaggatataaagcaaattattttctaagacatttacagtgtatgttttcctatgtttacatgtgctcatttcacgtcatgtattttcctctacgacatgtttctgtgtgagtagttaacatgtagatctttagaattgatttttctgaagagtgaaacagcgctgcttccaatatctgttcaaaattcatttattgaaaagtccactcatatgtctgatttgaaatgctgtttcattatgtgttaaattctttcactgagctcttccatattcctagtaaatgatgcattactttggtatgttctcagatttgggtaaagccttcctcatgttctataaaaattggttaactgctggtgagcacatctcttgaagttttgatatgggttgcacaacatttataggactgatttggagagaccgacaataccgagtgcagtcctcccttggtatctagttccaggacccctgtggataccaaaatccaagcaatgccctgcagatcatgggacctatgcatatgaaaagtcggtccttgtatttgagggttttgcatccctcaaataccatatgttttatttgtgtttggttgaaaaaagtttgcatataagtgaaacttagcatttcaaacctgtgttgttcaaagatcatttgtatttctcttcaagaacaatgaatgtcttcattaaatcatcttttgtgggagagcttttggtttcatagattttcatatatatatatgatataataaacactttttgacattc

SEQ ID NO: 199776 - DNA, 4462 bp, Homo sapiens
  Payload ID: 19417
  Gene Name: WD repeat domain 37
  Uniprot ID: Q9Y2I8
  ENST ID: ENST00000263150
  CDS Start-End: 152-1636
gcggtgtcctgcgcgtcttcgggtcagtacggggggccgcgtcgtagggactcactggcggtgcgcgacctgggctggctccgggggtggcgggcgcagctgctgtgacagcttattgcaggagtgaccaggacactacctcctagaagtaatgcccacagaaagcgcaagttgttcgactgctcgccaaacaaaacagaagcgcaaatcccatagcctttctatacgaagaactaacagctcggagcaggagaggacgggactgccaagagacatgttagaaggacaagattctaaactgccttcctcggttcgcagtacacttctggaactgtttggtcaaatagaaagagaatttgaaaacctttatatcgaaaacttagaattacgtagagaaatcgacactcttaatgaacgtttagctgctgaaggacaagcgattgatggagcagagctgagtaagggccaactcaaaacaaaagccagtcacagcaccagccagctctcccagaaactgaagaccacttacaaggcttccaccagcaagattgtctccagctttaagaccacgacatcgagagctgcctgccagctcgtgaaggagtacatcggccaccgggacggcatctgggatgtcagcgtggccaagacacagccagtggtgctcgggactgcatcagccgatcacacggctttgctgtggagcatagagacagggaagtgcctagtcaagtacgcaggccacgtgggctcagtaaattctatcaaatttcatccctcagagcagttggctctcactgcttctggagatcagactgctcatatctggagatacgcggtgcagctgccgacaccccagcctgttgctgacactagtatatctggggaagatgaagtagagtgctctgacaaggacgagcccgacctcgatggggatgtgtccagcgactgccccaccatccgcgtcccactgacatccctcaagagccaccagggcgtggtcatcgcctccgactggctggttggggggaagcaggctgtgactgcctcctgggaccggacggcaaacctgtacgacgtggagacgtccgagctcgttcactctctgacagggcacgaccaggagttgacgcactgctgcacacaccccacccagcggctcgtggtgacctcctcccgtgacacgactttccgcctctgggatttcagggacccctccatccactcggtgaatgttttccagggacacacggacactgtgacttctgccgtgttcaccgtgggagacaacgtggtttcaggcagcgatgaccgcacggtgaaagtctgggacttgaaaaatatgagatcccccattgcaactattcgcacggactctgccattaacaggatcaatgtatgtgtcggccaaaaaatcatagccctcccccatgacaaccgacaagtgagactgtttgatatgtcaggagtgcgcctggcgcggcttccccggagcagccgacagggccacaggagaatggtatgctgctcggcatggagtgaagaccaccccgtgtgcaatctgttcacctgtgggtttgaccggcaagccattggttggaacatcaacatccctgcattgctacaagaaaaataaggacaccggcagcccttagtttcactgtttgccagcacagacctttgatgggtgcaggcttttctgcgtattaatcagccatttttgtgagagtttgaccctggaaagggtgctttgtatatgttcttttcacatagtgcccagcttgcatgaaatgtacagagaaatgtgtggtcgtattttttacttttgtcttgtatatgtatgtatattgggtcctctgggcagtagaggcaaagctcacctcccatgtagcacatgaaatgcttgtgagttgttgacattggacaggtgaacagtagggcattacatttgtgtgaattaaatgtgaacttctgtattacgttgcggcgtcggcagtcctgcgttccctggagtaactgtacgtatctgcctttgctgggaagactgtggggctgcctgtgttggctggcgaccagcaggattgctccaggattttgtgtttacctcgcgtgaagttcagcacgtgctgtcgtgtagtcagcttctactctaatttctgttacagttctgcaaaggtaacctggagtttagaagttaaaaaaaagcatgggatgttggatttgcaccatttggagtttctttaggaaagaaaagttttctgcttttttatagaaaatcatttcagtctcccgaggtctcatgctagcaaattttgaaataggattctaatcactgatttcaaatattaagcaaaatgtaaagcactttaatttatagctatggttataaacaggttttagatgtttcaaatgacttgtccactgaatgtcacttgaccttgataagaggccgcctgcacacagagcccagttaattctccgcacctcggttgtgtgcttccgaatgggctcactcccgtggtggtgtttgagagccaacaacactacctcagagacgggtctttgggaaactttgggtctcactgttgcctggctggagcactttggtttatagctggaatactgagttcagttcagaaggcaggaaagacagtcacaccgacgtgtcctgaaggtgtaggctctccacttaggcgcacaagctgacggctgcagccagcaggccccggtgacgagacacttccaggtcttgtggtggggacgcctctcagtgccagtcccgccactgctgagtgagcctggtgttcttgccttcttggaaattactgctcacctggtatctgtacgttaatgtttcttgctgagttacagttttgataaagaggctctcatttcctgtgtcttgtatattcagtcctttcaatacgtccacctggaggctcaccacttggagagacacaggaaggtaatatttacagctgtcatgtgacatccccaggtctttgtgttttgccctgttttacggtgaggtaggagggaacccatctggggaccggtaggtgcaggtgcagtaggacgtgggacttttggacccgtcctttggtgcagctcgccagggatgagaggcacctccctacttgggtcttcaggagctggtccaaggagcttcgaatctaagtcatctagaatgaccctgaaatgactgacagccccgggcccaagaaaaacccataaccacctcagatggatctgacgtggctaagggacaaacagcaaatatttcagtcattttgattttacaaataaaaaatgtgttgtgtttttgtccgacattatttcctgactgcactgttctgagaatggagtccacctggtccctctggttgattagaatctcaggtttcagctcctgctgtcctgagcgaacttgcctgatgcagggctgtgctgtgtccagatgttgctggggcctcactttttctcttggctggaggtccaattgccagagcctcccacactgcacatacaaaggtctgagcccagggcagcttctggggccactgcacaggccacctgcttgggttcctcggagtttaatttgaaagtctgggtgtcttaggatgatggttaggaacattgaaaaatggctgcaaatagccaaatcaaacttaagaaccagatctctgccagattaaacatttttgaagcttttaaaagtcaatattcctagtggccactgagttccaggcacactggtgccctttactgccacagctgctcaccttgtctggcaaactggagggacctcagaaactggactcctgcatgtccttgggggcgcagccctgtggtgctcaggcagagctctcaggagccggggcaccttgctgttcgctgctgtgtcgtcttctaatgtgagctcatccactgctgctgcagcgtggtgatcaggagtcacagacaagatcggggatggtgtgtgtgtgtgtgtgtgtgtgtgtgtgcacgtgtgtgtggctaaattaagtcatactgtcaaccacacgtgatctcgtctgaaacagtgtttggaagtgggaacagttttgtcctgtatgctgatgtgtccagaatttcatttaatgatagacggaaaatgtgtggttactgaaaactgtatatgatacagaatttcataagagccatgctgttgggcaaagcaactctttttcaaccactgctcatcagtttctgtagagacaaaaactctgtacatattttggaatctgaagaatcctatgtaaatcatttgttacttaagtctgtgaaaaacatatttctttggaggaaaatgtatgcatttataagtgttccatggaatcagtttttattgtatcgatataattgtctctaagtgttgactgtcttcattgcaatatgaaattcattaaaatgtccatgttccataattactattataaaa

SEQ ID NO: 199777 - DNA, 4582 bp, Homo sapiens
  Payload ID: 19417
  Gene Name: WD repeat domain 37
  Uniprot ID: Q9Y2I8
  ENST ID: ENST00000358220
  CDS Start-End: 145-1629
agaacgatggcctttctgcggtgtctgcgaccgggaccaaggcggagcaaagtcgccgggggtgtggggtgttccacgctatgttgggagtgttcgctttcgagcttattgcaggagtgaccaggacactacctcctagaagtaatgcccacagaaagcgcaagttgttcgactgctcgccaaacaaaacagaagcgcaaatcccatagcctttctatacgaagaactaacagctcggagcaggagaggacgggactgccaagagacatgttagaaggacaagattctaaactgccttcctcggttcgcagtacacttctggaactgtttggtcaaatagaaagagaatttgaaaacctttatatcgaaaacttagaattacgtagagaaatcgacactcttaatgaacgtttagctgctgaaggacaagcgattgatggagcagagctgagtaagggccaactcaaaacaaaagccagtcacagcaccagccagctctcccagaaactgaagaccacttacaaggcttccaccagcaagattgtctccagctttaagaccacgacatcgagagctgcctgccagctcgtgaaggagtacatcggccaccgggacggcatctgggatgtcagcgtggccaagacacagccagtggtgctcgggactgcatcagccgatcacacggctttgctgtggagcatagagacagggaagtgcctagtcaagtacgcaggccacgtgggctcagtaaattctatcaaatttcatccctcagagcagttggctctcactgcttctggagatcagactgctcatatctggagatacgcggtgcagctgccgacaccccagcctgttgctgacactagtatatctggggaagatgaagtagagtgctctgacaaggacgagcccgacctcgatggggatgtgtccagcgactgccccaccatccgcgtcccactgacatccctcaagagccaccagggcgtggtcatcgcctccgactggctggttggggggaagcaggctgtgactgcctcctgggaccggacggcaaacctgtacgacgtggagacgtccgagctcgttcactctctgacagggcacgaccaggagttgacgcactgctgcacacaccccacccagcggctcgtggtgacctcctcccgtgacacgactttccgcctctgggatttcagggacccctccatccactcggtgaatgttttccagggacacacggacactgtgacttctgccgtgttcaccgtgggagacaacgtggtttcaggcagcgatgaccgcacggtgaaagtctgggacttgaaaaatatgagatcccccattgcaactattcgcacggactctgccattaacaggatcaatgtatgtgtcggccaaaaaatcatagccctcccccatgacaaccgacaagtgagactgtttgatatgtcaggagtgcgcctggcgcggcttccccggagcagccgacagggccacaggagaatggtatgctgctcggcatggagtgaagaccaccccgtgtgcaatctgttcacctgtgggtttgaccggcaagccattggttggaacatcaacatccctgcattgctacaagaaaaataaggacaccggcagcccttagtttcactgtttgccagcacagacctttgatgggtgcaggcttttctgcgtattaatcagccatttttgtgagagtttgaccctggaaagggtgctttgtatatgttcttttcacatagtgcccagcttgcatgaaatgtacagagaaatgtgtggtcgtattttttacttttgtcttgtatatgtatgtatattgggtcctctgggcagtagaggcaaagctcacctcccatgtagcacatgaaatgcttgtgagttgttgacattggacaggtgaacagtagggcattacatttgtgtgaattaaatgtgaacttctgtattacgttgcggcgtcggcagtcctgcgttccctggagtaactgtacgtatctgcctttgctgggaagactgtggggctgcctgtgttggctggcgaccagcaggattgctccaggattttgtgtttacctcgcgtgaagttcagcacgtgctgtcgtgtagtcagcttctactctaatttctgttacagttctgcaaaggtaacctggagtttagaagttaaaaaaaagcatgggatgttggatttgcaccatttggagtttctttaggaaagaaaagttttctgcttttttatagaaaatcatttcagtctcccgaggtctcatgctagcaaattttgaaataggattctaatcactgatttcaaatattaagcaaaatgtaaagcactttaatttatagctatggttataaacaggttttagatgtttcaaatgacttgtccactgaatgtcacttgaccttgataagaggccgcctgcacacagagcccagttaattctccgcacctcggttgtgtgcttccgaatgggctcactcccgtggtggtgtttgagagccaacaacactacctcagagacgggtctttgggaaactttgggtctcactgttgcctggctggagcactttggtttatagctggaatactgagttcagttcagaaggcaggaaagacagtcacaccgacgtgtcctgaaggtgtaggctctccacttaggcgcacaagctgacggctgcagccagcaggccccggtgacgagacacttccaggtcttgtggtggggacgcctctcagtgccagtcccgccactgctgagtgagcctggtgttcttgccttcttggaaattactgctcacctggtatctgtacgttaatgtttcttgctgagttacagttttgataaagaggctctcatttcctgtgtcttgtatattcagtcctttcaatacgtccacctggaggctcaccacttggagagacacaggaaggtaatatttacagctgtcatgtgacatccccaggtctttgtgttttgccctgttttacggtgaggtaggagggaacccatctggggaccggtaggtgcaggtgcagtaggacgtgggacttttggacccgtcctttggtgcagctcgccagggatgagaggcacctccctacttgggtcttcaggagctggtccaaggagcttcgaatctaagtcatctagaatgaccctgaaatgactgacagccccgggcccaagaaaaacccataaccacctcagatggatctgacgtggctaagggacaaacagcaaatatttcagtcattttgattttacaaataaaaaatgtgttgtgtttttgtccgacattatttcctgactgcactgttctgagaatggagtccacctggtccctctggttgattagaatctcaggtttcagctcctgctgtcctgagcgaacttgcctgatgcagggctgtgctgtgtccagatgttgctggggcctcactttttctcttggctggaggtccaattgccagagcctcccacactgcacatacaaaggtctgagcccagggcagcttctggggccactgcacaggccacctgcttgggttcctcggagtttaatttgaaagtctgggtgtcttaggatgatggttaggaacattgaaaaatggctgcaaatagccaaatcaaacttaagaaccagatctctgccagattaaacatttttgaagcttttaaaagtcaatattcctagtggccactgagttccaggcacactggtgccctttactgccacagctgctcaccttgtctggcaaactggagggacctcagaaactggactcctgcatgtccttgggggcgcagccctgtggtgctcaggcagagctctcaggagccggggcaccttgctgttcgctgctgtgtcgtcttctaatgtgagctcatccactgctgctgcagcgtggtgatcaggagtcacagacaagatcggggatggtgtgtgtgtgtgtgtgtgtgtgtgtgtgcacgtgtgtgtggctaaattaagtcatactgtcaaccacacgtgatctcgtctgaaacagtgtttggaagtgggaacagttttgtcctgtatgctgatgtgtccagaatttcatttaatgatagacggaaaatgtgtggttactgaaaactgtatatgatacagaatttcataagagccatgctgttgggcaaagcaactctttttcaaccactgctcatcagtttctgtagagacaaaaactctgtacatattttggaatctgaagaatcctatgtaaatcatttgttacttaagtctgtgaaaaacatatttctttggaggaaaatgtatgcatttataagtgttccatggaatcagtttttattgtatcgatataattgtctctaagtgttgactgtcttcattgcaatatgaaattcattaaaatgtccatgttccataattactattataaaagctttgtgttattgggagtcttattatttttatagtttttcatgttttgctttggtgaaacattgtgaatgactatataaacatcacgatgagctagaaattgaacaaatataatactggtcactcg

SEQ ID NO: 199778 - DNA, 1307 bp, Homo sapiens
  Payload ID: 19417
  Gene Name: WD repeat domain 37
  ENST ID: ENST00000381329
  CDS Start-End: 202-951
ctgaccgcgccgtccccgccaggctcccgcgcggccggcaccgcggccctgagcgcaggcggccccgggtctcaggcctcaggcggaccgcgccccgggctcgcagccctcccgccccggctgccgggctacggggcagatggactcggagcgccccgccgcttattgcaggagtgaccaggacactacctcctagaagtaatgcccacagaaagcgcaagttgttcgactgctcgccaaacaaaacagaagcgcaaatcccatagcctttctatacgaagaactaacagctcggagcaggagaggacgggactgccaagagacatgttagaaggacaagattctaaactgccttcctcggttcgcagtacacttctggaactgtttggtcaaatagaaagagaatttgaaaacctttatatcgaaaacttagaattacgtagagaaatcgacactcttaatgaacgtttagctgctgaaggacaagcgattgatggagcagagctgagtaagggccaactcaaaacaaaagccagtcacagcaccagccagctctcccagaaactgaagaccacttacaaggcttccaccagcaagattgtctccagctttaagaccacgacatcgagagctgcctgccagctcgtgaaggagtacatcggccaccgggacggcatctgggatgtcagcgtggccaagacacagccagtggtgctcgggactgcatcagccgatcacacggctttgctgtggagcatagagacagggaagtgcctagtcaagtacgcaggccacgtgggctcagtaaattctatcaaatttcatccctcagagcagttggctctcactgcttctggagatcagactgctcatatctggagatacgcggtgcagctgccgacaccccagcctgttgctgacactagtgtaagcacctttccttacctgtgaatgtgtaggatgctgatgtctgcgaatctgagaatccatttatgatatctgtcatggacggaatgtttgtgtccccccaagttcagtgttgaaggcctcacccccggtatggttgaatttggagattgggcctctaaggtagtagttaaggttcagtgaggttgcgtgaggtcctcataagaggagacagtggagagctcacctgtgttctcaatctctctgtcactctccgtgtcacgtaagagcagagccagagggcggccgtctttaaggatgagcccgcaccagaacctgaattggcttgatcttggacttccagcctccagcactgtgagaaaataaatgtctgtttttta

SEQ ID NO: 199779 - DNA, 714 bp, Homo sapiens
  Payload ID: 19417
  Gene Name: WD repeat domain 37
  ENST ID: ENST00000436154
  CDS Start-End: 88-714
ggtctccaagccgcacggcctcgtcctctgctccacctttggcctgtgtctcccacgctcgctccctagacggagctcatttgttcaatgagcagtgattcggagtgggaccggtcagcatgttctgattctaaactgccttcctcggttcgcagtacacttctggaactgtttggtcaaatagaaagagaatttgaaaacctttatatcgaaaacttagaattacgtagagaaatcgacactcttaatgaacgtttagctgctgaaggacaagcgattgatggagcagagctgagtaagggccaactcaaaacaaaagccagtcacagcaccagccagctctcccagaaactgaagaccacttacaaggcttccaccagcaagattgtctccagctttaagaccacgacatcgagagctgcctgccagctcgtgaaggagtacatcggccaccgggacggcatctgggatgtcagcgtggccaagacacagccagtggtgctcgggactgcatcagccgatcacacggctttgctgtggagcatagagacagggaagtgcctagtcaagtacgcaggccacgtgggctcagtaaattctatcaaatttcatccctcagagcagttggctctcactgcttctggagatcagactgctcatatctggagatacgcggtgcagctgccgacaccccagcctgttgctgacactagt

SEQ ID NO: 199780 - DNA, 1303 bp, Homo sapiens
  Payload ID: 19417
  Gene Name: WD repeat domain 37
  ENST ID: ENST00000620998
  CDS Start-End: 202-993
ctgaccgcgccgtccccgccaggctcccgcgcggccggcaccgcggccctgagcgcaggcggccccgggtctcaggcctcaggcggaccgcgccccgggctcgcagccctcccgccccggctgccgggctacggggcagatggactcggagcgccccgccgcttattgcaggagtgaccaggacactacctcctagaagtaatgcccacagaaagcgcaagttgttcgactgctcgccaaacaaaacagaagcgcaaatcccatagcctttctatacgaagaactaacagctcggagcaggagaggacgggactgccaagagacatgttagaaggacaagattctaaactgccttcctcggttcgcagtacacttctggaactgtttggtcaaatagaaagagaatttgaaaacctttatatcgaaaacttagaattacgtagagaaatcgacactcttaatgaacgtttagctgctgaaggacaagcgattgatggagcagagctgagtaagggccaactcaaaacaaaagccagtcacagcaccagccagctctcccagaaactgaagaccacttacaaggcttccaccagcaagattgtctccagctttaagaccacgacatcgagagctgcctgccagctcgtgaaggagtacatcggccaccgggacggcatctgggatgtcagcgtggccaagacacagccagtggtgctcgggactgcatcagccgatcacacggctttgctgtggagcatagagacagggaagtgcctagtcaagtacgcaggccacgtgggctcagtaaattctatcaaatttcatccctcagagcagttggctctcactgcttctggagatcagactgctcatatctggagatacgcggtgcagctgccgacaccccagcctgttgctgacactagtgtaagcacctttccttacctgatgtgtaggatgctgatgtctgcgaatctgagaatccatttatgatatctgtcatggacggaatgtttgtgtccccccaagttcagtgttgaaggcctcacccccggtatggttgaatttggagattgggcctctaaggtagtagttaaggttcagtgaggttgcgtgaggtcctcataagaggagacagtggagagctcacctgtgttctcaatctctctgtcactctccgtgtcacgtaagagcagagccagagggcggccgtctttaaggatgagcccgcaccagaacctgaattggcttgatcttggacttccagcctccagcactgtgagaaaataaatgtctgtttttt

SEQ ID NO: 199781 - DNA, 1252 bp, Homo sapiens
  Payload ID: 19418
  Gene Name: WD repeat domain 38
  Uniprot ID: Q5JTN6
  ENST ID: ENST00000373574
  CDS Start-End: 57-1001
gggtcccgcggccgcctaggagggagcccgccggggcggggcggggccgggtgcccatgaacagcggggtcccggccacgctggccgtgcggagagtgaaattcttcggccagcacggcggggaggtcaactcttctgccttctcccctgatggccagatgctgctcacaggctcagaagatggctgcgtgtatggctgggagacccggagtgggcagctgctgtggaggctgggtggccacacaggccccgtgaagttctgccgcttctcccctgatggccacctcttcgccagcgcctcctgtgactgcactgtccgcctgtgggatgtggcaagagcgaagtgtctgcgggtcctgaagggtcaccaacggagtgtggagacggtcagcttcagccctgactcgagacagctggcatcaggtggctgggacaagcgggtgatgctctgggatgtgcagtccggccagatgctgcgcctcttagttgggcaccgtgactccatccagagcagcgacttctcacccacggtgaactgcctggccaccggctcctgggactccaccgtacacatctgggacctgcggatggtgaccccagcagtctcccaccaggcgctagagggacacagtgccaacatcagctgcctgtgctattcagcatccggcctcctggcatccggctcctgggacaagaccatccacatctggaagcccacaaccagcagcctgcttatccaactgaagggccatgtcacctgggtgaagagcatagccttctctcccgacgagctgtggctggccagcgccggctattcccgcatggtcaaagtctgggactgcaacacaggaaagtgccttgagaccctgaagggagtcctggatgtggcccacacctgtgccttcaccccagatgggaaaatcttagtgtctggagctgccgatcagactagacgtcaaatatcccgcacgtccaaatcacccagggaccctcaaacctaacaccaaccaccttagatggtgccgacctcacccgctcccctcagtggcgcacaggcatgccgcttctccccacagacgcaaagtgactgtgctggcatccagcagatccccatggccaggactctccaggccccaccagagcagacaactgtggtgggcaggacgcttgctggaacccatcagacacctggtccccaaaaccagacccacccacctccacccaatcagtggaagtgccaggaaacaaagca

SEQ ID NO: 199782 - DNA, 1323 bp, Homo sapiens
  Payload ID: 19418
  Gene Name: WD repeat domain 38
  ENST ID: ENST00000613760
  CDS Start-End: 116-1063
gccccgattaccatggagaccgcctgtacacagtttcctctttcctctgcccagtcctggggtcccgcggccgcctaggagggagcccgccggggcggggcggggccgggtgcccatgaacagcggggtcccggccacgctggccgtgcggagagtgaaattcttcggccagcacggcggggaggtcaactcttctgccttctcccctgatggccagatgctgctcacaggctcagaagatggctgcgtgtatggctgggagacccggagtgggcagctgctgtggaggctgggtggccacacaggccccgtgaagttctgccgcttctcccctgatggccacctcttcgccagcgcctcctgtgactgcactgtccgcctgtgggatgtggcaagagcgaagtgtctgcgggtcctgaagggtcaccaacggagtgtggagacggtcagcttcagccctgactcgagacagctggcatcaggtggctgggacaagcgggtgatgctctgggatgtgcagtccggccagatgctgcgcctcttagttgggcaccgtgactccatccagagcagcgacttctcacccacggtgaactgcctggccaccggctcctgggactccaccgtacacatctgggacctgcggatggtgaccccagcagtctcccaccaggcgctagagggacacagtgccaacatcagctgcctgtgctattcagcatccggcctcctggcatccggctcctgggacaagaccatccacatctggaagcccacaaccagcagcctgcttatccaactgaagggccatgtcacctgggtgaagagcatagccttctctcccgacgagctgtggctggccagcgccggctattcccgcatggtcaaagtctgggactgcaacacaggaaagtgccttgagaccctgaagcagggagtcctggatgtggcccacacctgtgccttcaccccagatgggaaaatcttagtgtctggagctgccgatcagactagacgtcaaatatcccgcacgtccaaatcacccagggaccctcaaacctaacaccaaccaccttagatggtgccgacctcacccgctcccctcagtggcgcacaggcatgccgcttctccccacagacgcaaagtgactgtgctggcatccagcagatccccatggccaggactctccaggccccaccagagcagacaactgtggtgggcaggacgcttgctggaacccatcagacacctggtccccaaaaccagacccacccacctccacccaatcagtggaagtgccaggaaacaaagcagtctcagcc

SEQ ID NO: 199783 - DNA, 1270 bp, Homo sapiens
  Payload ID: 19418
  Gene Name: WD repeat domain 38
  ENST ID: ENST00000618744
  CDS Start-End: 210-1010
gccccgattaccatggagaccgcctgtacacagtttcctctttcctctgcccagtcctggggtcccgcggccgcctaggagggagcccgccggggcggggcggggccgggtgcccatgaacagcggggtcccggccacgctggccgtgcggagagtgaaattcttcggccagcacggcggggaggtcaactcttctgccttctcccctgatggccagatgctgctcacaggctcagaagatggctgcgtgtatggctgggagacccggagtgggcagctgctgtggaggctgggtggccacacagatggtgctgtgtcctgtgtcacgtcacctttccaccttccccgaccccgggctggtgcctgcaggtcaccaacggagtgtggagacggtcagcttcagccctgactcgagacagctggcatcaggtggctgggacaagcgggtgatgctctgggatgtgcagtccggccagatgctgcgcctcttagttgggcaccgtgactccatccagagcagcgacttctcacccacggtgaactgcctggccaccggctcctgggactccaccgtacacatctgggacctgcggatggtgaccccagcagtctcccaccaggcgctagagggacacagtgccaacatcagctgcctgtgctattcagcatccggcctcctggcatccggctcctgggacaagaccatccacatctggaagcccacaaccagcagcctgcttatccaactgaagggccatgtcacctgggtgaagagcatagccttctctcccgacgagctgtggctggccagcgccggctattcccgcatggtcaaagtctgggactgcaacacaggaaagtgccttgagaccctgaagcagggagtcctggatgtggcccacacctgtgccttcaccccagatgggaaaatcttagtgtctggagctgccgatcagactagacgtcaaatatcccgcacgtccaaatcacccagggaccctcaaacctaacaccaaccaccttagatggtgccgacctcacccgctcccctcagtggcgcacaggcatgccgcttctccccacagacgcaaagtgactgtgctggcatccagcagatccccatggccaggactctccaggccccaccagagcagacaactgtggtgggcaggacgcttgctggaacccatcagacacctggtccccaaaaccagacccacccacctccacccaatcagtggaagtgccaggaaacaaagcagtctcagcc

SEQ ID NO: 199784 - DNA, 1471 bp, Homo sapiens
  Payload ID: 19419
  Gene Name: WD repeat domain 4
  Uniprot ID: P57081
  ENST ID: ENST00000330317
  CDS Start-End: 37-1275
ctggcacatgtgtatggcggtgaggcgggcgggtacatggcgggctctgtgggactggcgttgtgcgggcagacgttggtggtgcggggcggcagccgattcctggccacctccatagcaagcagtgatgatgacagcctcttcatctatgactgcagtgctgcagaaaagaagtcacaagaaaataaaggggaggacgcgcccttggaccaggggagcggtgcgattctggcgtccaccttctccaagtctggcagctattttgctttaaccgatgacagtaagcgtctgattcttttccgtacaaaaccatggcaatgtctgagtgtcaggaccgtggcaaggaggtgtacagccctgactttcatagcctcggaggagaaggtcttggtggccgacaagtctggagacgtctactccttttcggtgctggagccacacgggtgtggccgtctagagctggggcacctgtctatgctgttagatgtggctgtgagtcctgatgaccgcttcatcctcactgccgaccgggacgagaagatccgagtcagctgggccgcggcgccccatagcatcgagtccttctgcttggggcacacagagtttgtgagccgtatctccgtggtgccaactcagcccgggctgcttctgtcctcctctggggacggcaccctgaggctctgggagtacaggagcggccgccagctgcactgctgtcacctggccagtctgcaggagctggtggacccccaggccccccagaagtttgccgcgtccaggattgcattctggtgccaggagaactgcgtggcgctcctgtgcgacggcactcctgtggtctacatcttccagctggacgcccgcagacagcagttggtgtacaggcagcagctggcgttccagcaccaagtgtgggacgtggctttcgaggagacccaggggctgtgggtgctccaggactgccaggaagcccccctggtgctctacaggcctgtgggcgaccagtggcagtctgttcctgagagcaccgtgttaaagaaagtctctggtgttcttcgtgggaactgggccatgctggaaggctctgccggcgcagacgccagcttcagcagtctctacaaggccacgttcgacaacgtgacctcctacctgaagaagaaagaggagagactgcagcagcagctagagaagaagcagcggcgccggagtcccccgcctgggcccgacgggcatgccaagaagatgagaccgggggaggcgacgctaagttgctgatcgtggcggtctgtttctgtcgactgtggaccacttatgtgcgatccgtggaccacttgcgtgcgatctgtcggccgacgatgagcttgttcggatgtagctccatcgtaagtcgaggagcatctgtgatttgtcctctgcttatgggatatgtttttccgctactgagtctgtgtagtaaatttttgactaggaa

SEQ ID NO: 199785 - DNA, 2122 bp, Homo sapiens
  Payload ID: 19419
  Gene Name: WD repeat domain 4
  Uniprot ID: P57081
  ENST ID: ENST00000398208
  CDS Start-End: 61-1299
gtgcggacaggaagaggctctgggctggcacatgtgtatggcggtgaggcgggcgggtacatggcgggctctgtgggactggcgttgtgcgggcagacgttggtggtgcggggcggcagccgattcctggccacctccatagcaagcagtgatgatgacagcctcttcatctatgactgcagtgctgcagaaaagaagtcacaagaaaataaaggggaggacgcgcccttggaccaggggagcggtgcgattctggcgtccaccttctccaagtctggcagctattttgctttaaccgatgacagtaagcgtctgattcttttccgtacaaaaccatggcaatgtctgagtgtcaggaccgtggcaaggaggtgtacagccctgactttcatagcctcggaggagaaggtcttggtggccgacaagtctggagacgtctactccttttcggtgctggagccacacgggtgtggccgtctagagctggggcacctgtctatgctgttagatgtggctgtgagtcctgatgaccgcttcatcctcactgccgaccgggacgagaagatccgagtcagctgggccgcggcgccccatagcatcgagtccttctgcttggggcacacagagtttgtgagccgtatctccgtggtgccaactcagcccgggctgcttctgtcctcctctggggacggcaccctgaggctctgggagtacaggagcggccgccagctgcactgctgtcacctggccagtctgcaggagctggtggacccccaggccccccagaagtttgccgcgtccaggattgcattctggtgccaggagaactgcgtggcgctcctgtgcgacggcactcctgtggtctacatcttccagctggacgcccgcagacagcagttggtgtacaggcagcagctggcgttccagcaccaagtgtgggacgtggctttcgaggagacccaggggctgtgggtgctccaggactgccaggaagcccccctggtgctctacaggcctgtgggcgaccagtggcagtctgttcctgagagcaccgtgttaaagaaagtctctggtgttcttcgtgggaactgggccatgctggaaggctctgccggcgcagacgccagcttcagcagtctctacaaggccacgttcgacaacgtgacctcctacctgaagaagaaagaggagagactgcagcagcagctagagaagaagcagcggcgccggagtcccccgcctgggcccgacgggcatgccaagaagatgagaccgggggaggcgacgctaagttgctgatcgtggcggtcagtggtgtctctcacctcaaattaggaaaagctttttaacttgttcccctgcatcctggcatgtcccttcaagaaggaaaaggtgacatcagttgtgaccagctcagaggatggggctgtcccctgggctctagaaagaacattctgtgtcaccagcacaggctcttgctgggtgcctgtgccccctttctggttgaagggaagccagaccagtggagtggaagctcttgaagcactttcttttcatgtcggaggctgcgtgtgagccggtggtggcggcagctgtctgtgtttctcctgttctcataccgcccttcgtgtccgctgcatcttcctctaggagcatctgtgggctgacgtttctggcatggtggatgttttcatgttgttccgccgtctcagcatccaggtgacgtgctgtcccgcagtagctgctcgccacacaggctgttgaaactcagcacgaatgcttgagcctgccccagccccagccgtagcccttgtgctcaggagctgctcctggagagtggctcccttgtgggaagtgagaaacacgtttcggagtcgcagggagctctgtctggcatcggtggcacagatggtgaacttgtttcaggaagtgtgagcacgggcctggctggcacccggtttacagggaggtgattgaggacgtcgttatgatttgatttgaccttggcacacactgcagagccacagggatgttgctgaatttcaatcaccgatcagcaaggatgaaccttctcaacttcctaggaatgtttagcagcaaccgaatataccaggcaaaactc

SEQ ID NO: 199786 - DNA, 3958 bp, Homo sapiens
  Payload ID: 19420
  Gene Name: WD repeat domain 41
  Uniprot ID: Q9HAD4
  ENST ID: ENST00000296679
  CDS Start-End: 377-1756
gtcgggttgctgctccgcgcgcgtccaccaggggccgctcgagctacctaagctccgtgcgctacccggcggcgctcccgcgcgtgctcactcggagcagcgcgcgccccgcaatcgccgcagccgcccccgccgtcggccgccgcaccccaagcgactgcccaaactaagcctccgtggctgggtacgggagcgctttggggacaaaaattctccctcaactgtggtctgcattccttcggcccgtgggctgatctggggcgggaagtattagcgtctcagttgcgctgcagccggggaggaaggaggaggccgagcctggggcggagtttgggctgactggggctggaccgggcaagacgccgccgctgcccggatgttgcgatggctgatcgggggaggccgagaaccgcagggactggccgagaaatctcctttacagacaataggtgaagaacaaacccagaatccctacactgaactgctagtactgaaggctcatcatgatattgtacgatttctggtacagttagatgactacagatttgcatctgctggtgatgatggaattgtagttgtgtggaatgcccagacaggggaaaaacttttagaactgaatggacacactcaaaagataacagctattattacatttccttccttggaatcttgtgaagagaaaaatcaactcatcttgacagcctctgctgatagaacagttattgtgtgggatggtgatactaccagacaagttcagagaatatcatgcttccagtctactgtaaagtgtttaactgttcttcagagactagatgtttggctttctggtgggaatgacctgtgtgtgtggaaccgaaaattagatctcctgtgtaagactagccacctttctgatacaggtattagtgctttggttgaaatacctaagaactgtgttgtggcagcagttggcaaagaactgataattttcaggttggtagcacccacagaaggatcactagaatgggatattcttgaagttaagcgcctccttgatcaccaggataatattctctcattgattaatgtcaatgatttgagttttgtcaccggctcccacgtcggagagctgatcatctgggatgccctggactggaccatgcaggcctatgaacgcaacttctgggacccatctccacaactggacacccaacaagaaataaaactctgtcaaaaatcaaatgacatttctattcatcatttcacatgtgatgaagagaatgtatttgctgcagttggaaggggtttatacgtgtatagccttcaaatgaagcgtgtgattgcctgccagaaaactgcacatgactccaatgtcctgcacgttgccagacttccaaacaggcagttaatctcatgctcagaagatggcagtgtacgcatttgggagttaagagaaaaacagcagcttgcagctgagcctgtaccaacaggtttttttaacatgtggggatttggaagagtcagcaaacaagccagccaacctgttaaaaagcagcaagaaaatgctacttcatgttcactggagcttattggagatttgattggacactcatcatctgtggagatgtttctatactttgaagatcatggactagtgacgtgctccgctgatcatctcattattttgtggaaaaatggagagcgagaatctggattgcgcagtttaagattatttcaaaaattagaggagaatggtgacttataccttgctgtctagtttaaggaattaaaaatacacatgcatgaaccttgaacatcaaatatcgggtactactctgaaaaccattaatatattgatcacttaaattggtaattttttttgtcagtccataaaattctacatgtttaaattttttgtggacctaccaaccaggaacatgttgcttctcaggtcctagtatatcctccaaagaatataccacaagtttttccatttgactttgagctgctgttgaagtggtgagtgctgtgttttgagcttattttgaacctagatccttgtgaaaggtacaaatagaggtaatagttaagttatggcatttattagaagttttattatttggcttcctttagaattattgtgaagtttaaaaatagcctttctcctgcaaattttcctagtctttagtaactgttagtgttctatatagcacaaacttgaatctctcagccaaaaaagggaacatatatactgtttaagtatggcaagttttctttggtaccaatttgtttagataattttaaaaatgttttttagttctagctactaaaacctgtatgaactcaaatggataggcatcttgtgagggtgtgtttttcccagtgtgaattggcttgaagagccatgggctaaatgggtactagaacaacaactgcccctcatgtacgccaaggatgagctctagatcatttgagaggcacagtgtttccggagtcagggactgcagctgagcgcaactgccccatctgaccactgactcaaatacgaactgcttgagacagacttcttttatgtagttctttgcagtgtccattgagacactataaccagccttgtaacaatatgttttctccttttggtgctaaaaaatgaaaatattagaaagtagtctacacattaaagattgaaattcttaaactactgatgaagaaagggcaacgtgacagatgttagcagactgacccttcttacagaaaacctacagatttatttgttcattatacaaatatactacaaatataccctaaagggaatctccataagttcttttactagttttagctttgacagttgcttccacaactacctacaaagactggaagagttaaggtcatctgagtagaccagtggcataatgttacaaatgaggaaactgaggcccagtgcagtaaggccttgcaattaaatctgtagtgcccagtatcaccaagcagctctaaaaacaggaactgaagactgaatgagaaaaggcttatatgactactttaaatccaaacaacattgagtcatgaaaagttctatggagaaatattaaaacttaagctacctcaattacagaagactttctcccattattcacgtgctttttcctttagaaattctgcattggcccatacatttgtaaagttgttttctgaagttgtatgacacaagggagccatagacttaactgttttacttcctagcctgttctaggctagtattttgtgatagtaatctattcaaatggagtggtagaaatcacatgaattttggaagcaaatggtaccgtaagtaccacagcaaattccttctggtcattatacaggcgtacctcagagatactacaggttaggtttcagaccacatcaaaaaagcaactattgcaaatagagtgagtcacatctagtttttggtttcccagtgcctataaaacttgtgtttatactacagtcttaaatttctaaaaaatgtacataccttaagaatactttattgctaaaaaatgctaacaatcatctgagccttcagcgagtcataatctttttgctggtggagggtcttgatactgctggctgttgactaaggtggttactgaaggttggggtggctgtggcagttccttaaaataagatagcgatgaagttttccaaatcaattgacttcctttcacaaatgagatctctgtaacatgtaatactatttaatagcattttacccacagtagaacttctttcaaaatttagagtctgtcatctcaaatcctgatgctcctttatgaactaagtttatagaatattctaaatcctttgttgtcatttcaactatgtttacagcatcttcactgtggaaatgactgtctccagaaaccactttctatacacattcttaagcaacttctcatctattaaagtttgatcatgagattacagcaattca

SEQ ID NO: 199787 - DNA, 2338 bp, Homo sapiens
  Payload ID: 19420
  Gene Name: WD repeat domain 41
  ENST ID: ENST00000414719
  CDS Start-End: 70-654
ggaggccgagcctggggcggagtttgggctgactggggctggaccgggcaagacgccgccgctgcccggatgttgcgatggctgatcgggggaggccgagaaccgcagggactggccgagaaatctcctttacagacaataggtgaagaacaaacccagaatccctacactgaactgctagtactgaaggctcatcatgatattgtacgatttctggtacagttagatgactacagatttgcatctgctggtgatgatggaattgtagttgtgtggaatgcccagacaggggaaaaacttttagaactgaatggacacactcaaaagataacagctattattacatttccttccttggaatcttgtgaagagaaaaatcaactcatcttgacagcctctgctgatagaacagttattgtgtgggatggtgatactaccagacaagttcagagaatatcatgcttccagtctactgtaaagtgtttaactgttcttcagagactagatgtttggctttctggtgggaatgacctgtgtgtgtggaaccgaaaattagatctcctgtgtaagactagccacctttctgatacaggtattagtgctttggttgaaatacctaagaactgtgtttggcagcagttggcaaagaactgataattttcaggttggtagcacccacagaaggatcactagaatgggatattcttgaagttaagcgcctccttgatcaccaggataatattctctcattgattaatgtcaatgatttgagttttgtcaccggctcccacgtcggagagctgatcatctgggatgccctggactggaccatgcaggcctatgaacgcaacttctgggacccatctccacaactggacacccaacaagaaataaaactctgtcaaaaatcaaatgacatttctattcatcatttcacatgtgatgaagagaatgtatttgctgcagttggaaggggtttatacgtgtatagccttcaaatgaagcgtgtgattgcctgccagaaaactgcacatgactccaatgtcctgcacgttgccagacttccaaacaggcagttaatctcatgctcagaagatggcagtgtacgcatttgggagttaagagaaaaacagcagcttgcagctgagcctgtaccaacaggtttttttaacatgtggggatttggaagagtcagcaaacaagccagccaacctgttaaaaagcagcaagaaaatgctacttcatgttcactggagcttattggagatttgattggacactcatcatctgtggagatgtttctatactttgaagatcatggactagtgacgtgctccgctgatcatctcattattttgtggaaaaatggagagcgagaatctggattgcgcagtttaagattatttcaaaaattagaggagaatggtgacttataccttgctgtctagtttaaggaattaaaaatacacatgcatgaaccttgaacatcaaatatcgggtactactctgaaaaccattaatatattgatcacttaaattggtaattttttttgtcagtccataaaattctacatgtttaaattttttgtggacctaccaaccaggaacatgttgcttctcaggtcctagtatatcctccaaagaatataccacaagtttttccatttgactttgagctgctgttgaagtggtgagtgctgtgttttgagcttattttgaacctagatccttgtgaaaggtacaaatagaggtaatagttaagttatggcatttattagaagttttattatttggcttcctttagaattattgtgaagtttaaaaatagcctttctcctgcaaattttcctagtctttagtaactgttagtgttctatatagcacaaacttgaatctctcagccaaaaaagggaacatatatactgtttaagtatggcaagttttctttggtaccaatttgtttagataattttaaaaatgttttttagttctagctactaaaacctgtatgaactcaaatggataggcatcttgtgagggtgtgtttttcccagtgtgaattggcttgaagagccatgggctaaatgggtactagaacaacaactgcccctcatgtacgccaaggatgagctctagatcatttgagaggcacagtgtttccggagtcagggactgcagctgagcgcaactgccccatctgaccactgactcaaatacgaactgcttgagacagacttcttttatgtagttctttgcagtgtccattgagacactataaccagccttgtaacaatatgttttctccttttggtgctaaaaaatgaaaatattagaaagt

SEQ ID NO: 199788 - DNA, 854 bp, Homo sapiens
  Payload ID: 19420
  Gene Name: WD repeat domain 41
  ENST ID: ENST00000503035
  CDS Start-End: 258-341
gcagccgcccccgccgtcggccgccgcaccccaagcgactgcccaaactaagcctccgtggctgggtacgggagcgctttggggacaaaaattctccctcaactgtggtctgcattccttcggcccgtgggctgatctggggcgggaagtattagcgtctcagttgcgctgcagccggggaggaaggaggaggccgagcctggggcggagtttgggctgactggggctggaccgggcaagacgccgccgctgcccggatgttgcgatggctgatcgggggaggccgagaaccgcagggactggccgaggtaaaccccggaaatctcctttacagacaataggtgaagaacaaacccagaatccctacactgaactgctagtactgaaggctcatcatgatattgtacgatttctggtacagttagatgactacagatttgcatctgctggtgatgatggaattgtagttgtgtggaatgcccagacaggggaaaaacttttagaactgaatggacacactcaaaagataacagctattattacatttccttccttggaatcttgtgaagagaaaaatcaactcatcttgacagcctctgctgatagaacagttattgtgtgggatggtgatactaccagacaagttcagagaatatcatgcttccagtctactgtaaagtgtttaactgttcttcagagactagatgtttggctttctggtgggaatgacctgtgtgtgtggaaccgaaaattagatctcctgtgtaagactagccacctttctgatacaggtattagtgctttggttgaaatacctaagaactgtgttgtggcagcagttggcaaagaactga

SEQ ID NO: 199789 - DNA, 805 bp, Homo sapiens
  Payload ID: 19420
  Gene Name: WD repeat domain 41
  ENST ID: ENST00000511036
  CDS Start-End: 268-805
cgcaatcgccgcagccgcccccgccgtcggccgccgcaccccaagcgactgcccaaactaagcctccgtggctgggtacgggagcgctttggggacaaaaattctccctcaactgtggtctgcattccttcggcccgtgggctgatctggggcgggaagtattagcgtctcagttgcgctgcagccggggaggaaggaggaggccgagcctggggcggagtttgggctgactggggctggaccgggcaagacgccgccgctgcccggatgttgcgatggctgatcgggggaggccgagaaccgcagggactggccgagacaataggtgaagaacaaacccagaatccctacactgaactgctagtactgaaggctcatcatgatattgtacgatttctggtacagttagatgactacagatttgcatctgctggtgatgatggaattgtagttgtgtggaatgcccagacaggggaaaaacttttagaactgaatggacacactcaaaagataacagctattattacatttccttccttggaatcttgtgaagagaaaaatcaactcatcttgacagcctctgctgatagaacagttattgtgtgggatggtgatactaccagacaagttcagagaatatcatgcttccagtctactgtaaagtgtttaactgttcttcagagactagatgtttggctttctggtgggaatgacctgtgtgtgtggaaccgaaaattagatctcctgtgtaagactagccacctttctgatacaggtattagtgctttggttgaaatacctaaga

SEQ ID NO: 199790 - DNA, 543 bp, Homo sapiens
  Payload ID: 19420
  Gene Name: WD repeat domain 41
  ENST ID: ENST00000509971
  CDS Start-End: 92-543
agaatgaaaagaatgggcagcctagtggttgctcaggtgagcgcaggtacacagaccaggaagtatctctgctcctaacctctctttatgtatgcatgaagctaattgttcaagtccaggggaaactggtgagaaatctcctttacagacaataggtgaagaacaaacccagaatccctacactgaactgctagtactgaaggctcatcatgatattgtacgatttctggtacagttagatgactacagatttgcatctgctggtgatgatggaattgtagttgtgtggaatgcccagacaggggaaaaacttttagaactgaatggacacactcaaaagataacagctattattacatttccttccttggaatcttgtgaagagaaaaatcaactcatcttgacagcctctgctgatagaacagttattgtgtgggatggtgatactaccagacaagttcagagaatatcatgcttccagtctactgtaaagtgtttaactgttcttcagagactagatgtttggctttctggtgggaatga

SEQ ID NO: 199791 - DNA, 577 bp, Homo sapiens
  Payload ID: 19420
  Gene Name: WD repeat domain 41
  ENST ID: ENST00000513417
  CDS Start-End: 1-186
atgttgcgatggctgatcgggggaggccgagaaccgcagggactggccgagaaatctcctttacagacaataggtgaagaacaaacccagaatccctacactgaactgctagtactgaaggctcatcatgatattgtacgatttctggtacagttagatgactacagacaggggaaaaacttttagaactgaatggacacactcaaaagataacagctattattacatttccttccttggaatcttgtgaagagaaaaatcaactcatcttgacagcctctgctgatagaacagttattgtgtgggatggtgatactaccagacaagttcagagaatatcatgcttccagtctactgtaaagtgtttaactgttcttcagagactagatgtttggctttctggtgggaatgacctgtgtgtgtggaaccgaaaattagatctcctgtgtaagactagccacctttctgatacaggtattagtgctttggttgaaatacctaagaactgtgttgtggcagcagttggcaaagaactgataattttcaggttggtagcacccacagaaggatcactaga

SEQ ID NO: 199792 - DNA, 429 bp, Homo sapiens
  Payload ID: 19420
  Gene Name: WD repeat domain 41
  ENST ID: ENST00000511791
  CDS Start-End: 68-429
aggccgagcctggggcggagtttgggctgactggggctggaccgggcaagacgccgccgctgcccggatgttgcgatggctgatcgggggaggccgagaaccgcagggactggccgagaaatctcctttacagacaatagatttgagttttgtcaccggctcccacgtcggagagctgatcatctgggatgccctggactggaccatgcaggcctatgaacgcaacttctgggacccatctccacaactggacacccaacaagaaataaaactctgtcaaaaatcaaatgacatttctattcatcatttcacatgtgatgaagagaatgtatttgctgcagttggaaggggtttatacgtgtatagccttcaaatgaagcgtgtgattgcctgccagaaaactgcacatgactccaatgtcctgcacgt

SEQ ID NO: 199793 - DNA, 1553 bp, Homo sapiens
  Payload ID: 19420
  Gene Name: WD repeat domain 41
  Uniprot ID: Q9HAD4
  ENST ID: ENST00000507029
  CDS Start-End: 97-1311
agttgcgctgcagccggggaggaaggaggaggccgagcctggggcggagtttgggctgactggggctggaccgggcaagacgccgccgctgcccggatgttgcgatggctgatcgggggaggccgagaaccgcagggactggccgagacaggggaaaaacttttagaactgaatggacacactcaaaagataacagctattattacatttccttccttggaatcttgtgaagagaaaaatcaactcatcttgacagcctctgctgatagaacagttattgtgtgggatggtgatactaccagacaagttcagagaatatcatgcttccagtctactgtaaagtgtttaactgttcttcagagactagatgtttggctttctggtgggaatgacctgtgtgtgtggaaccgaaaattagatctcctgtgtaagactagccacctttctgatacaggtattagtgctttggttgaaatacctaagaactgtgttgtggcagcagttggcaaagaactgataattttcaggttggtagcacccacagaaggatcactagaatgggatattcttgaagttaagcgcctccttgatcaccaggataatattctctcattgattaatgtcaatgatttgagttttgtcaccggctcccacgtcggagagctgatcatctgggatgccctggactggaccatgcaggcctatgaacgcaacttctgggacccatctccacaactggacacccaacaagaaataaaactctgtcaaaaatcaaatgacatttctattcatcatttcacatgtgatgaagagaatgtatttgctgcagttggaaggggtttatacgtgtatagccttcaaatgaagcgtgtgattgcctgccagaaaactgcacatgactccaatgtcctgcacgttgccagacttccaaacaggcagttaatctcatgctcagaagatggcagtgtacgcatttgggagttaagagaaaaacagcagcttgcagctgagcctgtaccaacaggtttttttaacatgtggggatttggaagagtcagcaaacaagccagccaacctgttaaaaagcagcaagaaaatgctacttcatgttcactggagcttattggagatttgattggacactcatcatctgtggagatgtttctatactttgaagatcatggactagtgacgtgctccgctgatcatctcattattttgtggaaaaatggagagcgagaatctggattgcgcagtttaagattatttcaaaaattagaggagaatggtgacttataccttgctgtctagtttaaggaattaaaaatacacatgcatgaaccttgaacatcaaatatcgggtactactctgaaaaccattaatatattgatcacttaaattggtaattttttttgtcagtccataaaattctacatgtttaaattttttgtggacctaccaaccaggaacatgttgcttctcaggtcctagtatatcctccaaagaatataccacaagtttttccatttgactttgagctgctgttgaagtg

SEQ ID NO: 199794 - DNA, 582 bp, Homo sapiens
  Payload ID: 19420
  Gene Name: WD repeat domain 41
  ENST ID: ENST00000506307
  CDS Start-End: 4-459
cggatgttgcgatggctgatcgggggaggccgagaaccgcagggactggccgagaaatctcctttacagacaataggtgaagaacaaacccagaatccctacactgaactgctagtactgaaggctcatcatgatattgtacgatttctggtacagttagatgactacagatttgcatctgctggtgatgatggaattgtagttgtgtggaatgcccagacaggggaaaaacttttagaactgaatggacacactcaaaagataacagctattattacatttccttccttggaatcttgtgaagagaaaaatcaactcatcttgacagcctctgctgatagaacagttattgtgtgggatggtgatactaccagacaagttcagagaatatcatgcttccagtctactgtaaaggttggtagcacccacagaaggatcactagaatgggatattcttgaagttaagcgcctccttgatcaccaggataatattctctcattgattaatgtcaatgatttgagttttgtcaccggctcccacgtcggagagctgatcatctgggatgccctggactggaccat

SEQ ID NO: 199795 - DNA, 1042 bp, Homo sapiens
  Payload ID: 19420
  Gene Name: WD repeat domain 41
  ENST ID: ENST00000505129
  CDS Start-End: 277-750
cgcgcgccccgcaatcgccgcagccgcccccgccgtcggccgccgcaccccaagcgactgcccaaactaagcctccgtggctgggtacgggagcgctttggggacaaaaattctccctcaactgtggtctgcattccttcggcccgtgggctgatctggggcgggaagtattagcgtctcagttgcgctgcagccggggaggaaggaggaggccgagcctggggcggagtttgggctgactggggctggaccgggcaagacgccgccgctgcccggatgttgcgatggctgatcgggggaggccgagaaccgcagggactggccgagaaatctcctttacagacaataggtgaagaacaaacccagaatccctacactgaactgctagtactgaaggctcatcatgatattgtacgatttctggtacagttagatgactacagatttgcatctgctggtgatgatggaattgtagttgtgtggaatgcccagacaggggaaaaacttttagaactgaatggacacactcaaaagataacagctattattacatttccttccttggaatcttgtgaagagaaaaatcaactcatcttgacagcctctgctgatagaacagttattgtgtgggatggtgatactaccagacaagttcagagaatatcatgcttccagtctactgtaaaggtattagtgctttggttgaaatacctaagaactgtgttgtggcagcagttggcaaagaactgataattttcaggttggtagcacccacagaaggatcactagaatgggatattcttgaagttaagcgcctccttgatcaccaggataatattctctcattgattaatgtcaatgatttgagttttgtcaccggctcccacgtcggagagctgatcatctgggatgccctggactggaccatgcaggcctatgaacgcaacttctgggacccatctccacaactggacacccaacaagaaataaaactctgtcaaaaatcaaatgacatttctattcatcatttcacatgtgatga

SEQ ID NO: 199796 - DNA, 516 bp, Homo sapiens
  Payload ID: 19420
  Gene Name: WD repeat domain 41
  ENST ID: ENST00000511630
  CDS Start-End: 1-491
gtattagtgctttggttgaaatacctaagaactgtgttgtggcagcagttggcaaagaactgataattttcaggttggtagcacccacagaaggatcactagaatgggatattcttgaagttaagcgcctccttgatcaccaggataatattctctcattgattaatgtcaatgatttgagttttgtcaccggctcccacgtcggagagctgatcatctgggatgccctggactggaccatgcaggcctatgaacgcaacttctgggacccatctccacaactggacacccaacaagaaataaaactctgtcaaaaatcaaatgacatttctattcatcatttcacatgtgatgaagagaatgtatttgctgcagttggaaggggtttatacgtgtatagccttcaaatgaagcgtgtgattgcctgccagaaaactgcacatgactccaatgtcctgcacgttgccagacttccaaacaggtttttttaacatgtggggatttggaagagtcagc

SEQ ID NO: 199797 - DNA, 560 bp, Homo sapiens
  Payload ID: 19420
  Gene Name: WD repeat domain 41
  ENST ID: ENST00000506474
  CDS Start-End: 1-201
atgttgcgatggctgatcgggggaggccgagaaccgcagggactggccgagaaatctcctttacagacaataggtgaagaacaaacccagaatccctacactgaactgctagtactgaaggctcatcatgatattgtacgatttctggtacagttagatgactacagcctctccagcacctgttgtttcctgactttttaatgatcgccattctaactggtgtgagatgatatctcattgtggttttgatttgcatttctctgatggccagtgatgatttgcatctgctggtgatgatggaattgtagttgtgtggaatgcccagacaggggaaaaacttttagaactgaatggacacactcaaaagataacagctattattacatttccttccttggaatcttgtgaagagaaaaatcaactcatcttgacagcctctgctgatagaacagttattgtgtgggatggtgatactaccagacaagttcagagaatatcatgcttccagtctactgtaaagtgtttaactgttcttcagagactagatgtttggctttctg

SEQ ID NO: 199798 - DNA, 516 bp, Homo sapiens
  Payload ID: 19420
  Gene Name: WD repeat domain 41
  ENST ID: ENST00000504895
  CDS Start-End: 67-516
aaaggggagttgttctctggcgggcaggagtggggcaaggtgctcaggggagctttttgagccaggatgagccaggaaaaggacttttacaagaaatctcctttacagacaataggtgaagaacaaacccagaatccctacactgaactgctagtactgaaggctcatcatgatattgtacgatttctggtacagttagatgactacagatttgcatctgctggtgatgatggaattgtagttgtgtggaatgcccagacaggggaaaaacttttagaactgaatggacacactcaaaagataacagctattattacatttccttccttggaatcttgtgaagagaaaaatcaactcatcttgacagcctctgctgatagaacagttattgtgtgggatggtgatactaccagacaagttcagagaatatcatgcttccagtctactgtaaagtgtttaactgttcttcagagactagatgtttggctttctggtgggaatgacctgtgtgtgtgg

SEQ ID NO: 199799 - DNA, 1507 bp, Homo sapiens
  Payload ID: 19420
  Gene Name: WD repeat domain 41
  ENST ID: ENST00000515253
  CDS Start-End: 1-1185
ggaggccgagaaccgcagggactggccgagaaatctcctttacagacaataggtgaagaacaaacccagaatccctacactgaactgctagtactgaaggctcatcatgatattgtacgatttctggtacagttagatgactacagatttgcatctgctggtgatgatggaattgtagttgtgtggaatgcccagacaggggaaaaacttttagaactgaatggacacactcaaaagataacagctattattacatttccttccttggaatcttgtgaagagaaaaatcaactcatcttgacagcctctgctgatagaacagttattgtgtgggatggtgatactaccagacaagttcagagaatatcatgcttccagtctactgtaaagtgtttaactgttcttcagagactagatgtttggctttctggtgggaatgacctgtgtgtgtggaaccgaaaattagatctcctgtgtaagactagccacctttctgatacagatttgagttttgtcaccggctcccacgtcggagagctgatcatctgggatgccctggactggaccatgcaggcctatgaacgcaacttctgggacccatctccacaactggacacccaacaagaaataaaactctgtcaaaaatcaaatgacatttctattcatcatttcacatgtgatgaagagaatgtatttgctgcagttggaaggggtttatacgtgtatagccttcaaatgaagcgtgtgattgcctgccagaaaactgcacatgactccaatgtcctgcacgttgccagacttccaaacaggcagttaatctcatgctcagaagatggcagtgtacgcatttgggagttaagagaaaaacagcagcttgcagctgagcctgtaccaacaggtttttttaacatgtggggatttggaagagtcagcaaacaagccagccaacctgttaaaaagcagcaagaaaatgctacttcatgttcactggagcttattggagatttgattggacactcatcatctgtggagatgtttctatactttgaagatcatggactagtgacgtgctccgctgatcatctcattattttgtggaaaaatggagagcgagaatctggattgcgcagtttaagattatttcaaaaattagaggagaatggtgacttataccttgctgtctagtttaaggaattaaaaatacacatgcatgaaccttgaacatcaaatatcgggtactactctgaaaaccattaatatattgatcacttaaattggtaattttttttgtcagtccataaaattctacatgtttaaattttttgtggacctaccaaccaggaacatgttgcttctcaggtcctagtatatcctccaaagaatataccacaagtttttccatttgactttgagctgctgttgaagtggtgagtgctgtgttttgagcttattttgaacctagatccttgtgaaaggtacaaatagaggtaatagttaagttatggca

SEQ ID NO: 199800 - DNA, 570 bp, Homo sapiens
  Payload ID: 19420
  Gene Name: WD repeat domain 41
  ENST ID: ENST00000514559
  CDS Start-End: 3-570
ggatgttgcgatggctgatcgggggaggccgagaaccgcagggactggccgagaaatctcctttacagacaataggtgaagaacaaacccagaatccctacactgaactgctagtactgaaggctcatcatgatattgtacgatttctggtacagttagatgactacagatttgcatctgctggtgatgatggaattgtagttgtgtggaatgcccagacaggggaaaaacttttagaactgaatggacacactcaaaagataacagctattattacatttccttccttggaatcttgtgaagagaaaaatcaactcatcttgacagcctctgctgatagaacagttattgtgtgggatggtgatactaccagacaagttcagagaatatcatgcttccagtctactgtaaagagactagatgtttggctttctggtgggaatgacctgtgtgtgtggaaccgaaaattagatctcctgtgtaagactagccacctttctgatacaggtattagtgctttggttgaaatacctaagaactgtgttgtggcagcagttggcaaagaactga

SEQ ID NO: 199801 - DNA, 611 bp, Homo sapiens
  Payload ID: 19420
  Gene Name: WD repeat domain 41
  ENST ID: ENST00000509892
  CDS Start-End: 1-181
gcgatggctgatcgggggaggccgagaaccgcagggactggccgagaaatctcctttacagacaataggtgaagaacaaacccagaatccctacactgaactgctagtactgaaggctcatcatgatattgtacgatttctggtacagttagatgactacagacaggggaaaaacttttagaactgaatggacacactcaaaagataacagctattattacatttccttccttggaatcttgtgaagagaaaaatcaactcatcttgacagcctctgctgatagaacagttattgtgtgggatggtgatactaccagacaagttcagagaatatcatgcttccagtctactgtaaaggtaaaatcttaatgtttaactgttcttcagagactagatgtttggctttctggtgggaatgacctgtgtgtgtggaaccgaaaattagatctcctgtgtaagactagccacctttctgatacaggtattagtgctttggttgaaatacctaagaactgtgttgtggcagcagttggcaaagaactgataattttcaggttggtagcacccacagaaggatcactagaatgggatattcttgaagttaagcgcct

SEQ ID NO: 199802 - DNA, 562 bp, Homo sapiens
  Payload ID: 19420
  Gene Name: WD repeat domain 41
  ENST ID: ENST00000507654
  CDS Start-End: 141-562
cgggggaggccgagaaccgcagggactggccgagaaatctcctttacagacaataggtgaagaacaaacccagaatccctacactgaactgctagtactgaaggctcatcatgatattgtacgatttctggtacagttagatgactacagatttgagttttgtcaccggctcccacgtcggagagctgatcatctgggatgccctggactggaccatgcaggcctatgaacgcaacttctgggacccatctccacaactggacacccaacaagaaataaaactctgtcaaaaatcaaatgacatttctattcatcatttcacatgtgatgaagagaatgtatttgctgcagttggaaggggtttatacgtgtatagccttcaaatgaagcgtgtgattgcctgccagaaaactgcacatgactccaatgtcctgcacgttgccagacttccaaacaggcagttaatctcatgctcagaagatggcagtgtacgcatttgggagttaagagaaaaacagcagcttgcagctgagcctgtaccaacaggtttttttaacatgtg

SEQ ID NO: 199803 - DNA, 949 bp, Homo sapiens
  Payload ID: 19420
  Gene Name: WD repeat domain 41
  ENST ID: ENST00000509701
  CDS Start-End: 1-531
atgttgcgatggctgatcgggggaggccgagaaccgcagggactggccgagaaatctcctttacagacaataggtgaagaacaaacccagaatccctacactgaactgctagtactgaaggctcatcatgatattgtacgatttctggtacagttagatgactacagatttgcatctgctggtgatgatggaattgtagttgtgtggaatgcccagacaggggaaaaacttttagaactgaatggacacactcaaaagataacagctattattacatttccttccttggaatcttgtgaagagaaaaatcaactcatcttgacagcctctgctgatagaacagttattgtgtgggatggtgatactaccagacaagttcagagaatatcatgcttccagtctactgtaaagtgtttaactgttcttcagagactagatgtttggctttctggtgggaatgacctgtgtgtgtggaaccgaaaattagatctcctgtgtaagactagccacctttctgatacaggttggtagcacccacagaaggatcactagaatgggatattcttgaagttaagcgcctccttgatcaccaggataatattctctcattgattaatgtcaatgatttgagttttgtcaccggctcccacgtcggagagctgatcatctgggatgccctggactggaccatgcaggcctatgaacgcaacttctgggacccatctccacaactggacacccaacaagaaataaaactctgtcaaaaatcaaatgacatttctattcatcatttcacatgtgatgaagagaatgtatttgctgcagttggaaggggtttatacgtgtatagccttcaaatgaagcgtgtgattgcctgccagaaaactgcacatgactccaatgtcctgcacgttgccagacttccaaacaggcagttaatctcatgctc

SEQ ID NO: 199804 - DNA, 787 bp, Homo sapiens
  Payload ID: 19421
  Gene Name: WD repeat domain 43
  ENST ID: ENST00000296126
  CDS Start-End: 227-787
ggaaggcctggaggagaagtgatttcatttggaccttctgggatagagtggtggacatgacaacagagtcaactgcatacagtggcatcaagacagtggctgtttatatagttgttcagatgataaacatattgtggaatggaacgtacagacatgcaaagtaaagtgcaaatggaaaggcgacaatagcagtgtcagttccctatgtatcagcccagatggaaagatgttgctttcagctggtcgaacaatcaaactatgggttttggagaccaaagaagtctacaggcatttcacaggacatgcaacgccagtttcgtcactgatgttcactaccatcagacctcctaatgagagccagccctttgatggaattacaggtctttatttcttatctggagcagtacatgaccggttacttaatgtctggcaggtccgatcagaaaacaaagaaaagagtgcagtgatgtcatttacagttaccgatgaacctgtctatattgacttaactttgtcagaaaacaaagaagagcctgtcaagttggctgttgtttgcagagatggtcaagtccatctttttgaacacatattaaatgggtactgcaaaaagcctttgacttcaaactgcacaattcagatagcaacacctgggaaaggcaagaagtcaacaccaaaacccatccctattctagctgctggtttttgctcagacaaaatgtcattgttgcttgtatatggcagttggtttcagcctactattgagcgagtggctttaaactccagagaa

SEQ ID NO: 199805 - DNA, 3533 bp, Homo sapiens
  Payload ID: 19421
  Gene Name: WD repeat domain 43
  Uniprot ID: Q15061
  ENST ID: ENST00000407426
  CDS Start-End: 57-2090
gcgccggtgcgcctgcgcacggacgaacacgtggctgcagcggggccagagcagcaatggcggcgggcggcggcggtagctgcgaccccctggcccctgctggggtcccttgcgccttctccccgcacagccaggcctacttcgctttggcctctaccgacggtcacttacgagtatgggagacggccaacaaccggctgcaccaggagtacgtgccttccgcgcacctcagtggtacctgcacctgtctggcctgggcgccagcgcggctgcaggccaaggaaagtccccagaggaaaaaaaggaaatcagaagctgtaggaatgagtaaccagactgacttattggctcttggcacagcagttggtagcattttattatacagcacagtaaaaggagagttacacagtaaattaataagtggtggacatgacaacagagtcaactgcatacagtggcatcaagacagtggctgtttatatagttgttcagatgataaacatattgtggaatggaacgtacagacatgcaaagtaaagtgcaaatggaaaggcgacaatagcagtgtcagttccctatgtatcagcccagatggaaagatgttgctttcagctggtcgaacaatcaaactatgggttttggagaccaaagaagtctacaggcatttcacaggacatgcaacgccagtttcgtcactgatgttcactaccatcagacctcctaatgagagccagccctttgatggaattacaggtctttatttcttatctggagcagtacatgaccggttacttaatgtctggcaggtccgatcagaaaacaaagaaaagagtgcagtgatgtcatttacagttaccgatgaacctgtctatattgacttaactttgtcagaaaacaaagaagagcctgtcaagttggctgttgtttgcagagatggtcaagtccatctttttgaacacatattaaatgggtactgcaaaaagcctttgacttcaaactgcacaattcagatagcaacacctgggaaaggcaagaagtcaacaccaaaacccatccctattctagctgctggtttttgctcagacaaaatgtcattgttgcttgtatatggcagttggtttcagcctactattgagcgagtggctttaaactccagagaacctcatatgtgtttagtaagagatatttcaaactgctgggcccccaaagtagaaacagctataacaaaggtgaggacaccagtgatgaattctgaagcaaaagttctggtgcctgggattcctggtcatcatgcagctatcaagcccgctcctccacaaaccgagcaagtagagagcaagaggaagtcagggggaaatgaggttagcattgaagaacgtctgggagcaatggatatagacacacacaaaaaaggaaaggaagacctccagacgaatagctttccagttcttcttacccagggcttagaaagtaacgattttgaaatgctaaataaagtacttcaaactaggaatgtaaaccttataaagaagactgtattaaggatgcccctgcatactattattccgttgttacaagagcttacaaagaggttacaaggacatcctaatagtgctgtgctaatggttcagtggctaaaatgtgtgttaacagttcatgcatcatacctgtccacgttgcctgacctggtaccccagctggggacactctaccagttaatggaaagcagagtcaaaacttttcagaaactttcacaccttcatggaaagcttattcttctaattacacaagtaacagcatcagagaagacaaagggagcaacttcccctggacagaaggcaaagttggtgtatgaagaagagtcttctgaagaggagtctgatgatgaaatagcagataaggattctgaagataattgggatgaagatgaggaggagagtgaaagtgaaaaagatgaggacgttgaagaggaagatgaggatgccgaaggaaaagatgaagaaaatggcgaggacagagatacagcaagtgaaaaagaattaaatggagattctgatttagatcctgaaaatgaaagtgaagaagaatgaagacagcaaagcaagccggtcaaactatataaactctggctcaccttgcccagtggtgagggctgcctctgtgccaggatgccaaggaccgctgcacatttccaaattcacagcagtggatcccatgccactttgctgtcctgagcaccccagacttgactgtgtaaataagagtgtttcattcaaatgttaataaactttacacagtatatagacacattttctgcaatgtactgacatcagtgtccaatatatggtatatttttataatataatatcctagtatgattggttatatcaagaattgacaagtgcagataaagacctttcccataggagttcaagaactggactgttgtgaagaagtcagctcttatctcaggttggtatctttcatcaaatccagatgcaaagcagcactagtgaaaatttttttaatttagtacatttaatttggtacattttcataaaatatgaagggataactacaaactggagtaaaaatgatggtaattaaaaaaaatcctcagtatccctagcttgtctattaactgtgataatctgacttgagtcagattgaatatttggagtgcttccccagaataaccacttatttttgaagctatcatgtgaagtatttttttaaaacaaaacaaaaattatggtcattaaaaaactagagaattagccatattaaggatttttcttgactgcaaattacttctaaagaatcatcagtgtatagattagaagtgctcattacctgcaacttttaaaaaaaattcagttatagctgcttttgaagaggtttccatttttatttaaattactaatggatcaaagaacaattgtttattttttctctttggttttagatattaatgataaccttgttggaattttttttccaaagaaaatatttttataattaaataatttaatgtttttcttccttttcattacctactcttggcagtgttagggtatctgtttacctttaaaatgataagtctcactcaagattttttatgtatgtataaatattttggtgtgctacaaaagcctttgcaaattatcagtagtagtttttttttttttttttttttttttaaagaatgagccgatattggcttagtgctcactaggggacatgcacatggaagctcacctctaagaaagggctgggcagatggatttattttttcccacctgtgaatatgtaaaacaaaaccattatctttgagggagtttttaataccaatgacagaacagagatttgtgtgctcatcttaagagccagagccatataagcatcttgggaaagcaagtttgaaccagctgctggtgtaatgtacagttatatttgtctataaatggagctgtttatggcaatttaataccattctctttgtaaagtgaataaatattcatctttacccagtg

SEQ ID NO: 199806 - DNA, 386 bp, Homo sapiens
  Payload ID: 19421
  Gene Name: WD repeat domain 43
  ENST ID: ENST00000434238
  CDS Start-End: 311-386
gcgtgcggcctgccgcgagggcagtgagggagggcgcagctcgacccggccggcctcgtatccgagccctgccggctggcccaatgaggcctgggccccactgttgacgggcagccatgttcgccaagtcccctggtccccctggggcggcttccttctgccgggccttggctcatcagagttctggtttttgacagagccccatcttgggactatctaactttcctctgtctgtgatccggctcatcagttttgcactgggcagttggaaagtccccagaggaaaaaaaggaaatcagaagctgtaggaatgagtaaccagactgacttattggctcttggcacagcagttggtagcattttattatacagcacagtaaaaggag

SEQ ID NO: 199807 - DNA, 541 bp, Homo sapiens
  Payload ID: 19421
  Gene Name: WD repeat domain 43
  ENST ID: ENST00000440983
  CDS Start-End: 101-541
tacagagtagccaaaccgaatcactgcaaagtgatttggaaacatcaggtatcctgaggaaagtccccagaggaaaaaaaggaaatcagaagctgtaggaatgagtaaccagactgacttattggctcttggcacagcagttggtagcattttattatacagcacagtaaaaggagagttacacagtaaattaataagtggtggacatgacaacagagtcaactgcatacagtggcatcaagacagtggctgtttatatagttgttcagatgataaacatattgtggaatggaacgtacagacatgcaaagtaaagtgcaaatggaaaggcgacaatagcagtgtcagttccctatgtatcagcccagatggaaagatgttgctttcagctggtcgaacaatcaaactatgggttttggagaccaaagaagtctacaggcatttcacaggacatgcaacgccagtttcgtcactgatgttcactaccatcagacctcctaatgagagccagccctttgatggaattacaggtctttatttc

SEQ ID NO: 199808 - DNA, 4111 bp, Homo sapiens
  Payload ID: 19422
  Gene Name: WD repeat domain 44
  Uniprot ID: Q5JSH3
  ENST ID: ENST00000254029
  CDS Start-End: 396-3137
attttgcgggcaactagctcttccagctgctgtaaattgctgctgcgggagaaactggagccgctgtagccggcgcgcccttcttcccttactgcgaggagccaccgcctctttcgcgctccttatacacctatcactgggagcggtggcagcaacattccctggaccaaccgccgcctcttcaggcggccgctttgccggtcattcccgaagcccggcaactgagggcggccccctttccttaacagtctcctcgctacagatcgtctgctccctcagcctcgcccgagacccacttccccagtctcgcccgggtggaggtcgacgaggaggagacaagagtcacccttcctccaggcggcgccggccccctcacccgcgggtgtgtcctataaatggcgtcggaaagcgacaccgaggaattctatgatgcccctgaagatgtgcacctagggggcggctaccccgtggggtctccaggaaaagttgggctttcaacattcaaggaaacagagaacactgcatacaaagttggaaatgagtcccctgtacaagaattgaaacaagatgtgtctaaaaagattattgaaagtattattgaggagagtcagaaagtactacagcttgaagatgactctttggattccaaaggaaaagaactctctgatcaagctactgccagtcctattgtggctagaacagatctgagcaatatacccggactgttagccatagatcaagtactaccggaagaatcccaaaaggcagagagtcagaatacatttgaagagactgaattagaattaaaaaaatgctttccttctgatgaaacctgtgagaaaccagtagatgaaaccacgaagttaactcaaacaagttcaactgagcagcttaatgtgcttgaaactgaaacagaagtattgaacaaggaagcagtggaagtcaaaggaggtggtgatgttttagagcctgtgtcctcagactccttatctactaaagattttgccgctgtggaagaagtggcccctgccaaacccccaagacaccttactccagagcctgatatagtggctagtacaaagaagcctgttccagcacgcccacctcctccaactaatttcccacctcctagacccccacctccttctcgacctgctccaccaccaagaaaaaggaaaagcgaattggaatttgagactctgaaaactcctgatatagatgttcccaaagagaatattacgtctgattctctcctaaccgcaagcatggcttcagaaagtacggttaaggattctcagccttctcttgatttggcaagtgctaccagtggagataaaatagttaccgcccaggaaaatggaaaagcacctgatgggcagactgtagcaggtgaagtgatgggccctcagagacctagatccaactctgggagagagcttactgatgaggaaattttagccagtgtaatgattaagaacctggatactggagaagaaatacctttgagtcttgcagaagagaaactaccaacaggcattaatcctctcactctacacatcatgagaaggacaaaagaatatgtaagtaatgacgcggcacagtcagatgatgaagagaagttacagtctcagccaacagatactgatggtggaaggttaaaacagaaaacgactcaactaaagaagtttcttggaaaatcagtaaagagagcaaagcaccttgctgaggaatatggtgaacgtgctataaataaagttaaaagtgttagagatgaagtgtttcatactgatcaagatgatccttcatcaagtgatgatgaaggaatgccatacacaagaccagttaaattcaaagcagcacacggtttcaaaggaccttatgattttgatcagatcaaagtggtgcaagatcttagtggtgaacatatgggagctgtttggaccatgaaattttctcactgtggccgattacttgcctcagctggacaagacaatgtagtgagaatatgggctttaaaaaatgcttttgactatttcaacaatatgcgaatgaaatacaatactgaaggacgtgtgtccccatcaccctctcaggaaagtctaagttcatcaaaatcggatacagatacaggggtatgcagtggaactgatgaagaccctgatgataaaaacgcaccctttcggcaacggccattttgcaaatataaaggacatactgctgatctccttgatctttcatggtctaaaaactactttcttctttcttcttcaatggataaaacagtcagattatggcacatttctcgaagagaatgcctttgctgttttcaacatatagattttgtcactgccatagcttttcatccaagagatgacaggtattttctaagtgggtctttggatggaaagctccgcctttggaacatacctgacaaaaaagtggctttgtggaatgaagtagatggtcagacaaaattgatcacagctgcaaatttctgtcagaatggcaaatatgcagtgattgggacatatgatggcagatgtattttctatgatacagagcatttgaaataccatacacaaatacatgtccgatctactagagggcgcaacaaggttggaagaaaaattactggcattgagcctttacctggagaaaataagatattggtaacctcaaatgactccagaatcagactatatgatttgagagatttgtcactatccatgaagtataagggttacgtcaatagcagcagccagatcaaagcaagtttcagccatgattttacttacctcgttagtggttcagaagataagtatgtttatatctggagtacctaccatgacctaagcaagtttacttcagtcaggagagatcgtaatgacttctgggaaggtattaaagcccacaatgcagttgttacatcagccatctttgcaccaaacccaagtttgatgttatctttggatgtgcaatctgaaaaatcagaagggaacgagaaaagtgaagatgctgaagttttggatgccacaccttctggtattatgaagacagataacacagaagttcttctctctgctgacttcactggagcaatcaaagtgtttgttaataaaagaaaaaatgtatcttaatttgaaatggcatttaaaataaacatatcagtaagtttctatatgtatcaaaactgaaaaaatagtgttccaggctaacatacttttttaatttttattgaaagttgttcaaatataatatattttttgagaggcagtgttaatgatctaggaaaccctgggctgatagagtagaaaggaatatggctagaataacattgccaaacattaggctttatgttttgttatgtttgtgttttcgttgtataattatgaacatgcacaagtttctgcatgaaaagatattaatatattaatcacatgtatgtgccttttggttacatgcattaaatctaacagagttaaattatttcagtggctcttttggcctcttactaggggggatagtcttgtttctagcttaaacaattttttttttgcacaaaatttcatttttaataaaagtggtatcttttgactgagttattgttttgaaaatggtatataggtttccagtaggtcaacaaccatatgtaaatggtttttataaatttctcaatttggggacaagatttttttgtggtctaaattgtgggcttaagattcttttctttatatgtgtacatataatttttttttctttgccacactggagcacaatgtttctatgtaaagaattattttcattctttatccatgagcaccaggctttgctcacttaaaaaaaaattaagccacattaaggagtgagtcttcttttttacaataatgtaaaaattaaactgtttacatttttttaaagcattgtagtttttaaaaattaagctgttttgttttgtgttgttgaatttgaaagcctttgtaaatatcaatataatgtaccaatgaaataacatctggggcaatgaaaccctgatcatgttgttgatggttagcatatgtttctgaaaattaaatatgtattattaaaagttggtctccaacacttgtttaaa

SEQ ID NO: 199809 - DNA, 3877 bp, Homo sapiens
  Payload ID: 19422
  Gene Name: WD repeat domain 44
  Uniprot ID: Q5JSH3
  ENST ID: ENST00000371822
  CDS Start-End: 432-2906
ccctccgaaatctcgcgagggtaggtgcgcgtcggtattttgcgggcaactagctcttccagctgctgtaaattgctgctgcgggagaaactggagccgctgtagccggcgcgcccttcttcccttactgcgaggagccaccgcctctttcgcgctccttatacacctatcactgggagcggtggcagcaacattccctggaccaaccgccgcctcttcaggcggccgctttgccggtcattcccgaagcccggcaactgagggcggccccctttccttaacagtctcctcgctacagatcgtctgctccctcagcctcgcccgagacccacttccccagtctcgcccgggtggaggtcgacgaggaggagacaagagtcacccttcctccaggcggcgccggccccctcacccgcgggtgtgtcctataaatggcgtcggaaagcgacaccgaggaattctatgatgcccctgaagatgtgcacctagggggcggctaccccgtggggtctccaggaaaagttgggctttcaacattcaagattattgaaagtattattgaggagagtcagaaagtactacagcttgaagatgactctttggattccaaaggaaaagaactctctgatcaagctactgccagtcctattgtggctagaacagatctgagcaatatacccggactgttagccatagatcaagtactaccggaagaatcccaaaaggcagagagtcagaatacatttgaagagactgaattagaattaaaaaaatgctttccttctgatgaaacctgtgagaaaccagtagatgaaaccacgaagttaactcaaacaagttcaactgagcagcttaatgtgcttgaaactgaaacagaagtattgaacaaggaagcagtggaagtcaaaggaggtggtgatgttttagagcctgtgtcctcagactccttatctactaaagattttgccgctgtggaagaagtggcccctgccaaacccccaagacaccttactccagagcctgatatagtggctagtacaaagaagcctgttccagcacgcccacctcctccaactaatttcccacctcctagacccccacctccttctcgacctgctccaccaccaagaaaaaggaaaagcgaattggaatttgagactctgaaaactcctgatatagatgttcccaaagagaatattacgtctgattctctcctaaccgcaagcatggcttcagaaagtacggttaaggattctcagccttctcttgatttggcaagtgctaccagtggagataaaatagttaccgcccaggaaaatggaaaagcacctgatgggcagactgtagcaggtgaagtgatgggccctcagagacctagatccaactctgggagagagcttactgatgaggaaattttagccagtgtaatgattaagaacctggatactggagaagaaatacctttgagtcttgcagaagagaaactaccaacaggcattaatcctctcactctacacatcatgagaaggacaaaagaatatgtaagtaatgacgcggcacagtcagatgatgaagagaagttacagtctcagccaacagatactgatggtggaaggttaaaacagaaaacgactcaactaaagaagtttcttggaaaatcagtaaagagagcaaagcaccttgctgaggaatatggtgaacgtgctataaataaagttaaaagtgttagagatgaagtgtttcatactgatcaagatgatccttcatcaagtgatgatgaaggaatgccatacacaagaccagttaaattcaaagcagcacacggtttcaaaggaccttatgattttgatcagatcaaagtggtgcaagatcttagtggtgaacatatgggagctgtttggaccatgaaattttctcactgtggccgattacttgcctcagctggacaagacaatgtagtgagaatatgggctttaaaaaatgcttttgactatttcaacaatatgcgaatgaaatacaatactgaaggacgtgtgtccccatcaccctctcaggaaagtctaagttcatcaaaatcggatacagatacaggggtatgcagtggaactgatgaagaccctgatgataaaaacgcaccctttcggcaacggccattttgcaaatataaaggacatactgctgatctccttgatctttcatggtctaaaaactactttcttctttcttcttcaatggataaaacagtcagattatggcacatttctcgaagagaatgcctttgctgttttcaacatatagattttgtcactgccatagcttttcatccaagacatttgaaataccatacacaaatacatgtccgatctactagagggcgcaacaaggttggaagaaaaattactggcattgagcctttacctggagaaaataagatattggtaacctcaaatgactccagaatcagactatatgatttgagagatttgtcactatccatgaagtataagggttacgtcaatagcagcagccagatcaaagcaagtttcagccatgattttacttacctcgttagtggttcagaagataagtatgtttatatctggagtacctaccatgacctaagcaagtttacttcagtcaggagagatcgtaatgacttctgggaaggtattaaagcccacaatgcagttgttacatcagccatctttgcaccaaacccaagtttgatgttatctttggatgtgcaatctgaaaaatcagaagggaacgagaaaagtgaagatgctgaagttttggatgccacaccttctggtattatgaagacagataacacagaagttcttctctctgctgacttcactggagcaatcaaagtgtttgttaataaaagaaaaaatgtatcttaatttgaaatggcatttaaaataaacatatcagtaagtttctatatgtatcaaaactgaaaaaatagtgttccaggctaacatacttttttaatttttattgaaagttgttcaaatataatatattttttgagaggcagtgttaatgatctaggaaaccctgggctgatagagtagaaaggaatatggctagaataacattgccaaacattaggctttatgttttgttatgtttgtgttttcgttgtataattatgaacatgcacaagtttctgcatgaaaagatattaatatattaatcacatgtatgtgccttttggttacatgcattaaatctaacagagttaaattatttcagtggctcttttggcctcttactaggggggatagtcttgtttctagcttaaacaattttttttttgcacaaaatttcatttttaataaaagtggtatcttttgactgagttattgttttgaaaatggtatataggtttccagtaggtcaacaaccatatgtaaatggtttttataaatttctcaatttggggacaagatttttttgtggtctaaattgtgggcttaagattcttttctttatatgtgtacatataatttttttttctttgccacactggagcacaatgtttctatgtaaagaattattttcattctttatccatgagcaccaggctttgctcacttaaaaaaaaattaagccacattaaggagtgagtcttcttttttacaataatgtaaaaattaaactgtttacatttttttaaagcattgtagtttttaaaaattaagctgttttgttttgtgttgttgaatttgaaagcctttgtaaatatcaatataatgtaccaatgaaataacatctggggcaatgaaaccctgatcatgttgttgatggttagcatatgtttctgaaaattaaatatgtattattaaaagttggtctccaacacttgttt

SEQ ID NO: 199810 - DNA, 4029 bp, Homo sapiens
  Payload ID: 19422
  Gene Name: WD repeat domain 44
  Uniprot ID: Q5JSH3
  ENST ID: ENST00000371825
  CDS Start-End: 362-3079
aattgctgctgcgggagaaactggagccgctgtagccggcgcgcccttcttcccttactgcgaggagccaccgcctctttcgcgctccttatacacctatcactgggagcggtggcagcaacattccctggaccaaccgccgcctcttcaggcggccgctttgccggtcattcccgaagcccggcaactgagggcggccccctttccttaacagtctcctcgctacagatcgtctgctccctcagcctcgcccgagacccacttccccagtctcgcccgggtggaggtcgacgaggaggagacaagagtcacccttcctccaggcggcgccggccccctcacccgcgggtgtgtcctataaatggcgtcggaaagcgacaccgaggaattctatgatgcccctgaagatgtgcacctagggggcggctaccccgtggggtctccaggaaaagttgggctttcaacattcaaggaaacagagaacactgcatacaaagttggaaatgagtcccctgtacaagaattgaaacaagatgtgtctaaaaagattattgaaagtattattgaggagagtcagaaagtactacagcttgaagatgactctttggattccaaaggaaaagaactctctgatcaagctactgccagtcctattgtggctagaacagatctgagcaatatacccggactgttagccatagatcaagtactaccggaagaatcccaaaaggcagagagtcagaatacatttgaagagactgaattagaattaaaaaaatgctttccttctgatgaaacctgtgagaaaccagtagatgaaaccacgaagttaactcaaacaagttcaactgagcagcttaatgtgcttgaaactgaaacagaagtattgaacaaggaagcagtggaagtcaaaggaggtggtgatgttttagagcctgtgtcctcagactccttatctactaaagattttgccgctgtggaagaagtggcccctgccaaacccccaagacaccttactccagagcctgatatagtggctagtacaaagaagcctgttccagcacgcccacctcctccaactaatttcccacctcctagacccccacctccttctcgacctgctccaccaccaagaaaaaggaaaagcgaattggaatttgagactctgaaaactcctgatatagatgttcccaaagagaatattacgtctgattctctcctaaccgcaagcatggcttcagaaagtacggttaaggattctcagccttctcttgatttggcaagtgctaccagtggagataaaatagttaccgcccaggaaaatggaaaagcacctgatgggcagactgtagcaggtgaagtgatgggccctcagagacctagatccaactctgggagagagcttactgatgaggaaattttagccagtgtaatgattaagaacctggatactggagaagaaatacctttgagtcttgcagaagagaaactaccaacaggcattaatcctctcactctacacatcatgagaaggacaaaagaatatgtaagtaatgacgcggcacagtcagatgatgaagagaagttacagtctcagccaacagatactgatggtggaaggttaaaacagaaaacgactcaactaaagaagtttcttggaaaatcagtaaagagagcaaagcaccttgctgaggaatatggtgaacgtgctataaataaagttaaaagtgttagagatgaagtgtttcatactgatcaagatgatccttcatcaagtgatgatgaaggaatgccatacacaagaccagttaaattcaaagcagcacacggtttcaaaggaccttatgattttgatcagatcaaagtggtgcaagatcttagtggtgaacatatgggagctgtttggaccatgaaattttctcactgtggccgattacttgcctcagctggacaagacaatgtagtgagaatatgggctttaaaaaatgcttttgactatttcaacaatatgcgaatgaaatacaatactgaaggacgtgtgtccccatcaccctctcaggaaagtctaagttcatcaaaatcggatacagatacaggggtatgcagtggaactgatgaagaccctgatgataaaaacgcaccctttcggcaacggccattttgcaaatataaaggacatactgctgatctccttgatctttcatggtctaaaaactactttcttctttcttcttcaatggataaaacagtcagattatggcacatttctcgaagagaatgcctttgctgttttcaacatatagattttgtcactgccatagcttttcatccaagagatgacaggtattttctaagtgggtctttggatggaaagctccgcctttggaacatacctgacaaaaaagtggctttgtggaatgaagtagatggtcagacaaaattgatcacagctgcaaatttctgtcagaatggcaaatatgcagtgattgggacatatgatggcagatgtattttctatgatacagagcatttgaaataccatacacaaatacatgtccgatctactagagggcgcaacaaggttggaagaaaaattactggcattgagcctttacctggagaaaataagatattggtaacctcaaatgactccagaatcagactatatgatttgagagatttgtcactatccatgaagtataagggttacgtcaatagcagcagccagatcaaagcaagtttcagtggttcagaagataagtatgtttatatctggagtacctaccatgacctaagcaagtttacttcagtcaggagagatcgtaatgacttctgggaaggtattaaagcccacaatgcagttgttacatcagccatctttgcaccaaacccaagtttgatgttatctttggatgtgcaatctgaaaaatcagaagggaacgagaaaagtgaagatgctgaagttttggatgccacaccttctggtattatgaagacagataacacagaagttcttctctctgctgacttcactggagcaatcaaagtgtttgttaataaaagaaaaaatgtatcttaatttgaaatggcatttaaaataaacatatcagtaagtttctatatgtatcaaaactgaaaaaatagtgttccaggctaacatacttttttaatttttattgaaagttgttcaaatataatatattttttgagaggcagtgttaatgatctaggaaaccctgggctgatagagtagaaaggaatatggctagaataacattgccaaacattaggctttatgttttgttatgtttgtgttttcgttgtataattatgaacatgcacaagtttctgcatgaaaagatattaatatattaatcacatgtatgtgccttttggttacatgcattaaatctaacagagttaaattatttcagtggctcttttggcctcttactaggggggatagtcttgtttctagcttaaacaattttttttttgcacaaaatttcatttttaataaaagtggtatcttttgactgagttattgttttgaaaatggtatataggtttccagtaggtcaacaaccatatgtaaatggtttttataaatttctcaatttggggacaagatttttttgtggtctaaattgtgggcttaagattcttttctttatatgtgtacatataatttttttttctttgccacactggagcacaatgtttctatgtaaagaattattttcattctttatccatgagcaccaggctttgctcacttaaaaaaaaattaagccacattaaggagtgagtcttcttttttacaataatgtaaaaattaaactgtttacatttttttaaagcattgtagtttttaaaaattaagctgttttgttttgtgttgttgaatttgaaagcctttgtaaatatcaatataatgtaccaatgaaataacatctggggcaatgaaaccctgatcatgttgttgatggttagcatatgtttctgaaaattaaatatgtattattaaaa

SEQ ID NO: 199811 - DNA, 2844 bp, Homo sapiens
  Payload ID: 19422
  Gene Name: WD repeat domain 44
  ENST ID: ENST00000371848
  CDS Start-End: 1-2419
aacagatctgagcaatatacccggactgttagccatagatcaagtactaccggaagaatcccaaaaggcagagagtcagaatacatttgaagagactgaattagaattaaaaaaatgctttccttctgatgaaacctgtgagaaaccagtagatgaaaccacgaagttaactcaaacaagttcaactgagcagcttaatgtgcttgaaactgaaacagaagtattgaacaaggaagcagtggaagtcaaaggaggtggtgatgttttagagcctgtgtcctcagactccttatctactaaagattttgccgctgtggaagaagtggcccctgccaaacccccaagacaccttactccagagcctgatatagtggctagtacaaagaagcctgttccagcacgcccacctcctccaactaatttcccacctcctagacccccacctccttctcgacctgctccaccaccaagaaaaaggaaaagcgaattggaatttgagactctgaaaactcctgatatagatgttcccaaagagaatattacgtctgattctctcctaaccgcaagcatggcttcagaaagtacggttaaggattctcagccttctcttgatttggcaagtgctaccagtggagataaaatagttaccgcccaggaaaatggaaaagcacctgatgggcagactgtagcaggtgaagtgatgggccctcagagacctagatccaactctgggagagagcttactgatgaggaaattttagccagtgtaatgattaagaacctggatactggagaagaaatacctttgagtcttgcagaagagaaactaccaacaggcattaatcctctcactctacacatcatgagaaggacaaaagaatatgtaagtaatgacgcggcacagtcagatgatgaagagaagttacagtctcagccaacagatactgatggtggaaggttaaaacagaaaacgactcaactaaagaagtttcttggaaaatcagtaaagagagcaaagcaccttgctgaggaatatggtgaacgtgctataaataaagttaaaagtgttagagatgaagtgtttcatactgatcaagatgatccttcatcaagtgatgatgaaggaatgccatacacaagaccagttaaattcaaagcagcacacggtttcaaaggaccttatgattttgatcagatcaaagtggtgcaagatcttagtggtgaacatatgggagctgtttggaccatgaaattttctcactgtggccgattacttgcctcagctggacaagacaatgtagtgagaatatgggctttaaaaaatgcttttgactatttcaacaatatgcgaatgaaatacaatactgaaggacgtgtgtccccatcaccctctcaggaaagtctaagttcatcaaaatcggatacagatacaggggtatgcagtggaactgatgaagaccctgatgataaaaacgcaccctttcggcaacggccattttgcaaatataaaggacatactgctgatctccttgatctttcatggtctaaaaactactttcttctttcttcttcaatggataaaacagtcagattatggcacatttctcgaagagaatgcctttgctgttttcaacatatagattttgtcactgccatagcttttcatccaagagatgacaggtattttctaagtgggtctttggatggaaagctccgcctttggaacatacctgacaaaaaagtggctttgtggaatgaagtagatggtcagacaaaattgatcacagctgcaaatttctgtcagaatggcaaatatgcagtgattgggacatatgatggcagatgtattttctatgatacagagcatttgaaataccatacacaaatacatgtccgatctactagagggcgcaacaaggttggaagaaaaattactggcattgagcctttacctggagaaaataagatattggtaacctcaaatgactccagaatcagactatatgatttgagagatttgtcactatccatgaagtataagggttacgtcaatagcagcagccagatcaaagcaagtttcagccatgattttacttacctcgttagtggttcagaagataagtatgtttatatctggagtacctaccatgacctaagcaagtttacttcagtcaggagagatcgtaatgacttctgggaaggtattaaagcccacaatgcagttgttacatcagccatctttgcaccaaacccaagtttgatgttatctttggatgtgcaatctgaaaaatcagaagggaacgagaaaagtgaagatgctgaagttttggatgccacaccttctgcaatgagttctcgttatgttgcccaggctggtctcgaacttctagcctcaaaaaggtattatgaagacagataacacagaagttcttctctctgctgacttcactggagcaatcaaagtgtttgttaataaaagaaaaaatgtatcttaatttgaaatggcatttaaaataaacatatcagtaagtttctatatgtatcaaaactgaaaaaatagtgttccaggctaacatacttttttaatttttattgaaagttgttcaaatataatatattttttgagaggcagtgttaatgatctaggaaaccctgggctgatagagtagaaaggaatatggctagaataacattgccaaacattaggctttatgttttgttatgtttgtgttttcgttgtataattatgaacatgcacaagtttctgcatgaaaagatattaatatattaatcacatgtatgtgccttttggttacatgcattaaatctaacagagttaaatta

SEQ ID NO: 199812 - DNA, 1688 bp, Homo sapiens
  Payload ID: 19423
  Gene Name: WD repeat domain 45
  Uniprot ID: Q9Y484
  ENST ID: ENST00000356463
  CDS Start-End: 440-1525
ggctcccacaccactgcctcgtgtggggttgttcgcccgtgaaggggcaggacagggtgcgcgctggtggaggttgaaattgttacattttggccgggcgcggtggctcacgcctgtaatcccagcactttgggaggccgaggcaggtggatcacgaggtcaggagatcgagaccatcctggctaacacagtgaaaccccgtctctactaaaaaaatacaaaaaatcagccgggcgtggtgacgggcgcctgtagtcccagctactcaggaggctgaggcaggaggatggcgtgaacccgggaggcggagcttgcagtgagccgagatcgcgccagtgcactccagcctgggcgacagagcgaaactacgtctcaaaaaaaaaaaaaaagaaagaaaagaaattgttacattttatatatataggaacaatcctgcaccatgactcaacagccacttcgaggagtgaccagcctgcgtttcaaccaagaccaaagctgcttttgctgcgccatggagacaggtgtgcgcatctacaacgtggagcccttgatggagaaggggcatctggaccacgagcaggtgggcagcatgggcttggtggagatgctgcaccgctccaaccttctggccttggtgggcggtggtagtagtcccaagttctcagagatctcagcagtgctgatctgggacgatgcccgggagggcaaggactccaaggagaagctggtgctggagttcaccttcaccaagccagtgctttctgtgcgcatgcgccatgacaagatcgtgatcgtgctgaagaaccgcatctatgtgtactccttccccgacaatccccgaaagctgtttgagtttgatacccgggacaaccccaaggggctctgtgacctctgccccagcctggagaagcaactgctagtgttcccgggacacaagtgtgggagtctgcaacttgtggacctggcgagcacaaagcctggcacctcgtctgctccattcacgatcaatgcacatcagagtgacatagcctgtgtgtctctaaaccagccaggcactgtagtggcctcagcctcccagaagggtacccttattcgcctctttgacacacaatccaaggagaaactggtggagctgcgccgaggcactgaccctgccaccctctactgcattaacttcagccacgactcctccttcctctgcgcttccagtgataagggtactgtccatatctttgctctcaaggatacccgcctcaaccgccgctccgcgctggctcgcgtgggcaaggtggggcctatgattgggcagtacgtggactctcagtggagcctggcgagcttcactgtgcctgctgagtcagcttgcatctgcgccttcggtcgcaatacttccaagaacgtcaactctgtcattgccatctgcgtagatgggaccttccacaaatatgtcttcactcctgatggaaactgcaacagagaggctttcgacgtgtaccttgacatctgtgatgatgatgacttttaaggaccctgggggctgtgctagggacctgcagtggcagaactgcagagctgagccttggcagtggggcgtgcttggaagccaccagccagcaagcattaatggggctggtgcccactttccactcagcagagctatgtctaaataaagagctcacttcccccca

SEQ ID NO: 199813 - DNA, 996 bp, Homo sapiens
  Payload ID: 19423
  Gene Name: WD repeat domain 45
  ENST ID: ENST00000367375
  CDS Start-End: 1-862
ccacgagcaggtgggcagcatgggcttggtggagatgctgcaccgctccaaccttctggccttggtgggcggtggtagtagtcccaagttctcagagatctcagtgctgatctgggacgatgcccgggagggcaaggactccaaggagaagctggtgctggagttcaccttcaccaagccagtgctttctgtgcgcatgcgccatgacaagatcgtgatcgtgctgaagaaccgcatctatgtgtactccttccccgacaatccccgaaagctgtttgagtttgatacccgggacaaccccaaggggctctgtgacctctgccccagcctggagaagcaactgctagtgttcccgggacacaagtgtgggagtctgcaacttgtgccaggcactgtagtggcctcagcctcccagaagggtacccttattcgcctctttgacacacaatccaaggagaaactggtggagctgcgccgaggcactgaccctgccaccctctactgcattaacttcagccacgactcctccttcctctgcgcttccagtgataagggtactgtccatatctttgctctcaaggatacccgcctcaaccgccgctccgcgctggctcgcgtgggcaaggtggggcctatgattgggcagtacgtggactctcagtggagcctggcgagcttcactgtgcctgctgagtcagcttgcatctgcgccttcggtcgcaatacttccaagaacgtcaactctgtcattgccatctgcgtagatgggaccttccacaaatatgtcttcactcctgatggaaactgcaacagagaggctttcgacgtgtaccttgacatctgtgatgatgatgacttttaaggaccctgggggctgtgctagggacctgcagtggcagaactgcagagctgagccttggcagtggggcgtgcttggaagccaccagccagcaagcattaatggggctggtgcccactttccactcagcagagcta

SEQ ID NO: 199814 - DNA, 1432 bp, Homo sapiens
  Payload ID: 19423
  Gene Name: WD repeat domain 45
  ENST ID: ENST00000376358
  CDS Start-End: 155-1033
aaacacccgagccgggctccaaggcccgggaggtcagaaaaccgggccgcgggcggcaccgacagctggggcccgggtcagggacacgcggaggtcaggccggtgaaggcggcaggaagctggagcacgatcccaggaggaacaatcctgcaccatgactcaacagccacttcgaggagtgaccagcctgcgtttcaaccaagaccaaagctgcttttgctgcgccatggagacaggtgtgcgcatctacaacgtggagcccttgatggagaaggggcatctggggctctgtgacctctgccccagcctggagaagcaactgctagtgttcccgggacacaagtgtgggagtctgcaacttgtggacctggcgagcacaaagcctggcacctcgtctgctccattcacgatcaatgcacatcagagtgacatagcctgtgtgtctctaaaccagccaggcactgtagtggcctcagcctcccagaagggtacccttattcgcctctttgacacacaatccaaggagaaactggtggagctgcgccgaggcactgaccctgccaccctctactgcattaacttcagccacgactcctccttcctctgcgcttccagtgataagggtactgtccatatctttgctctcaaggatacccgcctcaaccgccgctccgcgtacgtgcggccacttcatacgctcctgagcgcgctggtagtggcggtggccctcggcgtgctggtgtgggcagctgagacccgcgcagctgtgcgccgctgccgccgcagccaccctgcagcctgcctggccgcagtgcttgccgtcggcctcctggtgctctgggtcgcgggcggcgcttgcaccttcctgttcagcatcgccgggccggtgcttctgatcctggtgcacgcctcgttgcgcctgcgcaaccttaagaacaagattgagaacaagatcgagagcattggtctcaagcggacgccaatgggcctgctactagaggcactgggacaagagcaggaggctggatcctaggcccctgggatctgtacccaggacctggagaataccaccccacccccagcccataattgggacccagagccctttcccagcacttaaaacaggagcctagagccccctgcccaaacaaaacaggacatctgtgaccgccctacccccacgccagccccaaactaagatatccctcacacccagcccccattacctagggacaagagtcttccccagccttgaacccaggaccaagagccacctacatccagccccaaaactggcttcaggccagagcatccatggccaatttcaaattgtgaacccagagacactcccatccacccttctccatgctcatccccaaactggggcctggggcaaggcactctcaaatcttgaaccctggaccaaagcttt

SEQ ID NO: 199815 - DNA, 1444 bp, Homo sapiens
  Payload ID: 19423
  Gene Name: WD repeat domain 45
  Uniprot ID: Q9Y484
  ENST ID: ENST00000322995
  CDS Start-End: 166-1281
gggcctgatgtaaacacccgagccgggctccaaggcccgggaggtcagaaaaccgggccgcgggcggcaccgacagctggggcccgggtcagggacacgcggaggtcaggccggtgaaggcggcaggaagctggagcacgatcccaggaggaacaatcctgcaccatgactcaacagccacttcgaggagtgaccagcctgcgtttcaaccaagaccaaagctgcttttgctgcgccatggagacaggtgtgcgcatctacaacgtggagcccttgatggagaaggggcatctggaccacgagcaggtgggcagcatgggcttggtggagatgctgcaccgctccaaccttctggccttggtgggcggtggtagtagtcccaagttctcagagatctcagtgctgatctgggacgatgcccgggagggcaaggactccaaggagaagctggtgctggagttcaccttcaccaagccagtgctttctgtgcgcatgcgccatgacaagatcgtgatcgtgctgaagaaccgcatctatgtgtactccttccccgacaatccccgaaagctgtttgagtttgatacccgggacaaccccaaggccgcccaccccaccccccatcttcacaccctagggctctgtgacctctgccccagcctggagaagcaactgctagtgttcccgggacacaagtgtgggagtctgcaacttgtggacctggcgagcacaaagcctggcacctcgtctgctccattcacgatcaatgcacatcagagtgacatagcctgtgtgtctctaaaccagccaggcactgtagtggcctcagcctcccagaagggtacccttattcgcctctttgacacacaatccaaggagaaactggtggagctgcgccgaggcactgaccctgccaccctctactgcattaacttcagccacgactcctccttcctctgcgcttccagtgataagggtactgtccatatctttgctctcaaggatacccgcctcaaccgccgctccgcgctggctcgcgtgggcaaggtggggcctatgattgggcagtacgtggactctcagtggagcctggcgagcttcactgtgcctgctgagtcagcttgcatctgcgccttcggtcgcaatacttccaagaacgtcaactctgtcattgccatctgcgtagatgggaccttccacaaatatgtcttcactcctgatggaaactgcaacagagaggctttcgacgtgtaccttgacatctgtgatgatgatgacttttaaggaccctgggggctgtgctagggacctgcagtggcagaactgcagagctgagccttggcagtggggcgtgcttggaagccaccagccagcaagcattaatggggctggtgcccactttccactcagcagagctatgtctaaataaagagctcacttcccccca

SEQ ID NO: 199816 - DNA, 1381 bp, Homo sapiens
  Payload ID: 19423
  Gene Name: WD repeat domain 45
  Uniprot ID: Q9Y484
  ENST ID: ENST00000376368
  CDS Start-End: 197-1282
ttcctgcgacaggctccctcccccggaagtagggcctgatgtaaacacccgagccgggctccaaggcccgggaggtcagaaaaccgggccgcgggcggcaccgacagctggggcccgggtcagggacacgcggaggtcaggccggtgaaggcggcaggaagctggagcacgatcccaggaggaacaatcctgcaccatgactcaacagccacttcgaggagtgaccagcctgcgtttcaaccaagaccaaagctgcttttgctgcgccatggagacaggtgtgcgcatctacaacgtggagcccttgatggagaaggggcatctggaccacgagcaggtgggcagcatgggcttggtggagatgctgcaccgctccaaccttctggccttggtgggcggtggtagtagtcccaagttctcagagatctcagcagtgctgatctgggacgatgcccgggagggcaaggactccaaggagaagctggtgctggagttcaccttcaccaagccagtgctttctgtgcgcatgcgccatgacaagatcgtgatcgtgctgaagaaccgcatctatgtgtactccttccccgacaatccccgaaagctgtttgagtttgatacccgggacaaccccaaggggctctgtgacctctgccccagcctggagaagcaactgctagtgttcccgggacacaagtgtgggagtctgcaacttgtggacctggcgagcacaaagcctggcacctcgtctgctccattcacgatcaatgcacatcagagtgacatagcctgtgtgtctctaaaccagccaggcactgtagtggcctcagcctcccagaagggtacccttattcgcctctttgacacacaatccaaggagaaactggtggagctgcgccgaggcactgaccctgccaccctctactgcattaacttcagccacgactcctccttcctctgcgcttccagtgataagggtactgtccatatctttgctctcaaggatacccgcctcaaccgccgctccgcgctggctcgcgtgggcaaggtggggcctatgattgggcagtacgtggactctcagtggagcctggcgagcttcactgtgcctgctgagtcagcttgcatctgcgccttcggtcgcaatacttccaagaacgtcaactctgtcattgccatctgcgtagatgggaccttccacaaatatgtcttcactcctgatggaaactgcaacagagaggctttcgacgtgtaccttgacatctgtgatgatgatgacttttaaggaccctgggggctgtgctagggacctgcagtggcagaactgcagagctgagccttggcagtggggcgtgcttggaagccaccagccagcaagcattaa

SEQ ID NO: 199817 - DNA, 1639 bp, Homo sapiens
  Payload ID: 19423
  Gene Name: WD repeat domain 45
  Uniprot ID: Q9Y484
  ENST ID: ENST00000376372
  CDS Start-End: 183-1265
tccctcccccggaagtagggcctgatgtaaacacccgagccgggctccaaggcccgggaggtcagaaaaccgggccgcgggcggcaccgacagctggggcccgggtcagggacacgcggaggtcaggccggtgaaggcggcaggaagctggagcacgatcccaggaggaacaatcctgcaccatgactcaacagccacttcgaggagtgaccagcctgcgtttcaaccaagaccaaagctgcttttgctgcgccatggagacaggtgtgcgcatctacaacgtggagcccttgatggagaaggggcatctggaccacgagcaggtgggcagcatgggcttggtggagatgctgcaccgctccaaccttctggccttggtgggcggtggtagtagtcccaagttctcagagatctcagtgctgatctgggacgatgcccgggagggcaaggactccaaggagaagctggtgctggagttcaccttcaccaagccagtgctttctgtgcgcatgcgccatgacaagatcgtgatcgtgctgaagaaccgcatctatgtgtactccttccccgacaatccccgaaagctgtttgagtttgatacccgggacaaccccaaggggctctgtgacctctgccccagcctggagaagcaactgctagtgttcccgggacacaagtgtgggagtctgcaacttgtggacctggcgagcacaaagcctggcacctcgtctgctccattcacgatcaatgcacatcagagtgacatagcctgtgtgtctctaaaccagccaggcactgtagtggcctcagcctcccagaagggtacccttattcgcctctttgacacacaatccaaggagaaactggtggagctgcgccgaggcactgaccctgccaccctctactgcattaacttcagccacgactcctccttcctctgcgcttccagtgataagggtactgtccatatctttgctctcaaggatacccgcctcaaccgccgctccgcgctggctcgcgtgggcaaggtggggcctatgattgggcagtacgtggactctcagtggagcctggcgagcttcactgtgcctgctgagtcagcttgcatctgcgccttcggtcgcaatacttccaagaacgtcaactctgtcattgccatctgcgtagatgggaccttccacaaatatgtcttcactcctgatggaaactgcaacagagaggctttcgacgtgtaccttgacatctgtgatgatgatgacttttaaggaccctgggggctgtgctagggacctgcagtggcagaactgcagagctgagccttggcagtggggcgtgcttggaagccaccagccagcaagcattaatggggctggtgcccactttccactcagcagagctatgtctaaataaagagctcacttccccccagcacttcttgatgactgtgtgccccaagggccaggccagagacccaggaaggcagcgaccccttgggatccctaacctggaggaaattgccagggacccagagggagtgccctaatccaacctggggattttttaaaagcttcctaggaagagatgatctccgatgtgatgaatacgaataaaaggcccttaatggcatttacggcttgac

SEQ ID NO: 199818 - DNA, 1146 bp, Homo sapiens
  Payload ID: 19423
  Gene Name: WD repeat domain 45
  ENST ID: ENST00000396681
  CDS Start-End: 170-1135
agtagggcctgatgtaaacacccgagccgggctccaaggcccgggaggtcagaaaaccgggccgcgggcggcaccgacagctggggcccgggtcagggacacgcggaggtcaggccggtgaaggcggcaggaagctggagcacgatcccaggaggaacaatcctgcaccatgactcaacagccacttcgaggagtgaccagcctgcgtttcaaccaagaccaaagctgcttttgctgcgccatggagacaggtgtgcgcatctacaacgtggagcccttgatggagaaggggcatctggtgctgatctgggacgatgcccgggagggcaaggactccaaggagaagctggtgctggagttcaccttcaccaagccagtgctttctgtgcgcatgcgccatgacaagatcgtgatcgtgctgaagaaccgcatctatgtgtactccttccccgacaatccccgaaagctgtttgagtttgatacccgggacaaccccaaggggctctgtgacctctgccccagcctggagaagcaactgctagtgttcccgggacacaagtgtgggagtctgcaacttgtggacctggcgagcacaaagcctggcacctcgtctgctccattcacgatcaatgcacatcagagtgacatagcctgtgtgtctctaaaccagccaggcactgtagtggcctcagcctcccagaagggtacccttattcgcctctttgacacacaatccaaggagaaactggtggagctgcgccgaggcactgaccctgccaccctctactgccacgactcctccttcctctgcgcttccagtgataagggtactgtccatatctttgctctcaaggatacccgcctcaaccgccgctccgcgctggctcgcgtgggcaaggtggggcctatgattgggcagtacgtggactctcagtggagcctggcgagcttcactgtgcctgctgagtcagcttgcatctgcgccttcggtcgcaatacttccaagaacgtcaactctgtcattgccatctgcgtagatgggaccttccacaaatatgtcttcactcctgatggaaactgcaacagagaggctttcgacgtgtaccttgacatctgtgatgatgatgacttttaaggaccctgggg

SEQ ID NO: 199819 - DNA, 643 bp, Homo sapiens
  Payload ID: 19423
  Gene Name: WD repeat domain 45
  ENST ID: ENST00000419567
  CDS Start-End: 18-643
aggaacaatcctgcaccatgactcaacagccacttcgaggagtgaccagcctgcgtttcaaccaagaccaaagctgcttttgctgcgccatggagacaggtgtgcgcatctacaacgtggagcccttgatggagaaggggcatctggaccacgagcaggtgggcagcatgggcttggtggagatgctgcaccgctccaaccttctggccttggtgggcggtggtagtagtcccaagttctcagagatctcagtgctgatctgggacgatgcccgggagggcaaggactccaaggagaagctggtgctggagttcaccttcaccaagccagtgctttctgtgcgcatgcgccatgacaagatcgtgatcgtgctgaagaaccgcatctatgtgtactccttccccgacaatccccgaaagctgtttgagtttgatacccgggacaaccccaagggtgagagggctcagatacacaggtggctctgtgacctctgccccagcctggagaagcaactgctagtgttcccgggacacaagtgtgggagtctgcaacttgtggacctggcgagcacaaagcctggcacctcgtctgctccattcacgatcaatgcacatcagagtgacatagcctgtgtgtctctaaa

SEQ ID NO: 199820 - DNA, 816 bp, Homo sapiens
  Payload ID: 19423
  Gene Name: WD repeat domain 45
  ENST ID: ENST00000423215
  CDS Start-End: 233-816
tttcgctttgctgggggcaaggcacgctctctctccccacccttccgggttccctcagacagtctcggccttgaggaacccccttcgcctccggtcccccagccaaccttcctccgctccccgcgccctccccggagaaccccactgtcactcgcgatgctccgaagacccgggaactaggcgaggaaggcggtggccgcctttttccagctgggaggaacaatcctgcaccatgactcaacagccacttcgaggagtgaccagcctgcgtttcaaccaagaccaaagctgcttttgctgcgccatggagacaggtgtgcgcatctacaacgtggagcccttgatggagaaggggcatctggaccacgagcaggtgggcagcatgggcttggtggagatgctgcaccgctccaaccttctggccttggtgggcggtggtagtagtcccaagttctcagagatctcagggctgccccttaccctaaaccttggccccgacaacccacccacctgcccagcagtgctgatctgggacgatgcccgggagggcaaggactccaaggagaagctggtgctggagttcaccttcaccaagccagtgctttctgtgcgcatgcgccatgacaagatcgtgatcgtgctgaagaaccgcatctatgtgtactccttccccgacaatccccgaaagctgtttgagtttgatacccgggacaaccccaaggggctctgtgacctctgccccagcctggagaagcaactgctagtgttcccgggacacaagtgtgggagtctgcaacttgtggacctggcgagcac

SEQ ID NO: 199821 - DNA, 1077 bp, Homo sapiens
  Payload ID: 19423
  Gene Name: WD repeat domain 45
  ENST ID: ENST00000473974
  CDS Start-End: 140-910
gctccaaggcccgggaggtcagaaaaccgggccgcgggcggcaccgacagctggggcccgggtcagggacacgcggaggtcaggccggtgaaggcggcaggaagctggagcacgatcccaggaggaacaatcctgcaccatgactcaacagccacttcgaggagtgaccagcctgcgtttcaaccaagaccaaagctgcttttgctgcgccatggagacaggtgtgcgcatctacaacgtggagcccttgatggagaaggggcatctggaccacgagcaggtgggcagcatgggcttggtggagatgctgcaccgctccaaccttctggccttggtgggcggtggtagtagtcccaagttctcagagatctcagtgctgatctgggacgatgcccgggagggcaaggactccaaggagaagctggtgctggagttcaccttcaccaagccagtgctttctgtgcgcatgcgccatgacaagatcgtgatcgtgctgaagaaccgcatctatgtgtactccttccccgacaatccccgaaagctgtttgagtttgatacccgggacaaccccaaggggctctgtgacctctgccccagcctggagaagcaactgctagtgttcccgggacacaagtgtgggagtctgcaacttgtggacctggcgagcacaaagcctggcacctcgtctgctccattcacgatcaatgcacatcagagtgacatagcctgtgtgtctctaaaccagccaggcactgtagtggcctcagcctcccagaagggtacccttattcgcctctttgacacacaatccaaggagaaactggtggagctgcgccgaggcactgaccctgccaccctctactgccatctgcgtagatgggaccttccacaaatatgtcttcactcctgatggaaactgcaacagagaggctttcgacgtgtaccttgacatctgtgatgatgatgacttttaaggaccctgggggctgtgctagggacctgcagtggcagaactgcagagctgagccttggcagtggggcgtgcttggaagccaccagccagcaagcattaatggg

SEQ ID NO: 199822 - DNA, 794 bp, Homo sapiens
  Payload ID: 19423
  Gene Name: WD repeat domain 45
  ENST ID: ENST00000475977
  CDS Start-End: 1-369
ctgcaacttgtggacctggcgagcacaaagcctggcacctcgtctgctccattcacgatcaatgcacatcagagtgacatagcctgtgtgtctctaaaccagccaggcactgtagtggcctcagcctcccagaagggtacccttattcgcctctttgacacacaatccaaggagaaactggtggagctgcgccgaggcactgaccctgccaccctctactgcattaacttcagccacgactcctccttcctctgcgcttccagtgataagggtactgtccatatctttgctctcaaggatacccgcctcaaccgccgctccgcccatctgcgtagatgggaccttccacaaatatgtcttcactcctgatggaaactgcaacagagaggctttcgacgtgtaccttgacatctgtgatgatgatgacttttaaggaccctgggggctgtgctagggacctgcagtggcagaactgcagagctgagccttggcagtggggcgtgcttggaagccaccagccagcaagcattaatggggctggtgcccactttccactcagcagagctatgtctaaataaagagctcacttccccccagcacttcttgatgactgtgtgccccaagggccaggccagagacccaggaaggcagcgaccccttgggatccctaacctggaggaaattgccagggacccagagggagtgccctaatccaacctggggattttttaaaagcttcctaggaagagatgatctccgatgtgatgaatacgaataaaaggcccttaatggca

SEQ ID NO: 199823 - DNA, 699 bp, Homo sapiens
  Payload ID: 19423
  Gene Name: WD repeat domain 45
  ENST ID: ENST00000471338
  CDS Start-End: 175-699
aagtagggcctgatgtaaacacccgagccgggctccaaggcccgggaggtcagaaaaccgggccgcgggcggcaccgacagctggggcccgggtcagggacacgcggaggtcaggccggtgaaggcggcaggaagctggagcacgatcccagggttgaggaacaatcctgcaccatgactcaacagccacttcgaggagtgaccagcctgcgtttcaaccaagaccaaagctgcttttgctgcgccatggagacaggtgtgcgcatctacaacgtggagcccttgatggagaaggggcatctggaccacgagcaggtgggcagcatgggcttggtggagatgctgcaccgctccaaccttctggccttggtgggcggtggtagtagtcccaagttctcagagatctcagtgctgatctgggacgatgcccgggagggcaaggactccaaggagaagctggtgctggagttcaccttcaccaagccagtgctttctgtgcgcatgcgccatgacaagatcgtgatcgtgctgaagaaccgcatctatgtgtactccttccccgacaatccccgaaagctgtttgagtttgatacccgggacaaccccaaggggctctgtgacctctgccccagcctggagaagcaactgctagtgttcccgggacacaagtgtgggagtctgcaacttgtggacctggcg

SEQ ID NO: 199824 - DNA, 872 bp, Homo sapiens
  Payload ID: 19423
  Gene Name: WD repeat domain 45
  ENST ID: ENST00000475880
  CDS Start-End: 148-872
cgagccgggctccaaggcccgggaggtcagaaaaccgggccgcgggcggcaccgacagctggggcccgggtcagggacacgcggaggtcaggccggtgaaggcggcaggaagctggagcacgatcccaggaggaacaatcctgcaccatgactcaacagccacttcgaggagtgaccagcctgcgtttcaaccaagaccaaagctgcttttgctgcgccatggagacaggtgtgcgcatctacaacgtggagcccttgatggagaaggggcatctggcagtgctgatctgggacgatgcccgggagggcaaggactccaaggagaagctggtgctggagttcaccttcaccaagccagtgctttctgtgcgcatgcgccatgacaagatcgtgatcgtgctgaagaaccgcatctatgtgtactccttccccgacaatccccgaaagctgtttgagtttgatacccgggacaaccccaaggggctctgtgacctctgccccagcctggagaagcaactgctagtgttcccgggacacaagtgtgggagtctgcaacttgtggacctggcgagcacaaagcctggcacctcgtctgctccattcacgatcaatgcacatcagagtgacatagcctgtgtgtctctaaaccagccaggcactgtagtggcctcagcctcccagaagggtacccttattcgcctctttgacacacaatccaaggagaaactggtggagctgcgccgaggcactgaccctgccaccctctactgcattaacttcagccacgactcctccttcctctgcgcttccagtgataagggtactgtccatatctttgctctcaaggatacccgcctcaaccgccgctccgc

SEQ ID NO: 199825 - DNA, 569 bp, Homo sapiens
  Payload ID: 19423
  Gene Name: WD repeat domain 45
  ENST ID: ENST00000476728
  CDS Start-End: 155-569
aaacacccgagccgggctccaaggcccgggaggtcagaaaaccgggccgcgggcggcaccgacagctggggcccgggtcagggacacgcggaggtcaggccggtgaaggcggcaggaagctggagcacgatcccaggaggaacaatcctgcaccatgactcaacagccacttcgaggagtgaccagcctgcgtttcaaccaagaccaaagctgcttttgctgcgccatggagacaggtgtgcgcatctacaacgtggagcccttgatggagaaggggcatctggtgctgatctgggacgatgcccgggagggcaaggactccaaggagaagctggtgctggagttcaccttcaccaagccagtgctttctgtgcgcatgcgccatgacaagatcgtgatcgtgctgaagaaccgcatctatgtgtactccttccccgacaatccccgaaagctgtttgagtttgatacccgggacaaccccaaggccgcccaccccaccccccatcttcacaccctagggctctgtgacctctgccccagcctggagaagcaactgctagtgttcccgg

SEQ ID NO: 199826 - DNA, 422 bp, Homo sapiens
  Payload ID: 19423
  Gene Name: WD repeat domain 45
  ENST ID: ENST00000486337
  CDS Start-End: 1-259
caaccgccgctccgcgctggctcgcgtgggcaaggtggggcctatgattgggcagtacgtggactctcagtggagcctggcgagcttcactgtgcctgctgagtcagcttgcatctgcgccttcggtcgcaatacttccaagaacgtcaactctgtcattgatgggaccttccacaaatatgtcttcactcctgatggaaactgcaacagagaggctttcgacgtgtaccttgacatctgtgatgatgatgacttttaaggaccctgggggctgtgctagggacctgcagtggcagaactgcagagctgagccttggcagtggggcgtgcttggaagccaccagccagcaagcattaatggggctggtgcccactttccactcagcagagctatgtctaaataaagagctcacttcccccca

SEQ ID NO: 199827 - DNA, 1301 bp, Homo sapiens
  Payload ID: 19423
  Gene Name: WD repeat domain 45
  ENST ID: ENST00000485908
  CDS Start-End: 179-1156
tcccccggaagtagggcctgatgtaaacacccgagccgggctccaaggcccgggaggtcagaaaaccgggccgcgggcggcaccgacagctggggcccgggtcagggacacgcggaggtcaggccggtgaaggcggcaggaagctggagcacgatcccaggaggaacaatcctgcaccatgactcaacagccacttcgaggagtgaccagcctgcgtttcaaccaagaccaaagctgcttttgctgcgccatggagacaggtgtgcgcatctacaacgtggagcccttgatggagaaggggcatctggtgctgatctgggacgatgcccgggagggcaaggactccaaggagaagctggtgctggagttcaccttcaccaagccagtgctttctgtgcgcatgcgccatgacaagatcgtgatcgtgctgaagaaccgcatctatgtgtactccttccccgacaatccccgaaagctgtttgagtttgatacccgggacaaccccaaggggctctgtgacctctgccccagcctggagaagcaactgctagtgttcccgggacacaagtgtgggagtctgcaacttgtggacctggcgagcacaaagcctggcacctcgtctgctccattcacgatcaatgcacatcagagtgacatagcctgtgtgtctctaaaccagccaggcactgtagtggcctcagcctcccagaagggtacccttattcgcctctttgacacacaatccaaggagaaactggtggagctgcgccgaggcactgaccctgccaccctctactgcattaacttcagccacgactcctccttcctctgcgcttccagtgataagggtactgtccatatctttgctctcaaggatacccgcctcaaccgccgctccgcgctggctcgcgtgggcaaggtggggcctatgattgggcagtacgtggactctcagtggagcctggcgagcttcactgtgcctgctgagtcagcttgcatctgcgccttcggtcgcaatacttccaagaacgtcaactctgtcattgccatctgcgtagatgggaccttccacaaatatgtcttcactcctgatggaaactgcaacagagaggctttcgacgtgtaccttgacatctgtgatgatgatgacttttaaggaccctgggggctgtgctagggacctgcagtggcagaactgcagagctgagccttggcagtggggcgtgcttggaagccaccagccagcaagcattaatggggctggtgcccactttccactcagcagagctatgtctaaataa

SEQ ID NO: 199828 - DNA, 811 bp, Homo sapiens
  Payload ID: 19423
  Gene Name: WD repeat domain 45
  ENST ID: ENST00000465382
  CDS Start-End: 336-811
aaccggggcggctactctcggccgccgcggaggtccgcgtcttgttagcagggaaggtttactcccccattgtgggtgaccaaggggctgagggcttggccggtttcgctttgctgggggcaaggcacgctctctctccccacccttccgggttccctcagacagtctcggccttgaggaacccccttcgcctccggtcccccagccaaccttcctccgctccccgcgccctccccggagaaccccactgtcactcgcgatgctccgaagacccgggaactaggcgaggaaggcggtggccgcctttttccagctgggaggaacaatcctgcaccatgactcaacagccacttcgaggagtgaccagcctgcgtttcaaccaagaccaaagctgcttttgctgcgccatggagacaggtgtgcgcatctacaacgtggagcccttgatggagaaggggcatctggaccacgagcaggtgggcagcatgggcttggtggagatgctgcaccgctccaaccttctggccttggtgggcggtggtagtagtcccaagttctcagagatctcagtgctgatctgggacgatgcccgggagggcaaggactccaaggagaagctggtgctggagttcaccttcaccaagccagtgctttctgtgcgcatgcgccatgacaagatcgtgatcgtgctgaagaaccgcatctatgtgtactccttccccgacaatccccgaaagctgtttgagtttgatacccgggacaaccccaaggccgcccaccccaccccccatcttcacaccctagggctctg

SEQ ID NO: 199829 - DNA, 728 bp, Homo sapiens
  Payload ID: 19423
  Gene Name: WD repeat domain 45
  ENST ID: ENST00000474053
  CDS Start-End: 88-728
ggaggtcagaaaaccgggccgcgggcggcaccgacagctggggcccgggtcagggacacgcggaggtcagaggaacaatcctgcaccatgactcaacagccacttcgaggagtgaccagcctgcgtttcaaccaagaccaaagctgcttttgctgcgccatggagacaggtgtgcgcatctacaacgtggagcccttgatggagaaggggcatctggaccacgagcaggtgggcagcatgggcttggtggagatgctgcaccgctccaaccttctggccttggtgggcggtggtagtagtcccaagttctcagagatctcaggggtggatcctgtgtcaccagggctgccccttaccctaaaccttggccccgacaacccacccacctgcccagcagtgctgatctgggacgatgcccgggagggcaaggactccaaggagaagctggtgctggagttcaccttcaccaagccagtgctttctgtgcgcatgcgccatgacaagatcgtgatcgtgctgaagaaccgcatctatgtgtactccttccccgacaatccccgaaagctgtttgagtttgatacccgggacaaccccaaggggctctgtgacctctgccccagcctggagaagcaactgctagtgttcccgggacacaagtgtgggagtctgcaacttgtggacctggcgagcacaaagcctggcacctcgtctgctccattcacgatcaa

SEQ ID NO: 199830 - DNA, 1745 bp, Homo sapiens
  Payload ID: 19423
  Gene Name: WD repeat domain 45
  ENST ID: ENST00000634944
  CDS Start-End: 302-1384
cccttcgcctccggtcccccagccaaccttcctccgctccccgcgccctccccggagaaccccactgtcactcgcgatgctccgaagacccgggaactaggcgaggaaggcggtggccgcctttttccagctggggtgagtcatttcctgcgacaggctccctcccccggaagtagggcctgatgtaaacacccgagccgggctccaaggcccgggaggtcagaaaaccgggccgcgggcggcaccgacagctggggcccgggtcagggacacgcggaggtcagaggaacaatcctgcaccatgactcaacagccacttcgaggagtgaccagcctgcgtttcaaccaagaccaaagctgcttttgctgcgccatggagacaggtgtgcgcatctacaacgtggagcccttgatggagaaggggcatctggaccacgagcaggtgggcagcatgggcttggtggagatgctgcaccgctccaaccttctggccttggtgggcggtggtagtagtcccaagttctcagagatctcagtgctgatctgggacgatgcccgggagggcaaggactccaaggagaagctggtgctggagttcaccttcaccaagccagtgctttctgtgcgcatgcgccatgacaagatcgtgatcgtgctgaagaaccgcatctatgtgtactccttccccgacaatccccgaaagctgtttgagtttgatacccgggacaaccccaaggggctctgtgacctctgccccagcctggagaagcaactgctagtgttcccgggacacaagtgtgggagtctgcaacttgtggacctggcgagcacaaagcctggcacctcgtctgctccattcacgatcaatgcacatcagagtgacatagcctgtgtgtctctaaaccagccaggcactgtagtggcctcagcctcccagaagggtacccttattcgcctctttgacacacaatccaaggagaaactggtggagctgcgccgaggcactgaccctgccaccctctactgcattaacttcagccacgactcctccttcctctgcgcttccagtgataagggtactgtccatatctttgctctcaaggatacccgcctcaaccgccgctccgcgctggctcgcgtgggcaaggtggggcctatgattgggcagtacgtggactctcagtggagcctggcgagcttcactgtgcctgctgagtcagcttgcatctgcgccttcggtcgcaatacttccaagaacgtcaactctgtcattgccatctgcgtagatgggaccttccacaaatatgtcttcactcctgatggaaactgcaacagagaggctttcgacgtgtaccttgacatctgtgatgatgatgacttttaaggaccctgggggctgtgctagggacctgcagtggcagaactgcagagctgagccttggcagtggggcgtgcttggaagccaccagccagcaagcattaatggggctggtgcccactttccactcagcagagctatgtctaaataaagagctcacttccccccagcacttcttgatgactgtgtgccccaagggccaggccagagacccaggaaggcagcgaccccttgggatccctaacctggaggaaattgccagggacccagagggagtgccctaatccaacctggggattttttaaaagcttcctaggaagagatgatctccgatgtgatgaatacgaataaaaggcccttaatggca

SEQ ID NO: 199831 - DNA, 1192 bp, Homo sapiens
  Payload ID: 19423
  Gene Name: WD repeat domain 45
  ENST ID: ENST00000634559
  CDS Start-End: 160-1029
gatgtaaacacccgagccgggctccaaggcccgggaggtcagaaaaccgggccgcgggcggcaccgacagctggggcccgggtcagggacacgcggaggtcaggccggtgaaggcggcaggaagctggagcacgatcccaggaggaacaatcctgcaccatgactcaacagccacttcgaggagtgaccagcctgcgtttcaaccaagaccaaagctgcttttgctgcgccatggagacaggtgtgcgcatctacaacgtggagcccttgatggagaaggggcatctggaccacgagcaggtgggcagcatgggcttggtggagatgctgcaccgctccaaccttctggccttggtgggcggtggtagtagtcccaagttctcagagatctcagggctctgtgacctctgccccagcctggagaagcaactgctagtgttcccgggacacaagtgtgggagtctgcaacttgtggacctggcgagcacaaagcctggcacctcgtctgctccattcacgatcaatgcacatcagagtgacatagcctgtgtgtctctaaaccagccaggcactgtagtggcctcagcctcccagaagggtacccttattcgcctctttgacacacaatccaaggagaaactggtggagctgcgccgaggcactgaccctgccaccctctactgccacgactcctccttcctctgcgcttccagtgataagggtactgtccatatctttgctctcaaggatacccgcctcaaccgccgctccgcgctggctcgcgtgggcaaggtggggcctatgattgggcagtacgtggactctcagtggagcctggcgagcttcactgtgcctgctgagtcagcttgcatctgcgccttcggtcgcaatacttccaagaacgtcaactctgtcattgccatctgcgtagatgggaccttccacaaatatgtcttcactcctgatggaaactgcaacagagaggctttcgacgtgtaccttgacatctgtgatgatgatgacttttaaggaccctgggggctgtgctagggacctgcagtggcagaactgcagagctgagccttggcagtggggcgtgcttggaagccaccagccagcaagcattaatggggctggtgcccactttccactcagcagagctatgtctaaataaagagctcacttcccccca

SEQ ID NO: 199832 - DNA, 822 bp, Homo sapiens
  Payload ID: 19423
  Gene Name: WD repeat domain 45
  ENST ID: ENST00000634671
  CDS Start-End: 646-822
ttcagtgcctgggctccgggaaagtcgtgcttttacggttccgggtactggctcccacaccactgcctcgtgtggggttgttcgcccgtgaaggggcaggacagggtgcgcgctggtggaggttgaaattgttacattttggccgggcgcggtggctcacgcctgtaatcccagcactttgggaggccgaggcaggtggatcacgaggtcaggagatcgagaccatcctggctaacacagtgaaaccccgtctctactaaaaaaatacaaaaaatcagccgggcgtggtgacgggcgcctgtagtcccagctactcaggaggctgaggcaggaggatggcgtgaacccgggaggcggagcttgcagtgagccgagatcgcgccagtgcactccagcctgggcgacagagcgaaactacgtctcaaaaaaaaaaaaaaagaaagaaaagaaattgttacattttatatatatacagtctcggccttgaggaacccccttcgcctccggtcccccagccaaccttcctccgctccccgcgccctccccggagaaccccactgtcactcgcgatgctccgaagacccgggaactaggcgaggaaggcggtggccgcctttttccagctgggaggaacaatcctgcaccatgactcaacagccacttcgaggagtgaccagcctgcgtttcaaccaagaccaaagctgcttttgctgcgccatggagacagaccacgagcaggtgggcagcatgggcttggtggagatgctgcaccgctccaaccttctggccttggtgggcggtggtagtagtcccaagttctca

SEQ ID NO: 199833 - DNA, 1376 bp, Homo sapiens
  Payload ID: 19423
  Gene Name: WD repeat domain 45
  ENST ID: ENST00000635003
  CDS Start-End: 135-1016
aaggcccgggaggtcagaaaaccgggccgcgggcggcaccgacagctggggcccgggtcagggacacgcggaggtcaggccggtgaaggcggcaggaagctggagcacgatcccaggaggaacaatcctgcaccatgactcaacagccacttcgaggagtgaccagcctgcgtttcaaccaagaccaaagctgcttttgctgcgccatggagacaggtgtgcgcatctacaacgtggagcccttgatggagaaggggcatctggaccacgagcaggtgggcagcatgggcttggtggagatgctgcaccgctccaaccttctggccttggtgggcggtggtagtagtcccaagttctcagagatctcagggctctgtgacctctgccccagcctggagaagcaactgctagtgttcccgggacacaagtgtgggagtctgcaacttgtggacctggcgagcacaaagcctggcacctcgtctgctccattcacgatcaatgcacatcagagtgacatagcctgtgtgtctctaaaccagccaggcactgtagtggcctcagcctcccagaagggtacccttattcgcctctttgacacacaatccaaggagaaactggtggagctgcgccgaggcactgaccctgccaccctctactgcattaacttcagccacgactcctccttcctctgcgcttccagtgataagggtactgtccatatctttgctctcaaggatacccgcctcaaccgccgctccgcgctggctcgcgtgggcaaggtggggcctatgattgggcagtacgtggactctcagtggagcctggcgagcttcactgtgcctgctgagtcagcttgcatctgcgccttcggtcgcaatacttccaagaacgtcaactctgtcattgccatctgcgtagatgggaccttccacaaatatgtcttcactcctgatggaaactgcaacagagaggctttcgacgtgtaccttgacatctgtgatgatgatgacttttaaggaccctgggggctgtgctagggacctgcagtggcagaactgcagagctgagccttggcagtggggcgtgcttggaagccaccagccagcaagcattaatggggctggtgcccactttccactcagcagagctatgtctaaataaagagctcacttccccccagcacttcttgatgactgtgtgccccaagggccaggccagagacccaggaaggcagcgaccccttgggatccctaacctggaggaaattgccagggacccagagggagtgccctaatccaacctggggattttttaaaagcttcctaggaagagatgatctccgatgtgatgaatacgaataaaaggcccttaatggc

SEQ ID NO: 199834 - DNA, 947 bp, Homo sapiens
  Payload ID: 19423
  Gene Name: WD repeat domain 45
  ENST ID: ENST00000635666
  CDS Start-End: 118-947
gtaaacacccgagccgggctccaaggcccgggaggtcagaaaaccgggccgcgggcggcaccgacagctggggcccgggtcagggacacgcggaggtcaggctgcttttgctgcgccatggagacaggtgtgcgcatctacaacgtggagcccttgatggagaaggggcatctggaccacgagcaggtgggcagcatgggcttggtggagatgctgcaccgctccaaccttctggccttggtgggcggtggtagtagtcccaagttctcagagatctcagtgctgatctgggacgatgcccgggagggcaaggactccaaggagaagctggtgctggagttcaccttcaccaagccagtgctttctgtgcgcatgcgccatgacaagatcgtgatcgtgctgaagaaccgcatctatgtgtactccttccccgacaatccccgaaagctgtttgagtttgatacccgggacaaccccaaggggctctgtgacctctgccccagcctggagaagcaactgctagtgttcccgggacacaagtgtgggagtctgcaacttgtggacctggcgagcacaaagcctggcacctcgtctgctccattcacgatcaatgcacatcagagtgacatagcctgtgtgtctctaaaccagccaggcactgtagtggcctcagcctcccagaagggtacccttattcgcctctttgacacacaatccaaggagaaactggtggagctgcgccgaggcactgaccctgccaccctctactgcattaacttcagccacgactcctccttcctctgcgcttccagtgataagggtactgtccatatctttgctctcaaggatacccgcctcaaccgccgctccgctgctgcctgcaggctggctcgcgtgggcaaggtggggcctatgattgggcagtacgtggactctcagtggagcct

SEQ ID NO: 199835 - DNA, 918 bp, Homo sapiens
  Payload ID: 19423
  Gene Name: WD repeat domain 45
  ENST ID: ENST00000634849
  CDS Start-End: 431-918
cgctggtggaggttagtgaggtcacacaccgggccgtggcgcctggtgcgctgggcgcttccacctcaaccttcgtagcaaacccagcggggttctgtgcctgcgcaccgtggttcctgcgttcatttactgtcccgtttctcactccggaaagtgtggctttgagtttgatctgcaggagtaggacgggcacagcgggtgtctggtcttcctcgcaccataaatcgcagagcgagccctctgtggtctctggatacagtataccaaagttagattaactgtactccttctcacaagccggtccaacgtttgcagcagtgaaaaagccctaagtgtcagggcctttggcgaagcctgtgtaagggaataaacactttccccagttttccaggcgcaaactgatggttttggagcattaaggtctggtcggatggggcaggatggctgcgttgacacgtcttatttaatccacatcatagaggaacaatcctgcaccatgactcaacagccacttcgaggagtgaccagcctgcgtttcaaccaagaccaaagctgcttttgctgcgccatggagacaggtgtgcgcatctacaacgtggagcccttgatggagaaggggcatctggaccacgagcaggtgggcagcatgggcttggtggagatgctgcaccgctccaaccttctggccttggtgggcggtggtagtagtcccaagttctcagagatctcagcagtgctgatctgggacgatgcccgggagggcaaggactccaaggagaagctggtgctggagttcaccttcaccaagccagtgctttctgtgcgcatgcgccatgacaagatcgtgatcgtgctgaagaaccgcatctatgtgtactccttccccgacaatccccgaaagctgtttgagtttgatac

SEQ ID NO: 199836 - DNA, 1545 bp, Homo sapiens
  Payload ID: 19423
  Gene Name: WD repeat domain 45
  ENST ID: ENST00000634838
  CDS Start-End: 149-1189
ccgagccgggctccaaggcccgggaggtcagaaaaccgggccgcgggcggcaccgacagctggggcccgggtcagggacacgcggaggtcaggccggtgaaggcggcaggaagctggagcacgatcccaggaggaacaatcctgcaccatgactcaacagccacttcgaggagtgaccagcctgcgtttcaaccaagaccaaagctgcttttgctgcgccatggagacaggtgtgcgcatctacaacgtggagcccttgatggagaaggggcatctggaccacgagcaggtgggcagcatgggcttggtggagatgctgcaccgctccaaccttctggccttggtgggcggtggtagtagtcccaagttctcagagatctcagtgctgatctgggacgatgcccgggagggcaaggactccaaggagaagctggtgctggagttcaccttcaccaagccagtgctttctgtgcgcatgcgccatgacaagatcgtgatcgtgctgaagaaccgcatctatgtgtactccttccccgacaatccccgaaagctgtttgagtttgatacccgggacaaccccaaggggctctgtgacctctgccccagcctggagaagcaactgctagtgttcccgggacacaagtgtgggagtctgcaacttgtggacctggcgagcacaaagcctggcacctcgtctgctccattcacgatcaatgcacatcagagtgacatagcctgtgtgtctctaaaccagccaggcactgtagtggcctcagcctcccagaagggtacccttattcgcctctttgacacacaatccaaggagaaactggtggagctgcgccgaggcactgaccctgccaccctctactgtgataagggtactgtccatatctttgctctcaaggatacccgcctcaaccgccgctccgcgctggctcgcgtgggcaaggtggggcctatgattgggcagtacgtggactctcagtggagcctggcgagcttcactgtgcctgctgagtcagcttgcatctgcgccttcggtcgcaatacttccaagaacgtcaactctgtcattgccatctgcgtagatgggaccttccacaaatatgtcttcactcctgatggaaactgcaacagagaggctttcgacgtgtaccttgacatctgtgatgatgatgacttttaaggaccctgggggctgtgctagggacctgcagtggcagaactgcagagctgagccttggcagtggggcgtgcttggaagccaccagccagcaagcattaatggggctggtgcccactttccactcagcagagctatgtctaaataaagagctcacttccccccagcacttcttgatgactgtgtgccccaagggccaggccagagacccaggaaggcagcgaccccttgggatccctaacctggaggaaattgccagggacccagagggagtgccctaatccaacctggggattttttaaaagcttcctaggaagagatgatctccgatgtgatgaatacgaataaaaggcccttaa

SEQ ID NO: 199837 - DNA, 545 bp, Homo sapiens
  Payload ID: 19423
  Gene Name: WD repeat domain 45
  ENST ID: ENST00000634522
  CDS Start-End: 85-327
ggtcagaaaaccgggccgcgggcggcaccgacagctggggcccgggtcagggacacgcggaggtcagaggaacaatcctgcaccatgactcaacagccacttcgaggagtgaccagcctgcgtttcaaccaagaccaaagctgcttttgctgcgccatggagacaggtgtgcgcatctacaacgtggagcccttgatggagaaggggcatctggaccacgagcaggtgggcagcatgggcttggtggagatgctgcaccgctccaaccttctggccttggtgggcggtggtagtagtcccaagttctcagagatctcaggatcgtgatcgtgctgaagaaccgcatctatgtgtactccttccccgacaatccccgaaagctgtttgagtttgatacccgggacaaccccaaggggctctgtgacctctgccccagcctggagaagcaactgctagtgttcccgggacacaagtgtgggagtctgcaacttgtggacctggcgagcacaaagcctggcacctcgtctgctccattcacgatcaat

SEQ ID NO: 199838 - DNA, 737 bp, Homo sapiens
  Payload ID: 19423
  Gene Name: WD repeat domain 45
  ENST ID: ENST00000635344
  CDS Start-End: 131-268
agtagggcctgatgtaaacacccgagccgggctccaaggcccgggaggtcagaaaaccgggccgcgggcggcaccgacagctggggcccgggtcagggacacgcggaggtcagaggaacaatcctgcaccatgactcaacagccacttcgaggagtgaccagcctgcgtttcaaccaagaccaaagctgcttttgctgcgccatggagacaggtgtgcgcatctacaacgtggagcccttgatggagaaggggcatctgggatcgtgatcgtgctgaagaaccgcatctatgtgtactccttccccgacaatccccgaaagctgtttgagtttgatacccgggacaaccccaaggggctctgtgacctctgccccagcctggagaagcaactgctagtgttcccgggacacaagtgtgggagtctgcaacttgtggacctggcgagcacaaagcctggcacctcgtctgctccattcacgatcaatgcacatcagagtgacatagcctgtgtgtctctaaaccagccaggcactgtagtggcctcagcctcccagaagggtacccttattcgcctctttgacacacaatccaaggagaaactggtggagctgcgccgaggcactgaccctgccaccctctactgcattaacttcagccacgactcctccttcctctgcgcttccagtgataagggtactgtccatatctttgctctcaaggatacccgcctcaaccg

SEQ ID NO: 199839 - DNA, 757 bp, Homo sapiens
  Payload ID: 19423
  Gene Name: WD repeat domain 45
  ENST ID: ENST00000634736
  CDS Start-End: 168-757
tagggcctgatgtaaacacccgagccgggctccaaggcccgggaggtcagaaaaccgggccgcgggcggcaccgacagctggggcccgggtcagggacacgcggaggtcaggccggtgaaggcggcaggaagctggagcacgatcccaggaggaacaatcctgcaccatgactcaacagccacttcgaggagtgaccagcctgcgtttcaaccaagaccaaagctgcttttgctgcgccatggagacaggtgtgcgcatctacaacgtggagcccttgatggagaaggggcatctggggctctgtgacctctgccccagcctggagaagcaactgctagtgttcccgggacacaagtgtgggagtctgcaacttgtggacctggcgagcacaaagcctggcacctcgtctgctccattcacgatcaatgcacatcagagtgacatagcctgtgtgtctctaaaccagccaggcactgtagtggcctcagcctcccagaagggtacccttattcgcctctttgacacacaatccaaggagaaactggtggagctgcgccgaggcactgaccctgccaccctctactgcattaacttcagccacgactcctccttcctctgcgcttccagtgataagggtactgtccatatctttgctctcaaggatacccgcctcaaccgccgctccgcgctggctcgcgtgggcaaggtggggcctatgattgggcagtacgtggactctcagtggagcctggcgag

SEQ ID NO: 199840 - DNA, 2587 bp, Homo sapiens
  Payload ID: 19424
  Gene Name: WD repeat domain 45B
  Uniprot ID: Q5MNZ6
  ENST ID: ENST00000392325
  CDS Start-End: 196-1230
gtggggcgcgggcgcgcgcacggacgtccagcacgcacgcacgcacgtccagcacacacgcacatccagcacgcacgcacgtacgtccggcacttccggccgcggcggcctcagcgccggcccgaagggaccaggccgccgtccccagcgagaggcatgcagcgctgaggagcggcgacccagcacggcggcgccatgaacctcctgccgtgtaaccctcacggcaacgggctgctctacgccggcttcaaccaggaccacggatgctttgcgtgtgggatggaaaatggattccgagtctataacactgatccactaaaagaaaaagagaaacaagaatttctagaaggaggagttggccatgttgaaatgttatttcgctgcaactatttagctttagttggtggtggaaaaaagccgaaataccctcccaacaaagtaatgatctgggatgacctgaagaagaagactgttattgaaatagaattttctacagaagtcaaggcagtcaagctgcggcgagatagaattgtggtggttttggactccatgattaaggtgttcacattcacacacaatccccatcagttgcacgtcttcgaaacctgctataaccccaaaggcctctgtgtcctttgtcccaatagtaacaactccctcctggcctttccgggcacgcacacgggccatgtgcagcttgtggacctggccagcacggagaagccacccgtggacattcctgcacacgagggtgtcctgagctgcattgcactcaacctgcagggaacaagaattgcaactgcatccgagaaagggacgcttataagaatatttgatacttcatcagggcatttaatccaggaactgcgaagaggatctcaagcagccaatatttactgcatcaacttcaatcaggatgcgtccctcatctgcgtatccagcgaccacggcacagtgcatatttttgcagctgaagatccaaaaaggaataaacagtccagtttggcctcagccagtttccttccaaaatacttcagttccaagtggagtttctccaagtttcaggttccctcaggctctccgtgcatttgtgcctttggaacagagccaaacgccgtcattgcaatttgtgcagacggcagctactacaaattcctgttcaaccccaagggggagtgcatccgagatgtctacgcgcagtttctagagatgaccgatgacaagctgtgactccagctgggggcgccacagcacccaccacctgccgccttcagactctcggggctggtgccagtgccccaggggcctcctgggccacgggctggaggggctgcccagggaccttggtctcgaagccatacgtggttgtctgctttcctaaggactcccatttccagtattaaagagagaatcatcatcaaggcaccgtaggtaactcagtggctgtgaccagctcgactggcggccactggctgttcccatgagttcagctgtgacgttagcttcagtggctccgccgcatcctcacactgacgggggctccatacggacctggggactgggctgagagggtggacgagttcaggtttgtttttgcagcagattccgtcgttcttactgagtctgcagcgggggagtgaacaagtgtgcagatgtaagttcttacatgataagcagattgaatacaacaccagcagcttgccttagaaaaggagaaaggaattccttttcccgcccgaacatgaagaaaaatgacctgaccctgtagagagaacacagtgtgaatgtttcccctcgtgtgagcccagcctgtggtcttctccgtacccgcaacgtggtcatctgtgcccgtgacgtcacctgtgcccgtgcgtggcgtccccgtctccgttggggccattagaatgaggcagacaccaggccactctagaagccgagccgtcacacctcaggcgtgtgcggggcggggacggggggtctcctggttacattttggattaaacctgtttcccggttatgtgtagggaacagcagagtgatgcacgaactttgaacattcgttatggggaaaacatcctttaacttcggggtcgtctgccagagcagggtctgggagggtccatgcagttcccgctggtgtggagggaaatgccctggtctggcctccgagcccccaggtccaccgtctcccctcccctcatttgtaagaatagctacacactaacattttgggaaggagaggcacataactttttttaacatttggtaactaggttatgggctctacattgtcagctacttgggatatatatttaattttcttaaattcccgttaaactctattttatggttttgatttcagattgcaaacatgtaaaacctgcatagcagcgagttctcggttttgccggtttctttagttctttactgtcactgtcatgtaatcagctaattctctgtggatgttgctgtaaagtatgcatgttcctttcatgtgtatttaatcatgatgtttaattttgcacacttatttgtaatgtttcttttaaataaaagtgactaattttgttgtagtctggacctgtaa

SEQ ID NO: 199841 - DNA, 896 bp, Homo sapiens
  Payload ID: 19424
  Gene Name: WD repeat domain 45B
  ENST ID: ENST00000573616
  CDS Start-End: 105-629
acttccggccgcggcggcctcagcgccggcccgaagggaccaggccgccgtccccagcgagaggcatgcagcgctgaggagcggcgacccagcacggcggcgccatgaacctcctgccgtgtaaccctcacggcaacgggctgctctacgccggcttcaaccaggaccacggatgctttgcgtgtgggatggaaaatggattccgagtctataacactgatccactaaaagaaaaagagaaacaagtaatgatctgggatgacctgaagaagaagactgttattgaaatagaattttctacagaagtcaaggcagtcaagctgcggcgagatagaattgtggtggttttggactccatgattaaggtgttcacattcacacacaatccccatcagttgcacgtcttcgaaacctgctataaccccaaaggcctctgtgtcctttgtcccaatagtaacaactccctcctggcctttccgggcacgcacacgggccatgtgcagcttgtggacctggccagcacggagaagccacccgtggacattcctgcacacgagggtgtcctgagctgcattgcactcaacctgcagggaacaagaattgcaactgcatccgagaaaggcatttaatccaggaactgcgaagaggatctcaagcagccaatatttactgcatcaacttcaatcaggatgcgtccctcatctgcgtatccagcgaccacggcacagtgcatatttttgcagctgaagatccaaaaaggaataaacagtccagtttggcctcagccagtttccttccaaaatacttcagttccaagtggagtttctccaagtttcaggttccctcaggctctccgtgcatttgtgcctttggaacagagccaaacgccgtcattg

SEQ ID NO: 199842 - DNA, 779 bp, Homo sapiens
  Payload ID: 19424
  Gene Name: WD repeat domain 45B
  ENST ID: ENST00000576517
  CDS Start-End: 1-373
ccaggaactgcgaagaggatctcaagcagccaatatttactgcatcaacttcaatcaggatgcgtccctcatctgcgtatccagcgaccacggcacagtgcatatttttgcagctgaagatccaaaaaggaataaacagtccagtttggcctcagccagtttccttccaaaatacttcagttccaagtggagtttctccaagtttcaggttccctcaggctctccgtgcatttgtgcctttggaacagagccaaacgccgtcattgcaatttgtgcagacggcagctactacaaattcctgttcaaccccaagggggagtgcatccgagatgtctacgcgcagtttctagagatgaccgatgacaagctgtgactccagctgggggcgccacagcacccaccacctgccgccttcagactctcggggctggtgccagtgccccaggggcctcctgggccacgggctggaggggctgcccagggaccttggtctcgaagccatacgtggttgtctgctttcctaaggactcccatttccagtattaaagagagaatcatcatcaaggcaccgtagattgcaaacatgtaaaacctgcatagcagcgagttctcggttttgccggtttctttagttctttactgtcactgtcatgtaatcagctaattctctgtggatgttgctgtaaagtatgcatgttcctttcatgtgtatttaatcatgatgtttaattttgcacacttatttgtaatgtttcttttaaataaaagtgactaatttt

SEQ ID NO: 199843 - DNA, 889 bp, Homo sapiens
  Payload ID: 19424
  Gene Name: WD repeat domain 45B
  ENST ID: ENST00000571817
  CDS Start-End: 109-366
cggcacttccggccgcggcggcctcagcgccggcccgaagggaccaggccgccgtccccagcgagaggcatgcagcgctgaggagcggcgacccagcacggcggcgccatgaacctcctgccgtgtaaccctcacggcaacgggctgctctacgccggcttcaaccaggaccacggatgctttgcgtgtgggatggaaaatggattccgagtctataacactgatccactaaaagaaaaagagaaacaagaatttctagaaggaggagttggccatgttgaaatgttatttcgctgcaactatttagctttagttggtggtggaaaaaagccgaaataccctcccaacaaaggaacagagaaatgaaatgggaagagattatcggtaggaaaaacagtggaagacagggcttgagatcttggcctttgagcggttctgtaatctcacaagtaatgatctgggatgacctgaagaagaagactgttattgaaatagaattttctacagaagtcaaggcagtcaagctgcggcgagatagaattgtggtggttttggactccatgattaaggtgttcacattcacacacaatccccatcagttgcacgtcttcgaaacctgctataaccccaaaggcctctgtgtcctttgtcccaatagtaacaactccctcctggcctttccgggcacgcacacgggccatgtgcagcttgtggacctggccagcacggagaagccacccgtggacattcctgcacacgagggtgtcctgagctgcattgcactcaacctgcagggaacaagaattgcaactgcatccgagaaagggacgcttataagaatatttgatacttcatcagggcatttaatccaggaactgcgaagaggatc

SEQ ID NO: 199844 - DNA, 2322 bp, Homo sapiens
  Payload ID: 19424
  Gene Name: WD repeat domain 45B
  ENST ID: ENST00000572583
  CDS Start-End: 1-605
ctcacggcaacgggctgctctacgccggcttcaaccaggaccacggatgctttgcgtgtgggatggaaaatggattccgagtctataacactgatccactaaaagaaaaagagaaacaagaatttctagaaggaggagttggccatgttgaaatgttatttcgctgcaactatttagctttagttggtggtggaaaaaagccgaaataccctcccaacaaagtaatgatctgggatgacctgaagaagaagactgttattgaaatagaattttctacagaagtcaaggcagtcaagctgcggcgagatagaattgtggtggttttggactccatgattaaggtgttcacattcacacacaatccccatcagttgcacgtcttcgaaacctgctataaccccaaaggcctctgtgtcctttgtcccaatagtaacaactccctcctggcctttccgggcacgcacacgggccatgtgcagcttgtggacctggccagcacggagaagccacccgtggacattcctgcacacgagggtgtcctgagctgcattgcactcaacctgcagggaacaagaattgcaactgcatccgagaaaggcatttaatccaggaactgcgaagaggatctcaagcagccaatatttactgcatcaacttcaatcaggatgcgtccctcatctgcgtatccagcgaccacggcacagtgcatatttttgcagctgaagatccaaaaaggaataaacagtccagtttggcctcagccagtttccttccaaaatacttcagttccaagtggagtttctccaagtttcaggttccctcaggctctccgtgcatttgtgcctttggaacagagccaaacgccgtcattgcaatttgtgcagacggcagctactacaaattcctgttcaaccccaagggggagtgcatccgagatgtctacgcgcagtttctagagatgaccgatgacaagctgtgactccagctgggggcgccacagcacccaccacctgccgccttcagactctcggggctggtgccagtgccccaggggcctcctgggccacgggctggaggggctgcccagggaccttggtctcgaagccatacgtggttgtctgctttcctaaggactcccatttccagtattaaagagagaatcatcatcaaggcaccgtaggtaactcagtggctgtgaccagctcgactggcggccactggctgttcccatgagttcagctgtgacgttagcttcagtggctccgccgcatcctcacactgacgggggctccatacggacctggggactgggctgagagggtggacgagttcaggtttgtttttgcagcagattccgtcgttcttactgagtctgcagcgggggagtgaacaagtgtgcagatgtaagttcttacatgataagcagattgaatacaacaccagcagcttgccttagaaaaggagaaaggaattccttttcccgcccgaacatgaagaaaaatgacctgaccctgtagagagaacacagtgtgaatgtttcccctcgtgtgagcccagcctgtggtcttctccgtacccgcaacgtggtcatctgtgcccgtgacgtcacctgtgcccgtgcgtggcgtccccgtctccgttggggccattagaatgaggcagacaccaggccactctagaagccgagccgtcacacctcaggcgtgtgcggggcggggacggggggtctcctggttacattttggattaaacctgtttcccggttatgtgtagggaacagcagagtgatgcacgaactttgaacattcgttatggggaaaacatcctttaacttcggggtcgtctgccagagcagggtctgggagggtccatgcagttcccgctggtgtggagggaaatgccctggtctggcctccgagcccccaggtccaccgtctcccctcccctcatttgtaagaatagctacacactaacattttgggaaggagaggcacataactttttttaacatttggtaactaggttatgggctctacattgtcagctacttgggatatatatttaattttcttaaattcccgttaaactctattttatggttttgatttcagattgcaaacatgtaaaacctgcatagcagcgagttctcggttttgccggtttctttagttctttactgtcactgtcatgtaatcagctaattctctgtggatgttgctgtaaagtatgcatgttcctttcatgtgtatttaatcatgatgtttaattttgcacacttatttgtaatgtttcttttaaataaaagtgactaattttgttgta

SEQ ID NO: 199845 - DNA, 2358 bp, Homo sapiens
  Payload ID: 19425
  Gene Name: WD repeat domain 46
  Uniprot ID: O15213
  ENST ID: ENST00000374617
  CDS Start-End: 358-2190
gtagttctgacatgtttagggagtggagttctgctaaaaagactagactaggacatttttaggcaagatggggaaactaatccagaaaaagaaaccgcaccgctacttagcccctggctccggacctgcctttcttttttaaatcactcttgcataagctgccgctcgcgataaggtgccaaaaactgttccgcccctctaaggagagcgtgccctcactcaagatggcacctagagagcttcatacctggtacgctgctgattggatgaaggacagagggcttccgggagttttcaagccgactgtgtggcagctgagaggagttttgcacgtggatcgccgttcgggtgggcgagatggagacagcccccaagccgggcaaggatgtcccgcccaagaaagacaaacttcagaccaagagaaagaaaccgcggcgatactgggaggaagagaccgttccgaccacagccggagcctctccagggcctcctcgtaacaagaagaatcgggagctccgtcctcagagaccaaaaaatgcttacatcttaaagaagtctcggatctctaagaagcctcaggtcccgaagaaaccccgagaatggaagaacccggagtcccagcgcggcttgtccgggacccaagatccattcccaggccccgcccccgtccctgtggaagtggtccagaagttctgtcgcattgacaaatcccgaaagctaccacattctaaagccaaaactcgaagccgacttgaggtggctgaagctgaggaagaggaaacaagtatcaaagctgctcgttctgagctgctgcttgctgaagaacctgggtttctggaaggggaggatggggaagacacagcaaagatatgccaggctgacattgtggaggctgtggacattgcaagtgcagccaagcactttgacttgaatctgcggcagtttggaccctacagactaaactactctcgaactggaagacacctggcttttggagggcgccgaggtcatgtggctgcccttgattgggtaacaaagaagcttatgtgcgagatcaacgtcatggaggcggtgcgggacatccggtttctccattctgaggcactgcttgctgttgctcagaaccgctggctccacatctatgacaatcagggcattgagctccactgtatccgccgctgtgaccgagtaacacggcttgagttcctgcccttccacttcctcctggctacagcttcagaaacagggtttctaacctacctggatgtgtcagtggggaagattgtggcagctctgaatgctcgagctgggcggctcgatgttatgagtcagaacccttacaatgccgtcatccatctcggacacagcaatggtactgtgtctttatggagtccagctatgaaggagccactggcaaagattctctgtcatcgtggtggggtccgggctgtggcagtagattctacaggcacgtacatggccacctctggcctagaccaccagctgaagatctttgacttgcgagggacgtaccagcctctgagcactcggaccctgccccatggagcagggcacctggccttctcccagaggggactgctggtggcgggaatgggtgacgttgtcaacatctgggcagggcagggcaaggccagcccaccctcccttgaacagccctacctcacccaccggctctcaggccctgtgcatggccttcagttctgcccctttgaagatgtgctgggggtggggcacactgggggcatcaccagcatgctggtccctggggccggtgagcccaacttcgatggcctggagagtaatccatacagaagccggaagcagcgccaggagtgggaggtgaaggccctgctagagaaggtacctgcagagcttatttgtctggacccacgagccctggccgaggtggatgtcatctccctggagcagggaaagaaggagcagatagagaggctgggctatgacccgcaggctaaggctcccttccagccaaagccaaagcagaagggccgcagctccacggcaagcctggtgaagaggaagaggaaggtcatggatgaggaacacagggacaaggtccggcagagccttcagcagcagcatcataaggaggcgaaggccaagcccacgggggcccggccatctgccctggacagatttgtgcgctgagccagactccagggttgcctgggaacagtctctccccaagatcacctgtagggaaatgagtgttccctggaacaaggaggtgggggcagtgtggccccttccccaactgggggtggacagctgtctcctggggtgggttggtattaaagaggaaagcgattttttgga

SEQ ID NO: 199846 - DNA, 2358 bp, Homo sapiens
  Payload ID: 19425
  Gene Name: WD repeat domain 46
  Uniprot ID: O15213
  ENST ID: ENST00000383208
  CDS Start-End: 358-2190
gtagttctgacatgtttagggagtggagttctgctaaaaagactagactaggacatttttaggcaagatggggaaactaatccagaaaaagaaaccgcaccgctacttagcccctggccccggacctgcctttcttttttaagtcactcttgcataagctgccgctcgcgataaggtgccaaaaactgttccgcccctctaaggagagcgtgccctcactcaagatggcacctagagagcttcatacctggtacgctgctgattggatgaaggacagagggcttccgggagttttcaagccgactgtgtggcagctgagaagagttttgcacgtggatcgccgttcgggtgggcgagatggagacagcccccaagccgggcaaggatgtcccgcccaagaaagacaaacttcagaccaagagaaagaaaccgcggcgatactgggaggaagagaccgttccgaccacagccggagcctctccagggcctcctcgtaacaagaagaatcgggagctccgtcctcagagaccaaaaaatgcttacatcttaaagaagtctcggatctctaagaagcctcaggtcccgaagaaaccccgagaatggaagaacccggagtcccagcgcggcttgtccggggcccaagatccattcccaggccccgcccccgtccctgtggaagtggtccagaagttctgtcgcattgacaaatctcgaaagctaccacattctaaagccaaaactcgaagccgacttgaggtggctgaagctgaggaagaggaaacaagtatcaaagctgctcgttctgagctgctgcttgctgaagaacctgggtttctggaaggggaggatggggaagacacagcaaagatatgccaggctgacattgtggaggctgtggacattgcaagtgcagccaagcactttgacttgaatctgcggcagtttggaccctacagactaaactactctcgaactggaagacacctggcttttggagggcgccgaggtcatgtggctgcccttgattgggtaacaaagaagcttatgtgcgagatcaacgtcatggaggcggtgcgggacatccggtttctccattctgaggcactgcttgctgttgctcagaaccgctggctccacatctatgacaatcagggcattgagctccactgtatccgccgctgtgaccgagtaacacggcttgagttcctgcccttccacttcctcctggctacagcttcagaaacagggtttctaacctacctggatgtgtcagtggggaagattgtggcagctctgaatgctcgagctgggcggctcgatgttatgagtcagaacccttacaatgccgtcatccatctcggacacagcaatggtactgcgtctttatggagtccagctatgaaggagccactggcaaagattctctgtcatcgtggtggggtccgggctgtggcagtagattctacaggcacgtacatggccacctctggcctagaccaccagctgaagatctttgacttgcgagggacgtaccagcctctgagcactcggaccctgccccatggagcagggcacctggccttctcccagaggggactgctggtggcgggaatgggtgacgttgtcaacatctgggcagggcagggcaaggccagcccaccctcccttgaacagccctacctcacccaccggctctcaggccctgtgcatggccttcagttctgcccctttgaagatgtgctgggggtggggcacactgggggcatcaccagcatgctggtccctggggccggtgagcccaacttcgatggcctggagagtaatccatacagaagccggaagcagcgccaggagtgggaggtgaaggccctgctagagaaggtacctgcagagcttatttgtctggacccacgagccctggccgaggtggatgtcatctccctggagcagggaaagaaggagcagatagagaggctgggctatgacccgcaggctaaggctcccttccagccaaagccaaagcagaagggccgcagctccacggcaagcctggtgaagaggaagaggaaggtcatggatgaggaacacagggacaaggtccggcagagccttcagcagcagcatcataaggaggcgaaggccaagcccacgggggcccggccatctgccctggacagatttgtgcgctgagccagactccagggttgcctgggaacagtctctccccaagatcacctgtagggaaatgagtgttccctggaacaaggaggtgggggcagtgtggccccttccccaactgggggtggacagctgtctcctggggtgggttggtattaaagaggaaagcgattttttgga

SEQ ID NO: 199847 - DNA, 2358 bp, Homo sapiens
  Payload ID: 19425
  Gene Name: WD repeat domain 46
  Uniprot ID: O15213
  ENST ID: ENST00000432933
  CDS Start-End: 358-2190
gtagttctgacatgtttagggagtggagttctgctaaaaagactagactaggacatttttaggcaagatggggaaactaatccagaaaaagaaaccgcaccgctacttagcccctggccccggacctgcctttcttttttaagtcactcttgcataagctgccgctcgcgataaggtgccaaaaactgttccgcccctctaaggagagcgtgccctcactcaagatggcacctagagagcttcatacctggtacgctgctgattggatgaaggacagagggcttccgggagttttcaagccgactgtgtggcagctgagaagagttttgcacgtggatcgccgttcgggtgggcgagatggagacagcccccaagccgggcaaggatgtcccgcccaagaaagacaaacttcagaccaagagaaagaaaccgcggcgatactgggaggaagagaccgttccgaccacagccggagcctctccagggcctcctcgtaacaagaagaatcgggagctccgtcctcagagaccaaaaaatgcttacatcttaaagaagtctcggatctctaagaagcctcaggtcccgaagaaaccccgagaatggaagaacccggagtcccagcgcggcttgtccggggcccaagatccattcccaggccccgcccccgtccctgtggaagtggtccagaagttctgtcgcattgacaaatcccgaaagctaccacattctaaagccaaaactcgaagccgacttgaggtggctgaagctgaggaagaggaaacaagtatcaaagctgctcgttctgagctgctgcttgctgaagaacctgggtttctggaaggggaggatggggaagacacagcaaagatatgccaggctgacattgtggaggctgtggacattgcaagtgcagccaagcactttgacttgaatctgcggcagtttggaccctacagactaaactactctcgaactggaagacacctggcttttggagggcgccgaggtcatgtggctgcccttgattgggtaacaaagaagcttatgtgcgagatcaacgtcatggaggcggtgcgggacatccggtttctccattctgaggcactgcttgctgttgctcagaaccgctggctccacatctatgacaatcagggcattgagctccactgtatccgccgctgtgaccgagtaacacggcttgagttcctgcccttccacttcctcctggctacagcttcagaaacagggtttctaacctacctggatgtgtcagtggggaagattgtggcagctctgaatgctcgagctgggcggctcgatgttatgagtcagaacccttacaatgccgtcatccatctcggacacagcaatggtactgtgtctttatggagtccagctatgaaggagccactggcaaagattctctgtcatcgtggtggggtccgggctgtggcagtagattctacaggcacgtacatggccacctctggcctagaccaccagctgaagatctttgacttgcgagggacgtaccagcctctgagcactcggaccctgccccatggagcagggcacctggccttctcccagaggggactgctggtggcgggaatgggtgacgttgtcaacatctgggcagggcagggcaaggccagcccaccctcccttgaacagccctacctcacccaccggctctcaggccctgtgcatggccttcagttctgcccctttgaagatgtgctgggggtggggcacactgggggcatcaccagcatgctggtccctggggccggtgagcccaacttcgatggcctggagagtaatccatacagaagccggaagcagcgccaggagtgggaggtgaaggccctgctagagaaggtacctgcagagcttatttgtctggacccacgagccctggccgaggtggatgtcatctccctggagcagggaaagaaggagcagatagagaggctgggctatgacccgcaggctaaggctcccttccagccaaagccaaagcagaagggccgcagctccacggcaagcctggtgaagaggaagaggaaggtcatggatgaggaacacagggacaaggtccggcagagccttcagcagcagcatcataaggaggcgaaggccaagcccacgggggcccggccatctgccctggacagatttgtgcgctgagccagactccagggttgcctgggaacagtctctccccaagatcacctgtagggaaatgagtgttccctggaacaaggaggtgggggcagtgtggccccttccccaactgggggtggacagctgtctcctggggtgggttggtattaaagaggaaagcgattttttgga

SEQ ID NO: 199848 - DNA, 2358 bp, Homo sapiens
  Payload ID: 19425
  Gene Name: WD repeat domain 46
  Uniprot ID: O15213
  ENST ID: ENST00000432609
  CDS Start-End: 358-2190
gtagttctgacatgtttagggagtggagttctgctaaaaagactagactaggacatttttaggcaagatggggaaactaatccagaaaaagaaaccgcaccgctacttagcccctggctccggacctgcctttcttttttaagtcactcttgcataagctgccgctcgcgataaggtgccaaaaactgttccgcccctctaaggagagcgtgccctcactcaagatggcacctagagagcttcatacctggtacgctgctgattggatgaaggacagagggcttccgggagttttcaagccgactgtgtggcagctgagaggagttttgcacgtggatcgccgttcgggtgggcgagatggagacagcccccaagccgggcaaggatgtcccgcccaagaaagacaaacttcagaccaagagaaagaaaccgcggcgatactgggaggaagagaccgttccgaccacagccggagcctctccagggcctcctcgtaacaagaagaatcgggagctccgtcctcagagaccaaaaaatgcttacatcttaaagaagtctcggatctctaagaagcctcaggtcccgaagaaaccccgagaatggaagaacccggagtcccagcgcggcttgtccggggcccaagatccattcccaggccccgcccccgtccctgtggaagtggtccagaagttctgtcgcattgacaaatcccgaaagctaccacattctaaagccaaaactcgaagccgacttgaggtggctgaagctgaggaagaggaaacaagtatcaaagctgctcgttctgagctgctgcttgctgaagaacctgggtttctggaaggggaggatggggaagacacagcaaagatatgccaggctgacattgtggaggctgtggacattgcaagtgcagccaagcactttgacttgaatctgcggcagtttggaccctacagactaaactactctcgaactggaagacacctggcttttggagggcgccgaggtcatgtggctgcccttgattgggtaacaaagaagcttatgtgcgagatcaacgtcatggaggcggtgcgggacatccggtttctccattctgaggcactgcttgctgttgctcagaaccgctggctccacatctatgacaatcagggcattgagctccactgtatccgccgctgtgaccgagtaacacggcttgagttcctgcccttccacttcctcctggctacagcttcagaaacagggtttctaacctacctggatgtgtcagtggggaagattgtggcagctctgaatgctcgagctgggcggctcgatgttatgagtcagaacccttacaatgccgtcatccatctcggacacagcaatggtactgtgtctttatggagtccagctatgaaggagccactggcaaagattctctgtcatcgtggtggggtccgggctgtggcagtagattctacaggcacgtacatggccacctctggcctagaccaccagctgaagatctttgacttgcgagggacgtaccagcctctgagcactcggaccctgccccatggagcagggcacctggccttctcccagaggggactgctggtggcgggaatgggtgacgttgtcaacatctgggcagggcagggcaaggccagcccaccctcccttgaacagccctacctcacccaccggctctcaggccctgtgcatggccttcagttctgcccctttgaagatgtgctgggggtggggcacactgggggcatcaccagcatgctggtccctggggccggtgagcccaacttcgatggcctggagagtaatccatacagaagccggaagcagcgccaggagtgggaggtgaaggccctgctagagaaggtacctgcagagcttatttgtctggacccacgagccctggccgaggtggatgtcatctccctggagcagggaaagaaggagcagatagagaggctgggctatgacccgcaggctaaggctcccttccagccaaagccaaagcagaagggccgcagctccacggcaagcctggtgaagaggaagaggaaggtcatggatgaggaacacagggacaaggtccggcagagccttcagcagcagcatcataaggaggcgaaggccaagcccacgggggcccggccatctgccctggacagatttgtgcgctgagccagactccagggttgcctgggaacagtctctccccaagatcacctgtagggaaatgagtgttccctggaacaaggaggtgggggcagtgtggccccttccccaactgggggtggacagctgtctcctggggtgggttggtattaaagaggaaagcgattttttgga

SEQ ID NO: 199849 - DNA, 968 bp, Homo sapiens
  Payload ID: 19425
  Gene Name: WD repeat domain 46
  ENST ID: ENST00000444176
  CDS Start-End: 1-968
aagtctcggatctctaagaagcctcaggtcccgaagaaaccccgagaatggaagaacccggagtcccagcgcggcttgtccgggacccaagatccattcccaggccccgcccccgtccctgtggaagtggtccagaagttctgtcgcattgacaaatcccgaaagctaccacattctaaagccaaaactcgaagccgacttgaggtggctgaagctgaggaagaggaaacaagtatcaaagctgctcgttctgagctgctgcttgctgaagaacctgggtttctggaaggggaggatggggaagacacagcaaagatatgccaggctgacattgtggaggctgtggacattgcaagtgcagccaagtttggaccctacagactaaactactctcgaactggaagacacctggcttttggagggcgccgaggtcatgtggctgcccttgattgggtaacaaagaagcttatgtgcgagatcaacgtcatggaggcggtgcgggacatccggtttctccattctgaggcactgcttgctgttgctcagaaccgctggctccacatctatgacaatcagggcattgagctccactgtatccgccgctgtgaccgagtaacacggcttgagttcctgcccttccacttcctcctggctacagcttcagaaacagggtttctaacctacctggatgtgtcagtggggaagattgtggcagctctgaatgctcgagctgggcggctcgatgttatgagtcagaacccttacaatgccgtcatccatctcggacacagcaatggtactgtgtctttatggagtccagctatgaaggagccactggcaaagattctctgtcatcgtggtggggtccgggctgtggcagtagattctacaggcacgtacatggccacctctggcctagaccaccagctgaagatctttgacttgcgagggacgtaccagcctctgag

SEQ ID NO: 199850 - DNA, 2358 bp, Homo sapiens; identical to SEQ ID NO: 199847
  Payload ID: 19425
  Gene Name: WD repeat domain 46
  Uniprot ID: O15213
  ENST ID: ENST00000457382
  CDS Start-End: 358-2190

SEQ ID NO: 199851 - DNA, 968 bp, Homo sapiens
  Payload ID: 19425
  Gene Name: WD repeat domain 46
  ENST ID: ENST00000416777
  CDS Start-End: 1-968
aagtctcggatctctaagaagcctcaggtcccgaagaaaccccgagaatggaagaacccggagtcccagcgcggcttgtccggggcccaagatccattcccaggccccgcccccgtccctgtggaagtggtccagaagttctgtcgcattgacaaatctcgaaagctaccacattctaaagccaaaactcgaagccgacttgaggtggctgaagctgaggaagaggaaacaagtatcaaagctgctcgttctgagctgctgcttgctgaagaacctgggtttctggaaggggaggatggggaagacacagcaaagatatgccaggctgacattgtggaggctgtggacattgcaagtgcagccaagtttggaccctacagactaaactactctcgaactggaagacacctggcttttggagggcgccgaggtcatgtggctgcccttgattgggtaacaaagaagcttatgtgcgagatcaacgtcatggaggcggtgcgggacatccggtttctccattctgaggcactgcttgctgttgctcagaaccgctggctccacatctatgacaatcagggcattgagctccactgtatccgccgctgtgaccgagtaacacggcttgagttcctgcccttccacttcctcctggctacagcttcagaaacagggtttctaacctacctggatgtgtcagtggggaagattgtggcagctctgaatgctcgagctgggcggctcgatgttatgagtcagaacccttacaatgccgtcatccatctcggacacagcaatggtactgcgtctttatggagtccagctatgaaggagccactggcaaagattctctgtcatcgtggtggggtccgggctgtggcagtagattctacaggcacgtacatggccacctctggcctagaccaccagctgaagatctttgacttgcgagggacgtaccagcctctgag

SEQ ID NO: 199852 - DNA, 968 bp, Homo sapiens
  Payload ID: 19425
  Gene Name: WD repeat domain 46
  ENST ID: ENST00000443102
  CDS Start-End: 1-968
aagtctcggatctctaagaagcctcaggtcccgaagaaaccccgagaatggaagaacccggagtcccagcgcggcttgtccggggcccaagatccattcccaggccccgcccccgtccctgtggaagtggtccagaagttctgtcgcattgacaaatcccgaaagctaccacattctaaagccaaaactcgaagccgacttgaggtggctgaagctgaggaagaggaaacaagtatcaaagctgctcgttctgagctgctgcttgctgaagaacctgggtttctggaaggggaggatggggaagacacagcaaagatatgccaggctgacattgtggaggctgtggacattgcaagtgcagccaagtttggaccctacagactaaactactctcgaactggaagacacctggcttttggagggcgccgaggtcatgtggctgcccttgattgggtaacaaagaagcttatgtgcgagatcaacgtcatggaggcggtgcgggacatccggtttctccattctgaggcactgcttgctgttgctcagaaccgctggctccacatctatgacaatcagggcattgagctccactgtatccgccgctgtgaccgagtaacacggcttgagttcctgcccttccacttcctcctggctacagcttcagaaacagggtttctaacctacctggatgtgtcagtggggaagattgtggcagctctgaatgctcgagctgggcggctcgatgttatgagtcagaacccttacaatgccgtcatccatctcggacacagcaatggtactgtgtctttatggagtccagctatgaaggagccactggcaaagattctctgtcatcgtggtggggtccgggctgtggcagtagattctacaggcacgtacatggccacctctggcctagaccaccagctgaagatctttgacttgcgagggacgtaccagcctctgag

SEQ ID NO: 199853 - DNA, 968 bp, Homo sapiens; identical to SEQ ID NO: 199852
  Payload ID: 19425
  Gene Name: WD repeat domain 46
  ENST ID: ENST00000456332
  CDS Start-End: 1-968

SEQ ID NO: 199854 - DNA, 968 bp, Homo sapiens; identical to SEQ ID NO: 199852
  Payload ID: 19425
  Gene Name: WD repeat domain 46
  ENST ID: ENST00000450918
  CDS Start-End: 1-968

SEQ ID NO: 199855 - DNA, 4144 bp, Homo sapiens
  Payload ID: 19426
  Gene Name: WD repeat domain 47
  ENST ID: ENST00000357672
  CDS Start-End: 251-2932
gcagtctgcaagaggctgagctgaggagtcgctgggccgggaggggcggacgtgagaaggacggattgacgaactgatggattgacgcgcgggcggtaggagggaggaccgacgccaaacccagaccgccgccgtcgtgctcctgccgcagcccggagccggccgcttcggggccctggccgccggcctcccagccgcgttctcctccgccgctcctccgggcttgccctggagccctcaggctatcaatatgacggctgaagaaacagtgaatgtaaaagaggttgaaatcattaagctaattttggacttcctgaattcaaagaagcttcacattagtatgctggccctggagaaggaaagtggagtcataaatggcctgttttcagatgatatgcttttcctgaggtttcgttatattatcctgaagcagaagtttttagaagctttatgtgttaacaacgcgatgtcagcagaagatgagccccagcatctggaatttaccatgcaagaagctgtgcaatgtttacatgctctagaagaatactgtccttctaaagatgactatagtaagctctgtttgcttttgactttgcctcgtctgaccaatcatgccgagtttaaggactggaatcccagcaccgcacgagttcactgttttgaagaggcttgtgtcatggttgcagaattcatccctgctgataggaagctaagtgaagctggttttaaggctagtaacaatcgtttatttcagcttgtaatgaaaggcctgctttatgaatgctgtgtagaattttgtcagagtaaagcaactggagaagaaattacagaaagcgaagtgcttcttggcatcgacctcttatgtggtaatggttgtgatgatttggatctgagtttactgtcatggcttcagaatcttccatcttctgtcttctcttgtgcttttgaacagaaaatgcttaatattcatgttgacaaacttctgaaacctacaaaagctgcatatgctgatcttttgactcctcttatcagcaaactctctccctatccatcatccccaatgagaagacctcaatcagctgatgcctatatgacccgctctctgaatcctgctttagatggcctcacctgtggactaaccagtcatgataagagaatttcagaccttggaaacaaaacttctccaatgtcacactcctttgctaacttccattatccaggggtacaaaacctcagtagaagtctcatgcttgagaatacagaatgtcacagtatttacgaagaatcccctgagcgtgatacacctgttgatgcacagaggcctatcggcagtgaaatcttgggccagagttcagtttcagaaaaagagcctgcaaatggagcacagaatccaggaccagctaaacaagaaaaaaatgagcttcgagattcaacagaacaatttcaagaatattataggcaaagattacgctatcaacagcatttagaacagaaggagcaacagcggcagatataccaacagatgttgcttgaaggaggcgtgaatcaggaggatggtcctgatcagcagcagaatcttactgaacagttccttaataggtccattcaaaagcttggtgaattaaatattggaatggatggccttggtaatgaggtatcagcactcaaccagcaatgtaatgggagcaaaggcaatggatctaatggttcttctgtgactagttttactacaccaccccaagactctagtcagagattaacacatgatgcttcaaatattcatacaagcactcctcgtaatcctggatcaacaaatcacataccttttctggaggaatcaccttgtggaagccaaatctcttcagaacattcggtcattaagccacctcttggagattctccagggagtctttcaaggtcgaaaggggaagaggatgacaaatcaaaaaagcagtttgtttgtattaatatcctagaagacacacaagctgttagagcagtggcttttcatccagctggaggtttatatgctgttggttcaaattcaaaaactctgagagtatgtgcctatccagatgtaattgatccaagtgcacatgagactcctaagcagccggtggtacgttttaaaaggaataaacatcataaaggatccatttactgtgtggcctggagtccttgtgggcagttattagcaacaggatcaaatgacaaatacgtcaaagtgctgcccttcaatgcagagacttgtaacgcaacagtttcaggaccagatctggaatttagtatgcatgatggaacaattagagacttggcatttatggaaggcccagaaagcggaggagctattttaataagtgctggagcaggggattgtaacatttatacaaccgattgtcaaagaggacagggcctccatgctttgagtggacatactgggcatattttagcactttatacctggagtggctggatgattgcatctggttcccaagataagactgttagattttgggatcttcgagtaccaagttgtgttcgtgttgttggcacaacatttcatggaactggcagtgcagtggcatctgtagctgtagatcccagtggtcgtctcttagccacaggtcaagaagattctagctgcatgttgtatgacataagaggaggaagaatggtacaaagttatcatcctcattccagtgatgttcgctctgttcgattctcccctggagctcactacttgctaacaggctcttatgatatgaaaataaaggtgacagacctacaaggggacctcaccaagcagcttcctatcatggtggtgggggagcacaaggacaaagtgattcagtgcagatggcacacccaggatctttccttcctgtcatcctctgcagatagaactgtcaccctctggacttacaatgggtagagcacaccgcatgtcagtctatgcagcaaaagcacagagacttaagactactgagttgtgaaaattacaaatctgaagaacatagtgtccaggaaagtggtttagcacgaagaggccccttattaccatgtatcccactgataggaggtgttgggtggtgttattccgcagtgctttcagtcttccatgtgagctcgtgctgctgtgacctgctatatgtagtctcgttgccaaagtctgcagaagagctcttcagttgttggtgtgcactccaagtcaggatggacaatgtgtttacggtttagtattcaatgcattccttggtctttgcctaaataacagttttatatgcacattgaaatggaattatacttcaactatattattaaatgtaatgcaaccaagttcctcccagattaaacttcccaggtgttcagaattacttttgctcttctcacgatcccatattgtattatcacttgtcttctagaggtcagaattccataatatatgtcactcaaaagttacatggttgctttcacttaaggatcattgtggagtttaaagatgaatgaaaaactgcttcttagtttactacatggtataggcccttttttcttaaacccagggatatgattattttgtcatataattttgtttcaggctaaaaggtaaatgtgtttgcttcagaaacttgttaacttcagttttttgaatgcaacaggatacctcccttccaaactgaactgtagaagcagagcagcagcagttatgtgatgcaacacttgatggtacagtaaatttactggcatttttctccttaaaaattaaaatccttgacatagaccatagcatggcttgaaatgctatgtctgcatgataatttaaaatggaagatttaaactttgcactccaaaagcttatttggatttttttcttgcactgttttgtgtaatgcagaataatgattttatttctacagctttgtagattctaacatttatgtatctttattttcatattgtacagtaattttactttaaattatttaaataggctattttatttatttcaaatgcagttgtattagttctcattattgaactgtctgtgcactgtatgtagcaagcatttttcatctgttgtatacaagtggaaagggtattagaagtgtaactgtgctattatttcaataaagacctcttgacattt

SEQ ID NO: 199856 - DNA, 4115 bp, Homo sapiens
  Payload ID: 19426
  Gene Name: WD repeat domain 47
  Uniprot ID: O94967
  ENST ID: ENST00000361054
  CDS Start-End: 224-2899
gtcgctgggccgggaggggcggacgtgagaaggacggattgacgaactgatggattgacgcgcgggcggtaggagggaggaccgacgccaaacccagaccgccgccgtcgtgctcctgccgcagcccggagccggccgcttcggggccctggccgccggcctcccagccgcgttctcctccgccgctcctccgggcttgccctggagccctcaggctatcaatatgacggctgaagaaacagtgaatgtaaaagaggttgaaatcattaagctaattttggacttcctgaattcaaagaagcttcacattagtatgctggccctggagaaggaaagtggagtcataaatggcctgttttcagatgatatgcttttcctgaggtttcgttatattatcctgaagcagaagtttttagaagctttatgtgttaacaacgcgatgtcagcagaagatgagccccagcatctggaatttaccatgcaagaagctgtgcaatgtttacatgctctagaagaatactgtccttctaaagatgactatagtaagctctgtttgcttttgactttgcctcgtctgaccaatcatgccgagtttaaggactggaatcccagcaccgcacgagttcactgttttgaagaggcttgtgtcatggttgcagaattcatccctgctgataggaagctaagtgaagctggttttaaggctagtaacaatcgtttatttcagcttgtaatgaaaggcctgctttatgaatgctgtgtagaattttgtcagagtaaagcaactggagaagaaattacagaaagcgaagtgcttcttggcatcgacctcttatgtggtaatggttgtgatgatttggatctgagtttactgtcatggcttcagaatcttccatcttctgtcttctcttgtgcttttgaacagaaaatgcttaatattcatgttgacaaacttctgaaacctacaaaagctgcatatgctgatcttttgactcctcttatcagcaaactctctccctatccatcatccccaatgagaagacctcaatcagctgatgcctatatgacccgctctctgaatcctgctttagatggcctcacctgtggactaaccagtcatgataagagaatttcagaccttggaaacaaaacttctccaatgtcacactcctttgctaacttccattatccaggggtacaaaacctcagtagaagtctcatgcttgagaatacagaatgtcacagtatttacgaagaatcccctgagcgtgatacacctgttgatgcacagaggcctatcggcagtgaaatcttgggccagagttcagtttcagaaaaagagcctgcaaatggagcacagaatccaggaccagctaaacaagaaaaaaatgagcttcgagattcaacagaacaatttcaagaatattataggcaaagattacgctatcaacagcatttagaacagaaggagcaacagcggcagatataccaacagatgttgcttgaaggaggcgtgaatcaggaggatggtcctgatcagcagcagaatcttactgaacagttccttaataggtccattcaaaagcttggtgaattaaatattggaatggatggccttggtaatgaggtatcagcactcaaccagcaatgtaatgggagcaaaggcaatggatctaatggttcttctgtgactagttttactacaccaccccaagactctagtcagagattaacacatgatgcttcaaatattcatacaagcactcctcgtaatcctggatcaacaaatcacataccttttctggaggaatcaccttgtggaagccaaatctcttcagaacattcggtcattaagccacctcttggagattctccagggagtctttcaaggtcgaaaggggaagaggatgacaaatcaaaaaagcagtttgtttgtattaatatcctagaagacacacaagctgttagagcagtggcttttcatccagctggaggtttatatgctgttggttcaaattcaaaaactctgagagtatgtgcctatccagatgtaattgatccaagtgcacatgagactcctaagcagccggtggtacgttttaaaaggaataaacatcataaaggatccatttactgtgtggcctggagtccttgtgggcagttattagcaacaggatcaaatgacaaatacgtcaaagtgctgcccttcaatgcagagacttgtaacgcaacaggaccagatctggaatttagtatgcatgatggaacaattagagacttggcatttatggaaggcccagaaagcggaggagctattttaataagtgctggagcaggggattgtaacatttatacaaccgattgtcaaagaggacagggcctccatgctttgagtggacatactgggcatattttagcactttatacctggagtggctggatgattgcatctggttcccaagataagactgttagattttgggatcttcgagtaccaagttgtgttcgtgttgttggcacaacatttcatggaactggcagtgcagtggcatctgtagctgtagatcccagtggtcgtctcttagccacaggtcaagaagattctagctgcatgttgtatgacataagaggaggaagaatggtacaaagttatcatcctcattccagtgatgttcgctctgttcgattctcccctggagctcactacttgctaacaggctcttatgatatgaaaataaaggtgacagacctacaaggggacctcaccaagcagcttcctatcatggtggtgggggagcacaaggacaaagtgattcagtgcagatggcacacccaggatctttccttcctgtcatcctctgcagatagaactgtcaccctctggacttacaatgggtagagcacaccgcatgtcagtctatgcagcaaaagcacagagacttaagactactgagttgtgaaaattacaaatctgaagaacatagtgtccaggaaagtggtttagcacgaagaggccccttattaccatgtatcccactgataggaggtgttgggtggtgttattccgcagtgctttcagtcttccatgtgagctcgtgctgctgtgacctgctatatgtagtctcgttgccaaagtctgcagaagagctcttcagttgttggtgtgcactccaagtcaggatggacaatgtgtttacggtttagtattcaatgcattccttggtctttgcctaaataacagttttatatgcacattgaaatggaattatacttcaactatattattaaatgtaatgcaaccaagttcctcccagattaaacttcccaggtgttcagaattacttttgctcttctcacgatcccatattgtattatcacttgtcttctagaggtcagaattccataatatatgtcactcaaaagttacatggttgctttcacttaaggatcattgtggagtttaaagatgaatgaaaaactgcttcttagtttactacatggtataggcccttttttcttaaacccagggatatgattattttgtcatataattttgtttcaggctaaaaggtaaatgtgtttgcttcagaaacttgttaacttcagttttttgaatgcaacaggatacctcccttccaaactgaactgtagaagcagagcagcagcagttatgtgatgcaacacttgatggtacagtaaatttactggcatttttctccttaaaaattaaaatccttgacatagaccatagcatggcttgaaatgctatgtctgcatgataatttaaaatggaagatttaaactttgcactccaaaagcttatttggatttttttcttgcactgttttgtgtaatgcagaataatgattttatttctacagctttgtagattctaacatttatgtatctttattttcatattgtacagtaattttactttaaattatttaaataggctattttatttatttcaaatgcagttgtattagttctcattattgaactgtctgtgcactgtatgtagcaagcatttttcatctgttgtatacaagtggaaagggtattagaagtgtaactgtgctattatttcaataaagacctcttgacatttaaaa

SEQ ID NO: 199857 - DNA, 4199 bp, Homo sapiens
  Payload ID: 19426
  Gene Name: WD repeat domain 47
  Uniprot ID: O94967
  ENST ID: ENST00000369962
  CDS Start-End: 224-2983
gtcgctgggccgggaggggcggacgtgagaaggacggattgacgaactgatggattgacgcgcgggcggtaggagggaggaccgacgccaaacccagaccgccgccgtcgtgctcctgccgcagcccggagccggccgcttcggggccctggccgccggcctcccagccgcgttctcctccgccgctcctccgggcttgccctggagccctcaggctatcaatatgacggctgaagaaacagtgaatgtaaaagaggttgaaatcattaagctaattttggacttcctgaattcaaagaagcttcacattagtatgctggccctggagaaggaaagtggagtcataaatggcctgttttcagatgatatgcttttcctgaggcagctaatacttgatggtcaatgggatgaagttcttcagttcattcagcctctagaatgtatggaaaaatttgacaaaaaaaggtttcgttatattatcctgaagcagaagtttttagaagctttatgtgttaacaacgcgatgtcagcagaagatgagccccagcatctggaatttaccatgcaagaagctgtgcaatgtttacatgctctagaagaatactgtccttctaaagatgactatagtaagctctgtttgcttttgactttgcctcgtctgaccaatcatgccgagtttaaggactggaatcccagcaccgcacgagttcactgttttgaagaggcttgtgtcatggttgcagaattcatccctgctgataggaagctaagtgaagctggttttaaggctagtaacaatcgtttatttcagcttgtaatgaaaggcctgctttatgaatgctgtgtagaattttgtcagagtaaagcaactggagaagaaattacagaaagcgaagtgcttcttggcatcgacctcttatgtggtaatggttgtgatgatttggatctgagtttactgtcatggcttcagaatcttccatcttctgtcttctcttgtgcttttgaacagaaaatgcttaatattcatgttgacaaacttctgaaacctacaaaagctgcatatgctgatcttttgactcctcttatcagcaaactctctccctatccatcatccccaatgagaagacctcaatcagctgatgcctatatgacccgctctctgaatcctgctttagatggcctcacctgtggactaaccagtcatgataagagaatttcagaccttggaaacaaaacttctccaatgtcacactcctttgctaacttccattatccaggggtacaaaacctcagtagaagtctcatgcttgagaatacagaatgtcacagtatttacgaagaatcccctgagcgtgatacacctgttgatgcacagaggcctatcggcagtgaaatcttgggccagagttcagtttcagaaaaagagcctgcaaatggagcacagaatccaggaccagctaaacaagaaaaaaatgagcttcgagattcaacagaacaatttcaagaatattataggcaaagattacgctatcaacagcatttagaacagaaggagcaacagcggcagatataccaacagatgttgcttgaaggaggcgtgaatcaggaggatggtcctgatcagcagcagaatcttactgaacagttccttaataggtccattcaaaagcttggtgaattaaatattggaatggatggccttggtaatgaggtatcagcactcaaccagcaatgtaatgggagcaaaggcaatggatctaatggttcttctgtgactagttttactacaccaccccaagactctagtcagagattaacacatgatgcttcaaatattcatacaagcactcctcgtaatcctggatcaacaaatcacataccttttctggaggaatcaccttgtggaagccaaatctcttcagaacattcggtcattaagccacctcttggagattctccagggagtctttcaaggtcgaaaggggaagaggatgacaaatcaaaaaagcagtttgtttgtattaatatcctagaagacacacaagctgttagagcagtggcttttcatccagctggaggtttatatgctgttggttcaaattcaaaaactctgagagtatgtgcctatccagatgtaattgatccaagtgcacatgagactcctaagcagccggtggtacgttttaaaaggaataaacatcataaaggatccatttactgtgtggcctggagtccttgtgggcagttattagcaacaggatcaaatgacaaatacgtcaaagtgctgcccttcaatgcagagacttgtaacgcaacaggaccagatctggaatttagtatgcatgatggaacaattagagacttggcatttatggaaggcccagaaagcggaggagctattttaataagtgctggagcaggggattgtaacatttatacaaccgattgtcaaagaggacagggcctccatgctttgagtggacatactgggcatattttagcactttatacctggagtggctggatgattgcatctggttcccaagataagactgttagattttgggatcttcgagtaccaagttgtgttcgtgttgttggcacaacatttcatggaactggcagtgcagtggcatctgtagctgtagatcccagtggtcgtctcttagccacaggtcaagaagattctagctgcatgttgtatgacataagaggaggaagaatggtacaaagttatcatcctcattccagtgatgttcgctctgttcgattctcccctggagctcactacttgctaacaggctcttatgatatgaaaataaaggtgacagacctacaaggggacctcaccaagcagcttcctatcatggtggtgggggagcacaaggacaaagtgattcagtgcagatggcacacccaggatctttccttcctgtcatcctctgcagatagaactgtcaccctctggacttacaatgggtagagcacaccgcatgtcagtctatgcagcaaaagcacagagacttaagactactgagttgtgaaaattacaaatctgaagaacatagtgtccaggaaagtggtttagcacgaagaggccccttattaccatgtatcccactgataggaggtgttgggtggtgttattccgcagtgctttcagtcttccatgtgagctcgtgctgctgtgacctgctatatgtagtctcgttgccaaagtctgcagaagagctcttcagttgttggtgtgcactccaagtcaggatggacaatgtgtttacggtttagtattcaatgcattccttggtctttgcctaaataacagttttatatgcacattgaaatggaattatacttcaactatattattaaatgtaatgcaaccaagttcctcccagattaaacttcccaggtgttcagaattacttttgctcttctcacgatcccatattgtattatcacttgtcttctagaggtcagaattccataatatatgtcactcaaaagttacatggttgctttcacttaaggatcattgtggagtttaaagatgaatgaaaaactgcttcttagtttactacatggtataggcccttttttcttaaacccagggatatgattattttgtcatataattttgtttcaggctaaaaggtaaatgtgtttgcttcagaaacttgttaacttcagttttttgaatgcaacaggatacctcccttccaaactgaactgtagaagcagagcagcagcagttatgtgatgcaacacttgatggtacagtaaatttactggcatttttctccttaaaaattaaaatccttgacatagaccatagcatggcttgaaatgctatgtctgcatgataatttaaaatggaagatttaaactttgcactccaaaagcttatttggatttttttcttgcactgttttgtgtaatgcagaataatgattttatttctacagctttgtagattctaacatttatgtatctttattttcatattgtacagtaattttactttaaattatttaaataggctattttatttatttcaaatgcagttgtattagttctcattattgaactgtctgtgcactgtatgtagcaagcatttttcatctgttgtatacaagtggaaagggtattagaagtgtaactgtgctattatttcaataaagacctcttgacatttaaaa

SEQ ID NO: 199858 - DNA, 4240 bp, Homo sapiens
  Payload ID: 19426
  Gene Name: WD repeat domain 47
  Uniprot ID: O94967
  ENST ID: ENST00000369965
  CDS Start-End: 262-3024
acttgacaaccgcagtctgcaagaggctgagctgaggagtcgctgggccgggaggggcggacgtgagaaggacggattgacgaactgatggattgacgcgcgggcggtaggagggaggaccgacgccaaacccagaccgccgccgtcgtgctcctgccgcagcccggagccggccgcttcggggccctggccgccggcctcccagccgcgttctcctccgccgctcctccgggcttgccctggagccctcaggctatcaatatgacggctgaagaaacagtgaatgtaaaagaggttgaaatcattaagctaattttggacttcctgaattcaaagaagcttcacattagtatgctggccctggagaaggaaagtggagtcataaatggcctgttttcagatgatatgcttttcctgaggcagctaatacttgatggtcaatgggatgaagttcttcagttcattcagcctctagaatgtatggaaaaatttgacaaaaaaaggtttcgttatattatcctgaagcagaagtttttagaagctttatgtgttaacaacgcgatgtcagcagaagatgagccccagcatctggaatttaccatgcaagaagctgtgcaatgtttacatgctctagaagaatactgtccttctaaagatgactatagtaagctctgtttgcttttgactttgcctcgtctgaccaatcatgccgagtttaaggactggaatcccagcaccgcacgagttcactgttttgaagaggcttgtgtcatggttgcagaattcatccctgctgataggaagctaagtgaagctggttttaaggctagtaacaatcgtttatttcagcttgtaatgaaaggcctgctttatgaatgctgtgtagaattttgtcagagtaaagcaactggagaagaaattacagaaagcgaagtgcttcttggcatcgacctcttatgtggtaatggttgtgatgatttggatctgagtttactgtcatggcttcagaatcttccatcttctgtcttctcttgtgcttttgaacagaaaatgcttaatattcatgttgacaaacttctgaaacctacaaaagctgcatatgctgatcttttgactcctcttatcagcaaactctctccctatccatcatccccaatgagaagacctcaatcagctgatgcctatatgacccgctctctgaatcctgctttagatggcctcacctgtggactaaccagtcatgataagagaatttcagaccttggaaacaaaacttctccaatgtcacactcctttgctaacttccattatccaggggtacaaaacctcagtagaagtctcatgcttgagaatacagaatgtcacagtatttacgaagaatcccctgagcgaagtgatacacctgttgatgcacagaggcctatcggcagtgaaatcttgggccagagttcagtttcagaaaaagagcctgcaaatggagcacagaatccaggaccagctaaacaagaaaaaaatgagcttcgagattcaacagaacaatttcaagaatattataggcaaagattacgctatcaacagcatttagaacagaaggagcaacagcggcagatataccaacagatgttgcttgaaggaggcgtgaatcaggaggatggtcctgatcagcagcagaatcttactgaacagttccttaataggtccattcaaaagcttggtgaattaaatattggaatggatggccttggtaatgaggtatcagcactcaaccagcaatgtaatgggagcaaaggcaatggatctaatggttcttctgtgactagttttactacaccaccccaagactctagtcagagattaacacatgatgcttcaaatattcatacaagcactcctcgtaatcctggatcaacaaatcacataccttttctggaggaatcaccttgtggaagccaaatctcttcagaacattcggtcattaagccacctcttggagattctccagggagtctttcaaggtcgaaaggggaagaggatgacaaatcaaaaaagcagtttgtttgtattaatatcctagaagacacacaagctgttagagcagtggcttttcatccagctggaggtttatatgctgttggttcaaattcaaaaactctgagagtatgtgcctatccagatgtaattgatccaagtgcacatgagactcctaagcagccggtggtacgttttaaaaggaataaacatcataaaggatccatttactgtgtggcctggagtccttgtgggcagttattagcaacaggatcaaatgacaaatacgtcaaagtgctgcccttcaatgcagagacttgtaacgcaacaggaccagatctggaatttagtatgcatgatggaacaattagagacttggcatttatggaaggcccagaaagcggaggagctattttaataagtgctggagcaggggattgtaacatttatacaaccgattgtcaaagaggacagggcctccatgctttgagtggacatactgggcatattttagcactttatacctggagtggctggatgattgcatctggttcccaagataagactgttagattttgggatcttcgagtaccaagttgtgttcgtgttgttggcacaacatttcatggaactggcagtgcagtggcatctgtagctgtagatcccagtggtcgtctcttagccacaggtcaagaagattctagctgcatgttgtatgacataagaggaggaagaatggtacaaagttatcatcctcattccagtgatgttcgctctgttcgattctcccctggagctcactacttgctaacaggctcttatgatatgaaaataaaggtgacagacctacaaggggacctcaccaagcagcttcctatcatggtggtgggggagcacaaggacaaagtgattcagtgcagatggcacacccaggatctttccttcctgtcatcctctgcagatagaactgtcaccctctggacttacaatgggtagagcacaccgcatgtcagtctatgcagcaaaagcacagagacttaagactactgagttgtgaaaattacaaatctgaagaacatagtgtccaggaaagtggtttagcacgaagaggccccttattaccatgtatcccactgataggaggtgttgggtggtgttattccgcagtgctttcagtcttccatgtgagctcgtgctgctgtgacctgctatatgtagtctcgttgccaaagtctgcagaagagctcttcagttgttggtgtgcactccaagtcaggatggacaatgtgtttacggtttagtattcaatgcattccttggtctttgcctaaataacagttttatatgcacattgaaatggaattatacttcaactatattattaaatgtaatgcaaccaagttcctcccagattaaacttcccaggtgttcagaattacttttgctcttctcacgatcccatattgtattatcacttgtcttctagaggtcagaattccataatatatgtcactcaaaagttacatggttgctttcacttaaggatcattgtggagtttaaagatgaatgaaaaactgcttcttagtttactacatggtataggcccttttttcttaaacccagggatatgattattttgtcatataattttgtttcaggctaaaaggtaaatgtgtttgcttcagaaacttgttaacttcagttttttgaatgcaacaggatacctcccttccaaactgaactgtagaagcagagcagcagcagttatgtgatgcaacacttgatggtacagtaaatttactggcatttttctccttaaaaattaaaatccttgacatagaccatagcatggcttgaaatgctatgtctgcatgataatttaaaatggaagatttaaactttgcactccaaaagcttatttggatttttttcttgcactgttttgtgtaatgcagaataatgattttatttctacagctttgtagattctaacatttatgtatctttattttcatattgtacagtaattttactttaaattatttaaataggctattttatttatttcaaatgcagttgtattagttctcattattgaactgtctgtgcactgtatgtagcaagcatttttcatctgttgtatacaagtggaaagggtattagaagtgtaactgtgctattatttcaataaagacctcttgacatttaaaa

SEQ ID NO: 199859 - DNA, 4134 bp, Homo sapiens
  Payload ID: 19426
  Gene Name: WD repeat domain 47
  Uniprot ID: O94967
  ENST ID: ENST00000400794
  CDS Start-End: 135-2918
aaacccagaccgccgccgtcgtgctcctgccgcagcccggagccggccgcttcggggccctggccgccggcctcccagccgcgttctcctccgccgctcctccgggcttgccctggagccctcaggctatcaatatgacggctgaagaaacagtgaatgtaaaagaggttgaaatcattaagctaattttggacttcctgaattcaaagaagcttcacattagtatgctggccctggagaaggaaagtggagtcataaatggcctgttttcagatgatatgcttttcctgaggcagctaatacttgatggtcaatgggatgaagttcttcagttcattcagcctctagaatgtatggaaaaatttgacaaaaaaaggtttcgttatattatcctgaagcagaagtttttagaagctttatgtgttaacaacgcgatgtcagcagaagatgagccccagcatgtaagatttttattcctgaagctggaatttaccatgcaagaagctgtgcaatgtttacatgctctagaagaatactgtccttctaaagatgactatagtaagctctgtttgcttttgactttgcctcgtctgaccaatcatgccgagtttaaggactggaatcccagcaccgcacgagttcactgttttgaagaggcttgtgtcatggttgcagaattcatccctgctgataggaagctaagtgaagctggttttaaggctagtaacaatcgtttatttcagcttgtaatgaaaggcctgctttatgaatgctgtgtagaattttgtcagagtaaagcaactggagaagaaattacagaaagcgaagtgcttcttggcatcgacctcttatgtggtaatggttgtgatgatttggatctgagtttactgtcatggcttcagaatcttccatcttctgtcttctcttgtgcttttgaacagaaaatgcttaatattcatgttgacaaacttctgaaacctacaaaagctgcatatgctgatcttttgactcctcttatcagcaaactctctccctatccatcatccccaatgagaagacctcaatcagctgatgcctatatgacccgctctctgaatcctgctttagatggcctcacctgtggactaaccagtcatgataagagaatttcagaccttggaaacaaaacttctccaatgtcacactcctttgctaacttccattatccaggggtacaaaacctcagtagaagtctcatgcttgagaatacagaatgtcacagtatttacgaagaatcccctgagcgaagtgatacacctgttgatgcacagaggcctatcggcagtgaaatcttgggccagagttcagtttcagaaaaagagcctgcaaatggagcacagaatccaggaccagctaaacaagaaaaaaatgagcttcgagattcaacagaacaatttcaagaatattataggcaaagattacgctatcaacagcatttagaacagaaggagcaacagcggcagatataccaacagatgttgcttgaaggaggcgtgaatcaggaggatggtcctgatcagcagcagaatcttactgaacagttccttaataggtccattcaaaagcttggtgaattaaatattggaatggatggccttggtaatgaggtatcagcactcaaccagcaatgtaatgggagcaaaggcaatggatctaatggttcttctgtgactagttttactacaccaccccaagactctagtcagagattaacacatgatgcttcaaatattcatacaagcactcctcgtaatcctggatcaacaaatcacataccttttctggaggaatcaccttgtggaagccaaatctcttcagaacattcggtcattaagccacctcttggagattctccagggagtctttcaaggtcgaaaggggaagaggatgacaaatcaaaaaagcagtttgtttgtattaatatcctagaagacacacaagctgttagagcagtggcttttcatccagctggaggtttatatgctgttggttcaaattcaaaaactctgagagtatgtgcctatccagatgtaattgatccaagtgcacatgagactcctaagcagccggtggtacgttttaaaaggaataaacatcataaaggatccatttactgtgtggcctggagtccttgtgggcagttattagcaacaggatcaaatgacaaatacgtcaaagtgctgcccttcaatgcagagacttgtaacgcaacaggaccagatctggaatttagtatgcatgatggaacaattagagacttggcatttatggaaggcccagaaagcggaggagctattttaataagtgctggagcaggggattgtaacatttatacaaccgattgtcaaagaggacagggcctccatgctttgagtggacatactgggcatattttagcactttatacctggagtggctggatgattgcatctggttcccaagataagactgttagattttgggatcttcgagtaccaagttgtgttcgtgttgttggcacaacatttcatggaactggcagtgcagtggcatctgtagctgtagatcccagtggtcgtctcttagccacaggtcaagaagattctagctgcatgttgtatgacataagaggaggaagaatggtacaaagttatcatcctcattccagtgatgttcgctctgttcgattctcccctggagctcactacttgctaacaggctcttatgatatgaaaataaaggtgacagacctacaaggggacctcaccaagcagcttcctatcatggtggtgggggagcacaaggacaaagtgattcagtgcagatggcacacccaggatctttccttcctgtcatcctctgcagatagaactgtcaccctctggacttacaatgggtagagcacaccgcatgtcagtctatgcagcaaaagcacagagacttaagactactgagttgtgaaaattacaaatctgaagaacatagtgtccaggaaagtggtttagcacgaagaggccccttattaccatgtatcccactgataggaggtgttgggtggtgttattccgcagtgctttcagtcttccatgtgagctcgtgctgctgtgacctgctatatgtagtctcgttgccaaagtctgcagaagagctcttcagttgttggtgtgcactccaagtcaggatggacaatgtgtttacggtttagtattcaatgcattccttggtctttgcctaaataacagttttatatgcacattgaaatggaattatacttcaactatattattaaatgtaatgcaaccaagttcctcccagattaaacttcccaggtgttcagaattacttttgctcttctcacgatcccatattgtattatcacttgtcttctagaggtcagaattccataatatatgtcactcaaaagttacatggttgctttcacttaaggatcattgtggagtttaaagatgaatgaaaaactgcttcttagtttactacatggtataggcccttttttcttaaacccagggatatgattattttgtcatataattttgtttcaggctaaaaggtaaatgtgtttgcttcagaaacttgttaacttcagttttttgaatgcaacaggatacctcccttccaaactgaactgtagaagcagagcagcagcagttatgtgatgcaacacttgatggtacagtaaatttactggcatttttctccttaaaaattaaaatccttgacatagaccatagcatggcttgaaatgctatgtctgcatgataatttaaaatggaagatttaaactttgcactccaaaagcttatttggatttttttcttgcactgttttgtgtaatgcagaataatgattttatttctacagctttgtagattctaacatttatgtatctttattttcatattgtacagtaattttactttaaattatttaaataggctattttatttatttcaaatgcagttgtattagttctcattattgaactgtctgtgcactgtatgtagcaagcatttttcatctgttgtatacaagtggaaagggtattagaagtgtaactgtgctattatttcaataaagacctcttgacatttaaaa

SEQ ID NO: 199860 - DNA, 580 bp, Homo sapiens
  Payload ID: 19426
  Gene Name: WD repeat domain 47
  ENST ID: ENST00000528747
  CDS Start-End: 263-580
aaacccagaccgccgccgtcgtgctcctgccgcagcccggagccggccgcttcggggccctggccgccggcctcccagccgcgttctcctccgccgctcctccgggcttgccctggagccctcagagacatggtcttcctctgttgttcagaggtgtgcagtggtgtgatcatagctcactgtatgtaacttctaacttctgggctcaagcgatcctcctgcttcagcctcccaaagtgctgggactacaggcgctatcaatatgacggctgaagaaacagtgaatgtaaaagaggttgaaatcattaagctaattttggacttcctgaattcaaagaagcttcacattagtatgctggccctggagaaggaaagtggagtcataaatggcctgttttcagatgatatgcttttcctgaggcagctaatacttgatggtcaatgggatgaagttcttcagttcattcagcctctagaatgtatggaaaaatttgacaaaaaaaggtttcgttatattatcctgaagcagaagtttttagaagctttatgtgttaacaacgcgatgtcagcagaagatgag

SEQ ID NO: 199861 - DNA, 556 bp, Homo sapiens
  Payload ID: 19426
  Gene Name: WD repeat domain 47
  ENST ID: ENST00000530772
  CDS Start-End: 38-556
ctggcactgagcagcaagtgagcgcgaggctatcaatatgacggctgaagaaacagtgaatgtaaaagaggttgaaatcattaagctaattttggacttcctgaattcaaagaagcttcacattagtatgctggccctggagaaggaaagtggagtcataaatggcctgttttcagatgatatgcttttcctgaggcagctaatacttgatggtcaatgggatgaagttcttcagttcattcagcctctagaatgtatggaaaaatttgacaaaaaaaggtttcgttatattatcctgaagcagaagtttttagaagctttatgtgttaacaacgcgatgtcagcagaagatgagccccagcatctggaatttaccatgcaagaagctgtgcaatgtttacatgctctagaagaatactgtccttctaaagatgactatagtaagctctgtttgcttttgactttgcctcgtctgaccaatcatgccgagtttaaggactggaatcccagcaccgcacgagttcactgttttgaagaggcttgtgtcatggttgca

SEQ ID NO: 199862 - DNA, 469 bp, Homo sapiens
  Payload ID: 19426
  Gene Name: WD repeat domain 47
  ENST ID: ENST00000531337
  CDS Start-End: 300-469
gcagtctgcaagaggctgagctgaggagtcgctgggccgggaggggcggacgtgagaaggacggattgacgaactgatggattgacgcgcgggcggtaggagggaggaccgacgccaaacccagaccgccgccgtcgtgctcctgccgcagcccggagccggccgcttcggggccctggccgccggcctcccagccgcgttctcctccgccgctcctccgggcttgccctggagccctcaggtttcgttatattatcctgaagcagaagtttttagaagctttatgtgttaacaacgcgatgtcagcagaagatgagccccagcatctggaatttaccatgcaagaagctgtgcaatgtttacatgctctagaagaatactgtccttctaaagatgactatagtaagctctgtttgcttttgactttgcctcgtctgaccaatcatgccgagtttaaggactggaatcc

SEQ ID NO: 199863 - DNA, 586 bp, Homo sapiens
  Payload ID: 19426
  Gene Name: WD repeat domain 47
  ENST ID: ENST00000529074
  CDS Start-End: 306-586
accgcagtctgcaagaggctgagctgaggagtcgctgggccgggaggggcggacgtgagaaggacggattgacgaactgatggattgacgcgcgggcggtaggagggaggaccgacgccaaacccagaccgccgccgtcgtgctcctgccgcagcccggagccggccgcttcggggccctggccgccggcctcccagccgcgttctcctccgccgctcctccgggcttgccctggagccctcaggcagctaatacttgatggtcaatgggatgaagttcttcagttcattcagcctctagaatgtatggaaaaatttgacaaaaaaaggtttcgttatattatcctgaagcagaagtttttagaagctttatgtgttaacaacgcgatgtcagcagaagatgagccccagcatctggaatttaccatgcaagaagctgtgcaatgtttacatgctctagaagaatactgtccttctaaagatgactatagtaagctctgtttgcttttgactttgcctcgtctgaccaatcatgccgagtttaaggactggaatcccagcaccgcacgagttcactgttttgaaga

SEQ ID NO: 199864 - DNA, 3707 bp, Homo sapiens
  Payload ID: 19427
  Gene Name: WD repeat domain 48
  Uniprot ID: Q8TAF3
  ENST ID: ENST00000302313
  CDS Start-End: 29-2062
aagtgacgtcggagtgtcaacatgcaagatggcggcccatcaccggcagaacacagcagggcggaggaaagtgcaggtttcctatgttattcgagatgaagtggagaagtacaaccgaaatggagtcaatgctctgcagctggatccagcactaaatagacttttcacagccggtcgagactctatcataagaatatggagtgtcaatcagcacaagcaagatccatatatagcatctatggaacaccatactgattgggtaaacgacattgtactctgttgtaatgggaaaacattaatatctgcttcttctgacacgacagtaaaagtatggaatgcacacaagggattttgcatgtcaacattaaggacacataaggattacgtaaaggccttagcatatgccaaggataaagaactagtagcatcagctgggttggacagacaaatattcctttgggatgtgaatactctaacagcattgactgcctcaaataacactgtcacaacttcttctttaagtggaaacaaagattccatttatagcctggccatgaatcaactgggaacaatcattgtatcagggtccactgaaaaggtgttacgggtatgggatccaagaacatgtgcaaaactaatgaagcttaaagggcacacggataatgtgaaggcattgctattaaacagagatggcacgcaatgcctgtcaggcagttctgatgggacaattcgcctttggtcccttggccagcagagatgtatagcaacataccgagtccatgatgaaggtgtttgggcgctgcaagtcaatgatgccttcacacatgtgtattctggtggaagggacaggaagatttattgtacagacctaagaaaccctgacattcgggtgctaatttgtgaagaaaaagcaccagttctcaagatggagcttgatagatcagctgatcctcctcctgcaatttgggttgcaacaactaagtctacagtaaataaatggactttgaaaggaattcataattttagagcctctggagattatgacaatgactgtacaaatcctataacacctctttgtacacaacctgaccaggttattaaagggggtgctagtattattcagtgccacattcttaatgataagagacatatattaaccaaagataccaataataatgtggcatattgggatgtattgaaggcatgtaaagttgaagatctgggcaaagtggattttgaagatgaaattaagaaaagatttaaaatggtgtatgtgccaaattggttctcagtagacttaaaaacagggatgttaactattactttggatgaaagtgattgttttgctgcctgggtttctgcaaaagatgctggtttcagcagccctgatgggtcagatccaaaattgaatttaggaggacttttactccaagcactcctggaatattggcctagaacacatgtgaatccaatggatgaagaggaaaatgaagtaaaccatgtaaatggggagcaggagaaccgagtgcagaagggaaatggatattttcaagtgcccccacatacacccgtgatctttggtgaagctggaggtcgcacactgttcaggctgctctgccgagattccgggggtgagactgagtctatgcttcttaatgaaacagtgccacaatgggtaattgacatcactgtggataaaaatatgcccaaattcaacaaaattcctttctacctccaacctcatgcatcttcaggagcaaaaaccttaaaaaaagatagactctctgctagtgacatgctccaagtccgaaaagttatggaacatgtttatgaaaaaattatcaacttggataatgagtctcaaaccactagctcttctaataatgaaaaaccaggagaacaggaaaaagaagaagatattgctgtgttggcagaggagaaaattgaacttttgtgccaggaccaggttttggatccaaatatggaccttcgaacagtgaaacacttcatatggaagagcggtggagacctcaccctccattaccgtcagaagtccacgtgaaggctgggctaatgctcctggatattcatttacgaccttcctctatggccccaagagtagtcctaggaagcccactgatccccaacgggagcaagacttctaacggctgattggtatggaccgagattatctttcaattgaagtgactaatcgagatgtaatatagaaaccagtctccatgtgtagattaagctgtccccagggaagcagagtgcaagagcagaagagccccaagcagactatgtctttcaagatgtacagaagactgacaacaggccagtgcagactttgcttcctccttttgtttcaaaggaccttatctacccattaacacttgttagagacacctcagtcgggccacaactgtctctgtttcaactttaagcccacacactctgtagcttttctaaaacagtacattccattcatgcagtagatatgaaggctttttccaagtttgtcatataaagtaatcaaattgttttcaccgtttaagacagttatttttaatgggaatttgctgttgcacaatttgagaaccagcccatttcataataaaagattaatgttgggcttgttgttaatattgcatctcagatgtgttcttgtaggaagatctgttgaaattccaggtgctggatcatagcacttggactgttgggccggagtttgtgcagcccatgcctagcgatgctgcacctcccatgatgtcctggctttgtggcaaccccagggaggtgcagcagtttcactccttcctccactgtgtccagttttatttacacaaagcgagctgagaccacaggttcttgctctggatgagcagcatgacaccatcaaaatttaagaccatgatgaaatttcagtttcattcaaatgttacctaaaatttatggtgtcagaataaagggagatcatagtgagttaatttgatattcatatcctggaagtatacatatttgtttttccaaagttttatatgcaggtttttgttgtacctgtatccagatcttcttttcactgttctaacaatctaacactttcatagaatcatttggatcttgtatagagtgtaacttattggggataaacacttcaacttttggcagaaaatactttggattctccccaaggtcatttgtattcagagtaaatcagtggtccacccccataaaactgtaagacaagcctcctgtatgaagccagaagcacaagtgccttcagagggcagttgattccagtccagttgcctccctagcttgtgtgtggcctgcctccaccatagcagggactagggagggaggcagggaacgttttttcttttctacatcttcacaggttcggctgggggcagctgataggcctaaggccataccttactatttaagatactctgatcgcacaactgcagagacagggttccctcactgctagtcagcttcttttggaaactggacaggccattgccacctgcactttgaagaagtgagcaaagacgtggccacatttctaataagttgaaatggtctttctcccttcctcagagagcaaccagcttctttttttttaaaagtcctttctatctgttggatacaacagtgtgcttttggtgcacattttttagcaatagttgtgaattaatggc

SEQ ID NO: 199865 - DNA, 2300 bp, Homo sapiens
  Payload ID: 19427
  Gene Name: WD repeat domain 48
  ENST ID: ENST00000413099
  CDS Start-End: 11-202
aacatgcaagatggcggcccatcaccggcagaacacagcagggcggaggaaagtgcaggtttcctatgttattcgagatgaagtggagaagtacaaccgaaatggagtcaatgctctgcagctggatccagcactaaatagacttttcacagccggtcgagactctatcataagaatatggagtgtcaatcagcacaagtaatatctgcttcttctgacacgacagtaaaagtatggaatgcacacaagggattttgcatgtcaacattaaggacacataaggattacgtaaaggccttagcatatgccaaggataaagaactagtagcatcagctgggttggacagacaaatattcctttgggatgtgaatactctaacagcattgactgcctcaaataacactgtcacaacttcttctttaagtggaaacaaagattccatttatagcctggccatgaatcaactgggaacaatcattgtatcagggtccactgaaaaggtgttacgggtatgggatccaagaacatgtgcaaaactaatgaagcttaaagggcacacggataatgtgaaggcattgctattaaacagagatggcacgcaatgcctgtcaggcagttctgatgggacaattcgcctttggtcccttggccagcagagatgtatagcaacataccgagtccatgatgaaggtgtttgggcgctgcaagtcaatgatgccttcacacatgtgtattctggtggaagggacaggaagatttattgtacagacctaagaaaccctgacattcgggtgctaatttgtgaagaaaaagcaccagttctcaagatggagcttgatagatcagctgatcctcctcctgcaatttgggttgcaacaactaagtctacagtaaataaatggactttgaaaggaattcataattttagagcctctggagattatgacaatgactgtacaaatcctataacacctctttgtacacaacctgaccaggttattaaagggggtgctagtattattcagtgccacattcttaatgataagagacatatattaaccaaagataccaataataatgtggcatattgggatgtattgaaggcatgtaaagttgaagatctgggcaaagtggattttgaagatgaaattaagaaaagatttaaaatggtgtatgtgccaaattggttctcagtagacttaaaaacagggatgttaactattactttggatgaaagtgattgttttgctgcctgggtttctgcaaaagatgctggtttcagcagccctgatgggtcagatccaaaattgaatttaggaggacttttactccaagcactcctggaatattggcctagaacacatgtgaatccaatggatgaagaggaaaatgaagtaaaccatgtaaatggggagcaggagaaccgagtgcagaagggaaatggatattttcaagtgcccccacatacacccgtgatctttggtgaagctggaggtcgcacactgttcaggctgctctgccgagattccgggggtgagactgagtctatgcttcttaatgaaacagtgccacaatgggtaattgacatcactgtggataaaaatatgcccaaattcaacaaaattcctttctacctccaacctcatgcatcttcaggagcaaaaaccttaaaaaaagatagactctctgctagtgacatgctccaagtccgaaaagttatggaacatgtttatgaaaaaattatcaacttggataatgagtctcaaaccactagctcttctaataatgaaaaaccaggagaacaggaaaaagaagaagatattgctgtgttggcagaggagaaaattgaacttttgtgccaggaccaggttttggatccaaatatggaccttcgaacagtgaaacacttcatatggaagagcggtggagacctcaccctccattaccgtcagaagtccacgtgaaggctgggctaatgctcctggatattcatttacgaccttcctctatggccccaagagtagtcctaggaagcccactgatccccaacgggagcaagacttctaacggctgattggtatggaccgagattatctttcaattgaagtgactaatcgagatgtaatatagaaaccagtctccatgtgtagattaagctgtccccagggaagcagagtgcaagagcagaagagccccaagcagactatgtctttcaagatgtacagaagactgacaacaggccagtgcagactttgcttcctccttttgtttcaaaggaccttatctacccattaacact

SEQ ID NO: 199866 - DNA, 563 bp, Homo sapiens
  Payload ID: 19427
  Gene Name: WD repeat domain 48
  ENST ID: ENST00000423296
  CDS Start-End: 14-418
gtcaacatgcaagatggcggcccatcaccggcagaacacagcagggcggaggaaagtgcaggtttcctatgttattcgagatgaagtggagaagtacaaccgaaatggagtcaatgctctgcagctggatccagcactaaatagacttttcacagccggtcgagactctatcataagaatatggagtgtcaatcagcacaagcaagatccatatatagcatctatggaacaccatactgattgggtaaacgacattgtactctgttgtaatgggaaaacattaatatctgcttcttctgacacgacagtaaaagtatggaatgcacacaagggattttgcatgtcaacattaaggacacataagtatgtctgttctattacaggattacgtaaaggccttagcatatgccaaggataaagaactagtagcatcagctgggttggacagacaaatattcctttgggatgtgaatactctaacagcattgactgcctcaaataacactgtcacaacttcttctttaagtggaaacaaagattccatttatagcctggccatgaat

SEQ ID NO: 199867 - DNA, 645 bp, Homo sapiens
  Payload ID: 19427
  Gene Name: WD repeat domain 48
  ENST ID: ENST00000433841
  CDS Start-End: 8-232
atgcaagatggcggcccatcaccggcagaacacagcagggcggaggaaagtgcaggtttcctatgttattcgagatgaagtggagaagtacaaccgaaatggagtcaatgctctgcagctggatccagcactaaatagacttttcacagccggtcgagactctatcataagaatatggagtgtcaatcagcacaaggatttttcttttaatttcagcaagatccatatatagcatctatggaacaccatactgattgggtaaacgacattgtactctgttgtaatgggaaaacattaatatctgcttcttctgacacgacagtaaaagtatggaatgcacacaagggattttgcatgtcaacattaaggacacataaggattacgtaaaggccttagcatatgccaaggataaagaactagtagcatcagctgggttggacagacaaatattcctttgggatgtgaatactctaacagcattgactgcctcaaataacactgtcacaacttcttctttaagtggaaacaaagattccatttatagcctggccatgaatcaactgggaacaatcattgtatcagggtccactgaaaaggtgttacgggtatgggatccaagaacatgtgcaaaactaatgaagctt

SEQ ID NO: 199868 - DNA, 3772 bp, Homo sapiens
  Payload ID: 19427
  Gene Name: WD repeat domain 48
  ENST ID: ENST00000420940
  CDS Start-End: 7-369
tgcaagatggcggcccatcaccggcagaacacagcagggcggaggaaagtgcaggtttcctatgttattcgagatgaagtggagaagtacaaccgaaatggagtcaatgctctgcagctggatccagcactaaatagacttttcacagccggtcgagactctatcataagaatatggagtgtcaatcagcacaagcaagatccatatatagcatctatggaacaccatactgattgggtaaacgacattgtactctgttgtaatgggaaaacattaatatctgcttcttctgacacgacagtaaaagtatggaatgcacacaagggattttgcatgtcaacattaaggacacataagcttcttctttaagtggaaacaaagattccatttatagcctggccatgaatcaactgggaacaatcattgtatcagggtccactgaaaaggtgttacgggtatgggatccaagaacatgtgcaaaactaatgaagcttaaagggcacacggataatgtgaaggcattgctattaaacagagatggcacgcaatgcctgtcaggcagttctgatgggacaattcgcctttggtcccttggccagcagagatgtatagcaacataccgagtccatgatgaaggtgtttgggcgctgcaagtcaatgatgccttcacacatgtgtattctggtggaagggacaggaagatttattgtacagacctaagaaaccctgacattcgggtgctaatttgtgaagaaaaagcaccagttctcaagatggagcttgatagatcagctgatcctcctcctgcaatttgggttgcaacaactaagtctacagtaaataaatggactttgaaaggaattcataattttagagcctctggagattatgacaatgactgtacaaatcctataacacctctttgtacacaacctgaccaggttattaaagggggtgctagtattattcagtgccacattcttaatgataagagacatatattaaccaaagataccaataataatgtggcatattgggatgtattgaaggcatgtaaagttgaagatctgggcaaagtggattttgaagatgaaattaagaaaagatttaaaatggtgtatgtgccaaattggttctcagtagacttaaaaacagggatgttaactattactttggatgaaagtgattgttttgctgcctgggtttctgcaaaagatgctggtttcagcagccctgatgggtcagatccaaaattgaatttaggaggacttttactccaagcactcctggaatattggcctagaacacatgtgaatccaatggatgaagaggaaaatgaagtaaaccatgtaaatggggagcaggagaaccgagtgcagaagggaaatggatattttcaagtgcccccacatacacccgtgatctttggtgaagctggaggtcgcacactgttcaggctgctctgccgagattccgggggtgagactgagtctatgcttcttaatgaaacagtgccacaatgggtaattgacatcactgtggataaaaatatgcccaaattcaacaaaattcctttctacctccaacctcatgcatcttcaggagcaaaaaccttaaaaaaagatagactctctgctagtgacatgctccaagtccgaaaagttatggaacatgtttatgaaaaaattatcaacttggataatgagtctcaaaccactagctcttctaataatgaaaaaccaggagaacaggaaaaagaagaagatattgctgtgttggcagaggagaaaattgaacttttgtgccaggaccaggttttggatccaaatatggaccttcgaacagtgaaacacttcatatggaagagcggtggagacctcaccctccattaccgtcagaagtccacgtgaaggctgggctaatgctcctggatattcatttacgaccttcctctatggccccaagagtagtcctaggaagcccactgatccccaacgggagcaagacttctaacggctgattggtatggaccgagattatctttcaattgaagtgactaatcgagatgtaatatagaaaccagtctccatgtgtagattaagctgtccccagggaagcagagtgcaagagcagaagagccccaagcagactatgtctttcaagatgtacagaagactgacaacaggccagtgcagactttgcttcctccttttgtttcaaaggaccttatctacccattaacacttgttagagacacctcagtcgggccacaactgtctctgtttcaactttaagcccacacactctgtagcttttctaaaacagtacattccattcatgcagtagatatgaaggctttttccaagtttgtcatataaagtaatcaaattgttttcaccgtttaagacagttatttttaatgggaatttgctgttgcacaatttgagaaccagcccatttcataataaaagattaatgttgggcttgttgttaatattgcatctcagatgtgttcttgtaggaagatctgttgaaattccaggtgctggatcatagcacttggactgttgggccggagtttgtgcagcagtttcactccttcctccactgtgtccagttttatttacacaaagcgagctgagaccacaggttcttgctctggatgagcagcatgacaccatcaaaatttaagaccatgatgaaatttcagtttcattcaaatgttacctaaaatttatggtgtcagaataaagggagatcatagtgagttaatttgatattcatatcctggaagtatacatatttgtttttccaaagttttatatgcaggtttttgttgtacctgtatccagatcttcttttcactgttctaacaatctaacactttcatagaatcatttggatcttgtatagagtgtaacttattggggataaacacttcaacttttggcagaaaatactttggattctccccaaggtcatttgtattcagagtaaatcagtggtccacccccataaaactgtaagacaagcctcctgtatgaagccagaagcacaagtgccttcagagggcagttgattccagtccagttgcctccctagcttgtgtgtggcctgcctccaccatagcagggactagggagggaggcagggaacgttttttcttttctacatcttcacaggttcggctgggggcagctgataggcctaaggccataccttactatttaagatactctgatcgcacaactgcagagacagggttccctcactgctagtcagcttcttttggaaactggacaggccattgccacctgcactttgaagaagtgagcaaagacgtggccacatttctaataagttgaaatggtctttctcccttcctcagagagcaaccagcttctttttttttaaaagtcctttctatctgttggatacaacagtgtgcttttggtgcacattttttagcaatagttgtgaattaatggcaaagaaaaaaaaaattatttaccagccctcagttgtgtttgcccgaggggcctttgagcaaagaaatgggttttgctgggtcattttgccctgtgtgctaagccttgggtggctgcattcccctcctgtcatagatctgacccccagcatgattgtatttctttcccctccagtcaaaccgtaatacagtttccagaaaattcgacagtctgcaatgccaaaagggtaaaaatctgtatttcacagttgtatagaataaaggctttagttaaaatatttcaaa

SEQ ID NO: 199869 - DNA, 949 bp, Homo sapiens
  Payload ID: 19427
  Gene Name: WD repeat domain 48
  ENST ID: ENST00000441361
  CDS Start-End: 464-949
attctgagcccgggattgcttgtcgccgctcttctgtaggagtggacttgcggggtcgggataggctcgttccccgcccacttgcctcccccttgccctgtctttcttcgaagcgctctgccctcgctgcgtcggagccgaggcctccaggggtttcccaggggggtgggcgttggaggagtgagcggcttgtgcgggggcgtggcgaggcggcggagcgccaacggccctgcggggtttctgctgaggattccgcacttgggagcccccagccctctcttatgtgggagctgtcccctgggtttcctatgttattcgagatgaagtggagaagtacaaccgaaatggagtcaatgctctgcagctggatccagcactaaatagacttttcacagccggtcgagactctatcataagaatatggagtgtcaatcagcacaagcaagatccatatatagcatctatggaacaccatactgattgggtaaacgacattgtactctgttgtaatgggaaaacattaatatctgcttcttctgacacgacagtaaaagtatggaatgcacacaagggattttgcatgtcaacattaaggacacataaggattacgtaaaggccttagcatatgccaaggataaagaactagtagcatcagctgggttggacagacaaatattcctttgggatgtgaatactctaacagcattgactgcctcaaataacactgtcacaacttcttctttaagtggaaacaaagattccatttatagcctggccatgaatcaactgggaacaatcattgtatcagggtccactgaaaaggtgttacgggtatgggatccaagaacatgtgcaaaactaatgaagcttaaagggcacacggataatgtgaaggcattgctattaaacagagatggcacgcaatgcctgtcaggcagttctgatggg

SEQ ID NO: 199870 - DNA, 2594 bp, Homo sapiens
  Payload ID: 19428
  Gene Name: WD repeat domain 49
  Uniprot ID: Q8IV35
  ENST ID: ENST00000308378
  CDS Start-End: 307-2400
aggcacctgttgaaggaaaaagaagatccatccttatagaaatagttgaaggcaactgagaaaaggtgaagccattatgagttgccagaaagctgtacttgagttaaacatagggtcacagcttgggccaaagagtcctgagagaacagaaggtgtaactgcatttgaagactatggcacaggcctgcttgaaaaccaactcagcgtgggtgactttgtaaaaatacagaaggcctttgagttacttacaatgcatctttagacgctatcatttccagtacaaccagcaatacaaatagtgtggtgatggcttggagagagaaatcaaaaaagcgtcttaatatgacatccttcaacattgcccagggcattcatgcttttgattatcactctcggctcaatttaattgcaactgctggcattaacaataaagtttgcctttggaatccctatgttgtctctaaaccagtgggtgtcctttggggccactcagccagtgtaatagccgtccaattctttgtggaaagaaaacaacttttcagcttctccaaggataaagttttgagactctgggatattcaacaccagctgtccatccagaggatagcttgttctttccccaaaagtcaggacttcagatgtctcttccactttgatgaagcccatggacgacttttcatctcgtttaataaccagctagcattgttggcaatgaaaagtgaagccagcaagagggtgaaaagccatgagaaagcagtcacttgtgttctttacaattctatcttgaagcaggtaatcagctctgatacagggtctactgtttccttctggatgatagacactgggcagaaaatcaaacagtttactggttgccacggcaacgcagaaatcagcactatggcccttgatgcaaatgagactcggcttttgactggcagcacagatgggactgtaaagatatgggacttcaatggatattgtcaccatacactaaatgttgggcaagatggagctgtggatatttcacaaatcctcattcttaagaagaaaatactggttacaggctgggagagggctattactgtgtttcgaccccaaaacttcaatcaatttttcatccagcctgaagaatggaaaggaggtatacagcaccatgatgacatcttgtgtgctgcgtttttacctccacaaactcttgttacggggagttatgatggagaaattgttctatggaacaatagcacagagaatgctcaccatgttcttcaccctgattaccagaggttgctaaagtcaaaattagatacaaaacctcaaaaacttctcagtgctgggagaagccaaccctcccaccccatggcagaccattctaccacgggagtccgcaactttgagattgacactgagggcaaaaatgctgttatgagactttgctttcttaaagcaagaaaaaacactgcagtgacaggaggagctaacctggtatcatgtggaggatctggttatgtcagattttgggatatatataagaagcaacttctggctgaatttttggctcatagtggagttggatcgattattatgtctactgataagatgaatcgataccttaccacaggagatcttgatggatggttgaaaatctggaatatagaggagtactgtcttaactccagtaagaacaaaatcaccaaggccccaactctgataagatcattccaacctcatgaggaccgaataagttccttagagatgtgtgagccaggtggtcagttactgattatctcctcctctgcagactgcagtatttgtgtgactggtgtctgcaatgctcctgtttggatctttggtcaggcaaagcactggcatattgaaaactgccttttccttcctaaaagagatactaatttagtggaaagtgagattcaaaaggaaatttctttattttctaaggaggaatcttgtttagacccaacagaacattctctacttaataagaaaaacaaagatgactcaacatacaatgtcagaccatcagaagatataaatttagatataaaatataaggaaagaagtacctgcatgaaagaaacacaaaaaccttattatggtgaagttataaaaaaatcattcagtacatttaggtcattaaacattggagccctggaagagctgcctgaagtgaataaacctgctttccttctagaccctgagaaatactttaggaaagaaccagaggaagagcgtccccaaattctggaggccccgtcactttttaaaactttgaaagctgtatttgatgagaaaaacctgtttcccaaggaaattctgcatcatgaacgaaaagccaagcaattatgccaagaaaaaagttgtgaagtgaagaaaaataagaagtaattacaacagaaaaaccttcactgttacataaggtacagatataaaatgcagaaaaagcatcaagaattctgccttttattttattttatatttaaacttcaggaagttttctcttcatgggataatttagtactgcttttatctatcatctgtcaatttctctgtattcttaataaaataaatattgaactaaa

SEQ ID NO: 199871 - DNA, 1108 bp, Homo sapiens
  Payload ID: 19428
  Gene Name: WD repeat domain 49
  ENST ID: ENST00000460448
  CDS Start-End: 167-352
cttcattggtagggaaactctgcagctttgtcatctaactcttccagacaagaaagtggaattgaaaactacaacatgttaatggaagcaaggcacctgttgaaggaaaaagaagatccatccttatagaaatagttgaaggcaactgagaaaaggtgaagccattatgagttgccagaaagctgtacttgagttaaacatagggtcacagcttgggccaaagagtcctgagagaacagaaggtgtaactgcatttgaagactatggcacaggcctgcttgaaaaccaactcagcgtgggtgactttgtaaaaatacagaaggcctttgagttacttacaatgcatctttagacgctatcatttccagtacaaccagcaatacaaatagtgtggtgatggcttggagagagaaatcaaaaaagcgtcttaatatgacatccttcaacattgcccagggcattcatgcttttgattatcactctcggctcaatttaattgcaactgctggcattaacaataaagtttgcctttggaatccctatgttgtctctaaaccagtgggtgtcctttggggccactcagccagtgtaatagccgtccaattctttgtggaaagaaaacaacttttcagcttctccaaggataaagttttgagactctgggatattcaacaccagctgtccatccagaggatagcttgttctttccccaaaagtcaggacttcagatgtctcttccactttgatgaagcccatggacgacttttcatctcgtttaataaccagctagcattgttggcaatgaaaagtgaagccagcaagagggtgaaaagccatgagaaagcagtcacttgtgttctttacaattctatcttgaagcagggctattactgtgtttcgaccccaaaacttcaatcaatttttcatccagcctgaagaatggaaaggaggtatacagcaccatgatgacatcttgtgtgctgcgtttttacctccacaaactcttgttacggggagttatgatggagaaattgttctatggaacaatagcacagagaatgctcaccatgttcttcaccctgattaccagaggttgctaaagtcaaaa

SEQ ID NO: 199872 - DNA, 416 bp, Homo sapiens
  Payload ID: 19428
  Gene Name: WD repeat domain 49
  ENST ID: ENST00000493061
  CDS Start-End: 1-416
agattgacactgagggcaaaaatgctgttatgagactttgctttcttaaagcaagaaaaaacactgcagtgacaggaggagctaacctggtatcatgtggaggatctggttatgtcagattttgggatatatataagaagcaacttctggctgaatttttggctcatagtggagttggatcgattattatgtctactgataagatgaatcgataccttaccacaggagatcttgatggatggttgaaaatctggaatatagaggcaaagcactggcatattgaaaactgccttttccttcctaaaagagatactaatttagtggaaagtgagattcaaaaggaaatttctttattttctaaggaggaatcttgtttagacccaacagaacattctctacttaataagaaaaacaaa

SEQ ID NO: 199873 - DNA, 575 bp, Homo sapiens
  Payload ID: 19428
  Gene Name: WD repeat domain 49
  ENST ID: ENST00000466760
  CDS Start-End: 220-575
agatgaaacaaacaactccacattgctgggaaggtggcattcagagtcaagtacttcattggtagggaaactctgcagctttgtcatctaactcttccagacaagaaagtggaattgaaaactacaacatgttaatggaagcaaggcacctgttgaaggaaaaagaagatccatccttatagaaatagttgaaggcaactgagaaaaggtgaagccattatgagttgccagaaagctgtacttgagttaaacatagggtcacagcttgggccaaagagtcctgagagaacagaaggtgtaactgcatttgaagactatggcacaggcctgcttgaaaaccaactcagcgtgggtgactttgtaaaaatacagaaggcctttgaggtaatcagctctgatacagggtctactgtttccttctggatgatagacactgggcagaaaatcaaacagtttactggttgccacggcaacgcagaaatcagcactatggcccttgatgcaaatgagactcggcttttgactggcagcacagatgggactgtaaagatatgggacttcaatggatattgtca

SEQ ID NO: 199874 - DNA, 2215 bp, Homo sapiens
  Payload ID: 19428
  Gene Name: WD repeat domain 49
  ENST ID: ENST00000472600
  CDS Start-End: 1-2024
ggcctgctagtgcatgtgaagatggagaagccactatgaccattaactgggcagagctgctctctggatgtcacaaatgttgccatatattagagcataaacttcatcaaggagattgggtcaggcaagttacttacaatgcatctttagacgctatcatttccagtacaaccagcaatacaaatagtgtggtgatggcttggagagagaaatcaaaaaagcgtcttaatatgacatccttcaacattgcccagggcattcatgcttttgattatcactctcggctcaatttaattgcaactgctggcattaacaataaagtttgcctttggaatccctatgttgtctctaaaccagtgggtgtcctttggggccactcagccagtgtaatagccgtccaattctttgtggaaagaaaacaacttttcagcttctccaaggataaagttttgagactctgggatattcaacaccagctgtccatccagaggatagcttgttctttccccaaaagtcaggacttcagatgtctcttccactttgatgaagcccatggacgacttttcatctcgtttaataaccagctagcattgttggcaatgaaaagtgaagccagcaagagggtgaaaagccatgagaaagcagtcacttgtgttctttacaattctatcttgaagcaggtaatcagctctgatacagggtctactgtttccttctggatgatagacactgggcagaaaatcaaacagtttactggttgccacggcaacgcagaaatcagcactatggcccttgatgcaaatgagactcggcttttgactggcagcacagatgggactgtaaagatatgggacttcaatggatattgtcaccatacactaaatgttgggcaagatggagctgtggatatttcacaaatcctcattcttaagaagaaaatactggttacaggctgggagaggtatgattatgcctcatggaaaactataggaagggctattactgtgtttcgaccccaaaacttcaatcaatttttcatccagcctgaagaatggaaaggaggtatacagcaccatgatgacatcttgtgtgctgcgtttttacctccacaaactcttgttacggggagttatgatggagaaattgttctatggaacaatagcacagagaatgctcaccatgttcttcaccctgattaccagaggttgctaaagtcaaaattagatacaaaacctcaaaaacttctcagtgctgggagaagccaaccctcccaccccatggcagaccattctaccacgggagtccgcaactttgagattgacactgagggcaaaaatgctgttatgagactttgctttcttaaagcaagaaaaaacactgcagtgacaggaggagctaacctggtatcatgtggaggatctggttatgtcagattttgggatatatataagaagcaacttctggctgaatttttggctcatagtggagttggatcgattattatgtctactgataagatgaatcgataccttaccacaggagatcttgatggatggttgaaaatctggaatatagaggaggaatcttgtttagacccaacagaacattctctacttaataagaaaaacaaagatgactcaacatacaatgtcagaccatcagaagatataaatttagatataaaatataaggaaagaagtacctgcatgaaagaaacacaaaaaccttattatggtgaagttataaaaaaatcattcagtacatttaggtcattaaacattggagccctggaagagctgcctgaagtgaataaacctgctttccttctagaccctgagaaatactttaggaaagaaccagaggaagagcgtccccaaattctggaggccccgtcactttttaaaactttgaaagctgtatttgatgagaaaaacctgtttcccaaggaaattctgcatcatgaacgaaaagccaagcaattatgccaagaaaaaagttgtgaagtgaagaaaaataagaagtaattacaacagaaaaaccttcactgttacataaggtacagatataaaatgcagaaaaagcatcaagaattctgccttttattttattttatatttaaacttcaggaagttttctcttcatgggataatttagtactgcttttatctatcatctgtcaatttctctgtattcttaataaaataaatattgaact

SEQ ID NO: 199875 - DNA, 2108 bp, Homo sapiens
  Payload ID: 19428
  Gene Name: WD repeat domain 49
  ENST ID: ENST00000479765
  CDS Start-End: 225-1781
agaacagatgaaacaaacaactccacattgctgggaaggtggcattcagagtcaagtacttcattggtagggaaactctgcagctttgtcatctaactcttccagacaagaaagtggaattgaaaactacaacatgttaatggaagcaaggcacctgttgaaggaaaaagaagatccatccttatagaaatagttgaaggcaactgagaaaaggtgaagccattatgagttgccagaaagctgtacttgagttaaacatagggtcacagcttgggccaaagagtcctgagagaacagaaggtgtaactgcatttgaagactatggcacaggcctgcttgaaaaccaactcagcgtgggtgactttgtaaaaatacagaaggcctttgagtccccacagccaaggaaaatcatttgtatgtccagagaagacttcacgcagaagatgacagagattgttggttggggcacgaaggaagaatatggggagctctttgacaaagtggatgtggcccaagatggcttcattaattgggacaagctgacttcatttatactgctagagctttatgagcaagatgaacgagcaaaggcaactgtggtgccccagtggaaggaccttgaattcctcccagtaaaacacaaggacaccattcaaaaagtaattttcttaaaaaattcaagtcattatctgacaattagtaaagaaggtttattggcaatctggggagagcatttaaagctgcaagaaacattccccatcacttcagatgccaccaagctcaaacacctgtgggtgacaagtctggtttctctggaaaatgtaaacaagatagcagtggcttttacaagtaaagaggtttgtttctatgatctgctgtccaaagaagaatttgcttgccaatacaaactccaaggcctgaaaggaacaccaatttgcatggattattggtatgatcctcttgatgccaatgaatcaattctttcttttggggatataactggaaaggttcaagcaattgctttcaccgcagccttgatttccctgtttgaacggcctgctagtgcatgtgaagatggagaagccactatgaccattaactgggcagagctgctctctggatgtcacaaatgttgccatatattagagcataaacttcatcaaggagattgggtcaggcaagttacttacaatgcatctttagacgctatcatttccagtacaaccagcaatacaaatagtgtggtgatggcttggagagagaaatcaaaaaagcgtcttaatatgacatccttcaacattgcccagggcattcatgcttttgattatcactctcggctcaatttaattgcaactgctggcattaacaataaagtttgcctttggaatccctatgttgtctctaaaccagtgggtgtcctttggggccactcagccagtgtaatagccgtccaattctttgtggaaagaaaacaacttttcagcttctccaaggataaagttttgagactctgggatattcaacaccagctgtccatccagaggatagcttgttctttccccaaaagtcaggacttcagatgtctcttccactttgatgaagcccatggacgacttttcatctcgtttaataaccagctagcattgttggcaatgaaaagtgaagccagcaagagggtgaaaagccatgagaaagcagtcacttgtgttctttacaattctatcttgaagcagccttctcaatgtgaagacgacacgaatgaagacccttatgataattgacttccactcaataaatactttgaaagctgtatttgatgagaaaaacctgtttcccaaggaaattctgcatcatgaacgaaaagccaagcaattatgccaagaaaaaagttgtgaagtgaagaaaaataagaagtaattacaacagaaaaaccttcactgttacataaggtacagatataaaatgcagaaaaagcatcaagaattctgccttttattttattttatatttaaacttcaggaagttttctcttcatgggataatttagtactgcttttatctatcatctgtcaatttctctgtattcttaataaaataaatattgaact

SEQ ID NO: 199876 - DNA, 521 bp, Homo sapiens
  Payload ID: 19428
  Gene Name: WD repeat domain 49
  ENST ID: ENST00000488012
  CDS Start-End: 182-521
attcagagtcaagtacttcattggtagggaaactctgcagctttgtcatctaactcttccagacaagaaagtggaattgaaaactacaacatgttaatggaagcaaggcacctgttgaaggaaaaagaagatccatccttatagaaatagttgaaggcaactgagaaaaggtgaagccattatgagttgccagaaagctgtacttgagttaaacatagggtcacagcttgggccaaagagtcctgagagaacagaaggtgtaactgcatttgaagactatggcacaggcctgcttgaaaaccaactcagcgtgggtgactttgtaaaaatacagaaggcctttgagatagcagtggcttttacaagtaaagaggtttgtttctatgatctgctgtccaaagaagaatttgcttgccaatacaaactccaaggcctgaaaggaacaccaatttgcatggattattggtatgatcctcttgatgccaatgaatcaattctttcttttggggatataactggaa

SEQ ID NO: 199877 - DNA, 3151 bp, Homo sapiens
  Payload ID: 19429
  Gene Name: WD repeat domain 5
  Uniprot ID: P61964
  ENST ID: ENST00000358625
  CDS Start-End: 172-1176
gccgcctggcgcccgcccgagctgccgccttgtcgagctgagtccgcgctcccgcccaggcggcggccgacgcgacgccccgagcgcccggccccgccgccgcggcccggcagactgcctctgtcaccgggtccctccacccttgtctcctgtgcggccagcgtcagagccatggcgacggaggagaagaagcccgagaccgaggccgccagagcacagccaaccccttcgtcatccgccactcagagcaagcctacacctgtgaagccaaactatgctctaaagttcacccttgctggccacaccaaagcagtgtcctccgtgaaattcagcccgaatggagagtggctggcaagttcatctgctgataaacttattaaaatttggggcgcgtatgatgggaaatttgagaaaaccatatctggtcacaagctgggaatatccgatgtagcctggtcgtcagattctaaccttcttgtttctgcctcagatgacaaaaccttgaagatatgggacgtgagctcgggcaagtgtctgaaaaccctgaagggacacagtaattatgtcttttgctgcaacttcaatccccagtccaaccttattgtctcaggatcctttgacgaaagcgtgaggatatgggatgtgaaaacagggaagtgcctcaagactttgccagctcactcggatccagtctcggccgttcattttaatcgtgatggatccttgatagtttcaagtagctatgatggtctctgtcgcatctgggacaccgcctcaggccagtgcctgaagacgctcatcgatgacgacaacccccccgtgtcttttgtgaagttctccccgaacggcaaatacatcctggccgccacgctggacaacactctgaagctctgggactacagcaaggggaagtgcctgaagacgtacactggccacaagaatgagaaatactgcatatttgccaatttctctgttactggtgggaagtggattgtgtctggctcagaggataaccttgtttacatctggaaccttcagacgaaagagattgtacagaaactacaaggccacacagatgtcgtgatctcaacagcttgtcacccaacagaaaacatcatcgcctctgctgcgctagaaaatgacaaaacaattaaactgtggaagagtgactgctaagtccctttgctcctgcccgcgagagactgtcgggaagttgacccggattggcaagaaacagggtgtcttggaggtggtcccccagatctgcgcctgggggtcaggacagggcctgatttgagcctcctctctgaagatgatttggccgagcggaaggtgtggaccaccggaaagttcttaaaagttgctggtgacatttcttgccaattctaacactgtctagggaagagttcctagtctattgtgttcaaacagagtcaacaaaagtttttaattttttattacagaagggtgaagttcaatttaacatgcgttgtgttttttcagtaaacgttctgtatctttttgatattccatgacccagtgcacgctgtggcctgtcaccgccaccgtggccccgccagctggcctcccctttggcccacgccggccgcccccattctctgctgcgtagatgccctggcccagggccctgactcctccattcccgccagtagctgttcctagtgtattttcgtctttctggaaaacagcattgagtggttgttttctgtgtaaagagccgtttgtgtcttgggagtttgtggcccacatgccgatagcacggtcatcgcacatgactctcccgtttgtctcagtgtccctgcaacaagcagcaccgcagactgtaataaaaggtggggttttgtgaatggttgtggcaagtgcgtccttgtgaagctcgtctccatgtggctttcttggagaaaggctcccctggggcaagagggtggaaggtttctttggacaggaggtgctgaggctggctgcacctgctctctgaagacgccttcctctctaggttcattgttcagtgttgctgggggcggggaacgggggtggggaggttcttagttgcgaaggagccaagctcctgatggacttgcgttgggatgtgggggacacctgtggcatggtaaggctccctgagtcccttactccaggtcagatgccagtgggactcatgcgccctatgagggctgcagggccagtgctgcccctcggactcctcgaggggttgggtgctaagcgcgagcctcgccgtccctgctggagccctcgcctgcctgcccctctgcctgtgctcctggcagtgtggcttcccggtgctcacctgcacagcagttaacagcagaggccgagcgggagcctctggggagcgaggctgaaacctgaacctgcccatggagacagttgtggtgagggttgccacacacagtgagggcggagcagggtggctgagggcacaggtgcctgggtctgtcccacggggcagggctttggggctgtgatgctctgggaagccagcttgggtcctgggtctacagagggccctggccccggagcccagccagctctgcctctctcagggcctggagtcctgggggagctcagccagctctgcctttctcagggcctggagtcctggatgaatcctgcaggtttttggttgcaccggcccagggaggaagcggggggtttgtcaggtgggctctcctggaggtcctcgagtggcaggggtgaggaggggattatctgaggcatctggagatgtatatcctgtggtttcccctgcccctctgtttccgatgaggtgtacggatgagtgacctgcactaagaagtgagttgccacagtgaaaatgggttggtttttgtcttcgacgctcagggtctgggcgcctcgcatttgcagtctgttgtgacagacacggggagctccgcgtgccagcctgtggctgccctgctgtgggggtcctggggccggcgaggccccttcagtcttgttctggggggacggcccactccggggagggggtgtgctgtgctgagcgctgtatccctgaatatagtttattttttctacatttgaattctgttgtagatttatgtaaaaatacattctttttgaaaataaaaattttcatgtcttctaa

SEQ ID NO: 199878 - DNA, 705 bp, Homo sapiens
  Payload ID: 19429
  Gene Name: WD repeat domain 5
  ENST ID: ENST00000608937
  CDS Start-End: 537-705
gtgagtttgcgcactgcggagcgggcgcgggtgactccagagcggccctgccagtccgcggggctggcggggagcaggttcgtgcaccgcgggctctgtgcatgcagaggcgggaagagcccccagcccggcagccggccccgcgggaaggcgcagcccgggcttccgaaccctgtgaacgcgcaggttcctggtcttccagatgggcaggaatcgtcctgcccgcccggggtgggaggccacatgggggcactgcgcccgggcgcggccccaggtgctttccaaatgcccactgccgctctcatccgtaccagcgatgatcaagaaggggcctggtcgcccggggaggtgccccggcccgaatcgactccggagacaacgccgggcgacgccacctgcgcaggtcccggagggccgctggtgtctgtgtacagggcgtgctgtctgtggaaacgcgagggcacactagcactttcctactgcctctgtcaccgggtccctccacccttgtctcctgtgcggccagcgtcagagccatggcgacggaggagaagaagcccgagaccgaggccgccagagcacagccaaccccttcgtcatccgccactcagagcaagcctacacctgtgaagccaaactatgctctaaagttcacccttgctggccacaccaaagcagtgtcctccgtgaaattcagcccgaatg

SEQ ID NO: 199879 - DNA, 577 bp, Homo sapiens
  Payload ID: 19429
  Gene Name: WD repeat domain 5
  ENST ID: ENST00000608739
  CDS Start-End: 288-577
actgcggagcgggcgcgggtgactccagagcggccctgccagtccgcggggctggcggggagcagcgatgatcaagaaggggcctggtcgcccggggaggtgccccggcccgaatcgactccggagacaacgccgggcgacgccacctgcgcaggtcccggagggccgctggtgtctgtgtacagggcgtgctgtctgtggaaacgcgagggcacactagcactttcctactgcctctgtcaccgggtccctccacccttgtctcctgtgcggccagcgtcagagccatggcgacggaggagaagaagcccgagaccgaggccgccagagcacagccaaccccttcgtcatccgccactcagagcaagcctacacctgtgaagccaaactatgctctaaagttcacccttgctggccacaccaaagcagtgtcctccgtgaaattcagcccgaatggagagtggctggcaagttcatctgctgataaacttattaaaatttggggcgcgtatgatgggaaatttgagaaaaccatatctggtcacaagctgggaatatccgatgtagcctggtcgtc

SEQ ID NO: 199880 - DNA, 1679 bp, Homo sapiens
  Payload ID: 19430
  Gene Name: WD repeat domain 53
  Uniprot ID: Q7Z5U6
  ENST ID: ENST00000332629
  CDS Start-End: 569-1645
gttcctctcggccccggatgtgactgtttggctgcgccgcctcacgcctgacgctcgacgggattgggcgccggcgggtgaggttatcactaggcgccgaggaggggagcgggaagcgcagtgccagcgccacagcccttcaatcattttggttgctatccagcttctccacatcaagtccaacttcagaaaccccaagcctgtagagaaaagttgacctgtgctgactctggtgatggtgactgtctctcactaatttctttgaagtcttcaaggataagcagagttgatccatctgagaaagggatcatgaactagacagaatgaacagccttagaggcacagactcttgaacgggacggtggtggtatgactagtgcagagtgtttagagatcactcagtttttaaagactggcctttatcgtgtctcagtgcagccgaggcagagcctttgaaggatgcgatgttgtcattcttactaatctagtccagccgctgaggtgactttcaacggcagaccgtctcctgagcgccccaggtagaatttcaaaagtctccgggaccattatggcagtcaagtggacgggtgggcattcttctcctgtcctctgcctgaatgcaagtaaagaagggctgctggcttctggagcagagggcggagatctcacggcttggggtgaagatggaactccattaggacacacgcggttccaaggggctgatgatgttaccagtgtcttattttctccctcctgtcccaccaagctctatgcctcacatggagaaaccattagtgtactggatgtcaggtccctcaaagattccttggaccattttcatgtgaatgaagaagaaatcaattgtctttcattgaatcaaacggaaaacctgctggcttctgctgacgactctggggcaatcaaaatcctagacttggaaaacaagaaagttatcagatccttgaagagacattccaatatctgctcctcagtggcttttcggcctcagaggcctcagagcctggtgtcatgtggactggatatgcaggtgatgctgtggagtcttcaaaaagcccgaccactctggattacaaatttacaggaggatgaaacagaagaaatggaaggcccacagtcacctggtcagctcttaaaccctgccctagcccattctatctctgtggcttcgtgtggtaatatttttagttgtggtgcagaagatggtaaggttcgaatctttcgggtgatgggagttaagtgtgaacaggaactgggatttaagggccacacttcaggggtatcccaggtctgctttctcccagaatcctatttgctgcttactggagggaatgatgggaagatcacgttgtgggatgcaaacagtgaagttgagaaaaaacagaagagtcccacaaaacgtacccacaggaagaaacctaaaagaggaacttgcaccaagcagggtggaaatactaacgcttcagtaacagatgaggaagaacatggcaacattttaccaaagctaaatattgaacatggagaaaaagtgaactggctcttgggtacaaaaataaagggacaccaaaatatattagtagctgatcaaactagttgtatatctgtataccccttaaatgaattttaaatccaataaaaacatttgaagaattgtggcaaaa

SEQ ID NO: 199881 - DNA, 980 bp, Homo sapiens
  Payload ID: 19430
  Gene Name: WD repeat domain 53
  ENST ID: ENST00000425888
  CDS Start-End: 519-980
gcaggtatgaggctggcgccggtggcttcgatgctgctttccggtgacttcgatgctgttttccagtgctttttcctttttctgtgccagcgccacagcccttcaatcattttggttgctatccagcttctccacatcaagtccaacttcagaaaccccaagcctgtagagaaaagttgacctgtgctgactctggtgatggtgactgtctctcactaatttctttgaagtcttcaaggataagcagagttgatccatctgagaaagggatcatgaactagacagaatgaacagccttagaggcacagactcttgaacgggacggtggtggtatgactagtgcagagtgtttagagatcactcagtttttaaagactggcctttatcgtgtctcagtgcagccgaggcagagcctttgaaggatgcgatgttgtcattcttactaatctagtccagccgctgaggtgactttcaacggcagaccgtctcctgagcgccccagagtctccgggaccattatggcagtcaagtggacgggtgggcattcttctcctgtcctctgcctgaatgcaagtaaagaagggctgctggcttctggagcagagggcggagatctcacggcttggggtgaagatggaactccattaggacacacgcggttccaaggggctgatgatgttaccagtgtcttattttctccctcctgtcccaccaagctctatgcctcacatggagaaaccattagtgtactggatgtcaggtccctcaaagattccttggaccattttcatgtgaatgaagaagaaatcaattgtctttcattgaatcaaacggaaaacctgctggcttctgctgacgactctggggcaatcaaaatcctagacttggaaaacaagaaagttatcagatccttgaagagacattccaatatctgctcctcagtggcttttcggcctcagaggcctcagagcctggtgtca

SEQ ID NO: 199882 - DNA, 683 bp, Homo sapiens
  Payload ID: 19430
  Gene Name: WD repeat domain 53
  ENST ID: ENST00000429115
  CDS Start-End: 67-660
cgggattgggcgccggcgggtgaggttatcactaggcgccgaggaggggagcgggaagcgcaggtgatgctgtggagtcttcaaaaagcccgaccactctggattacaaatttacaggaggatgaaacagaagaaatggaaggcccacagtcacctggtcagctcttaaaccctgccctagcccattctatctctgtggcttcgtgtggtaatatttttagttgtggtgcagaagatggtaaggttcgaatctttcgggtgatgggagttaagtgtgaacaggaactgggatttaagggccacacttcaggggtatcccaggtctgctttctcccagaatcctatttgctgcttactggagggaatgatgggaagatcacgttgtgggatgcaaacagtgaagttgagaaaaaacagaagagtcccacaaaacgtacccacaggaagaaacctaaaagaggaacttgcaccaagcagggtggaaatactaacgcttcagtaacagatgaggaagaacatggcaacattttaccaaagctaaatattgaacatggagaaaaagtgaactggctcttgggtacaaaaataaagggacaccaaaatatattagtagctgatcaaactagttgtatatctgtataccccttaaatgaattttaaatccaataaaaacatttgaagaa

SEQ ID NO: 199883 - DNA, 616 bp, Homo sapiens
  Payload ID: 19430
  Gene Name: WD repeat domain 53
  ENST ID: ENST00000456677
  CDS Start-End: 137-616
cagtgccagcgccacagcccttcaatcattttggttgctatccagcttctccacatcaagtccaacttcagaaaccccaagcctgtagagaaaagttgacctgtgctgactctggtgatgagtctccgggaccattatggcagtcaagtggacgggtgggcattcttctcctgtcctctgcctgaatgcaagtaaagaagggctgctggcttctggagcagagggcggagatctcacggcttggggtgaagatggaactccattaggacacacgcggttccaaggggctgatgatgttaccagtgtcttattttctccctcctgtcccaccaagctctatgcctcacatggagaaaccattagtgtactggatgtcaggtccctcaaagattccttggaccattttcatgtgaatgaagaagaaatcaattgtctttcattgaatcaaacggaaaacctgctggcttctgctgacgactctggggcaatcaaaatcctagacttggaaaacaagaaagttatcagatccttgaagagacattccaatatctgctcctcagtggcttttcggcctcagaggcctcagagcctggtgtcatgtggactggatatgcag

SEQ ID NO: 199884 - DNA, 887 bp, Homo sapiens
  Payload ID: 19430
  Gene Name: WD repeat domain 53
  ENST ID: ENST00000433160
  CDS Start-End: 271-870
gcacgaagcaagggcgcacgcccagctcgttcgcggttcctctcggccccggatgtgactgtttggctgcgccgcctcacgcctgacgctcgacgggattgggcgccggcgggtgaggttatcactaggcgccgaggaggggagcgggaagcgcagtgccagcgccacagcccttcaatcattttggttgctatccagcttctccacatcaagtccaacttcagaaaccccaagcctgtagagaaaagttgacctgtgctgactctggtgatggtgatgctgtggagtcttcaaaaagcccgaccactctggattacaaatttacaggaggatgaaacagaagaaatggaaggcccacagtcacctggtcagctcttaaaccctgccctagcccattctatctctgtggcttcgtgtggtaatatttttagttgtggtgcagaagatggtaaggttcgaatctttcgggtgatgggagttaagtgtgaacaggaactgggatttaagggccacacttcaggggtatcccaggtctgctttctcccagaatcctatttgctgcttactggagggaatgatgggaagatcacgttgtgggatgcaaacagtgaagttgagaaaaaacagaagagtcccacaaaacgtacccacaggaagaaacctaaaagaggaacttgcaccaagcagggtggaaatactaacgcttcagtaacagatgaggaagaacatggcaacattttaccaaagctaaatattgaacatggagaaaaagtgaactggctcttgggtacaaaaataaagggacaccaaaatatattagtagctgatcaaactagttgtatatctgtataccccttaaatgaattttaaatccaataaaaacattt

SEQ ID NO: 199885 - DNA, 1147 bp, Homo sapiens
  Payload ID: 19431
  Gene Name: WD repeat domain 54
  Uniprot ID: Q9H977
  ENST ID: ENST00000348227
  CDS Start-End: 89-1093
gtgcgtacgtgcgtcgtctctatggtggcggcggatttggagggaccctacgaaccaggagtcaggcgagccgatctggggctgcaggatgttccgctgggagcgctccattcccctgcgaggctcggccgccgccctgtgcaacaacctcagtgtgctgcagctgccggctcgcaacctcacgtattttggcgtggttcatggaccaagcgcccagcttctcagcgctgctcctgagggtgtgcccttggcccagcgccagctccacgctaaggagggtgctggagtgagtcccccacttatcactcaggtccactggtgtgtcctccccttccgagtgctgctggtactcacctcacatcgaggaatacagatgtacgagtccaatggctacaccatggtctactggcatgcactggactctggagatgcctccccagtacaggctgtgtttgcccggggaattgctgccagtggccacttcatctgtgtgggaacgtggtcaggccgggtgctggtgtttgacatcccagcaaagggtcccaacattgtactgagcgaggagctggctgggcaccagatgccaatcacagacattgccaccgagcctgcccagggacaggattgtgtggctgacatggtgacggcagatgactcaggcttgctgtgtgtctggcggtcagggccagaattcacattattgacccgcattccaggatttggagttccgtgcccctctgtgcagctgtggcaggggatcatagcagcaggctatgggaacggacaagtgcatctatatgaggccactacaggaaatctacatgtccagatcaatgcccatgcccgggccatctgcgccctggacctggcttctgaggtgggcaagctactctctgcaggtgaggacacctttgtgcatatctggaagctgagcagaaacccagagagtggctacattgaggtggaacactgtcatggtgagtgtgtcgccgacacccagctgtgtggtgctcgattttgtgattcctcaggcaactcctttgctgtgactggctatgaccttgcggagatccggagattcagcagtgtgtgagaagagcagccttcctttgtccctgtggtattcataaagtacccgctccaccca

SEQ ID NO: 199886 - DNA, 854 bp, Homo sapiens
  Payload ID: 19431
  Gene Name: WD repeat domain 54
  ENST ID: ENST00000409791
  CDS Start-End: 23-757
cgtgcgtacgtgcgtcgtctctatggtggcggcggatttggagggaccctacgaaccaggagtcaggcgagccgatctggggctgcaggtccactggtgtgtcctccccttccgagtgctgctggtactcacctcacatcgaggaatacagatgtacgagtccaatggctacaccatggtctactggcatgcactggactctggagatgcctccccagtacaggctgtgtttgcccggggaattgctgccagtggccacttcatctgtgtgggaacgtggtcaggccgggtgctggtgtttgacatcccagcaaagggtcccaacattgtactgagcgaggagctggctgggcaccagatgccaatcacagacattgccaccgagcctgcccagggacaggattgtgtggctgacatggtgacggcagatgactcaggcttgctgtgtgtctggcggtcagggccagaattcacattattgacccgcattccaggatttggagttccgtgcccctctgtgcagctgtggcaggggatcatagcagcaggctatgggaacggacaagtgcatctatatgaggccactacaggaaatctacatgtccagatcaatgcccatgcccgggccatctgcgccctggacctggcttctgaggtgggcaagctactctctgcaggtgaggacacctttgtgcatatctggaagctgagcagaaacccagagagtggctacattgaggcaactcctttgctgtgactggctatgaccttgcggagatccggagattcagcagtgtgtgagaagagcagccttcctttgtccctgtggtattcataaagtacccgctccaccc

SEQ ID NO: 199887 - DNA, 576 bp, Homo sapiens
  Payload ID: 19431
  Gene Name: WD repeat domain 54
  ENST ID: ENST00000426787
  CDS Start-End: 89-576
gtgcgtacgtgcgtcgtctctatggtggcggcggatttggagggaccctacgaaccaggagtcaggcgagccgatctggggctgcaggatgttccgctgggagcgctccattcccctgcgaggctcggccgccgccctgtgcaacaacctcagtgtgctgcagctgccggctcgcaacctcacgtattttggcgtggttcatggaccaagcgcccagcttctcagcgctgctcctgagggtgtgcccttggcccagcgccagctccacgctaaggagggtgctggagtgagtcccccacttatcactcaggtccactggtgtgtcctccccttccgagtgctgctggtactcacctcacatcgaggaatacagatgtacgagtccaatggctacaccatggtctactggcatgcactggactctggagatgcctccccaggaacgtggtcaggccgggtgctggtgtttgacatcccagcaaagggtcccaacattgtactgagcgaggagctggctgggcaccagatgccaatcacagacattgccaccgagcctgcccagggacaggtgagtgg

SEQ ID NO: 199888 - DNA, 4080 bp, Homo sapiens
  Payload ID: 19432
  Gene Name: WD repeat domain 55
  Uniprot ID: Q9H6Y2
  ENST ID: ENST00000358337
  CDS Start-End: 238-1389
aaacggggtcacagcaggacaaggaagtagccgatctcccagatgcggtctcttcgctccgctccacccgcaccagcagcggcccacccacctctcctgtaagaggaagaacgtcccggagacacttccggccccgccccccgaggcggaagcggagtgccaggctactcctcccgcagtgtgggtggttccgaggctgactaccctgcggcggcgcggctcgcagtccttctcagcatggaccgcacttgtgaggagaggcccgctgaggatgggagcgacgaggaggacccagactccatggaagccccaacccggatccgggacactccggaagacatcgtgctggaagctccggctagtgggctggcgttccatccggcccgtgacctactggctgcaggggacgtggacggggacgtgttcgtcttttcctactcttgccaagagggagaaaccaaggagctctggtcatcaggtcaccatctcaaggcctgccgagctgtggccttctctgaagatgggcagaagctcattactgtctccaaggacaaagccatccatgttctagatgtggagcagggccaactggaaagacgtgtttccaaggctcatggtgcccccatcaatagtcttctgctggtggatgagaatgttctggccactggggatgacacaggtggtatctgtctctgggaccagcggaaggagggccccttaatggatatgaggcaacatgaagagtacatcgcagacatggctctggatccagccaaaaagctgctgctgacagccagcggggatggctgccttggcatcttcaacattaagaggcgtcggtttgagctgctctcagaacctcagtctggggacctgacctctgtcactctcatgaaatgggggaagaaggtagcctgtggctccagtgaaggtaccatctacctcttcaattggaatggctttggggccacaagtgaccgctttgccctgagagctgaatctatcgactgcatggttccagtcaccgagagtctgctgtgtactggctccactgatggagtcatcagggctgtgaacatcctaccgaaccgagtggtgggcagtgtgggccagcacactggggagcctgtggaggagctggccctctcccactgtggccgcttcctggccagtagtggccatgaccagcgcctcaagttttgggacatggcccagctgcgagctgtggtggtggatgactaccgtcggcgcaaaaaaaagggaggaccactgcgggctctgagcagcaagacttggagcaccgatgacttcttcgcaggactgagggaagagggagaagactccatggctcaggaagaaaaggaggagactggggatgacagtgactgaaggaatgaattgaatcttgagacgggtcctcaccaggcaagagtcttgcttattgggctgcatccccagagaggatatgaattattttttgaaaagacagggttttgccatcgtccaggctggagtgcgctggcttgatcttggctcactgcagcctcaatgtccccaggctcagattgtccttccaccttagcctctggagcagctgggactacaggtgtgcactaccacaccaggccaatttttgttttttttttttggtagaaacgggtctgttttgcccaggctggtcttcaactcctggactcaaatgatccacctgcctctgcttcccaaagtgctgggattacaggcacgagccaccacacctggccaaaaaaatttatattttttgagacaaggtctcactctgtcacccaggctggagtacagtgggttgatcatggctcactgcatccttgacttcctgggctcaagtgatccacctcagcctgcctggtagctgagacttaacaggcatctgccaccatgcttgactaatttttgtgatttttttttggtagagaccaggggtttcactatgttgaccaagctggtcttggaactcctgggctcaagtgatcctcctgccttggcctcccaaaatgctgggattacaggcatgagccactgtgcctggctggatatgaaattttttttttttttttttttgagacagggtttcgctcttgttgccagggctggagtgcaatggcgtgatcttggctcactgcaacctccgcctcccgggttcaagcaattctcctgcctcagcctcccaagtagctgggattacaggtgtctgccaccatgccaggctaatttttgtattttcagtagagacggggtttctccatgctggccaggctggtctcgaactcctgacctcaggtgatccacccgcctcagcctcccaaagtgctgggattacaggcaaaagccaacacacccggcctggatatgaatttataataccctacagtgcaacacaagaagatgcactcaaagcactgatgtgaggaagtacttgccccgtagcagctattcactctaccagtgtaaacaaactctaagctagggcaagacagcacagacacaagtatatactaaccaggggtttaatataaatacaaccagcatagaaagacccaaaactatacagaaaccaaaaccagaatgccatgtggtggaggcaaagggcagaatttctgacccctttggctcagctgcccttccccacaaataaaaaccaacaaagaggacaaatcaggacaataaagaagattcatgctaagctgtggcagaggggggaaggtatgatcgggtgggggtgggacaaggaacggccatggaagatcactgggtcaggttggaccctgggctgggagcgggagggcaaggcccctcaccacaacttaacccaaacctaagctgcccccaggtgccataggtccctgtcccagcagggaggctgatgggcctgggcccatgcccctccccacctttgggggtcagaaagtggccacccaggcctgctgggatggggcctgacacaggctctgcatgcccattcagggtgcctgtggagaaagaatggagtcactgtttaaccatggtacctgcctcagccccagcagaccacaggaggttggccccagactcactgagtgcctgcagcagccgtacagacacagcatccttggccacctcatgcccatcccggccatctagggtcagcacaacccagatgaggccgctgaagggcaccggatgcccaggaatcaccacctggtaccagaagcggtgccagccagcaggtcctatgcccaaacacttggtgaggaacacagggctgcccagcttcattcgttggcacagcaactgcagggtagcccgagccccttggaaccctaacttgtcccttgccaaagccaactggctgccctctggctgtggggaccgcaagaagggacccacaagctgctggcgaagtcgctgcttcaggtctggcttgagccactccacagccacctgctctccacagaggtgtgactgccctgtaggaaaaatgcaaagacaagggcaggtctaaaccctgggcccaagcctccaggtggtgagccctttggagctacacagtcctgttatttgtagccttcccatttcctggtagtgtgaccatgggtaagaaaagacaatgaagccttcagcctccattatttgcaaagggagtataacacactgctaccttacaagtttccttggagaagtactggttaattgcaggctttgtctgcctcataaccatcataatggctaatctttactgggaaaacttgctgtaagtcagtcagtgtgctaagtaccgtacacccattatgttacttaattctcataacagtctgaggaaacagattctatagtagtaaaaagctcagttggattcccttgagcaaatcaatttctctaacagtttcctcatagcttgagggtcctgtgcctattttgcggtgtgggggtgggggaaggttgagaattaagtcaggaggtaatgctcgggaagtgtcacaaatttaggtaagcggtggtggtagcaccattggaagttttaaaaatctgagatcaaatagtaaaaggttgcaaattctggca

SEQ ID NO: 199889 - DNA, 2477 bp, Homo sapiens
  Payload ID: 19432
  Gene Name: WD repeat domain 55
  ENST ID: ENST00000506393
  CDS Start-End: 46-459
gaggctgactaccctgcggcggcgcggctcgcagtccttctcagcatggaccgcacttgtgaggagaggcccgctgaggatgggagcgacgaggaggacccagactccatggaagccccaacccggatccgggacactccggaagacatcgtgctggaagctccggctagtgggctggcgttccatccggcccgtgacctactggctgcaggggacgtggacggggacgtgttcgtcttttcctactcttgccaagagggagaaaccaaggagctctggtcatcaggtcaccatctcaaggcctgccgagctgtggccttctctgaagatgggcagagtgagtactggggaagacaaccagcaatgtggtggaagggagcagtgagcagcaccatgacctgggcaccttttccccagagctcattactgtctccaaggacaaagccatccatgttctagatgtggagcagggccaactggaaagacgtgtttccaaggctcatggtgcccccatcaatagtcttctgctggtggatgagaatgttctggccactggggatgacacaggtggtatctgtctctgggaccagcggaaggagggccccttaatggatatgaggcaacatgaagagtacatcgcagacatggctctggatccagccaaaaagctgctgctgacagccagcggggatggctgccttggcatcttcaacattaagaggcgtcggtttgagctgctctcagaacctcagtctggggacctgacctctgtcactctcatgaaagtacagctggttatggtgggatggaggggtgtgtgctgggggcttagtctgaggcagcttccacattgttttctctatttccctgcagtgggggaagaaggtagcctgtggctccagtgaaggtaccatctacctcttcaattggaatggctttggggccacaagtgaccgctttgccctgagagctgaatctatcgactgcatggttccagtcaccgagagtctgctgtgtactggctccactgatggagtcatcagggctgtgaacatcctaccgaaccgagtggtgggcagtgtgggccagcacactggggagcctgtggaggagctggccctctcccactgtggccgcttcctggccagtagtggccatgaccagcgcctcaagttttgggacatggcccagctgcgagctgtggtggtggatgactaccgtcggcgcaaaaaaaagggaggaccactgcgggctctgagcagcaagacttggagcaccgatgacttcttcgcaggactgagggaagagggagaagactccatggctcaggaagaaaaggaggagactggggatgacagtgactgaaggaatgaattgaatcttgagacgggtcctcaccagggtgcctgtggagaaagaatggagtcactgtttaaccatggtacctgcctcagccccagcagaccacaggaggttggccccagactcactgagtgcctgcagcagccgtacagacacagcatccttggccacctcatgcccatcccggccatctagggtcagcacaacccagatgaggccgctgaagggcaccggatgcccaggaatcaccacctggtaccagaagcggtgccagccagcaggtcctatgcccaaacacttggtgaggaacacagggctgcccagcttcattcgttggcacagcaactgcagggtagcccgagccccttggaaccctaacttgtcccttgccaaagccaactggctgccctctggctgtggggaccgcaagaagggacccacaagctgctggcgaagtcgctgcttcaggtctggcttgagccactccacagccacctgctctccacagaggtgtgactgccctgtaggaaaaatgcaaagacaagggcaggtctaaaccctgggcccaagcctccaggtggtgagccctttggagctacacagtcctgttatttgtagccttcccatttcctggtagtgtgaccatgggtaagaaaagacaatgaagccttcagcctccattatttgcaaagggagtataacacactgctaccttacaagtttccttggagaagtactggttaattgcaggctttgtctgcctcataaccatcataatggctaatctttactgggaaaacttgctgtaagtcagtcagtgtgctaagtaccgtacacccattatgttacttaattctcataacagtctgaggaaacagattctatagtagtaaaaagctcagttggattcccttgagcaaatcaatttctctaacagtttcctcatagcttgagggtcctgtgcctattttgcggtgtgggggtgggggaaggttgagaattaagtcaggaggtaatgctcgggaagtgtcacaaatttaggtaagcggtggtggtagcaccattggaagttttaaaaatctgagatcaaatagtaaaaggttgcaaattctggc

SEQ ID NO: 199890 - DNA, 2953 bp, Homo sapiens
  Payload ID: 19432
  Gene Name: WD repeat domain 55
  ENST ID: ENST00000504897
  CDS Start-End: 293-961
cttttcctactcttgccaagagggagaaaccaaggagctctggtcatcaggtcaccatctcaaggcctgccgagctgtggccttctctgaagatgggcagaagctcattactgtctccaaggacaaagccatccatgttctagatgtggagcagggccaactggaaagacgtgtttccaaggctcatggtgcccccatcaatagtcttctgctggtggatgagaatgttctggccactggggatgacacaggtggtatctgtctctgggaccagcggaaggagggccccttaatggatatgaggcaacatgaagagtacatcgcagacatggctctggatccagccaaaaagctgctgctgacagccagcggggatggctgccttggcatcttcaacattaagaggcgtcggtttgagctgctctcagaacctcagtctggggacctgacctctgtcactctcatgaaatgggggaagaaggtagcctgtggctccagtgaaggtaccatctacctcttcaattggaatggctttggggccacaagtgaccgctttgccctgagagctgaatctatcgactgcatggttccagtcaccgagagtctgctgtgtactggctccactgatggagtcatcagggctgtgaacatcctaccgaaccgagtggtgggcagtgtgggccagcacactggggagcctgtggaggagctggccctctcccactgtggccgcttcctggccagtagtggccatgaccagcgcctcaagttttgggacatggcccagctgcgagctgtggtggtggatgactaccgtcggcgcaaaaaaaagggaggaccactgcgggctctgagcagcaagacttggagcaccgatgacttcttcgcaggactgagggaagagggagaagactccatggctcaggaagaaaaggaggagactggggatgacagtgactgaaggaatgaattgaatcttgagacgggtcctcaccagccccagcagaccacaggaggttggccccagactcactgagtgcctgcagcagccgtacagacacagcatccttggccacctcatgcccatcccggccatctagggtcagcacaacccagatgaggccgctgaagggcaccggatgcccaggaatcaccacctggtaccagaagcggtgccagccagcaggtcctatgcccaaacacttgctatgctcagtataaagtgccgggcagaacgcgtttggccccaaccagcacccccgccccagcctaccttccaccagggcctttttggccatggcagcggcccggtgcgagctgaatttgagcagagcgatctgcccgggcgccggtccggggctgggcagcagccgcgcctcctgcaagccgggacccagcggctgcagcgcgagcagcagcgcgctgcgggtcagattcggcggcaggccgtcaacgctcagctcacacttctcggtgctgcggcacacgagcagcgggcaggacggccgcagcggatggttgtgcagcgtggcgatggcggcctgcgcgccgcgcctcgagctgtagcgggcataggcgaagccgcggttcaggccgctgaaggtcatcatcaggcggaactcgtagaggcggcccacgcgctggaacagcgggataagctggtgctcgtacacgtcctgaggcagccgcccgatgaacacctctgacccagctggcggcgggctgcccacccagcctgtgggaagagggtatgcaaggccaccgtcaggcgacgctttcgaattctgagcccacggacccagcgcgcgggggtgggaggcgatgtgaacaaaggtctgtgaaatgggtttacacccgtaccctgggtggttggcataattaggtgactgcgctaacaagggggctggcacagagtaggtacaccttgagattggccccctccctcgacggggcgggtggacgtggagccacagttcctcctttgctggggggtataaatccgggtagttcgcagtttctgacagtgaaggctcggagcagcccctcccccaaagggggctggtgtagccggacaggcggaggggctgggactaccgtacctgggggtggcccgccatacttcctctgcccgttcacctgcaccaggcggatgcctgtctccctgacccacgcctccagcgccgccttgttctctggattcaccctctcacaccacagctgagagggaaaggaaggttggaatggcggatcgccaagcgcgcccccacctctcctgtggtactggggtccctaaagccgacccccgctccggcggggctcgccggcccccaagtcgccagccgcttacctcacaatcccgcttggactgcatggctctccagctggccccctcgtaccctctttataacttcctccccaccggcctctggaagcttccctacccctccaccccgcaagctctcattggctctgagcgcgaccccgcctcccaggggggtggaggtatccactgcacgtgcgccgcccgggcttcgctcagaccttcaggtgaaagctgcaaagtcgcgggtgcgtatgtacgggggctgcctcccgaggaggagctcccaagccgcagggtggacgctggagacaagaacctcagggtcacaagtttactgtttttctcccttttccatccctacattggtctgctggggaaggcggggctaggcatcactgacacacgcagactccgtggttgaggcattttattggacctttggcaattggtggtggggaggcatctgctccaactggtgcggggccctgcagatgggaccatctcaggctgggtccttgtagcccaggagcacagactggactaagcctcctgggccttgtatgaaaaaggtgttgtacctggccgtttttgccagtaataatcaataaaataaccataataaaaatcaaa

SEQ ID NO: 199891 - DNA, 5898 bp, Homo sapiens
  Payload ID: 19433
  Gene Name: WD repeat domain 59
  Uniprot ID: Q6PJI9
  ENST ID: ENST00000262144
  CDS Start-End: 132-3056
ctcaggagcaaccagggcacggggcgtgtcggggctgattctctggctgtgtggggcgcacggtcccgggatactggggacggcggggtgggagggcgccgtcctggggccgcggcggccgggcgggggagatggcggcgcgatggagcagcgaaaacgtggttgtagagttccgtgactcccaggcaactgcgatgtctgtggactgtcttgggcagcatgcagtgctttctggccgcagattcttatacatcgtcaatctagatgcccctttcgaaggtcaccgaaagatctctcgccagagcaaatgggacattggagctgtgcagtggaatcctcatgacagctttgcacactattttgcggcttcgagtaaccaacgagtagacctttacaagtggaaagacggcagtggggaagttggcacaaccttacaaggccacactcgtgtcatcagcgacttggactgggcggtgtttgagcctgacctcctggttaccagctctgtggacacctacatctacatttgggatatcaaagacacaaggaaacctactgttgcactgtctgctgttgcgggtgcctcccaggtcaaatggaataaaaaaaatgctaactgccttgccaccagccatgacggcgatgtgcggatatgggataagaggaaacccagtacagcagtggaatatctagccgcccacctctccaaaatccatggcctggactggcacccagacagcgagcacattcttgctacctccagtcaagacaattctgtgaagttctgggattaccgccagcctcggaaatacctcaatattcttccttgccaggtgcctgtctggaaggccagatacacacctttcagcaatggattggtgactgtgatggttccccagctgcggagggaaaacagccttctcctgtggaatgtctttgacttgaacaccccagtccacaccttcgtggggcatgatgatgtggtcctggagttccagtggaggaagcagaaggaagggtccaaggactatcaactggtgacgtggtcccgggatcagaccttgagaatgtggcgggtggattcccagatgcagaggctttgtgcaaatgacatattagatggtgttgatgagttcattgagagtatttcccttctgccggaacctgagaagaccctgcacactgaagatacagatcaccagcacactgcaagccatggggaggaagaagccctaaaagaagatccccctagaaatctcctggaagagaggaaatcagatcaactggggctgcctcagaccttgcagcaggaattctccctgatcaatgtgcaaatccggaatgtcaatgtggagatggatgcggcagacaggagctgcacagtgtctgtgcactgcagcaaccatcgtgtcaagatgctggtgaagttccctgcacagtacccaaacaacgccgccccttccttccagtttattaaccccacaaccatcacatccaccatgaaagctaagctgctgaagatcctgaaggacacagccctgcagaaagtgaagcgtggccagagctgcctggagccctgcctgcgccagctcgtctcctgccttgagtcctttgtgaaccaggaagacagcgcttccagcaacccgtttgcactccccaactctgtcactccccccttaccgacgtttgcgcgggtgaccacggcttacgggtcgtaccaggacgccaacattccctttcctaggacttctggggccaggttctgcggagcaggttacctggtatatttcacaaggcccatgacaatgcatcgggcggtgtctcccacagagcctactccgagatctctctcagccttgtctgcttatcacactggcttgatcgcgcccatgaagatccgcacagaggcccctgggaaccttcgtttatacagtgggagccccactcgcagcgagaaagagcaggtctccatcagctccttctactacaaggagcggaaatcaagacgatggaaaagtaagcgtgagggatcagactctggcaatcgacagatcaaggctgctgggaaagtcatcatccaggatattgcttgcctcctgcctgttcacaaatcgctgggagagctgtacatattgaatgtgaatgatattcaggaaacatgtcagaagaatgccgcctctgccttgctcgttggaagaaaggatcttgtccaggtttggtcgctggctacggtagctacagatctttgccttggtccgaaatctgacccagatttggaaacaccctgggctcgacatccatttgggcggcagctgctggagtccctgttggctcactattgccggctccgggatgttcagacactggcgatgctctgtagcgtgtttgaagcccagtctcggcctcaggggctaccaaacccctttgggccttttcctaaccgttcttctaatcttgtggtgtcccatagtcgatatcctagctttacctcttctggttcctgctccagtatgtcagacccagggctcaacactggcggctggaacatagcgggaagagaggcagagcacttgtcctccccttggggagaatcctcaccagaagagctccgctttgggagtctgacctacagtgatccccgtgagcgagaacgcgaccagcatgataaaaataaaaggctcctggaccccgccaatacccagcaatttgatgactttaagaaatgctatggggaaatcctctaccgttggggtctgagagagaagcgagctgaagtgttgaagtttgtctcctgtcctcctgaccctcacaaagggatcgagttcggcgtgtactgcagccactgccggagtgaggtccgtggcacgcagtgtgccatctgcaaaggcttcacgttccagtgtgccatctgtcacgtggctgtgcggggatcgtccaatttctgcctgacctgtgggcacggtggccacaccagccacatgatggagtggtttcggacccaggaggtgtgtcccaccgggtgtgggtgccactgcctgcttgaaagcactttctgaacctacagaagttgggtattgtctgaaatcccagaggacccataagtgccggtgacaagctgtctgtcaggggagaggctccagaacctgggttcgtccccagtgagaccggaggatgatcccccaaggactgcgcagcatcagctcttggtgggcctctgccttctcttctgtttggccacctggtgtggatgtcactgtgtgaagataaggacagaagtgcagagctgcgctttgtgtgttgtctatgtcggctgagctaccaaggtggaagttttcatggagaaaagcacctggctccagggccagtgttacagtgttaccctgtaaggtgttagccttaaaccaccgagcagcgttctcttgatgccagtgcagagaccagagtcagatgcccgaggacagtgggtaggaatttcatcaacaaatggacctatggcatcatggctttagaagctggtacatttactgagctgatggacagtggccttctaaaatatgacacttaaattgtaaatatgcactgtacttaaggattcttaagatgtatttttttgttatttctcctccagctgctatcccttggctaataaaattctagtaatttgaaaaaaaaaaaaaagagagaaagttaaacaacattatggtgaatcattttttaccctaattctaattgaaggtagctattttgaataggaccaaagtcagtgctccgatttttaaaggaaatgctgatttacttttgtcatctgacaagagaaaatggaatttgacatttaaggttcttcctagccccaagagtcttatttcttctagcaaaaggaggacaagattgccgtgcagcatggatagaaaagtctccctggccaggccccatggctcatgcctgtaatcccacactttagaaggcaaaagtgaggggatcacctgagctcaggagttcgagaccagcctgggcaacataaggagatcccatctctgcaaaaaatttaaaaaataggccgggcacggtggctcatgcctgtaatcccagcactttgggaggctgaggtgggaggattacctgaggtcaggagttcgagactagcctggccaacatggtgaaaccccatctctactaaaaatagaaaaattagccgggcatggtggcgggcgcctgtaatcccaggtactggggaggctgagacaggagaatcgcttgaacttgggaagcagaggttgcagcgagctgagattatgccattgcactccagcctgggtgacaagagtgagactctgtctcaaaaaaagaaaaaaaaaattaaaaaaatagccgggtgtggtggcacatgcctgtggtcccagctacttgaggggccgaggtgggaggatcacttgagtccaggaggttgaggctgcagtgagccttgattgcaccgctgcactccagcctgggcaacagagtgagaccctgtcaataaaccaaagtcttccttgcctctgttcagatgggctgggttccagtgagtgccctcactcttcctttaggctccctcgcaaactgcctgtgtttgcctgtgttctgagtagttataacatctgtgtccaccaattcttcagaatgattttcttttttaaagttaaattttttttttttttttttagagagagagacagggtctcactctgtcacccagactggagagtggtgatgcaatcatagctcactgtagcctctatcacctgagctcaagtgatcctcccacctcagcctcccgagtagctgggactacaggtgtgcaccaccatgcctggctaatttcagaatgattttcaacttcacattttgtatgtgccagtgaaaagaaatcttttttattatttctactgaaatatctatttctgtttcttagaattttacagttccaagtagattagcttagggactaggacatgtctcataatgggagagcattgcatattcatgtgtttcaaactccaggtcaggacccattagtggattgtgacattgatctagtgcggaaaaccagcatttaaaaaaatgaaatggtgtaagagaaaaatgatcacaatgtaccatacatagctaaggaaaatgttttgtgtaacttgtttacgtgtgtgcagcacatgtgtgcacaggtgtataccggatcatagcgtaaattcatttcttactgaaagttgtagtcaaaacattttcacaacactgttttggatgaagcttatacctcgtcccctgtgttactgggcacaaaacttcaggatgtaagaaagaactgagatcctgtgcagtggaaccagaggtttagtgctgggctctggtctgaggtaaggtgccagtgtctcagtagcgtgagcagggcgggggagccgctgggaggatgacaggagaaggcccagccgggaatttgcatacacaaattctgttgtaatggtgatcacagaataggttggctgatttacacagagagaaaggatctgttgtgttcctcagtgaaatcacaccatttgcagagagcaatcttttcctgttccccactgctcaagttagtgtaaaaacctgtccctatctgtccccatcaagaatgagatgtttttcttgttttattgttggaggaacattgactttcaaaattgaaaaaccttaatggtgtgaagaaatttcgagtttaaaatattacataatgtcatccttcaatacggaaattccttttgaatttccaagttaccagaacaaaagtctaatattttaaaatattcatgtttggaaacaggttggttgtctggttgcgggccatggccgatattctctcagccgcagaatagatgattacaagca

SEQ ID NO: 199892 - DNA, 901 bp, Homo sapiens
  Payload ID: 19433
  Gene Name: WD repeat domain 59
  ENST ID: ENST00000569229
  CDS Start-End: 1-901
caaccatcacatccaccatgaaagctaagctgctgaagatcctgaaggacacagccctgcagaaagtgaagcgtggccagagctgcctggagccctgcctgcgccagctcgtctcctgccttgagtcctttgtgaaccaggaagacagcgcttccagcaacccgtttgcactccccaactctgtcactccccccttaccgacgtttgcgcgggtgaccacggcttacgggtcgtaccaggacgccaacattccctttcctaggacttctggggccaggttctgcggagcaggttacctggtatatttcacaaggcccatgacaatgcatcgggcggtgtctcccacagagcctactccgagatctctctcagccttgtctgcttatcacactggcttgatcgcgcccatgaagatccgcacagaggcccctgggaaccttcgtttatacagtgggagccccactcgcagcgagaaagagcaggtctccatcagctccttctactacaaggagcggatgtctcctcgctctgcccggcggcgttggtccatacaagcaattaacgacttcccgaaatcaagacgatggaaaagtaagcgtgagggatcagactctggcaatcgacagatcaaggctgctgggaaagtcatcatccaggatattgcttgcctcctgcctgttcacaaatcgctgggagagctgtacatattgaatgtgaatgatattcaggaaacatgtcagaagaatgccgcctctgccttgctcgttggaagaaaggatcttgtccaggtttggtcgctggctacggtagctacagatctttgccttggtccgaaatctgacccagatttggaaacaccctgggctcgacatccatttgggcggcagctgctggagtccct

SEQ ID NO: 199893 - DNA, 652 bp, Homo sapiens
  Payload ID: 19433
  Gene Name: WD repeat domain 59
  ENST ID: ENST00000563797
  CDS Start-End: 1-652
gtttatacagtgggagccccactcgcagcgagaaagagcaggtctccatcagctccttctactacaaggagcggaaatcaagacgatggaaaagtaagcgtgagggatcagactctggcaatcgacagatcaaggctgctgggaaagtcatcatccaggatattgcttgcctcctgcctgttcacaaatcgctgggagagctgtacatattgaatgtgaatgatattcaggaaacatgtcagaagaatgccgcctctgccttgctcgttggaagaaaggatcttgtccagcctagctttacctcttctggttcctgctccagtatgtcagacccagggctcaacactggcggctggaacatagcgggaagagaggcagagcacttgtcctccccttggggagaatcctcaccagaagagctccgctttgggagtctgacctacagtgatccccgtgagcgagaacgcgaccagcatgataaaaataaaaggctcctggaccccgccaatacccagcaatttgatgactttaagaaatgctatggggaaatcctctaccgttggggtctgagagagaagcgagctgaagtgttgaagtttgtctcctgtcctcctgaccctcacaaagggatcgagttcggcgtgtactgcag

SEQ ID NO: 199894 - DNA, 583 bp, Homo sapiens
  Payload ID: 19433
  Gene Name: WD repeat domain 59
  ENST ID: ENST00000563111
  CDS Start-End: 115-583
tttaattgccatttaaatagccactgtggctaatggctatgatattggaaagtacagttcagagtactgagaagtgtggagattagttttcactctcaaggaaaggcaactgcgatgtctgtggactgtcttgggcagcatgcagtgctttctggccgcagattcttatacatcgtcaatctagatgcccctttcgaaggtcaccgaaagatctctcgccagagcaaatgggacattggagctgtgcagtggaatcctcatgacagctttgcacactattttgcggcttcgagtaaccaacgagtagacctttacaagtggaaagacggcagtggggaagttggcacaaccttacaaggccacactcgtgtcatcagcgacttggactgggcggtgtttgagcctgacctcctggttaccagctctgtggacacctacatctacatttgggatatcaaagacacaaggaaacctactgttgcactgtctgctgttgcgggtgcctcccaggtcaaatggaataaaaaaaatgctaactgccttgccaccagccatgacggcgatgtgcggatatgggataaga

SEQ ID NO: 199895 - DNA, 488 bp, Homo sapiens
  Payload ID: 19433
  Gene Name: WD repeat domain 59
  ENST ID: ENST00000564859
  CDS Start-End: 15-122
gccgggcgggggagatggcggcgcgatggagcagcgaaaacgtggttgtagagttccgtgactcccaggcaactgcgatgtctgtggactgtcttgggcagcatgcagtgctttctggataaggtcttgccaggttgcccaggctggtcttaactccgggcctcaagcgatgcttctgcctcggcctgcagcactaagagttccagtgtgagctgctgcttccaaccatgaaggcttttttcctttctgttgcattagtccctatccttcaggtttcctccggtgactgagatcgttggctgctaatgctaaagagcgactggcatctctctttaagtgggtagacggtggaggagatcagccgcagattcttatacatcgtcaatctagatgcccctttcgaaggtcaccgaaagatctctcgccagagcaaatgggacattggagctgtgcagtggaatcctcatgacagctttgcacactatttt

SEQ ID NO: 199896 - DNA, 569 bp, Homo sapiens
  Payload ID: 19433
  Gene Name: WD repeat domain 59
  ENST ID: ENST00000566924
  CDS Start-End: 1-144
actccccccttaccgacgtttgcgcgggtgaccacggcttacgggtcgtaccaggacgccaacattccctttcctaggacttctggggccaggttctgcggagcagatctctctcagccttgtctgcttatcacactggcttgatcgcgcccatgaagatccgcacagaggcccctgggaaccttcgtttatacagtgggagccccactcgcagcgagaaagagcaggtctccatcagctccttctactacaaggagcggaaatcaagacgatggaaaagtaagcgtgagggatcagactctggcaatcgacagatcaaggctgctgggaaagtcatcatccaggatattgcttgcctcctgcctgttcacaaatcgctgggagagctgtacatattgaatgtgaatgatattcaggaaacatgtcagaagaatgccgcctctgccttgctcgttggaagaaaggatcttgtccaggtttggtcgctggctacggtagctacagatctttgccttggtccgaaatctgacccagatttggaaacaccctgggctcgacatccatttggg

SEQ ID NO: 199897 - DNA, 1752 bp, Homo sapiens
  Payload ID: 19433
  Gene Name: WD repeat domain 59
  ENST ID: ENST00000536050
  CDS Start-End: 234-1610
ctcttaggccccgtcgggggagggaagacgaccatcgggggcaatcggggcgagcatggacggagtttcggggctccctacgcgggtaggggagtggggtccgccttgtgacactgaggcagagactgcgcatcgtgagtgctgaggggaggcttcccacaatcagggtacggagcgagggcgtgacggcttcccgaggccctagccgcgtgtggcgacttaaggcaactgcgatgtctgtggactgtcttgggcagcatgcagtgctttctggccgcagattcttatacatcgtcaatctagatgcccctttcgaaggtcaccgaaagatctctcgccagagcaaatgggacattggagctgtgcagtggaatcctcatgacagctttgcacactattttgcggcttcgagtaaccaacgagtagacctttacaagtggaaagacggcagtggggaagttggcacaaccttacaaggccacactcgtgtcatcagcgacttggactgggcggtgtttgagcctgacctcctggttaccagctctgtggacacctacatctacatttgggatatcaaagacacaaggaaacctactgttgcactgtctgctgttgcgggtgcctcccaggtcaaatggaataaaaaaaatgctaactgccttgccaccagccatgacggcgatgtgcggatatgggataagaggaaacccagtacagcagtggaatatctagccgcccacctctccaaaatccatggcctggactggcacccagacagcgagcacattcttgctacctccagtcaagacaattctgtgaagttctgggattaccgccagcctcggaaatacctcaatattcttccttgccaggtgcctgtctggaaggccagatacacacctttcagcaatggattggtgactgtgatggttccccagctgcggagggaaaacagccttctcctgtggaatgtctttgacttgaacaccccagtccacaccttcgtggggcatgatgatgtggtcctggagttccagtggaggaagcagaaggaagggtccaaggactatcaactggtgacgtggtcccgggatcagaccttgagaatgtggcgggtggattcccagatgcagaggctttgtgcaaatgacatattagatggtgttgatgagttcattgagagtatttcccttctgccggaacctgagaagaccctgcacactgaagatacagatcaccagcacactgcaagccatggggaggaagaagccctaaaagaagatccccctagaaatctcctggaagagaggaaatcagatcaactggggctgcctcagaccttgcagcaggaattctccctgatcaatgtgcaaatccggaatgtcaatgtggagatggatgcggcagacaggagctgcacagtgtctgtgcactgcagcaaccatcgtgtcaagatgctggtgaagttccctgcacagtacccaaacaacgccgccccttccttccagtttattaaccccacaaccatcacatccaccatgaaagctaagctgctgaaggtgggggtctgggttcccaaattctccttgctgttctgcatcattgtctagatggattagtaaagaagaatgaaaactccagtagatgagattcggaagtcatctgtttcgtacacacactagtattagcaacgtaacctctgaacttgccatttactttgtgcagaaaacatcagagcagtggttcttaacc

SEQ ID NO: 199898 - DNA, 1953 bp, Homo sapiens
  Payload ID: 19433
  Gene Name: WD repeat domain 59
  Uniprot ID: Q6PJI9
  ENST ID: ENST00000616369
  CDS Start-End: 67-1782
ccgggatactggggacggcggggtgggagggcgccgtcctggggccgcggcggccgggcgggggagatggcggcgcgatggagcagcgaaaacgtggttgtagagttccgtgactcccaggcaactgcgatgtctgtggactgtcttgggcagcatgcagtgctttctggccgcagattcttatacatcgtcaatctagatgcccctttcgaaggtcaccgaaagatctctcgccagagcaaatgggacattggagctgtgcagtggaatcctcatgacagctttgcacactattttgcggcttcgagtaaccaacgagtagacctttacaagtggaaagacggcagtggggaagttggcacaaccttacaaggccacactcgtgtcatcagcgacttggactgggcggtgtttgagcctgacctcctggttaccagctctgtggacacctacatctacatttgggatatcaaagacacaaggaaacctactgttgcactgtctgctgttgcgggtgcctcccaggtcaaatggaataaaaaaaatgctaactgccttgccaccagccatgacggcgatgtgcggatatgggataagaggaaacccagtacagcagtggaatatctagccgcccacctctccaaaatccatggcctggactggcacccagacagcgagcacattcttgctacctccagtcaagacaattctgtgaagttctgggattaccgccagcctcggaaatacctcaatattcttccttgccaggtgcctgtctggaaggccagatacacacctttcagcaatggattggtgactgtgatggttccccagctgcggagggaaaacagccttctcctgtggaatgtctttgacttgaacaccccagtccacaccttcgtggggcatgatgatgtggtcctggagttccagtggaggaagcagaaggaagggtccaaggactatcaactggtgacgtggtcccgggatcagaccttgagaatgtggcgggtggattcccagatgcagaggctttgtgcaaatgacatattagatggtgttgatgagttcattgagagtatttcccttctgccggaacctgagaagaccctgcacactgaagatacagatcaccagcacactgcaagccatggggaggaagaagccctaaaagaagatccccctagaaatctcctggaagagaggaaatcagatcaactggggctgcctcagaccttgcagcaggaattctccctgatcaatgtgcaaatccggaatgtcaatgtggagatggatgcggcagacaggagctgcacagtgtctgtgcactgcagcaaccatcgtgtcaagatgctggtgaagttccctgcacagtacccaaacaacgccgccccttccttccagtttattaaccccacaaccatcacatccaccatgaaagctaagctgctgaagatcctgaaggacacagccctgcagaaagtgaagcgtggccagagctgcctggagccctgcctgcgccagctcgtctcctgccttgagtcctttgtgaaccaggaagacagcgcttccagcaacccgtttgcactccccaactctgtcactccccccttaccgacgtttgcgcgggtgaccacggcttacgggtcgtaccaggacgccaacattccctttcctaggacttctggggccaggttctgcggagcaggttacctggtatatttcacaaggcccatgacaatgcatcgggcggtgtctcccacagagcctactccgaggtgagtcagggagatgcagaagccgctctacgttcccggggccagaagtggccagagacctgggaaggaccactgagtttgcttttggacagtgcatttcagttcttcagtaaactcccattataagatttatttgagaaagattgaagtcaattaaattgcaaaaaagctgtga

SEQ ID NO: 199899 - DNA, 3720 bp, Homo sapiens
  Payload ID: 19434
  Gene Name: WD repeat domain 5B
  Uniprot ID: Q86VZ2
  ENST ID: ENST00000330689
  CDS Start-End: 524-1516
gctggtacgagcaaaagtagccgacaggccagagtttccagtttcggtggcttcgtaggcttttagcttctgaaatccgctaaaagcggcggttcattcatcttcaagtacctagcctgactggtagggctgctcagcattccgaaacatttcgacctggggaggggggcggcggtgaaagaatactttctgtagagagtgcccctcgcgtcgcccctgctttgaaggctttatgtattaacggaatgccgaacatttgtgtcctacttgctgacagcgcacaggatccttctaacagtatttctcaagtacttaacaaaaagatgaaaacttgaagtccaagccgtgctgctgattccgtctcacagtttaaagactgtccagaaactttaagctttcaaaactgtacattttaaaatcctgtgcgtttatcttcattttgctgggcagaaagccaaagtactggactgcctggttcagggctgaacgcctagtacacctgctaacttggagcttcagagccatggcaaccaaggagtcaagagacgccaaagcacagttggccctctcctcatcggccaatcagagcaaggaagtgcctgaaaacccaaactatgctctcaaatgtactcttgtgggacacacggaagcagtgtcatcagttaagtttagtcctaatggagaatggctagcaagttcttctgctgataggctaatcataatttggggagcatatgatggaaaatatgagaaaacactctatggtcataatttggaaatatcggatgttgcctggtcatcagattccagtcgtcttgtttctgcctcagatgataaaactctaaaattatgggatgtgagatctggaaaatgtttgaaaacactgaaggggcacagtaattatgtcttttgttgtaacttcaatccgccatccaaccttataatctcgggatcttttgatgagactgtaaaaatatgggaggtgaaaacaggaaagtgtctcaagactttgtctgctcattctgacccagtttctgctgttcattttaattgtagtgggtccttgatagtgtcaggtagctatgatggcctctgtagaatctgggatgctgcatcaggtcagtgtttaaaaacgctcgttgatgacgataaccctcctgtctcttttgtaaaattttctccaaatggtaaatacattctcactgcaactttggacaacactcttaaactatgggattatagcagaggcaggtgcctgaaaacatacactggtcataagaatgagaaatattgcatatttgccaatttttcagttactggtggaaagtggattgtgtctggttccgaggataacctggtttacatttggaaccttcagactaaagagattgtgcagaaattacaaggccatacagatgttgtgatctcagcagcttgtcatcctacagaaaacctcatcgcatcagcagcattagaaaatgacaaaacaattaaactgtggatgagtaaccactaatccctttgaaaatcaagtagtagagccaagttggccaaaaaacttggatatttaaaaagacggtttcttttaattttggcagtttggtattttaaaaattgtctattgttaaattttgagattcatacactacatttacaaaatgagatagttgaaaaagcacatctagaattcagcttctgactaccaatcttttttgagcaactttttgtaatttttatggatttatgtcacttttattacagggatatattgcatagtggtgaaatctgggcttagtataccctcacccaaatagtatacattgtacctagtaaatactttcccatctctcaccccactcccacctttgaaggctctagtgtctatgattctgctctccacgtccaggtgtacacattgtttatctcccacttacgagaacatgtggtttttgactttctgtatcattacttcacttaatggcctccaggtccatccatgttgttgcaaaagataagatttcattatttttttttggctgagtagtattctgtggtgtgtatgtgtgtgtgtgtatgcatatatgtgtatgtgtatgtatataagtatatacaccacattatccagtcatctggatatgtatataagtatatacaccacattttctttatccagtcatctcttgatggacccttaggttggttccataactttgctattacgaatagtgctgcgataaacagcactattatgaatagtgctgcgataaacagtgcaggtgattttaaaatataatttcctttgggtagatacctactagtgggattgctggatcgaatggtagtttttagttggaaaatctccatactgttttccagaggttgtaaaatgtacattcctccccacagtgtataagctgtgcctttactctgcatctttgccatgattctttttgagacagagtctctggtgcccaggctggagtgcagtggcacaatcttggctcactgcaacctctgcctcccgggttcaagcagttctcatgtctcaacatcccaggtagctaggattacaggcgtgccaccatgcctggctaatgtttctatttttagtagagacagggtttcaccatgttcgaggctggtcttgaactcctggcctcaagtgatccacctgcctcggcctcccaaagtgctgggattacaggcatgagccactgtacccagccattttttgactttttaataatagccattctaactggtttaagagagtatctcattgtggttatattttgtattcctctgatgattagtgatgttgagcatttttttgtgtgtgtttgttggccacttgtatgtcttctttgaaaactgacttctaatcttgaggcctattaataatttcatttgtctgtcactggacaatttctcattcctctcagtgactatcctagaggatcagtgtatttgagaaatatttagaagtaaagttgacaggacaggatgattgattaaaagaggggagcaagggaatttgaaataattccagggtttctggtttgggagatcagatgaacaagtgcataagcctgggatgctggtggaggactggagagacatggcagatgctacctgcacacttttggtaatattctgtgtgatgggatatgaaatggtccatagaaaaaaaccggaaaaatacgccaaggttaggttcattctaagagtctaaaaatttcaaaaaccaaaacaacattataaatggtgtttctcaaggacctttcactacctttttagattgtgcttgtgattttcaggcaagctaaatgtctgatgaagactgctcttcttttgttctgtgtctgacctactaattcctgcccatgcttcaaactcagttcagaaatcactgaaggaaccatccactgccggcctgcctgcaaccacagctgacagctgagttagttaggttttcctgtccctattatttaccagtttgtactgaaatgctttcatgggctgtgcttccagattatgagttctgtggaatcaggaagtatgtctctgtattcttgtattctttggcttttttgtgtagtaaagggactcaagtaatgtttgacagtgaaggatacaacttcattccttgcctgctttgataaattttagtaataaattcccaaaactatcatgttgattaaaaataaaaagtaaccgtaa

SEQ ID NO: 199900 - DNA, 4401 bp, Homo sapiens
  Payload ID: 19435
  Gene Name: WD repeat domain 6
  ENST ID: ENST00000395474
  CDS Start-End: 281-3736
tttattgtgtactgactccatctgccccgtcaaataaaaaaccacaaggttcgagccgccgggcccgacaaactccgggtcggcgaaacagagtccgcgataggtgcagcgggctggcagctgggagcgccccgcaagcgtcacgtgagggggcgaggggcgggatgcccctccgcgggccccgccaatgatgagctggattgcgtgggacgaagggtcgtcattggacaaccgccgcgggcgccctggtctctgctacctgtagctgagggcgctgttgatgggcagcgcggcgcgctgggaaggctcgttctcgcgagagttcagctcccttcttagccgtggctgcctcagcacctcgaggatcgacatggacgctctcgaggactacgtttggccgcgggcaacctcggagcttatactcctcccagtgacgggtctggagtgcgtgggggaccggctgttggcgggtgagggtcccgatgtcctggtgtacagcttggactttggtgggcatctgcggatgataaagcgagtgcagaacctgcttggccactatcttatccatggcttccgggtacggccagagcctaatggagaccttgacttggaggccatggtggctgtgtttggaagcaagggactccgagttgtgaaaattagctggggacagggccacttctgggagctttggcgctctggcctgtggaacatgtctgactggatttgggatgcacgctggcttgagggaaatatagccttggccctgggccacaactcagtggtgctatatgaccctgtagtagggtgcatcctgcaagaggtgccctgcacagacaggtgcaccctctcttcagcctgcctgattggagacgcctggaaggagctgaccatagtggcaggtgctgtttccaaccagctcttggtctggtacccagcaactgccttagcagacaacaaacctgtagcacctgaccgacgaatcagtgggcatgtgggcatcatcttcagcatgtcatacctggaaagcaagggattgctggctacagcttcagaagaccgaagcgttcgtatctggaaggtgggcgacctgcgagtgcctgggggtcgggtgcagaatattgggcactgctttgggcacagcgcccgtgtgtggcaggtcaagcttctagagaattaccttatcagtgcaggagaggattgtgtctgcttggtgtggagccatgaaggtgagatcctccaggcctttcggggacaccagggacgtgggatccgggccatagctgcccatgagaggcaggcctgggtgatcactgggggtgatgactcaggcattcggctgtggcacttggtagggcgtgggtaccggggattgggggtctcggctctctgcttcaagtcccgtagtaggccaggtacactcaaggctgtgactctggctggctcttggcgactgctggcagtgactgatacaggggccctgtatctctatgacgtcgaggtcaagtgctgggagcagctgctagaggataaacatttccagtcctactgcctgctggaggcagctcctggtcccgagggcttcggattgtgtgctatggccaatggggaaggtcgtgtcaaggttgtccccatcaacactccaactgctgctgtggaccagaccctgtttcctgggaaggtgcacagcttgagctgggccctgcgtggttatgaggagctcctgttgctggcatcgggccctggcggggtagtagcttgcctagagatctcagccgcaccctctggcaaggccatctttgtcaaggaacgttgtcggtacctgctgcccccaagcaagcagagatggcacacatgcagtgccttcctacccccaggtgacttcctggtgtgtggtgaccgccggggctctgtgctgctattcccctccagaccaggtctgctcaaggaccctggggtgggaggcaaggctcgggctggtgctggggcacctgtagtgggtagtggtagtagtgggggtgggaatgctttcactgggttgggcccagtgtctaccctgccctctctgcacgggaagcagggtgtgacctcagtcacatgccatggtggctatgtgtataccacagggcgtgatggagcctactaccagctgtttgtacgagacggccagctccagccagtcctaaggcagaagtcctgtcgaggcatgaactggctagctgggctccgtatagtgcccgatgggagcatggttatcctgggtttccatgccaatgagtttgtggtgtggaaccctcggtcacacgagaagctgcacatcgtcaactgtggtggagggcaccgttcgtgggcattctctgatactgaggcggccatggcctttgcttacctcaaggatggggatgtcatgctgtacagggctctgggtggctgcacccggccacacgtgattctccgggagggtctgcatggccgtgagatcacttgtgtaaagcgtgtgggcaccattaccctggggcctgaatatggagtgcccagcttcatgcagcctgatgacctggagcctggcagtgaggggcccgacttgactgacattgtgatcacatgtagtgaggacactactgtctgtgtcctagcactccctacaaccacaggctcagcccacgcactcacagctgtttgtaaccatatctcctcggtacgtgctgtggctgtgtggggcattggcaccccaggtggccctcaggatcctcagccaggcctgactgcccatgtggtgtctgcgggggggcgggctgagatgcactgcttcagcatcatggttactccggaccccagcaccccaagccgcctcgcctgccatgtcatgcacctttcgtcccaccggctagatgagtattgggaccggcaacgcaatcggcatcggatggttaaggtagacccagagaccaggtacatgtcccttgctgtgtgtgaacttgaccagcccggccttggcccccttgtggctgcagcctgtagtgatggggccgtaaggctctttcttttgcaggattctgggcggattctgcagctccttgctgaaaccttccaccataagcgatgtgtcctcaaggtccactcctttacacacgaggcacccaaccagaggcggaggctcctcctgtgcagcgcagctactgatggcagcctggctttctgggatctcaccaccatgctagaccatgactccactgtcctggagcctccagtggatcctgggcttccctaccggcttggcaccccctccctgactctccaggcccacagctgtggtatcaacagcctgcacaccttgcccacccgtgagggccaccatctcgtggccagtggcagtgaagatggatccctccatgtcttcgtgcttgctgtggagatgctacagctagaagaggctgtgggagaggctgggctggtaccccagctgcgtgtgctagaggaatactctgtcccctgtgcacatgctgcccatgtgacaggcctcaagatcctaagcccaagcatcatggtctcagcctccattgatcaacggctgaccttctggcgtctggggcatggtgaacccaccttcatgaatagcactgtgttccatgtgcctgatgtggctgacatggactgctggcctgtgagccctgagtttggccaccgttgtgcccttgggggtcaggggcttgaggtttacaactggtatgactgaggtatcctgcggtggctggcgtgctgggcatggggcctgctcacagacagcatggagcagggatgggctgtctgtgcccatgctcagcatgccttgaggggaggaggtggtggccgtgggttcctgatgtcggtgcaggagctgaaggtgagtggagtgctgccaagaatatgcccgactccccatgacaagacagaactttgtaacaaacagtaccaatttattttggccgtgggtttttgctttttttccagttgatgactttgtgaacattcccaggtattggagcctctgtggccttaaatgtggctcagtggagggagacccagcatagccaggccagtatggagcacctcacgcacagctctcagaagctgcaggcggacgaacatctgaccaaagaggtgtggtcgaggctcctgaaagagaaagggcctgctggtctcatcctctgcttcctttgcctttaccctatacctctctgcacgtcccaccccattttgctgtgtgctcacccccaggatgtgtacccggttgtagtaggagctgaaatccatgctgagctgtaccaggaacttgcatatctagagacagagactgagtcactggcccatctctttgctcttgtgccccaggccagaataaagaatagagtgtagagtgtc

SEQ ID NO: 199901 - DNA, 852 bp, Homo sapiens
  Payload ID: 19435
  Gene Name: WD repeat domain 6
  ENST ID: ENST00000438660
  CDS Start-End: 40-852
cttcttagccgtggctgcctcagcacctcgaggatcgacatggacgctctcgaggactacgtttggccgcgggcaacctcggagcttatactcctcccagtgacgggtctggagtgcgtgggggaccggctgttggcggagtctggctttggctttccaaagtgcccagattacaggcgtgagccaccgcacccggccgagaccaaggattttctaagattcaagctgcaggattgtgagggtcccgatgtcctggtgtacagcttggactttggtgggcatctgcggatgataaagcgagtgcagaacctgcttggccactatcttatccatggcttccgggtacggccagagcctaatggagaccttgacttggaggccatggtggctgtgtttggaagcaagggactccgagttgtgaaaattagctggggacagggccacttctgggagctttggcgctctggcctgtggaacatgtctgactggatttgggatgcacgctggcttgagggaaatatagccttggccctgggccacaactcagtggtgctatatgaccctgtagtagggtgcatcctgcaagaggtgccctgcacagacaggtgcaccctctcttcagcctgcctgattggagacgcctggaaggagctgaccatagtggcaggtgctgtttccaaccagctcttggtctggtacccagcaactgccttagcagacaacaaacctgtagcacctgaccgacgaatcagtgggcatgtgggcatcatcttcagcatgtcatacctggaaagcaagggattgctggctacagcttcagaagaccgaagcgttcgtatctggaaggtgggc

SEQ ID NO: 199902 - DNA, 538 bp, Homo sapiens
  Payload ID: 19435
  Gene Name: WD repeat domain 6
  ENST ID: ENST00000419837
  CDS Start-End: 242-538
aggggtgccctgaggagaaggacgggcagcaggttgaggccgatcggagagtctggctttggctttccaaagtgcccagattacaggcgtgagccaccgcacccggccgagaccaaggattttctaagattcaagctgcaggattgtgtgtcctgatgcattcataggctacatgccgagaagtttccctgatccccatctcttccctgtgggtcatcagagttaggtacctagctctgacatggctctttgcctctatctaggtgagggtcccgatgtcctggtgtacagcttggactttggtgggcatctgcggatgataaagcgagtgcagaacctgcttggccactatcttatccatggcttccgggtacggccagagcctaatggagaccttgacttggaggccatggtggctgtgtttggaagcaagggactccgagttgtgaaaattagctggggacagggccacttctgggagctttggcgctctggcctgtggaacatgtctgactggatttgggatgcacgctggctt

SEQ ID NO: 199903 - DNA, 3656 bp, Homo sapiens
  Payload ID: 19435
  Gene Name: WD repeat domain 6
  ENST ID: ENST00000420783
  CDS Start-End: 30-215
gtggctgcctcagcacctcgaggatcgacatggacgctctcgaggactacgtttggccgcgggcaacctcggagcttatactcctcccagtgacgggtctggagtgcgtgggggaccggctgttggcgggctggagtgcagtggcacggtctcggctccctgcaacctccgcctcccaggttcaagtgattctcctgcctcagcctccggagtagctgggattacaggtgagggtcccgatgtcctggtgtacagcttggactttggtgggcatctgcggatgataaagcgagtgcagaacctgcttggccactatcttatccatggcttccgggtacggccagagcctaatggagaccttgacttggaggccatggtggctgtgtttggaagcaagggactccgagttgtgaaaattagctggggacagggccacttctgggagctttggcgctctggcctgtggaacatgtctgactggatttgggatgcacgctggcttgagggaaatatagccttggccctgggccacaactcagtggtgctatatgaccctgtagtagggtgcatcctgcaagaggtgccctgcacagacaggtgcaccctctcttcagcctgcctgattggagacgcctggaaggagctgaccatagtggcaggtgctgtttccaaccagctcttggtctggtacccagcaactgccttagcagacaacaaacctgtagcacctgaccgacgaatcagtgggcatgtgggcatcatcttcagcatgtcatacctggaaagcaagggattgctggctacagcttcagaagaccgaagcgttcgtatctggaaggtgggcgacctgcgagtgcctgggggtcgggtgcagaatattgggcactgctttgggcacagcgcccgtgtgtggcaggtcaagcttctagagaattaccttatcagtgcaggagaggattgtgtctgcttggtgtggagccatgaaggtgagatcctccaggcctttcggggacaccagggacgtgggatccgggccatagctgcccatgagaggcaggcctgggtgatcactgggggtgatgactcaggcattcggctgtggcacttggtagggcgtgggtaccggggattgggggtctcggctctctgcttcaagtcccgtagtaggccaggtacactcaaggctgtgactctggctggctcttggcgactgctggcagtgactgatacaggggccctgtatctctatgacgtcgaggtcaagtgctgggagcagctgctagaggataaacatttccagtcctactgcctgctggaggcagctcctggtcccgagggcttcggattgtgtgctatggccaatggggaaggtcgtgtcaaggttgtccccatcaacactccaactgctgctgtggaccagaccctgtttcctgggaaggtgcacagcttgagctgggccctgcgtggttatgaggagctcctgttgctggcatcgggccctggcggggtagtagcttgcctagagatctcagccgcaccctctggcaaggccatctttgtcaaggaacgttgtcggtacctgctgcccccaagcaagcagagatggcacacatgcagtgccttcctacccccaggtgacttcctggtgtgtggtgaccgccggggctctgtgctgctattcccctccagaccaggtctgctcaaggaccctggggtgggaggcaaggctcgggctggtgctggggcacctgtagtgggtagtggtagtagtgggggtgggaatgctttcactgggttgggcccagtgtctaccctgccctctctgcacgggaagcagggtgtgacctcagtcacatgccatggtggctatgtgtataccacagggcgtgatggagcctactaccagctgtttgtacgagacggccagctccagccagtcctaaggcagaagtcctgtcgaggcatgaactggctagctgggctccgtatagtgcccgatgggagcatggttatcctgggtttccatgccaatgagtttgtggtgtggaaccctcggtcacacgagaagctgcacatcgtcaactgtggtggagggcaccgttcgtgggcattctctgatactgaggcggccatggcctttgcttacctcaaggatggggatgtcatgctgtacagggctctgggtggctgcacccggccacacgtgattctccgggagggtctgcatggccgtgagatcacttgtgtaaagcgtgtgggcaccattaccctggggcctgaatatggagtgcccagcttcatgcagcctgatgacctggagcctggcagtgaggggcccgacttgactgacattgtgatcacatgtagtgaggacactactgtctgtgtcctagcactccctacaaccacaggctcagcccacgcactcacagctgtttgtaaccatatctcctcggtacgtgctgtggctgtgtggggcattggcaccccaggtggccctcaggatcctcagccaggcctgactgcccatgtggtgtctgcgggggggcgggctgagatgcactgcttcagcatcatggttactccggaccccagcaccccaagccgcctcgcctgccatgtcatgcacctttcgtcccaccggctagatgagtattgggaccggcaacgcaatcggcatcggatggttaaggtagacccagagaccaggtaatatatgctcctgggcagggtgtggtatgggtcatgcagatgctcccaggcttgcaggctccacctgacagctgcatgttgtctctgcaggtacatgtcccttgctgtgtgtgaacttgaccagcccggccttggcccccttgtggctgcagcctgtagtgatggggccgtaaggctctttcttttgcaggattctgggcggattctgcagctccttgctgaaaccttccaccataagcgatgtgtcctcaaggtccactcctttacacacgaggcacccaaccagaggcggaggctcctcctgtgcagcgcagctactgatggcagcctggctttctgggatctcaccaccatgctagaccatgactccactgtcctggagcctccagtggatcctgggcttccctaccggcttggcaccccctccctgactctccaggcccacagctgtggtatcaacagcctgcacaccttgcccacccgtgagggccaccatctcgtggccagtggcagtgaagatggatccctccatgtcttcgtgcttgctgtggagatgctacagctagaagaggctgtgggagaggctgggctggtaccccagctgcgtgtgctagaggaatactctgtcccctgtgcacatgctgcccatgtgacaggcctcaagatcctaagcccaagcatcatggtctcagcctccattgatcaacggctgaccttctggcgtctggggcatggtgaacccaccttcatgaatagcactgtgttccatgtgcctgatgtggctgacatggactgctggcctgtgagccctgagtttggccaccgttgtgcccttgggggtcaggggcttgaggtttacaactggtatgactgaggtatcctgcggtggctggcgtgctgggcatggggcctgctcacagacagcatggagcagggatgggctg

SEQ ID NO: 199904 - DNA, 1883 bp, Homo sapiens
  Payload ID: 19435
  Gene Name: WD repeat domain 6
  ENST ID: ENST00000415265
  CDS Start-End: 37-1746
cttagccgtggctgcctcagcacctcgaggatcgacatggacgctctcgaggactacgtttggccgcgggcaacctcggagcttatactcctcccagtgacgggtctggagtgcgtgggggaccggctgttggcggggcgtgatggagcctactaccagctgtttgtacgagacggccagctccagccagtcctaaggcagaagtcctgtcgaggcatgaactggctagctgggctccgtatagtgcccgatgggagcatggttatcctgggtttccatgccaatgagtttgtggtgtggaaccctcggtcacacgagaagctgcacatcgtcaactgtggtggagggcaccgttcgtgggcattctctgatactgaggcggccatggcctttgcttacctcaaggatggggatgtcatgctgtacagggctctgggtggctgcacccggccacacgtgattctccgggagggtctgcatggccgtgagatcacttgtgtaaagcgtgtgggcaccattaccctggggcctgaatatggagtgcccagcttcatgcagcctgatgacctggagcctggcagtgaggggcccgacttgactgacattgtgatcacatgtagtgaggacactactgtctgtgtcctagcactccctacaaccacaggctcagcccacgcactcacagctgtttgtaaccatatctcctcggtacgtgctgtggctgtgtggggcattggcaccccaggtggccctcaggatcctcagccaggcctgactgcccatgtggtgtctgcgggggggcgggctgagatgcactgcttcagcatcatggttactccggaccccagcaccccaagccgcctcgcctgccatgtcatgcacctttcgtcccaccggctagatgagtattgggaccggcaacgcaatcggcatcggatggttaaggtagacccagagaccaggtacatgtcccttgctgtgtgtgaacttgaccagcccggccttggcccccttgtggctgcagcctgtagtgatggggccgtaaggctctttcttttgcaggattctgggcggattctgcagctccttgctgaaaccttccaccataagcgatgtgtcctcaaggtccactcctttacacacgaggcacccaaccagaggcggaggctcctcctgtgcagcgcagctactgatggcagcctggctttctgggatctcaccaccatgctagaccatgactccactgtcctggagcctccagtggatcctgggcttccctaccggcttggcaccccctccctgactctccaggcccacagctgtggtatcaacagcctgcacaccttgcccacccgtgagggccaccatctcgtggccagtggcagtgaagatggatccctccatgtcttcgtgcttgctgtggagatgctacagctagaagaggctgtgggagaggctgggctggtaccccagctgcgtgtgctagaggaatactctgtcccctgtgcacatgctgcccatgtgacaggcctcaagatcctaagcccaagcatcatggtctcagcctccattgatcaacggctgaccttctggcgtctggggcatggtgaacccaccttcatgaatagcactgtgttccatgtgcctgatgtggctgacatggactgctggcctgtgagccctgagtttggccaccgttgtgcccttgggggtcaggggcttgaggtttacaactggtatgactgaggtatcctgcggtggctggcgtgctgggcatggggcctgctcacagacagcatggagcagggatgggctgtctgtgcccatgctcagcatgccttgaggggaggaggtggtggccgtgggttcctgatgtcggtgca

SEQ ID NO: 199905 - DNA, 3377 bp, Homo sapiens
  Payload ID: 19435
  Gene Name: WD repeat domain 6
  ENST ID: ENST00000448293
  CDS Start-End: 106-3318
aaaaggggtgccctgaggagaaggacgggcagcaggttgaggccgatcggaggtgagggtcccgatgtcctggtgtacagcttggactttggtgggcatctgcggatgataaagcgagtgcagaacctgcttggccactatcttatccatggcttccgggtacggccagagcctaatggagaccttgacttggaggccatggtggctgtgtttggaagcaagggactccgagttgtgaaaattagctggggacagggccacttctgggagctttggcgctctggcctgtggaacatgtctgactggatttgggatgcacgctggcttgagggaaatatagccttggccctgggccacaactcagtggtgctatatgaccctgtagtagggtgcatcctgcaagaggtgccctgcacagacaggtgcaccctctcttcagcctgcctgattggagacgcctggaaggagctgaccatagtggcaggtgctgtttccaaccagctcttggtctggtacccagcaactgccttagcagacaacaaacctgtagcacctgaccgacgaatcagtgggcatgtgggcatcatcttcagcatgtcatacctggaaagcaagggattgctggctacagcttcagaagaccgaagcgttcgtatctggaaggtgggcgacctgcgagtgcctgggggtcgggtgcagaatattgggcactgctttgggcacagcgcccgtgtgtggcaggtcaagcttctagagaattaccttatcagtgcaggagaggattgtgtctgcttggtgtggagccatgaaggtgagatcctccaggcctttcggggacaccagggacgtgggatccgggccatagctgcccatgagaggcaggcctgggtgatcactgggggtgatgactcaggcattcggctgtggcacttggtagggcgtgggtaccggggattgggggtctcggctctctgcttcaagtcccgtagtaggccaggtacactcaaggctgtgactctggctggctcttggcgactgctggcagtgactgatacaggggccctgtatctctatgacgtcgaggtcaagtgctgggagcagctgctagaggataaacatttccagtcctactgcctgctggaggcagctcctggtcccgagggcttcggattgtgtgctatggccaatggggaaggtcgtgtcaaggttgtccccatcaacactccaactgctgctgtggaccagaccctgtttcctgggaaggtgcacagcttgagctgggccctgcgtggttatgaggagctcctgttgctggcatcgggccctggcggggtagtagcttgcctagagatctcagccgcaccctctggcaaggccatctttgtcaaggaacgttgtcggtacctgctgcccccaagcaagcagagatggcacacatgcagtgccttcctacccccaggtgacttcctggtgtgtggtgaccgccggggctctgtgctgctattcccctccagaccaggtctgctcaaggaccctggggtgggaggcaaggctcgggctggtgctggggcacctgtagtgggtagtggtagtagtgggggtgggaatgctttcactgggttgggcccagtgtctaccctgccctctctgcacgggaagcagggtgtgacctcagtcacatgccatggtggctatgtgtataccacagggcgtgatggagcctactaccagctgtttgtacgagacggccagctccagccagtcctaaggcagaagtcctgtcgaggcatgaactggctagctgggctccgtatagtgcccgatgggagcatggttatcctgggtttccatgccaatgagtttgtggtgtggaaccctcggtcacacgagaagctgcacatcgtcaactgtggtggagggcaccgttcgtgggcattctctgatactgaggcggccatggcctttgcttacctcaaggatggggatgtcatgctgtacagggctctgggtggctgcacccggccacacgtgattctccgggagggtctgcatggccgtgagatcacttgtgtaaagcgtgtgggcaccattaccctggggcctgaatatggagtgcccagcttcatgcagcctgatgacctggagcctggcagtgaggggcccgacttgactgacattgtgatcacatgtagtgaggacactactgtctgtgtcctagcactccctacaaccacaggctcagcccacgcactcacagctgtttgtaaccatatctcctcggtacgtgctgtggctgtgtggggcattggcaccccaggtggccctcaggatcctcagccaggcctgactgcccatgtggtgtctgcgggggggcgggctgagatgcactgcttcagcatcatggttactccggaccccagcaccccaagccgcctcgcctgccatgtcatgcacctttcgtcccaccggctagatgagtattgggaccggcaacgcaatcggcatcggatggttaaggtagacccagagaccaggtacatgtcccttgctgtgtgtgaacttgaccagcccggccttggcccccttgtggctgcagcctgtagtgatggggccgtaaggctctttcttttgcaggattctgggcggattctgcagctccttgctgaaaccttccaccataagcgatgtgtcctcaaggtccactcctttacacacgaggcacccaaccagaggcggaggctcctcctgtgcagcgcagctactgatggcagcctggctttctgggatctcaccaccatgctagaccatgactccactgtcctggagcctccagtggatcctgggcttccctaccggcttggcaccccctccctgactctccaggcccacagctgtggtatcaacagcctgcacaccttgcccacccgtgagggccaccatctcgtggccagtggcagtgaagatggatccctccatgtcttcgtgcttgctgtggagatgctacagctagaagaggctgtgggagaggctgggctggtaccccagctgcgtgtgctagaggaatactctgtcccctgtgcacatgctgcccatgtgacaggcctcaagatcctaagcccaagcatcatggtctcagcctccattgatcaacggctgaccttctggcgtctggggcatggtgaacccaccttcatgaatagcactgtgttccatgtgcctgatgtggctgacatggactgctggcctgtgagccctgagtttggccaccgttgtgcccttgggggtcaggggcttgaggtttacaactggtatgactgaggtatcctgcggtggctggcgtgctgggcatggggcctgctcacagacagcatggagca

SEQ ID NO: 199906 - DNA, 3916 bp, Homo sapiens
  Payload ID: 19435
  Gene Name: WD repeat domain 6
  ENST ID: ENST00000452875
  CDS Start-End: 36-242
ttagccgtggctgcctcagcacctcgaggatcgacatggacgctctcgaggactacgtttggccgcgggcaacctcggagcttatactcctcccagtgacgggtctggagtgcgtgggggaccggctgttggcggagtctggctttggctttccaaagtgcccagattacaggcgtgagccaccgcacccggccgagaccaaggattttctaagattcaagctgcaggattgtgtgtcctgatgcattcataggctacatgccgagaagtttccctgatccccatctcttccctgtgggtcatcagagttaggtacctagctctgacatggctctttgcctctatctaggtgagggtcccgatgtcctggtgtacagcttggactttggtgggcatctgcggatgataaagcgagtgcagaacctgcttggccactatcttatccatggcttccgggtacggccagagcctaatggagaccttgacttggaggccatggtggctgtgtttggaagcaagggactccgagttgtgaaaattagctggggacagggccacttctgggagctttggcgctctggcctgtggaacatgtctgactggatttgggatgcacgctggcttgagggaaatatagccttggccctgggccacaactcagtggtgctatatgaccctgtagtagggtgcatcctgcaagaggtgccctgcacagacaggtgcaccctctcttcagcctgcctgattggagacgcctggaaggagctgaccatagtggcaggtgctgtttccaaccagctcttggtctggtacccagcaactgccttagcagacaacaaacctgtagcacctgaccgacgaatcagtgggcatgtgggcatcatcttcagcatgtcatacctggaaagcaagggattgctggctacagcttcagaagaccgaagcgttcgtatctggaaggtgggcgacctgcgagtgcctgggggtcgggtgcagaatattgggcactgctttgggcacagcgcccgtgtgtggcaggtcaagcttctagagaattaccttatcagtgcaggagaggattgtgtctgcttggtgtggagccatgaaggtgagatcctccaggcctttcggggacaccagggacgtgggatccgggccatagctgcccatgagaggcaggcctgggtgatcactgggggtgatgactcaggcattcggctgtggcacttggtagggcgtgggtaccggggattgggggtctcggctctctgcttcaagtcccgtagtaggccaggtacactcaaggctgtgactctggctggctcttggcgactgctggcagtgactgatacaggggccctgtatctctatgacgtcgaggtcaagtgctgggagcagctgctagaggataaacatttccagtcctactgcctgctggaggcagctcctggtcccgagggcttcggattgtgtgctatggccaatggggaaggtcgtgtcaaggttgtccccatcaacactccaactgctgctgtggaccagaccctgtttcctgggaaggtgcacagcttgagctgggccctgcgtggttatgaggagctcctgttgctggcatcgggccctggcggggtagtagcttgcctagagatctcagccgcaccctctggcaaggccatctttgtcaaggaacgttgtcggtacctgctgcccccaagcaagcagagatggcacacatgcagtgccttcctacccccaggtgacttcctggtgtgtggtgaccgccggggctctgtgctgctattcccctccagaccaggtctgctcaaggaccctggggtgggaggcaaggctcgggctggtgctggggcacctgtagtgggtagtggtagtagtgggggtgggaatgctttcactgggttgggcccagtgtctaccctgccctctctgcacgggaagcagggtgtgacctcagtcacatgccatggtggctatgtgtataccacagggcgtgatggagcctactaccagctgtttgtacgagacggccagctccagccagtcctaaggcagaagtcctgtcgaggcatgaactggctagctgggctccgtatagtgcccgatgggagcatggttatcctgggtttccatgccaatgagtttgtggtgtggaaccctcggtcacacgagaagctgcacatcgtcaactgtggtggagggcaccgttcgtgggcattctctgatactgaggcggccatggcctttgcttacctcaaggatggggatgtcatgctgtacagggctctgggtggctgcacccggccacacgtgattctccgggagggtctgcatggccgtgagatcacttgtgtaaagcgtgtgggcaccattaccctggggcctgaatatggagtgcccagcttcatgcagcctgatgacctggagcctggcagtgaggggcccgacttgactgacattgtgatcacatgtagtgaggacactactgtctgtgtcctagcactccctacaaccacaggctcagcccacgcactcacagctgtttgtaaccatatctcctcggtacgtgctgtggctgtgtggggcattggcaccccaggtggccctcaggatcctcagccaggcctgactgcccatgtggtgtctgcgggggggcgggctgagatgcactgcttcagcatcatggttactccggaccccagcaccccaagccgcctcgcctgccatgtcatgcacctttcgtcccaccggctagatgagtattgggaccggcaacgcaatcggcatcggatggttaaggtagacccagagaccaggtacatgtcccttgctgtgtgtgaacttgaccagcccggccttggcccccttgtggctgcagcctgtagtgatggggccgtaaggctctttcttttgcaggattctgggcggattctgcagctccttgctgaaaccttccaccataagcgatgtgtcctcaaggtccactcctttacacacgaggcacccaaccagaggcggaggctcctcctgtgcagcgcagctactgatggcagcctggctttctgggatctcaccaccatgctagaccatgactccactgtcctggagcctccagtggatcctgggcttccctaccggcttggcaccccctccctgactctccaggcccacagctgtggtatcaacagcctgcacaccttgcccacccgtgagggccaccatctcgtggccagtggcagtgaagatggatccctccatgtcttcgtgcttgctgtggagatgctacagctagaagaggctgtgggagaggctgggctggtaccccagctgcgtgtgctagaggaatactctgtcccctgtgcacatgctgcccatgtgacaggcctcaagatcctaagcccaagcatcatggtctcagcctccattgatcaacggctgaccttctggcgtctggggcatggtgaacccaccttcatgaatagcactgtgttccatgtgcctgatgtggctgacatggactgctggcctgtgagccctgagtttggccaccgttgtgcccttgggggtcaggggcttgaggtttacaactggtatgactgaggtatcctgcggtggctggcgtgctgggcatggggcctgctcacagacagcatggagcagggatgggctgtctgtgcccatgctcagcatgccttgaggggaggaggtggtggccgtgggttcctgatgtcggtgcaggagctgaaggtgagtggagtgctgccaagaatatgcccgactccccatgacaagacagaactttgtaacaaacagtaccaatttattttggccgtgggtttttgctttttttccagttgatgactttgtgaacattcccaggtattggagcctctgtggcctt

SEQ ID NO: 199907 - DNA, 564 bp, Homo sapiens
  Payload ID: 19435
  Gene Name: WD repeat domain 6
  ENST ID: ENST00000489427
  CDS Start-End: 190-564
aaggtgggggtgaagatcctctgaggagggtggcgtcgcggaaaacggcggataagacctttccgagtagggggcggtgcccggggaagcaggggctgagaccccctcctgagatggttgaggtccaggaaatcaggtgagggtcccgatgtcctggtgtacagcttggactttggtgggcatctgcggatgataaagcgagtgcagaacctgcttggccactatcttatccatggcttccgggtacggccagagcctaatggagaccttgacttggaggccatggtggctgtgtttggaagcaagggactccgagttgtgaaaattagctggggacagggccacttctgggagctttggcgctctggcctgtggaacatgtctgactggatttgggatgcacgctggcttgagggaaatatagccttggccctgggccacaactcagtggtgctatatgaccctgtagtagggtgcatcctgcaagaggtgccctgcacagacaggtgcaccctctcttcagcctgcctgattggagacgcctggaaggagctgaccatagtg

SEQ ID NO: 199908 - DNA, 4070 bp, Homo sapiens
  Payload ID: 19435
  Gene Name: WD repeat domain 6
  Uniprot ID: Q9NNW5
  ENST ID: ENST00000608424
  CDS Start-End: 40-3405
cttcttagccgtggctgcctcagcacctcgaggatcgacatggacgctctcgaggactacgtttggccgcgggcaacctcggagcttatactcctcccagtgacgggtctggagtgcgtgggggaccggctgttggcgggtgagggtcccgatgtcctggtgtacagcttggactttggtgggcatctgcggatgataaagcgagtgcagaacctgcttggccactatcttatccatggcttccgggtacggccagagcctaatggagaccttgacttggaggccatggtggctgtgtttggaagcaagggactccgagttgtgaaaattagctggggacagggccacttctgggagctttggcgctctggcctgtggaacatgtctgactggatttgggatgcacgctggcttgagggaaatatagccttggccctgggccacaactcagtggtgctatatgaccctgtagtagggtgcatcctgcaagaggtgccctgcacagacaggtgcaccctctcttcagcctgcctgattggagacgcctggaaggagctgaccatagtggcaggtgctgtttccaaccagctcttggtctggtacccagcaactgccttagcagacaacaaacctgtagcacctgaccgacgaatcagtgggcatgtgggcatcatcttcagcatgtcatacctggaaagcaagggattgctggctacagcttcagaagaccgaagcgttcgtatctggaaggtgggcgacctgcgagtgcctgggggtcgggtgcagaatattgggcactgctttgggcacagcgcccgtgtgtggcaggtcaagcttctagagaattaccttatcagtgcaggagaggattgtgtctgcttggtgtggagccatgaaggtgagatcctccaggcctttcggggacaccagggacgtgggatccgggccatagctgcccatgagaggcaggcctgggtgatcactgggggtgatgactcaggcattcggctgtggcacttggtagggcgtgggtaccggggattgggggtctcggctctctgcttcaagtcccgtagtaggccaggtacactcaaggctgtgactctggctggctcttggcgactgctggcagtgactgatacaggggccctgtatctctatgacgtcgaggtcaagtgctgggagcagctgctagaggataaacatttccagtcctactgcctgctggaggcagctcctggtcccgagggcttcggattgtgtgctatggccaatggggaaggtcgtgtcaaggttgtccccatcaacactccaactgctgctgtggaccagaccctgtttcctgggaaggtgcacagcttgagctgggccctgcgtggttatgaggagctcctgttgctggcatcgggccctggcggggtagtagcttgcctagagatctcagccgcaccctctggcaaggccatctttgtcaaggaacgttgtcggtacctgctgcccccaagcaagcagagatggcacacatgcagtgccttcctacccccaggtgacttcctggtgtgtggtgaccgccggggctctgtgctgctattcccctccagaccaggtctgctcaaggaccctggggtgggaggcaaggctcgggctggtgctggggcacctgtagtgggtagtggtagtagtgggggtgggaatgctttcactgggttgggcccagtgtctaccctgccctctctgcacgggaagcagggtgtgacctcagtcacatgccatggtggctatgtgtataccacagggcgtgatggagcctactaccagctgtttgtacgagacggccagctccagccagtcctaaggcagaagtcctgtcgaggcatgaactggctagctgggctccgtatagtgcccgatgggagcatggttatcctgggtttccatgccaatgagtttgtggtgtggaaccctcggtcacacgagaagctgcacatcgtcaactgtggtggagggcaccgttcgtgggcattctctgatactgaggcggccatggcctttgcttacctcaaggatggggatgtcatgctgtacagggctctgggtggctgcacccggccacacgtgattctccgggagggtctgcatggccgtgagatcacttgtgtaaagcgtgtgggcaccattaccctggggcctgaatatggagtgcccagcttcatgcagcctgatgacctggagcctggcagtgaggggcccgacttgactgacattgtgatcacatgtagtgaggacactactgtctgtgtcctagcactccctacaaccacaggctcagcccacgcactcacagctgtttgtaaccatatctcctcggtacgtgctgtggctgtgtggggcattggcaccccaggtggccctcaggatcctcagccaggcctgactgcccatgtggtgtctgcgggggggcgggctgagatgcactgcttcagcatcatggttactccggaccccagcaccccaagccgcctcgcctgccatgtcatgcacctttcgtcccaccggctagatgagtattgggaccggcaacgcaatcggcatcggatggttaaggtagacccagagaccaggtacatgtcccttgctgtgtgtgaacttgaccagcccggccttggcccccttgtggctgcagcctgtagtgatggggccgtaaggctctttcttttgcaggattctgggcggattctgcagctccttgctgaaaccttccaccataagcgatgtgtcctcaaggtccactcctttacacacgaggcacccaaccagaggcggaggctcctcctgtgcagcgcagctactgatggcagcctggctttctgggatctcaccaccatgctagaccatgactccactgtcctggagcctccagtggatcctgggcttccctaccggcttggcaccccctccctgactctccaggcccacagctgtggtatcaacagcctgcacaccttgcccacccgtgagggccaccatctcgtggccagtggcagtgaagatggatccctccatgtcttcgtgcttgctgtggagatgctacagctagaagaggctgtgggagaggctgggctggtaccccagctgcgtgtgctagaggaatactctgtcccctgtgcacatgctgcccatgtgacaggcctcaagatcctaagcccaagcatcatggtctcagcctccattgatcaacggctgaccttctggcgtctggggcatggtgaacccaccttcatgaatagcactgtgttccatgtgcctgatgtggctgacatggactgctggcctgtgagccctgagtttggccaccgttgtgcccttgggggtcaggggcttgaggtttacaactggtatgactgaggtatcctgcggtggctggcgtgctgggcatggggcctgctcacagacagcatggagcagggatgggctgtctgtgcccatgctcagcatgccttgaggggaggaggtggtggccgtgggttcctgatgtcggtgcaggagctgaaggtgagtggagtgctgccaagaatatgcccgactccccatgacaagacagaactttgtaacaaacagtaccaatttattttggccgtgggtttttgctttttttccagttgatgactttgtgaacattcccaggtattggagcctctgtggccttaaatgtggctcagtggagggagacccagcatagccaggccagtatggagcacctcacgcacagctctcagaagctgcaggcggacgaacatctgaccaaagaggtgtggtcgaggctcctgaaagagaaagggcctgctggtctcatcctctgcttcctttgcctttaccctatacctctctgcacgtcccaccccattttgctgtgtgctcacccccaggatgtgtacccggttgtagtaggagctgaaatccatgctgagctgtaccaggaacttgcatatctagagacagagactgagtcactggcccatctctttgctcttgtgccccaggccagaataaagaatagagtgtagagtgtc

SEQ ID NO: 199909 - DNA, 563 bp, Homo sapiens
  Payload ID: 19435
  Gene Name: WD repeat domain 6
  ENST ID: ENST00000429900
  CDS Start-End: 470-563
ggcgcgctgggaaggctcgttctcgcgagagttcagctcccttcttagccgtggctgcctcagcacctcgaggatcgacatggacgctctcgaggactacgtttggccgcgggcaacctcggagcttatactcctcccagtgacgggtctggagtgcgtgggggaccggctgttggcgggctggagtgcagtggcacggtctcggctccctgcaacctccgcctcccaggttcaagtgattctcctgcctcagcctccggagtagctgggattacagagtctggctttggctttccaaagtgcccagattacaggcgtgagccaccgcacccggccgagaccaaggattttctaagattcaagctgcaggattgtgtgtcctgatgcattcataggctacatgccgagaagtttccctgatccccatctcttccctgtgggtcatcagagttaggtacctagctctgacatggctctttgcctctatctaggtgagggtcccgatgtcctggtgtacagcttggactttggtgggcatctgcggatgataaagcgagtgcaga

SEQ ID NO: 199910 - DNA, 491 bp, Homo sapiens
  Payload ID: 19435
  Gene Name: WD repeat domain 6
  ENST ID: ENST00000491365
  CDS Start-End: 387-491
gggggtgaagatcctctgaggagggtggcgtcgcggaaaacggcggataagacctttccgagtagggggcggtgcccggggaagcaggggctgagaccccctcctgagatggttgaggtccaggaaatcaggtgtggaggtccctccaaggagaaccgggtcgcaaaggacaggcgaggcctgggacctgaggtgtcagagtccaggctggtctcgaacagtcattacatgaagccactaatgacccatgttggtgctgctgagttgtataagggtcctgaggcagggccttggcggtcaggccttgagtgagttgccaccagtcctaagagggtgagggtcccgatgtcctggtgtacagcttggactttggtgggcatctgcggatgataaagcgagtgcagaacctgcttggccactatcttatccatggcttccgggtacggccagagcctaatggagaccttgacttggaggccatggtggctgtg

SEQ ID NO: 199911 - DNA, 1949 bp, Homo sapiens
  Payload ID: 19435
  Gene Name: WD repeat domain 6
  ENST ID: ENST00000615452
  CDS Start-End: 423-1292
ggtgagggtcccgatgtcctggtgtacagcttggactttggtgggcatctgcggatgataaagcgagtgcagaacctgcttggccactatcttatccatggcttccgggtacggccagagcctaatggagaccttgacttggaggccatggtggctgtgtttggaagcaagggactccgagttgtgaaaattagctggggacagggccacttctgggagctttggcgctctggcctgtggaacatatctcctcggtacgtgctgtggctgtgtggggcattggcaccccaggtggccctcaggatcctcagccaggcctgactgcccatgtggtgtctgcgggggggcgggctgagatgcactgcttcagcatcatggttactccggaccccagcaccccaagccgcctcgcctgccatgtcatgcacctttcgtcccaccggctagatgagtattgggaccggcaacgcaatcggcatcggatggttaaggtagacccagagaccaggtacatgtcccttgctgtgtgtgaacttgaccagcccggccttggcccccttgtggctgcagcctgtagtgatggggccgtaaggctctttcttttgcaggattctgggcggattctgcagctccttgctgaaaccttccaccataagcgatgtgtcctcaaggtccactcctttacacacgaggcacccaaccagaggcggaggctcctcctgtgcagcgcagctactgatggcagcctggctttctgggatctcaccaccatgctagaccatgactccactgtcctggagcctccagtggatcctgggcttccctaccggcttggcaccccctccctgactctccaggcccacagctgtggtatcaacagcctgcacaccttgcccacccgtgagggccaccatctcgtggccagtggcagtgaagatggatccctccatgtcttcgtgcttgctgtggagatgctacagctagaagaggctgtgggagaggctgggctggtaccccagctgcgtgtgctagaggaatactctgtcccctgtgcacatgctgcccatgtgacaggcctcaagatcctaagcccaagcatcatggtctcagcctccattgatcaacggctgaccttctggcgtctggggcatggtgaacccaccttcatgaatagcactgtgttccatgtgcctgatgtggctgacatggactgctggcctgtgagccctgagtttggccaccgttgtgcccttgggggtcaggggcttgaggtttacaactggtatgactgaggtatcctgcggtggctggcgtgctgggcatggggcctgctcacagacagcatggagcagggatgggctgtctgtgcccatgctcagcatgccttgaggggaggaggtggtggccgtgggttcctgatgtcggtgcaggagctgaaggtgagtggagtgctgccaagaatatgcccgactccccatgacaagacagaactttgtaacaaacagtaccaatttattttggccgtgggtttttgctttttttccagttgatgactttgtgaacattcccaggtattggagcctctgtggccttaaatgtggctcagtggagggagacccagcatagccaggccagtatggagcacctcacgcacagctctcagaagctgcaggcggacgaacatctgaccaaagaggtgtggtcgaggctcctgaaagagaaagggcctgctggtctcatcctctgcttcctttgcctttaccctatacctctctgcacgtcccaccccattttgctgtgtgctcacccccaggatgtgtacccggttgtagtaggagctgaaatccatgctgagctgtaccaggaacttgcatatctagagacagagactgagtcactggcccatctctttgctcttgtgccccaggccagaataaagaatagagtgt

SEQ ID NO: 199912 - DNA, 4259 bp, Homo sapiens
  Payload ID: 19435
  Gene Name: WD repeat domain 6
  ENST ID: ENST00000610967
  CDS Start-End: 139-3594
acgtgagggggcgaggggcgggatgcccctccgcgggccccgccaatgatgagctggattgcgtgggacgaagggtcgtcattggacaaccgccgcgggcgccctggtctctgctacctgtagctgagggcgctgttgatgggcagcgcggcgcgctgggaaggctcgttctcgcgagagttcagctcccttcttagccgtggctgcctcagcacctcgaggatcgacatggacgctctcgaggactacgtttggccgcgggcaacctcggagcttatactcctcccagtgacgggtctggagtgcgtgggggaccggctgttggcgggtgagggtcccgatgtcctggtgtacagcttggactttggtgggcatctgcggatgataaagcgagtgcagaacctgcttggccactatcttatccatggcttccgggtacggccagagcctaatggagaccttgacttggaggccatggtggctgtgtttggaagcaagggactccgagttgtgaaaattagctggggacagggccacttctgggagctttggcgctctggcctgtggaacatgtctgactggatttgggatgcacgctggcttgagggaaatatagccttggccctgggccacaactcagtggtgctatatgaccctgtagtagggtgcatcctgcaagaggtgccctgcacagacaggtgcaccctctcttcagcctgcctgattggagacgcctggaaggagctgaccatagtggcaggtgctgtttccaaccagctcttggtctggtacccagcaactgccttagcagacaacaaacctgtagcacctgaccgacgaatcagtgggcatgtgggcatcatcttcagcatgtcatacctggaaagcaagggattgctggctacagcttcagaagaccgaagcgttcgtatctggaaggtgggcgacctgcgagtgcctgggggtcgggtgcagaatattgggcactgctttgggcacagcgcccgtgtgtggcaggtcaagcttctagagaattaccttatcagtgcaggagaggattgtgtctgcttggtgtggagccatgaaggtgagatcctccaggcctttcggggacaccagggacgtgggatccgggccatagctgcccatgagaggcaggcctgggtgatcactgggggtgatgactcaggcattcggctgtggcacttggtagggcgtgggtaccggggattgggggtctcggctctctgcttcaagtcccgtagtaggccaggtacactcaaggctgtgactctggctggctcttggcgactgctggcagtgactgatacaggggccctgtatctctatgacgtcgaggtcaagtgctgggagcagctgctagaggataaacatttccagtcctactgcctgctggaggcagctcctggtcccgagggcttcggattgtgtgctatggccaatggggaaggtcgtgtcaaggttgtccccatcaacactccaactgctgctgtggaccagaccctgtttcctgggaaggtgcacagcttgagctgggccctgcgtggttatgaggagctcctgttgctggcatcgggccctggcggggtagtagcttgcctagagatctcagccgcaccctctggcaaggccatctttgtcaaggaacgttgtcggtacctgctgcccccaagcaagcagagatggcacacatgcagtgccttcctacccccaggtgacttcctggtgtgtggtgaccgccggggctctgtgctgctattcccctccagaccaggtctgctcaaggaccctggggtgggaggcaaggctcgggctggtgctggggcacctgtagtgggtagtggtagtagtgggggtgggaatgctttcactgggttgggcccagtgtctaccctgccctctctgcacgggaagcagggtgtgacctcagtcacatgccatggtggctatgtgtataccacagggcgtgatggagcctactaccagctgtttgtacgagacggccagctccagccagtcctaaggcagaagtcctgtcgaggcatgaactggctagctgggctccgtatagtgcccgatgggagcatggttatcctgggtttccatgccaatgagtttgtggtgtggaaccctcggtcacacgagaagctgcacatcgtcaactgtggtggagggcaccgttcgtgggcattctctgatactgaggcggccatggcctttgcttacctcaaggatggggatgtcatgctgtacagggctctgggtggctgcacccggccacacgtgattctccgggagggtctgcatggccgtgagatcacttgtgtaaagcgtgtgggcaccattaccctggggcctgaatatggagtgcccagcttcatgcagcctgatgacctggagcctggcagtgaggggcccgacttgactgacattgtgatcacatgtagtgaggacactactgtctgtgtcctagcactccctacaaccacaggctcagcccacgcactcacagctgtttgtaaccatatctcctcggtacgtgctgtggctgtgtggggcattggcaccccaggtggccctcaggatcctcagccaggcctgactgcccatgtggtgtctgcgggggggcgggctgagatgcactgcttcagcatcatggttactccggaccccagcaccccaagccgcctcgcctgccatgtcatgcacctttcgtcccaccggctagatgagtattgggaccggcaacgcaatcggcatcggatggttaaggtagacccagagaccaggtacatgtcccttgctgtgtgtgaacttgaccagcccggccttggcccccttgtggctgcagcctgtagtgatggggccgtaaggctctttcttttgcaggattctgggcggattctgcagctccttgctgaaaccttccaccataagcgatgtgtcctcaaggtccactcctttacacacgaggcacccaaccagaggcggaggctcctcctgtgcagcgcagctactgatggcagcctggctttctgggatctcaccaccatgctagaccatgactccactgtcctggagcctccagtggatcctgggcttccctaccggcttggcaccccctccctgactctccaggcccacagctgtggtatcaacagcctgcacaccttgcccacccgtgagggccaccatctcgtggccagtggcagtgaagatggatccctccatgtcttcgtgcttgctgtggagatgctacagctagaagaggctgtgggagaggctgggctggtaccccagctgcgtgtgctagaggaatactctgtcccctgtgcacatgctgcccatgtgacaggcctcaagatcctaagcccaagcatcatggtctcagcctccattgatcaacggctgaccttctggcgtctggggcatggtgaacccaccttcatgaatagcactgtgttccatgtgcctgatgtggctgacatggactgctggcctgtgagccctgagtttggccaccgttgtgcccttgggggtcaggggcttgaggtttacaactggtatgactgaggtatcctgcggtggctggcgtgctgggcatggggcctgctcacagacagcatggagcagggatgggctgtctgtgcccatgctcagcatgccttgaggggaggaggtggtggccgtgggttcctgatgtcggtgcaggagctgaaggtgagtggagtgctgccaagaatatgcccgactccccatgacaagacagaactttgtaacaaacagtaccaatttattttggccgtgggtttttgctttttttccagttgatgactttgtgaacattcccaggtattggagcctctgtggccttaaatgtggctcagtggagggagacccagcatagccaggccagtatggagcacctcacgcacagctctcagaagctgcaggcggacgaacatctgaccaaagaggtgtggtcgaggctcctgaaagagaaagggcctgctggtctcatcctctgcttcctttgcctttaccctatacctctctgcacgtcccaccccattttgctgtgtgctcacccccaggatgtgtacccggttgtagtaggagctgaaatccatgctgagctgtaccaggaacttgcatatctagagacagagactgagtcactggcccatctctttgctcttgtgccccaggccagaataaagaatagagtgtagagtgtc

SEQ ID NO: 199913 - DNA, 207 bp, Homo sapiens
  Payload ID: 19435
  Gene Name: WD repeat domain 6
  ENST ID: ENST00000627177
  CDS Start-End: 1-207
atggacgctctcgaggactacgtttggccgcgggcaacctcggagcttatactcctcccagtgacgggtctggagtgcgtgggggaccggctgttggcggagtctggctttggctttccaaagtgcccagattacaggcgtgagccaccgcacccggccgagaccaaggattttctaagattcaagctgcaggattgtgtgtcctga

SEQ ID NO: 199914 - DNA, 457 bp, Homo sapiens
  Payload ID: 19436
  Gene Name: WD repeat domain 60
  ENST ID: ENST00000397143
  CDS Start-End: 169-457
cgcagaaggagcacagactccctctgtgtgcacagcatttgggacagaagaaccaaagatgatacctggaaagcagatgacctcagaaaacatctctgggccatacagtcaggtggttccaaggaagaaagaaagcacagagagaagaagctgcgtaaggagtctgagatggaccttcctgaacataaggagccgaggtgcagggatcccgaccaggatgccaggagcagagacagggtggccgaagtccacaccgctaaggagagtcctcgtggggagagggacagagacagacagagggagaggagaagagacgcaaaagaccgggagaaagaaaagctgaaggagaaacatcgagaggcagaaaagtctcacagcagaggaaaggacagggaaaaagaaaaagacagaagggcccggaaggaagagctccggcagaccgtggcccaccacaacc

SEQ ID NO: 199915 - DNA, 3769 bp, Homo sapiens
  Payload ID: 19436
  Gene Name: WD repeat domain 60
  Uniprot ID: Q8WVS4
  ENST ID: ENST00000407559
  CDS Start-End: 159-3359
ctgggcagtgcttctgggccctctgctgctcctgcttgtcggttgctaggcgctgggacgcgcctcccgaagggtgcggggcacaggtggcctcttcggggtggaccgcgcctggccggggccgaggacaccgcggccgcccgggcctgcgggaagcgatggagcccgggaagagaagaaccaaagatgatacctggaaagcagatgacctcagaaaacatctctgggccatacagtcaggtggttccaaggaagaaagaaagcacagagagaagaagctgcgtaaggagtctgagatggaccttcctgaacataaggagccgaggtgcagggatcccgaccaggatgccaggagcagagacagggtggccgaagtccacaccgctaaggagagtcctcgtggggagagggacagagacagacagagggagaggagaagagacgcaaaagaccgggagaaagaaaagctgaaggagaaacatcgagaggcagaaaagtctcacagcagaggaaaggacagggaaaaagaaaaagacagaagggcccggaaggaagagctccggcagaccgtggcccaccacaacctgctgggccaggagacacgcgaccggcagctcctggagcgggcggagaggaaaggccgctcagtaagtaaagtaagaagtgaagagaaagatgaagactctgaaagaggagatgaagatagagaaagaagataccgagaaagaaagctgcagtacggagacagcaaggacaaccctctcaagtactggctttataaagaagaaggcgagaggagacacaggaagcccagagagccagatcgagacaacaaacaccgagaaaaaagcagcacaagggaaaaaagagagaaatattccaaagagaaaagtaattcattctctgacaaaggggaagaaagacataaagaaaagcgacacaaagaaggttttcattttgatgatgagaggcaccaaagcaacgtggatagaaaagagaaatcggcaaaagatgagcccaggaaaagggaatcccagaatggtgaacacagaaatcgaggtgcaagctcaaaaagagatgggaccagcagccagcatgctgagaatttagtaaggaatcatggaaaagataaagattcaagacggaagcatggccacgaggaaggctcttctgtgtggtggaagctggaccagaggccgggaggcgaggaaaccgtggaaattgaaaaggaagaaactgatttagaaaatgctagagctgatgcatatacagccagttgtgaagatgattttgaagactatgaagatgactttgaggtttgtgatggtgatgatgatgaaagcagtaatgaacctgagtcaagagaaaaactggaagaacttcctctagctcaaaaaaaggaaatacaagaaattcaaagagctattaatgcagaaaatgaaaggattggcgagttatctttgaaactgtttcagaagcgaggtagaacagaatttgaaaaggagcccaggacagatacaaacagttccccttccagagcctctgtttgtggaatttttgtggattttgcctcagcttcacaccgtcaaaagagtcggactcaggcccttaagcaaaagatgcgaagtacaaaactgcttcggctcattgacttagatttttcatttactttctctctcttggatctaccaccagtaaatgaatatgacatgtatatcagaaactttgggaaaaaaaataccaagcaggcatatgttcagtgtaacgaagataatgttgaaagagacattcaaacggaggaaatagagaccagggaagtgtggacccagcacccgggagaaagtactgttgtatctggaggcagtgaacaaagagatacctctgatgctgtagttatgccaaagattgatactccaaggttatgtagctttctgcgggctgcttgtcaggtgatggccgttttgctggaagaggatcgcttggcagctgaacccagctggaatcttagggctcaagacagggccctgtattttagtgacagctcatctcagctgaacaccagtctaccattccttcaaaatcgaaaagtatcctccttgcacacctcccgagttcagaggcagatggtggtctccgttcacgacttacccgagaagagctttgtgcccctgctggacagcaaatacgtcctctgtgtgtgggatatttggcagccttcagggccacagaaagttctgatatgtgagtcccaggtcacgtgttgctgcttgagccctttgaaagcatttttactgtttgccggaacagcgcacggctcagttgtcgtctgggatttgagagaagactcaaggctgcattactctgtgacgctgagcgatggcttctggacgttccggaccgccacgttttccaccgatggaatccttacctcagtaaaccaccgaagccctcttcaagcagtagaacctatctcaacgtccgtccacaaaaagcagagctttgtgctttcacccttttctactcaagaagaaatgtcaggtttgtccttccacatcgcttccttggatgagagtggggttctcaatgtatgggtggttgttgaattaccaaaggcagacatcgcaggttcaataagtgatttaggtctgatgcctggagggagggtcaagctggtacatagtgctctgatccagttgggtgacagtctttcccataaaggtaatgaattttggggcactacacaaacactgaatgttaaatttctgccttcagatcctaatcactttattattggcacagacatgggtctcataagccatggcacaagacaagatttgagagtggctcccaaactattcaaacctcagcaacatggtataagaccagtgaaagttaatgtcattgatttttcaccatttggagaaccaatatttttggccggctgttcggacggaagcatcaggctgcaccagctgagctccgcgtttccgctcctgcagtgggacagcagcacggacagccatgcggtcaccggcctgcagtggtccccaaccaggcctgccgtgttcctggtgcaggacgacacatccaacatctacatctgggacctcctccagagcgatctgggtcctgtcgccaaacagcaggtctcccccaacaggctggtggccatggctgcggtgggtgagcctgagaaggctggtggcagcttcctggccctggtgctggccagggcgtctggctccatcgacatccagcacctgaagaggcggtgggcggccccggaggtggacgagtgcaacaggctgcgtctgcttttgcaggaagccctgtggccagagggaaaactgcacaagtagcgggtgtggctgagaggaccgcgtttctgtaatgacccagatttaaaagacataaggtggataattctacatttgtgtgcaagtatatttatgtatatagactatgtatattctgtatataatttattttacatgaatatgtctttggtattcccagtaaatagatgactacttttgagtggaaacaaagaacattctagcatttacaaaacttccaggggaatgtagagccacgtccagggtgctcttttctgagagtatttcgagttatttttagaacagtttaaatattgtcacattactgctagattttaaacagcctaccatgaaaatgtatcttaatgaactattttcttatgcataaagtatgtgaacacatgtctaaattaaaaggaattactccaccgaaa

SEQ ID NO: 199916 - DNA, 2769 bp, Homo sapiens
  Payload ID: 19436
  Gene Name: WD repeat domain 60
  ENST ID: ENST00000444851
  CDS Start-End: 1-1569
gacaacaaacaccgagaaaaaagcagcacaagggaaaaaagagagaaatattccaaagagaaaagtaattcattctctgacaaaggggaagaaagacataaagaaaagcgacacaaagaaggttttcattttgatgatgagaggcaccaaagcaacgtggatagaaaagagaaatcggcaaaagatgagcccaggaaaagggaatcccagaatggtgaacacagaaatcgaggtgcaagctcaaaaagagatgggaccagcagccagcatgctgagaatttagtaaggaatcatggaaaagataaagattcaagacggaagcatggccacgaggaaggctcttctgtgtggtggaagctggaccagaggccgggaggcgaggaaaccgtggaaattgaaaaggaagaaactgatttagaaaatgctagagctgatgcatatacagccagttgtgaagatgattttgaagactatgaagatgactttgaggtttgtgatggtgatgatgatgaaagcagtaatgaacctgagtcaagagaaaaactggaagaacttcctctagctcaaaaaaaggaaatacaagaaattcaaagagctattaatgcagaaaatgaaaggattggcgagttatctttgaaactgtttcagaagcgaggtagaacagaatttgaaaaggagcccaggacagatacaaacagttccccttccagagcctctgtttgtggaatttttgtggattttgcctcagcttcacaccgtcaaaagagtcggactcaggcccttaagcaaaagatgcgaagtacaaaactgcttcggctcattgacttagatttttcatttactttctctctcttggatctaccaccagtaaatgaatatgacatgtatatcagaaactttgggaaaaaaaataccaagcaggcatatgttcagtgtaacgaagataatgttgaaagagacattcaaacggaggaaatagagaccagggaagtgtggacccagcacccgggagaaagtactgttgtatctggaggcagtgaacaaagagatacctctgatgctgtagttatgccaaagattgatactccaaggttatgtagctttctgcgggctgcttgtcaggtgatggccgttttgctggaagaggatcgcttggcagctgaacccagctggaatcttagggctcaagacagggccctgtattttagtgacagctcatctcagctgaacaccagtctaccattccttcaaagtcacgtgttgctgcttgagccctttgaaagcatttttactgtttgccggaacagcgcacggctcagttgtcgtctgggatttgagagaagactcaaggctgcattactctgtgacgctgagcgatggcttctggacgttccggaccgccacgttttccaccgatggaatccttacctcagtaaaccaccgaagccctcttcaagcagtagaacctatctcaacgtccgtccacaaaaagcagagctttgtgctttcacccttttctactcaagaagaaatgtcaggtttgtccttccacatcgcttccttggatgagagtggggttctcaatgtatgggtggttgttgaattaccaaaggcagacatcgcaggttcaataagtgatttaggtctgatgcctggagggagggtcaagctggtacatagtgctctgatccagttgggtgacagtctttcccataaaggtaatgaattttggggcactacacaaacactgaatgttaaatttctgccttcagatcctaatcactttattattggcacagacatgggtctcataagccatggcacaagacaagatttgagagtggctcccaaactattcaaacctcagcaacatggtataagaccagtgaaagttaatgtcattgatttttcaccatttggagaaccaatatttttggccggctgttcggacggaagcatcaggctgcaccagctgagctccgcgtttccgctcctgcagtgggacagcagcacggacagccatgcggtcaccggcctgcagtggtccccaaccaggcctgccgtgttcctggtgcaggacgacacatccaacatctacatctgggacctcctccagagcgatctgggtcctgtcgccaaacagcaggtctcccccaacaggctggtggccatggctgcggtgggtgagcctgagaaggctggtggcagcttcctggccctggtgctggccagggcgtctggctccatcgacatccagcacctgaagaggcggtgggcggccccggaggtggacgagtgcaacaggctgcgtctgcttttgcaggaagccctgtggccagagggaaaactgcacaagtagcgggtgtggctgagaggaccgcgtttctgtaatgacccagatttaaaagacataaggtggataattctacatttgtgtgcaagtatatttatgtatatagactatgtatattctgtatataatttattttacatgaatatgtctttggtattcccagtaaatagatgactacttttgagtggaaacaaagaacattctagcatttacaaaacttccaggggaatgtagagccacgtccagggtgctcttttctgagagtatttcgagttatttttagaacagtttaaatattgtcacattactgctagattttaaacagcctaccatgaaaatgtatcttaatgaactattttcttatgcataaagtatgtgaacacatgtctaaattaaaaggaattactccaccgaaa

SEQ ID NO: 199917 - DNA, 812 bp, Homo sapiens
  Payload ID: 19436
  Gene Name: WD repeat domain 60
  ENST ID: ENST00000454771
  CDS Start-End: 1-591
tcagatcctaatcactttattattggcacagacatgggtctcataagccatggcacaagacaagatttgagagtggctcccaaactattcaaacctcagcaacatggtataagaccagtgaaagttaatgtcattgatttttcaccatttggagaaccaatatttttggccggctgttcggacggaagcatcaggctgcaccagctgagctccgcgtttccgctcctgcagtgggacagcagcacggacagccatgcggtcaccggcctgcagtggtccccaaccaggcctgccgtgttcctggtgcaggacgacacatccaacatctacatctgggacctcctccagagcgatctgggtcctgtcgccaaacagcaggtctcccccaacaggctggtggccatggctgcggtgggtgagcctgagaaggctggtggcagcttcctggccctggtgctggccagggcgtctggctccatcgacatccagcacctgaagaggcggtgggcggccccggaggtggacgagtgcaacaggctgcgtctgcttttgcaggaagccctgtggccagagggaaaactgcacaagtagcgggtgtggctgagaggaccgcgtttctgtaatgacccagatttaaaagacataaggctgtgatgccacaaagcaaatgaagaggcgagaaggcgacagggcttggagccggaacctcagcttgatgcccagatctgtggagcagccctgtccccaggcaagtcgccgactgcttcagatcccagtgcccggtggggactatacgtgccctgcttacctcc

SEQ ID NO: 199918 - DNA, 1387 bp, Homo sapiens
  Payload ID: 19437
  Gene Name: WD repeat domain 61
  Uniprot ID: Q9GZS3
  ENST ID: ENST00000267973
  CDS Start-End: 273-1190
aaatttccaactaccactcctctggaagcaggacctggcttcctccctcctctctccgcccaccctcgtcggcgtctgccccgcgcccgccatagcgacggcaacgggcgctgcggagtgctccgagccgtgagggcggggccggcgcgatgccccgccccttcgatagctcatctttgcgcgtcgcagtcgcgcggagcccggcttccgacgtgcagcctggcagtgcagtgagctgtctggccttttgtccttgatccttggttaaggaaatgaccaaccagtacggtattctcttcaaacaagagcaagcccatgatgatgccatttggtcagttgcttgggggacaaacaagaaggaaaactctgagacagtggtcacaggctccctagatgacctggtgaaggtctggaaatggcgtgatgagaggctggacctacagtggagtctggagggacatcagctgggagtggtgtctgtggacatcagccacaccctgcccattgctgcatccagctctcttgatgctcatattcgtctttgggacttggaaaatggcaaacagataaagtccatagatgcaggacctgtggatgcctggactttggccttttctcctgattcccagtatctggccacaggaactcatgtcgggaaagtgaacatttttggtgtggaaagtgggaaaaaggaatattctttggacacgagaggaaaattcattcttagtattgcatatagtcctgatgggaaatacctagccagtggagccatagatggaatcatcaatatttttgatattgcaactggaaaacttctgcataccctggaaggccatgccatgcccattcgctccttgaccttttccccggactcccagctccttgtcactgcttcagatgatggctacatcaagatctatgatgtacaacatgccaatttggctggcacgctgagcggccatgcctcctgggtgctgaacgttgcattctgtcctgatgacactcactttgtttccagttcgtctgacaaaagtgtaaaagtttgggatgttggaacgaggacttgtgttcacaccttctttgatcaccaggatcaggtctggggagtaaaatacaatggaaatggttcaaaaattgtgtctgttggagatgaccaggaaattcacatctatgattgtccaatttaaacatcaaagtctccaggcttatgctgcaaagagaatgtacggattgatcatgacattccttaccttcttaggcttgtttaaaagaaatatagcatttattgtagcaaagacttaaattttgtagatacaatatgaatcttttcatgttttattggaaatgctgttcatactttaacataaagctttcttaatgcaaa

SEQ ID NO: 199919 - DNA, 884 bp, Homo sapiens
  Payload ID: 19437
  Gene Name: WD repeat domain 61
  ENST ID: ENST00000558459
  CDS Start-End: 70-708
gcttccgacgtgcagcctggcagtgcagtgagctgtctggccttttgtccttgatccttggttaaggaaatgaccaaccagtacggtattctcttcaaacaagagcaagtggatgcctggactttggccttttctcctgattcccagtatctggccacaggaactcatgtcgggaaagtgaacatttttggtgtggaaagtgggaaaaaggaatattctttggacacgagaggaaaattcattcttagtattgcatatagtcctgatgggaaatacctagccagtggagccatagatggaatcatcaatatttttgatattgcaactggaaaacttctgcataccctggaaggccatgccatgcccattcgctccttgaccttttccccggactcccagctccttgtcactgcttcagatgatggctacatcaagatctatgatgtacaacatgccaatttggctggcacgctgagcggccatgcctcctgggtgctgaacgttgcattctgtcctgatgacactcactttgtttccagttcgtctgacaaaagtgtaaaagtttgggatgttggaacgaggacttgtgttcacaccttctttgatcaccaggatcaggtctggggagtaaaatacaatggaaatggttcaaaaattgtgtctgttggagatgaccaggaaattcacatctatgattgtccaatttaaacatcaaagtctccaggcttatgctgcaaagagaatgtacggattgatcatgacattccttaccttcttaggcttgtttaaaagaaatatagcatttattgtagcaaagacttaaattttgtagatacaatatgaatcttttcatgttttattggaaatgctgttcatactttaac

SEQ ID NO: 199920 - DNA, 463 bp, Homo sapiens
  Payload ID: 19437
  Gene Name: WD repeat domain 61
  ENST ID: ENST00000558453
  CDS Start-End: 1-219
cttctgcataccctggaaggccatgccatgcccattcgctccttgaccttttccccggactcccagctccttgtcactgcttcagatgatggctacatcaagatctatgatgtgtgtcgcttcttgctgctctcaagccctactccccatgcttctgcttctagcttgctgggagctgggaaactgaccaagcatggaaaactacagcaatgctcataacaggctaaaaggctctggggaagaaggcatttcaacagcagaaaagaggaagaagagggagaagagaaaatggagaaacaagaaataagccaacacaaaagaggggtgaagaaaagagagggtgcaaaagagaacaaagtaaaaacaaaaacaaaacaaaaaggacaaacaaatccccaaagaactctccaacggcaggtttcctggatgctccacccttccttataataaagaaggaaatgga

SEQ ID NO: 199921 - DNA, 832 bp, Homo sapiens
  Payload ID: 19437
  Gene Name: WD repeat domain 61
  ENST ID: ENST00000560610
  CDS Start-End: 80-226
gcggagcccggcttccgacgtgcagcctggcagtgcagtgagctgtctggccttttgtccttgatccttggttaaggaaatgaccaaccagtacggtattctcttcaaacaagagcaagcccatgatgatgccatttggtcagttgcttgggggacaaacaagaaggaaaactctgagacagtggtcacaggctccctagatgacctggtgaaggtctggaaatgaccattggtattgcatagtcacagggacccagaatttcagatgccaggtaaagtgtgttctttgtgaagaaatccatttctctgtcccctgttgaaggcgtgatgagaggctggacctacagtggagtctggagggacatcagctgggagtggtgtctgtggacatcagccacaccctgcccattgctgcatccagctctcttgatgctcatattcgtctttgggacttggaaaatggcaaacagataaagtccatagatgcaggacctgtggatgcctggactttggccttttctcctgattcccagtatctggccacaggaactcatgtcgggaaagtgaacatttttggtgtggaaagtgggaaaaaggaatattctttggacacgagaggaaaattcattcttagtattgcatatagtcctgatgggaaatacctagccagtggagccatagatggaatcatcaatatttttgatattgcaactggaaaacttctgcataccctggaaggccatgccatgcccattcgctccttgaccttttccccggactcccagctccttgtcactgcttcagatgatggctacatcaagatctatgatgt

SEQ ID NO: 199922 - DNA, 756 bp, Homo sapiens
  Payload ID: 19437
  Gene Name: WD repeat domain 61
  ENST ID: ENST00000559848
  CDS Start-End: 76-645
agcccggcttccgacgtgcagcctggcagtgcagtgagctgtctggccttttgtccttgatccttggttaaggaaatgaccaaccagtacggtattctcttcaaacaagagcaagcccatgatgatgccatttggtcagttgcttgggggacaaacaagaaggaaaactctgagacagtggtcacaggctccctagatgacctggtgaaggtctggaaatggcgtgatgagaggctggacctacagtggagtctggagggacatcagctgggagtggtgtctgtggacatcagccacaccctgcccattgctgcatccagctctcttgatgctcatattcgtctttgggacttggaaaatggcaaacagataaagtccatagatgcaggacctgtggatgcctggactttggccttttctcctgattcccagtatctggccacaggaactcatgtcgggaaagtgaacatttttggtgtggaaagtgggaaaaaggaatattctttggacacgagaggaaaattcattcttagtattgcatatagtcctgatgggaaatacctagccagtggagccatagatggaatcatcaatatttttgatattgcaactggaaaacttctgcataccctggaaggtggatgaaagtattgtgcccactgtccacaccggtggcctctggaaaggaggactgggtagctaaagaacaggggccatgccatgcccattcgctccttgaccttttccccggactcc

SEQ ID NO: 199923 - DNA, 1266 bp, Homo sapiens
  Payload ID: 19437
  Gene Name: WD repeat domain 61
  Uniprot ID: Q9GZS3
  ENST ID: ENST00000558311
  CDS Start-End: 152-1069
tcgcgcggagcccggcttccgacgtgcagcctggcagtgcagtggggaacttcctgtgtgccttctatcctgatgacaccccctcactgaaatcctggtgttgtttccacagagctgtctggccttttgtccttgatccttggttaaggaaatgaccaaccagtacggtattctcttcaaacaagagcaagcccatgatgatgccatttggtcagttgcttgggggacaaacaagaaggaaaactctgagacagtggtcacaggctccctagatgacctggtgaaggtctggaaatggcgtgatgagaggctggacctacagtggagtctggagggacatcagctgggagtggtgtctgtggacatcagccacaccctgcccattgctgcatccagctctcttgatgctcatattcgtctttgggacttggaaaatggcaaacagataaagtccatagatgcaggacctgtggatgcctggactttggccttttctcctgattcccagtatctggccacaggaactcatgtcgggaaagtgaacatttttggtgtggaaagtgggaaaaaggaatattctttggacacgagaggaaaattcattcttagtattgcatatagtcctgatgggaaatacctagccagtggagccatagatggaatcatcaatatttttgatattgcaactggaaaacttctgcataccctggaaggccatgccatgcccattcgctccttgaccttttccccggactcccagctccttgtcactgcttcagatgatggctacatcaagatctatgatgtacaacatgccaatttggctggcacgctgagcggccatgcctcctgggtgctgaacgttgcattctgtcctgatgacactcactttgtttccagttcgtctgacaaaagtgtaaaagtttgggatgttggaacgaggacttgtgttcacaccttctttgatcaccaggatcaggtctggggagtaaaatacaatggaaatggttcaaaaattgtgtctgttggagatgaccaggaaattcacatctatgattgtccaatttaaacatcaaagtctccaggcttatgctgcaaagagaatgtacggattgatcatgacattccttaccttcttaggcttgtttaaaagaaatatagcatttattgtagcaaagacttaaattttgtagatacaatatgaatcttttcatgttttattggaaatgctgttcatactttaacataaagctttcttaatgcaaa

SEQ ID NO: 199924 - DNA, 1036 bp, Homo sapiens
  Payload ID: 19437
  Gene Name: WD repeat domain 61
  ENST ID: ENST00000560569
  CDS Start-End: 155-1036
agtgcagtggtgagttggagcgcagggccgttggggattggggtcattagggccgttgacagtccaggccagagggcgagtgagcgaggttgggcccgaggctgcctgtaagcagagctgtctggccttttgtccttgatccttggttaaggaaatgaccaaccagtacggtattctcttcaaacaagagcaagcccatgatgatgccatttggtcagttgcttgggggacaaacaagaaggaaaactctgagacagtggtcacaggctccctagatgacctggtgaaggtctggaaatggcgtgatgagaggctggacctacagtggagtctggagggacatcagctgggagtggtgtctgtggacatcagccacaccctgcccattgctgcatccagctctcttgatgctcatattcgtctttgggacttggaaaatggcaaacagataaagtccatagatgcaggacctgtggatgcctggactttggccttttctcctgattcccagtatctggccacaggaactcatgtcgggaaagtgaacatttttggtgtggaaagtgggaaaaaggaatattctttggacacgagaggaaaattcattcttagtattgcatatagtcctgatgggaaatacctagccagtggagccatagatggaatcatcaatatttttgatattgcaactggaaaacttctgcataccctggaaggccatgccatgcccattcgctccttgaccttttccccggactcccagctccttgtcactgcttcagatgatggctacatcaagatctatgatgtacaacatgccaatttggctggcacgctgagcggccatgcctcctgggtgctgaacgttgcattctgtcctgatgacactcactttgtttccagttcgtctgacaaaagtgtaaaagtttgggatgttggaacgaggacttgtgttcacaccttctttgatcaccaggatcaggtctggggagtaaaatacaatggaaatggttcaaaaattgtgtctgttggagat

SEQ ID NO: 199925 - DNA, 789 bp, Homo sapiens
  Payload ID: 19437
  Gene Name: WD repeat domain 61
  ENST ID: ENST00000560807
  CDS Start-End: 1-490
gaacatttttggtgtggaaagtgggaaaaaggaatattctttggacacgagaggaaaattcattcttagtattgcatatagtcctgatgggaaatacctagccagtggagccatagatggaatcatcaatatttttgatattgcaactggaaaacttctgcataccctggaaggccatgccatgcccattcgctccttgaccttttccccggactcccagctccttgtcactgcttcagatgatggctacatcaagatctatgatgtacaacatgccaatttggctggcacgctgagcggccatgcctcctgggtgctgaacgttgcattctgtcctgatgacactcactttgtttccagttcgtctgacaaaagtgtaaaagtttgggatgttggaacgaggacttgtgttcacaccttctttgatcaccaggatcaggtgtcgcttcttgctgctctcaagccctactccccatgcttctgcttctagcttgctgggagctgggaaactgaccaagcatggaaaactacagcaatgctcataacaggctaaaaggctctggggaagaaggcatttcaacagcagaaaagaggaagaagagggagaagagaaaatggagaaacaagaaataagccaacacaaaagaggggtgaagaaaagagagggtgcaaaagagaacaaagtaaaaacaaaaacaaaacaaaaaggacaaacaaatccccaaagaactctccaacggcaggtttcctggatgctccacccttccttataataaagaaggaaatgga

SEQ ID NO: 199926 - DNA, 4632 bp, Homo sapiens
  Payload ID: 19438
  Gene Name: WD repeat domain 62
  Uniprot ID: O43379
  ENST ID: ENST00000270301
  CDS Start-End: 1-4557
atggcggccgtagggtccggaggctatgcgcggaacgatgcaggggagaagctgccctctgtcatggcgggagttccggcgcggaggggccagtcctccccgccccccgccccaccaatctgcctacggcggcggacgcgactctcgacggcctccgaggagacggtgcagaaccgggtgtcactcgagaaggtgcttggcatcacagcccagaacagcagtggcctaacctgtgaccccggcacaggccatgtggcctacctggcaggctgtgtggtggtgattttggaccccaaggagaacaagcagcagcacatctttaacaccgccaggaagtctctcagtgctctggccttctcccctgatgggaagtacatagtgacaggggagaatgggcataggcctgctgtgcgcatctgggatgtggaggagaagaatcaggtggcggagatgctaggccacaagtatggtgtggcgtgtgtggccttctcacccaatatgaagcacatcgtgtccatgggctaccaacatgacatggtgctcaacgtctgggactggaagaaagacatcgtagtggcctccaacaaggtatcttgtagagtcattgccctctccttctcagaggacagcagctattttgtcactgttgggaaccgccatgtgaggttctggttcttggaagtctccactgagacaaaggtgacgagcacagtgccccttgtagggcgctcgggcatcctgggcgagctgcacaacaacatcttctgtggtgtggcctgcggtcggggccggatggcgggcagtaccttctgtgtgtcctactcgggcctcctctgccagttcaatgagaagagggtgctggagaagtggatcaacctgaaggtctccctgtcttcctgcctctgtgtcagccaggagctcatcttctgtggctgcacagatgggatagtccgcatcttccaggcccatagcctgcactacctcgccaacctgcccaagccacactaccttggggtagacgtggcacagggcctggagcccagcttcctcttccacaggaaggcggaagcagtctacccagatacagtggcactgaccttcgaccccatccaccagtggctgtcctgcgtgtataaggaccacagcatctacatctgggatgtcaaggacatcaacagagtgggcaaggtgtggtcagagctcttccacagctcctacgtttggaacgtggaggtgtatcctgagtttgaagaccagagagcttgtttgccatcaggatcctttctgacttgttcttcagacaacaccattcgcttctggaacttggacagcagccctgattctcactggcagaaaaacatcttcagcaataccctgctgaaggtcgtgtacgtggagaatgacatccagcacctgcaggacatgtcacacttcccagaccgggggagcgagaatgggacacccatggacgtgaaagccggggtgcgggtcatgcaggtcagtcctgacggccagcatttggcttcaggcgaccgaagtggaaatctgaggatccacgagctgcacttcatggacgagctggtcaaggtggaggcccatgatgctgaggtgctgtgcctggagtactccaagccagagacggggctgaccttgctggcctcagccagtcgggaccggctgatccatgtgctgaacgtggagaagaactacaacctggagcagacgctggatgaccactcctcctccatcaccgccatcaagttcgctggcaacagagacatccagatgatcagctgtggggctgacaagagcatctactttcgcagtgcccagcagggttcggatggactacactttgtccgtacccaccacgtagcagagaaaaccaccttgtatgacatggacattgacatcacccagaagtacgtggccgtggcctgccaggaccgcaatgtgagagtctacaacactgtgaacgggaagcagaagaagtgctacaagggctcccagggtgacgaagggtccttgctgaaggtccatgtggacccctcaggcaccttcctggccaccagctgctctgacaaaagcatctcagtgattgacttttactcgggcgagtgcattgccaagatgtttggccattcagaaattattaccagcatgaagttcacctatgactgtcatcacttgatcacagtatctggagacagctgcgtgttcatctggcacctgggcccggagatcaccaactgcatgaagcagcacttgctggagattgaccaccggcagcagcagcagcacacaaatgacaagaagcggagtggccaccccaggcaggatacgtatgtgtccacacctagtgagattcactccctgagccctggagagcaaacagaggatgatctggaggaagagtgtgagccagaagagatgctgaagacaccatccaaagatagcttggatccagatcctcgttgcctgctaaccaacggcaagctgccactgtgggcaaagcggctgctaggggacgatgatgtggcagatggcttggccttccacgccaagcgcagctaccagccccacggccgctgggcagagcgggccggccaagagcccctcaagaccatcctggatgcccaggacctggattgctactttacccccatgaagcccgagagtctggagaactccattctggattcactggagccacagagcctggccagcctgctgagtgagtcagagagtccccaggaagctggccgcgggcacccctccttcctgccccagcagaaggaatcatctgaggccagtgagctcatcctctactctctggaggcagaagtgacagtcacagggacagacagccagtattgcaggaaggaggtggaggccgggcctggagaccagcagggcgactcctacctcagggtgtcctccgacagcccaaaggaccagagcccgcctgaggactcgggggagtcagaggccgacctggagtgcagcttcgcagccatccactccccagctccgcctcctgaccctgcccctcggtttgccacgtcgctgccccatttcccaggatgcgcaggtcccacagaagatgagctgtccctgcccgagggacccagcgtccccagcagctccctaccccagactccggagcaggagaagttcctccgccaccactttgagacactgactgagtccccctgcagagctctgggagacgtggaggcctctgaagctgaagaccacttcttcaacccacgcctgagtatctccacgcagttcctctcaagcctccagaaggcatccaggttcacccataccttccctccccgggcaacccagtgccttgtgaagtctccagaggtcaagctcatggaccgaggcggaagccagcccagagcaggtactggctacgcctccccagacaggacccacgtcctcgctgcagggaaggctgaagagaccctggaggcctggcgcccaccacctccctgccttacgagcctggcgtcctgtgtccctgcttcctccgtgctgcccacagacaggaatctcccaacgcccacatctgcacccaccccaggcctggctcagggtgtccatgccccctccacctgttcctacatggaggccactgccagctcccgtgccaggatatcacgcagcatctccctcggtgacagtgagggccctatcgtggccacactggcccagcccctccgtaggccatcgtccgttggggagctggcctccttgggccaggagcttcaggccatcaccaccgcgacaacacccagtttggacagtgagggccaagagcctgccctgcgttcctggggcaaccacgaggcccgggccaacctgagactgaccctgtcaagtgcctgtgatgggctcctgcagccccccgtggatacccagcctggcgtcaccgtccctgcagtgagcttcccagcccctagccctgtggaagagagcgccctgaggctccacggctctgcctttcgcccaagtctcccagctcctgagtcccctggccttcctgcccaccccagtaacccccagcttccagaggcccggcctggcatccctggcggcactgcctccctcctggagcccacctccggtgcacttggtctgttacagggcagccctgcccgctggagtgagccctgggtgccggttgaagccctgcccccatctccccttgagctgagcagggtggggaacatcttgcacaggctgcagaccaccttccaagaagccctcgacctttaccgtgtgttggtctccagtggccaggtggacaccgggcagcagcaggcacggactgagctggtctccaccttcctgtggatccacagccagctggaggctgaatgcctggtggggactagtgtggccccagcccaggctctgcccagcccaggacccccgtccccaccgacgctgtaccccctggccagcccagacctgcaggccctgctggaacactactcggagctgctggtgcaggccgtgcggaggaaggcacgggggcactgagggcgcagcccctccaccgcagccctgctgcttctgaggacttaggtattttaagcgaataaactgacagctttg

SEQ ID NO: 199927 - DNA, 4682 bp, Homo sapiens
  Payload ID: 19438
  Gene Name: WD repeat domain 62
  Uniprot ID: O43379
  ENST ID: ENST00000401500
  CDS Start-End: 36-4607
aggggatgtaacggtcgcccgcctccggcgtgacgatggcggccgtagggtccggaggctatgcgcggaacgatgcaggggagaagctgccctctgtcatggcgggagttccggcgcggaggggccagtcctccccgccccccgccccaccaatctgcctacggcggcggacgcgactctcgacggcctccgaggagacggtgcagaaccgggtgtcactcgagaaggtgcttggcatcacagcccagaacagcagtggcctaacctgtgaccccggcacaggccatgtggcctacctggcaggctgtgtggtggtgattttggaccccaaggagaacaagcagcagcacatctttaacaccgccaggaagtctctcagtgctctggccttctcccctgatgggaagtacatagtgacaggggagaatgggcataggcctgctgtgcgcatctgggatgtggaggagaagaatcaggtggcggagatgctaggccacaagtatggtgtggcgtgtgtggccttctcacccaatatgaagcacatcgtgtccatgggctaccaacatgacatggtgctcaacgtctgggactggaagaaagacatcgtagtggcctccaacaaggtatcttgtagagtcattgccctctccttctcagaggacagcagctattttgtcactgttgggaaccgccatgtgaggttctggttcttggaagtctccactgagacaaaggtgacgagcacagtgccccttgtagggcgctcgggcatcctgggcgagctgcacaacaacatcttctgtggtgtggcctgcggtcggggccggatggcgggcagtaccttctgtgtgtcctactcgggcctcctctgccagttcaatgagaagagggtgctggagaagtggatcaacctgaaggtctccctgtcttcctgcctctgtgtcagccaggagctcatcttctgtggctgcacagatgggatagtccgcatcttccaggcccatagcctgcactacctcgccaacctgcccaagccacactaccttggggtagacgtggcacagggcctggagcccagcttcctcttccacaggaaggcggaagcagtctacccagatacagtggcactgaccttcgaccccatccaccagtggctgtcctgcgtgtataaggaccacagcatctacatctgggatgtcaaggacatcaacagagtgggcaaggtgtggtcagagctcttccacagctcctacgtttggaacgtggaggtgtatcctgagtttgaagaccagagagcttgtttgccatcaggatcctttctgacttgttcttcagacaacaccattcgcttctggaacttggacagcagccctgattctcactggcagaaaaacatcttcagcaataccctgctgaaggtcgtgtacgtggagaatgacatccagcacctgcaggacatgtcacacttcccagaccgggggagcgagaatgggacacccatggacgtgaaagccggggtgcgggtcatgcaggtcagtcctgacggccagcatttggcttcaggcgaccgaagtggaaatctgaggatccacgagctgcacttcatggacgagctggtcaaggtggaggcccatgatgctgaggtgctgtgcctggagtactccaagccagagacggggctgaccttgctggcctcagccagtcgggaccggctgatccatgtgctgaacgtggagaagaactacaacctggagcagacgctggatgaccactcctcctccatcaccgccatcaagttcgctggcaacagagacatccagatgatcagctgtggggctgacaagagcatctactttcgcagtgcccagcagggttcggatggactacactttgtccgtacccaccacgtagcagagaaaaccaccttgtatgacatggacattgacatcacccagaagtacgtggccgtggcctgccaggaccgcaatgtgagagtctacaacactgtgaacgggaagcagaagaagtgctacaagggctcccagggtgacgaagggtccttgctgaaggtccatgtggacccctcaggcaccttcctggccaccagctgctctgacaaaagcatctcagtgattgacttttactcgggcgagtgcattgccaagatgtttggccattcagaaattattaccagcatgaagttcacctatgactgtcatcacttgatcacagtatctggagacagctgcgtgttcatctggcacctgggcccggagatcaccaactgcatgaagcagcacttgctggagattgaccaccggcagcagcagcagcacacaaatgacaagaagcggagtggccaccccaggcaggatacgtatgtgtccacacctagtgagattcactccctgagccctggagagcaaacagaggatgatctggaggaagagtgtgagccagaagagatgctgaagacaccatccaaagatagcttggatccagatcctcgttgcctgctaaccaacggcaagctgccactgtgggcaaagcggctgctaggggacgatgatgtggcagatggcttggccttccacgccaagcgcagctaccagccccacggccgctgggcagagcgggccggccaagagcccctcaagaccatcctggatgcccaggacctggattgctactttacccccatgaagcccgagagtctggagaactccattctggattcactggagccacagagcctggccagcctgctgagtgagtcagagagtccccaggaagctggccgcgggcacccctccttcctgccccagcagaaggaatcatctgaggccagtgagctcatcctctactctctggaggcagaagtgacagtcacagggacagacagccagtattgcaggaaggaggtggaggccgggcctggagaccagcagggcgactcctacctcagggtgtcctccgacagcccaaaggaccagagcccgcctgaggactcgggggagtcagaggccgacctggagtgcagcttcgcagccatccactccccagctccgcctcctgaccctgcccctcggtttgccacgtcgctgccccatttcccaggatgcgcaggtcccacagaagatgagctgtccctgcccgagggacccagcgtccccagcagctccctaccccagactccggagcaggagaagttcctccgccaccactttgagacactgactgagtccccctgcagagagctcttccccgcagctctgggagacgtggaggcctctgaagctgaagaccacttcttcaacccacgcctgagtatctccacgcagttcctctcaagcctccagaaggcatccaggttcacccataccttccctccccgggcaacccagtgccttgtgaagtctccagaggtcaagctcatggaccgaggcggaagccagcccagagcaggtactggctacgcctccccagacaggacccacgtcctcgctgcagggaaggctgaagagaccctggaggcctggcgcccaccacctccctgccttacgagcctggcgtcctgtgtccctgcttcctccgtgctgcccacagacaggaatctcccaacgcccacatctgcacccaccccaggcctggctcagggtgtccatgccccctccacctgttcctacatggaggccactgccagctcccgtgccaggatatcacgcagcatctccctcggtgacagtgagggccctatcgtggccacactggcccagcccctccgtaggccatcgtccgttggggagctggcctccttgggccaggagcttcaggccatcaccaccgcgacaacacccagtttggacagtgagggccaagagcctgccctgcgttcctggggcaaccacgaggcccgggccaacctgagactgaccctgtcaagtgcctgtgatgggctcctgcagccccccgtggatacccagcctggcgtcaccgtccctgcagtgagcttcccagcccctagccctgtggaagagagcgccctgaggctccacggctctgcctttcgcccaagtctcccagctcctgagtcccctggccttcctgcccaccccagtaacccccagcttccagaggcccggcctggcatccctggcggcactgcctccctcctggagcccacctccggtgcacttggtctgttacagggcagccctgcccgctggagtgagccctgggtgccggttgaagccctgcccccatctccccttgagctgagcagggtggggaacatcttgcacaggctgcagaccaccttccaagaagccctcgacctttaccgtgtgttggtctccagtggccaggtggacaccgggcagcagcaggcacggactgagctggtctccaccttcctgtggatccacagccagctggaggctgaatgcctggtggggactagtgtggccccagcccaggctctgcccagcccaggacccccgtccccaccgacgctgtaccccctggccagcccagacctgcaggccctgctggaacactactcggagctgctggtgcaggccgtgcggaggaaggcacgggggcactgagggcgcagcccctccaccgcagccctgctgcttctgaggacttaggtattttaagcgaataaactgacagctttg

SEQ ID NO: 199928 - DNA, 955 bp, Homo sapiens
  Payload ID: 19438
  Gene Name: WD repeat domain 62
  ENST ID: ENST00000427823
  CDS Start-End: 1-955
ggaggctatgcgcggaacgatgcaggggagaagctgccctctgtcatggcgggagttccggcgcggaggggccagtcctccccgccccccgccccaccaatctgcctacggcggcggacgcgactctcgacggcctccgaggagacggtgcagaaccgggtgtcactcgagaaggtgcttggcatcacagcccagaacagcagtggcctaacctgtgaccccggcacaggccatgtggcctacctggcaggaatgtggagaatggggcctgcctctgagagctgtggagaggattccatagccccctctctgtctagaacagttcctggcatgtactgtgtggtggtgattttggaccccaaggagaacaagcagcagcacatctttaacaccgccaggaagtctctcagtgctctggccttctcccctgatgggaagtacatagtgacaggggagaatgggcataggcctgctgtgcgcatctgggatgtggaggagaagaatcaggtggcggagatgctaggccacaagtatggtgtggcgtgtgtggccttctcacccaatatgaagcacatcgtgtccatgggctaccaacatgacatggtgctcaacgtctgggactggaagaaagacatcgtagtggcctccaacaaggtatcttgtagagtcattgccctctccttctcagaggacagcagctattttgtcactgttgggaaccgccatgtgaggttctggttcttggaagtctccactgagacaaaggtgacgagcacagtgccccttgtagggcgctcgggcatcctgggcgagctgcacaacaacatcttctgtggtgtggcctgcggtcggggccggatggcgggcagtaccttctgtgtgtcctactcgggcctcctctgccagttcaatgagaagagggtgctggagaagtggatcaacctgaaggtctccc

SEQ ID NO: 199929 - DNA, 5971 bp, Homo sapiens
  Payload ID: 19438
  Gene Name: WD repeat domain 62
  Uniprot ID: O43379
  ENST ID: ENST00000587391
  CDS Start-End: 10-1461
ggcgtgacgatggcggccgtagggtccggaggctatgcgcggaacgatgcaggggagaagctgccctctgtcatggcgggagttccggcgcggaggggccagtcctccccgccccccgccccaccaatctgcctacggcggcggacgcgactctcgacggcctccgaggagacggtgcagaaccgggtgtcactcgagaaggtgcttggcatcacagcccagaacagcagtggcctaacctgtgaccccggcacaggccatgtggcctacctggcaggctgtgtggtggtgattttggaccccaaggagaacaagcagcagcacatctttaacaccgccaggaagtctctcagtgctctggccttctcccctgatgggaagtacatagtgacaggggagaatgggcataggcctgctgtgcgcatctgggatgtggaggagaagaatcaggtggcggagatgctaggccacaagtatggtgtggcgtgtgtggccttctcacccaatatgaagcacatcgtgtccatgggctaccaacatgacatggtgctcaacgtctgggactggaagaaagacatcgtagtggcctccaacaaggtatcttgtagagtcattgccctctccttctcagaggacagcagctattttgtcactgttgggaaccgccatgtgaggttctggttcttggaagtctccactgagacaaaggtgacgagcacagtgccccttgtagggcgctcgggcatcctgggcgagctgcacaacaacatcttctgtggtgtggcctgcggtcggggccggatggcgggcagtaccttctgtgtgtcctactcgggcctcctctgccagttcaatgagaagagggtgctggagaagtggatcaacctgaaggtctccctgtcttcctgcctctgtgtcagccaggagctcatcttctgtggctgcacagatgggatagtccgcatcttccaggcccatagcctgcactacctcgccaacctgcccaagccacactaccttggggtagacgtggcacagggcctggagcccagcttcctcttccacaggaaggcggaagcagtctacccagatacagtggcactgaccttcgaccccatccaccagtggctgtcctgcgtgtataaggaccacagcatctacatctgggatgtcaaggacatcaacagagtgggcaaggtgtggtcagagctcttccacagctcctacgtttggaacgtggaggtgtatcctgagtttgaagaccagagagcttgtttgccatcaggatcctttctgacttgttcttcagacaacaccattcgcttctggaacttggacagcagccctgattctcactggcagaaaaacatcttcagcaatttggctcctgctctgcagatgtgtggacgtggccactcccggcagcccaacacacccagcccaggtgaaattgcttcctaagtcttgagatggaattccctgggagagcacctgatgagccagcccattcagctgccacacaaccctgctgaaggtcgtgtacgtggagaatgacatccagcacctgcaggacatgtcacacttcccagaccgggggagcgagaatgggacacccatggacgtgaaagccggggtgcgggtcatgcaggtcagtcctgacggccagcatttggcttcaggcgaccgaagtggaaatctgaggatccacgagctgcacttcatggacgagctggtcaaggtggaggcccatgatgctgaggtgctgtgcctggagtactccaagccagagacggggctgaccttgctggcctcagccagtcgggaccggctgatccatgtgctgaacgtggagaagaactacaacctggagcagacgctggatgaccactcctcctccatcaccgccatcaagttcgctggcaacagagacatccagatgatcagctgtggggctgacaagagcatctactttcgcagtgcccagcagggttcggatggactacactttgtccgtacccaccacgtagcagagaaaaccaccttgtatgacatggacattgacatcacccagaagtacgtggccgtggcctgccaggaccgcaatgtgagagtctacaacactgtgaacgggaagcagaagaagtgctacaagggctcccagggtgacgaagggtccttgctgaaggtccatgtggacccctcaggcaccttcctggccaccagctgctctgacaaaagcatctcagtgattgacttttactcgggcgagtgcattgccaagatgtttggccattcagaaattattaccagcatgaagttcacctatgactgtcatcacttgatcacagtatctggagacagctgcgtgttcatctggcacctgggcccggagatcaccaactgcatgaagcagcacttgctggagattgaccaccggcagcagcagcagcacacaaatgacaagaagcggagtggccaccccaggcaggatacgtatgtgtccacacctagtgagattcactccctgagccctggagagcaaacagaggatgatctggaggaagagtgtgagccagaagagatgctgaagacaccatccaaagatagcttggatccagatcctcgttgcctgctaaccaacggcaagctgccactgtgggcaaagcggctgctaggggacgatgatgtggcagatggcttggccttccacgccaagcgcagctaccagccccacggccgctgggcagagcgggccggccaagagcccctcaagaccatcctggatgcccaggacctggattgctactttacccccatgaagcccgagagtctggagaactccattctggattcactggagccacagagcctggccagcctgctgagtgagtcagagagtccccaggaagctggccgcgggcacccctccttcctgccccagcagaaggaatcatctgaggccagtgagctcatcctctactctctggaggcagaagtgacagtcacagggacagacagccagtattgcaggaaggaggtggaggccgggcctggagaccagcagggcgactcctacctcagggtgtcctccgacagcccaaaggaccagagcccgcctgagggtgagtgcagggcaggcagggaccctgtgacagtctgtgcgttcagccaagcccctttctgggcaccgatggtgactttgacccagtactgaagctcagagtctgtcgaggaagacacatgtggtccctgctgctgcctgaggattctgggcccagctgcctacagctgagagcccagctctgccacctccttgatgtggaacttcccttattcataaaatggggggcagctgctcttaccatccctcctccagatggggaaactgagcccagggaagggtagccctggccctggctcaccagaatggtcaggctgtgggctcctgaccccgactctgtccttcagactcgggggagtcagaggccgacctggagtgcagcttcgcagccatccactccccagctccgcctcctgaccctgcccctcggtttgccacgtcgctgccccatttcccaggtaagcaggggccagacacgcaggggactcgctgctcgggcctggcttagggccagtcacaatgtctaagcacaggccctgcacttggagcccactgagcctggaagacggggatccctgcttctcagcctgcgggcaacagggcagggatgggtggggcccgctttctccatttcaggtggcgtctgctgtgactcatggtgttggctcctcttgtccctcccctccttccctgtcaggatgcgcaggtcccacagaagatgagctgtccctgcccgagggacccagcgtccccagcagctccctaccccagactccggagcaggagaagttcctccgccaccactttgagacactgactgagtccccctgcagaggtagggccctgcctcacccacacctgccgaggccgtctgtgcagcctgggcacagcattggcgtccctggagttggctccccagcagggccaggagggtgagtggagagcaactgcttcgttttttttgagacggagtctcgctctgttgccaggctggagtgcggtggcccaatcttggctcactgcaacctccgactccctggttcaagcaattctcctgcctcagcctcctgagtagctgggattataggcatccacaaccacgccctgctaattttttgtatttttagtagagatgaggtttcaccatgttggccagactggtctcaaactcctgcctcagatgatctgcccgccttggcctcccaaagtgctgggattacaggcgtgagccaccgtgcccggcccactgcttcactcttgacctgagcctcacgatgcctcctcacccactgcccctgctcgtaccctgtgtctgtacataagggtttctggggagtgccccgctgggctgtgggctggcctagggccagggctgctcggcgggaagggttatgagggtcccctcgggatcttcccctagagctcttccccgcagctctgggagacgtggaggcctctgaagctgaagaccacttcttcaacccacgcctgagtatctccacgcagttcctctcaagcctccagaaggcatccaggttcacccataccttccctccccgggcaacccagtgccttgtgaagtctccagaggtcaagctcatggaccgaggcggaagccagcccagagcaggtactggctacgcctccccagacaggacccacgtcctcgctgcagggaaggctgaagagaccctggaggcctggcgcccaccacctccctgccttacgagcctggcgtcctgtgtccctgcttcctccgtgctgcccacagacaggaatctcccaacgcccacatctgcacccaccccaggcctggctcagggtgtccatgccccctccacctgttcctacatggaggccactgccagctcccgtgccaggatatcacgcagcatctccctcggtgacagtgagggccctatcgtggccacactggcccagcccctccgtaggccatcgtccgttggggagctggcctccttgggccaggagcttcaggccatcaccaccgcgacaacacccagtttggacagtgagggccaagagcctgccctgcgttcctggggcaaccacgaggcccgggccaacctgagactgaccctgtcaagtgcctgtgatgggctcctgcagccccccgtggatacccagcctggcgtcaccgtccctgcagtgagcttcccagcccctagccctgtggaagagagcgccctgaggctccacggctctgcctttcgcccaagtctcccagctcctgagtcccctggccttcctgcccaccccagtaacccccagcttccagaggcccggcctggcatccctggcggcactgcctccctcctggagcccacctccggtgcacttggtctgttacagggcagccctgcccgctggagtgagccctgggtgccggttgaagccctgcccccatctccccttgagctgagcagggtggggaacatcttgcacaggctgcagaccaccttccaagaagccctcgacctttaccgtgtgttggtctccagtggccaggtggacaccgggcagcagcaggcacggactgagctggtctccaccttcctgtggatccacagccagctggaggctgaatgcctggtggggactagtgtggccccagcccaggctctgcccagcccaggacccccgtccccaccgacgctgtaccccctggccagcccagacctgcaggccctgctggaacactactcggagctgctggtgcaggccgtgcggaggaaggcacgggggcactgagggcgcagcccctccaccgcagccctgctgcttctgaggacttaggtattttaagcgaataaactgacagctttgagg

SEQ ID NO: 199930 - DNA, 2995 bp, Homo sapiens
  Payload ID: 19439
  Gene Name: WD repeat domain 63
  Uniprot ID: Q8IWG1
  ENST ID: ENST00000294664
  CDS Start-End: 181-2856
agcgacagatgcgtcctggcaacagtcggcagagttgctgcggtttgtgcccttgcgatttctttttctgagagaggagagtcaaactcccacctccagctctcgaaggagcttttcctgagggcactgcaaagaggctccttttctttcagatcagcagtatcagcccaagtcagaaccatggctccaaaacaaaagaaaaagacatcacgtggcaaaaaaagactaaaaccagtattagctgctagtgaagacatggaaccagtaaatatggagagcatgggtcatccagaaatttatcctttagtattaaccaccaagacccaagaaatatttaactgccgaatagatgaagatgtcacagatgaacaaccttataagcttatcaataaagaagacatttttgaggacctgcgcaacagagctgcagtatctgatttccacccagtcaaaaaaattgtccaggaatatcctggaaatgagcttctgcttgtttatgacaaagacttcaaatatggacttaacttttatcttattgcaactgaagagggcaaagaaaactatttaaatcccccagaagtaccagaagaacaagaagaatataaagaacatattcctgaagatgtgtatatttataaaccacctgtctctaaaccatgggtttctttgggcagtgaaaaagaaattgaggaagaatcagttacggaatctacaaagcagattacatatatgatttctcgaaaacgaagtgaatttggtgcaccaattaagttcagtgaccagaatgcttccagtgtaaaagatgcctatattgaatgtacagcctacccagataaaaattttacccttaaacaacttgaaaaagatgttggcatgcaagtaatcccccaaataaaggacataagcactcagacaaaatggacatatcctaaaaatgctactacgcaatattatccaagagaattctcagaagaggaaaaagagacactcaaacaatcaaagcctttggttgattttcttaacaatgcatccataagtgttgaaatagccctgcagcaaaatgaaatcatgaacacatttattgatgactggaaatacctcgcagaagaagaaggcacctttggggacaagaccgatacccacctgaaagagtaccagtcctttaccgaccttcatagcccaacggagaaaatgattacctgtgtctcatggcatccaactatctatgggctaatagctgtgtcggtagccgtgcgactttcttttgaagacagagttcacttttctggtaaattattgctgcagccatcactgattcttttctggagcttctctgatcctatacatcctcagttaatgctggagagcccagatgacatcttctgcttcaagttctgtccgagtgatcctaatatcattgctggaggctgtatcaatgggcagattgtcatgtgggatatcaccgcacatgcagatcgcatagaaaacattaaggcaggtggtagtagaagtaaaagagccacactgaagcctatgtttctccttgaaccggagagtaataaagaagcaatgtatatcagacactgtgcagtctcttcaatagaaaatggacataagaaagtaattacagatatacactggttgtctgacacatttgagattaacagaatgggctccgtctttgagaatcgaagtggaatatgctgtcaacttgtcacatgttcagcagattgcacaatatgtttttgggatattagaccacagaaacctttaaccccccaaacaacagagaaaaagaaggaggaaagtattgaaattccttttgatgtaccatctacttttttgcatctggatctctcctggaaacctctcactaaggtaaggctgtccaagggtgaaacaagtttagaccactgtccaaccaagataagcctgaatgaagaccatcttctttgcaaaacacaagacaaaatgttagcacagagcaaaacagagaaggcagaagaaatgaacccgtatcataatctggaaagtgggatggccaatcttctcaagccaatagatgacttctgcacaaagttctttgtgggaacagaggaaggcgaagtgatatacacagattggaaaatggaaaaagaccctgaaactggccgacttatgtcaaagaagccagtgagccaccacaccattcacgacggaactgtccacactattcagagatcacctttctacaacgacattattctcacggttggaggttggaacgtggccatatggaaagaaggtgttatgactggaccgctccttcagtcatgctgtgcaccaaaaaggtacacctcaggccactggtccctgactcggcccggagttttctacatcggccgagaagatggatacattgatatctgggaccttctggagaaaacccatgaaccagcccagtctcaaaacatttgcataactatgatcacctacatcaaaccctggatcttttcttctaaacagcaatttatagccacagctgattattatggaacactgcatatattagaaattccttggacattaagtcgcccttccaccaatgagatggcaagtgtcaaccactattttgaaagagaagtcaagcatctggaatacgtagaacagcgcaaaaaaattcgtgagcaagaaaagaaagaaatggaactagaaatggcaaagaaaaaagttaaaacatatcagaagtcaaaagaacaaatgcaggctgaattaaaaatggactatgagagttatctggaactggaaaagactgttcttatcaaccttggcctaatcaaagtcacagagaaggggtcatacatggaggtgatgtaaaaaagcttcctgaaggggtgttttggggacttcttccctctatttatttttatgtcaggtgaactggcatgctgaacatatatatatataggctcatttatagacttttatttccctgctattaaaacttttgaatttt

SEQ ID NO: 199931 - DNA, 2888 bp, Homo sapiens
  Payload ID: 19439
  Gene Name: WD repeat domain 63
  Uniprot ID: Q8IWG1
  ENST ID: ENST00000326813
  CDS Start-End: 190-2748
ttttctcttagcgacagatgcgtcctggcaacagtcggcagagttgctgcggtttgtgcccttgcgatttctttttctgagagaggagagtcaaactcccacctccagctctcgaaggagcttttcctgagggcactgcaaagaggctccttttctttcagatcagcagtatcagcccaagtcagaaccatggctccaaaacaaaagaaaaagacatcacgtggcaaaaaaagactaaaaccagtattagctgctagtgaagacatggaaccagtaaatatggagagcatgggtcatccagaaatttatcctttagtattaaccaccaagacccaagaaatatttaactgccgaatagatgaagatgtcacagatgaacaaccttataagcttatcaataaagaagacatttttgaggacctgcgcaacagagctgcagtatctgatttccacccagtcaaaaaaattgtccaggaatatcctggaaatgagcttctgcttgtttatgacaaagacttcaaatatggacttaacttttatcttattgcaactgaagagggcaaagaaaactatttaaatcccccagaagtaccagaagaacaagaagaatataaagaacatattcctgaagatgtgtatatttataaaccacctgtctctaaaccatgggtttctttgggcagtgaaaaagaaattgaggaagaatcagttacggaatctacaaagcagattacatatatgatttctcgaaaacgaagtgaatttggtgcaccaattaagttcagtgaccagaatgcttccagtgtaaaagatgcctatattgaatgtacagcctacccagataaaaattttacccttaaacaacttgaaaaagatgttggcatgcaagtaatcccccaaataaaggacataagcactcagacaaaatgtgttgaaatagccctgcagcaaaatgaaatcatgaacacatttattgatgactggaaatacctcgcagaagaagaaggcacctttggggacaagaccgatacccacctgaaagagtaccagtcctttaccgaccttcatagcccaacggagaaaatgattacctgtgtctcatggcatccaactatctatgggctaatagctgtgtcggtagccgtgcgactttcttttgaagacagagttcacttttctggtaaattattgctgcagccatcactgattcttttctggagcttctctgatcctatacatcctcagttaatgctggagagcccagatgacatcttctgcttcaagttctgtccgagtgatcctaatatcattgctggaggctgtatcaatgggcagattgtcatgtgggatatcaccgcacatgcagatcgcatagaaaacattaaggcaggtggtagtagaagtaaaagagccacactgaagcctatgtttctccttgaaccggagagtaataaagaagcaatgtatatcagacactgtgcagtctcttcaatagaaaatggacataagaaagtaattacagatatacactggttgtctgacacatttgagattaacagaatgggctccgtctttgagaatcgaagtggaatatgctgtcaacttgtcacatgttcagcagattgcacaatatgtttttgggatattagaccacagaaacctttaaccccccaaacaacagagaaaaagaaggaggaaagtattgaaattccttttgatgtaccatctacttttttgcatctggatctctcctggaaacctctcactaaggtaaggctgtccaagggtgaaacaagtttagaccactgtccaaccaagataagcctgaatgaagaccatcttctttgcaaaacacaagacaaaatgttagcacagagcaaaacagagaaggcagaagaaatgaacccgtatcataatctggaaagtgggatggccaatcttctcaagccaatagatgacttctgcacaaagttctttgtgggaacagaggaaggcgaagtgatatacacagattggaaaatggaaaaagaccctgaaactggccgacttatgtcaaagaagccagtgagccaccacaccattcacgacggaactgtccacactattcagagatcacctttctacaacgacattattctcacggttggaggttggaacgtggccatatggaaagaaggtgttatgactggaccgctccttcagtcatgctgtgcaccaaaaaggtacacctcaggccactggtccctgactcggcccggagttttctacatcggccgagaagatggatacattgatatctgggaccttctggagaaaacccatgaaccagcccagtctcaaaacatttgcataactatgatcacctacatcaaaccctggatcttttcttctaaacagcaatttatagccacagctgattattatggaacactgcatatattagaaattccttggacattaagtcgcccttccaccaatgagatggcaagtgtcaaccactattttgaaagagaagtcaagcatctggaatacgtagaacagcgcaaaaaaattcgtgagcaagaaaagaaagaaatggaactagaaatggcaaagaaaaaagttaaaacatatcagaagtcaaaagaacaaatgcaggctgaattaaaaatggactatgagagttatctggaactggaaaagactgttcttatcaaccttggcctaatcaaagtcacagagaaggggtcatacatggaggtgatgtaaaaaagcttcctgaaggggtgttttggggacttcttccctctatttatttttatgtcaggtgaactggcatgctgaacatatatatatataggctcatttatagacttttatttccctgctattaaaacttttgaatttta

SEQ ID NO: 199932 - DNA, 2905 bp, Homo sapiens
  Payload ID: 19439
  Gene Name: WD repeat domain 63
  Uniprot ID: Q8IWG1
  ENST ID: ENST00000370596
  CDS Start-End: 207-2765
tggagcccggggtttggggacccctgcagacggagaaatagtttcaaaagggagatctgaggatctcaaacattaatgtgcatatgagtcaccagagtttttattgaagcagactgattcagtaggacctgaggttttgcatttctagcaagaagatgctcctgctgctgctgctgctgctggtcccactctcccaagtcagaaccatggctccaaaacaaaagaaaaagacatcacgtggcaaaaaaagactaaaaccagtattagctgctagtgaagacatggaaccagtaaatatggagagcatgggtcatccagaaatttatcctttagtattaaccaccaagacccaagaaatatttaactgccgaatagatgaagatgtcacagatgaacaaccttataagcttatcaataaagaagacatttttgaggacctgcgcaacagagctgcagtatctgatttccacccagtcaaaaaaattgtccaggaatatcctggaaatgagcttctgcttgtttatgacaaagacttcaaatatggacttaacttttatcttattgcaactgaagagggcaaagaaaactatttaaatcccccagaagtaccagaagaacaagaagaatataaagaacatattcctgaagatgtgtatatttataaaccacctgtctctaaaccatgggtttctttgggcagtgaaaaagaaattgaggaagaatcagttacggaatctacaaagcagattacatatatgatttctcgaaaacgaagtgaatttggtgcaccaattaagttcagtgaccagaatgcttccagtgtaaaagatgcctatattgaatgtacagcctacccagataaaaattttacccttaaacaacttgaaaaagatgttggcatgcaagtaatcccccaaataaaggacataagcactcagacaaaatgtgttgaaatagccctgcagcaaaatgaaatcatgaacacatttattgatgactggaaatacctcgcagaagaagaaggcacctttggggacaagaccgatacccacctgaaagagtaccagtcctttaccgaccttcatagcccaacggagaaaatgattacctgtgtctcatggcatccaactatctatgggctaatagctgtgtcggtagccgtgcgactttcttttgaagacagagttcacttttctggtaaattattgctgcagccatcactgattcttttctggagcttctctgatcctatacatcctcagttaatgctggagagcccagatgacatcttctgcttcaagttctgtccgagtgatcctaatatcattgctggaggctgtatcaatgggcagattgtcatgtgggatatcaccgcacatgcagatcgcatagaaaacattaaggcaggtggtagtagaagtaaaagagccacactgaagcctatgtttctccttgaaccggagagtaataaagaagcaatgtatatcagacactgtgcagtctcttcaatagaaaatggacataagaaagtaattacagatatacactggttgtctgacacatttgagattaacagaatgggctccgtctttgagaatcgaagtggaatatgctgtcaacttgtcacatgttcagcagattgcacaatatgtttttgggatattagaccacagaaacctttaaccccccaaacaacagagaaaaagaaggaggaaagtattgaaattccttttgatgtaccatctacttttttgcatctggatctctcctggaaacctctcactaaggtaaggctgtccaagggtgaaacaagtttagaccactgtccaaccaagataagcctgaatgaagaccatcttctttgcaaaacacaagacaaaatgttagcacagagcaaaacagagaaggcagaagaaatgaacccgtatcataatctggaaagtgggatggccaatcttctcaagccaatagatgacttctgcacaaagttctttgtgggaacagaggaaggcgaagtgatatacacagattggaaaatggaaaaagaccctgaaactggccgacttatgtcaaagaagccagtgagccaccacaccattcacgacggaactgtccacactattcagagatcacctttctacaacgacattattctcacggttggaggttggaacgtggccatatggaaagaaggtgttatgactggaccgctccttcagtcatgctgtgcaccaaaaaggtacacctcaggccactggtccctgactcggcccggagttttctacatcggccgagaagatggatacattgatatctgggaccttctggagaaaacccatgaaccagcccagtctcaaaacatttgcataactatgatcacctacatcaaaccctggatcttttcttctaaacagcaatttatagccacagctgattattatggaacactgcatatattagaaattccttggacattaagtcgcccttccaccaatgagatggcaagtgtcaaccactattttgaaagagaagtcaagcatctggaatacgtagaacagcgcaaaaaaattcgtgagcaagaaaagaaagaaatggaactagaaatggcaaagaaaaaagttaaaacatatcagaagtcaaaagaacaaatgcaggctgaattaaaaatggactatgagagttatctggaactggaaaagactgttcttatcaaccttggcctaatcaaagtcacagagaaggggtcatacatggaggtgatgtaaaaaagcttcctgaaggggtgttttggggacttcttccctctatttatttttatgtcaggtgaactggcatgctgaacatatatatatataggctcatttatagacttttatttccctgctattaaaacttttgaatttta

SEQ ID NO: 199933 - DNA, 3477 bp, Homo sapiens
  Payload ID: 19439
  Gene Name: WD repeat domain 63
  ENST ID: ENST00000464801
  CDS Start-End: 116-1222
ttctgagagaggagagtcaaactcccacctccagctctcgaaggagcttttcctgagggcactgcaaagaggctccttttctttcagatcagcagtatcagcccaagtcagaaccatggctccaaaacaaaagaaaaagacatcacgtggcaaaaaaagactaaaaccagtattagctgctagtgaagacatggaaccagtaaatatggagagcatgggtcatccagaaatttatcctttagtattaaccaccaagacccaagaaatatttaactgccgaatagatgaagatgtcacagatgaacaaccttataagcttatcaataaagaagacatttttgaggacctgcgcaacagagctgcagtatctgatttccacccagtcaaaaaaattgtccaggaatatcctggaaatgagcttctgcttgtttatgacaaagacttcaaatatggacttaacttttatcttattgcaactgaagagggcaaagaaaactatttaaatcccccagaagtaccagaagaacaagaagaatataaagaacatattcctgaagatgtgtatatttataaaccacctgtctctaaaccatgggtttctttgggcagtgaaaaagaaattgaggaagaatcagttacggaatctacaaagcagattacatatatgatttctcgaaaacgaagtgaatttggtgcaccaattaagttcagtgaccagaatgcttccagtgtaaaagatgcctatattgaatgtacagcctacccagataaaaattttacccttaaacaacttgaaaaagatgttggcatgcaagtaatcccccaaataaaggacataagcactcagacaaaatggacatatcctaaaaatgctactacgcaatattatccaagagaattctcagaagaggaaaaagagacactcaaacaatcaaagcctttggttgattttcttaacaatgcatccataagtgttgaaatagccctgcagcaaaatgaaatcatgaacacatttattgatgactggaaatacctcgcagaagaagaaggcacctttggggacaagaccgatacccacctgaaagagtaccagtcctttaccgaccttcatagcccaacggagaaaatgattacctgtgtctcatggcatccaactatctatggtacctgccatgtgctttccacgccctcactgtcatgtgtcctcccaacaaccctgtaggatacacacctgtcattatctctgtttcacaacaaaaggacccaagctcaactcagggaagtgactcgcccaggtcacccagatggcataaggcagagtctgggttgggcttgggcctgttgctctcccaaggctaaatttcttcctcctaacactgcctttctgattactagacaagagaggaaatgtgcctcctttaaagagctcagcagccaagggaggtaggtagggatgtgcaaagatggaaacatggaaagagagaggtatttgtcctctttcttcctcctttcaccctacactggcccttttctcacaaaaaagaaacaaaacaagattttcttttcttccaaaatcttctgagtcccctgtatattttatactaacagtacatgtcagtttggaccagccagatttcaagtgctaaataagtagcatgtaactagtggcaaccacattagccagcagagctctaagaaaactcttgctctcctgtggacaaagtgtaaatgaagagtggctgtgtagaaaagcaaaagctagagacatctctccatgtatagttgctgccaactttaatttctacatgtgtttccatcagggctaatagctgtgtcggtagccgtgcgactttcttttgaagacagagttcacttttctggtaaattattgctgcagccatcactgattcttttctggagcttctctgatcctatacatcctcagttaatgctggagagcccagatgacatcttctgcttcaagttctgtccgagtgatcctaatatcattgctggaggctgtatcaatgggcagattgtcatgtgggatatcaccgcacatgcagatcgcatagaaaacattaaggcaggtggtagtagaagtaaaagagccacactgaagcctatgtttctccttgaaccggagagtaataaagaagcaatgtatatcagacactgtgcagtctcttcaatagaaaatggacataagaaagtaattacagatatacactggttgtctgacacatttgagattaacagaatgggctccgtctttgagaatcgaagtggaatatgctgtcaacttgtcacatgttcagcagattgcacaatatgtttttgggatattagaccacagaaacctttaaccccccaaacaacagagaaaaagaaggaggaaagtattgaaattccttttgatgtaccatctacttttttgcatctggatctctcctggaaacctctcactaaggtaaggctgtccaagggtgaaacaagtttagaccactgtccaaccaagataagcctgaatgaagaccatcttctttgcaaaacacaagacaaaatgttagcacagagcaaaacagagaaggcagaagaaatgaacccgtatcataatctggaaagtgggatggccaatcttctcaagccaatagatgacttctgcacaaagttctttgtgggaacagaggaaggcgaagtgatatacacagattggaaaatggaaaaagaccctgaaactggccgacttatgtcaaagaagccagtgagccaccacaccattcacgacggaactgtccacactattcagagatcacctttctacaacgacattattctcacggttggaggttggaacgtggccatatggaaagaaggtgttatgactggaccgctccttcagtcatgctgtgcaccaaaaaggtacacctcaggccactggtccctgactcggcccggagttttctacatcggccgagaagatggatacattgatatctgggaccttctggagaaaacccatgaaccagcccagtctcaaaacatttgcataactatgatcacctacatcaaaccctggatcttttcttctaaacagcaatttatagccacagctgattattatggaacactgcatatattagaaattccttggacattaagtcgcccttccaccaatgagatggcaagtgtcaaccactattttgaaagagaagtcaagcatctggaatacgtagaacagcgcaaaaaaattcgtgagcaagaaaagaaagaaatggaactagaaatggcaaagaaaaaagttaaaacatatcagaagtcaaaagaacaaatgcaggctgaattaaaaatggactatgagagttatctggaactggaaaagactgttcttatcaaccttggcctaatcaaagtcacagagaaggggtcatacatggaggtgatgtaaaaaagcttcctgaaggggtgttttgggga

SEQ ID NO: 199934 - DNA, 548 bp, Homo sapiens
  Payload ID: 19439
  Gene Name: WD repeat domain 63
  ENST ID: ENST00000528899
  CDS Start-End: 175-548
agatgcgtcctggcaacagtcggcagagttgctgcggtttgtgcccttgcgatttctttttctgagagaggagagtcaaactcccacctccagctctcgaaggagcttttcctgagggcactgcaaagaggctccttttctttcagatcagcagtatcagcccaagtcagaaccatggctccaaaacaaaagaaaaagacatcacgtggcaaaaaaagactaaaaccagtattagctggtcatccagaaatttatcctttagtattaaccaccaagacccaagaaatatttaactgccgaatagatgaagatgtcacagatgaacaaccttataagcttatcaataaagaagacatttttgaggacctgcgcaacagagctgcagtatctgatttccacccagtcaaaaaaattgtccaggaatatcctggaaatgagcttctgcttgtttatgacaaagacttcaaatatggacttaacttttatcttattgcaactgaagagggcaaagaaaactatttaaatcccccagaagtaccagaagaaca

SEQ ID NO: 199935 - DNA, 447 bp, Homo sapiens
  Payload ID: 19439
  Gene Name: WD repeat domain 63
  ENST ID: ENST00000484007
  CDS Start-End: 1-387
acctcaggccactggtccctgactcggcccggagttttctacatcggccgagaagatggatacattgatatctgggaccttctggagaaaacccatgaaccagcccagtctcaaaacatttgcataactatgatcacctacatcaaaccctggatcttttcttctaaacagcaatttatagccacagctgattattatggaacactgcatatattagaaattccttggacattaagtcgcccttccaccaatgagatggcaagtgtcaaccactattttgaaagagaagtcaagcatctggaatacgtagaacagcgcaaaaaaattcgtgagcaagaaaagaaagaaatggaactagaaatggcaaagaaaaaagttgtaagttaaatttcagaaatgaaagatgttttcctcgaacaccagtggaaatatatttgtttggcttaa

SEQ ID NO: 199936 - DNA, 4371 bp, Homo sapiens
  Payload ID: 19440
  Gene Name: WD repeat domain 64
  Uniprot ID: B1ANS9
  ENST ID: ENST00000366552
  CDS Start-End: 208-3453
atcagacctaaatcagctttcctccctgctaacatcctagtggcaactcttactcctacccgcactatgggattttaagatcaaaggaattagacctagggcaaaaactgagacagcagggaggcactgtaacaactggaaagttttccaaattggtaaacttgcagtattctttctgtacagaagtaaaagatcccctatgtccctatggatatcaggaaggaaaagcgtctcaacatggcacttcagatgagcaatttcaaaaaggctttgaacaggtttgaaaaattggttgaacaaacagcagcccagaaaagagatgaaagagcaggcttatttatccataaagaagatgcaattggttatgacaagttttatgcatcggtacagaagctctttggtccagatgtgaagaatcaagatgtgaaacgcttttacaggaaactgtgcaacaacacggatgcatctgcagactggtgtgagatctttggatacttctcctctgaagaagatcctattgcttcccagttggatgaagaaaatttggttttctttgtgtctagaaaaaggcgaattttaatttcaggtagtagaagacgagatgtgattaagagcattgtcaagatacctcacctggatttactaataacagctactcagaaaggattaataacagtttttaataaccaggacacctcctggattacagggtgtgattacctcttgcagctgaaacgaatcgtagccacaaccgaaaggaccattattgtctgggattataaagctcaagggagcagccaggaaaattattttgtcataaaaccaatggatcactgcctcctgtgtgtgtgtgtggtgcctttgcctgaccatctctgccgagatgacatcctcttgggggatgatgggggttttgtgaacagattcacagtcaacagtgatgactttggaataaagcaggcaaaatccaaaagaaaattacaaaatcaggtcttagactcaaagaactttaaaagtgttaaaaggaagctacataatgactgggttatgaaaattagatatatttcagccctaaattgttttggatcctgctccttagacagtaatcattcattagttttggaatccttgaagagactcgaggataatttgcctgtcagagagttttccatgccaagaggagccaacactttttgctactgtgttaaggcaaatgtgattgtcactggaggagatgataaggtcatccggttgtggcaccccaatatcagcaccaagccagtagggaaacttgtaggacacatgttcagtatcgccgagatcgtaaccaatgaaaaagatcaacatgtcgtcagcctttcctctgcaaaggttttccgggtgtgggatatacaaactctttcactattacaagtcttccatgacagccagggaggaccaggagacatgcagatttactctatgatatatgatgccaatcatggcatgcttattacgggatctagtgttatggacatgtatcctttgactaggatgatacaagatacaaaacaggttcctcacactcatgaacgagaaatcaatgtcatgctttacaacaaatattttcatcaagtactcactatctgctctgaatccataattagggtatgggaactcgagactgggctccaagtataccagattttagaacctcatggtttcaatactgaagtgacttctgcagctgtcgatgaaagtggatttctttttgccacaggagcgtataatggaacagtcagaatctgggactttggcagtgggcaggagatgaaggtgttgccggaggggaaagactggaaggaggacgagcactgcctacgacgcctcattttcctcaaagcccaagaaaaacaccagcagctggtcctggccttggagcgcaacgggactatcaaaatgatccagggtaaggaagatgatatctacctcatggtgatctgggagctgcctgatgttgtgcctttcctacaagatgggaaacatgctgtgcatctgagaatgtctactagagacaggaacatggctattcctttcccagatgtcgagttgatagttgagaggaacttttctcaacctactgataatcccaccatggatttattacgagtgaactgcattgatttactacaagtagaaggatataatttgatagcagctggaaccttaaatggtgtgatcatcttatggaattttgtgacgtctactgtcaaaaaagtgtaccgacctgaagattgcttcactgtaaaccctgacttgcatcccaagcactttaaaattaatgacatactgttcctctttcgtacccctgaatgtgcaaggagatcaagtcaggattccatatgttcttcatcccagtgtgaatccagcaaaggtccacagagcagtaagggaagcaagcaaagcatacatgacagtgaggttaaaggtgaacaaacagatgtaatggtgggaaagcaacagccaatggacaaaaaacaccctggaattgccaatttaccagaagcccagccacctatccttgtcactgctcatgaggatggacacctccgcttgtggactctggagggaagactactgaaagatatgctacctttcacaaaacattctgccatttctctgacatcgctgtatactgattcatgtacgaggatactactggctggaaatgtggaaggacatgttatcctttgcaatattagctctttcctggatccacctcatgatgaaaagaaattcaagcagctgctttcctggcgtgctcattctttggaaattattcaagtaatctatgtagaagaaaaacaagtggtacttactgcctccatcgatggctcagtaaggctctggcatgccctcaatggacattattgtggatattttggacagcgaaggctctttgaattatcacagacaagagatttcattttgccttgtgatgttactgaatatcccatagaaataaaagaagaaagcaagttcacagagaagcaaaaatatgaatatcctctgatatttgaccgggaaaaatggagaaaaatgagctcagtgtctctacttttcaaacgcacacctcccaaggcctttgaagtggaacaggatttcaagtttttcaagtctctttcttctcctaagattcgaagatatcccttggaaggtttcgtgactgaaaacagagaggcagggattgttttcggctctctgcctatatacagtatatcaagccccactagtctaagatttcttccactgattggcgtagaagcccaaaaggactcttcagatggcattacaggaaagaagaagggaggtcatgttcaacgtgaaaaagcaccacgaagaagaagtttgaaaaaaaatttagtcccacaaataaatctggcttcttccttcttcccagctatacccaagtaaggagaaaaaatcagaaatggctgctgcacataaaatggcaacgtttggatgatacctgctctttatttcaggatgagagggagaaaccaccagacactatcagtcatctctggtgtcaggccatcctattgatgggaaagattgcttagggagttctggtgaccttaactctgaataccaagcaagcagcaagcagccagaagtttaggcggtgtttcttatttactgtcagcaaactgacacataagaaaacaaatgaaatcaacagcattagtaggtctaaaataatatggttatcaatgtttagctttccacttcctcccattggtcaccttactccacagcaagaatgactgtcagaacatgtgcagtaaaaggcactttcaagtcatgctatgtgttgtacaaaaagaattattaaaaagaaaaatgtaccagtcagatctctagatgtttgtcttcttcatttagagaaatattatctggaagaaaatgtcctaagtttctcaaagtcagaaattatttctatgtagtccagacctgactccagataaatataaaagacggcaaagaaaggaagaaaaatgggtcatagaaatagaaaaagcatagtaacatggtagatttaaccttaaatatatcaataattatgaaacctttaataggttaaagtatgcaagtttaaaaggttgtcagaatggattaaaaaaacaaaatccaactatatgttgtttacaagaaacacatctaacatacaaggacaccaaactcttaaagataaaagaatgaaaaaagatgtatgatgcaaaaactaacctaaagaaaatcaatatagccatattaatattaaaatacactttaagaaaataaacaagaatctttataaaagttttataaagttattaataataactcaaa

SEQ ID NO: 199937 - DNA, 2310 bp, Homo sapiens
  Payload ID: 19440
  Gene Name: WD repeat domain 64
  ENST ID: ENST00000437684
  CDS Start-End: 154-2058
ttgggggatgatgggggttttgtgaacagattcacagtcaacagtgatgactttggaataaagcaggcaaaatccaaaagaaaattacaaaatcaggtcttagactcaaagaactttaaaagtgttaaaaggaagctacataatgactgggttatgaaaattagatatatttcagccctaaattgttttggatcctgctccttagacagtaatcattcattagttttggaatccttgaagagactcgaggataatttgcctgtcagagagttttccatgccaagaggagccaacactttttgctactgtgttaaggcaaatgtgattgtcactggaggagatgataaggtcatccggttgtggcaccccaatatcagcaccaagccagtagggaaacttgtaggacacatgttcagtatcgccgagatcgtaaccaatgaaaaagatcaacatgtcgtcagcctttcctctgcaaaggttttccgggtgtgggatatacaaactctttcactattacaagtcttccatgacagccagggaggaccaggagacatgcagatttactctatgatatatgatgccaatcatggcatgcttattacgggatctagtgttatggacatgtatcctttgactaggatgatacaagatacaaaacaggttcctcacactcatgaacgagaaatcaatgtcatgctttacaacaaatattttcatcaagtactcactatctgctctgaatccataattagggtatgggaactcgagactgggctccaagtataccagattttagaacctcatggtttcaatactgaagtgacttctgcagctgtcgatgaaagtggatttctttttgccacaggagcgtataatggaacagtcagaatctgggactttggcagtgggcaggagatgaaggtgttgccggaggggaaagactggaaggaggacgagcactgcctacgacgcctcattttcctcaaagcccaagaaaaacaccagcagctggtcctggccttggagcgcaacgggactatcaaaatgatccagggtaaggaagatgatatctacctcatggtgatctgggagctgcctgatgttgtgcctttcctacaagatgggaaacatgctgtgcatctgagaatgtctactagagacaggaacatggctattcctttcccagatgtcgagttgatagttgagaggaacttttctcaacctactgataatcccaccatggatttattacgagtgaactgcattgatttactacaagtagaaggatataatttgatagcagctggaaccttaaatgaaggacatgttatcctttgcaatattagctctttcctggatccacctcatgatgaaaagaaattcaagcagctgctttcctggcgtgctcattctttggaaattattcaagtaatctatgtagaagaaaaacaagtggtacttactgcctccatcgatggctcagtaaggctctggcatgccctcaatggacattattgtggatattttggacagcgaaggctctttgaattatcacagacaagagatttcattttgccttgtgatgttactgaatatcccatagaaataaaagaagaaagcaagttcacagagaagcaaaaatatgaatatcctctgatatttgaccgggaaaaatggagaaaaatgagctcagtgtctctacttttcaaacgcacacctcccaaggcctttgaagtggaacaggatttcaagtttttcaagtctctttcttctcctaagattcgaagatatcccttggaaggtttcgtgactgaaaacagagaggcagggattgttttcggctctctgcctatatacagtatatcaagccccactagtctaagatttcttccactgattggcgtagaagcccaaaaggactcttcagatggcattacaggaaagaagaagggaggtcatgttcaacgtgaaaaagtaacacgaagaagaagtttgaaaaaaaatttagtcccacaaataaatctggcttcttccttcttcccagctatacccaagtaaggagaaaaaatcagaaatggctgctgcacataaaatggcaacgtttggatgatacctgctctttatttcaggatgagagggagaaaccaccagacactatcagtcatctctggtgtcaggccatcctattgatgggaaagattgcttagggagttctggtgaccttaactctgaataccaagcaagcagcaagcagccagaagtttaggcggtgtttcttatttactgtcagcaaactgacacataagaaaa

SEQ ID NO: 199938 - DNA, 2122 bp, Homo sapiens
  Payload ID: 19440
  Gene Name: WD repeat domain 64
  ENST ID: ENST00000425826
  CDS Start-End: 1-1682
gaacagtcagaatctgggactttggcagtgggcaggagatgaaggtgttgccggaggggaaagactggaaggaggacgagcactgcctacgacgcctcattttcctcaaagcccaagaaaaacaccagcagctggtcctggccttggagcgcaacgggactatcaaaatgatccagggtaaggaagatgatatctacctcatggtgatctgggagctgcctgatgttgtgcctttcctacaagatgggaaacatgctgtgcatctgagaatgtctactagagacaggaacatggctattcctttcccagatgtcgagttgatagttgagaggaacttttctcaacctactgataatcccaccatggatttattacgagtgaactgcattgatttactacaagtagaaggatataatttgatagcagctggaaccttaaatggtgtgatcatcttatggaattttgtgacgtctactgtcaaaaaagtgtaccgacctgaagattgcttcactgtaaaccctgacttgcatcccaagcactttaaaattaatgacatactgttcctctttcgtacccctgaatgtgcaaggagatcaagtcaggattccatatgttcttcatcccagtgtgaatccagcaaaggtccacagagcagtaagggaagcaagcaaagcatacatgacagtgaggttaaaggtgaacaaacagatgtaatggtgggaaagcaacagccaatggacaaaaaacaccctggaattgccaatttaccagaagcccagccacctatccttgtcactgctcatgaggatggacacctccgcttgtggactctggagggaagactactgaaagatatgctacctttcacaaaacattctgccatttctctgacatcgctgtatactgattcatgtacgaggatactactggctggaaatgtggaaggacatgttatcctttgcaatattagctctttcctggatccacctcatgatgaaaagaaattcaagcagctgctttcctggcgtgctcattctttggaaattattcaagtaatctatgtagaagaaaaacaagtggtacttactgcctccatcgatggctcagtaaggctctggcatgccctcaatggacattattgtggatattttggacagcgaaggctctttgaattatcacagacaagagatttcattttgccttgtgatgttactgaatatcccatagaaataaaagaagaaagcaagttcacagagaagcaaaaatatgaatatcctctgatatttgaccgggaaaaatggagaaaaatgagctcagtgtctctacttttcaaacgcacacctcccaaggcctttgaagtggaacaggatttcaagtttttcaagtctctttcttctcctaagattcgaagatatcccttggaaggtttcgtgactgaaaacagagaggcagggattgttttcggctctctgcctatatacagtatatcaagccccactagtctaagatttcttccactgattggcgtagaagcccaaaaggactcttcagatggcattacaggaaagaagaagggaggtcatgttcaacgtgaaaaagcaccacgaagaagaagtttgaaaaaaaatttagtcccacaaataaatctggcttcttccttcttcccagctatacccaagtaaggagaaaaaatcagaaatggctgctgcacataaaatggcaacgtttggatgatacctgctctttatttcaggatgagagggagaaaccaccagacactatcagtcatctctggtgtcaggccatcctattgatgggaaagattgcttagggagttctggtgaccttaactctgaataccaagcaagcagcaagcagccagaagtttaggcggtgtttcttatttactgtcagcaaactgacacataagaaaacaaatgaaatcaacagcattagtaggtctaaaataatatggttatcaatgtttagctttccacttcctcccattggtcaccttactccacagcaagaatgactgtcagaacatgtgcagtaaaaggcactttcaagtcatgctatgtgttgtacaaaaagaattattaaaaagaaaaatgtaccagtc

SEQ ID NO: 199939 - DNA, 2306 bp, Homo sapiens
  Payload ID: 19440
  Gene Name: WD repeat domain 64
  ENST ID: ENST00000414635
  CDS Start-End: 1-2058
ttgggggatgatgggggttttgtgaacagattcacagtcaacagtgatgactttggaataaagcaggcaaaatccaaaagaaaattacaaaatcaggtcttagactcaaagaactttaaaagtgttaaaaggaagctacataatgactgggttatgaaaattagatatatttcagccctaaattgttttggatcctgctccttagacagtaatcattcattagttttggaatccttgaagagactcgaggataatttgcctgtcagagagttttccatgccaagaggagccaacactttttgctactgtgttaaggcaaatgtgattgtcactggaggagatgataaggtcatccggttgtggcaccccaatatcagcaccaagccagtagggaaacttgtaggacacatgttcagtatcgccgagatcgtaaccaatgaaaaagatcaacatgtcgtcagcctttcctctgcaaaggttttccgggtgtgggatatacaaactctttcactattacaagtcttccatgacagccagggaggaccaggagacatgcagatttactctatgatatatgatgccaatcatggcatgcttattacgggatctagtgttatggacatgtatcctttgactaggatgatacaagatacaaaacaggttcctcacactcatgaacgagaaatcaatgtcatgctttacaacaaatattttcatcaagtactcactatctgctctgaatccataattagggtatgggaactcgagactgggctccaagtataccagattttagaacctcatggtttcaatactgaagtgacttctgcagctgtcgatgaaagtggatttctttttgccacaggagcgtataatggaacagtcagaatctgggactttggcagtgggcaggagatgaaggtgttgccggaggggaaagactggaaggaggacgagcactgcctacgacgcctcattttcctcaaagcccaagaaaaacaccagcagctggtcctggccttggagcgcaacgggactatcaaaatgatccagggtaaggaagatgatatctacctcatggtgatctgggagctgcctgatgttgtgcctttcctacaagatgggaaacatgctgtgcatctgagaatgtctactagagacaggaacatggctattcctttcccagatgtcgagttgatagttgagaggaacttttctcaacctactgataatcccaccatggatttattacgagtgaactgcattgatttactacaagtagaaggatataatttgatagcagctggaaccttaaatgaaggacatgttatcctttgcaatattagctctttcctggatccacctcatgatgaaaagaaattcaagcagctgctttcctggcgtgctcattctttggaaattattcaagtaatctatgtagaagaaaaacaagtggtacttactgcctccatcgatggctcagtaaggctctggcatgccctcaatggacattattgtggatattttggacagcgaaggctctttgaattatcacagacaagagatttcattttgccttgtgatgttactgaatatcccatagaaataaaagaagaaagcaagttcacagagaagcaaaaatatgaatatcctctgatatttgaccgggaaaaatggagaaaaatgagctcagtgtctctacttttcaaacgcacacctcccaaggcctttgaagtggaacaggatttcaagtttttcaagtctctttcttctcctaagattcgaagatatcccttggaaggtttcgtgactgaaaacagagaggcagggattgttttcggctctctgcctatatacagtatatcaagccccactagtctaagatttcttccactgattggcgtagaagcccaaaaggactcttcagatggcattacaggaaagaagaagggaggtcatgttcaacgtgaaaaagcaccacgaagaagaagtttgaaaaaaaatttagtcccacaaataaatctggcttcttccttcttcccagctatacccaagtaaggagaaaaaatcagaaatggctgctgcacataaaatggcaacgtttggatgatacctgctctttatttcaggatgagagggagaaaccaccagacactatcagtcatctctggtgtcaggccatcctattgatgggaaagattgcttagggagttctggtgaccttaactctgaataccaagcaagcagcaagcagccagaagtttaggcggtgtttcttatttactgtcagcaaactgacacataag

SEQ ID NO: 199940 - DNA, 1661 bp, Homo sapiens
  Payload ID: 19440
  Gene Name: WD repeat domain 64
  ENST ID: ENST00000472717
  CDS Start-End: 1-1569
aggatgatacaagatacaaaacaggttcctcacactcatgaacgagaaatcaatgtcatgctttacaacaaatattttcatcaagtactcactatctgctctgaatccataattagggtatgggaactcgagactgggctccaagtataccagattttagaacctcatggtttcaatactgaagtgacttctgcagctgtcgatgaaagtggatttctttttgccacaggagcgtataatggaacagtcagaatctgggactttggcagtgggcaggagatgaaggtgttgccggaggggaaagactggaaggaggacgagcactgcctacgacgcctcattttcctcaaagcccaagaaaaacaccagcagctggtcctggccttggagcgcaacgggactatcaaaatgatccagggtaaggaagatgatatctacctcatggtgatctgggagctgcctgatgttgtgcctttcctacaagatgggaaacatgctgtgcatctgagaatgtctactagagacaggaacatggctattcctttcccagatgtcgagttgatagttgagaggaacttttctcaacctactgataatcccaccatggatttattacgagtgaactgcattgatttactacaagtagaaggatataatttgatagcagctggaaccttaaatggtgtgatcatcttatggaattttgtgacgtctactgtcaaaaaagtgtaccgacctgaagattgcttcactgtaaaccctgacttgcatcccaagcactttaaaattaatgacatactgttcctctttcgtacccctgaatgtgcaaggagatcaagtcaggattccatatgttcttcatcccagtgtgaatccagcaaaggtccacagagcagtaagggaagcaagcaaagcatacatgacagtgaggttaaaggtgaacaaacagatgtaatggtgggaaagcaacagccaatggacaaaaaacaccctggaattgccaatttaccagaagcccagccacctatccttgtcactgctcatgaggatggacacctccgcttgtggactctggagggaagactactgaaagatatgctacctttcacaaaacattctgccatttctctgacatcgctgtatactgattcatgtacgaggatactactggctggaaatgtggaaggacatgttatcctttgcaatattagctctttcctggatccacctcatgatgaaaagaaattcaagcagctgctttcctggcgtgctcattctttggaaattattcaagtaatctatgtagaagaaaaacaagtggtacttactgcctccatcgatggctcagtaaggctctggcatgccctcaatggacattattgtggatattttggacagcgaaggctctttgaattatcacagacaagagatttcattttgccttgtgatgttactgaatatcccatagaaataaaagaagaaagcaagttcacagagaagcaaaaatatgaatatcctctgatatttgaccgggaaaaattcgaagatatcccttggaaggtttcgtgactgaaaacagagaggcagggattgttttcggctctctgcctatatacagtatatcaagccccactagtctaagatttcttccactgattggc

SEQ ID NO: 199941 - DNA, 4467 bp, Homo sapiens
  Payload ID: 19441
  Gene Name: WD repeat domain 66
  Uniprot ID: Q8TBY9
  ENST ID: ENST00000288912
  CDS Start-End: 855-4304
tttatcctttcttttttattttaagatgtatgcatattaatcaatttaccatcactggggcatggcagtgtgggcggggagaattattcacattctcctaaaatgacagcagcagagagccttctgcctcagtggctctggctggtttcctgcaggggtcccagtggaaacccgtgtggccacctgttgccgtcttccatgagatgttagtggagagccactttgacgtggaatgatcctaatagatatagccagaccggttttgcggaaacgctttgtgctgagaaccgcaagctggtgcaccctgtgtcatatctgcccccagccagctggaattgtctgcaacacgcggtgcccggtgaggaggcaggcaggacggttgtgtgctgcatccatgagacctggaaattcagtttgcttttggaaaagagcattgtatccgagttcatacttctccaccccatcttgccaaggttgcggaaagtaaaaattggcagtattggccgctgcagcttcttaggggacgggaccatgtgaaaaggtgggatcgtgcgagcggaggaaggacagaaaagcgaggaaagtctatgccgccagcgaccggcaggaggcacgtcgggcacgctcgtcaccgtttcctggcacgtgaccaccgccctgccctgtcgctttagggcctgtcgcttccggcggtggcggttgccatggggacggagcttgggtggcaaccagaactagggagctggtggagaaggtggcggccgctggaaggaggcccgggaggtggctgaggggtccaggcggcgggacgactctggccttttgaagaccgggaggaaactctacagagaagaatgtcagatgcagcagaagctccccgagaagcaacaggagaaaatggagaaacagaaatgaaagaagaggaggaacctaatccaaattataaagaagtagaagatccacaacaggaatcaaaagatgacacaatagcatggagagagtctcaggaggaggagaggaaaacgggcgaggaggaaggggaggaggaggggaaggaggacaaaaagattgtcatggaagaaactgaggaaaaggctggagaagtccaagagaaggaggcttcaggaatacaggaagaaaccacagtagagccccaagaagtcacagcgtccatgatccgtttggagacacagattactgattcccagtcaatcacatcaggaattttcccaaaaacccaaagaggtagcaagtcaaagctttccttacaattggaggatgcagaaacagatgagcttttaagagacctgagcacacaaattgaatttcttgatttggatcaaatcagtcctgaggaacaacagattagttcccctgaaaggcagccctcaggagagcttgaggagaaaaccgaccggatgccccaagatgaactgggacaagaaagaagggacttggagccagaaaacagagaggagggacaagaaaggagagtatccgacatccagtccaaagcagggatctcccgggagtcactggtgtccagcaccacagaggacattctgtttcaaaaggataaaagcaccccggtgtatcccttgaccatgacctggtcgtttggatggaacagttctcttcctgtttactatattcgagaggaaaggcagagagttcttctgtatgtttgtgctcacactgcgatcatctacaacgtgttcaggaacaatcaataccaccttcagggccacgccaatattatctcctgcctctgcgtcagtgaagacaggcggtggatcgccacagcagacaaagggccagactgcctggtgattatatgggactccttcacaggtattcctgtgcacacaatatttgacagctgccctgaagggaatggcatcatggccatggccatgacccacgacgccaagtatctggcaaccatctcagatgctgaagtccagaaggtatgcatctggaagtggactttggcagtggaaacgccagcatgcactctcgaactccccacagagtacggtgttcagaactacgttacttttaacccaacaaataataaagaattggtgagcaatagtaaaacacgggcaatatattatgcatggtatgaagagagggatacactggctcacagtgccccacttttaactgaaaaaaccttcaacaagcttgtgggaaagtttagccagtccatctttcacttgaatttaacacaaatactctcagccacaatggaagggaagctggttgtctgggacatacaccgcccaccctcatctgcctccacctttttgggctttccctatatcaagccttgtaaattggttcatttgcagaaagagggtatcacggtacttaccacaattgatagctacattgtcacaggtgacattaaggggaacattaagttctatgatcacaccctgtctattgttaactggtacagtcacttgaaactgggcgccataagaactctgtccttttcaaagaccccagcaactcctcctactgaaaaatcaaactatcctcctgactgcactttaaaaggtgacctttttgtcttaaggaattttatcattggaacatctgatgccgcggtgtaccacttaacaacagatgggaccaaacttgagaagttatttgtagagcccaaggatgccatttgtgccatctcctgccacccatatcaacccctcattgccatcgggagcatctgtgggatgatcaaagtgtggaattatgaaaacaaacaatatcttttcagcagggtttttgagaaggggcttggagtccagagtctgacctacaaccccgaaggagcccttcttggagctggctttacagaggggacagtttacattcttgatgcaatgtctttagaaaatgaaagcccagagcctttcaaatattccagaaccagtgtgactcatataagcttttcccatgactcccagtatatggcaactgctgatagaagttttactgtggctgtttacatgctggtggtcagaaatggacagagggtctgggagtacttagcaagacttcgctctcatcgcaaaagcattcgaagtctcctgtttggggtttacctggacagcaatgagcctagactgctgagccttgggacagacaggctcttgatagagtatgatcttctcaggagctacaaagaccacctggaagtcctggacattcaccacaccgaccagggctgctatcccacctgcatggtctggtacccaccactcaccagggaactcttcctgcttatttgcaacagtggctacaaagtgaagctttttaatgctactaccaaaatgtgcagaaagacgcttctggggccagcttatggttcccctattgagcagacacaagtcctcccagtgagaagcatggcggagctacagaaacgctacttggtgtttattaacagagacaaggtgggacttcagatcttaccagttgacggcaatccacataagacatctgctattgtttgccacccgaacggggtggccggcatggccgtttcctatgatggctgctacgccttcactgcgggagggcacgatcgctcggtggtgcagtggaaaatcaccttaagtgtcctggaggcagcggtttctcttgggggtgaagacttgaccccattctatggtctgctgtctggtggccgggaaggaaaattctacagggagctagaagactacttctactattctcagctccgcagtcaaggcatcgacacaatggagaccagaaaggtgtcagaacacatttgcctgtcagagcttccttttgtcatgagagcaattggcttttacccatctgaagagaagattgatgatatatttaacgaaatcaaatttggtgaatatgtggacactggaaagctaatcgacaagatcaacttaccagatttcctaaaagtgtaccttaaccacaagccaccttttggtaacaccatgagtggcatccacaagagctttgaggtgctcggttataccaactccaaagggaaaaaggccattcgaagagaggacttcctgagactgctcgttactaaaggtgagcatatgacggaggaggagatgttggattgctttgcttcactgtttggcctgaatcccgagggatggaaatccgagcctgcaacctgctccgtcaaaggttcagaaatttgccttgaagaagaacttccagacgaaatcactgcagaaatattcgcgactgaaattcttggcttaaccatttcagaagattccggccaggatggtcagtgaagttaccaggaatgtttaaagcacaaaggactttgggtgtgtgtgcatgcacatgtgtgtgttttccatgaggcactgctttttatgcatttccctcccccctctcatctttagaacatttagacattaaagcaagtttctggtgagcaatggaattcacaaa

SEQ ID NO: 199942 - DNA, 3420 bp, Homo sapiens
  Payload ID: 19441
  Gene Name: WD repeat domain 66
  Uniprot ID: Q8TBY9
  ENST ID: ENST00000397454
  CDS Start-End: 138-2963
agaactagggagctggtggagaaggtggcggccgctggaaggaggcccgggaggtggctgaggggtccaggcggcgggacgactctggccttttgaagaccggggtgggtgctctctaggaaactctacagagaagaatgtcagatgcagcagaagctccccgagaagcaacaggagaaaatggagaaacagaaatgaaagaagaggaggaacctaatccaaattataaagaagtagaagatccacaacaggaatcaaaagatgacacaatagcatggagagagtctcaggaggaggagaggaaaacgggcgaggaggaaggggaggaggaggggaaggaggacaaaaagattgtcatggaagaaactgaggaaaaggctggagaagtccaagagaaggaggcttcaggaatacaggaagaaaccacagtagagccccaagaagtcacagcgtccatgatccgtttggagacacagattactgattcccagtcaatcacatcaggaattttcccaaaaacccaaagaggtagcaagtcaaagctttccttacaattggaggatgcagaaacagatgagcttttaagagacctgagcacacaaattgaatttcttgatttggatcaaatcagtcctgaggaacaacagattagttcccctgaaaggcagccctcaggagagcttgaggagaaaaccgaccggatgccccaagatgaactgggacaagaaagaagggacttggagccagaaaacagagaggagggacaagaaaggagagtatccgacatccagtccaaagcagggatctcccgggagtcactggtgtccagcaccacagaggacattctgtttcaaaaggataaaagcaccccggtgtatcccttgaccatgacctggtcgtttggatggaacagttctcttcctgtttactatattcgagaggaaaggcagagagttcttctgtatgtttgtgctcacactgcgatcatctacaacgtgttcaggaacaatcaataccaccttcagggccacgccaatattatctcctgcctctgcgtcagtgaagacaggcggtggatcgccacagcagacaaagggccagactgcctggtgattatatgggactccttcacaggtattcctgtgcacacaatatttgacagctgccctgaagggaatggcatcatggccatggccatgacccacgacgccaagtatctggcaaccatctcagatgctgaagtccagaaggtatgcatctggaagtggactttggcagtggaaacgccagcatgcactctcgaactccccacagagtacggtgttcagaactacgttacttttaacccaacaaataataaagaattggtgagcaatagtaaaacacgggcaatatattatgcatggtatgaagagagggatacactggctcacagtgccccacttttaactgaaaaaaccttcaacaagcttgtgggaaagtttagccagtccatctttcacttgaatttaacacaaatactctcagccacaatggaagggaagctggttgtctgggacatacaccgcccaccctcatctgcctccacctttttgggctttccctatatcaagccttgtaaattggttcatttgcagaaagagggtatcacggtacttaccacaattgatagctacattgtcacaggtgacattaaggggaacattaagttctatgatcacaccctgtctattgttaactggtacagtcacttgaaactgggcgccataagaactctgtccttttcaaagaccccagcaactcctcctactgaaaaatcaaactatcctcctgactgcactttaaaaggtgacctttttgtcttaaggaattttatcattggaacatctgatgccgcggtgtaccacttaacaacagatgggaccaaacttgagaagttatttgtagagcccaaggatgccatttgtgccatctcctgccacccatatcaacccctcattgccatcgggagcatctgtgggatgatcaaagtgtggaattatgaaaacaaacaatatcttttcagcagggtttttgagaaggggcttggagtccagagtctgacctacaaccccgaaggagcccttcttggagctggctttacagaggggacagtttacattcttgatgcaatgtctttagaaaatgaaagcccagagcctttcaaatattccagaaccagtgtgactcatataagcttttcccatgactcccagtatatggcaactgctgatagaagttttactgtggctgtttacatgctggtggtcagaaatggacagagggtctgggagtacttagcaagacttcgctctcatcgcaaaagcattcgaagtctcctgtttggggtttacctggacagcaatgagcctagactgctgagccttgggacagacaggctcttgatagagtatgatcttctcaggagctacaaagaccacctggaagtcctggacattcaccacaccgaccagggctgctatcccacctgcatggtctggtacccaccactcaccagggaactcttcctgcttatttgcaacagtggctacaaagtgaagctttttaatgctactaccaaaatgtgcagaaagacgcttctggggccagcttatggttcccctattgagcagacacaagtcctcccagtgagaagcatggcggagctacagaaacgctacttggtgtttattaacagagacaaggtgggacttcagatcttaccagttgacggcaatccacataagacatctgctattgtttgccacccgaacggggtggccggcatggccgtttcctatgatggctgctacgccttcactgcgggagggcacgatcgctcggtggtgcagtggaaaatcaccttaagccatcctgggagccaggcaccaatattatccccatcagacacatcaagaagctaactccaaggggtctgatgactgcccaagcaatggaggaggcagtggagctgggattcacagccagggctttctaagtccaccccacaccttaacaaacattcattacaggaggaaaataaaggacttttgtctccaatctttgtgatatggtttggctctgtgttcctacccaaatctcatcttgaattgtactccgataattcccgtgtatggtgggagggacctggtgggagatggttggatggtgggggagcagggggtggtttcccccatgttgttctcgtggtagtgaataagtctcacaagatctgatggtttgataaggggaaacctgtttcacttggctctcattctctcttgccactgccatgtgagacgtgcctttcaccttccgccatgattgtgaggcctccccagccacatgaaactgtaacaataaacctctttcttttgtaaa

SEQ ID NO: 199943 - DNA, 14083 bp, Homo sapiens
  Payload ID: 19442
  Gene Name: WD repeat domain 7
  Uniprot ID: Q9Y4E6
  ENST ID: ENST00000254442
  CDS Start-End: 212-4684
ggcggcaccggcaccttgcagtatcactggggagacggcggctgtatagcgcttgccgccccacggattatcccagcaggatctacgcaccccgcatcctccgtagttccgccctatccttgtcctccttggctggggcgcccaccggcggtctgataggctacatcgcggcatgagatgaagctgtgacaggtttgaaaacacaaacacaatggcaggaaacagccttgttctacccattgttctttggggtcgaaaagcgcccacacattgcatctcagccgtacttttaacagatgatggggccacgatcgtaacaggatgtcacgacggacaaatatgtctctgggatctttcagtagaactgcaaattaatcctcgagcactgttgtttggtcatacagcatcaatcacttgtttgtctaaagcttgtgcttccagtgacaaacagtatattgtgagtgcatctgaaagtggagagatgtgcctctgggatgtgagtgatggcagatgtattgaatttacaaaattagcttgcacacatactggcatacagttctaccagttctctgttgggaatcagcgagaaggaaggcttttatgccacggacattaccctgaaatccttgttgtggatgctaccagccttgaagtattatactccttagtatcaaagatatcaccagactggattagctccatgagtattattcgatcccaccgaacacaagaggacacagtggtagcactctcggtgactggcatcctgaaggtctggattgttacctcggaaataagtgacatgcaggatactgagccaatatttgaggaggaatccaaaccaatttattgtcagaattgccaaagcatctctttttgtgcatttacacaaaggtcacttttggttgtgtgttccaaatattggagggtgttcgatgccggagactattccttgttgtgttcaggtcctagtgaaaatggacagacatggaccgggggggactttgtctcatcagataaagtcatcatttggacagaaaatgggcaaagttatatttacaaactacctgccagttgccttccagctagtgattcattccgcagtgatgtggggaaggcagttgaaaatttaattcctcctgtacaacatatcctcttggatcgaaaagataaagagttgctaatttgtcctcctgttactcggttcttctatggatgcagagaatatttccataaactgttaattcagggtgattcttctggaaggttgaatatttggaacatatcagacacagctgataaacagggaagtgaagaagggctggcaatgacaacttctattagtttgcaagaggcatttgataaactgaatccttgtcctgctggaattatagatcagctgagtgtgattcccaatagtaatgaacctcttaaagtaactgcaagtgtgtacataccagcacatggacgacttgtttgtggtcgtgaagatggaagcatagttattgtacctgccacacagacggccatagtacagctgttgcaaggggaacacatgctcagaagaggttggccacctcacagaacactccgtggtcatcggaacaaagtcacatgtttgctatatcctcatcaggtctcagctcggtatgatcaaagatacctgatatctggaggtgtggatttttcagtcataatttgggacatattttctggagaaatgaaacatatcttctgtgttcatggtggtgagattactcaacttctagttccacctgaaaactgtagtgcaagagtacagcactgcatctgctctgtagccagtgaccactcagtaggacttctaagtttgcgagagaaaaaatgcataatgttggcatctcgtcacctttttcctattcaagtaatcaaatggaggccttctgatgattacctggtggtggggtgttcagatggttctgtgtacgtctggcaaatggatactggtgcattggatcgttgtgtgatggggataacagcagttgagattctaaacgcttgtgatgaagctgttcctgctgctgttgattcacttagtcatccagcagtcaacctaaaacaagctatgacgagacgtagtcttgctgctcttaaaaatatggcccatcataagctacaaacccttgcaactaacctcttggcttctgaggcatctgacaagggaaatttacctaaatattctcataactccctgatggttcaagcaataaagacaaacctaacagacccggacatacatgtgctattctttgatgtggaagcgttgattattcaactcctgactgaagaagcctctaggccgaatactgctcttatttccccagagaatttgcaaaaagcatctggcagttcagacaaagggggctcttttttaactggaaaacgagcagcagttctcttccaacaagtgaaagaaacgatcaaagagaacatcaaggaacacctccttgatgatgaagaggaggatgaggagataatgaggcagagaagggaagaaagtgatcctgaatatcggtccagcaaatcaaagccattgaccctattagaatataatttaactatggacactgcaaagctgtttatgtcctgccttcacgcctggggtttgaatgaagtactggatgaagtttgcctggatcgccttggaatgctgaaaccccactgcaccgtatcgtttggcctcttgtcaagaggaggccatatgtcactgatgctgccgggttataatcagcctgcttgtaaactgtcacatgggaaaacagaagtaggaaggaagctgccagcgtctgagggagtaggaaagggaacttacggagtgtcccgtgccgtcaccacacagcatctcctgtctatcatttctttggcaaatactttaatgagtatgaccaatgcaacttttattggtgatcatatgaagaagggtcctaccaggccacctagaccaagcaccccagacctttctaaggcaaggggttcccctccaacttccagtaatattgtgcaaggacagattaaacaagttgctgcacctgtcgtttccgctcggtctgatgctgatcactctggctctgaccctccttctgctcctgctttacatacctgtttcttagtaaatgaaggttggagtcagttagctgctatgcactgtgttatgctgccagacctactgggattggataaatttaggcctccccttctggagatgctggcccgaagatggcaagatcgatgcttggaggtgagagaagccgcgcaggccctgcttctggcggaactgagaagaattgagcaggcaggcaggaaggaagccattgatgcctgggctccttacttacctcagtacatagaccacgtcatatcacctggagtcacatcagaagccgcgcagactatcaccacggctcctgatgcctcagggcctgaagcaaaagtccaggaggaagagcatgaccttgttgacgatgacatcaccactggttgcttatcaagtgtcccacaaatgaaaaaaatttctacatcttacgaggaaagacggaagcaagctaccgctattgttttacttggagtaataggagctgaatttggtgctgaaattgaacctcctaaactattgaccagacctcgaagctctagccaaattcctgagggattcgggttgactagtggtggatccaactactcgctggccagacatacttgcaaggcactgacgtttcttctgctacagcctccaagccccaaacttcctccacacagcactatccgaagaacagccattgatctgattggacgtgggttcactgtttgggagccttacatggatgtgtccgctgttctgatggggcttctcgaactttgtgccgatgccgagaaacaacttgccaacatcacaatggggttgcctctgagcccagcagctgactcggcccgctctgcgaggcatgccctctcgctcattgccaccgccagaccacccgccttcatcaccaccatagccaaagaggtacacagacatacggctcttgcagcaaatacccaatcacagcagaatatgcacacaacaactcttgcacgagctaaaggggaaattttgagagtcattgaaattcttattgaaaagatgcccacagatgttgtggatcttctcgtggaggttatggacatcattatgtactgccttgaaggatctttagttaaaaagaaaggtcttcaagaatgtttcccagccatctgcaggttctacatggtcagctattatgagcggaatcacagaatagcagttggagctcgccatggttcagtggccctgtacgacatccggactggaaaatgtcagacaatccatggacacaagggaccaatcactgcagtggcttttgctcctgatggaagatatcttgccacctactcaaacactgacagccacatttctttttggcagatgaacacgtcactgctgggaagcatcggcatgctgaactcggcacctcagctgcgctgcattaaaacctaccaggtgccccctgtgcagcccgcgtcccccggctcccacaatgccctcaagctggcccggctcatctggacttccaaccgcaacgtcatcctcatggcccatgacgggaaggagcaccgcttcatggtctaatgctgctgcctgccgccgtgactgcgttttagttctctaaattatccaagccgatgttgctctgtccttcctcacaccagattgttcccaggggcctgcccaccccagtgccatccagtggcacggccgggtcttgtcacttgtgcatgcttctcaggggcagaacccgctcgtgccatctgtcgattcagaggcacgcacacatgctctgcaggatgtggccatcctgtcaccaggtagtttttccctgccagagatggcaggggaaagccagtggttcctgggaacgctcttgttgcttggtgcaacagaagcacaaaaatcaataaacactgtgattgcactcccagcccagatcagcatttttagccatctcaaccgcacctctgaagtgctgcttgaatctggccgttctgacactgggtgttgaggtcatgtggcagtcctcacgattgaaattattgccctttgaattacctaaaatattgtttaccaaaaagattctgtgtttacatgttcttttcttctggtgattgctaggaaattactcaatccaatttcctagggtttagctaccaccttctttatcaacagctaaccaatttgagattcatgattaattatgtacacaaaaatattttccttgtagaaaatagttttccagacacttagccttctgaagtgctcatctcttgcttaaatgatagtctatttagtagtttaaaataaaaataatcactccctatgatctagttaatgtaattatccagtcactgtaactaatctcttgaagggacttttgtgataaagagccaagttcagaagcatagcgtgtaccgaaaatgaagactctcctatctactgctacagatcctgttgaagaaagagcttacccctttcccccggaaaacttgcaatcctgtagttcccatatgtgtggcatatgtcagttatgaaattattataattcagccttcaaactactactgatcaactaaaggaaagctaataaggtatttcttttaaacaagtattctggaaaagtaataactatggcacaaatgttcaggagtgtatataaaaatatgtgggctctcgatttatttgagcaaacattgcaatgagggtgttcattatgcttctaagtaagctttaactagaccactttcttcttatgtcagattgtgctggttctagctcataataatgaaaaaaatagaattatattttgtatgaattgtttctaacaaaccttgatctgtatatacttgtgaggggttgtttggttgcctaattgttgattggttggttagttgggcaaaatcatttattacatgcaaaaatagaaaattatttgttaaattcagagaaaatatgtgaagtttacaaaggaaccaaaatgataatgggagaatttagtcttaaaagtttaggttgtcagagtttatctgatatacaaaaaagtaggatcaaagtctaggaacaaacattggttatttcactgaaacagatttttaaagagcatattaagaaattaagaccattagatcatctctttcataatgatatgatgttatttccattgacggcaaatctatactgttccttggttttagagttgggtattctttcaaaagtgaatttaggcacatgcatgtacattgtatttataaagattatatatgtagtttccaaggaagaaacaaagacctatacagtttagactttatttgtttggtgaacgtgctgttgtgtttggcatagctagagaaatgtaaggtaaaaggctcactttgttttccagtgggtccagagtcttctctatacccaacatatgtttactttatgaacttaaatggaaattaatttattgtagactacatctctatttggaatgatgaggtaaatgtataccttagcattttctttaacaaaaatgttctgtgtgtcaggaaagaggtgtgagagtggtaggcagcctgccgcaaacacacggatggctccccccgccacgaaggttgagaacaaagccagggggcccagaggagcaatagccctgggccacaagcgtgggtaggcctttcacgtattccgtctgcacaggcaaccaaggccagtagaaagctatggctgcaaaaccctggggtggacgatgtttgatgattagacggtcatctctaactactaaactaatatctgcattcttgttaacataaatctctccttggctattttaatagccacagtcccaaacttcatcccagcttagatttctcagcactgaggtaaactctgcattgtcatcccagcgtacacctttaatgttttattgatttcactggcactgtatttggacctgtccttgtatatgtagagacatatgtggcttcattggtaatttacaagcaaaagatgacatgacgtgacacctgtatgaaaatgtgatgattgaactccctgtgtacagcgagtgaattaaaatgtctgcctctccagacatttcttaatgattccacttaatagactctatgtgtgctgaatgttcctgtgtacatatgtgtgttaaataaaacaattgtattgaagactgtttttctcacaatattaccttttccagtgttcactcatcttaaacatcctcagttgaaatccgtatgctccgctagccctgctgcttctaatcattcatttccctggagagctggcttgggaaaggcaacttattcccagaggacagtagagcagaagtgcagaggtaagctctccctccagaaactcactggcactctctgtggtttgggaaaggcgttgcatgcctgttgctttatctctactctacatgctcccaaatagactggtaatggcaccaaatcatatcttgtcagattggatggcatgggttggctgcctctcgggagctaggctgagatcatcaagttcattgcatttcacgctcagtttggagtcgaatttgaatccctcaggtaaagggtataattggttttcagaaaaatcaagaataataaaataggtccttactgctcatagagggttatgtgtaagtagtgaatgtacttcttgtctcttaattatttcagataagaacacaaaagcttgatttgagtcaatcatcgtgtaacagtataattttctgtaagaattcggtgaacattccaggagtggtctgaggcatcttgggccctattaaatgcccactgtgggccccaggaaatgttttaacatctcatgacttaaatgtattcttatagggaaaataggggcagtaacagttctatatgatcagcgatcacataaactgatcaaatgtggaaaggcgtgacgttaataggaaggtaaagccaagcagtgctgggtgaactttcacctttcaccccttcggctgactgacagagcccagtgttgaagaaaatcaatactttggagccaggagggaaatacttccaccctctaactagagaatgtgttttgacaaggccaagataatccaagctgcacaggagaaagagaaaagaagactcatttttaaagcctgacacttcaaggtgtttttgtgcaatggtttagagatcgtcaatacatacaaataccaaaggtcaaaaagaaaagccagaagaatttcaaaaattagatgttcagttctttttgctgtttaaaaaaaaaaaaaaaaggactacagagagttttgtgcttgtaattgtccttttaatgaactaagctcacaattgtgtgaccattgaggtgatcatccctctttaatcaaaacttacatttttgtagcagcagaacgatgaatattgaatgctcaaaaagcattcagacttcctgcttctgtacaccttttggctacagattgttttgttttgttttgttttgtttttttgagtggttacattgttttgtgctaacatctcagaatttggttttgcaattcatgttgattctgccataatggcattgtaaatcctggatcctccttcacattcagttcaatcctttgcatgagaaaagagttcttgtacctagaacttaattttttttctagtttcccaagtccctttaagcaaattacttatgaagatattctaattaatgtctctctgagtgagaggtttatgcacctctaggaagatggtaaacaattcattcttaccagcaagattagagccattcattctgtagacaaatacctccatcaagtggatatagattctttgctttcctactgataagaaaactaagaagccagtggtgcccatacctgccagacaagctcagaaggacaaaggagtcttaagtatctaaagtacatcatcaggcctgctgtaaacatgtgctaattaaagagtattaaaaatatagtgaaaatatagcttctatttatatacctgcttactcattaataaatcccgttctattctgaggtgatagatcaggctggaaatttttattttgttttgtttcaaaaagagaacgcagccagccaaacctcctcaatattctgagatttcccagagaaggccaggagtctagcactgctcgaattgtaggggtatgaagtaaatatgtgctgcatttgtgaaatccattgtattgcacctgtcaaatgctcagaagagtggcacacaggaagcactcaatagatgtaagctaatatttttaggagacaggagtcctaattgagcatggataaacaagatgacctgtgttctttggaaaacttggatttttgttttatgttttcatctctatgtggactccacaagtagatctgaacatcctatccaaaggagggctcctgtggttctgtttgtattccccagctgctttgccatattgctatgtgttaccaccccgcttctcaccaaaatttgtagacatgaagaaatgcctaaatacatgccaatggaggaaactggttggttgtggctgaagttatcactgattcctcaaaaagaaagatcaccgcattagatttaggactcacattagcatcaggggtgactttgagtttcttaatgagtttcttccaaatatgcatctatcgagattgaataagactctggacaaaagtattgtagagtggatttcatggaatcaccaaagcaaaggaaactgaatatgtaggttctgttgccaatatcttcttgttctgacttaacgtcaaaatgacttagtgctttagtcttcccaaatttgaaatgtattctctaaaacagcggccctcaacccctgatatcagactgtggcctgtgaggaaccaggctgcacagcaggaggtgagtggtggtgagccagcaaagtttcatctgtatttacagaggtccccatcacttgcattactgcctgagctcagcctcctgtcatatcagctgcggcattagattctcataagagcgtgaatcctattgtgaactgagcatgtgagggatctaggttgcactctccttgtgagaatctaatacctgatgatctgtcagtgtatcccatcacccccagagaggaccgtttagttgcaggaaaacaagctcagggctctcactgattctacattatggtgagttgtataattattttatatatatatatatatatatatatatatatatatatatatatacagtgtaataatagaaataatgtgcacaataaatataatgcatttgaatcatcccgaaaacatccccaaccaccagccttttttgcatgaaactggtccctcgtgcaaaaaaggttgggaaatgatgctctaaaacttgacccacccagcggcacttcaagttttagtgaaaatgtgtgaataaagatacggcaatgaaacattatttgtattcaaccagcaagcttgtattgaaccttagaatatgccaagcgtatgttctttattttattttcctcttgctgatgagctcacaatctcaccaagcaccataacactatggaataagtgctgagacccggggcaggtaaagagcaatgagaacacaggaagtgatcgattctgatgaggtggtattgttaggtttcccagagaggaaacatttgggctaggccttaaaaaataaataggaattaattaggaggatactggggatgttataatgtaggaatttatagaagtcaaagttttgtgtgatcggaatgagtataaactacttcagacctacaacctgaaggacattggtagatgctgccaacaatcaagaaagttcttcactttgcagccattattgcaataacagaaaaccagactcctttgtcaaaggacactcgaaatccataagtcaaaaaccctaataaaagatttttccggctttagtgttttccatgtttcattttctttatttaagaaaagcttttgttgttttaaaaataagttgtgtgttctcctactcctggattctactgtgtgactggcacagtgagttgaatgcctggcacagtgcactgcccaggtcctcccacccccacccaaatcccactgcagaaccgaagcattctaacagctgtgtgctgagtccttccgtaaagattgcttcccagccaaagagaactgtctcacccaaggtcatgcttcctttcctggggagcaaacacatcccatgatgggtcaggaaagaggtttaaagacccagccccggctgaggtgtggtggctcatgcctgtaatcccagcattttgcgagggtgaggcggggaggatcacttgaggtcaggagttcaagaccagcctggacaatgtggtgaaaccccatctgtattagaaatacaaaaattagatgggcgtgttggtgggcatctgtaatcccagctactcaggaggctgaggcaggagaatcacttgaacccaggaggtggaggttgcaacaagccgagattgtgccactgcactccagcccaggcaagagagtgagactctgggtgacagagactcagcaagtcgtaaggaaggtgctaaggatggtgagtctccgcctcaaaaaaaaaataaataaataaaaataaaagacccagccccaagctccatttcaaaaccacttggaaaggccatcccagctccagaactcccttgagcattgactgaaggcttcactgaactgcatcccagctcaacctctctgtctgcccaggcctgggcatttccttacagatgctgatcccgagaacactgctccataaacttcctatgtgcagacctctctcacacatagtctgcatcccaaagaacccaccaggagtgtcccaagaaaacagattcaaaaatggagtttgggagctgagccacccattgaaccatgaaaagaaggacccatcactggtcgtgggccctcatggacagcctctggcacgcttggctgcacaattgttaaaactttccttggtgatgcttgtatggcgtgctgatggagggcgatgtgctggagggtaccacgtggcaggaattgaaaagtaagggaaaggaaaaattataaagacgatggacttggatgactgttgtggagtgctctggaaaaaagacaatgaaaagctgaagggtgattaatcacccagtagaggctaaatgtgaaagcctctggctttctctcagagagagaaagtctctctgagactccttaacatctaaggagagcttcatctcctacagccaaacatgagcaggctcagcccatggagaagcacagctccagaggctgaactcacctctaaaaatcttctgccccagggtcagagccctgacagaggtgaacggggttctctgggttgatgcacttgaacaatcttgaacccccgattccagtgaaccctcctcgggcctgcctacatggccagctcctccctgttcaaagccggcgttcctctttctttgcttgaagataatgcagaggcttctcccatgcaaaactacacatgccccccactggagtgacttgggttaagtcatggtacaacctggctgccaaagtgctggacctgctaggacagggaaagaaccatctcccataggagctgtaggtcctcaccaacatgtacccaacatagccactgaaatgggactggatttagcaggtgctgggtcaaggggaaacggactataaagtgggtcaagggagagtttatcgataggagattgaacaacccgcaaggacccagggaaaaagtgctgccctgatgttataagctgcttggcttggagaaaatggtggctgacactaagaagaaatgtcagaactgatgtgacagagggtggaggcaagaacaggaaagctcagagtgaggagactgctggagcaggtatgctaggtacccccaaatccactggatgcctctgctctgcgagagaggctggggacattcattccagcaatgaattgaaggaaggtgctagaagggcacccacatccctgcaggccaggactgagggtagaagatgtcatgacagaactgggccccaggtatcaaggaggatgacaaggtcctgaaataatacagacctggtgggtgcaatcatcataattagtagcaagtttggagtggcggccagagagaccagacctgcagagatctttggatctaataaaacatgtcatccctaagtgcaagatgggagggcagccaacaagggtattgttcatctatacaggcaaaagaaatcgaaaatggatcacaggaggctgaaagcagccattccagtaagaagtcaaaatcccttgcctggtttgtaaacccaaatggcatggttagcaggagctcagaccccttgtggatgagactctgggtttgcccagtagtaagcaatggaaagtagcagagattcttgccaagggggaggagagtttagaatgagtagtagagaagggaagcaatagatatcagtggtggctttgggagcagctgcgacagcaggggttgtagtttgttccactaatatttctgttatgtttcccccagaatcctggaatggctgttcccaggcttttttcaaagcaagtggatctgagcggggcaaagggtgaaggcaggggacactgtggtatgcattcactcccccaggtactgggttgtcggcagctgatatttcccaactgagacctgctacaggaattgcttgaggctaaagagagccactctcctcaaggccacatcctcctccctaatgagagctacacccaataacccatcatggggataaaaggactcaaccctctttgcttcagtttggaacatctctgaagggccattccagcttcatagctcccagcgcatttgtcagagaactctgttgcaaccacatcacagtccagctcccccctgcctatgtattgcttccttcacacagatgttgatcccaggaacacttcctaatacacccgctttcagcaaa

SEQ ID NO: 199944 - DNA, 7213 bp, Homo sapiens
  Payload ID: 19442
  Gene Name: WD repeat domain 7
  Uniprot ID: Q9Y4E6
  ENST ID: ENST00000357574
  CDS Start-End: 236-4609
ctgatttactgcagtggcggcggcggcggcaccggcaccttgcagtatcactggggagacggcggctgtatagcgcttgccgccccacggattatcccagcaggatctacgcaccccgcatcctccgtagttccgccctatccttgtcctccttggctggggcgcccaccggcggtctgataggctacatcgcggcatgagatgaagctgtgacaggtttgaaaacacaaacacaatggcaggaaacagccttgttctacccattgttctttggggtcgaaaagcgcccacacattgcatctcagccgtacttttaacagatgatggggccacgatcgtaacaggatgtcacgacggacaaatatgtctctgggatctttcagtagaactgcaaattaatcctcgagcactgttgtttggtcatacagcatcaatcacttgtttgtctaaagcttgtgcttccagtgacaaacagtatattgtgagtgcatctgaaagtggagagatgtgcctctgggatgtgagtgatggcagatgtattgaatttacaaaattagcttgcacacatactggcatacagttctaccagttctctgttgggaatcagcgagaaggaaggcttttatgccacggacattaccctgaaatccttgttgtggatgctaccagccttgaagtattatactccttagtatcaaagatatcaccagactggattagctccatgagtattattcgatcccaccgaacacaagaggacacagtggtagcactctcggtgactggcatcctgaaggtctggattgttacctcggaaataagtgacatgcaggatactgagccaatatttgaggaggaatccaaaccaatttattgtcagaattgccaaagcatctctttttgtgcatttacacaaaggtcacttttggttgtgtgttccaaatattggagggtgttcgatgccggagactattccttgttgtgttcaggtcctagtgaaaatggacagacatggaccgggggggactttgtctcatcagataaagtcatcatttggacagaaaatgggcaaagttatatttacaaactacctgccagttgccttccagctagtgattcattccgcagtgatgtggggaaggcagttgaaaatttaattcctcctgtacaacatatcctcttggatcgaaaagataaagagttgctaatttgtcctcctgttactcggttcttctatggatgcagagaatatttccataaactgttaattcagggtgattcttctggaaggttgaatatttggaacatatcagacacagctgataaacagggaagtgaagaagggctggcaatgacaacttctattagtttgcaagaggcatttgataaactgaatccttgtcctgctggaattatagatcagctgagtgtgattcccaatagtaatgaacctcttaaagtaactgcaagtgtgtacataccagcacatggacgacttgtttgtggtcgtgaagatggaagcatagttattgtacctgccacacagacggccatagtacagctgttgcaaggggaacacatgctcagaagaggttggccacctcacagaacactccgtggtcatcggaacaaagtcacatgtttgctatatcctcatcaggtctcagctcggtatgatcaaagatacctgatatctggaggtgtggatttttcagtcataatttgggacatattttctggagaaatgaaacatatcttctgtgttcatggtggtgagattactcaacttctagttccacctgaaaactgtagtgcaagagtacagcactgcatctgctctgtagccagtgaccactcagtaggacttctaagtttgcgagagaaaaaatgcataatgttggcatctcgtcacctttttcctattcaagtaatcaaatggaggccttctgatgattacctggtggtggggtgttcagatggttctgtgtacgtctggcaaatggatactggtgcattggatcgttgtgtgatggggataacagcagttgagattctaaacgcttgtgatgaagctgttcctgctgctgttgattcacttagtcatccagcagtcaacctaaaacaagctatgacgagacgtagtcttgctgctcttaaaaatatggcccatcataagctacaaacccttgcaactaacctcttggcttctgaggcatctgacaagggaaatttacctaaatattctcataactccctgatggttcaagcaataaagacaaacctaacagacccggacatacatgtgctattctttgatgtggaagcgttgattattcaactcctgactgaagaagcctctaggccgaatactgctcttatttccccagagaatttgcaaaaagcatctggcagttcagacaaagggggctcttttttaactggaaaacgagcagcagttctcttccaacaagtgaaagaaacgatcaaagagaacatcaaggaacacctccttgatgatgaagaggaggatgaggagataatgaggcagagaagggaagaaagtgatcctgaatatcggtccagcaaatcaaagccattgaccctattagaatataatttaactatggacactgcaaagctgtttatgtcctgccttcacgcctggggtttgaatgaagtactggatgaagtttgcctggatcgccttggaatgctgaaaccccactgcaccgtatcgtttggcctcttgtcaagaggaggccatatgtcactgatgctgccgggttataatcagcctgcttgtaaactgtcacatgggaaaacagaagtaggaaggaagctgccagcgtctgagggagtaggaaagggaacttacggagtgtcccgtgccgtcaccacacagcatctcctgtctatcatttctttggcaaatactttaatgagtatgaccaatgcaacttttattggtgatcatatgaagaagggtcctaccaggccacctagaccaagcaccccagacctttctaaggcaaggggttcccctccaacttccagtaatattgtgcaaggacagattaaacaaggttggagtcagttagctgctatgcactgtgttatgctgccagacctactgggattggataaatttaggcctccccttctggagatgctggcccgaagatggcaagatcgatgcttggaggtgagagaagccgcgcaggccctgcttctggcggaactgagaagaattgagcaggcaggcaggaaggaagccattgatgcctgggctccttacttacctcagtacatagaccacgtcatatcacctggagtcacatcagaagccgcgcagactatcaccacggctcctgatgcctcagggcctgaagcaaaagtccaggaggaagagcatgaccttgttgacgatgacatcaccactggttgcttatcaagtgtcccacaaatgaaaaaaatttctacatcttacgaggaaagacggaagcaagctaccgctattgttttacttggagtaataggagctgaatttggtgctgaaattgaacctcctaaactattgaccagacctcgaagctctagccaaattcctgagggattcgggttgactagtggtggatccaactactcgctggccagacatacttgcaaggcactgacgtttcttctgctacagcctccaagccccaaacttcctccacacagcactatccgaagaacagccattgatctgattggacgtgggttcactgtttgggagccttacatggatgtgtccgctgttctgatggggcttctcgaactttgtgccgatgccgagaaacaacttgccaacatcacaatggggttgcctctgagcccagcagctgactcggcccgctctgcgaggcatgccctctcgctcattgccaccgccagaccacccgccttcatcaccaccatagccaaagaggtacacagacatacggctcttgcagcaaatacccaatcacagcagaatatgcacacaacaactcttgcacgagctaaaggggaaattttgagagtcattgaaattcttattgaaaagatgcccacagatgttgtggatcttctcgtggaggttatggacatcattatgtactgccttgaaggatctttagttaaaaagaaaggtcttcaagaatgtttcccagccatctgcaggttctacatggtcagctattatgagcggaatcacagaatagcagttggagctcgccatggttcagtggccctgtacgacatccggactggaaaatgtcagacaatccatggacacaagggaccaatcactgcagtggcttttgctcctgatggaagatatcttgccacctactcaaacactgacagccacatttctttttggcagatgaacacgtcactgctgggaagcatcggcatgctgaactcggcacctcagctgcgctgcattaaaacctaccaggtgccccctgtgcagcccgcgtcccccggctcccacaatgccctcaagctggcccggctcatctggacttccaaccgcaacgtcatcctcatggcccatgacgggaaggagcaccgcttcatggtctaatgctgctgcctgccgccgtgactgcgttttagttctctaaattatccaagccgatgttgctctgtccttcctcacaccagattgttcccaggggcctgcccaccccagtgccatccagtggcacggccgggtcttgtcacttgtgcatgcttctcaggggcagaacccgctcgtgccatctgtcgattcagaggcacgcacacatgctctgcaggatgtggccatcctgtcaccaggtagtttttccctgccagagatggcaggggaaagccagtggttcctgggaacgctcttgttgcttggtgcaacagaagcacaaaaatcaataaacactgtgattgcactcccagcccagatcagcatttttagccatctcaaccgcacctctgaagtgctgcttgaatctggccgttctgacactgggtgttgaggtcatgtggcagtcctcacgattgaaattattgccctttgaattacctaaaatattgtttaccaaaaagattctgtgtttacatgttcttttcttctggtgattgctaggaaattactcaatccaatttcctagggtttagctaccaccttctttatcaacagctaaccaatttgagattcatgattaattatgtacacaaaaatattttccttgtagaaaatagttttccagacacttagccttctgaagtgctcatctcttgcttaaatgatagtctatttagtagtttaaaataaaaataatcactccctatgatctagttaatgtaattatccagtcactgtaactaatctcttgaagggacttttgtgataaagagccaagttcagaagcatagcgtgtaccgaaaatgaagactctcctatctactgctacagatcctgttgaagaaagagcttacccctttcccccggaaaacttgcaatcctgtagttcccatatgtgtggcatatgtcagttatgaaattattataattcagccttcaaactactactgatcaactaaaggaaagctaataaggtatttcttttaaacaagtattctggaaaagtaataactatggcacaaatgttcaggagtgtatataaaaatatgtgggctctcgatttatttgagcaaacattgcaatgagggtgttcattatgcttctaagtaagctttaactagaccactttcttcttatgtcagattgtgctggttctagctcataataatgaaaaaaatagaattatattttgtatgaattgtttctaacaaaccttgatctgtatatacttgtgaggggttgtttggttgcctaattgttgattggttggttagttgggcaaaatcatttattacatgcaaaaatagaaaattatttgttaaattcagagaaaatatgtgaagtttacaaaggaaccaaaatgataatgggagaatttagtcttaaaagtttaggttgtcagagtttatctgatatacaaaaaagtaggatcaaagtctaggaacaaacattggttatttcactgaaacagatttttaaagagcatattaagaaattaagaccattagatcatctctttcataatgatatgatgttatttccattgacggcaaatctatactgttccttggttttagagttgggtattctttcaaaagtgaatttaggcacatgcatgtacattgtatttataaagattatatatgtagtttccaaggaagaaacaaagacctatacagtttagactttatttgtttggtgaacgtgctgttgtgtttggcatagctagagaaatgtaaggtaaaaggctcactttgttttccagtgggtccagagtcttctctatacccaacatatgtttactttatgaacttaaatggaaattaatttattgtagactacatctctatttggaatgatgaggtaaatgtataccttagcattttctttaacaaaaatgttctgtgtgtcaggaaagaggtgtgagagtggtaggcagcctgccgcaaacacacggatggctccccccgccacgaaggttgagaacaaagccagggggcccagaggagcaatagccctgggccacaagcgtgggtaggcctttcacgtattccgtctgcacaggcaaccaaggccagtagaaagctatggctgcaaaaccctggggtggacgatgtttgatgattagacggtcatctctaactactaaactaatatctgcattcttgttaacataaatctctccttggctattttaatagccacagtcccaaacttcatcccagcttagatttctcagcactgaggtaaactctgcattgtcatcccagcgtacacctttaatgttttattgatttcactggcactgtatttggacctgtccttgtatatgtagagacatatgtggcttcattggtaatttacaagcaaaagatgacatgacgtgacacctgtatgaaaatgtgatgattgaactccctgtgtacagcgagtgaattaaaatgtctgcctctccagacatttcttaatgattccacttaatagactctatgtgtgctgaatgttcctgtgtacatatgtgtgttaaataaaacaattgtattgaagactgtttttctcacaata

SEQ ID NO: 199945 - DNA, 650 bp, Homo sapiens
  Payload ID: 19442
  Gene Name: WD repeat domain 7
  ENST ID: ENST00000593058
  CDS Start-End: 144-650
ctagccgggggcggtgctagctgtcagatcgctgcggctgcaagcctgcaggtcgggcccaaaagtaggcgccgttaccaagagcgtgggggccagccgggggtctttgtggctcccttgcctggtttgaaaacacaaacacaatggcaggaaacagccttgttctacccattgttctttggggtcgaaaagcgcccacacattgcatctcagccgtacttttaacagatgatggggccacgatcgtaacaggatgtcacgacggacaaatatgtctctgggatctttcagtagaactgcaaattaatcctcgagcactgttgtttggtcatacagcatcaatcacttgtttgtctaaagcttgtgcttccagtgacaaacagtatattgtgagtgcatctgaaagtggagagatgtgcctctgggatgtgagtgatggcagatgtattgaatttacaaaattagcttgcacacatactggcatacagttctaccagttctctgttgggaatcagcgagaaggaaggcttttatgccacggacattaccctgaaatccttgttgtggatgctaccagccttgaagtattatactccttagtatcaaagatatcaccagactggattagctccatgagtattattcgatcc

SEQ ID NO: 199946 - DNA, 572 bp, Homo sapiens
  Payload ID: 19442
  Gene Name: WD repeat domain 7
  ENST ID: ENST00000585669
  CDS Start-End: 1-122
acatggtcagctattatgagcggaatcacagaatagcagttggagctcgccatggttcagtggccctgtacgacatccggactggaaaatgtcaggcactataccaggcaaaggagaggtgacaaaggagcgggaacacatgtgaagatcctgacctactgctctaaccaaaccatcttccgttaaccataacccaaatcaaaacccacgaaaatgccaagtcccatcatgacggacatttacttaggaatgtgattgctgtccagtgagttagtgtgtacatgtgtctgctgaagtcctgccatgtaaaagcctgaaatgtctagaaagggtggagataatcaagaccattcatgctgctgaggaactccatgtggaagcaggaggggagggatttattttcatagcacagtataagacttctagcatgtgttcaaatagttttctattagaaatactgaaaaaaacatttagctttgggtttgcccagatctgaagaaaacattttgtgtgactttttaggcatatgcaagtgaaactttaataaatatttcatatgagcagtgtaaata

SEQ ID NO: 199947 - DNA, 544 bp, Homo sapiens
  Payload ID: 19442
  Gene Name: WD repeat domain 7
  ENST ID: ENST00000589935
  CDS Start-End: 235-438
agttggggctggtgtcagctgatttactgcagtggcggcggcggcggcaccggcaccttgcagtatcactggggagacggcggctgtatagcgcttgccgccccacggattatcccagcaggatctacgcaccccgcatcctccgtagttccgccctatccttgtcctccttggctggggcgcccaccggcggtctgataggctacatcgcggcatgagatgaagctgtgacagatgaacacgtcactgctgggaagcatcggcatgctgaactcggcacctcagctgcgctgcattaaaacctaccaggtgccccctgtgcagcccgcgtcccccggctcccacaatgccctcaagctggcccggctcatctggacttccaaccgcaacgtcatcctcatggcccatgacgggaaggagcaccgcttcatggtctaatgctgctgcctgccgccgtgactgcgttttagttctctaaattatccaagccgatgttgctctgtccttcctcacaccagattgttcccaggggcctgcccacccc

SEQ ID NO: 199948 - DNA, 522 bp, Homo sapiens
  Payload ID: 19442
  Gene Name: WD repeat domain 7
  ENST ID: ENST00000591449
  CDS Start-End: 1-188
atgccctctcgctcattgccaccgccagaccacccgccttcatcaccaccatagccaaagagcaggcatatgaaaactcaaatacattaaaggtgttcacacttttcacatgtacacagacatacggctcttgcagcaaatacccaatcacagcagaatatgcacacaacaactcttgcacgagctaaaggggaaattttgagagtcattgaaattcttattgaaaagatgcccacagatgttgtggatcttctcgtggaggttatggacatcattatgtactgccttgaaggatctttagttaaaaagaaaggtcttcaagaatgtttcccagccatctgcaggttctacatggtcagctattatgagcggaatcacagaatagcagttggagctcgccatggttcagtggccctgtacgacatccggactggaaaatgtcagacaatccatggacacaagggaccaatcactgcagtggcttttgctcctgatggaagatatcttgccacctactcaaac

SEQ ID NO: 199949 - DNA, 5257 bp, Homo sapiens
  Payload ID: 19442
  Gene Name: WD repeat domain 7
  ENST ID: ENST00000615645
  CDS Start-End: 212-2659
ggcggcaccggcaccttgcagtatcactggggagacggcggctgtatagcgcttgccgccccacggattatcccagcaggatctacgcaccccgcatcctccgtagttccgccctatccttgtcctccttggctggggcgcccaccggcggtctgataggctacatcgcggcatgagatgaagctgtgacaggtttgaaaacacaaacacaatggcaggaaacagccttgttctacccattgttctttggggtcgaaaagcgcccacacattgcatctcagccgtacttttaacagatgatggggccacgatcgtaacaggatgtcacgacggacaaatatgtctctgggatctttcagtagaactgcaaattaatcctcgagcactgttgtttggtcatacagcagttctcttccaacaagtgaaagaaacgatcaaagagaacatcaaggaacacctccttgatgatgaagaggaggatgaggagataatgaggcagagaagggaagaaagtgatcctgaatatcggtccagcaaatcaaagccattgaccctattagaatataatttaactatggacactgcaaagctgtttatgtcctgccttcacgcctggggtttgaatgaagtactggatgaagtttgcctggatcgccttggaatgctgaaaccccactgcaccgtatcgtttggcctcttgtcaagaggaggccatatgtcactgatgctgccgggttataatcagcctgcttgtaaactgtcacatgggaaaacagaagtaggaaggaagctgccagcgtctgagggagtaggaaagggaacttacggagtgtcccgtgccgtcaccacacagcatctcctgtctatcatttctttggcaaatactttaatgagtatgaccaatgcaacttttattggtgatcatatgaagaagggtcctaccaggccacctagaccaagcaccccagacctttctaaggcaaggggttcccctccaacttccagtaatattgtgcaaggacagattaaacaagttgctgcacctgtcgtttccgctcggtctgatgctgatcactctggctctgaccctccttctgctcctgctttacatacctgtttcttagtaaatgaaggttggagtcagttagctgctatgcactgtgttatgctgccagacctactgggattggataaatttaggcctccccttctggagatgctggcccgaagatggcaagatcgatgcttggaggtgagagaagccgcgcaggccctgcttctggcggaactgagaagaattgagcaggcaggcaggaaggaagccattgatgcctgggctccttacttacctcagtacatagaccacgtcatatcacctggagtcacatcagaagccgcgcagactatcaccacggctcctgatgcctcagggcctgaagcaaaagtccaggaggaagagcatgaccttgttgacgatgacatcaccactggttgcttatcaagtgtcccacaaatgaaaaaaatttctacatcttacgaggaaagacggaagcaagctaccgctattgttttacttggagtaataggagctgaatttggtgctgaaattgaacctcctaaactattgaccagacctcgaagctctagccaaattcctgagggattcgggttgactagtggtggatccaactactcgctggccagacatacttgcaaggcactgacgtttcttctgctacagcctccaagccccaaacttcctccacacagcactatccgaagaacagccattgatctgattggacgtgggttcactgtttgggagccttacatggatgtgtccgctgttctgatggggcttctcgaactttgtgccgatgccgagaaacaacttgccaacatcacaatggggttgcctctgagcccagcagctgactcggcccgctctgcgaggcatgccctctcgctcattgccaccgccagaccacccgccttcatcaccaccatagccaaagaggtacacagacatacggctcttgcagcaaatacccaatcacagcagaatatgcacacaacaactcttgcacgagctaaaggggaaattttgagagtcattgaaattcttattgaaaagatgcccacagatgttgtggatcttctcgtggaggttatggacatcattatgtactgccttgaaggatctttagttaaaaagaaaggtcttcaagaatgtttcccagccatctgcaggttctacatggtcagctattatgagcggaatcacagaatagcagttggagctcgccatggttcagtggccctgtacgacatccggactggaaaatgtcagacaatccatggacacaagggaccaatcactgcagtggcttttgctcctgatggaagatatcttgccacctactcaaacactgacagccacatttctttttggcagatgaacacgtcactgctgggaagcatcggcatgctgaactcggcacctcagctgcgctgcattaaaacctaccaggtgccccctgtgcagcccgcgtcccccggctcccacaatgccctcaagctggcccggctcatctggacttccaaccgcaacgtcatcctcatggcccatgacgggaaggagcaccgcttcatggtctaatgctgctgcctgccgccgtgactgcgttttagttctctaaattatccaagccgatgttgctctgtccttcctcacaccagattgttcccaggggcctgcccaccccagtgccatccagtggcacggccgggtcttgtcacttgtgcatgcttctcaggggcagaacccgctcgtgccatctgtcgattcagaggcacgcacacatgctctgcaggatgtggccatcctgtcaccaggtagtttttccctgccagagatggcaggggaaagccagtggttcctgggaacgctcttgttgcttggtgcaacagaagcacaaaaatcaataaacactgtgattgcactcccagcccagatcagcatttttagccatctcaaccgcacctctgaagtgctgcttgaatctggccgttctgacactgggtgttgaggtcatgtggcagtcctcacgattgaaattattgccctttgaattacctaaaatattgtttaccaaaaagattctgtgtttacatgttcttttcttctggtgattgctaggaaattactcaatccaatttcctagggtttagctaccaccttctttatcaacagctaaccaatttgagattcatgattaattatgtacacaaaaatattttccttgtagaaaatagttttccagacacttagccttctgaagtgctcatctcttgcttaaatgatagtctatttagtagtttaaaataaaaataatcactccctatgatctagttaatgtaattatccagtcactgtaactaatctcttgaagggacttttgtgataaagagccaagttcagaagcatagcgtgtaccgaaaatgaagactctcctatctactgctacagatcctgttgaagaaagagcttacccctttcccccggaaaacttgcaatcctgtagttcccatatgtgtggcatatgtcagttatgaaattattataattcagccttcaaactactactgatcaactaaaggaaagctaataaggtatttcttttaaacaagtattctggaaaagtaataactatggcacaaatgttcaggagtgtatataaaaatatgtgggctctcgatttatttgagcaaacattgcaatgagggtgttcattatgcttctaagtaagctttaactagaccactttcttcttatgtcagattgtgctggttctagctcataataatgaaaaaaatagaattatattttgtatgaattgtttctaacaaaccttgatctgtatatacttgtgaggggttgtttggttgcctaattgttgattggttggttagttgggcaaaatcatttattacatgcaaaaatagaaaattatttgttaaattcagagaaaatatgtgaagtttacaaaggaaccaaaatgataatgggagaatttagtcttaaaagtttaggttgtcagagtttatctgatatacaaaaaagtaggatcaaagtctaggaacaaacattggttatttcactgaaacagatttttaaagagcatattaagaaattaagaccattagatcatctctttcataatgatatgatgttatttccattgacggcaaatctatactgttccttggttttagagttgggtattctttcaaaagtgaatttaggcacatgcatgtacattgtatttataaagattatatatgtagtttccaaggaagaaacaaagacctatacagtttagactttatttgtttggtgaacgtgctgttgtgtttggcatagctagagaaatgtaaggtaaaaggctcactttgttttccagtgggtccagagtcttctctatacccaacatatgtttactttatgaacttaaatggaaattaatttattgtagactacatctctatttggaatgatgaggtaaatgtataccttagcattttctttaacaaaaatgttctgtgtgtcaggaaagaggtgtgagagtggtaggcagcctgccgcaaacacacggatggctccccccgccacgaaggttgagaacaaagccagggggcccagaggagcaatagccctgggccacaagcgtgggtaggcctttcacgtattccgtctgcacaggcaaccaaggccagtagaaagctatggctgcaaaaccctggggtggacgatgtttgatgattagacggtcatctctaactactaaactaatatctgcattcttgttaacataaatctctccttggctattttaatagccacagtcccaaacttcatcccagcttagatttctcagcactgaggtaaactctgcattgtcatcccagcgtacacctttaatgttttattgatttcactggcactgtatttggacctgtccttgtatatgtagagacatatgtggcttcattggtaatttacaagcaaaagatgacatgacgtgacacctgtatgaaaatgtgatgattgaactccctgtgtacagcgagtgaattaaaatgtctgcctctccagacatttcttaatgattccacttaatagactctatgtgtgctgaatgttcctgtgtacatatgtgtgttaaataaaacaattgtattgaagactgtttttctc

SEQ ID NO: 199950 - DNA, 2983 bp, Homo sapiens
  Payload ID: 19443
  Gene Name: WD repeat domain 70
  Uniprot ID: Q9NW82
  ENST ID: ENST00000265107
  CDS Start-End: 157-2121
cgcggtccctctgcggaaggcgccgctcttggcttcggcggcgccgctgtagcttgaaggcggtacttcctccagcatttgccgcaagttattggcaagttcccctgcagttgtttgggctgtccctgtggctggttctggggtgtgcggccagccatggagcgctctgggcccagcgaagtgacaggctcagacgcgtcgggaccggacccgcagcttgcggtcaccatgggcttcacggggttcggtaaaaaagctcgcacatttgacttggaagcaatgtttgaacaaactcgaaggacagctgtggaaagaagtcgcaaaacactggaagcaagagaaaaagaggaagaaatgaacagagagaaagaattaagaagacaaaatgaagatattgagccaacatcctcaagatcaaatgtggtcagagattgctccaaatcatcttccagggatacgagcagcagtgaaagtgaacagagttctgactcttctgatgatgagttaattggccctcctttaccccctaaaatggtaggaaaaccagttaattttatggaggaagatatcctcggtcctttacctccacctcttaatgaagaagaagaagaagcagaggaagaagaagaggaagaggaggaagaggaaaatcctgttcacaagattcctgactcgcatgagataacgctgaagcatggcactaaaacagtgtctgctttgggtctggatccctcaggtgcccgtttggtgacaggaggatatgactatgatgttaagttttgggattttgctggaatggatgcttcttttaaggcatttcgatcccttcagccctgtgagtgccatcagatcaagtcattacagtatagtaacacaggagacatgattcttgttgtatctggaagctctcaggccaaggtgattgacagagatggttttgaagtaatggaatgtataaaaggagaccagtatattgtggacatggccaacaccaagggtcatacagcaatgcttcatactggctcatggcatcccaaaataaagggagaatttatgacttgctcaaatgatgcgactgtgaggacgtgggaagttgaaaatccaaagaagcaaaaaagtgtgtttaaaccacggacgatgcaaggcaaaaaagtcattcccactacgtgcacatatagtagagatggaaacctcatagcagctgcctgccagaatggaagcatacagatctgggaccgaaatttgactgttcatcctaagttccactataaacaggctcatgactcgggcacagacacttcttgcgtgactttttcctatgatggtaatgtccttgcctctcgtggaggtgacgattcattaaaattatgggacatccgacaatttaataaaccacttttttcagcctcgggtcttcccaccatgttcccaatgactgactgctgtttcagtccagatgataagctcatagtcactggtacatctattcaaagaggatgtggcagcggcaaacttgttttctttgagcgtaggactttccaaagggtgtatgaaatagacatcacagatgcgagtgttgttcgctgcctgtggcatccaaagctgaaccagatcatggttggaactggaaatggattggctaaagtctattacgaccccaacaagagtcagaggggagcaaaattatgtgtggttaaaacccagcggaaggcaaaacaagctgagactctaactcaggactacatcatcacccctcatgccttgcctatgttccgtgagccccgccaacggagtacaaggaaacagctggagaaggacagactggatcccctgaagtcgcataaacctgaacctcctgtagcaggcccaggtcgtggtggccgagttggaacccacgggggcactctctcttcctatattgtgaagaacattgctttggacaagaccgatgacagtaatcctcgggaagccattttgcgtcatgccaaagcagcagaagacagcccatattgggtttctccagcatattccaagactcagcccaaaaccatgtttgcccaagttgaatctgatgatgaggaagcaaagaatgagccagaatggaaaaaacgtaaaatttgaagaatctcatttgagagctgtttgcatgagtgggaggggtatgggacaggtttgggttttttttttatgctcatgaaattaaaaattcatttttatgaacaggttttgtcctttgcattattgaactggtcaaaagtttggtggctaggcttcactaaaattgtgcttaaattttcttacctgcaactattaaactgattacagataaacaagaaacagattcttagtctattaccaagtactttaggtatttggaaactttattcaacaattattggtcttgtccagattctcataaccttagagaggaaaatgtacattaagatgtgcatctgtctctagcaattctaggaacataatatagaaatagagatcaaaaagtttaatgtttctgtataatttcacaacagttgtttacatgactgtaattaattaggctgagttcaaaccaaatacattgccatactgggaaagagcattatctcattatccttcaatagcagaatacagtggttaagagttaggagtgggctttgaagtcagactcatgtggattcaagtcctggctttgctctttacttctgggtcatcttaagagagttatttaacttttcttttctagcctcagatgatgaaatagtacgtactttgcaggttcgtcagaagaattaaatgggacatgcctcacagagcatttagtacagtacctggaacacagtaaatgtataccaaatatttgctattttaaaatagggctaatatttactttgcttggtttttatcagtattaaattagaaaggtatagaattgctttgtaaatgtaaagactaaacagaagacattaaaaattattctaaaaaa

SEQ ID NO: 199951 - DNA, 1526 bp, Homo sapiens
  Payload ID: 19443
  Gene Name: WD repeat domain 70
  ENST ID: ENST00000504564
  CDS Start-End: 84-1247
agcatttgccgcaagttattggcaagttcccctgcagttgtttgggctgtccctgtggctggttctggggtgtgcggccagccatggagcgctctgggcccagcgaagtgacaggctcagacgcgtcgggaccggacccgcagcttgcggtcaccatgggcttcacggggttcggtaaaaaagctcgcacatttgacttggaagcaatgtttgaacaaactcgaaggacagctgtggaaagaagtcgcaaaacactggaagcaagagaaaaagaggaagaaatgaacagagagaaagaattaagaagacaaaatgaagatattgagccaacatcctcaagatcaaatgtggtcagagattgctccaaatcatcttccagggatacgagcagcagtgaaagtgaacagagttctgactcttctgatgatgagttaattggccctcctttaccccctaaaatggtaggaaaaccagttaattttatggaggaagatatcctcggtcctttacctccacctcttaatgaagaagaagaagaagcagaggaagaagaagaggaagaggaggaagaggaaaatcctgttcacaagattcctgactcgcatgagataacgctgaagcatggcactaaaacagtgtctgctttgggtctggatccctcaggtgcccgtttggtgacaggaggatatgactatgatgttaagttttgggattttgctggaatggatgcttcttttaaggcatttcgatcccttcagccctgtgagtgccatcagatcaagtcattacagtatagtaacacaggagacatgattcttgttgtatctggaagctctcaggccaaggtgattgacagagatggttttgaagtaatggaatgtataaaaggagaccagtatattgtggacatggccaacaccaagggtcatacagcaatgcttcatactggctcatggcatcccaaaataaagggagaatttatgacttgctcaaatgatgcgactgtgaggacgtgggaagttgaaaatccaaagaagcaaaaaagtgtgtttaaaccacggacgatgcaaggcaaaaaagtcattcccactacgtgcacatatagtagagatggaaacctcatagcagctgcctgccagaatggaagcatacagatctgggaccgaaatttgactagcaacaagttaagactgtcatatggaactgtctgcatgctctgggctcacactgaagtttgtgtgatgtgaatccactggactctataacttttaaggttcatcctaagttccactataaacaggctcatgactcgggcacagacacttcttgcgtgactttttcctatgatggtaatgtccttgcctctcgtggaggtaggttaaaagctttctttttgatgtatttctctatataaaataatcatctttaacaaatatgacaataatatcctagtgcttagtaaagcttgctttgatttttgttaatgcacctttgccagtctgatttcttcattaaaatacatttct

SEQ ID NO: 199952 - DNA, 5887 bp, Homo sapiens
  Payload ID: 19444
  Gene Name: WD repeat domain 72
  Uniprot ID: Q3MJ13
  ENST ID: ENST00000360509
  CDS Start-End: 43-3351
cctctgccgctcctccgccccacggctcaggattcgcccaaaatgaggacttccctgcaggcagtggcactctggggacagaaggcccctccccacagcatcactgccatcatgatcactgatgaccagcgaacgattgtgactggaagtcaagagggtcagctctgtctctggaatctctcacatgaactaaagatttcagcgaaagaactcctatttggtcattcagcttcggtaacatgtttggcaagagcaagggacttctctaaacagccctacattgttagtgctgctgaaaatggggagatgtgtgtttggaatgtcaccaatggacagtgcatggagaaggctacacttccttacaggcacactgcaatctgttattaccactgctcattccggatgacaggagaaggctggcttctttgttgtggagaatatcaagatgtccttataattgatgccaaaactttggctgttgttcacagttttagatcatctcagtttcctgactggatcaactgcatgtgcattgttcactccatgagaattcaagaagattctctcttggtggtatcagtagctggtgagctcaaagtatgggatctttcctcatctatcaacagcattcaggaaaagcaagatgtctatgaaaaagaatccaagtttcttgagtccttgaactgccagacaattcgattttgcacatatactgagagacttctattggtggtattttctaaatgttggaaggtttatgattattgtgatttttcccttctgctgactgaagttagtagaaatgggcagttctttgctggtggagaagtgattgctgctcacagaatcctcatctggacagaagatggtcacagttacatctatcagctgctgaacagtgggctttcaaaaagcatataccctgctgatggaagagtgcttaaagagaccatttatcctcatttactgtgctctacttctgtgcaggaaaataaggaacagagccgtccctttgttatgggctacatgaatgaaaggaaagagcctttttacaaggtacttttctctggagaagtctcaggaagaattactttgtggcacatccctgatgttcctgtatccaagtttgatggttctcctagagagataccagtaactgccacctggactcttcaagataattttgataagcatgatactatgtcacaaagtattattgactatttctctgggcttaaagatggggcaggaactgctgtagtcacttcatcagagtatattccaagtcttgataaactaatatgtggctgtgaagatgggacaattatcattacccaggctttgaatgctgccaaagcaagacttctggaaggtggttctttagtaaaagattctccccctcataaagttcttaaaggccaccaccaaagtgtcacttcattactctatccacatggtctctcttcgaaattagaccaaagttggatgttgtctggggacctggactcatgtgtgatcttgtgggatatctttactgaagaaattttgcataaattctttttggaagctggtccagtaacaagtcttttgatgtcaccagagaagtttaaactaaggggtgagcagataatttgctgtgtgtgcggtgaccattccgtggctctccttcaccttgagggaaagagttgcctcctgcatgcccggaagcacctttttcctgtgaggatgataaaatggcacccggttgagaattttttaattgttggatgtgcagatgactcagtttatatctgggaaattgaaacaggcactttggaaagacatgagacaggagaaagagcacgaattattcttaattgttgtgatgattcacagcttgtgaagtctgtacttcccattgcctcagagacacttaagcacaaaagtatagaacagagatcctccagcccctaccagcttgggccattaccttgccctggtctgcaggtggagtcttcatgtaaggttactgatgccaaattttgcccaagaccttttaatgtcttgcctgtgaagacaaaatggagtaacgttggctttcatattcttctatttgatctggaaaaccttgttgaacttttgctaccaactccactcagtgatgttgactcttccagttcattctatggtggtgaggtcctgagaagagccaagagcacagtggagaagaagacactgacactgagaaaaagtaaaactgcctgtggtcctctttcagcagaggcactagccaagcctattactgaaagcctggcccaaggagataataccatcaaattctcagaagaaaatgatggcattaaaaggcagaagaaaatgaagatctccaaaaaaatgcagcctaagccatcaagaaaagtagatgccagtctcacaatagacacagcaaaattgtttctgtcttgccttttgccatggggagtggataaagatttagattatctttgcattaagcacctcaatattttaaagcttcagggtcctatttctttgggaatttctttgaatgaagataatttctcactgatgttgccaggttgggatttatgcaatagtggaatgataaaagactattcaggagtaaatttattttccaggaaagttttggacttgtcagataaatacacagccactcttccaaatcaggttggaattccaagaggattggaaaataattgtgattctttgcgagagtcagatactatagtttatttgttgagcagactatttttagttaataaattagttaacatgcctttagaattggcatgtagagttggcagttctttcagaatggaaagtatacataataagatgagaggtgctgggaatgacattttaaatatgtcaagcttctacagttgcttacgaaatggtaagaatgaatcccatgtacctgaggctgacctttcacttttgaagctaatttcctgttggagagaccagtctgtgcaggtaactgaagcaatacaagctgttctcttggcggaagttcaacaacacatgaagagtttgggaaagatacccgtcaatagtcaaccagtgtccatggcagagaatggtaactgtgagatgaagcagatgctgccaaagctggaatggacagaagaactagagttacagtgtgttagaaacactttgcctctgcaaactccagtcagcccggtcaagcatgacagcaactcaaactcggcaaacttccaagacgtggaggacatgcctgacagatgtgccttggaagagtctgagagtccaggtgagccaaggcatcattcatggatagcaaaggtctgcccctgcaaggtgtcttaaatggaatctcatcagtaggagctgaatttggacaaattaagaaatccaaaagatgccatttgtttattactgtataaaagcattgttgttattggtcaagttattaggctgtagtggatttgctaatactttagccaacatgtattaaagtgattttaatacatgctgattacaatgcaatacatactgattgaaaatattcatattcatctaattttagaaaaatattgcctagatcattctctattcctgtttcttactttttctgttaatatttccaacagggaatgccagtccacagacacaaatttaatactgctttaaattttctcctatccttttagtccctgaattatataataaacaatgttaaaaccaatgtagtacacaatacttacttacaaatttaatactgcttcaaggtatttaatctaaaattttaccaactttgatttgtctggttaggatattttgttttagtggatatgctttaattcggatcaattactgcagtaaatctcatccctaagcatgaaatgttgtcaacaaatacccagttccatttagttatcaattagcccaaataagagatacaaagtataacagtgaccaaccttgtactgttgagttaatttgaacttctaatgacattgaggctaatgtctttagctcaaggttgatcttgttggccatatagatgtgaactagggaaggggaatcaacttacagcatatcacaattgatccttattaagtataaactcttgtaggtcttttcccagaaagaagcttgactagcaggaattctaaaactgaaatatatcaaacagcataaataggaatagacataaagtgctcttctattaaagcctttggtgatctatttactatgatttatattgtacagttcctcgatttacagaaaatcatcaaaattattaatctacatatcttatgtatataaatattgcctaatccatagaaaaaaggatataaagtattaaatatgtgatatatagctatatctatctatctatgtatctaatagggaagtccaagtcacttcaattgaagaaacatatctctgagcataggagcagcctcaggtcctatggtgggatgcagtggacaggagagggggaaattagaaaagagaactatataattgaaaaagggatataaagcattaaatatatgatatatagctatatctatgtatgtatctaacagagaagttcaagtcacttcaattaaagaaacatttttgagcatgggaccagcctcaggtcttatgctgggatgcagtagacaggagatggggaaattagaaaagagaactgtgtaattgaaatgacgtgggctgcacccttaaggaacttataattaatgatgatctgaataaacataccaggataaagatgtcaaatgagtgtgactcccttaaagtagattaaagtgtgcattctttgtttcctaaaatatgattttactgcttgaaattacatttgagttgaagtttagaaactaacatagcattaatatgaataatcatggaaaattattatcctttgaaaactgattgataaatatattccccctcctttagaaacagtcaaaagccacttcaaacaagtttcaaaataaaggaaggtagcaagttaggcgatggattatattttcttgcttgttgtataccagttgtcaaggacattataaggactcccaaaagcattttgaaggatggcaatatcaaataagtgtatgtcctctcaaatgaggcatttttaattgttaaaatctatttggacgctcaggttatgatatgtttatgaaaaataagcttcattatttttatagctacatcctattattcccttttagaaacaagaataacaataggttttaatagttgccatacttagcatttatcagttctaatgaaaccaatattgaatctctgataaatattttctgatgttactagctatgggaaattagaactggcacaaccctgacattactaagtggaaatgttaggatttttcggcatcgcatgttagaatctctaaaatttaaacattcctgttaaatgactaaggtttgcttttatcaatatgaattctgaaggccaatatcataccattaactatgaaagcttttaattcctaaaaatagttttagagatattcaagcaatgctctcctaatatccatacgcaagtgtgtttatgacacaaattcactagtctgtttaaaaatgaattctttatattgactggtgttccacatatttcagtaatttctgttatgagaggacttgaaatagcaaattgccacacagttaactggatagaccacgtacgtggtgatcataaccacttggtactacacccagaaactcaaaattgtctttctcctgatgagatatgggtgtccttttgtacgtctaggcctaggtaaccagtggagtgattatattagcaaatgtgtttgtatccggagtcttcctgtcattgtaataaaaaatttatttaaaaa

SEQ ID NO: 199953 - DNA, 7507 bp, Homo sapiens
  Payload ID: 19444
  Gene Name: WD repeat domain 72
  Uniprot ID: Q3MJ13
  ENST ID: ENST00000396328
  CDS Start-End: 241-3549
gttcttttgttcttttctctctgcccccattttgtgggcccccaaattattatgggtcctgggcaccgtccctaatggataagccagccctgatctgagacacagagaggctgagggtctctaagaccactaagctagctacagcagagctcagacaagagcaactaggtctagacctctttctacatttgcgactatgaaaactatggagaaggctctgctcaagaggattcgcccaaaatgaggacttccctgcaggcagtggcactctggggacagaaggcccctccccacagcatcactgccatcatgatcactgatgaccagcgaacgattgtgactggaagtcaagagggtcagctctgtctctggaatctctcacatgaactaaagatttcagcgaaagaactcctatttggtcattcagcttcggtaacatgtttggcaagagcaagggacttctctaaacagccctacattgttagtgctgctgaaaatggggagatgtgtgtttggaatgtcaccaatggacagtgcatggagaaggctacacttccttacaggcacactgcaatctgttattaccactgctcattccggatgacaggagaaggctggcttctttgttgtggagaatatcaagatgtccttataattgatgccaaaactttggctgttgttcacagttttagatcatctcagtttcctgactggatcaactgcatgtgcattgttcactccatgagaattcaagaagattctctcttggtggtatcagtagctggtgagctcaaagtatgggatctttcctcatctatcaacagcattcaggaaaagcaagatgtctatgaaaaagaatccaagtttcttgagtccttgaactgccagacaattcgattttgcacatatactgagagacttctattggtggtattttctaaatgttggaaggtttatgattattgtgatttttcccttctgctgactgaagttagtagaaatgggcagttctttgctggtggagaagtgattgctgctcacagaatcctcatctggacagaagatggtcacagttacatctatcagctgctgaacagtgggctttcaaaaagcatataccctgctgatggaagagtgcttaaagagaccatttatcctcatttactgtgctctacttctgtgcaggaaaataaggaacagagccgtccctttgttatgggctacatgaatgaaaggaaagagcctttttacaaggtacttttctctggagaagtctcaggaagaattactttgtggcacatccctgatgttcctgtatccaagtttgatggttctcctagagagataccagtaactgccacctggactcttcaagataattttgataagcatgatactatgtcacaaagtattattgactatttctctgggcttaaagatggggcaggaactgctgtagtcacttcatcagagtatattccaagtcttgataaactaatatgtggctgtgaagatgggacaattatcattacccaggctttgaatgctgccaaagcaagacttctggaaggtggttctttagtaaaagattctccccctcataaagttcttaaaggccaccaccaaagtgtcacttcattactctatccacatggtctctcttcgaaattagaccaaagttggatgttgtctggggacctggactcatgtgtgatcttgtgggatatctttactgaagaaattttgcataaattctttttggaagctggtccagtaacaagtcttttgatgtcaccagagaagtttaaactaaggggtgagcagataatttgctgtgtgtgcggtgaccattccgtggctctccttcaccttgagggaaagagttgcctcctgcatgcccggaagcacctttttcctgtgaggatgataaaatggcacccggttgagaattttttaattgttggatgtgcagatgactcagtttatatctgggaaattgaaacaggcactttggaaagacatgagacaggagaaagagcacgaattattcttaattgttgtgatgattcacagcttgtgaagtctgtacttcccattgcctcagagacacttaagcacaaaagtatagaacagagatcctccagcccctaccagcttgggccattaccttgccctggtctgcaggtggagtcttcatgtaaggttactgatgccaaattttgcccaagaccttttaatgtcttgcctgtgaagacaaaatggagtaacgttggctttcatattcttctatttgatctggaaaaccttgttgaacttttgctaccaactccactcagtgatgttgactcttccagttcattctatggtggtgaggtcctgagaagagccaagagcacagtggagaagaagacactgacactgagaaaaagtaaaactgcctgtggtcctctttcagcagaggcactagccaagcctattactgaaagcctggcccaaggagataataccatcaaattctcagaagaaaatgatggcattaaaaggcagaagaaaatgaagatctccaaaaaaatgcagcctaagccatcaagaaaagtagatgccagtctcacaatagacacagcaaaattgtttctgtcttgccttttgccatggggagtggataaagatttagattatctttgcattaagcacctcaatattttaaagcttcagggtcctatttctttgggaatttctttgaatgaagataatttctcactgatgttgccaggttgggatttatgcaatagtggaatgataaaagactattcaggagtaaatttattttccaggaaagttttggacttgtcagataaatacacagccactcttccaaatcaggttggaattccaagaggattggaaaataattgtgattctttgcgagagtcagatactatagtttatttgttgagcagactatttttagttaataaattagttaacatgcctttagaattggcatgtagagttggcagttctttcagaatggaaagtatacataataagatgagaggtgctgggaatgacattttaaatatgtcaagcttctacagttgcttacgaaatggtaagaatgaatcccatgtacctgaggctgacctttcacttttgaagctaatttcctgttggagagaccagtctgtgcaggtaactgaagcaatacaagctgttctcttggcggaagttcaacaacacatgaagagtttgggaaagatacccgtcaatagtcaaccagtgtccatggcagagaatggtaactgtgagatgaagcagatgctgccaaagctggaatggacagaagaactagagttacagtgtgttagaaacactttgcctctgcaaactccagtcagcccggtcaagcatgacagcaactcaaactcggcaaacttccaagacgtggaggacatgcctgacagatgtgccttggaagagtctgagagtccaggtgagccaaggcatcattcatggatagcaaaggtctgcccctgcaaggtgtcttaaatggaatctcatcagtaggagctgaatttggacaaattaagaaatccaaaagatgccatttgtttattactgtataaaagcattgttgttattggtcaagttattaggctgtagtggatttgctaatactttagccaacatgtattaaagtgattttaatacatgctgattacaatgcaatacatactgattgaaaatattcatattcatctaattttagaaaaatattgcctagatcattctctattcctgtttcttactttttctgttaatatttccaacagggaatgccagtccacagacacaaatttaatactgctttaaattttctcctatccttttagtccctgaattatataataaacaatgttaaaaccaatgtagtacacaatacttacttacaaatttaatactgcttcaaggtatttaatctaaaattttaccaactttgatttgtctggttaggatattttgttttagtggatatgctttaattcggatcaattactgcagtaaatctcatccctaagcatgaaatgttgtcaacaaatacccagttccatttagttatcaattagcccaaataagagatacaaagtataacagtgaccaaccttgtactgttgagttaatttgaacttctaatgacattgaggctaatgtctttagctcaaggttgatcttgttggccatatagatgtgaactagggaaggggaatcaacttacagcatatcacaattgatccttattaagtataaactcttgtaggtcttttcccagaaagaagcttgactagcaggaattctaaaactgaaatatatcaaacagcataaataggaatagacataaagtgctcttctattaaagcctttggtgatctatttactatgatttatattgtacagttcctcgatttacagaaaatcatcaaaattattaatctacatatcttatgtatataaatattgcctaatccatagaaaaaaggatataaagtattaaatatgtgatatatagctatatctatctatctatgtatctaatagggaagtccaagtcacttcaattgaagaaacatatctctgagcataggagcagcctcaggtcctatggtgggatgcagtggacaggagagggggaaattagaaaagagaactatataattgaaaaagggatataaagcattaaatatatgatatatagctatatctatgtatgtatctaacagagaagttcaagtcacttcaattaaagaaacatttttgagcatgggaccagcctcaggtcttatgctgggatgcagtagacaggagatggggaaattagaaaagagaactgtgtaattgaaatgacgtgggctgcacccttaaggaacttataattaatgatgatctgaataaacataccaggataaagatgtcaaatgagtgtgactcccttaaagtagattaaagtgtgcattctttgtttcctaaaatatgattttactgcttgaaattacatttgagttgaagtttagaaactaacatagcattaatatgaataatcatggaaaattattatcctttgaaaactgattgataaatatattccccctcctttagaaacagtcaaaagccacttcaaacaagtttcaaaataaaggaaggtagcaagttaggcgatggattatattttcttgcttgttgtataccagttgtcaaggacattataaggactcccaaaagcattttgaaggatggcaatatcaaataagtgtatgtcctctcaaatgaggcatttttaattgttaaaatctatttggacgctcaggttatgatatgtttatgaaaaataagcttcattatttttatagctacatcctattattcccttttagaaacaagaataacaataggttttaatagttgccatacttagcatttatcagttctaatgaaaccaatattgaatctctgataaatattttctgatgttactagctatgggaaattagaactggcacaaccctgacattactaagtggaaatgttaggatttttcggcatcgcatgttagaatctctaaaatttaaacattcctgttaaatgactaaggtttgcttttatcaatatgaattctgaaggccaatatcataccattaactatgaaagcttttaattcctaaaaatagttttagagatattcaagcaatgctctcctaatatccatacgcaagtgtgtttatgacacaaattcactagtctgtttaaaaatgaattctttatattgactggtgttccacatatttcagtaatttctgttatgagaggacttgaaatagcaaattgccacacagttaactggatagaccacgtacgtggtgatcataaccacttggtactacacccagaaactcaaaattgtctttctcctgatgagatatgggtgtccttttgtacgtctaggcctaggtaaccagtggagtgattatattagcaaatgtgtttgtatccggagtcttcctgtcattgtaataaaaaatttatttaaaaattttgtcttgtgtttcttttttggtaatcatcttggtgatatttatgaatgtatttgtgtgtgtgtgtgtgtgtgtatacatacatatatatgtgtgtatatatatacacacatatatatacacatatatatgtgtgtatatatatatatatatggcatatcccccaaaggaatatcatattttcatttgcaagccttgattctttgacttgctgttgagtttcacattggctccattgtatattgcaggaaaaagtacctggaaagcctggagggttaaaagcagaggctcctcggcagcgtgtccaggccgtgtgtgcttgctgtgcttgtcagagcctcattccctcccctgtgttggagagctttctcacagggctcatccagaggtgctagaaagcaatgtgagcactattaaacacttcaaatataaggaaaaatgtataatgttagaaacacacagttaaaaagtagccccaggtatcaaacattctgttactattttagaaactaaattaaggctgctttgaacatgatggtattagaaaaatggtagaatacagtttgttaaatattaatattctatctttagatgatagcatttggtgacttttatttcttttctcatacattttttccagtgttctgtatttttaaaatcctttcataattattataatgaacactttagaaaagatactatttctcttccatccttagagggcacattataataattgagtattttaaaattaaattttatgccatgtatttaaaatgaaagttcaggttacattaattccaactgattttaaagccttattttcacagagtggactcattcaattttttaaattttatattcatacattttgattgctcagttatataaaagcggtgttatagactcctttattctccacaaaatgttgtcttatatgtaaagtgccaaaagttgtgtttaatttcctaagaaagtcattgctttgtaaacatttgcataatacttagtgttttttgtaattttaaaaaattagcttaaccaaaagagttgcaaaattaaaacttacttgagtaggtatctttcagacaaagctgcatggcttcatgtacaatagtccccagatcacctcgcactgtagtttgctcaagaaggagcctacagatggcaggtaggagaaggtaaactggaaattaacaggtctgtctgtaagagcatgccactggaaacacccatccaatttgggacccctggaagacagcatgtgtctaatgggaggcctgtcctagtacaactcctttactcttttcaccttcatcttgaccttctcagataccatctttatgtaaaatgttgatgttgtggagtttttgcagtaatttaatttttataaatattgtattaaaatatatttatcttga

SEQ ID NO: 199954 - DNA, 3602 bp, Homo sapiens
  Payload ID: 19444
  Gene Name: WD repeat domain 72
  ENST ID: ENST00000559418
  CDS Start-End: 35-3373
tcttcccttctttgtatgtcaggattcgcccaaaatgaggacttccctgcaggcagtggcactctggggacagaaggcccctccccacagcatcactgccatcatgatcactgatgaccagcgaacgattgtgactggaagtcaagagggtcagctctgtctctggaatctctcacatgaactaaagatttcagcgaaagaactcctatttggtcattcagcttcggtaacatgtttggcaagagcaagggacttctctaaacagccctacattgttagtgctgctgaaaatggggagatgtgtgtttggaatgtcaccaatggacagtgcatggagaaggctacacttccttacaggcacactgcaatctgttattaccactgctcattccggatgacaggagaaggctggcttctttgttgtggagaatatcaagatgtccttataattgatgccaaaactttggctgttgttcacagttttagatcatctcagtttcctgactggatcaactgcatgtgcattgttcactccatgagaattcaagaagattctctcttggtggtatcagtagctggtgagctcaaagtatgggatctttcctcatctatcaacagcattcaggaaaagcaagatgtctatgaaaaagaatccaagtttcttgagtccttgaactgccagacaattcgattttgcacatatactgagagacttctattggtggtattttctaaatgttggaaggtttatgattattgtgatttttcccttctgctgactgaagttagtagaaatgggcagttctttgctggtggagaagtgattgctgctcacagaatcctcatctggacagaagatggtcacagttacatctatcagctgctgaacaggtgggctcagatgggagcggcatacaaaacattcagtgggctttcaaaaagcatataccctgctgatggaagagtgcttaaagagaccatttatcctcatttactgtgctctacttctgtgcaggaaaataagagccgtccctttgttatgggctacatgaatgaaaggaaagagcctttttacaaggtacttttctctggagaagtctcaggaagaattactttgtggcacatccctgatgttcctgtatccaagtttgatggttctcctagagagataccagtaactgccacctggactcttcaagataattttgataagcatgatactatgtcacaaagtattattgactatttctctgggcttaaagatggggcaggaactgctgtagtcacttcatcagagtatattccaagtcttgataaactaatatgtggctgtgaagatgggacaattatcattacccaggctttgaatgctgccaaagcaagacttctggaaggtggttctttagtaaaagattctccccctcataaagttcttaaaggccaccaccaaagtgtcacttcattactctatccacatggtctctcttcgaaattagaccaaagttggatgttgtctggggacctggactcatgtgtgatcttgtgggatatctttactgaagaaattttgcataaattctttttggaagctggtccagtaacaagtcttttgatgtcaccagagaagtttaaactaaggggtgagcagataatttgctgtgtgtgcggtgaccattccgtggctctccttcaccttgagggaaagagttgcctcctgcatgcccggaagcacctttttcctgtgaggatgataaaatggcacccggttgagaattttttaattgttggatgtgcagatgactcagtttatatctgggaaattgaaacaggcactttggaaagacatgagacaggagaaagagcacgaattattcttaattgttgtgatgattcacagcttgtgaagtctgtacttcccattgcctcagagacacttaagcacaaaagtatagaacagagatcctccagcccctaccagcttgggccattaccttgccctggtctgcaggtggagtcttcatgtaaggttactgatgccaaattttgcccaagaccttttaatgtcttgcctgtgaagacaaaatggagtaacgttggctttcatattcttctatttgatctggaaaaccttgttgaacttttgctaccaactccactcagtgatgttgactcttccagttcattctatggtggtgaggtcctgagaagagccaagagcacagtggagaagaagacactgacactgagaaaaagtaaaactgcctgtggtcctctttcagcagaggcactagccaagcctattactgaaagcctggcccaaggagataataccatcaaattctcagaagaaaatgatggcattaaaaggcagaagaaaatgaagatctccaaaaaaatgcagcctaagccatcaagaaaagtagatgccagtctcacaatagacacagcaaaattgtttctgtcttgccttttgccatggggagtggataaagatttagattatctttgcattaagcacctcaatattttaaagcttcagggtcctatttctttgggaatttctttgaatgaagataatttctcactgatgttgccaggttgggatttatgcaatagtggaatgataaaagactattcaggagtaaatttattttccaggaaagttttggacttgtcagataaatacacagccactcttccaaatcaggttggaattccaagaggattggaaaataattgtgattctttgcgagagtcagatactatagtttatttgttgagcagactatttttagttaataaattagttaacatgcctttagaattggcatgtagagttggcagttctttcagaatggaaagtatacataataagatgagaggtgctgggaatgacattttaaatatgtcaagcttctacagttgcttacgaaatggtaagaatgaatcccatgtacctgaggctgacctttcacttttgaagctaatttcctgttggagagaccagtctgtgcaggtaactgaagcaatacaagctgttctcttggcggaagttcaacaacacatgaagagtttgggaaagatacccgtcaatagtcaaccagtgtccatggcagagaatggtaactgtgagatgaagcagatgctgccaaagctggaatggacagaagaactagagttacagtgtgttagaaacactttgcctctgcaaactccagtcagcccggtcaagcatgacagcaactcaaactcggcaaacttccaagacgtggaggacatgcctgacagatgtgccttggaagagtctgagagtccaggtgagccaaggcatcattcatggatagcaaaggtctgcccctgcaaggtgtcttaaatggaatctcatcagtaggagctgaatttggacaaattaagaaatccaaaagatgccatttgtttattactgtataaaagcattgttgttattggtcaagttattaggctgtagtggatttgctaatactttagccaacatgtattaaagtgattttaatacatgctgattacaatgcaatacatactgattgaaaatattcatattcatctaattttagaaaaatatt

SEQ ID NO: 199955 - DNA, 5900 bp, Homo sapiens
  Payload ID: 19444
  Gene Name: WD repeat domain 72
  ENST ID: ENST00000557913
  CDS Start-End: 61-3360
aggtaaggcaggcacccccagagcgcaggtcgggctgccgggtcccaggattcgcccaaaatgaggacttccctgcaggcagtggcactctggggacagaaggcccctccccacagcatcactgccatcatgatcactgatgaccagcgaacgattgtgactggaagtcaagagggtcagctctgtctctggaatctctcacatgaactaaagatttcagcgaaagaactcctatttggtcattcagcttcggtaacatgtttggcaagagcaagggacttctctaaacagccctacattgttagtgctgctgaaaatggggagatgtgtgtttggaatgtcaccaatggacagtgcatggagaaggctacacttccttacaggcacactgcaatctgttattaccactgctcattccggatgacaggagaaggctggcttctttgttgtggagaatatcaagatgtccttataattgatgccaaaactttggctgttgttcacagttttagatcatctcagtttcctgactggatcaactgcatgtgcattgttcactccatgagaattcaagattctctcttggtggtatcagtagctggtgagctcaaagtatgggatctttcctcatctatcaacagcattcaggaaaagcaagatgtctatgaaaaagaatccaagtttcttgagtccttgaactgccagacaattcgattttgcacatatactgagagacttctattggtggtattttctaaatgttggaaggtttatgattattgtgatttttcccttctgctgactgaagttagtagaaatgggcagttctttgctggtggagaagtgattgctgctcacagaatcctcatctggacagaagatggtcacagttacatctatcagctgctgaacagtgggctttcaaaaagcatataccctgctgatggaagagtgcttaaagagaccatttatcctcatttactgtgctctacttctgtgcaggaaaataagagccgtccctttgttatgggctacatgaatgaaaggaaagagcctttttacaaggtacttttctctggagaagtctcaggaagaattactttgtggcacatccctgatgttcctgtatccaagtttgatggttctcctagagagataccagtaactgccacctggactcttcaagataattttgataagcatgatactatgtcacaaagtattattgactatttctctgggcttaaagatggggcaggaactgctgtagtcacttcatcagagtatattccaagtcttgataaactaatatgtggctgtgaagatgggacaattatcattacccaggctttgaatgctgccaaagcaagacttctggaaggtggttctttagtaaaagattctccccctcataaagttcttaaaggccaccaccaaagtgtcacttcattactctatccacatggtctctcttcgaaattagaccaaagttggatgttgtctggggacctggactcatgtgtgatcttgtgggatatctttactgaagaaattttgcataaattctttttggaagctggtccagtaacaagtcttttgatgtcaccagagaagtttaaactaaggggtgagcagataatttgctgtgtgtgcggtgaccattccgtggctctccttcaccttgagggaaagagttgcctcctgcatgcccggaagcacctttttcctgtgaggatgataaaatggcacccggttgagaattttttaattgttggatgtgcagatgactcagtttatatctgggaaattgaaacaggcactttggaaagacatgagacaggagaaagagcacgaattattcttaattgttgtgatgattcacagcttgtgaagtctgtacttcccattgcctcagagacacttaagcacaaaagtatagaacagagatcctccagcccctaccagcttgggccattaccttgccctggtctgcaggtggagtcttcatgtaaggttactgatgccaaattttgcccaagaccttttaatgtcttgcctgtgaagacaaaatggagtaacgttggctttcatattcttctatttgatctggaaaaccttgttgaacttttgctaccaactccactcagtgatgttgactcttccagttcattctatggtggtgaggtcctgagaagagccaagagcacagtggagaagaagacactgacactgagaaaaagtaaaactgcctgtggtcctctttcagcagaggcactagccaagcctattactgaaagcctggcccaaggagataataccatcaaattctcagaagaaaatgatggcattaaaaggcagaagaaaatgaagatctccaaaaaaatgcagcctaagccatcaagaaaagtagatgccagtctcacaatagacacagcaaaattgtttctgtcttgccttttgccatggggagtggataaagatttagattatctttgcattaagcacctcaatattttaaagcttcagggtcctatttctttgggaatttctttgaatgaagataatttctcactgatgttgccaggttgggatttatgcaatagtggaatgataaaagactattcaggagtaaatttattttccaggaaagttttggacttgtcagataaatacacagccactcttccaaatcaggttggaattccaagaggattggaaaataattgtgattctttgcgagagtcagatactatagtttatttgttgagcagactatttttagttaataaattagttaacatgcctttagaattggcatgtagagttggcagttctttcagaatggaaagtatacataataagatgagaggtgctgggaatgacattttaaatatgtcaagcttctacagttgcttacgaaatggtaagaatgaatcccatgtacctgaggctgacctttcacttttgaagctaatttcctgttggagagaccagtctgtgcaggtaactgaagcaatacaagctgttctcttggcggaagttcaacaacacatgaagagtttgggaaagatacccgtcaatagtcaaccagtgtccatggcagagaatggtaactgtgagatgaagcagatgctgccaaagctggaatggacagaagaactagagttacagtgtgttagaaacactttgcctctgcaaactccagtcagcccggtcaagcatgacagcaactcaaactcggcaaacttccaagacgtggaggacatgcctgacagatgtgccttggaagagtctgagagtccaggtgagccaaggcatcattcatggatagcaaaggtctgcccctgcaaggtgtcttaaatggaatctcatcagtaggagctgaatttggacaaattaagaaatccaaaagatgccatttgtttattactgtataaaagcattgttgttattggtcaagttattaggctgtagtggatttgctaatactttagccaacatgtattaaagtgattttaatacatgctgattacaatgcaatacatactgattgaaaatattcatattcatctaattttagaaaaatattgcctagatcattctctattcctgtttcttactttttctgttaatatttccaacagggaatgccagtccacagacacaaatttaatactgctttaaattttctcctatccttttagtccctgaattatataataaacaatgttaaaaccaatgtagtacacaatacttacttacaaatttaatactgcttcaaggtatttaatctaaaattttaccaactttgatttgtctggttaggatattttgttttagtggatatgctttaattcggatcaattactgcagtaaatctcatccctaagcatgaaatgttgtcaacaaatacccagttccatttagttatcaattagcccaaataagagatacaaagtataacagtgaccaaccttgtactgttgagttaatttgaacttctaatgacattgaggctaatgtctttagctcaaggttgatcttgttggccatatagatgtgaactagggaaggggaatcaacttacagcatatcacaattgatccttattaagtataaactcttgtaggtcttttcccagaaagaagcttgactagcaggaattctaaaactgaaatatatcaaacagcataaataggaatagacataaagtgctcttctattaaagcctttggtgatctatttactatgatttatattgtacagttcctcgatttacagaaaatcatcaaaattattaatctacatatcttatgtatataaatattgcctaatccatagaaaaaaggatataaagtattaaatatgtgatatatagctatatctatctatctatgtatctaatagggaagtccaagtcacttcaattgaagaaacatatctctgagcataggagcagcctcaggtcctatggtgggatgcagtggacaggagagggggaaattagaaaagagaactatataattgaaaaagggatataaagcattaaatatatgatatatagctatatctatgtatgtatctaacagagaagttcaagtcacttcaattaaagaaacatttttgagcatgggaccagcctcaggtcttatgctgggatgcagtagacaggagatggggaaattagaaaagagaactgtgtaattgaaatgacgtgggctgcacccttaaggaacttataattaatgatgatctgaataaacataccaggataaagatgtcaaatgagtgtgactcccttaaagtagattaaagtgtgcattctttgtttcctaaaatatgattttactgcttgaaattacatttgagttgaagtttagaaactaacatagcattaatatgaataatcatggaaaattattatcctttgaaaactgattgataaatatattccccctcctttagaaacagtcaaaagccacttcaaacaagtttcaaaataaaggaaggtagcaagttaggcgatggattatattttcttgcttgttgtataccagttgtcaaggacattataaggactcccaaaagcattttgaaggatggcaatatcaaataagtgtatgtcctctcaaatgaggcatttttaattgttaaaatctatttggacgctcaggttatgatatgtttatgaaaaataagcttcattatttttatagctacatcctattattcccttttagaaacaagaataacaataggttttaatagttgccatacttagcatttatcagttctaatgaaaccaatattgaatctctgataaatattttctgatgttactagctatgggaaattagaactggcacaaccctgacattactaagtggaaatgttaggatttttcggcatcgcatgttagaatctctaaaatttaaacattcctgttaaatgactaaggtttgcttttatcaatatgaattctgaaggccaatatcataccattaactatgaaagcttttaattcctaaaaatagttttagagatattcaagcaatgctctcctaatatccatacgcaagtgtgtttatgacacaaattcactagtctgtttaaaaatgaattctttatattgactggtgttccacatatttcagtaatttctgttatgagaggacttgaaatagcaaattgccacacagttaactggatagaccacgtacgtggtgatcataaccacttggtactacacccagaaactcaaaattgtctttctcctgatgagatatgggtgtccttttgtacgtctaggcctaggtaaccagtggagtgattatattagcaaatgtgtttgtatccggagtcttcctgtcattgtaataaaaaatttatttaaaaatttt

SEQ ID NO: 199956 - DNA, 2572 bp, Homo sapiens
  Payload ID: 19444
  Gene Name: WD repeat domain 72
  ENST ID: ENST00000560036
  CDS Start-End: 248-2572
cagatgtggcatcaggagtgaacaaagccgctcatctcgcagtatccctacctatgctcctgggaggagtctaccccagatacgctctgaccttcggcaagttacttatgttctccaagactcattttcttcatgtttggaatagtgataataatgcatattgatattatgaggaccgcatgaagcagtgaacgtaatctaagcagcacagtgtctacaacttaacatatagtcagattcgcccaaaatgaggacttccctgcaggcagtggcactctggggacagaaggcccctccccacagcatcactgccatcatgatcactgatgaccagcgaacgattgtgactggaagtcaagagggtcagctctgtctctggaatctctcacatgaactaaagatttcagcgaaagaactcctatttggtcattcagcttcggtaacatgtttggcaagagcaagggacttctctaaacagccctacattgttagtgctgctgaaaatggggagatgtgtgtttggaatgtcaccaatggacagtgcatggagaaggctacacttccttacaggcacactgcaatctgttattaccactgctcattccggatgacaggagaaggctggcttctttgttgtggagaatatcaagatgtccttataattgatgccaaaactttggctgttgttcacagttttagatcatctcagtttcctgactggatcaactgcatgtgcattgttcactccatgagaattcaagaagattctctcttggtggtatcagtagctggtgagctcaaagtatgggatctttcctcatctatcaacagcattcaggaaaagcaagatgtctatgaaaaagaatccaagtttcttgagtccttgaactgccagacaattcgattttgcacatatactgagagacttctattggtggtattttctaaatgttggaaggtttatgattattgtgatttttcccttctgctgactgaagttagtagaaatgggcagttctttgctggtggagaagtgattgctgctcacagaatcctcatctggacagaagatggtcacagttacatctatcagctgctgaacagtgggctttcaaaaagcatataccctgctgatggaagagtgcttaaagagaccatttatcctcatttactgtgctctacttctgtgcaggaaaataaggaacagagccgtccctttgttatgggctacatgaatgaaaggaaagagcctttttacaaggtacttttctctggagaagtctcaggaagaattactttgtggcacatccctgatgttcctgtatccaagtttgatggttctcctagagagataccagtaactgccacctggactcttcaagataattttgataagcatgatactatgtcacaaagtattattgactatttctctgggcttaaagatggggcaggaactgctgtagtcacttcatcagagtatattccaagtcttgataaactaatatgtggctgtgaagatgggacaattatcattacccaggctttgaatgctgccaaagcaagacttctggaaggtggttctttagtaaaagattctccccctcataaagttcttaaaggccaccaccaaagtgtcacttcattactctatccacatggtctctcttcgaaattagaccaaagttggatgttgtctggggacctggactcatgtgtgatcttgtgggatatctttactgaagaaattttgcataaattctttttggaagctggtccagtaacaagtcttttgatgtcaccagagaagtttaaactaaggggtgagcagataatttgctgtgtgtgcggtgaccattccgtggctctccttcaccttgagggaaagagttgcctcctgcatgcccggaagcacctttttcctgtgaggatgataaaatggcacccggttgagaattttttaattgttggatgtgcagatgactcagtttatatctgggaaattgaaacaggcactttggaaagacatgagacaggagaaagagcacgaattattcttaattgttgtgatgattcacagcttgtgaagtctgtacttcccattgcctcagagacacttaagcacaaaagtatagaacagagatcctccagcccctaccagcttgggccattaccttgccctggtctgcaggtggagtcttcatgtaaggttactgatgccaaattttgcccaagaccttttaatgtcttgcctgtgaagacaaaatggagtaacgttggctttcatattcttctatttgatctggaaaaccttgttgaacttttgctaccaactccactcagtgatgttgactcttccagttcattctatggtggtgaggtcctgagaagagccaagagcacagtggagaagaagacactgacactgagaaaaagtaaaactgcctgtggtcctctttcagcagaggcactagccaagcctattactgaaagcctggcccaaggagataataccatcaaattctcagaagaaaatgatggcattaaaaggcagaagaaaatgaagatctcc

SEQ ID NO: 199957 - DNA, 4224 bp, Homo sapiens
  Payload ID: 19444
  Gene Name: WD repeat domain 72
  ENST ID: ENST00000614174
  CDS Start-End: 1-267
atggcgggcgtccctcccccagcctggctgccgccttgcagtttgatctcagactgctgtgctagcaatcagcgagactccgtgggcgtaggaccctccgagccagctccagtcagcccggtcaagcatgacagcaactcaaactcggcaaacttccaagacgtggaggacatgcctgacagatgtgccttggaagagtctgagagtccaggtgagccaaggcatcattcatggatagcaaaggtctgcccctgcaaggtgtcttaaatggaatctcatcagtaggagctgaatttggacaaattaagaaatccaaaagatgccatttgtttattactgtataaaagcattgttgttattggtcaagttattaggctgtagtggatttgctaatactttagccaacatgtattaaagtgattttaatacatgctgattacaatgcaatacatactgattgaaaatattcatattcatctaattttagaaaaatattgcctagatcattctctattcctgtttcttactttttctgttaatatttccaacagggaatgccagtccacagacacaaatttaatactgctttaaattttctcctatccttttagtccctgaattatataataaacaatgttaaaaccaatgtagtacacaatacttacttacaaatttaatactgcttcaaggtatttaatctaaaattttaccaactttgatttgtctggttaggatattttgttttagtggatatgctttaattcggatcaattactgcagtaaatctcatccctaagcatgaaatgttgtcaacaaatacccagttccatttagttatcaattagcccaaataagagatacaaagtataacagtgaccaaccttgtactgttgagttaatttgaacttctaatgacattgaggctaatgtctttagctcaaggttgatcttgttggccatatagatgtgaactagggaaggggaatcaacttacagcatatcacaattgatccttattaagtataaactcttgtaggtcttttcccagaaagaagcttgactagcaggaattctaaaactgaaatatatcaaacagcataaataggaatagacataaagtgctcttctattaaagcctttggtgatctatttactatgatttatattgtacagttcctcgatttacagaaaatcatcaaaattattaatctacatatcttatgtatataaatattgcctaatccatagaaaaaaggatataaagtattaaatatgtgatatatagctatatctatctatctatgtatctaatagggaagtccaagtcacttcaattgaagaaacatatctctgagcataggagcagcctcaggtcctatggtgggatgcagtggacaggagagggggaaattagaaaagagaactatataattgaaaaagggatataaagcattaaatatatgatatatagctatatctatgtatgtatctaacagagaagttcaagtcacttcaattaaagaaacatttttgagcatgggaccagcctcaggtcttatgctgggatgcagtagacaggagatggggaaattagaaaagagaactgtgtaattgaaatgacgtgggctgcacccttaaggaacttataattaatgatgatctgaataaacataccaggataaagatgtcaaatgagtgtgactcccttaaagtagattaaagtgtgcattctttgtttcctaaaatatgattttactgcttgaaattacatttgagttgaagtttagaaactaacatagcattaatatgaataatcatggaaaattattatcctttgaaaactgattgataaatatattccccctcctttagaaacagtcaaaagccacttcaaacaagtttcaaaataaaggaaggtagcaagttaggcgatggattatattttcttgcttgttgtataccagttgtcaaggacattataaggactcccaaaagcattttgaaggatggcaatatcaaataagtgtatgtcctctcaaatgaggcatttttaattgttaaaatctatttggacgctcaggttatgatatgtttatgaaaaataagcttcattatttttatagctacatcctattattcccttttagaaacaagaataacaataggttttaatagttgccatacttagcatttatcagttctaatgaaaccaatattgaatctctgataaatattttctgatgttactagctatgggaaattagaactggcacaaccctgacattactaagtggaaatgttaggatttttcggcatcgcatgttagaatctctaaaatttaaacattcctgttaaatgactaaggtttgcttttatcaatatgaattctgaaggccaatatcataccattaactatgaaagcttttaattcctaaaaatagttttagagatattcaagcaatgctctcctaatatccatacgcaagtgtgtttatgacacaaattcactagtctgtttaaaaatgaattctttatattgactggtgttccacatatttcagtaatttctgttatgagaggacttgaaatagcaaattgccacacagttaactggatagaccacgtacgtggtgatcataaccacttggtactacacccagaaactcaaaattgtctttctcctgatgagatatgggtgtccttttgtacgtctaggcctaggtaaccagtggagtgattatattagcaaatgtgtttgtatccggagtcttcctgtcattgtaataaaaaatttatttaaaaattttgtcttgtgtttcttttttggtaatcatcttggtgatatttatgaatgtatttgtgtgtgtgtgtgtgtgtgtatacatacatatatatgtgtgtatatatatacacacatatatatacacatatatatgtgtgtatatatatatatatatggcatatcccccaaaggaatatcatattttcatttgcaagccttgattctttgacttgctgttgagtttcacattggctccattgtatattgcaggaaaaagtacctggaaagcctggagggttaaaagcagaggctcctcggcagcgtgtccaggccgtgtgtgcttgctgtgcttgtcagagcctcattccctcccctgtgttggagagctttctcacagggctcatccagaggtgctagaaagcaatgtgagcactattaaacacttcaaatataaggaaaaatgtataatgttagaaacacacagttaaaaagtagccccaggtatcaaacattctgttactattttagaaactaaattaaggctgctttgaacatgatggtattagaaaaatggtagaatacagtttgttaaatattaatattctatctttagatgatagcatttggtgacttttatttcttttctcatacattttttccagtgttctgtatttttaaaatcctttcataattattataatgaacactttagaaaagatactatttctcttccatccttagagggcacattataataattgagtattttaaaattaaattttatgccatgtatttaaaatgaaagttcaggttacattaattccaactgattttaaagccttattttcacagagtggactcattcaattttttaaattttatattcatacattttgattgctcagttatataaaagcggtgttatagactcctttattctccacaaaatgttgtcttatatgtaaagtgccaaaagttgtgtttaatttcctaagaaagtcattgctttgtaaacatttgcataatacttagtgttttttgtaattttaaaaaattagcttaaccaaaagagttgcaaaattaaaacttacttgagtaggtatctttcagacaaagctgcatggcttcatgtacaatagtccccagatcacctcgcactgtagtttgctcaagaaggagcctacagatggcaggtaggagaaggtaaactggaaattaacaggtctgtctgtaagagcatgccactggaaacacccatccaatttgggacccctggaagacagcatgtgtctaatgggaggcctgtcctagtacaactcctttactcttttcaccttcatcttgaccttctcagataccatctttatgtaaaatgttgatgttgtggagtttttgcagtaatttaatttttataaatattgtattaaaatatatttatcttg

SEQ ID NO: 199958 - DNA, 5387 bp, Homo sapiens
  Payload ID: 19445
  Gene Name: WD repeat domain 73
  Uniprot ID: Q6P4I2
  ENST ID: ENST00000434634
  CDS Start-End: 62-1198
agagccgcgcggcccccgaaggctcgcaggcggaagtgagacgccggaagcggtcgttgccatggatcctggggacgactggctggtggaatccttgcgcttgtaccaggatttctatgcattcgacctgtcaggagccactcgagtccttgaatggattgatgacaaaggagtctttgttgctggctatgaaagcctgaaaaagaatgaaattcttcatctgaaattacctctcagactttctgtaaaggaaaacaagggcttattcccagaaagagatttcaaagtgcgccatggaggattttcagacaggtctatctttgatctaaagcatgtgccacataccagattgctggttaccagtggccttccaggttgttatctgcaggtgtggcaggttgcagaggacagtgatgtcattaaagctgtcagcaccattgctgtgcatgagaaagaggagagtctctggcctagggtggccgtcttctccacattggcacccggagtcctccatggggcgaggctccgaagtctgcaggtcgttgatctggagtcccggaagaccacgtacacctcagatgtcagtgacagtgaggagctgagtagcctgcaggtcctagatgcagacacctttgccttctgctgtgcttcaggccggctggggcttgttgacacccggcagaagtgggcaccgttggagaatcgcagccctggccctgggtctggtggagagagatggtgtgctgaagttgggagctggggccagggccctgggcccagcattgccagccttggctcagatgggcgtctttgtcttcttgacccccgggatctctgccatcctgtgagctcagtccagtgcccagtatccgtacctagccctgacccagagctgctgcgagtgacttgggccccaggcctgaagaattgcttggccatctcaggttttgatggtacagtccaggtctatgatgccacatcttgggatggaacacggagccaagatggaacacggagccaagtagaacctctcttcactcacagaggtcacatcttcctagatggaaatgggatggaccctgctcctttggtcaccacccacacctggcatccctgcagaccaaggactttgttatcagcaacaaatgatgcctctctgcatgtgtgggactgggtggacctttgtgccccccgctgacaccagcatctttccatctaggcctctagaaaggggaggagctgctgtagtagcaagggtgctcatgtaggactcaagtgactaccagtccctgttaccagctgtgtggccttgggcaagtctgccagcgtcacttagcctcagtttccttatctgtaaaatgaggatagtaagaactacctcgtagtgatattgcgaaggttagaagaaacgcatggcataattacttggtagctattgttagatctgggagtgtgaaatggtagcgttttgtccctgtcttcacactatcatagggagaatcaaaagagctaacaaatataaacatgctttgtgaatttttttaaagaaaaaaatgtagaggggccaataaacatgaaaaaatcccagccctagtagcaattaaggaaatagcaaaacaggatttctgctcctcttgagtgggtctcatgggaacacaggtgcactttcccacacttgtccccccaggtgactaggttcaagagacatttgcttttggtggccccacaaacatttccttttgagggcccatagtgaatattaaagtgtgctggacatggtggctcatgcctgtaatcccagcactttcagaggctgaggtgggcagattgcttgagctgaggagtttgagaccagcctgggcaacatagcaagatcccttcccttaaaaaaaaaaaaaaatttggctgggcatggtggctcatgcctgtaatcccagcaatgtaggcagccaagacaggtggatcacttgagtccaggagttcgagactagcctgagcaacatggcgaaaccttgtctctactaaaaatacaagttagctggttgtggtggtatgagcctgcagtcccagctattcaagaggctgaggtgggagggttgcctgagcctggcagttgaagtttgcagtgagctgtgatcatgccactgtattccagcctgggcaacagaatgagaccctgttacacacacacacacaaaatagataagttgttcactctgtcagcatctattagcccttcccatgtgcaacactaattacatgctagaaatacataaatgagaggcttcctaaggtggttgaattttttttttttttttttttgtagtagagatggagtcttgctctgtcacccaggcttgagtgcagtggcgtgatctcggctcactgcaacctccacctcatgggttcaagcaatgctcctgcctcagcctgccaagtagctgggattacaggcacgtaccaccatgcccaggtaatttttgtatttttggtacagacggagtttcaccatgttggccagaatggtcttgatctcttgaccttgtgatctacccacctcggcctcccgaagagctgggattacaggtgtgagccaccgcgcccggccaggggatttctcctgtgtgaattcgctggttaagtgataattaactgcagttaaaattcaggtcaagcatgtggctcatgtctgtaatcccagtactttgggaggctgaggtgggaggatagcttgagtccaggaggagttcgagatcagcctgggcaccatggtgaacccctgtctctaaaaaaaaagaaagatttttatttaaaaaacctaaacaaattcagataggaatttaaagatagaccaggcacagtggctcacgcctgtaatcccagcactttgtggggggccaaggtgggtggatcacttgaggtcaggagttcaagaccagcctggccaacatggtgaaaccccgtctctactaaaaatataaaaattagagacgggcatggtggtggcacacctgtaatccccactactcaggagggtgaggcaggagaattgcttgaacctgagaggtagaggctgcagtgaaccgagattgtgccactgcattccagcctgggtgacagggtgagactccatctcaaaaaaaataaaataaagataaaatcataaacactcataattcagttataccttttttcaagtaactaaagttcaaacttacttaggggaacaggctttcctgggtgccacctgcttctcaagtcctgtgctttccacaccacagaatagtaaactgggtgcactgagtgcctggttcccctcagcccttaaccagtgctggcttgtccgagtttagaatcccagggctgactttgttggtggaatgctagctcccattcatttcccacctgcactggacgttttctgaatctccttgaagtccgggagatcttcattccaaagctcttcacttttctgcagcattgtgaccccatctggctggggaactggaagtcctgctcagagaaaagcaggaggggacatggagttctgaaattcactttctgctcccatgtctggaagtgacaggtgaaatgagaatgatagtgcctctcaagaaggtctagttcccagaagagaaagtttaatgactcattttcccccttttactcctttgagggtacaggataatgcccttatctattttcataataattataatgatgatgataatgaaaactaacgtttgccaagtgctaatactgtgtcaggatcctcataacagcccagggaggtagaaaccatcacaatgtccactgtccagatgagaaaatggaggctaagggtatttaaagaggttgcccaagaacaacaaaccttttaaatggcagactggtgtgtataatctacgcagggttcacatctatggaacactttattttaaattcttttaataatattattatttttcagctgagtctgggtctcactctgtcgcccaggctggaatgcagtggcatgatcacagctcactgcggcctccaactcctgggctcaagtgattctcctgccccagcctcccgagtagctgggactacaggcttgcgccaccatgcccggcttatagggcactttagatggaaacaaatgactggatctttaactcctacctttctctcctctcttcctgtaatgttgttactgaaggcaggaagggagactccttggctaaagagcagagcaagagcctcaaagtggtctttgtgagccaccctggactactggttcagtagagggttgagtcaagcaatatttgaggacgggatataaacagtatttcttaaagttgtcaccaatttttcccccgatgaggccattccagacccaaattagtcataacagagccaggacaataatcacatctcctgattctgagcctgaatgcttcccacaggactgcgtcgctcccactgctctgaggtccattgtgggggagagttgccactgggattccacctcaaggcctggggaccaagcctccaggattcctcttgagactcctccactatttcattaccatcccgccacatcttctagtgctatgccctggttccctttggaatcctctcaatcccaaagaaggcctcctaccacctctaaggcatcaaaggtgttagaaagtgccccaagactcaacagggcatccatctcatcatagaagacactggtgcctggtgtgtaggtgctcctggctttgcagtagtcggtcaggaggtttttgaaccgatagcaacattgctccagggtccacaggaagccatgttctcacagctgctcagccataatccggtacacctggtggtttcgatggcaggtgcggagtttttcgtggatccaggcctctgagaattcccagaaaaatcttggtttctttgtatccccagtgcactcctgccaccttctcatcctccagggcctgccactccagctcgctccaggtcttggcttttctccagattagcacctggccagacttgactctcaccccagccactgagcagtctttcacactctctttttctccagaatttgaagatctagatgctgtgggttttcatcctactccacgtgggagttcactttgggcctatggattggaaaatctgtttgcaggcagacaaaagggagatgtaatggtttggtaaatctaatcccaaccattttatatgccagggagaggagatagtaattttttttttttaattctggggggattcttgggaaagctcagtgaaaagaacaactagaaaaaaaaattcaggcccaaatgcataactatatatccacgttcatctatcttaaataaaattcagacacatacctaaactga

SEQ ID NO: 199959 - DNA, 933 bp, Homo sapiens
  Payload ID: 19445
  Gene Name: WD repeat domain 73
  ENST ID: ENST00000559178
  CDS Start-End: 1-395
actggctggtggaatccttgcgcttgtaccaggatttctatgcattcgacctgtcaggagccactcgagtccttgaatggattgatgacaaaggagtctttgttgctggctatgaaagcctgaaaaagaatgaaattcttcatctgaaattacctctcagactttctgtaaaggaaaacaagggcttattcccagaaagagatttcaaagtgcgccatggaggattttcagacaggtctatctttgatctaaagcatgtgccacataccagattgctggttaccagtggccttccaggttgttatctgcaggtgtggcaggttgcagaggacagtgctactcaggaggctgaggcagaagaatttcttgaacctgagaggcggaggctgcagtgagctgagattgtgccactggactccagcctgggcaacagagtgagactctgtctcaaaaaaacaaaagaaccaaaacaaaacttgactcaaagccaaggatgttccattcagtgtaaaaaagatgtggactttcttgtccaccttacaagacaatgacatctgtaatgtgacctgtacttgctaggctttagcaagtcactcgaggtcatggaacatgtttttgaagaaataatatcagttcatgaattctgtacctgtttcttgtcgctgaagggatgtcattaaagctgtcagcaccattgctgtgcatgagaaagaggagagtctctggcctagggtggccgtcttctccacattggcacccggagtcctccatggggcgaggctccgaagtctgcaggtcgttgatctggagtcccggaagaccacgtacacctcaggtgttggggatacacagtgaataagaggtaagccctggcctctaagggctcctatgctggggcaggattaggcagtcccagggaccagcacccaacca

SEQ ID NO: 199960 - DNA, 997 bp, Homo sapiens
  Payload ID: 19445
  Gene Name: WD repeat domain 73
  ENST ID: ENST00000558521
  CDS Start-End: 1-536
tggatcctggggacgactggctggtggaatccttgcgcttgtaccaggatttctatgcattcgacctgtcaggagccactcgagtccttgaatggattgatgacaaaggagtctttgttgctggctatgaaagcctgaaaaagaatgaaattcttcatctgaaattacctctcagactttctgtaaaggaaaacaagggcttattcccagaaagagatttcaaagtgcgccatggaggattttcagacaggtctatctttgatctaaagcatgtgccacataccagattgctggttaccagtggccttccaggttgttatctgcaggtgtggcaggttgcagaggacagtgatgtcattaaagctgtcagcaccattgctgtgcatgagaaagaggagagtctctggcctagggtggccgtcttctccacattggcacccggagtcctccatggggcgaggctccgaagtctgcaggtcgttgatctggagtcccggaagaccacgtacacctcaggtgttggggatacacagtgaataagaggtaagccctggcctctaagggctcctatgctggggcaggattaggcagtcccagggaccagcacccaaccagctgagcagacaatgatgtcagtgacagtgaggagctgagtagcctgcaggtcctagatgcagacacctttgccttctgctgtgcttcaggccggctggggcttgttgacacccggcagaagtgggcaccgttggagaatcgcagccctggccctgggtctggtggagagagatggtgtgctgaagttgggagctggggccagggccctgggcccagcattgccagccttggctcagatgggcgtctttgtcttcttgacccccgggatctctgccatcctgtgagctcagtccagtgcccagtatccgtacctagccctgacccagagctgctgcgagtgacttgggccccaggcctgaagaattgcttggccatctcaggt

SEQ ID NO: 199961 - DNA, 788 bp, Homo sapiens
  Payload ID: 19445
  Gene Name: WD repeat domain 73
  ENST ID: ENST00000559224
  CDS Start-End: 1-256
tggggacgactggctggtggaatccttgcgcttgtaccaggatttctatgcattcgacctgtcaggagccactcgagtccttgaatggattgatgacaaaggagtctttgttgctggctatgaaagcctgaaaaagaatgaaattcttcatctgaaattacctctcagactttctgtaaaggaaaacaagattgctggttaccagtggccttccaggttgttatctgcaggtgtggcaggttgcagaggacagtgatgtcattaaagctgtcagcaccattgctgtgcatgagaaagaggagagtctctggcctagggtggccgtcttctccacattggcacccggagtcctccatggggcgaggctccgaagtctgcaggtcgttgatctggagtcccggaagaccacgtacacctcagatgtcagtgacagtgaggagctgagtagcctgcaggtcctagatgcagacacctttgccttctgctgtgcttcaggccggctggggcttgttgacacccggcagaagtgggcaccgttggagaatcgcagccctggccctgggtctggtggagagagatggtgtgctgaagttgggagctggggccagggccctgggcccagcattgccagccttggctcagatgggcgtctttgtcttcttgacccccgggatctctgccatcctgtgagctcagtccagtgcccagtatccgtacctagccctgacccagagctgctgcgagtgacttgggccccaggcctgaagaattgcttggccatctcaggt

SEQ ID NO: 199962 - DNA, 1289 bp, Homo sapiens
  Payload ID: 19446
  Gene Name: WD repeat domain 74
  Uniprot ID: Q6RFH5
  ENST ID: ENST00000278856
  CDS Start-End: 92-1249
agcaactacactgcgctgcatcggactcgacgcccgctggtgacgcacacgctgcgccggaagtgtgaactgtctgcctccaggctttgtcatggcggctgctgctgcacgctggaaccatgtgtgggtcggcaccgagactgggatcttgaaaggggtaaatcttcagcgaaaacaggcggcgaacttcacggccggaggacagccgcggcgcgaggaggcagtgagcgccctgtgttggggcaccggcggcgagacccagatgctggtgggctgcgcggacaggacggtgaagcacttcagcaccgaggatggcatattccagggtcagagacactgcccgggcggggagggcatgttccgtggcctcgcccaggccgacggcaccctcatcacatgtgtggattctgggattctcagagtctggcatgacaaggacaaggacacatcctctgacccactcctggaactgagagtgggccctggggtgtgtaggatgcgccaagacccagcacacccccatgtggttgccacaggtgggaaagagaatgctttgaagatatgggacctgcagggctctgaggaacctgtgttcagggccaagaacgtgcggaatgactggctggacttgcgggttcccatctgggaccaggacatacagtttctcccaggatcacagaagcttgtcacctgcacagggtaccaccaggtccgtgtttatgatccagcatccccccagcgccggccagtcctagagaccacctatggagagtacccactaacagccatgaccctcactccgggaggcaactcagtgattgtgggaaacactcatgggcagctggcagaaattgaccttcggcaagggcgtctactgggctgtctgaaggggctggcaggcagtgtgcgtgggttgcagtgccacccttcaaagcctctactagcctcctgtggcttggacagagtcttgaggatacacaggatccagaatccacggggtctggagcataaggtttatctcaagtctcaattgaactgcctcctcttgtcaggcagggacaactgggaggatgagccccaagagcctcaagaacccaacaaggtgcccctagaagacacagagacagatgaactttgggcatccttggaggcagctgccaagcggaagctctcgggtttggagcagccccaaggagctctccaaacgagacggagaaagaagaagcggcctgggtccaccagcccctgacgcccctgtgcccactttgtaaataaactgctgaacaccc

SEQ ID NO: 199963 - DNA, 1153 bp, Homo sapiens
  Payload ID: 19446
  Gene Name: WD repeat domain 74
  Uniprot ID: Q6RFH5
  ENST ID: ENST00000311713
  CDS Start-End: 12-1112
caggctttgtcatggcggctgctgctgcacgctggaaccatgtgtgggtcggcaccgagactgggatcttgaaaggggtaaatcttcagcgaaaacaggcggcgaacttcacggccggaggacagccgcggcgcgaggaggcagtgagcgccctgtgttggggcaccggcggcgagacccagatgctggtgggctgcgcggacaggacggtgaagcacttcagcaccgaggatggcatattccagggtcagagacactgcccgggcggggagggcatgttccgtggcctcgcccaggccgacggcaccctcatcacatgtgtggattctgggattctcagagtctggcatgacaaggacaaggacacatcctctgacccactcctggaactgagagtgggccctggggtgtgtaggatgcgccaagacccagcacacccccatgtggttgccacaggtgggaaagagaatgctttgaagatatgggacctgcagggctctgaggaacctgtgttcagggccaagaacgtgcggaatgactggctggacttgcgggttcccatctgggaccaggacatacagtttctcccaggatcacagaagcttgtcacctgcacagggtaccaccaggtccgtgtttatgatccagcatccccccagcgccggccagtcctagagaccacctatggagagtacccactaacagccatgaccctcactccgggaggcaactcagtgattgtgggaaacactcatgggcagctggcagaaattgaccttcggcaagggcgtctactgggctgtctgaaggggctggcaggcagtgtgcgtgggttgcagtgccacccttcaaagcctctactagcctcctgtggcttggacagagtcttgaggatacacaggatccagaatccacggggtctggagcataaggatgagccccaagagcctcaagaacccaacaaggtgcccctagaagacacagagacagatgaactttgggcatccttggaggcagctgccaagcggaagctctcgggtttggagcagccccaaggagctctccaaacgagacggagaaagaagaagcggcctgggtccaccagcccctgacgcccctgtgcccactttgtaaataaactgctgaacaccca

SEQ ID NO: 199964 - DNA, 1724 bp, Homo sapiens
  Payload ID: 19446
  Gene Name: WD repeat domain 74
  ENST ID: ENST00000525752
  CDS Start-End: 738-1724
ctccggagtagctgggactacaggcgcccgccaccacgcccggctagttttgtttttgtatgtttagtagagacggggattcaccgtgttagccaagatggtctcgatctcctgacctcatgatccgcccgcctcggcctcccaaagtgctgggattacaggcgtgagccaccgcgcctcgctgtccgcctcttgaagagtaaacgaggccgggcgcggtggtttagtaataccagctgtaatcccagctacttgggaggctgaggcagaagaatcgcttgaacccgggaggcggaggttgagtccagaacacatattacataatggagccgggagacagactagggctggcttgatccggccacgcagtccaggaaaggtgcttttcacccccaagtgcaaaatgatcaatgtattcttccgatctacataaacaagcacctcctggtttcattttcgtaaagcaaaacaagcatggaagctttactgtttcggctcttcaaacttccagcaactacactgcgctgcatcggactcgacgcccgctggtgacgcacacgctgcgccggaagtgtgaactgtctgcctccaggctttgtcatggcggctgctgctgcacgctggaaccatgggtaaatcttcagcgaaaacaggcggcgaacttcacggccggaggacagccgcggcgcgaggaggcagtgagcgccctgtgttggggcaccggcggcgagacccagatgctggtgggctgcgcggacaggacggtgaagcacttcagcaccgaggatggcatattccagggtcagagacactgcccgggcggggagggcatgttccgtggcctcgcccaggccgacggcaccctcatcacatgtgtggattctgggattctcagagtctggcatgacaaggacaaggacacatcctctgacccactcctggaactgagagtgggccctggggtgtgtaggatgcgccaagacccagcacacccccatgtggttgccacaggtgggaaagagaatgctttgaagatatgggacctgcagggctctgaggaacctgtgttcagggccaagaacgtgcggaatgactggctggacttgcgggttcccatctgggaccaggacatacagtttctcccaggatcacagaagcttgtcacctgcacagggtaccaccaggtccgtgtttatgatccagcatccccccagcgccggccagtcctagagaccacctatggagagtacccactaacagccatgaccctcactccgggaggcaactcagtgattgtgggaaacactcatgggcagctggcagaaattgaccttcggcaagggcgtctactgggctgtctgaaggggctggcaggcagtgtgcgtgggttgcagtgccacccttcaaagcctctactagcctcctgtggcttggacagagtcttgaggatacacaggatccagaatccacggggtctggagcataaggtttatctcaagtctcaattgaactgcctcctcttgtcaggcagggacaactgggaggatgagccccaagagcctcaagaacccaacaaggtgcccctagaagacacagagacagatgaactttgggcatccttggaggcagctgccaagcggaagctctcgggtttggagcagccccaaggagctctccaaacgagacggagaaagaagaagcggcctgggtccaccagcccctga

SEQ ID NO: 199965 - DNA, 1736 bp, Homo sapiens
  Payload ID: 19446
  Gene Name: WD repeat domain 74
  Uniprot ID: Q6RFH5
  ENST ID: ENST00000525239
  CDS Start-End: 539-1696
atcgcttctcggccttttggctaagatcaagtgtagtatctgttcttatcagtttaatatctgatacgtcctctatccgaggacaatatattaaatggatttttggaaataggagatggaataggagcttgctccgtccactccacgcatcgacctggtattgcagtacttccaggaacggtgcactctcccttcggggagagaacaaccgttgtttaatggaagatttcgatcagttaggtccagaacacatattacataatggagccgggagacagactagggctggcttgatccggccacgcagtccaggaaaggtgcttttcacccccaagtgcaaaatgatcaatgtattcttccgatctacataaacaagcacctcctggtttcattttcgtaaagcaaaacaagcatggaagctttactgtttcggctcttcaaacttccagcaactacactgcgctgcatcggactcgacgcccgctggtgacgcacacgctgcgccggaagtgtgaactgtctgcctccaggctttgtcatggcggctgctgctgcacgctggaaccatgtgtgggtcggcaccgagactgggatcttgaaaggggtaaatcttcagcgaaaacaggcggcgaacttcacggccggaggacagccgcggcgcgaggaggcagtgagcgccctgtgttggggcaccggcggcgagacccagatgctggtgggctgcgcggacaggacggtgaagcacttcagcaccgaggatggcatattccagggtcagagacactgcccgggcggggagggcatgttccgtggcctcgcccaggccgacggcaccctcatcacatgtgtggattctgggattctcagagtctggcatgacaaggacaaggacacatcctctgacccactcctggaactgagagtgggccctggggtgtgtaggatgcgccaagacccagcacacccccatgtggttgccacaggtgggaaagagaatgctttgaagatatgggacctgcagggctctgaggaacctgtgttcagggccaagaacgtgcggaatgactggctggacttgcgggttcccatctgggaccaggacatacagtttctcccaggatcacagaagcttgtcacctgcacagggtaccaccaggtccgtgtttatgatccagcatccccccagcgccggccagtcctagagaccacctatggagagtacccactaacagccatgaccctcactccgggaggcaactcagtgattgtgggaaacactcatgggcagctggcagaaattgaccttcggcaagggcgtctactgggctgtctgaaggggctggcaggcagtgtgcgtgggttgcagtgccacccttcaaagcctctactagcctcctgtggcttggacagagtcttgaggatacacaggatccagaatccacggggtctggagcataaggtttatctcaagtctcaattgaactgcctcctcttgtcaggcagggacaactgggaggatgagccccaagagcctcaagaacccaacaaggtgcccctagaagacacagagacagatgaactttgggcatccttggaggcagctgccaagcggaagctctcgggtttggagcagccccaaggagctctccaaacgagacggagaaagaagaagcggcctgggtccaccagcccctgacgcccctgtgcccactttgtaaataaactgctgaacaccc

SEQ ID NO: 199966 - DNA, 1366 bp, Homo sapiens
  Payload ID: 19446
  Gene Name: WD repeat domain 74
  Uniprot ID: Q6RFH5
  ENST ID: ENST00000529106
  CDS Start-End: 169-1326
tagtaataccagctgtaatcccagctacttgggaggctgaggcagaagaatcgcttgaacccgggaggcggaggttgagcaactacactgcgctgcatcggactcgacgcccgctggtgacgcacacgctgcgccggaagtgtgaactgtctgcctccaggctttgtcatggcggctgctgctgcacgctggaaccatgtgtgggtcggcaccgagactgggatcttgaaaggggtaaatcttcagcgaaaacaggcggcgaacttcacggccggaggacagccgcggcgcgaggaggcagtgagcgccctgtgttggggcaccggcggcgagacccagatgctggtgggctgcgcggacaggacggtgaagcacttcagcaccgaggatggcatattccagggtcagagacactgcccgggcggggagggcatgttccgtggcctcgcccaggccgacggcaccctcatcacatgtgtggattctgggattctcagagtctggcatgacaaggacaaggacacatcctctgacccactcctggaactgagagtgggccctggggtgtgtaggatgcgccaagacccagcacacccccatgtggttgccacaggtgggaaagagaatgctttgaagatatgggacctgcagggctctgaggaacctgtgttcagggccaagaacgtgcggaatgactggctggacttgcgggttcccatctgggaccaggacatacagtttctcccaggatcacagaagcttgtcacctgcacagggtaccaccaggtccgtgtttatgatccagcatccccccagcgccggccagtcctagagaccacctatggagagtacccactaacagccatgaccctcactccgggaggcaactcagtgattgtgggaaacactcatgggcagctggcagaaattgaccttcggcaagggcgtctactgggctgtctgaaggggctggcaggcagtgtgcgtgggttgcagtgccacccttcaaagcctctactagcctcctgtggcttggacagagtcttgaggatacacaggatccagaatccacggggtctggagcataaggtttatctcaagtctcaattgaactgcctcctcttgtcaggcagggacaactgggaggatgagccccaagagcctcaagaacccaacaaggtgcccctagaagacacagagacagatgaactttgggcatccttggaggcagctgccaagcggaagctctcgggtttggagcagccccaaggagctctccaaacgagacggagaaagaagaagcggcctgggtccaccagcccctgacgcccctgtgcccactttgtaaataaactgctgaacaccc

SEQ ID NO: 199967 - DNA, 988 bp, Homo sapiens
  Payload ID: 19446
  Gene Name: WD repeat domain 74
  ENST ID: ENST00000542347
  CDS Start-End: 13-138
ccaggctttgtcatggcggctgctgctgcacgctggaaccatgtgtgggtcggcaccgagactgggatcttgaaaggtgggtggcaggctcgggcgtcgggaagtgcaggggtgcactcgcgcccctggcgtgactgacgccttcgtctctcaggggtaaatcttcagcgaaaacaggcggcgaacttcacggccggaggacagccgcggcgcgaggaggcagtgagcgccctgtgttggggcaccggcggcgagacccagatgctggtgggctgcgcggacaggacggtgaagcacttcagcaccgaggatggcatattccagggtcagagacactgcccgggcggggagggcatgttccgtggcctcgcccaggccgacggcaccctcatcacatgtgtggattctgggattctcagagtctggcatgacaaggacaaggacacatcctctgacccactcctggaactgagagtgggccctggggtgtgtaggatgcgccaagacccagcacacccccatgtggttgccacaggtgggaaagagaatgctttgaagatatgggacctgcagggctctgaggaacctgtgttcagggccaagaacgtgcggaatgactggctggacttgcgggttcccatctgggaccaggacatacagtttctcccaggatcacagaagcttgtcacctgcacagggtaccaccaggtccgtgtttatgatccagcatccccccagcgccggccagtcctagagaccacctatggagagtacccactaacagccatgaccctcactccgggaggcaactcagtgattgtgggaaacactcatgggcagctggcagaaattgaccttcggcaagggcgtctactgggctgtctgaaggggctggcaggcagtgtgcgtgggttgcagtgccacccttcaaagcctctactagcctcctgtggcttggacagagtcttgaggatacacaggatccaga

SEQ ID NO: 199968 - DNA, 371 bp, Homo sapiens
  Payload ID: 19446
  Gene Name: WD repeat domain 74
  ENST ID: ENST00000536401
  CDS Start-End: 1-116
tttgggcatccttggaggcagctgccaagcggaagctctcgggtttggagcagccccaaggagctctccaaacgagacggagaaagaagaagcggcctgggtccaccagcccctgacgcccctgtgcccactttgcgccgaagatatcgacttgaactccccggaccatccgaatcacaagtcgaacgaaagccttctgattaccgtgctgtggcggcgactatccacgttcggtcgtcggggctcctcgcggccaagcaagaggcaaccagaccagattcggaagcaggagagtccgatccgagaaggcaaccaggaggagccggagaagggatgaccccagacctgctctcagtccgccccaacctcca

SEQ ID NO: 199969 - DNA, 548 bp, Homo sapiens
  Payload ID: 19446
  Gene Name: WD repeat domain 74
  ENST ID: ENST00000538098
  CDS Start-End: 378-548
atcgcttctcggccttttggctaagatcaagtgtagtatctgttcttatcagtttaatatctgatacgtcctctatccgaggacaatatattaaatggatttttggaaataggagatggaataggagcttgctccgtccactccacgcatcgacctggtattgcagtacttccaggaacggtgcactctcccttcggggagagaacaaccgttgtttaatggaagatttcgatcagttaggcaaaacaagcatggaagctttactgtttcggctcttcaaacttccagcaactacactgcgctgcatcggactcgacgcccgctggtgacgcacacgctgcgccggaagtgtgaactgtctgcctccaggctttgtcatggcggctgctgctgcacgctggaaccatgtgtgggtcggcaccgagactgggatcttgaaaggggtaaatcttcagcgaaaacaggcggcgaacttcacggccggaggacagccgcggcgcgaggaggcagtgagcgccctgtgttggggcaccggcggcgagacccag

SEQ ID NO: 199970 - DNA, 2701 bp, Homo sapiens
  Payload ID: 19447
  Gene Name: WD repeat domain 75
  Uniprot ID: Q8IWA0
  ENST ID: ENST00000314761
  CDS Start-End: 61-2553
ggctcaacgaaggaagttcagggcgggaccagagattggccattccgctactgcgcaaagatggtggaggaggagaacatccgcgtggttcgttgtggcggcagcgagttgaactttaggagagctgtgttctctgcagattctaagtatatcttctgtgtctctggagactttgttaaagtttacagcacagttacagaagagtgtgtacacatactgcatggacacagaaatctggtgactggaatccagcttaaccccaacaaccatctacagctgtattcttgttcccttgatggcacaattaaactgtgggactatatagatggcatcttaataaagactttcatagttggatgtaaacttcatgccctctttactcttgcccaagctgaggattctgtctttgttatagtgaataaagaaaaaccagatatatttcagctggtttcagtgaaactgccaaaatcctcaagccaggaagtagaagccaaggagctgtcctttgttttggattacataaaccagtcacccaagtgcattgcctttggaaacgagggagtatatgttgctgcagtacgggaattttacttgtctgtttattttttcaaaaagaaaacaacatcaaggtttactttatcatcatcaagaaataagaagcatgctaaaaacaattttacatgtgtagcatgtcacccaacggaagactgcatcgcatctggtcacatggatggcaaaattcgtctttggaggaatttttatgatgataagaaatatacgtacacatgtttacattggcaccatgatatggttatggatttggctttttcagtgacaggcaccagtctgctgagtggcggtcgtgaatctgtacttgtagagtggcgcgatgcaacagagaagaataaggagtttctcccgcgtttaggagctactattgaacatatctcagtctcgcctgcaggagatttattctgcacttctcactctgataataagataataattattcaccgaaaccttgaagcatccgcagtaattcaaggcctagtgaaagataggagtatcttcactggtttgatgattgatccaagaactaaagctttggttttgaatggaaaacctggccacctgcagttttattctctccagagtgataaacagttatacaatttagatattatacagcaagaatatattaatgattatggtctgatccaaattgaactaacaaaggctgcatttggctgctttggtaactggcttgcaacagtggaacagcggcaagaaaaggaaactgagcttgaattgcaaatgaaactgtggatgtataataagaaaacacaagggtttattcttaacactaaaattaacatgccacacgaagactgcattacagctctctgtttctgtaatgcagaaaaatctgaacagcccaccttggttacagctagcaaagatggttacttcaaagtatggatattaacagatgactctgacatatacaaaaaagctgttggctggacctgtgactttgttggtagttatcacaagtatcaagcaactaactgttgtttctccgaagatggttctttactagcagttagttttgaggaaatagtcacaatatgggattctgtaacatgggaacttaaatgtacattttgccaacgagctgggaaaataaggcacctttgctttgggagattgacgtgttcaaagtatctacttggtgctactgaaaatggcattctttgctgttggaatctgctgagctgtgcattggagtggaatgcaaaattaaatgttagagttatggaacccgatcctaattcagagaatattgctgcaatctctcagtcttcagtgggttcagacttgtttgtatttaaacctagtgagccaaggccattgtatattcaaaagggtatctccagagagaaagtccagtggggagtgtttgttccacgagatgtccctgaatccttcacctcagaagcttaccagtggctaaatagatcccagttttacttcctaacaaaatcacagagtttattgacattcagtacaaagtctccagaagaaaaactcacaccaacaagcaaacagctgctagcagaagaaagtcttcccacaaccccattttatttcatattgggaaaacacaggcaacagcaggatgaaaaactaaacgaaactttagagaatgagctggtacaactacccttaacagaaaacatacccgcaattagtgagcttcttcacactccagcccatgtcctgccatctgctgctttcctgtgctccatgtttgtaaattcattgctgctgtctaaagagactaagagtgctaaggaaattcctgaagatgtagatatggaagaagaaaaagaaagtgaagattcagatgaagaaaatgattttaccgaaaaagtccaggatacaagtaacacaggtttaggagaagacattatacatcagttgtcaaaatctgaagaaaaagaactgagaaaatttaggaaaatagactacagctggatagctgccctttaagccttggagatggggaggatccttggactttgtgtttttgattgtatgttgatattctaaaaacatctattttaatgttatttctgttctaaaaataagataataaatattaacaaactttgcttttttaaaaaactgataatatgaa

SEQ ID NO: 199971 - DNA, 4297 bp, Homo sapiens
  Payload ID: 19447
  Gene Name: WD repeat domain 75
  ENST ID: ENST00000427960
  CDS Start-End: 12-305
actgcgcaaagatggtggaggaggagaacatccgcgtggttcgttgtggcggcagcgagttgaactttaggagagctgtgttctctgcagattctaagtatatcttctgtgtctctggagactttgttaaagtttacagcacagttacagaagagtgtgtacacatactgcatggacacagaaatctggtgactggaatccagcttaaccccaacaaccatctacagtcacagccaacttggaagttattgattaaggatggatttgcattgccattcacttttattccaaaggaaataaagtagcaccgatcttttctttccaaaattaaatgagctacttctaaaaatcaaagttaagtaacttttctacgggatccaagtacatattttatgcttgccgtcctctgagggtttgacaaaagtttatcgctgtgtgtagtgtttgaatgtttttaatagcaaaactattattttgttaaaattgaaatttgtgaagtccatatactaagttttatagccaaaaaaacgtatacacaattcataaaagctttgtttcggatgactgaaagtgagtaaaattagagaagggcagttttatcagatttggttgaggtgcaggggcagcagttctggacttaggagtcacagtgtttgtgtattaaccattgttttgacagtaattatatgtttgacttgttacattttactagtccatatttatgattctcatatgcagtaattgtgatataaatttcctagtttgtataattttttgacttggatagataatatggttttactccaacatttttacattcctcttctctgagtccatgtctctatttgcagaaatcctaaaattgccactttctttaaaaatattaaaattctttgtaaacattataagcaaagtattttcctataacaacgacaacaaaatctagcagaaacttagtattaataaaactaagtacactgggacaaaagtaagcctatgtgttagtaaggtcttctggtgctaccaaagtatggtccacagaccagtgtcctaaaccattagttaccattctgtataagagtacagaatgtgagtgtcacaaaacactttgacattgcctcagcatccaagcatattataatttctattgtattttatgaaagtattggtccttgatggattggaagaaatttttttaagcagaatattcttcagtcacttgagaagcactcccttaatgctcatataaggtaaaaggagtttggctaataaaactgagtaagctgagttctggcaggaagagcaacaagctcttgtgtgggtgtttttgttttgttttgtttggttttggtttttttttctggagagtctcactctgtctcccaggctggagtacagcgatgtgattgatctcagctcactgcaacctcagcctcccaagtagctaggattacagggatgtgccaccacgcctggctaatttttgtaggggtttcgtcatgttggccaggctggtctcgaactcctggcctcaagtgatgcacccacctgggcctcccaaagtgctgagattacaggtggcagccactgcaccttggtgcttttcatatctcattcaaaaccttaccatctccctcttcaagacagaaagttggcttttttcctctctcttttagttaaaacttgaaatggatggatctgcttcttgcagaaagctgtgaaaagattgttttgcagaagcaatataaataaatgactctacctctttaaggttaacagtgaattaatgaatagaaaatgcccctgatcaacatttaattattcatttgatatcttgatgaatttcttttttttaaatcaattttgtattgttttacccttttagctgtattcttgttcccttgatggcacaattaaactgtgggactatatagatggcatcttaataaagactttcatagttggatgtaaacttcatgccctctttactcttgcccaagctgaggattctgtctttgttatagtgaataaagaaaaaccagatatatttcagctggtttcagtgaaactgccaaaatcctcaagccaggaagtagaagccaaggagctgtcctttgttttggattacataaaccagtcacccaagtgcattgcctttggaaacgagggagtatatgttgctgcagtacgggaattttacttgtctgtttattttttcaaaaagaaaacaacatcaaggtttactttatcatcatcaagaaataagaagcatgctaaaaacaattttacatgtgtagcatgtcacccaacggaagactgcatcgcatctggtcacatggatggcaaaattcgtctttggaggaatttttatgatgataagaaatatacgtacacatgtttacattggcaccatgatatggttatggatttggctttttcagtgacaggcaccagtctgctgagtggcggtcgtgaatctgtacttgtagagtggcgcgatgcaacagagaagaataaggagtttctcccgcgtttaggagctactattgaacatatctcagtctcgcctgcaggagatttattctgcacttctcactctgataataagataataattattcaccgaaaccttgaagcatccgcagtaattcaaggcctagtgaaagataggagtatcttcactggtttgatgattgatccaagaactaaagctttggttttgaatggaaaacctggccacctgcagttttattctctccagagtgataaacagttatacaatttagatattatacagcaagaatatattaatgattatggtctgatccaaattgaactaacaaaggctgcatttggctgctttggtaactggcttgcaacagtggaacagcggcaagaaaaggaaactgagcttgaattgcaaatgaaactgtggatgtataataagaaaacacaagggtttattcttaacactaaaattaacatgccacacgaagactgcattacagctctctgtttctgtaatgcagaaaaatctgaacagcccaccttggttacagctagcaaagatggttacttcaaagtatggatattaacagatgactctgacatatacaaaaaagctgttggctggacctgtgactttgttggtagttatcacaagtatcaagcaactaactgttgtttctccgaagatggttctttactagcagttagttttgaggaaatagtcacaatatgggattctgtaacatgggaacttaaatgtacattttgccaacgagctgggaaaataaggcacctttgctttgggagattgacgtgttcaaagtatctacttggtgctactgaaaatggcattctttgctgttggaatctgctgagctgtgcattggagtggaatgcaaaattaaatgttagagttatggaacccgatcctaattcagagaatattgctgcaatctctcagtcttcagtgggttcagacttgtttgtatttaaacctagtgagccaaggccattgtatattcaaaagggtatctccagagagaaagtccagtggggagtgtttgttccacgagatgtccctgaatccttcacctcagaagcttaccagtggctaaatagatcccagttttacttcctaacaaaatcacagagtttattgacattcagtacaaagtctccagaagaaaaactcacaccaacaagcaaacagctgctagcagaagaaagtcttcccacaaccccattttatttcatattgggaaaacacaggcaacagcaggatgaaaaactaaacgaaactttagagaatgagctggtacaactacccttaacagaaaacatacccgcaattagtgagcttcttcacactccagcccatgtcctgccatctgctgctttcctgtgctccatgtttgtaaattcattgctgctgtctaaagagactaagagtgctaaggaaattcctgaagatgtagatatggaagaagaaaaagaaagtgaagattcagatgaagaaaatgattttaccgaaaaagtccaggatacaagtaacacaggtttaggagaagacattatacatcagttgtcaaaatctgaagaaaaagaactgagaaaatttaggaaaatagactacagctggatagctgccctttaagccttggagatggggaggatccttggactttgtgtttttgattgtatgttgatattctaaaaacatctattttaatgttatttctgttctaaaaataagataataaatattaacaaactttgcttttttaaaaaa

SEQ ID NO: 199972 - DNA, 2703 bp, Homo sapiens
  Payload ID: 19447
  Gene Name: WD repeat domain 75
  ENST ID: ENST00000436347
  CDS Start-End: 48-317
aagttcagggcgggaccagagattggccattccgctactgcgcaaagatggtggaggaggagaacatccgcgtggttcgttgtggcggcagcgagttgaactttaggagagctgtgttctctgcagattctaagtatatcttctgtgtctctggagactttgttaaagtttacagcacagttacagaagagtgtgtacacatactgcatggacacagaaatctggtgactggaatccagcttaaccccaacaaccatctacaggttcccttacatgcattgcgaatatccaaaagagctgtattcttgttcccttgatggcacaattaaactgtgggactatatagatggcatcttaataaagactttcatagttggatgtaaacttcatgccctctttactcttgcccaagctgaggattctgtctttgttatagtgaataaagaaaaaccagatatatttcagctggtttcagtgaaactgccaaaatcctcaagccaggaagtagaagccaaggagctgtcctttgttttggattacataaaccagtcacccaagtgcattgcctttggaaacgagggagtatatgttgctgcagtacgggaattttacttgtctgtttattttttcaaaaagaaaacaacatcaaggtttactttatcatcatcaagaaataagaagcatgctaaaaacaattttacatgtgtagcatgtcacccaacggaagactgcatcgcatctggtcacatggatggcaaaattcgtctttggaggaatttttatgatgataagaaatatacgtacacatgtttacattggcaccatgatatggttatggatttggctttttcagtgacaggcaccagtctgctgagtggcggtcgtgaatctgtacttgtagagtggcgcgatgcaacagagaagaataaggagtttctcccgcgtttaggagctactattgaacatatctcagtctcgcctgcaggagatttattctgcacttctcactctgataataagataataattattcaccgaaaccttgaagcatccgcagtaattcaaggcctagtgaaagataggagtatcttcactggtttgatgattgatccaagaactaaagctttggttttgaatggaaaacctggccacctgcagttttattctctccagagtgataaacagttatacaatttagatattatacagcaagaatatattaatgattatggtctgatccaaattgaactaacaaaggctgcatttggctgctttggtaactggcttgcaacagtggaacagcggcaagaaaaggaaactgagcttgaattgcaaatgaaactgtggatgtataataagaaaacacaagggtttattcttaacactaaaattaacatgccacacgaagactgcattacagctctctgtttctgtaatgcagaaaaatctgaacagcccaccttggttacagctagcaaagatggttacttcaaagtatggatattaacagatgactctgacatatacaaaaaagctgttggctggacctgtgactttgttggtagttatcacaagtatcaagcaactaactgttgtttctccgaagatggttctttactagcagttagttttgaggaaatagtcacaatatgggattctgtaacatgggaacttaaatgtacattttgccaacgagctgggaaaataaggcacctttgctttgggagattgacgtgttcaaagtatctacttggtgctactgaaaatggcattctttgctgttggaatctgctgagctgtgcattggagtggaatgcaaaattaaatgttagagttatggaacccgatcctaattcagagaatattgctgcaatctctcagtcttcagtgggttcagacttgtttgtatttaaacctagtgagccaaggccattgtatattcaaaagggtatctccagagagaaagtccagtggggagtgtttgttccacgagatgtccctgaatccttcacctcagaagcttaccagtggctaaatagatcccagttttacttcctaacaaaatcacagagtttattgacattcagtacaaagtctccagaagaaaaactcacaccaacaagcaaacagctgctagcagaagaaagtcttcccacaaccccattttatttcatattgggaaaacacaggcaacagcaggatgaaaaactaaacgaaactttagagaatgagctggtacaactacccttaacagaaaacatacccgcaattagtgagcttcttcacactccagcccatgtcctgccatctgctgctttcctgtgctccatgtttgtaaattcattgctgctgtctaaagagactaagagtgctaaggaaattcctgaagatgtagatatggaagaagaaaaagaaagtgaagattcagatgaagaaaatgattttaccgaaaaagtccaggatacaagtaacacaggtttaggagaagacattatacatcagttgtcaaaatctgaagaaaaagaactgagaaaatttaggaaaatagactacagctggatagctgccctttaagccttggagatggggaggatccttggactttgtgtttttgattgtatgttgatattctaaaaacatctattttaatgttatttctgttctaaaaataagataataaatattaacaaactttgctttttt

SEQ ID NO: 199973 - DNA, 270 bp, Homo sapiens
  Payload ID: 19447
  Gene Name: WD repeat domain 75
  ENST ID: ENST00000631047
  CDS Start-End: 1-270
atggtggaggaggagaacatccgcgtggttcgttgtggcggcagcgagttgaactttaggagagctgtgttctctgcagattctaagtatatcttctgtgtctctggagactttgttaaagtttacagcacagttacagaagagtgtgtacacatactgcatggacacagaaatctggtgactggaatccagcttaaccccaacaaccatctacaggttcccttacatgcattgcgaatatccaaaagagctgtattcttgttcccttga

SEQ ID NO: 199974 - DNA, 3978 bp, Homo sapiens
  Payload ID: 19448
  Gene Name: WD repeat domain 76
  Uniprot ID: Q9H967
  ENST ID: ENST00000263795
  CDS Start-End: 71-1951
tcggacccgcccctcccggcctcccgccgcaatcttggcgggaaggcgccggccgctaagaagccgaaagatgtccaggtcgggcgcggcggctgagaaggcggactccagacagcgaccccagatgaaggtaaatgaatataaagaaaatcaaaacatcgcttatgtgtctctgagaccagcacagactacagttttaataaaaacagctaaggtctatcttgcccccttttcactcagtaattaccagctagaccagcttatgtgccccaaatccctatcagaaaagaattctaacaatgaagtggcgtgtaagaagactaaaataaagaaaacttgcagaaggattatacctccaaagatgaaaaacacatcttccaaggcagaatccacgctgcaaaattcatcctcagctgttcatactgaaagtaacaagctacaacccaagagaacggcagatgcgatgaatctcagtgttgatgtggaaagtagtcaggatggagacagtgatgaagataccacaccatccctggatttttcgggattgtcaccctacgaaaggaagagactgaagaacatatcagaaaacgcagacttttttgcttctcttcagttgtctgagtctgctgcaagactccgtgaaatgatagagaagagacagcctcctaaatccaaaagaaagaagcctaagagagaaaatgggattggatgtagaaggtcaatgcgattactaaaagttgatccttcgggagtttcattaccagcagctccaacaccgccgacattagtagcagatgaaactcctttgttacctcctgggcctttagaaatgacttctgaaaatcaagaagacaacaatgaacgatttaaaggatttctgcacacatgggcaggaatgagcaagccaagtagtaagaacactgagaagggattatctagcattaaaagctacaaagccaatttaaatggcatggtcattagtgaagataccgtttacaaagttaccacaggcccaatattctctatggctctccatccatcagaaactagaactttggtagcagttggggccaaatttgggcaagttggactttgtgatttgacccagcaacctaaagaagatggagtttatgtttttcatccccatagtcagccagttagctgtctttacttctcacccgccaatccggcccacatactgtcactgagctatgatggcacgttacgctgtggggatttttccagggctatttttgaagaggtgtatagaaatgaaagaagtagcttttcctccttcgacttcttggcagaagatgcctccactttaatagtaggacactgggatggaaatatgtcactggtggatagacggacacctggaacttcttatgagaaacttaccagttcttctatgggaaaaataagaactgttcatgtccacccagtgcatagacagtattttatcactgccggattgagggatactcatatttatgatgcaaggcgattgaattccaggagaagtcagcctttgatttctttgactgaacatacaaagagcattgcttccgcctatttttcacctcttactggtaacagagtggtgaccacatgtgctgattgtaatctgagaatttttgacagcagctgtatatcttctaagattccgctcctcaccaccatcaggcacaacactttcactgggcgatggctgaccaggttccaagccatgtgggatcctaaacaagaagactgtgtcatagttggcagcatggcccatccacgacgggtagaaatcttccatgagacaggaaagagggtgcattcgtttggtggagaataccttgtctctgtgtgttccatcaatgccatgcacccaactcggtatattttggctggaggtaattccagcgggaagatacatgtttttatgaatgaaaaaagctgctgagtttttggtttaggaacatcaatttgttcaaattgaccactgtctaaggagcctagtaatcggcgtgccttagtgtgtttatgtggtaatgtgttacatttagcaattataacattgttttattaataagactataagaagagtgtacttttagtaagggagaagtcttggagggttgcttctgcaggacggggagggaatttgaggggaggctgaggtgccgtcaggactttttttttttttttttttttgagatggagttttgctcttgttgcccaggctggagtgcaatagcgcgatcttggctcaccgcaacctccgcctcccaggttcaagcgattctcctgcctcagactcctaagtagctgggattacaggcacctgccaccacgcctggctatttttttgtatttttagtagagatggggtttcatcatgttggccaggctggtctcgagctcctgacctcaggtgatctgcccgcctcggcctccaaaagtgctggaattacaggcgtgagccaccatgcctggccatcagaacttgtaatcaagacagtatgttgagaaattctaacattataaattacaaagctttgactattaaagtttttgtgatctaatgatacagttttgattctatagtaatttgtggcttattttatagtttataatgaatacttatttctagactcatacactggaaggggacccggaaaggtaatgtaactcagtgattttaaaacttgatttttttaactgagaactttttttgccccctgcctgtaggttaagtcttacgtgaaatgccaagataattgctgagcagctttggttacccagggcggggtctgggtctgtctgtactttgcctttactctagatggctcctgagacacaggcaggactcccaagcaccgggttgggatctgccctggtcccggcattccagtataagattgcctcagacctgtgtttttcagactgggtttttgctcttcacatgaaatcaagttagatgacaatgactggtgttgaaaaaaatgaaaaggaaagaatttgtaaagaacagaaaatatatttgagtaagtattgtttggtaaaacttagttacatatgcatatatatttgttaggtatatatgtttatgtgtattctgatgtaaaatatatatatatatatattttattactatagtaccatgggtaatggataaagaagttaaagctactgcttagaatgaagaaggccccaggcttacctgtcccgatctttaaactgtccgaaggaaattcaatagcctgttaagtgaataccttcattcttacttgtatttgggggaatattatgaaatactcaccacttttggtattttatgaaaatgttttcttttcagaagttatggtaatttcaatgtgtttgttgttgggaggggagctgccaaatcagttactaatattactgtgtgacatctatccaacttttttcattattcttcattgccaaatactgaaagacttgtaaatggctttggcaatatgtttgaattctaagaggaaatattttcccataattgtatatcagagaaatatagtgatatacaatttccttgaaaaccaatttctaaataattttcttctctgtaatctaagtgtaaaaaggtttagttttttaataggtttaggtgtttataagcaatagttctctattttctagttgatataagtagaagaattgacaagtgagatggaaatgttaatttataaagggaaagaaaagctaggtgaggttgagttataattaaactgttcaggaaacatcgtaaaggctttaggctccctttttcatttctataccaattaatctcatgggttctagagtggttagttctacgggaattgtttttgtttttgtttttaaagatgctgaaaactactctcaatcaaattagtaccatcatttaagctttgaatacttggcagtaattgcctgggctcgtcaataaatgttagcaaattcttgatgttc

SEQ ID NO: 199975 - DNA, 2586 bp, Homo sapiens
  Payload ID: 19448
  Gene Name: WD repeat domain 76
  ENST ID: ENST00000381246
  CDS Start-End: 272-1960
ggcctcccgccgcaatcttggcgggaaggcgccggccgctaagaagccgaaagatgtccaggtcgggcgcggcggctgagaaggcggactccagacagcgaccccagatgaaggtgagaaacggactggtgcttccaaggtaaatgaatataaagaaaatcaaaacatcgcttatgtgtctctgagaccagcacagactacagttttaataaaaacagctaaggtctatcttgcccccttttcactcagtaattaccagctagaccagcttatgtgccccaaatccctatcagaaaagaattctaacaatgaagtggcgtgtaagaagactaaaataaagaaaacttgcagaaggattatacctccaaagatgaaaaacacatcttccaaggcagaatccacgctgcaaaattcatcctcagctgttcatactgaaagtaacaagctacaacccaagagaacggcagatgcgatgaatctcagtgttgatgtggaaagtagtcaggatggagacagtgatgaagataccacaccatccctggatttttcgggattgtcaccctacgaaaggaagagactgaagaacatatcagaaaacgcagacttttttgcttctcttcagttgtctgagtctgctgcaagactccgtgaaatgatagagaagagacagcctcctaaatccaaaagaaagaagcctaagagagaaaatgggattggatgtagaaggtcaatgcgattactaaaagttgatccttcgggagtttcattaccagcagctccaacaccgccgacattagtagcagatgaaactcctttgttacctcctgggcctttagaaatgacttctgaaaatcaagaagacaacaatgaacgatttaaaggatttctgcacacatgggcaggaatgagcaagccaagtagtaagaacactgagaagggattatctagcattaaaagctacaaagccaatttaaatggcatggtcattagtgaagataccgtttacaaagttaccacaggcccaatattctctatggctctccatccatcagaaactagaactttggtagcagttggggccaaatttgggcaagttggactttgtgatttgacccagcaacctaaagaagatggagtttatgtttttcatccccatagtcagccagttagctgtctttacttctcacccgccaatccggcccacatactgtcactgagctatgatggcacgttacgctgtggggatttttccagggctatttttgaagaggtgtatagaaatgaaagaagtagcttttcctccttcgacttcttggcagaagatgcctccactttaatagtaggacactgggatggaaatatgtcactggtggatagacggacacctggaacttcttatgagaaacttaccagttcttctatgggaaaaataagaactgttcatgtccacccagtgcatagacagtattttatcactgccggattgagggatactcatatttatgatgcaaggcgattgaattccaggagaagtcagcctttgatttctttgactgaacatacaaagagcattgcttccgcctatttttcacctcttactggtaacagagtggtgaccacatgtgctgattgtaatctgagaatttttgacagcagctgtatatcttctaagattccgctcctcaccaccatcaggcacaacactttcactgggcgatggctgaccaggttccaagccatgtgggatcctaaacaagaagactgtgtcatagttggcagcatggcccatccacgacgggtagaaatcttccatgagacaggaaagagggtgcattcgtttggtggagaataccttgtctctgtgtgttccatcaatgccatgcacccaactcggtatattttggctggaggtaattccagcgggaagatacatgtttttatgaatgaaaaaagctgctgagtttttggtttaggaacatcaatttgttcaaattgaccactgtctaaggagcctagtaatcggcgtgccttagtgtgtttatgtggtaatgtgttacatttagcaattataacattgttttattaataagactataagaagagtgtacttttagtaagggagaagtcttggagggttgcttctgcaggacggggagggaatttgaggggaggctgaggtgccgtcaggactttttttttttttttttttttgagatggagttttgctcttgttgcccaggctggagtgcaatagcgcgatcttggctcaccgcaacctccgcctcccaggttcaagcgattctcctgcctcagactcctaagtagctgggattacaggcacctgccaccacgcctggctatttttttgtatttttagtagagatggggtttcatcatgttggccaggctggtctcgagctcctgacctcaggtgatctgcccgcctcggcctccaaaagtgctggaattacaggcgtgagccaccatgcctggccatcagaacttgtaatcaagacagtatgttgagaaattctaacattataaattacaaagctttgactattaaagtttttgtgatctaatgat

SEQ ID NO: 199976 - DNA, 813 bp, Homo sapiens
  Payload ID: 19448
  Gene Name: WD repeat domain 76
  ENST ID: ENST00000452115
  CDS Start-End: 128-813
gccgcaatcttggcgggaaggcgccggccgctaagaagccgaaagatgtccaggtcgggcgcggcggctgagaaggcggactccagacagcgaccccagatgaagtaattaccagctagaccagcttatgtgccccaaatccctatcagaaaagaattctaacaatgaagtggcgtgtaagaagactaaaataaagaaaacttgcagaaggattatacctccaaagatgaaaaacacatcttccaaggcagaatccacgctgcaaaattcatcctcagctgttcatactgaaagtaacaagctacaacccaagagaacggcagatgcgatgaatctcagtgttgatgtggaaagtagtcaggatggagacagtgatgaagataccacaccatccctggatttttcgggattgtcaccctacgaaaggaagagactgaagaacatatcagaaaacgcagacttttttgcttctcttcagttgtctgagtctgctgcaagactccgtgaaatgatagagaagagacagcctcctaaatccaaaagaaagaagcctaagagagaaaatgggattggatgtagaaggtcaatgcgattactaaaagttgatccttcgggagtttcattaccagcagctccaacaccgccgacattagtagcagatgaaactcctttgttacctcctgggcctttagaaatgacttctgaaaatcaagaagacaacaatgaacgatttaaaggatttctgcacacatgggcaggaatgagcaagccaagtagtaagaacactgagaagggattatctagcattaaaag

SEQ ID NO: 199977 - DNA, 2576 bp, Homo sapiens
  Payload ID: 19449
  Gene Name: WD repeat domain 77
  Uniprot ID: Q9BQA1
  ENST ID: ENST00000235090
  CDS Start-End: 208-1236
agtcaagtaacgctgagagcctatcgcatgagggcgacagccggaaagcaggatggagccatagaagcaattctcgcgagaagtagagttgcggttccctcgggagaggggcggaggctcagaggtgcaccacgtggggtttgctgccggagcggagtctccggccggcgtccagtttgagtctaggttggagttggaaccgtggagatgcggaaggaaaccccaccccccctagtgcccccggcggcccgggagtggaatcttcccccaaatgcgcccgcctgcatggaacggcagttggaggctgcgcggtaccggtccgatggggcgcttctcctcggggcctccagcctgagtgggcgctgctgggccggctccctctggctttttaaggacccctgtgccgcccccaacgaaggcttctgctccgccggagtccaaacggaggctggagtggctgacctcacttgggttggggagagaggtattctagtggcctccgattcaggtgctgttgaattgtgggaactagatgagaatgagacacttattgtcagcaagttctgcaagtatgagcatgatgacattgtgtctacagtcagtgtcttgagctctggcacacaagctgtcagtggtagcaaagacatctgcatcaaggtttgggaccttgctcagcaggtggtactgagttcataccgagctcatgctgctcaggtcacttgtgttgctgcctctcctcacaaggactctgtgtttctttcatgcagcgaggacaatagaattttactctgggatacccgctgtcccaagccagcatcacagattggctgcagtgcgcctggctaccttcctacctcgctggcttggcatcctcagcaaagtgaagtctttgtctttggtgatgagaatgggacagtctcccttgtggacaccaagagtacaagctgtgtcctgagctcagctgtacactcccagtgtgtcactgggctggtgttctccccacacagtgttcccttcctggcctctctcagtgaagactgctcacttgctgtgctggactcaagcctttctgagttgtttagaagccaagcccacagagactttgtgagagatgcgacttggtccccgctcaatcactccctgcttaccacagtgggctgggaccatcaggtcgtccaccacgttgtgcccacagaacctctcccagcccctggacctgcaagtgttactgagtagattggatttaagacaaaaagcaagtcccccatgagtgtccacttctttgccctgccctctcagcttgtgagacaacacaggagccttctatagtatgttgatatgctagatctgtgccgttaataggcatcgtctctcagcctgagggaggctggattctgggttcctgtagtcacagggaggaaaagctttcttaaaaatggacatgtatgtgcgtgtgagtgtgtgtgtagatttatagtttttggtagtggcaggaataaaaaaaatccatcctacatcttccctaagcactgcctctctctcaccccccaaaacaagttgacgaaagggttttatgtagctgtctatgaggaattggccgtgtctgggtgggttatgggatgtgggcatccctgggttcttggaagcagctcttatgctactcatagagatgggattgactttatttttttatagtgcttaattcaccattatgagaaatgcttccagtcacaaaaatgcagcccagctcactctgaggaagaagcaggacttggtacggttttacacaactccttaccattaaactgaatcagaaatccattttctggctgaataaaaagtttggcttgcctgtgtaatgcccactcccttccccctggctccctagtgatgggacatatatgagagagaagtgtttttctatcatagacaccataggggaaagtttggggatgaaggagagcttaaaggtgtttcaattaagttagaaaactgacacaggctgttgagaattctttgccacttttcccaccccaaaacagcatggggcctgacatcttctgccctggtcccctttctcttgatgtggaaagtctgaatgcagtatttatagacttctaaggttttaaaatccagtatcaagaagaaaatcagaaatactggttggtgaaataaagagtttaggcattgttggcctgtcttttttgaagcatgtgtgttatgtgtagttagatatatttcacttatgtgagtcatcatggtgttggtcttgtagcccattatttttcctgtgcttccccagcttcccaaagtagctagttagaacttaaggtaaatatttattcttgggttggtggagtggatattgccagttaggagtcatggatcaattactgattatattgaaagtaaatataatcaattatgtacttttgagctttgcaggttcaatttaggtaaaaatcacattatgaaactgggaaagtctgaaggaatatgggcaaaatatttctcagtaaagcttccatgcttcacccttgacatgattacccttgagtaaaacatgggaatttgta

SEQ ID NO: 199978 - DNA, 877 bp, Homo sapiens
  Payload ID: 19449
  Gene Name: WD repeat domain 77
  ENST ID: ENST00000449340
  CDS Start-End: 1-875
cctgtgccgcccccaacgaaggcttctgctccgccggagtccaaacggaggctggagtggctgacctcacttgggttggggagagaggtattctagtggcctccgattcaggtgctgttgaattgtgggaactagatgagaatgagacacttattgtcagcaagttctgcaagtatgagcatgatgacattgtgtctacagtcagtgtcttgagctctggcacacaagctgtcagtggtagcaaagacatctgcatcaaggtttgggaccttgctcagcaggtggtactgagttcataccgagctcatgctgctcaggtcacttgtgttgctgcctctcctcacaaggactctgtgtttctttcatgcagcgaggacaatagaattttactctgggatacccgctgtcccaagccagcatcacagattggctgcagtgcgcctggctaccttcctacctcgctggcttggcatcctcagcaaagtgaagtctttgtctttggtgatgagaatgggacagtctcccttgtggacaccaagagtacaagctgtgtcctgagctcagctgtacactcccagtgtgtcactgggctggtgttctccccacacaggctggacctttcacaaccctctcctccatctgatagtgttcccttcctggcctctctcagtgaagactgctcacttgctgtgctggactcaagcctttctgagttgtttagaagccaagcccacagagactttgtgagagatgcgacttggtccccgctcaatcactccctgcttaccacagtgggctgggaccatcaggtcgtccaccacgttgtgcccacagaacctctcccagcccctggacctgcaagtgttactgagtagat

SEQ ID NO: 199979 - DNA, 1520 bp, Homo sapiens
  Payload ID: 19450
  Gene Name: WD repeat domain 78
  ENST ID: ENST00000371022
  CDS Start-End: 16-978
ggctccaccgtcgccatgacgcccggcaaacattccggagcctcggcccgagccgctaacggaggagcttgggggtacagggacttcagaggcggccaaaaaaaggggtggtgcaccactccccagctggtcgccaccatgccagtctctccggcaggcagtcacaagcagcagaacttcgggttgaacaatgccacacaaccaaagaagtctattagcttttttgctacaatgaaagcaacttcagtgaaaggatatactggtgcaaatcaaagcagaatggctgtgtccaaaaccgtgcttattccacctgaactgaaaactgtagaaaaaccaaatcccaatataaagacaacacaggtatttgacataaatggaactgatgttactccccgacctctttaccatccagatccacttactggtacagcaaaaccaagtaaactcttgacatcacaagaaggatcacttggatcagaatttatatcttcctatagcctttatcagaatacaataaatcctagtacgttagggcagtttacaaggtcagttttaggaagcagtacagtttctaagtcaagtgtatcagcaagtgaatcaatagcagaagacctggaagaaccatcctataaacgggaaagattgactagtttcacagatttgcaagttataagggcagcacctgaaaaaattgtaacaaaagaagacctggagaagaatatagagataatactcacagagacagaaacactgagattttttgacttgcccacagtcatggtctctgtagaatctgaagaagctgagaaagtaactcagagaaacaagaattatgaagtcctttgtagaaacagattaggcaatgacctatatgttgaaaggatgatgcagactttcaatggagcaccaaagaataaagatgttcaatgtgataaaatcataatggaagataaaggtaatttctatcattctgcttgataaactataatgttctaatatacattttttgagtctgtcaatcgacaagtgaatattgaaatgtataaagcaaaaataaaaataatttggccaaaccacaacagtagttggacactgtgttctatagctttcagaatttgacatgttaagtaataaatatatagatttgaataacataattattcatcttggtttttatgcatactatatcatagaactttatactctttaaacgtttatataaactgattatttactatgtcacaaagaatatcagccataactattaacattttaaatgtgtcagacactatgtccttcacatgtattaactggtttaatttttacagcaaccctatgaggtagatactattatgcttccccattttatagatgaggaaacaggcaaagagaagtttgctaactgttctggttctagagcttgtgcacttaactactatacttaccacctctcactgtgtacaaattaacaaccctgagcacattgcatagccaaaatctgtagggtgtagccaaagaag

SEQ ID NO: 199980 - DNA, 1697 bp, Homo sapiens
  Payload ID: 19450
  Gene Name: WD repeat domain 78
  Uniprot ID: Q5VTH9
  ENST ID: ENST00000371023
  CDS Start-End: 10-1647
accgtcgccatgacgcccggcaaacattccggagcctcggcccgagccgctaacggaggagcttgggggtacagggacttcagaggcggccaaaaaaaggggtggtgcaccactccccagctggtcgccaccatgccagtctctccggcaggcagtcacaagcagcagaacttcgggttgaacaatgccacacaaccaaagaagtctattagcttttttgctacaatgaaagcaacttcagtgaaaggatatactggtgcaaatcaaagcagaatggctgtgtccaaaaccgtgcttattccacctgaactgaaaactgtagaaaaaccaaatcccaatataaagacaacacaggtatttgacataaatggaactgatgttactccccgacctctttaccatccagatccacttactggtacagcaaaaccaagtaaactcttgacatcacaagaaggatcacttggatcagaatttatatcttcctatagcctttatcagaatacaataaatcctagtacgttagggcagtttacaaggtcagttttaggaagcagtacagtttctaagtcaagtgtatcagcaagtgaatcaatagcagaagacctggaagaaccatcctataaacgggaaagattgactagtttcacagatttgcaagttataagggcagcacctgaaaaaattgtaacaaaagaagacctggagaagaatatagagataatactcacagagacagaaacactgagattttttgacttgcccacagtcatggtctctgtagaatctgaagaagctgagaaagtaactcagagaaacaagaattatgaagtcctttgtagaaacagattaggcaatgacctatatgttgaaaggatgatgcagactttcaatggagcaccaaagaataaagatgttcaatgtgataaaatcataatggaagataaaggcataatgtccactgcctgggatttgtatgattcttacaatgctatggaacttgtatctttatcagtaaaacaatctgtggttgagtcaagtagtaaagcaaatgtacttcctaaagatcaggaccaaagattgccagggagcactacagaaaaaaatagtgaaactagttctctaatggacatagaaaatgtaattctggcaaaaatccatgaagatgaggaagaccactcagatgcaatattaaaatctgacaaatttcatcaggacttattttttatggaacgggttctgatggaaaatatatttcagcccaaacttgcagcttatcgtcagcttcctgttttaaaagaacctgaacctgaagagcctgaagatgttttagaaagtgcaaaacatgaagaggtagaggaagaatctaagaaggaggaggaagaagaaatacatgcagaagaatcaacaatacccgccaacttggaacgactttggtctttttcctgtgacttaaccaaaggcctcaatgtgagcagccttgcctggaataaaacaaatccagatcttttggctgttggctatgggcactttggatttaaagagcaaaaaagaggactggcttgctgctggtcaataaagaatcccatggtaacccaaacaagaataagaagcatttttatctggctgttgacaaaattctcataaaatatataattacatgtaataattaaataaagtctagaaaattttatcaa

SEQ ID NO: 199981 - DNA, 3848 bp, Homo sapiens
  Payload ID: 19450
  Gene Name: WD repeat domain 78
  Uniprot ID: Q5VTH9
  ENST ID: ENST00000371026
  CDS Start-End: 57-2603
ctcgtgccgccagccaaccgcgcggccgcttgttgagccagggctccaccgtcgccatgacgcccggcaaacattccggagcctcggcccgagccgctaacggaggagcttgggggtacagggacttcagaggcggccaaaaaaaggggtggtgcaccactccccagctggtcgccaccatgccagtctctccggcaggcagtcacaagcagcagaacttcgggttgaacaatgccacacaaccaaagaagtctattagcttttttgctacaatgaaagcaacttcagtgaaaggatatactggtgcaaatcaaagcagaatggctgtgtccaaaaccgtgcttattccacctgaactgaaaactgtagaaaaaccaaatcccaatataaagacaacacaggtatttgacataaatggaactgatgttactccccgacctctttaccatccagatccacttactggtacagcaaaaccaagtaaactcttgacatcacaagaaggatcacttggatcagaatttatatcttcctatagcctttatcagaatacaataaatcctagtacgttagggcagtttacaaggtcagttttaggaagcagtacagtttctaagtcaagtgtatcagcaagtgaatcaatagcagaagacctggaagaaccatcctataaacgggaaagattgactagtttcacagatttgcaagttataagggcagcacctgaaaaaattgtaacaaaagaagacctggagaagaatatagagataatactcacagagacagaaacactgagattttttgacttgcccacagtcatggtctctgtagaatctgaagaagctgagaaagtaactcagagaaacaagaattatgaagtcctttgtagaaacagattaggcaatgacctatatgttgaaaggatgatgcagactttcaatggagcaccaaagaataaagatgttcaatgtgataaaatcataatggaagataaaggcataatgtccactgcctgggatttgtatgattcttacaatgctatggaacttgtatctttatcagtaaaacaatctgtggttgagtcaagtagtaaagcaaatgtacttcctaaagatcaggaccaaagattgccagggagcactacagaaaaaaatagtgaaactagttctctaatggacatagaaaatgtaattctggcaaaaatccatgaagatgaggaagaccactcagatgcaatattaaaatctgacaaatttcatcaggacttattttttatggaacgggttctgatggaaaatatatttcagcccaaacttgcagcttatcgtcagcttcctgttttaaaagaacctgaacctgaagagcctgaagatgttttagaaagtgcaaaacatgaagaggtagaggaagaatctaagaaggaggaggaagaagaaatacatgcagaagaatcaacaatacccgccaacttggaacgactttggtctttttcctgtgacttaaccaaaggcctcaatgtgagcagccttgcctggaataaaacaaatccagatcttttggctgttggctatgggcactttggatttaaagagcaaaaaagaggactggcttgctgctggtcaataaagaatcccatgtggccagaacgtatttatcagagtccatatggagttactgctgtggatttttcaattggagcacctaaccttttagccgttggctatcacaatggcacaattgcaatttacaatgtacggagcaacagtaatgttccagttctggatagtagtgaatcacctcaaaaacatttgggacctgtatggcaactacagtggatagaacaagatcgaggaacaacaggagatggcaaaagagaaatactagtttctatatcagcagatggaagaatctccaaatgggttatacgaaaaggactagactgttatgatttgatgcgattaaagagaactacagctgccagtaacaaaaaaggaggggaaaaggaaaagaaagatgaagctttgatatctcgacaggctcctggaatgtgttttgcttttcatcccaaggacacaaatatctatttggctggcactgaagaaggtcatattcacaaatgttcttgttcatataatgaacaatacttagatacctacagaggacataagggtccagtgtataaagtgacatggaatccattttgtcatgatgtatttttaagctgttctgcagattggggtgttattatatggcaacaggagaatgtcaagccatctttgagtttttatccagctacttctgttgtttacgacgttgcctggtctccaaaatcatcctatatatttgcagctgcaaatgagaacagggtggagatttgggaccttcatatcagcactttggaccctctgattgtgaatactgctaaccctggaatcaagttcacaaccattctctttgccaaacaaacagattgccttctggtaggagacagtgatggacaggtttctgtgtatgaactgagaaatatgcctactgttttggaaactggccggggagatataatggatactttgcttggatccaagtcaaaccaatcagcataattcatcattcctaatatttttcttgtagttgttttaaaaaaggaattaacatccaatattctgtattacatactgtacaccagattttgatttcagaaaacaatatttgatgtataacttccacttaatttaaatttaataaacttttatttcagagatatttgattagtttacaatctaagagttattcttaagagtttcagtggaattttcttaatttttctaaagatattcctactctcttgatcatattctaagtacatatgagtacatgtacattcttatacaatgtctaaatgggttagaaaattattatacctatagaagcgaaacttggaaattaatagaatcacttaaaccaaaatctttataagacacaattctattgattttaaagcttctgctttccaggctctgttttccagagtttataattacgtagtttttagtagatgaaaataatggattcttgtacctaacattttatcctcttagatctaagagccgaagctatagaactttgttagactatttggcaagcaaaatatatgacagtaaatatcagaattttatggtttgaccagcgcttatcacattcccaattcagtgagaaaaattcatctgggacacaacagggtactcttctctgtttgcccagaatcagctctggattttaagcccagacttcagtggacccagatagaaaatataaagtctctgatctataggccacatcaggatgttattttatgaagagttctagagcaaggttgcggaaatcggggtggagatggggagcagtgactcctccaaatattcattgctaacaggccattctatgcagtttgttttaacaaatcctgggttaaactgaggccacaggacatgatgggctgttctataaagcattctaagtggagaggagacgatagggcatatgaaattcactaaactctctggaaaaaaaatatgtatatattaaaaaccaagactggaatcagtgcaacagtgggaactaccttttacaagtatccattgcttcataaactccatttgtttggaccaatcccttaaacaaaagcaaggcaaattttacatggatttagagcctaggtcaggttattaggattataaattttccactggtatgtcattgtgattatctttgtttttgtctttctgaaagattggattttctataacaccttgtgtaagaaaataaaaaacttgatctaactgaaaaaa

SEQ ID NO: 199982 - DNA, 569 bp, Homo sapiens
  Payload ID: 19450
  Gene Name: WD repeat domain 78
  ENST ID: ENST00000532629
  CDS Start-End: 1-168
aaacattccggagcctcggcccgagccgctaacggaggagcttgggggtacagggacttcagaggcggccaaaaaaaggggtggtgcaccactccccagctggtcgccaccatgccagtctctccggcaggcagtcacaagcagcagaacttcgggttggaggcatgagacatcaatcaatatatgtaagaagtacattggttccatccagaaaggcagggacaacttgaagcagggagggggcttccaggtcacaggaacaatgccacacaaccaaagaagtctattagcttttttgctacaatgaaagcaacttcagtgaaaggatatactggtgcaaatcaaagcagaatggctgtgtccaaaaccgtgcttattccacctgaactgaaaactgtagaaaaaccaaatcccaatataaagacaacacaggtatttgacataaatggaactgatgttactccccgacctctttaccatccagatccacttactggtacagcaaaaccaagtaaactcttgacatcacaagaaggatcacttggatcagaatttatatcttcctatag

SEQ ID NO: 199983 - DNA, 684 bp, Homo sapiens
  Payload ID: 19450
  Gene Name: WD repeat domain 78
  ENST ID: ENST00000469450
  CDS Start-End: 1-367
tcagagaaacaagaattatgaagtcctttgtagaaacagattaggcaatgacctatatgttgaaaggatgatgcagactttcaatggagcaccaaagaataaagatgttcaatgtgataaaatcataatggaagataaaggcataatgtccactgcctgggatttgtatgattcttacaatgctatggaacttgtatctttatcagtaaaacaatctgtggttgagtcaagtagtaaagcaaatgtacttcctaaagatcaggaccaaagattgccagggagcactacagaaaaaactgtggtctgggagagagacgtgatgacagaagaaggtcagcgggaatgcaatcaatgttgctgtctttgaagatgaaggaaaggttgtggtggcccccagaaactgaaaaaatcaaggaaacaaattctcctttaaaaccttcagaaaggaacaaagccctatcaacttcttggttttagctcagtgacatctgttaggcctctaatctactgaactgtaagataaatttgcattgttttaagccactgtgatttgttacagcagcaagagaaaacttaatacaatagtatagtatttctgtatagcaataatcaaatcagacctttttctgaaggctgatcatcttatttcaacttgaattttaaaagaataaagacaaaaattac

SEQ ID NO: 199984 - DNA, 550 bp, Homo sapiens
  Payload ID: 19450
  Gene Name: WD repeat domain 78
  ENST ID: ENST00000531552
  CDS Start-End: 1-504
ggcataatgtccactgcctgggatttgtatgattcttacaatgctatggaacttgtatctttatcagtaaaacaatctgtggttgagtcaagtagtaaagcaaatgtacttcctaaagatcaggaccaaagattgccagggagcactacagaaaaaaaacctgaacctgaagagcctgaagatgttttagaaagtgcaaaacatgaagaggtagaggaagaatctaagaaggaggaggaagaagaaatacatgcagaagaatcaacaatacccgccaacttggaacgactttggtctttttcctgtgacttaaccaaaggcctcaatgtgagcagccttgcctggaataaaacaaatccagatcttttggctgttggctatgggcactttggatttaaagagcaaaaaagaggactggcttgctgctggtcaataaagaatcccatggtaacccaaacaagaataagaagcatttttatctggctgttgacaaaattctcataaaatatataattacatgtaataattaaataaagtctagaaaatttta

SEQ ID NO: 199985 - DNA, 1906 bp, Homo sapiens
  Payload ID: 19450
  Gene Name: WD repeat domain 78
  ENST ID: ENST00000464352
  CDS Start-End: 1-1746
aatatagagataatactcacagagacagaaacactgagattttttgacttgcccacagtcatggtctctgtagaatctgaagaagctgagaaagtaactcagagaaacaagaattatgaagtcctttgtagaaacagattaggcaatgacctatatgttgaaaggatgatgcagactttcaatggagcaccaaagaataaagatgttcaatgtgataaaatcataatggaagataaaggcataatgtccactgcctgggatttgtatgattcttacaatgctatggaacttgtatctttatcagtaaaacaatctgtggttgagtcaagtagtaaagcaaatgtacttcctaaagatcaggaccaaagattgccagggagcactacagaaaaaaatagtgaaactagttctctaatggacatagaaaatgtaattctggcaaaaatccatgaagatgaggaagaccactcagatgcaatattaaaatctgacaaatttcatcaggacttattttttatggaacgggttctgatggaaaatatatttcagcccaaacttgcagcttatcgtcagcttcctgttttaaaagaacctgaacctgaagagcctgaagatgttttagaaagtgcaaaacatgaagaggtagaggaagaatctaagaaggaggaggaagaagaaatacatgcagaagaatcaacaatacccgccaacttggaacgactttggtctttttcctgtgacttaaccaaaggcctcaatgtgagcagccttgcctggaataaaacaaatccagatcttttggctgttggctatgggcactttggatttaaagagcaaaaaagaggactggcttgctgctggtcaataaagaatcccatgtggccagaacgtatttatcagagtccatatggagttactgctgtggatttttcaattggagcacctaaccttttagccgttggctatcacaatggcacaattgcaatttacaatgtacggagcaacagtaatgttccagttctggatagtagtgaatcacctcaaaaacatttgggacctgtatggcaactacagtggatagaacaagatcgaggaacaacaggagatggcaaaagagaaatactagtttctatatcagcagatggaagaatctccaaatgggttatacgaaaaggactagactgttatgatttgatgcgattaaagagaactacagctgccagtaacaaaaaaggaggggaaaaggaaaagaaagatgaagctttgatatctcgacaggctcctggaatgtgttttgcttttcatcccaagggtccagtgtataaagtgacatggaatccattttgtcatgatgtatttttaagctgttctgcagattggggtgttattatatggcaacaggagaatgtcaagccatctttgagtttttatccagctacttctgttgtttacgacgttgcctggtctccaaaatcatcctatatatttgcagctgcaaatgagaacagggtggagatttgggaccttcatatcagcactttggaccctctgattgtgaatactgctaaccctggaatcaagttcacaaccattctctttgccaaacaaacagattgccttctggtaggagacagtgatggacaggtttctgtgtatgaactgagaaatatgcctactgttttggaaactggccggggagatataatggatactttgcttggatccaagtcaaaccaatcagcataattcatcattcctaatatttttcttgtagttgttttaaaaaaggaattaacatccaatattctgtattacatactgtacaccagattttgatttcagaaaacaatatttgatgtataacttccacttaatttaaatttaataaacttttatttcagagata

SEQ ID NO: 199986 - DNA, 613 bp, Homo sapiens
  Payload ID: 19450
  Gene Name: WD repeat domain 78
  ENST ID: ENST00000488333
  CDS Start-End: 143-292
agggaaaagagaaaaaaataagataggagacctggaattatggatggagaagagtccctgagacaccagtgacaagtttcagagttcacataaaaggaacaatgccacacaaccaaagaagtctattagcttttttgctacaatgaaagcaacttcagtgaaaggatatactggtgcaaatcaaagcagaatggctgtgtccaaaaccgtgcttattccacctgaactgaaaactgtagaaaaaccaaatcccaatataaagacaacacaggtaatattcttagaattctgagtttatttgaaaatggcactgtgaaaaactcaattgaaatgttaaagatagaaaatatgctgctttcagataatcactcataattttgaaatactgattttgttaatttttaccacatattattccatacaacataatattgacacttggctcctataactagttattgataagaagaatattagagtggaatgagaaaagtctattcatgaccttaagaactatttgcttatggtattaattatatacattacaactatctttcactgttgtcagcaatatagtcttgaaaatacaataaaattatttgtcataaagtca

SEQ ID NO: 199987 - DNA, 4206 bp, Homo sapiens
  Payload ID: 19450
  Gene Name: WD repeat domain 78
  ENST ID: ENST00000491297
  CDS Start-End: 1-478
tactggtgcaaatcaaagcagaatggctgtgtccaaaaccgtgcttattccacctgaactgaaaactgtagaaaaaccaaatcccaatataaagacaacacaggtatttgacataaatggaactgatgttactccccgacctctttaccatccagatccacttactggtacagcaaaaccaagtaaactcttgacatcacaagaaggatcacttggatcagaatttatatcttcctatagcctttatcagaatacaataaatcctagtacgttagggcagtttacaaggtcagttttaggaagcagtacagtttctaagtcaagtgtatcagcaagtgaatcaatagcagaagacctggaagaaccatcctataaacgggaaagattgactagtttcacaggtaatgaaaatatacttgtttatttcagtaacagtccgttatttagtcaatatgcttattattggttggatacttgagataaaagaaatatggtaatgatttccaaatgctggcttgtgaagtcgcttcaagagaattaccaggggaatatctatttttttaagttccctgggtgactgttttgaatcatcagcctgaggaaccaatggcgctttgtgttagagctcagctgctgcttctgctgctgctgttgctgctgctgcttctgcttcttcttcttcttcttcctcttcctcttcttcttcctcttccttttcttcctcttcctcttttcctcttcttttcctcttcttcctcacttcttcttcctcctcttcctcttcttcctcttcctcctcctcctcttccttctccccctcttcctctccctcctcctcctccccctcctctccttcttcttcttcctcttcctcctcttcctcctctgcttccttctcctcttcctcttcttcttcttcctcttcttctttcttctttcctctttttttttattttgagacagagtcttgctctgtcacacaggctggcgtgcagtggcacaatctcagctcactgcaacctccgcctcctgggttcaagcaattctcctctctcagcctcccaagtagctgggattgcaggtgtccgccaccatgcctggctaatttttttgtatttttaatagagacggggtttcatcatgttggccaggctggtttcaaacttctgacctcaaatgatttgcctgcctcagcctcccaaagtgctgggattacaggcctgagccactgtgcctggcctcttctttcttcttcttctcaggatctcactctgtcacccagactggagtgcaatcttggctcactgcaacctctgcttcctgggctccagcgatcctcccacctcagcctctgaagtacctgggaatacagtcagagaaacaagaattatgaagtcctttgtagaaacagattaggcaatgacctatatgttgaaaggatgatgcagactttcaatggagcaccaaagaataaagatgttcaatgtgataaaatcataatggaagataaaggcataatgtccactgcctgggatttgtatgattcttacaatgctatggaacttgtatctttatcagtaaaacaatctgtggttgagtcaagtagtaaagcaaatgtacttcctaaagatcaggaccaaagattgccagggagcactacagaaaaaaatagtgaaactagttctctaatggacatagaaaatgtaattctggcaaaaatccatgaagatgaggaagaccactcagatgcaatattaaaatctgacaaatttcatcaggacttattttttatggaacgggttctgatggaaaatatatttcagcccaaacttgcagcttatcgtcagcttcctgttttaaaagaacctgaacctgaagagcctgaagatgttttagaaagtgcaaaacatgaagaggtagaggaagaatctaagaaggaggaggaagaagaaatacatgcagaagaatcaacaatacccgccaacttggaacgactttggtctttttcctgtgacttaaccaaaggcctcaatgtgagcagccttgcctggaataaaacaaatccagatcttttggctgttggctatgggcactttggatttaaagagcaaaaaagaggactggcttgctgctggtcaataaagaatcccatgtgaatcacctcaaaaacatttgggacctgtatggcaactacagtggatagaacaagatcgaggaacaacaggagatggcaaaagagaaatactagtttctatatcagcagatggaagaatctccaaatgggttatacgaaaaggactagactgttatgatttgatgcgattaaagagaactacagctgccagtaacaaaaaaggaggggaaaaggaaaagaaagatgaagctttgatatctcgacaggctcctggaatgtgttttgcttttcatcccaaggacacaaatatctatttggctggcactgaagaaggtcatattcacaaatgttcttgttcatataatgaacaatacttagatacctacagaggacataagggtccagtgtataaagtgacatggaatccattttgtcatgatgtatttttaagctgttctgcagattggggtgttattatatggcaacaggagaatgtcaagccatctttgagtttttatccagctacttctgttgtttacgacgttgcctggtctccaaaatcatcctatatatttgcagctgcaaatgagaacagggtggagatttgggaccttcatatcagcactttggaccctctgattgtgaatactgctaaccctggaatcaagttcacaaccattctctttgccaaacaaacagattgccttctggtaggagacagtgatggacaggtttctgtgtatgaactgagaaatatgcctactgttttggaaactggccggggagatataatggatactttgcttggatccaagtcaaaccaatcagcataattcatcattcctaatatttttcttgtagttgttttaaaaaaggaattaacatccaatattctgtattacatactgtacaccagattttgatttcagaaaacaatatttgatgtataacttccacttaatttaaatttaataaacttttatttcagagatatttgattagtttacaatctaagagttattcttaagagtttcagtggaattttcttaatttttctaaagatattcctactctcttgatcatattctaagtacatatgagtacatgtacattcttatacaatgtctaaatgggttagaaaattattatacctatagaagcgaaacttggaaattaatagaatcacttaaaccaaaatctttataagacacaattctattgattttaaagcttctgctttccaggctctgttttccagagtttataattacgtagtttttagtagatgaaaataatggattcttgtacctaacattttatcctcttagatctaagagccgaagctatagaactttgttagactatttggcaagcaaaatatatgacagtaaatatcagaattttatggtttgaccagcgcttatcacattcccaattcagtgagaaaaattcatctgggacacaacagggtactcttctctgtttgcccagaatcagctctggattttaagcccagacttcagtggacccagatagaaaatataaagtctctgatctataggccacatcaggatgttattttatgaagagttctagagcaaggttgcggaaatcggggtggagatggggagcagtgactcctccaaatattcattgctaacaggccattctatgcagtttgttttaacaaatcctgggttaaactgaggccacaggacatgatgggctgttctataaagcattctaagtggagaggagacgatagggcatatgaaattcactaaactctctggaaaaaaaatatgtatatattaaaaaccaagactggaatcagtgcaacagtgggaactaccttttacaagtatccattgcttcataaactccatttgtttggaccaatcccttaaacaaaagcaaggcaaattttacatggatttagagcctaggtcaggttattaggattataaattttccactggtatgtcattgtgattatctttgtttttgtctttctgaaagattggattttctataacaccttgtgtaagaaaataaaaaacttgatctaactg

SEQ ID NO: 199988 - DNA, 574 bp, Homo sapiens
  Payload ID: 19450
  Gene Name: WD repeat domain 78
  ENST ID: ENST00000531980
  CDS Start-End: 1-189
aaacattccggagcctcggcccgagccgctaacggaggagcttgggggtacagggacttcagaggcggccaaaaaaaggggtggtgcaccactccccagctggtcgccaccatgccagtctctccggcaggcagtcacaagcagcagaacttcgggttatccacttactggtacagcaaaaccaagtaaactcttgacatcacaagaaggatcacttggatcagaatttatatcttcctatagcctttatcagaatacaataaatcctagtacgttagggcagtttacaaggtcagttttaggaagcagtacagtttctaagtcaagtgtatcagcaagtgaatcaatagcagaagacctggaagaaccatcctataaacgggaaagattgactagtttcacagtcagagaaacaagaattatgaagtcctttgtagaaacagattaggcaatgacctatatgttgaaaggatgatgcagactttcaatggagcaccaaagaataaagatgttcaatgtgataaaatcataatggaagataaaggcataatgtccactgcctgggatttgtatg

SEQ ID NO: 199989 - DNA, 3808 bp, Homo sapiens
  Payload ID: 19451
  Gene Name: WD repeat domain 81
  Uniprot ID: Q562E7
  ENST ID: ENST00000309182
  CDS Start-End: 222-2894
aaagagcaggcgaaagccacggcgtctgcgtttgcaatgcatgctggtccgtgtagttctcagcctgacaccgtcgttcccagaacccagcgcgctctgtgctggcgggcgcagaggcctcccaggaggagagcaaggacctggcaggggctgctgaggaggaggagagcgggctgcccggggccgggcctggctcctgtgcttttggggaggagattcccatggatggggagcctcctgcctcctcgggcctggggctcccagactacacgtctggcgtcagcttccacgaccaggctgacctccctgagacagaggacttccaagccgggctctatgtgactgagtctccccagccccaggaggctgaggctgtgagcctgggccggctgagtgacaagagcagcaccagcgagacctccctgggtgaggagcgggctccagacgaggggggtgcccccgtggacaagagcagccttcgatcaggtgacagcagccaggacttgaagcaaagcgagggctccgaggaggaagaggaggaggaggacagctgcgtggtgctagaggaggaggagggggagcaggaggaggtcaccggggcatctgagctcactctgtctgacacggtgctgtccatggagacggttgtggccggcggcagtgggggagatggagaagaagaggaggaggcactgcctgagcagtcagaaggcaaagaacagaagatcctccttgatacagcctgcaagatggtccgctggctgtctgccaagctcggccccacagtggcctctcgccacgtggcccggaacctgctccgcctgctgacgtcttgttatgttggacccactcggcagcagttcacagtgagcagtggcgagagcccaccgctgagcgccggcaacatctaccagaagaggccggtcctgggcgacatcgtgtcagggcctgtgctcagctgcctcctccacatcgcccgcctgtatggggagcctgtcctcacctaccagtacctgccctacatcagctacctggtggccccagggagtgcctcaggccccagccgactgaacagccgtaaggaggcggggctgctggccgcggtgacgctgactcagaagatcatcgtgtacctctcagacaccacactcatggacatcctgccccggatcagccatgaggtcctgctgcccgtgctcagcttcctcacctccctcgtcacggggttcccaagtggggcccaggctcggaccatcctgtgtgtgaaaaccatcagcctcatcgccctcatctgcctgcgcattggacaggagatggtccagcagcacctgagcgagcccgtggccacctttttccaggtcttctctcagctgcatgagcttcggcaacaggatctgaagctggaccctgcgggccgtggtgagggccagctgccacaggtggtcttctctgatgggcagcagcggcccgtggaccccgccctgctggacgagctgcagaaggtgttcaccctggagatggcatacacaatctacgtgcccttctcctgcctgttgggtgacatcatccggaaaatcatccccaaccacgagctggttggggagctggcggcgctgtacttggagagcatcagccccagcagtcgcaaccctgccagcgtggagcccaccatgcccggcaccgggcccgagtgggacccccatggtgggggctgccctcaggatgacggccactcagggacctttgggagcgtcctggtggggaaccgcattcagatccccaatgactctcggcctgagaaccccggaccactgggccccatctcgggggtgggtggcgggggcctgggcagcgggagcgacgacaacgccctgaagcaggagctgccgcggagcgtgcacgggctgagcggaaactggctggcgtactggcagtacgagatcggcgtgagccagcaggatgcccactttcacttccaccagatccgcctgcagagcttcccgggccactcgggggccgtcaagtgcgtggcacccctaagcagcgaggacttcttcctgagcggcagcaaggatcgtaccgtgcgcctctggccgctgtacaactacggcgacgggaccagcgagacggccccacgcctcgtctacacccagcaccgcaagagcgtcttcttcgtgggccagcttgaggccccgcagcacgtggtgagctgtgacggggctgtgcacgtctgggaccccttcacagggaagacccttcgcacagtggagccgctggacagccgggtgcccctgactgcggtggctgtcatgcccgccccccacaccagcatcaccatggccagctctgactctaccctgcgctttgtggactgcaggaagcctggtctgcagcacgagttccgactgggcggtgggctgaaccctgggcttgtccgtgccctggccatcagccccagtggccgtagtgtcgtggccggcttctcctcaggcttcatggtgctcctggacacccgcacaggcctggttctgcgaggctggccagcccacgagggggacattctgcagatcaaggcggtggagggcagcgtcctggtcagctcctcctctgaccattccttgaccgtctggaaggagctggagcagaagcccacccatcactacaagtcagcatccgaccccatccacacctttgacctgtacggcagcgaggtggtcactggcaccgtgtccaacaagattggcgtctgctccctgcttgagccaccctcgcaggccaccacgaagctcagctctgagaacttccgcggcacgctcaccagcctggccttgctgcccactaaacgccacctcctgctgggctcagacaacggggttatccgcctcctggcatagactgaggcaggagctggccgggcaagggtgggaagacatctgcgggcgcgtgtccactcaccctgttccctgagcagcagctccctccagggaggccctgggtcccacgccctgggtgcccacatggcctgccaactagggcctgcaaatggagtgggggagtcctggcccctgaatcaccagagccaccaagcctgccagaggggtctcattcatggcttggggacacagggctcctagcaagcaggaagttaagagcaggaggaagcgttgctaccttcacttctccccagctctgccctctgggtccacatgaggacagggaagctcgggaaggggaagggagactggccctgcccagccggtctctagcccctcagcccccgctgggcactctctgtcccatccctctaggacagggaagctggcctggtccagggcactgatggtgcttggattccagcctaaggaaggctggccgtggtccaggagttaagggcttgggtctggggtttaagtggccacccatccaggccctggccagtgtgggaccgggacgggaaggaagaaggaggctaggagcagggggaaaaggtgcacttggccagtggcgcctgccaggagtgagtccatgcgttgtctgcccacccctaccacagtgtttgtgccttcagctgagggggcagcctctgggccctgaacccctgctggggctccacgaccctgagagaaggggtgagaagaatcatctctgcacctcgggtctctgccagaggaagacttaagcatccctgcgacctcacattctagacagagatgaggtccaggggttggcccctgctgccttctcacaatttgcaatagatgtaaataggaccaataaatcctttggaagagccatggggtgaactgag

SEQ ID NO: 199990 - DNA, 6733 bp, Homo sapiens
  Payload ID: 19451
  Gene Name: WD repeat domain 81
  Uniprot ID: Q562E7
  ENST ID: ENST00000409644
  CDS Start-End: 1-5826
atggcccagggcagcggggggcgggaaggcgctctcagaaccccggccgggggctggcattccccgccaagcccagacatgcaggagctgctccggagcgtggagagggacctgagcatcgatcccaggcagctggctccggccccggggggcacccacgtggtggccctagtgcctgcgcgctggctggccagcctccgcgatcgccggctgcccctgggaccctgtccccgcgcagagggcctgggagaagcggaagtcaggactctcctgcagcgctctgtgcaaaggctgcctgccggctggacgcgcgtggaggtgcatgggctgcggaagcggagactgtcctaccctctgggcgggggcctgccctttgaggacgggtcctgcggccctgagaccctcactcgcttcatgcaggaggttgccgcccagaattatcgcaacctgtggcgccatgcataccacacttacggccagccgtacagtcacagccctgccccctcagctgtccctgccttggactcagtacggcaggctctgcagagggtctatggttgctccttcctgccagtgggtgaaactacccaatgcccttcatatgccagagaaggcccctgcccccctcggggcagccctgcttgccctagtcttttacgggctgaggccttgctggagtcgccggagatgctgtatgtggtacacccttacgtacagttctccctacatgacgtggtcaccttcagccctgccaagctgaccaacagccaggccaaggtgctgttcattctcttccgcgtgctgagggctatggacgcctgtcaccgccaggggctggcgtgtggggccctgtctttgtatcacatcgcagtggatgagaagctttgcagcgagctgcgactggacctgagtgcttatgagaggcccgaggaggacgagaatgaggaggcccctgtggcaagggatgaggcgggcattgtgtctcaagaggagcagggagggcaacctgggcaacccactggccaggaggaacttcggagcctcgtgctagattgggtccacggccgcatcagcaacttccactacctcatgcagctgaatcggttggcaggtcggcggcagggggaccccaactaccaccccgtgctgccctgggtggtggacttcactacgccccatgggcgcttccgagacctgcgcaagtccaagttccgcctcaacaagggggataagcaactggacttcacgtatgagatgacacggcaggcattcgtagcaggcggggcgggcggcggggaaccccctcatgttccccaccacatctcagacgtgctctccgacatcacgtactatgtgtacaaggctcggcgcacgcctcggtcggtgctctgcggacacgtccgcgcgcagtgggagccccatgagtatccggccagcatggagcggatgcagaactggaccccggatgagtgcattccggagttctacaccgatccctctatcttccgctccatccaccccgacatgcctgacctggatgtgccagcctggtgcagctccagccaggagttcgtagctgcccaccgagccctgctggagagccgcgaggtatcccgggacctgcaccattggatcgacctcacgtttggctataaactccagggtaaggaggctgtcaaggaaaagaatgtgtgtctgcacctggtggacgcccacactcacctggccagctacggggtggtgcagctcttcgatcagccacacccccagcgcctggctggggctcctgcccttgcccccgagcctcccctcatccccaagctgttggtccagaccatccaggagaccacaggccgggaggacttcacggaaaacccgggacagcttccaaatggagtgggccggccagttttagaggccactccctgtgaggctagctggaccagagacaggccggtggcaggagaagacgacttggaacaggccacagaagctctggattccatttcccttgctgggaaagcaggtgaccagctgggctcctccagtcaagcgtcccctggacttctctctttctcagtggcctcagcctcccgtccaggccgcaggaataaagctgctggggcagaccctggggagggtgaggaggggaggattcttcttcccgagggcttcaatcccatgcaggccctggaggagctggagaaaacgggcaacttcttggccaaaggcctagggggcctgttggaggtgcctgagcagccccgggtccagccggctgtgccactgcagtgcctactccacagggacatgcaggcgctgggtgtcctattggcagagatggtgtttgccaccagggtgcggacgctgcagcccgatgcacctttgtgggtacgcttccaggctgtccgagggctctgcacgcgccaccccaaggaggtccctgtgtctttgcagcccgtgctggacacactcctgcagatgagtggccccgaagtccccatgggagcagagaggggcaagctggaccaactgtttgagtacaggcctgtctcccagggcctgcccccaccctgcccaagccagcttctcagccccttcagctccgtggttcccttcccaccctacttcccggcactgcacagattcatcctcctgtaccaggcaaggcgtgtggaggacgaggcccaggggcgcgagctggtgtttgctctgtggcagcagctgggcgcggtgctgaaggacatcacccctgagggcctggagatcctgctgcccttcgtgctctcactcatgtccgaggagcacacagctgtgtacacggcctggtatctgtttgagcctgttgccaaggcactgggccccaaaaatgccaataagtacctcctgaagccgctcattggtgcctacgagagcccctgccagctacacggccgcttctacctgtacacggactgctttgtggcccagctgatggtgcggctgggcctgcaggcatttctcactcacctgctgccccatgtcctgcaggtgctggcgggcgcagaggcctcccaggaggagagcaaggacctggcaggggctgctgaggaggaggagagcgggctgcccggggccgggcctggctcctgtgcttttggggaggagattcccatggatggggagcctcctgcctcctcgggcctggggctcccagactacacgtctggcgtcagcttccacgaccaggctgacctccctgagacagaggacttccaagccgggctctatgtgactgagtctccccagccccaggaggctgaggctgtgagcctgggccggctgagtgacaagagcagcaccagcgagacctccctgggtgaggagcgggctccagacgaggggggtgcccccgtggacaagagcagccttcgatcaggtgacagcagccaggacttgaagcaaagcgagggctccgaggaggaagaggaggaggaggacagctgcgtggtgctagaggaggaggagggggagcaggaggaggtcaccggggcatctgagctcactctgtctgacacggtgctgtccatggagacggttgtggccggcggcagtgggggagatggagaagaagaggaggaggcactgcctgagcagtcagaaggcaaagaacagaagatcctccttgatacagcctgcaagatggtccgctggctgtctgccaagctcggccccacagtggcctctcgccacgtggcccggaacctgctccgcctgctgacgtcttgttatgttggacccactcggcagcagttcacagtgagcagtggcgagagcccaccgctgagcgccggcaacatctaccagaagaggccggtcctgggcgacatcgtgtcagggcctgtgctcagctgcctcctccacatcgcccgcctgtatggggagcctgtcctcacctaccagtacctgccctacatcagctacctggtggccccagggagtgcctcaggccccagccgactgaacagccgtaaggaggcggggctgctggccgcggtgacgctgactcagaagatcatcgtgtacctctcagacaccacactcatggacatcctgccccggatcagccatgaggtcctgctgcccgtgctcagcttcctcacctccctcgtcacggggttcccaagtggggcccaggctcggaccatcctgtgtgtgaaaaccatcagcctcatcgccctcatctgcctgcgcattggacaggagatggtccagcagcacctgagcgagcccgtggccacctttttccaggtcttctctcagctgcatgagcttcggcaacaggatctgaagctggaccctgcgggccgtggtgagggccagctgccacaggtggtcttctctgatgggcagcagcggcccgtggaccccgccctgctggacgagctgcagaaggtgttcaccctggagatggcatacacaatctacgtgcccttctcctgcctgttgggtgacatcatccggaaaatcatccccaaccacgagctggttggggagctggcggcgctgtacttggagagcatcagccccagcagtcgcaaccctgccagcgtggagcccaccatgcccggcaccgggcccgagtgggacccccatggtgggggctgccctcaggatgacggccactcagggacctttgggagcgtcctggtggggaaccgcattcagatccccaatgactctcggcctgagaaccccggaccactgggccccatctcgggggtgggtggcgggggcctgggcagcgggagcgacgacaacgccctgaagcaggagctgccgcggagcgtgcacgggctgagcggaaactggctggcgtactggcagtacgagatcggcgtgagccagcaggatgcccactttcacttccaccagatccgcctgcagagcttcccgggccactcgggggccgtcaagtgcgtggcacccctaagcagcgaggacttcttcctgagcggcagcaaggatcgtaccgtgcgcctctggccgctgtacaactacggcgacgggaccagcgagacggccccacgcctcgtctacacccagcaccgcaagagcgtcttcttcgtgggccagcttgaggccccgcagcacgtggtgagctgtgacggggctgtgcacgtctgggaccccttcacagggaagacccttcgcacagtggagccgctggacagccgggtgcccctgactgcggtggctgtcatgcccgccccccacaccagcatcaccatggccagctctgactctaccctgcgctttgtggactgcaggaagcctggtctgcagcacgagttccgactgggcggtgggctgaaccctgggcttgtccgtgccctggccatcagccccagtggccgtagtgtcgtggccggcttctcctcaggcttcatggtgctcctggacacccgcacaggcctggttctgcgaggctggccagcccacgagggggacattctgcagatcaaggcggtggagggcagcgtcctggtcagctcctcctctgaccattccttgaccgtctggaaggagctggagcagaagcccacccatcactacaagtcagcatccgaccccatccacacctttgacctgtacggcagcgaggtggtcactggcaccgtgtccaacaagattggcgtctgctccctgcttgagccaccctcgcaggccaccacgaagctcagctctgagaacttccgcggcacgctcaccagcctggccttgctgcccactaaacgccacctcctgctgggctcagacaacggggttatccgcctcctggcatagactgaggcaggagctggccgggcaagggtgggaagacatctgcgggcgcgtgtccactcaccctgttccctgagcagcagctccctccagggaggccctgggtcccacgccctgggtgcccacatggcctgccaactagggcctgcaaatggagtgggggagtcctggcccctgaatcaccagagccaccaagcctgccagaggggtctcattcatggcttggggacacagggctcctagcaagcaggaagttaagagcaggaggaagcgttgctaccttcacttctccccagctctgccctctgggtccacatgaggacagggaagctcgggaaggggaagggagactggccctgcccagccggtctctagcccctcagcccccgctgggcactctctgtcccatccctctaggacagggaagctggcctggtccagggcactgatggtgcttggattccagcctaaggaaggctggccgtggtccaggagttaagggcttgggtctggggtttaagtggccacccatccaggccctggccagtgtgggaccgggacgggaaggaagaaggaggctaggagcagggggaaaaggtgcacttggccagtggcgcctgccaggagtgagtccatgcgttgtctgcccacccctaccacagtgtttgtgccttcagctgagggggcagcctctgggccctgaacccctgctggggctccacgaccctgagagaaggggtgagaagaatcatctctgcacctcgggtctctgccagaggaagacttaagcatccctgcgacctcacattctagacagagatgaggtccaggggttggcccctgctgccttctcacaatttgcaatagatgtaaataggaccaataaatcctttggaagagccatggggtg

SEQ ID NO: 199991 - DNA, 3184 bp, Homo sapiens
  Payload ID: 19451
  Gene Name: WD repeat domain 81
  Uniprot ID: Q562E7
  ENST ID: ENST00000437219
  CDS Start-End: 54-2270
aaacgagagtcctaaagagcaggcgaaagccacggcgtctgcgtttgcaatgcatgctggtccgtgtagttctcagcctgacaccgtcgttcccagaacccagcgcgctctatacagcctgcaagatggtccgctggctgtctgccaagctcggccccacagtggcctctcgccacgtggcccggaacctgctccgcctgctgacgtcttgttatgttggacccactcggcagcagttcacagtgagcagtggcgagagcccaccgctgagcgccggcaacatctaccagaagaggccggtcctgggcgacatcgtgtcagggcctgtgctcagctgcctcctccacatcgcccgcctgtatggggagcctgtcctcacctaccagtacctgccctacatcagctacctggtggccccagggagtgcctcaggccccagccgactgaacagccgtaaggaggcggggctgctggccgcggtgacgctgactcagaagatcatcgtgtacctctcagacaccacactcatggacatcctgccccggatcagccatgaggtcctgctgcccgtgctcagcttcctcacctccctcgtcacggggttcccaagtggggcccaggctcggaccatcctgtgtgtgaaaaccatcagcctcatcgccctcatctgcctgcgcattggacaggagatggtccagcagcacctgagcgagcccgtggccacctttttccaggtcttctctcagctgcatgagcttcggcaacaggatctgaagctggaccctgcgggccgtggtgagggccagctgccacaggtggtcttctctgatgggcagcagcggcccgtggaccccgccctgctggacgagctgcagaaggtgttcaccctggagatggcatacacaatctacgtgcccttctcctgcctgttgggtgacatcatccggaaaatcatccccaaccacgagctggttggggagctggcggcgctgtacttggagagcatcagccccagcagtcgcaaccctgccagcgtggagcccaccatgcccggcaccgggcccgagtgggacccccatggtgggggctgccctcaggatgacggccactcagggacctttgggagcgtcctggtggggaaccgcattcagatccccaatgactctcggcctgagaaccccggaccactgggccccatctcgggggtgggtggcgggggcctgggcagcgggagcgacgacaacgccctgaagcaggagctgccgcggagcgtgcacgggctgagcggaaactggctggcgtactggcagtacgagatcggcgtgagccagcaggatgcccactttcacttccaccagatccgcctgcagagcttcccgggccactcgggggccgtcaagtgcgtggcacccctaagcagcgaggacttcttcctgagcggcagcaaggatcgtaccgtgcgcctctggccgctgtacaactacggcgacgggaccagcgagacggccccacgcctcgtctacacccagcaccgcaagagcgtcttcttcgtgggccagcttgaggccccgcagcacgtggtgagctgtgacggggctgtgcacgtctgggaccccttcacagggaagacccttcgcacagtggagccgctggacagccgggtgcccctgactgcggtggctgtcatgcccgccccccacaccagcatcaccatggccagctctgactctaccctgcgctttgtggactgcaggaagcctggtctgcagcacgagttccgactgggcggtgggctgaaccctgggcttgtccgtgccctggccatcagccccagtggccgtagtgtcgtggccggcttctcctcaggcttcatggtgctcctggacacccgcacaggcctggttctgcgaggctggccagcccacgagggggacattctgcagatcaaggcggtggagggcagcgtcctggtcagctcctcctctgaccattccttgaccgtctggaaggagctggagcagaagcccacccatcactacaagtcagcatccgaccccatccacacctttgacctgtacggcagcgaggtggtcactggcaccgtgtccaacaagattggcgtctgctccctgcttgagccaccctcgcaggccaccacgaagctcagctctgagaacttccgcggcacgctcaccagcctggccttgctgcccactaaacgccacctcctgctgggctcagacaacggggttatccgcctcctggcatagactgaggcaggagctggccgggcaagggtgggaagacatctgcgggcgcgtgtccactcaccctgttccctgagcagcagctccctccagggaggccctgggtcccacgccctgggtgcccacatggcctgccaactagggcctgcaaatggagtgggggagtcctggcccctgaatcaccagagccaccaagcctgccagaggggtctcattcatggcttggggacacagggctcctagcaagcaggaagttaagagcaggaggaagcgttgctaccttcacttctccccagctctgccctctgggtccacatgaggacagggaagctcgggaaggggaagggagactggccctgcccagccggtctctagcccctcagcccccgctgggcactctctgtcccatccctctaggacagggaagctggcctggtccagggcactgatggtgcttggattccagcctaaggaaggctggccgtggtccaggagttaagggcttgggtctggggtttaagtggccacccatccaggccctggccagtgtgggaccgggacgggaaggaagaaggaggctaggagcagggggaaaaggtgcacttggccagtggcgcctgccaggagtgagtccatgcgttgtctgcccacccctaccacagtgtttgtgccttcagctgagggggcagcctctgggccctgaacccctgctggggctccacgaccctgagagaaggggtgagaagaatcatctctgcacctcgggtctctgccagaggaagacttaagcatccctgcgacctcacattctagacagagatgaggtccaggggttggcccctgctgccttctcacaatttgcaatagatgtaaataggaccaataaatcctttggaagagccatggggtgaactgag

SEQ ID NO: 199992 - DNA, 582 bp, Homo sapiens
  Payload ID: 19451
  Gene Name: WD repeat domain 81
  ENST ID: ENST00000418841
  CDS Start-End: 186-582
acgtgacccgcgtcagctgacccgtcacggtggagcccggtgctcgcgcccggcagcctctgccccgccgcgcccggagcgcaggacccgcggaggggttcccaagtggggcccaggctcggaccatcctgtgtgtgaaaaccatcagcctcatcgccctcatctgcctgcgcattggacaggagatggtccagcagcacctgagcgagcccgtggccacctttttccaggtcttctctcagctgcatgagcttcggcaacaggatctgaagctggaccctgcgggccgtggtgagggccagctgccacaggtggtcttctctgatgggcagcagcggcccgtggaccccgccctgctggacgagctgcagaaggtgttcaccctggagatggcatacacaatctacgtgcccttctcctgcctgttgggtgacatcatccggaaaatcatccccaaccacgagctggttggggagctggcggcgctgtacttggagagcatcagccccagcagtcgcaaccctgccagcgtggagcccaccatgcccggcaccgggcccgagtgggacccccatggtgggg

SEQ ID NO: 199993 - DNA, 570 bp, Homo sapiens
  Payload ID: 19451
  Gene Name: WD repeat domain 81
  ENST ID: ENST00000455636
  CDS Start-End: 54-570
aaacgagagtcctaaagagcaggcgaaagccacggcgtctgcgtttgcaatgcatgctggtccgtgtagttctcagcctgacaccgtcgttcccagaacccagcgcgctctatacagcctgcaagatggtccgctggctgtctgccaagctcggccccacagtggcctctcgccacgtggcccggaacctgctccgcctgctgacgtcttgttatgttggacccactcggcagcagttcacagtgagcagtggcgagagcccaccgctgagcgccggcaacatctaccagaagaggccggtcctgggcgacatcgtgtcagggcctgtgctcagctgcctcctccacatcgcccgcctgtatggggagcctgtcctcacctaccagtacctgccctacatcagctacctggtggccccagggagtgcctcaggccccagccgactgaacagccgtaaggaggcggggctgctggccgcggtgacgctgactcagaagatcatcgtgtacctctcagacaccacactcatggacatcctgccccggatcagccatgaggtcctgctgcccg

SEQ ID NO: 199994 - DNA, 2968 bp, Homo sapiens
  Payload ID: 19451
  Gene Name: WD repeat domain 81
  ENST ID: ENST00000446363
  CDS Start-End: 423-2165
tgacaccgtcgttcccagaacccagcgcgctctgtgagttggcatttttaaactgagctcggaatccagcccggggaagtccttaaagggcgacagcccctccttgttggagtcgacccactcggcagcagttcacagtgagcagtggcgagagcccaccgctgagcgccggcaacatctaccagaagaggccggtcctgggcgacatcgtgtcagggcctgtgctcagctgcctcctccacatcgcccgcctgtatggggagcctgtcctcacctaccagtacctgccctacatcagctacctggtggccccagggagtgcctcaggccccagccgactgaacagccgtaaggaggcggggctgctggccgcggtgacgctgactcagaagatcatcgtgtacctctcagacaccacactcatggacatcctgccccggatcagccatgaggtcctgctgcccgtgctcagcttcctcacctccctcgtcacggggttcccaagtggggcccaggctcggaccatcctgtgtgtgaaaaccatcagcctcatcgccctcatctgcctgcgcattggacaggagatggtccagcagcacctgagcgagcccgtggccacctttttccaggtcttctctcagctgcatgagcttcggcaacaggatctgaagctggaccctgcgggccgtggtgagggccagctgccacaggtggtcttctctgatgggcagcagcggcccgtggaccccgccctgctggacgagctgcagaaggtgttcaccctggagatggcatacacaatctacgtgcccttctcctgcctgttgggtgacatcatccggaaaatcatccccaaccacgagctggttggggagctggcggcgctgtacttggagagcatcagccccagcagtcgcaaccctgccagcgtggagcccaccatgcccggcaccgggcccgagtgggacccccatggtgggggctgccctcaggatgacggccactcagggacctttgggagcgtcctggtggggaaccgcattcagatccccaatgactctcggcctgagaaccccggaccactgggccccatctcgggggtgggtggcgggggcctgggcagcgggagcgacgacaacgccctgaagcaggagctgccgcggagcgtgcacgggctgagcggaaactggctggcgtactggcagtacgagatcggcgtgagccagcaggatgcccactttcacttccaccagatccgcctgcagagcttcccgggccactcgggggccgtcaagtgcgtggcacccctaagcagcgaggacttcttcctgagcggcagcaaggatcgtaccgtgcgcctctggccgctgtacaactacggcgacgggaccagcgagacggccccacgcctcgtctacacccagcaccgcaagagcgtcttcttcgtgggccagcttgaggccccgcagcacgtggtgagctgtgacggggctgtgcacgtctgggaccccttcacagggaagacccttcgcacagtggagccgctggacagccgggtgcccctgactgcggtggctgtcatgcccgccccccacaccagcatcaccatggccagctctgactctaccctgcgctttgtggactgcaggaagcctggtctgcagcacgagttccgactgggcggtgggctgaaccctgggcttgtccgtgccctggccatcagccccagtggccgtagtgtcgtggccggcttctcctcaggcttcatggtgctcctggacacccgcacaggcctggttctgcgaggctggccagcccacgagggggacattctgcagatcaaggcggtggagggcagcgtcctggtcagctcctcctctgaccattccttgaccgtctggaaggagctggagcagaagcccacccatcactacaagtcagcatccgaccccatccacacctttgacctgtacggcagcgaggtggtcactggcaccgtgtccaacaagattggcgtctgctccctgcttgagccaccctcgcaggccaccacgaagctcagctctgagaacttccgcggcacgctcaccagcctggccttgctgcccactaaacgccacctcctgctgggctcagacaacggggttatccgcctcctggcatagactgaggcaggagctggccgggcaagggtgggaagacatctgcgggcgcgtgtccactcaccctgttccctgagcagcagctccctccagggaggccctgggtcccacgccctgggtgcccacatggcctgccaactagggcctgcaaatggagtgggggagtcctggcccctgaatcaccagagccaccaagcctgccagaggggtctcattcatggcttggggacacagggctcctagcaagcaggaagttaagagcaggaggaagcgttgctaccttcacttctccccagctctgccctctgggtccacatgaggacagggaagctcgggaaggggaagggagactggccctgcccagccggtctctagcccctcagcccccgctgggcactctctgtcccatccctctaggacagggaagctggcctggtccagggcactgatggtgcttggattccagcctaaggaaggctggccgtggtccaggagttaagggcttgggtctggggtttaagtggccacccatccaggccctggccagtgtgggaccgggacgggaaggaagaaggaggctaggagcagggggaaaaggtgcacttggccagtggcgcctgccaggagtgagtccatgcgttgtctgcccacccctaccacagtgtttgtgccttcagctgagggggcagcctctgggccctgaacccctgctggggctccacgaccctgagagaaggggtgagaagaatcatctctgcacctcgggtctctgccagaggaagacttaagcatccctgcgacctcac

SEQ ID NO: 199995 - DNA, 3315 bp, Homo sapiens
  Payload ID: 19451
  Gene Name: WD repeat domain 81
  Uniprot ID: Q562E7
  ENST ID: ENST00000419248
  CDS Start-End: 262-2406
tggagaccctttcagccccgggaggaagcggagcccagaccgagccagagcggagcagcgggagggagggcggggaggccgccgggcaggaagcggggtcccgcccgggcctctggagccacgtgcgcttgtttccgtgctggggcgatcacgtgacccgcgtcagctgacccgtcacggtggagcccggtgctcgcgcccggcagcctctgccccgccgcgcccggagcgcaggacccgcggagggatacagcctgcaagatggtccgctggctgtctgccaagctcggccccacagtggcctctcgccacgtggcccggaacctgctccgcctgctgacgtcttgttatgttggacccactcggcagcagttcacagtgagcagtggcgagagcccaccgctgagcgccggcaacatctaccagaagaggccggtcctgggcgacatcgtgtcagggcctgtgctcagctgcctcctccacatcgcccgcctgtatggggagcctgtcctcacctaccagtacctgccctacatcagctacctggtggccccagggagtgcctcaggccccagccgactgaacagccgtaaggaggcggggctgctggccgcggtgacgctgactcagaagatcatcgtgtacctctcagacaccacactcatggacatcctgccccggatcagccatgaggtcctgctgcccgtgctcagcttcctcacctccctcgtcacggggttcccaagtggggcccaggctcggaccatcctgtgtgtgaaaaccatcagcctcatcgccctcatctgcctgcgcattggacaggagatggtccagcagcacctgagcgagcccgtggccacctttttccaggtcttctctcagctgcatgagcttcggcaacaggatctgaagctggaccctgcgggccgtggtgagggccagctgccacaggtggtcttctctgatgggcagcagcggcccgtggaccccgccctgctggacgagctgcagaaggtgttcaccctggagatggcatacacaatctacgtgcccttctcctgcctgttgggtgacatcatccggaaaatcatccccaaccacgagctggttggggagctggcggcgctgtacttggagagcatcagccccagcagtcgcaaccctgccagcgtggagcccaccatgcccggcaccgggcccgagtgggacccccatggtgggggctgccctcaggatgacggccactcagggacctttgggagcgtcctggtggggaaccgcattcagatccccaatgactctcggcctgagaaccccggaccactgggccccatctcgggggtgggtggcgggggcctgggcagcgggagcgacgacaacgccctgaagcaggagctgccgcggagcgtgcacgggctgagcggaaactggctggcgtactggcagtacgagatcggcgtgagccagcaggatgcccactttcacttccaccagatccgcctgcagagcttcccgggccactcgggggccgtcaagtgcgtggcacccctaagcagcgaggacttcttcctgagcggcagcaaggatcgtaccgtgcgcctctggccgctgtacaactacggcgacgggaccagcgagacggccccacgcctcgtctacacccagcaccgcaagagcgtcttcttcgtgggccagcttgaggccccgcagcacgtggtgagctgtgacggggctgtgcacgtctgggaccccttcacagggaagacccttcgcacagtggagccgctggacagccgggtgcccctgactgcggtggctgtcatgcccgccccccacaccagcatcaccatggccagctctgactctaccctgcgctttgtggactgcaggaagcctggtctgcagcacgagttccgactgggcggtgggctgaaccctgggcttgtccgtgccctggccatcagccccagtggccgtagtgtcgtggccggcttctcctcaggcttcatggtgctcctggacacccgcacaggcctggttctgcgaggctggccagcccacgagggggacattctgcagatcaaggcggtggagggcagcgtcctggtcagctcctcctctgaccattccttgaccgtctggaaggagctggagcagaagcccacccatcactacaagtcagcatccgaccccatccacacctttgacctgtacggcagcgaggtggtcactggcaccgtgtccaacaagattggcgtctgctccctgcttgagccaccctcgcaggccaccacgaagctcagctctgagaacttccgcggcacgctcaccagcctggccttgctgcccactaaacgccacctcctgctgggctcagacaacggggttatccgcctcctggcatagactgaggcaggagctggccgggcaagggtgggaagacatctgcgggcgcgtgtccactcaccctgttccctgagcagcagctccctccagggaggccctgggtcccacgccctgggtgcccacatggcctgccaactagggcctgcaaatggagtgggggagtcctggcccctgaatcaccagagccaccaagcctgccagaggggtctcattcatggcttggggacacagggctcctagcaagcaggaagttaagagcaggaggaagcgttgctaccttcacttctccccagctctgccctctgggtccacatgaggacagggaagctcgggaaggggaagggagactggccctgcccagccggtctctagcccctcagcccccgctgggcactctctgtcccatccctctaggacagggaagctggcctggtccagggcactgatggtgcttggattccagcctaaggaaggctggccgtggtccaggagttaagggcttgggtctggggtttaagtggccacccatccaggccctggccagtgtgggaccgggacgggaaggaagaaggaggctaggagcagggggaaaaggtgcacttggccagtggcgcctgccaggagtgagtccatgcgttgtctgcccacccctaccacagtgtttgtgccttcagctgagggggcagcctctgggccctgaacccctgctggggctccacgaccctgagagaaggggtgagaagaatcatctctgcacctcgggtctctgccagaggaagacttaagcatccctgcgacctcacattctagacagagatgaggtccaggggttggcccctgctgccttctcacaatttgcaatagatgtaaataggaccaataaatcctttggaagagccatggggtgaa

SEQ ID NO: 199996 - DNA, 590 bp, Homo sapiens
  Payload ID: 19451
  Gene Name: WD repeat domain 81
  ENST ID: ENST00000575206
  CDS Start-End: 1-590
acttccaagccgggctctatgtgactgagtctccccagccccaggaggctgaggctgtgagcctgggccggctgagtgacaagagcagcaccagcgagacctccctgggtgaggagcgggctccagacgaggggggtgcccccgtggacaagagcagccttcgatcaggtgacagcagccaggacttgaagcaaagcgagggctccgaggaggaagaggaggaggaggacagctgcgtggtgctagaggaggaggagggggagcaggaggaggtcaccggggcatctgagctcactctgtctgacacggtgctgtccatggagacggttgtggccggcggcagtgggggagatggagaagaagaggaggaggcactgcctgagcagtcagaaggcaaagaacagaagatcctccttggacccactcggcagcagttcacagtgagcagtggcgagagcccaccgctgagcgccggcaacatctaccagaagaggccggtcctgggcgacatcgtgtcagggcctgtgctcagctgcctcctccacatcgcccgcctgtatggggagcctgtcctcacctaccagtacctg

SEQ ID NO: 199997 - DNA, 562 bp, Homo sapiens
  Payload ID: 19451
  Gene Name: WD repeat domain 81
  ENST ID: ENST00000468539
  CDS Start-End: 50-562
aaacgagagtcctaaagagcaggcgaaagccacggcgtctgcgtttgcaatgcatgctggtccgtgtagttctcagcctgacaccgtcgttcccagaacccagcgcgctctgttcccaagtggggcccaggctcggaccatcctgtgtgtgaaaaccatcagcctcatcgccctcatctgcctgcgcattggacaggagatggtccagcagcacctgagcgagcccgtggccacctttttccaggtcttctctcagctgcatgagcttcggcaacaggatctgaagctggaccctgcgggccgtggtgagggccagctgccacaggtggtcttctctgatgggcagcagcggcccgtggaccccgccctgctggacgagctgcagaaggtgttcaccctggagatggcatacacaatctacgtgcccttctcctgcctgttgggtgacatcatccggaaaatcatccccaaccacgagctggttggggagctggcggcgctgtacttggagagcatcagccccagcagtcgcaaccctgccagcgtggagcccaccatgccc

SEQ ID NO: 199998 - DNA, 561 bp, Homo sapiens
  Payload ID: 19451
  Gene Name: WD repeat domain 81
  ENST ID: ENST00000474958
  CDS Start-End: 1-371
tccgcctgctgacgtcttgttatgttggacccactcggcagcagttcacagtgagcagtggcgagagcccaccgctgagcgccggcaacatctaccagaagaggccggtcctgggcgacatcgtgtcagggcctgtgctcagctgcctcctccacatcgcccgcctgtatggggagcctgtcctcacctaccagtacctgccctacatcagctacctggttcccaagtggggcccaggctcggaccatcctgtgtgtgaaaaccatcagcctcatcgccctcatctgcctgcgcattggacaggagatggtccagcagcacctgagcgagcccgtggccacctttttccaggtcttctctcagctgcatgagcttcggcaacaggatctgaagctggaccctgcgggccgtggtgagggccagctgccacaggtggtcttctctgatgggcagcagcggcccgtggaccccgccctgctggacgagctgcagaaggtgttcaccctggagatggcatacacaatctacgtgcccttctcctgcctgttgggtgacatcatc

SEQ ID NO: 199999 - DNA, 3184 bp, Homo sapiens
  Payload ID: 19451
  Gene Name: WD repeat domain 81
  Uniprot ID: Q562E7
  ENST ID: ENST00000613616
  CDS Start-End: 54-2270
aaacgagagtcctaaagagcaggcgaaagccacggcgtctgcgtttgcaatgcatgctggtccgtgtagttctcagcctgacaccgtcgttcccagaacccagcgcgctctatacagcctgcaagatggtccgctggctgtctgccaagctcggccccacagtggcctctcgccacgtggcccggaacctgctccgcctgctgacgtcttgttatgttggacccactcggcagcagttcacagtgagcagtggcgagagcccaccgctgagcgccggcaacatctaccagaagaggccggtcctgggcgacatcgtgtcagggcctgtgctcagctgcctcctccacatcgcccgcctgtatggggagcctgtcctcacctaccagtacctgccctacatcagctacctggtggccccagggagtgcctcaggccccagccgactgaacagccgtaaggaggcggggctgctggccgcggtgacgctgactcagaagatcatcgtgtacctctcagacaccacactcatggacatcctgccccggatcagccatgaggtcctgctgcccgtgctcagcttcctcacctccctcgtcacggggttcccaagtggggcccaggctcggaccatcctgtgtgtgaaaaccatcagcctcatcgccctcatctgcctgcgcattggacaggagatggtccagcagcacctgagcgagcccgtggccacctttttccaggtcttctctcagctgcatgagcttcggcaacaggatctgaagctggaccctgcgggccgtggtgagggccagctgccacaggtggtcttctctgatgggcagcagcggcccgtggaccccgccctgctggacgagctgcagaaggtgttcaccctggagatggcatacacaatctacgtgcccttctcctgcctgttgggtgacatcatccggaaaatcatccccaaccacgagctggttggggagctggcggcgctgtacttggagagcatcagccccagcagtcgcaaccctgccagcgtggagcccaccatgcccggcaccgggcccgagtgggacccccatggtgggggctgccctcaggatgacggccactcagggacctttgggagcgtcctggtggggaaccgcattcagatccccaatgactctcggcctgagaaccccggaccactgggccccatctcgggggtgggtggcgggggcctgggcagcgggagcgacgacaacgccctgaagcaggagctgccgcggagcgtgcacgggctgagcggaaactggctggcgtactggcagtacgagatcggcgtgagccagcaggatgcccactttcacttccaccagatccgcctgcagagcttcccgggccactcgggggccgtcaagtgcgtggcacccctgagcagcgaggacttcttcctgagcggcagcaaggatcgtaccgtgcgcctctggccgctgtacaactacggcgacgggaccagcgagacggccccacgcctcgtctacacccagcaccgcaagagcgtcttcttcgtgggccagcttgaggccccacagcacgtggtgagctgtgacggggctgtgcacgtctgggaccccttcacagggaagacccttcgcacagtggagccgctggacagccgggtgcccctgactgcggtggctgtcatgcccgccccccacaccagcatcaccatggccagctctgactctaccctgcgctttgtggactgcaggaagcctggtctgcagcacgagttccgactgggcggtgggctgaaccctgggcttgtccgtgccctggccatcagccccagtggccgtagtgtcgtggccggcttctcctcaggcttcatggtgctcctggacacccgcacgggcctggttctgcgaggctggccagcccacgagggggacattctgcagatcaaggcggtggagggcagcgtcctggtcagctcctcctctgaccattccttgaccgtctggaaggagctggagcagaagcccacccatcactacaagtcagcatccgaccccatccacacctttgacctgtacggcagtgaggtggtcactggcaccgtgtccaacaagattggcgtctgctccctgcttgagccaccctcgcaggccaccacgaagctcagctctgagaacttccgcggcacgctcaccagcctggccttgctgcccactaaacgccacctcctgctgggctcagacaacggggttatccgcctcctggcatagactgaggcaggagctggccgggcaagggtgggaagacatctgcgggcgcgtgtccgctcaccctgttccctgagcagcagctccctccagggaggccctgggtcccacgccctgggtgcccacatggcctgccaactagggcctgcaaatggagtgggggagtcctggcccctgaatcaccagagccaccaagcctgccagaggggtctcattcatggcttggggacacagggctcctagcaagcaggaagttaagagcaggaggaagcgttgctaccttcacttctccccagctctgccctctgggtccacatgaggacagggaagctcgggaaggggaagggagactggccctgcccagccggtctctagcccctcagcccccgctgggcactctctgtcccatccctctaggacagggaagctggcctggtccagggcactgatggtgcttggattccagcctaaggaaggctggccgtggtccaggagttaagggcttgggtctggggtttaagtggccacccatccaggccctggccagtgtgggaccgggacgggaaggaagaaggaggctaggagcagggggaaaaggtgcacttggccagtggcgcctgccaggagtgagtccatgcgttgtctgcccacccctaccacagtgtttgtgccttcagctgagggggcagcctctgggccctgaacccctgctggggctccacgaccctgagagaagggttgagaagaatcatctctgcacctcgggtctctgccagaggaagacttaagcatccctgcgacctcacattctagacagagatgaggtccaagggttggcccctgctgccttctcacaatttgcaatagatgtaaataggaccaataaatcctttggaagagccatggggtgaactgag

SEQ ID NO: 200000 - DNA, 3315 bp, Homo sapiens
  Payload ID: 19451
  Gene Name: WD repeat domain 81
  Uniprot ID: Q562E7
  ENST ID: ENST00000613381
  CDS Start-End: 262-2406
tggagaccctttcagccccgggaggaagcggagcccagaccgagccagagcggagcagcgggagggagggcggggaggccgccgggcaggaagcggggtcccgcccgggcctctggagccacgtgcgcttgtttccgtgctggggcgatcacgtgacccgcgtcagctgacccgtcacggtggagcccggtgctcgcgcccggcagcctctgccccgccgcgcccggagcgcaggacccgcggagggatacagcctgcaagatggtccgctggctgtctgccaagctcggccccacagtggcctctcgccacgtggcccggaacctgctccgcctgctgacgtcttgttatgttggacccactcggcagcagttcacagtgagcagtggcgagagcccaccgctgagcgccggcaacatctaccagaagaggccggtcctgggcgacatcgtgtcagggcctgtgctcagctgcctcctccacatcgcccgcctgtatggggagcctgtcctcacctaccagtacctgccctacatcagctacctggtggccccagggagtgcctcaggccccagccgactgaacagccgtaaggaggcggggctgctggccgcggtgacgctgactcagaagatcatcgtgtacctctcagacaccacactcatggacatcctgccccggatcagccatgaggtcctgctgcccgtgctcagcttcctcacctccctcgtcacggggttcccaagtggggcccaggctcggaccatcctgtgtgtgaaaaccatcagcctcatcgccctcatctgcctgcgcattggacaggagatggtccagcagcacctgagcgagcccgtggccacctttttccaggtcttctctcagctgcatgagcttcggcaacaggatctgaagctggaccctgcgggccgtggtgagggccagctgccacaggtggtcttctctgatgggcagcagcggcccgtggaccccgccctgctggacgagctgcagaaggtgttcaccctggagatggcatacacaatctacgtgcccttctcctgcctgttgggtgacatcatccggaaaatcatccccaaccacgagctggttggggagctggcggcgctgtacttggagagcatcagccccagcagtcgcaaccctgccagcgtggagcccaccatgcccggcaccgggcccgagtgggacccccatggtgggggctgccctcaggatgacggccactcagggacctttgggagcgtcctggtggggaaccgcattcagatccccaatgactctcggcctgagaaccccggaccactgggccccatctcgggggtgggtggcgggggcctgggcagcgggagcgacgacaacgccctgaagcaggagctgccgcggagcgtgcacgggctgagcggaaactggctggcgtactggcagtacgagatcggcgtgagccagcaggatgcccactttcacttccaccagatccgcctgcagagcttcccgggccactcgggggccgtcaagtgcgtggcacccctgagcagcgaggacttcttcctgagcggcagcaaggatcgtaccgtgcgcctctggccgctgtacaactacggcgacgggaccagcgagacggccccacgcctcgtctacacccagcaccgcaagagcgtcttcttcgtgggccagcttgaggccccacagcacgtggtgagctgtgacggggctgtgcacgtctgggaccccttcacagggaagacccttcgcacagtggagccgctggacagccgggtgcccctgactgcggtggctgtcatgcccgccccccacaccagcatcaccatggccagctctgactctaccctgcgctttgtggactgcaggaagcctggtctgcagcacgagttccgactgggcggtgggctgaaccctgggcttgtccgtgccctggccatcagccccagtggccgtagtgtcgtggccggcttctcctcaggcttcatggtgctcctggacacccgcacgggcctggttctgcgaggctggccagcccacgagggggacattctgcagatcaaggcggtggagggcagcgtcctggtcagctcctcctctgaccattccttgaccgtctggaaggagctggagcagaagcccacccatcactacaagtcagcatccgaccccatccacacctttgacctgtacggcagtgaggtggtcactggcaccgtgtccaacaagattggcgtctgctccctgcttgagccaccctcgcaggccaccacgaagctcagctctgagaacttccgcggcacgctcaccagcctggccttgctgcccactaaacgccacctcctgctgggctcagacaacggggttatccgcctcctggcatagactgaggcaggagctggccgggcaagggtgggaagacatctgcgggcgcgtgtccgctcaccctgttccctgagcagcagctccctccagggaggccctgggtcccacgccctgggtgcccacatggcctgccaactagggcctgcaaatggagtgggggagtcctggcccctgaatcaccagagccaccaagcctgccagaggggtctcattcatggcttggggacacagggctcctagcaagcaggaagttaagagcaggaggaagcgttgctaccttcacttctccccagctctgccctctgggtccacatgaggacagggaagctcgggaaggggaagggagactggccctgcccagccggtctctagcccctcagcccccgctgggcactctctgtcccatccctctaggacagggaagctggcctggtccagggcactgatggtgcttggattccagcctaaggaaggctggccgtggtccaggagttaagggcttgggtctggggtttaagtggccacccatccaggccctggccagtgtgggaccgggacgggaaggaagaaggaggctaggagcagggggaaaaggtgcacttggccagtggcgcctgccaggagtgagtccatgcgttgtctgcccacccctaccacagtgtttgtgccttcagctgagggggcagcctctgggccctgaacccctgctggggctccacgaccctgagagaagggttgagaagaatcatctctgcacctcgggtctctgccagaggaagacttaagcatccctgcgacctcacattctagacagagatgaggtccaagggttggcccctgctgccttctcacaatttgcaatagatgtaaataggaccaataaatcctttggaagagccatggggtgaa

SEQ ID NO: 200001 - DNA, 3805 bp, Homo sapiens
  Payload ID: 19451
  Gene Name: WD repeat domain 81
  Uniprot ID: Q562E7
  ENST ID: ENST00000611758
  CDS Start-End: 219-2891
aaagagcaggcgaaagccacggcgtctgcgtttgcaatgcatgctggtccgtgtagttctcagcctgacaccgtcgttcccagaacccagcgcgctctgtgctggcgggcgcagaggcctcccaggaggagagcaaggacctggcaggggctgctgaggaggagagcgggctgcccggggccgggcctggctcctgtgcttttggggaggagattcccatggatggggagcctcctgcctcctcgggcctggggctcccagactacacgtctggcgtcagcttccacgaccaggctgacctccctgagacagaggacttccaagccgggctctatgtgactgagtctccccagccccaggaggctgaggctgtgagcctgggccggctgagtgacaagagcagcaccagcgagacctccctgggtgaggagcgggctccagacgaggggggtgcccccgtggacaagagcagccttcgatcaggtgacagcagccaggacttgaagcaaagcgagggctccgaggaggaagaggaggaggaggacagctgcgtggtgctagaggaggaggagggggagcaggaggaggtcaccggggcatctgagctcactctgtctgacacggtgctgtccatggagacggttgtggccggcggcagtgggggagatggagaagaagaggaggaggcactgcctgagcagtcagaaggcaaagaacagaagatcctccttgatacagcctgcaagatggtccgctggctgtctgccaagctcggccccacagtggcctctcgccacgtggcccggaacctgctccgcctgctgacgtcttgttatgttggacccactcggcagcagttcacagtgagcagtggcgagagcccaccgctgagcgccggcaacatctaccagaagaggccggtcctgggcgacatcgtgtcagggcctgtgctcagctgcctcctccacatcgcccgcctgtatggggagcctgtcctcacctaccagtacctgccctacatcagctacctggtggccccagggagtgcctcaggccccagccgactgaacagccgtaaggaggcggggctgctggccgcggtgacgctgactcagaagatcatcgtgtacctctcagacaccacactcatggacatcctgccccggatcagccatgaggtcctgctgcccgtgctcagcttcctcacctccctcgtcacggggttcccaagtggggcccaggctcggaccatcctgtgtgtgaaaaccatcagcctcatcgccctcatctgcctgcgcattggacaggagatggtccagcagcacctgagcgagcccgtggccacctttttccaggtcttctctcagctgcatgagcttcggcaacaggatctgaagctggaccctgcgggccgtggtgagggccagctgccacaggtggtcttctctgatgggcagcagcggcccgtggaccccgccctgctggacgagctgcagaaggtgttcaccctggagatggcatacacaatctacgtgcccttctcctgcctgttgggtgacatcatccggaaaatcatccccaaccacgagctggttggggagctggcggcgctgtacttggagagcatcagccccagcagtcgcaaccctgccagcgtggagcccaccatgcccggcaccgggcccgagtgggacccccatggtgggggctgccctcaggatgacggccactcagggacctttgggagcgtcctggtggggaaccgcattcagatccccaatgactctcggcctgagaaccccggaccactgggccccatctcgggggtgggtggcgggggcctgggcagcgggagcgacgacaacgccctgaagcaggagctgccgcggagcgtgcacgggctgagcggaaactggctggcgtactggcagtacgagatcggcgtgagccagcaggatgcccactttcacttccaccagatccgcctgcagagcttcccgggccactcgggggccgtcaagtgcgtggcacccctgagcagcgaggacttcttcctgagcggcagcaaggatcgtaccgtgcgcctctggccgctgtacaactacggcgacgggaccagcgagacggccccacgcctcgtctacacccagcaccgcaagagcgtcttcttcgtgggccagcttgaggccccacagcacgtggtgagctgtgacggggctgtgcacgtctgggaccccttcacagggaagacccttcgcacagtggagccgctggacagccgggtgcccctgactgcggtggctgtcatgcccgccccccacaccagcatcaccatggccagctctgactctaccctgcgctttgtggactgcaggaagcctggtctgcagcacgagttccgactgggcggtgggctgaaccctgggcttgtccgtgccctggccatcagccccagtggccgtagtgtcgtggccggcttctcctcaggcttcatggtgctcctggacacccgcacgggcctggttctgcgaggctggccagcccacgagggggacattctgcagatcaaggcggtggagggcagcgtcctggtcagctcctcctctgaccattccttgaccgtctggaaggagctggagcagaagcccacccatcactacaagtcagcatccgaccccatccacacctttgacctgtacggcagtgaggtggtcactggcaccgtgtccaacaagattggcgtctgctccctgcttgagccaccctcgcaggccaccacgaagctcagctctgagaacttccgcggcacgctcaccagcctggccttgctgcccactaaacgccacctcctgctgggctcagacaacggggttatccgcctcctggcatagactgaggcaggagctggccgggcaagggtgggaagacatctgcgggcgcgtgtccgctcaccctgttccctgagcagcagctccctccagggaggccctgggtcccacgccctgggtgcccacatggcctgccaactagggcctgcaaatggagtgggggagtcctggcccctgaatcaccagagccaccaagcctgccagaggggtctcattcatggcttggggacacagggctcctagcaagcaggaagttaagagcaggaggaagcgttgctaccttcacttctccccagctctgccctctgggtccacatgaggacagggaagctcgggaaggggaagggagactggccctgcccagccggtctctagcccctcagcccccgctgggcactctctgtcccatccctctaggacagggaagctggcctggtccagggcactgatggtgcttggattccagcctaaggaaggctggccgtggtccaggagttaagggcttgggtctggggtttaagtggccacccatccaggccctggccagtgtgggaccgggacgggaaggaagaaggaggctaggagcagggggaaaaggtgcacttggccagtggcgcctgccaggagtgagtccatgcgttgtctgcccacccctaccacagtgtttgtgccttcagctgagggggcagcctctgggccctgaacccctgctggggctccacgaccctgagagaagggttgagaagaatcatctctgcacctcgggtctctgccagaggaagacttaagcatccctgcgacctcacattctagacagagatgaggtccaagggttggcccctgctgccttctcacaatttgcaatagatgtaaataggaccaataaatcctttggaagagccatggggtgaactgag

SEQ ID NO: 200002 - DNA, 2968 bp, Homo sapiens
  Payload ID: 19451
  Gene Name: WD repeat domain 81
  ENST ID: ENST00000615141
  CDS Start-End: 423-2165
tgacaccgtcgttcccagaacccagcgcgctctgtgagttggcatttttaaactgagctcggaatccagcccggggaagtccttaaagggcgacagcccctccttgttggagtcgacccactcggcagcagttcacagtgagcagtggcgagagcccaccgctgagcgccggcaacatctaccagaagaggccggtcctgggcgacatcgtgtcagggcctgtgctcagctgcctcctccacatcgcccgcctgtatggggagcctgtcctcacctaccagtacctgccctacatcagctacctggtggccccagggagtgcctcaggccccagccgactgaacagccgtaaggaggcggggctgctggccgcggtgacgctgactcagaagatcatcgtgtacctctcagacaccacactcatggacatcctgccccggatcagccatgaggtcctgctgcccgtgctcagcttcctcacctccctcgtcacggggttcccaagtggggcccaggctcggaccatcctgtgtgtgaaaaccatcagcctcatcgccctcatctgcctgcgcattggacaggagatggtccagcagcacctgagcgagcccgtggccacctttttccaggtcttctctcagctgcatgagcttcggcaacaggatctgaagctggaccctgcgggccgtggtgagggccagctgccacaggtggtcttctctgatgggcagcagcggcccgtggaccccgccctgctggacgagctgcagaaggtgttcaccctggagatggcatacacaatctacgtgcccttctcctgcctgttgggtgacatcatccggaaaatcatccccaaccacgagctggttggggagctggcggcgctgtacttggagagcatcagccccagcagtcgcaaccctgccagcgtggagcccaccatgcccggcaccgggcccgagtgggacccccatggtgggggctgccctcaggatgacggccactcagggacctttgggagcgtcctggtggggaaccgcattcagatccccaatgactctcggcctgagaaccccggaccactgggccccatctcgggggtgggtggcgggggcctgggcagcgggagcgacgacaacgccctgaagcaggagctgccgcggagcgtgcacgggctgagcggaaactggctggcgtactggcagtacgagatcggcgtgagccagcaggatgcccactttcacttccaccagatccgcctgcagagcttcccgggccactcgggggccgtcaagtgcgtggcacccctgagcagcgaggacttcttcctgagcggcagcaaggatcgtaccgtgcgcctctggccgctgtacaactacggcgacgggaccagcgagacggccccacgcctcgtctacacccagcaccgcaagagcgtcttcttcgtgggccagcttgaggccccacagcacgtggtgagctgtgacggggctgtgcacgtctgggaccccttcacagggaagacccttcgcacagtggagccgctggacagccgggtgcccctgactgcggtggctgtcatgcccgccccccacaccagcatcaccatggccagctctgactctaccctgcgctttgtggactgcaggaagcctggtctgcagcacgagttccgactgggcggtgggctgaaccctgggcttgtccgtgccctggccatcagccccagtggccgtagtgtcgtggccggcttctcctcaggcttcatggtgctcctggacacccgcacgggcctggttctgcgaggctggccagcccacgagggggacattctgcagatcaaggcggtggagggcagcgtcctggtcagctcctcctctgaccattccttgaccgtctggaaggagctggagcagaagcccacccatcactacaagtcagcatccgaccccatccacacctttgacctgtacggcagtgaggtggtcactggcaccgtgtccaacaagattggcgtctgctccctgcttgagccaccctcgcaggccaccacgaagctcagctctgagaacttccgcggcacgctcaccagcctggccttgctgcccactaaacgccacctcctgctgggctcagacaacggggttatccgcctcctggcatagactgaggcaggagctggccgggcaagggtgggaagacatctgcgggcgcgtgtccgctcaccctgttccctgagcagcagctccctccagggaggccctgggtcccacgccctgggtgcccacatggcctgccaactagggcctgcaaatggagtgggggagtcctggcccctgaatcaccagagccaccaagcctgccagaggggtctcattcatggcttggggacacagggctcctagcaagcaggaagttaagagcaggaggaagcgttgctaccttcacttctccccagctctgccctctgggtccacatgaggacagggaagctcgggaaggggaagggagactggccctgcccagccggtctctagcccctcagcccccgctgggcactctctgtcccatccctctaggacagggaagctggcctggtccagggcactgatggtgcttggattccagcctaaggaaggctggccgtggtccaggagttaagggcttgggtctggggtttaagtggccacccatccaggccctggccagtgtgggaccgggacgggaaggaagaaggaggctaggagcagggggaaaaggtgcacttggccagtggcgcctgccaggagtgagtccatgcgttgtctgcccacccctaccacagtgtttgtgccttcagctgagggggcagcctctgggccctgaacccctgctggggctccacgaccctgagagaagggttgagaagaatcatctctgcacctcgggtctctgccagaggaagacttaagcatccctgcgacctcac

SEQ ID NO: 200003 - DNA, 582 bp, Homo sapiens; identical to SEQ ID NO: 199992
  Payload ID: 19451
  Gene Name: WD repeat domain 81
  ENST ID: ENST00000631560
  CDS Start-End: 186-582

SEQ ID NO: 200004 - DNA, 561 bp, Homo sapiens; identical to SEQ ID NO: 199998
  Payload ID: 19451
  Gene Name: WD repeat domain 81
  ENST ID: ENST00000632313
  CDS Start-End: 1-371

SEQ ID NO: 200005 - DNA, 590 bp, Homo sapiens; identical to SEQ ID NO: 199996
  Payload ID: 19451
  Gene Name: WD repeat domain 81
  ENST ID: ENST00000631907
  CDS Start-End: 1-590

SEQ ID NO: 200006 - DNA, 6730 bp, Homo sapiens
  Payload ID: 19451
  Gene Name: WD repeat domain 81
  ENST ID: ENST00000632244
  CDS Start-End: 1-5823
atggcccagggcagcggggggcgggaaggcgctctcagaaccccggccgggggctggcattccccgccaagcccagacatgcaggagctgctccggagcgtggagagggacctgagcatcgatcccaggcagctggctccggccccggggggcacccacgtggtggccctagtgcctgcgcgctggctggccagcctccgcgatcgccggctgcccctgggaccctgtccccgcgcagagggcctgggagaagcggaagtcaggactctcctgcagcgctctgtgcaaaggctgcctgccggctggacgcgcgtggaggtgcatgggctgcggaagcggagactgtcctaccctctgggcgggggcctgccctttgaggacgggtcctgcggccctgagaccctcactcgcttcatgcaggaggttgccgcccagaattatcgcaacctgtggcgccatgcataccacacttacggccagccgtacagtcacagccctgccccctcagctgtccctgccttggactcagtacggcaggctctgcagagggtctatggttgctccttcctgccagtgggtgaaactacccaatgcccttcatatgccagagaaggcccctgcccccctcggggcagccctgcttgccctagtcttttacgggctgaggccttgctggagtcgccggagatgctgtatgtggtacacccttacgtacagttctccctacatgacgtggtcaccttcagccctgccaagctgaccaacagccaggccaaggtgctgttcattctcttccgcgtgctgagggctatggacgcctgtcaccgccaggggctggcgtgtggggccctgtctttgtatcacatcgcagtggatgagaagctttgcagcgagctgcgactggacctgagtgcttatgagaggcccgaggaggacgagaatgaggaggcccctgtggcaagggatgaggcgggcattgtgtctcaagaggagcagggagggcaacctgggcaacccactggccaggaggaacttcggagcctcgtgctagattgggtccacggccgcatcagcaacttccactacctcatgcagctgaatcggttggcaggtcggcggcagggggaccccaactaccaccccgtgctgccctgggtggtggacttcactacgccccatgggcgcttccgagacctgcgcaagtccaagttccgcctcaacaagggggataagcaactggacttcacgtatgagatgacacggcaggcattcgtagcaggcggggcgggcggcggggaaccccctcatgttccccaccacatctcagacgtgctctccgacatcacgtactatgtgtacaaggctcggcgcacgcctcggtcggtgctctgcggacacgtccgcgcgcagtgggagccccatgagtatccggccagcatggagcggatgcagaactggaccccggatgagtgcattccggagttctacaccgatccctctatcttccgctccatccaccccgacatgcctgacctggatgtgccagcctggtgcagctccagccaggagttcgtagctgcccaccgagccctgctggagagccgcgaggtatcccgggacctgcaccattggatcgacctcacgtttggctataaactccagggtaaggaggctgtcaaggaaaagaatgtgtgtctgcacctggtggacgcccacactcacctggccagctacggggtggtgcagctcttcgatcagccacacccccagcgcctggctggggctcctgcccttgcccccgagcctcccctcatccccaagctgttggtccagaccatccaggagaccacaggccgggaggacttcacggaaaacccgggacagcttccaaatggagtgggccggccagttttagaggccactccctgtgaggctagctggaccagagacaggccggtggcaggagaagacgacttggaacaggccacagaagctctggattccatttcccttgctgggaaagcaggtgaccagctgggctcctccagtcaagcgtcccctggacttctctctttctcagtggcctcagcctcccgtccaggccgcaggaataaagctgctggggcagaccctggggagggtgaggaggggaggattcttcttcccgagggcttcaatcccatgcaggccctggaggagctggagaaaacgggcaacttcttggccaaaggcctagggggcctgttggaggtgcctgagcagccccgggtccagccggctgtgccactgcagtgcctactccacagggacatgcaggcgctgggtgtcctattggcagagatggtgtttgccaccagggtgcggacgctgcagcccgatgcacctttgtgggtacgcttccaggctgtccgagggctctgcacgcgccaccccaaggaggtccctgtgtctttgcagcccgtgctggacacactcctgcagatgagtggccccgaagtccccatgggagcagagaggggcaagctggaccaactgtttgagtacaggcctgtctcccagggcctgcccccaccctgcccaagccagcttctcagccccttcagctccgtggttcccttcccaccctacttcccggcactgcacagattcatcctcctgtaccaggcaaggcgtgtggaggacgaggcccaggggcgcgagctggtgtttgctctgtggcagcagctgggcgcggtgctaaaggacatcacccctgagggcctggagatcctgctgcccttcgtgctctcactcatgtccgaggagcacacagctgtgtacacggcctggtatctgtttgagcctgttgccaaggcactgggccccaaaaatgccaataagtacctcctgaagccgctcattggtgcctacgagagcccctgccagctacacggccgcttctacctgtacacggactgctttgtggcccagctgatggtgcggctgggcctgcaggcatttctcactcacctgctgccccatgtcctgcaggtgctggcgggcgcagaggcctcccaggaggagagcaaggacctggcaggggctgctgaggaggagagcgggctgcccggggccgggcctggctcctgtgcttttggggaggagattcccatggatggggagcctcctgcctcctcgggcctggggctcccagactacacgtctggcgtcagcttccacgaccaggctgacctccctgagacagaggacttccaagccgggctctatgtgactgagtctccccagccccaggaggctgaggctgtgagcctgggccggctgagtgacaagagcagcaccagcgagacctccctgggtgaggagcgggctccagacgaggggggtgcccccgtggacaagagcagccttcgatcaggtgacagcagccaggacttgaagcaaagcgagggctccgaggaggaagaggaggaggaggacagctgcgtggtgctagaggaggaggagggggagcaggaggaggtcaccggggcatctgagctcactctgtctgacacggtgctgtccatggagacggttgtggccggcggcagtgggggagatggagaagaagaggaggaggcactgcctgagcagtcagaaggcaaagaacagaagatcctccttgatacagcctgcaagatggtccgctggctgtctgccaagctcggccccacagtggcctctcgccacgtggcccggaacctgctccgcctgctgacgtcttgttatgttggacccactcggcagcagttcacagtgagcagtggcgagagcccaccgctgagcgccggcaacatctaccagaagaggccggtcctgggcgacatcgtgtcagggcctgtgctcagctgcctcctccacatcgcccgcctgtatggggagcctgtcctcacctaccagtacctgccctacatcagctacctggtggccccagggagtgcctcaggccccagccgactgaacagccgtaaggaggcggggctgctggccgcggtgacgctgactcagaagatcatcgtgtacctctcagacaccacactcatggacatcctgccccggatcagccatgaggtcctgctgcccgtgctcagcttcctcacctccctcgtcacggggttcccaagtggggcccaggctcggaccatcctgtgtgtgaaaaccatcagcctcatcgccctcatctgcctgcgcattggacaggagatggtccagcagcacctgagcgagcccgtggccacctttttccaggtcttctctcagctgcatgagcttcggcaacaggatctgaagctggaccctgcgggccgtggtgagggccagctgccacaggtggtcttctctgatgggcagcagcggcccgtggaccccgccctgctggacgagctgcagaaggtgttcaccctggagatggcatacacaatctacgtgcccttctcctgcctgttgggtgacatcatccggaaaatcatccccaaccacgagctggttggggagctggcggcgctgtacttggagagcatcagccccagcagtcgcaaccctgccagcgtggagcccaccatgcccggcaccgggcccgagtgggacccccatggtgggggctgccctcaggatgacggccactcagggacctttgggagcgtcctggtggggaaccgcattcagatccccaatgactctcggcctgagaaccccggaccactgggccccatctcgggggtgggtggcgggggcctgggcagcgggagcgacgacaacgccctgaagcaggagctgccgcggagcgtgcacgggctgagcggaaactggctggcgtactggcagtacgagatcggcgtgagccagcaggatgcccactttcacttccaccagatccgcctgcagagcttcccgggccactcgggggccgtcaagtgcgtggcacccctgagcagcgaggacttcttcctgagcggcagcaaggatcgtaccgtgcgcctctggccgctgtacaactacggcgacgggaccagcgagacggccccacgcctcgtctacacccagcaccgcaagagcgtcttcttcgtgggccagcttgaggccccacagcacgtggtgagctgtgacggggctgtgcacgtctgggaccccttcacagggaagacccttcgcacagtggagccgctggacagccgggtgcccctgactgcggtggctgtcatgcccgccccccacaccagcatcaccatggccagctctgactctaccctgcgctttgtggactgcaggaagcctggtctgcagcacgagttccgactgggcggtgggctgaaccctgggcttgtccgtgccctggccatcagccccagtggccgtagtgtcgtggccggcttctcctcaggcttcatggtgctcctggacacccgcacgggcctggttctgcgaggctggccagcccacgagggggacattctgcagatcaaggcggtggagggcagcgtcctggtcagctcctcctctgaccattccttgaccgtctggaaggagctggagcagaagcccacccatcactacaagtcagcatccgaccccatccacacctttgacctgtacggcagtgaggtggtcactggcaccgtgtccaacaagattggcgtctgctccctgcttgagccaccctcgcaggccaccacgaagctcagctctgagaacttccgcggcacgctcaccagcctggccttgctgcccactaaacgccacctcctgctgggctcagacaacggggttatccgcctcctggcatagactgaggcaggagctggccgggcaagggtgggaagacatctgcgggcgcgtgtccgctcaccctgttccctgagcagcagctccctccagggaggccctgggtcccacgccctgggtgcccacatggcctgccaactagggcctgcaaatggagtgggggagtcctggcccctgaatcaccagagccaccaagcctgccagaggggtctcattcatggcttggggacacagggctcctagcaagcaggaagttaagagcaggaggaagcgttgctaccttcacttctccccagctctgccctctgggtccacatgaggacagggaagctcgggaaggggaagggagactggccctgcccagccggtctctagcccctcagcccccgctgggcactctctgtcccatccctctaggacagggaagctggcctggtccagggcactgatggtgcttggattccagcctaaggaaggctggccgtggtccaggagttaagggcttgggtctggggtttaagtggccacccatccaggccctggccagtgtgggaccgggacgggaaggaagaaggaggctaggagcagggggaaaaggtgcacttggccagtggcgcctgccaggagtgagtccatgcgttgtctgcccacccctaccacagtgtttgtgccttcagctgagggggcagcctctgggccctgaacccctgctggggctccacgaccctgagagaagggttgagaagaatcatctctgcacctcgggtctctgccagaggaagacttaagcatccctgcgacctcacattctagacagagatgaggtccaagggttggcccctgctgccttctcacaatttgcaatagatgtaaataggaccaataaatcctttggaagagccatggggtg

SEQ ID NO: 200007 - DNA, 570 bp, Homo sapiens; identical to SEQ ID NO: 199993
  Payload ID: 19451
  Gene Name: WD repeat domain 81
  ENST ID: ENST00000634001
  CDS Start-End: 54-570

SEQ ID NO: 200008 - DNA, 562 bp, Homo sapiens; identical to SEQ ID NO: 199997
  Payload ID: 19451
  Gene Name: WD repeat domain 81
  ENST ID: ENST00000632643
  CDS Start-End: 50-562

SEQ ID NO: 200009 - DNA, 4293 bp, Homo sapiens
  Payload ID: 19452
  Gene Name: WD repeat domain 82
  Uniprot ID: Q6UXN9
  ENST ID: ENST00000296490
  CDS Start-End: 283-1224
ttctgcctgtcgccccaaaatggcggacacaatgagccggcgacgcgccggttgtccgtgaggtggctgtgaggacgaacggtcggcgaggctccacagtccaggcagaagaccctcgaccaagcaggaagaagaggaggaggcggcccaactgttggccgacttcccgctagccgccggcgcggcgcccgccccgcctgggttggcccctcggcagcccgcccgctcgccgccgggccccgccccggccctgcgccgccgctgccttccccagccgccgccatgaagctgaccgacagcgtgttgcggagcttccgcgtcgctaaggtgttccgcgaaaactcggacaagattaactgcttcgatttcagccccaacggcgagacggtcatctcgagtagcgacgacgactccatcgtgctctatgactgccaggagggcaaaccaaagagaaccctgtacagtaagaaatatggtgtggacctcatcagatacactcatgcagcaaacacagttgtttacagctctaacaaaatagacgatactattcgttacttgtccttgcatgacaacaaatacatcagatactttcctggacatagcaaaagggtggtggccttgtccatgtcacctgtggatgacactttcatttctgggtctcttgataagaccattcgactctgggatctccggtctcctaactgccagggcctcatgcatctgcaggggaagccagtttgttcttttgatccagaagggttaattttcgctgcaggtgtcaactctgaaatggtcaagctttatgaccttcgttcttttgataaggggccatttgctacctttaagatgcagtatgatcgaacttgtgagtggacaggacttaaattcagcaatgatggcaagctcatcctcatttccaccaacggcagcttcattcgtctgattgatgcattcaaaggagtggtgatgcacacatttgggggttatgccaacagcaaagctgtcacactggaggcttcatttactccagactctcagtttattatgattggttcagaggatggcaagatccatgtctggaatggagagagcggtataaaagtagctgtgttggatggtaaacacacaggcccgattacctgtttgcaattcaaccccaagttcatgacttttgccagtgcgtgttccaacatggccttttggttgcccaccattgatgactgaccctgttgctgcttggctatttctgtatagtgagggcggccagcaggaagaaactcagagggaactgagataatagtgggattggatcatttgactgggctggagaacatccttttacatggccttcccatggatgtgctgtacatctgctcaaaagaaaataattactttgatgagcgtcttcaaaaggactcttggtgcaacagactcaattggaactcagcttttctaactgtcactgcaccaagctctgctggaggagtgaccagactcacgatttggtatagtggggctctcaagcatcttcaatttgaatgtacatgctgctgaggagccggtgaagtcatcagttccgcacatcccttctaccctccaactgcatgggaagccaaagtcctggttttgaaatgcttgggcagctcagccgcttgccctcaccctgcatgtcttgttactgggtctccctgtgtacttgtggcattatccacaaccatcatgtttcttaggtgccaaacatttacagaaacattttcatatatcttggggtcagagaaagggacagatacagaaggaccttgcttgcaggaagccatgcagttagtttctgcagttagtcgtgtgaggctaggtggttgggcaggcctcgggctgtaggtgttgggtgggaaaaagacccaagggcctgaaagggagggaaaggggagggtagcgggagggtagcaggtgagttcctagggctggaaggtttagcagcagcctggtgcagtgccctgtcatcaagacaaacccacggtcctcctgggtgcctaccaagcttggtttgtacaaaagcaaggtgggagtctatttttgtacatgagatacatcacacttacctgtgggccagtattgtgaagtgagtctgagttgtttacactgatgccttccctgcccaccacaaattgtgtacatagtcttcagatgataccacccctttccccagctcccaaccaagagctggttctaggcctgtgttatatgtcatatttagcgtttttatatatgacctttgatttctgttgtttgtattttagcacagtgtatgcaccttcatttaaatacatctgtgtgcatacagatacgcatatatgtgtgtgcgtatgcatatatctctcatctgtagtttccaagagttcagctgaagcagatggagtcctgcagcccaggagacaccctgcatccctgctaatagtgtttgccacaagtattagtgagtcttccttattaatattttcatttcagaagactgaagcaaagctgatagtgtttgctgtttctttggcagctaagtgagggtcttgggatgacttgctgtgttcctcaagctgcactttggggccatctctgcagtattagccccctttttgcttggtggtactctgtctgtgcctgtgtgtgtgtgtgatagtcactcttgcatggcttccatgtctggtttgtggcatttggggataaggtgctgaagccagagcatttgcagtttgtttgaggcctcgttgccaatgatagatcactcctgttgacctggtatgtctgcttgcttgctgcttttccttgctttctcttggaagaggaaaggactctggtcaggcccaggctgagtgagatgagctgcagctggctcatggccttcttagagcagagagaggagtatgtcattttactaagttcctaaacaaacatttatgcaggcaacactccttgcagatccagaaactgaggcacaatagggttatgacttgctcaagaatatgtagctgctagggggtaaatcaaggcatcacaatttctgttcagcgggcaggaataggctgtgaattgctagcactttttttttttaagcaattactttttgacttgttcctctgaaagtgcaagaggcgtacacctttcccaaatgtagactagaatctgcaggatgccacccactgtatagttctgctttcccagagaggaagaacttttagaaaccaaatgatcttaattgttattgcccacccctggcttttccgggtagaaaattcacagtaggaatgattgttaagagagagtgcttggaaccatgggttaacaggaaaggctacctaacttcacatatctgcaaccagagcagccaccaagcattacttagcagcaggaaaatgattgtatttgagttcctgtgtgtccaaaactgagcaccatgttctttgaaaacatgccacctcaaggctgggcgcggtggctcacacctgtaatcccagcactttgggaggccgaggcgggcggatcaccggaggtcgggagtttgagaccagcctgaccaacatggagaaaccccatctctactaaaaatacaaaattagccgggcgtggtggcatgcgcctataatctcagctacttgggaggctgaggcaggagaattgcttgaacccaggaggcggaggttgcggtgagttgagatcgtgccattgcactccggcctgggcaacaacagcaaaactccgtctcaaaaaaaaaaaaaaaaaaatgccacctcacagtctctatcgttgggccctgtggttgcaaagctgcctcctgaattaagaaggaaagggaaaagatatagctggaagcgagtggaagagatgctgagggctggggctgcacagacgtgctcagcagggctacaggtgctcaagccctattggggatgggtggggagtggggcagcggcgtttgccaccttaagaattggggccaaagccactgatgtttatttgacagtgacactgcactgggtacttaaagaaattatttcccgttgtaattataattactgcttattaaggaaaatatgggaattttagaaagaatcaagtttgccacccaaatgctaccactgttaatcttttggtgttaaatgttccccctagacatttctgtgcatagatttttggtgtgtttacatagtcgttattctgtatatacaattttatgtcccttttgtacttaacgtataaacattttttccatgttacagtcttaaacagaattttatggctgca

SEQ ID NO: 200010 - DNA, 574 bp, Homo sapiens
  Payload ID: 19452
  Gene Name: WD repeat domain 82
  ENST ID: ENST00000463624
  CDS Start-End: 434-574
aaggtagggccttagcgagggaaatggctgccgcgtaatgcccggtgatgcgagaaagaagggcctgctgccaccaggacccgtcatcgcccagcccagggaccgcttctgaaggccatgcgagccctggcggcgcagacttaccagcccacagctccggccgcggtgcccagcgctggagaacggaaacataattcaagacatttcctgagtgccttctgtgtgggccgaatgctgtagctgctgggatagaccaaagagaaccctgtacagtaagaaatatggtgtggacctcatcagatacactcatgcagcaaacacagttgtttacagctctaacaaaatagacgatactattcgttacttgtccttgcatgacaacaaatacatcagatactttcctggacatagcaaaagggtggtggccttgtccatgtcacctgtggatgacactttcatttctgggtctcttgataagaccattcgactctgggatctccggtctcctaactgccagggcctcatgcatctgcaggggaagccagtttgttcttttgatccagaagggttaatt

SEQ ID NO: 200011 - DNA, 587 bp, Homo sapiens
  Payload ID: 19452
  Gene Name: WD repeat domain 82
  ENST ID: ENST00000469000
  CDS Start-End: 364-587
ctaaggtgttccgcgaaaactcggacaagattaactgcttcgatttcagccccaacggcgagacggtcatctcgagtagcgacgacgactccatcgtgctctatgactgccaggagggcaagtgagtgcggcggaggccctgggcccgagtctcagtgcctccctccggtggcccagcacagaccaaagagaaccctgtacagtaagaaatatggtgtggacctcatcagatacactcatgcagcaaacacagttgtttacagctctaacaaaatagacgatactattcgttacttgtccttgcatgacaacaaatacatcagatactttcctggacatagcaaaagggtggtggccttgtccatgtcacctgtggatgacactttcatttctgggtctcttgataagaccattcgactctgggatctccggtctcctaactgccagggcctcatgcatctgcaggggaagccagtttgttcttttgatccagaagggttaattttcgctgcaggtgtcaactctgaaatggtcaagctttatgaccttcgttcttttgataaggggccatttgctacctttaagat

SEQ ID NO: 200012 - DNA, 775 bp, Homo sapiens
  Payload ID: 19453
  Gene Name: WD repeat domain 83
  ENST ID: ENST00000425834
  CDS Start-End: 1-225
gacaagacgctgaagctgtggaacccgcttcgggggacgctgctgcggacgtacagcggccacggctacgaggtgctggatgcggccggctcctttgacaacagtagtctctgctccggcggcggggacaaggcggtggttctgtgggatgtggcatcagggcaggtcgtgcgcaaattccggggccacgcagggctccgtggatggccgcgtgagacgctatgacctaaggatggggcagctcttctcagactacgtgggcagccccatcacctgcacctgcttcagccgggatgggcagtgcaccctggtgtccagcctggactccacattgcggctcctggacaaagacacaggggagctgctgggcgagtacaagggccataagaaccaggaatacaagctggactgctgcctgagcgagcgtgacacacatgtggtcagctgttctgaggacgggaaggtgttcttctgggacctggtggagggtgcgctggctctggccctgcctgtgggttccggtgtggtgcagtcgctggcctaccacccaacagagccctgcctgctgaccgccatgggaggcagcgtccagtgctggcgagaggaggcctatgaggcagaggatggagcaggctgaagccaggggacccaccaacaggaccaaggaccgagacacagacatggaaggacttcagataccatcttattctagagacgtagctgaccaaaaagtaggggaggggctgggtctgcaaattaataaatagaagagggg

SEQ ID NO: 200013 - DNA, 1457 bp, Homo sapiens
  Payload ID: 19453
  Gene Name: WD repeat domain 83
  Uniprot ID: Q9BRX9
  ENST ID: ENST00000418543
  CDS Start-End: 350-1297
ccagggcgcggtctggaggctcacgggagagaggctgtagccctgggcaatcccgggggtcgttacaggaaggtaggaaaatgccaccctcagggcactggttgggctaaaggtgacactggcgtctcacgggctatgaagacggaatgcctcttaatgccggaattccaagacggaatgcctcttaatgccgggcaagtctcacatgaagctactcatcatttgcttcgtgtcctccgagctccgagagttggcaaagctgatgaaggagcagtagacagcgacccaagcacaccacttcagctagggaaagaccgatttaaggctgcaaggaaggagtcctgggagcatggctttccctgagccaaagccgcggcctccagagctgccgcagaaacggttgaagacgctggactgcgggcagggggcagtgcgagccgtacgatttaatgtggatggcaattactgcctgacgtgcggcagtgacaagacgctgaagctgtggaacccgcttcgggggacgctgctgcggacgtacagcggccacggctacgaggtgctggatgcggccggctcctttgacaacagtagtctctgctccggcggcggggacaaggcggtggttctgtgggatgtggcatcagggcaggtcgtgcgcaaattccggggccacgcagggaaggtgaacacggtgcagtttaatgaagaggccacagttatcctgtccggctctattgattccagtatccgctgttgggattgccgctcacggaggcctgagccagtgcagacgctggatgaggccagagatggcgtgtccagtgtgaaggtgtcagaccacgagatcctggcaggctccgtggatggccgcgtgagacgctatgacctaaggatggggcagctcttctcagactacgtgggcagccccatcacctgcacctgcttcagccgggatgggcagtgcaccctggtgtccagcctggactccacattgcggctcctggacaaagacacaggggagctgctgggcgagtacaagggccataagaaccaggaatacaagctggactgctgcctgagcgagcgtgacacacatgtggtcagctgttctgaggacgggaaggtgttcttctgggacctggtggagggtgcgctggctctggccctgcctgtgggttccggtgtggtgcagtcgctggcctaccacccaacagagccctgcctgctgaccgccatgggaggcagcgtccagtgctggcgagaggaggcctatgaggcagaggatggagcaggctgaagccaggggacccaccaacaggaccaaggaccgagacacagacatggaaggacttcagataccatcttattctagagacgtagctgaccaaaaagtaggggaggggctgggtctgcaaattaataaatagaagagggggtaagaccttcctgggaccgca

SEQ ID NO: 200014 - DNA, 770 bp, Homo sapiens
  Payload ID: 19453
  Gene Name: WD repeat domain 83
  ENST ID: ENST00000547481
  CDS Start-End: 37-498
accgatttaaggctgcaaggaaggagtcctgggagcatggctttccctgagccaaagccgcggcctccagagctgccgcagaaacggttgaagacgctggactgcgggcagggggcagtgcgagccgtacgatttaatgtggatggcaattactgcctgacgtgcggcagtgacaagacgctgaagctgtggaacccgcttcgggggacgctgctgcggacgtacagcggccacggctacgaggtgctggatgcggccggctcctttgacaacagtagtctctgctccggcggcggggacaaggcggtggttctgtgggatgtggcatcagggcaggtcgtgcgcaaattccggggccacgcagggaaggtgaacacggtgcagtttaatgaagaggccacagttatcctgtccgtatccgctgttgggattgccgctcacggaggcctgagccagtgcagacgctggatgaggccagagatggcgtgtccagtgtgaaggtgtcagaccacgagatcctggcaggctccgtggatggccgcgtgagacgctatgacctaaggatggggcagctcttctcagactacgtgggcagccccatcacctgcacctgcttcagccgggatgggcagtgcaccctggtgtccagcctggactccacattgcggctcctggacaaagacacaggggagctgctgggcgagtacaagggccataagaaccaggaatacaagctggactgctgcctgagcgagcgtgacacacatgtg

SEQ ID NO: 200015 - DNA, 1425 bp, Homo sapiens
  Payload ID: 19453
  Gene Name: WD repeat domain 83
  ENST ID: ENST00000548381
  CDS Start-End: 336-551
ggaggctcacgggagagaggctgtagccctgggcaatcccgggggtcgttacaggaaggtaggaaaatgccaccctcagggcactggttgggctaaaggtgacactggcgtctcacgggctatgaagacggaatgcctcttaatgccggaattccaagacggaatgcctcttaatgccgggcaagtctcacatgaagctactcatcatttgcttcgtgtcctccgagctccgagagttggcaaagctgatgaaggagcagtagacagcgacccaagcacaccacttcagctagggaaagaccgatttaaggctgcaaggaaggagtcctgggagcatggctttccctgagccaaagccgcggcctccagagctgccgcagaaacggttgaagacgctggactgcgggcagggggcagtgcgagccgtacgatttaatgtggatggcaattactgcctgacgtgcggcagtgacaagacgctgaagctgtggaacccgcttcgggggacgctgctgcggacgtacagcggccacggctacgagctcctttgacaacagtagtctctgctccggcggcggggacaaggcggtggttctgtgggatgtggcatcagggcaggtcgtgcgcaaattccggggccacgcagggaaggtgaacacggtgcagtttaatgaagaggccacagttatcctgtccggctctattgattccagtatccgctgttgggattgccgctcacggaggcctgagccagtgcagacgctggatgaggccagagatggcgtgtccagtgtgaaggtgtcagaccacgagatcctggcaggctccgtggatggccgcgtgagacgctatgacctaaggatggggcagctcttctcagactacgtgggcagccccatcacctgcacctgcttcagccgggatgggcagtgcaccctggtgtccagcctggactccacattgcggctcctggacaaagacacaggggagctgctgggcgagtacaagggccataagaaccaggaatacaagctggactgctgcctgagcgagcgtgacacacatgtggtcagctgttctgaggacgggaaggtgttcttctgggacctggtggagggtgcgctggctctggccctgcctgtgggttccggtgtggtgcagtcgctggcctaccacccaacagagccctgcctgctgaccgccatgggaggcagcgtccagtgctggcgagaggaggcctatgaggcagaggatggagcaggctgaagccaggggacccaccaacaggaccaaggaccgagacacagacatggaaggacttcagataccatcttattctagagacgtagctgaccaaaaagtaggggaggggctgggtctgcaaattaataaatagaagagggggtaagaccttcctgggaccgc

SEQ ID NO: 200016 - DNA, 632 bp, Homo sapiens
  Payload ID: 19453
  Gene Name: WD repeat domain 83
  ENST ID: ENST00000547797
  CDS Start-End: 1-632
cagggcaggtcgtgcgcaaattccggggccacgcagggaaggtgaacacggtgcagtttaatgaagaggccacagttatcctgtccggctctattgattccagtatccgctgttgggattgccgctcacggaggcctgagccagtgcagacgctggatgaggccagagatggcgtgtccagtgtgaaggtgtcagaccacgagatcctggcaggcagggcgtggtggtgcatgcctgtattcccatctactcgggaggctgaggaaggagaatctcttgaacccgggaggcagaggttccgctccgtggatggccgcgtgagacgctatgacctaaggatggggcagctcttctcagactacgtgggcagccccatcacctgcacctgcttcagccgggatgggcagtgcaccctggtgtccagcctggactccacattgcggctcctggacaaagacacaggggagctgctgggcgagtacaagggccataagaaccaggaatacaagctggactgctgcctgagcgagcgtgacacacatgtggtcagctgttctgaggacgggaaggtgttcttctgggacctggtggagggtgcgctggctctggccctgcctgtgggttccggtgtg

SEQ ID NO: 200017 - DNA, 1039 bp, Homo sapiens
  Payload ID: 19453
  Gene Name: WD repeat domain 83
  ENST ID: ENST00000553179
  CDS Start-End: 320-535
gaggctgtagccctgggcaatcccgggggtcgttacaggaaggtaggaaaatgccaccctcagggcactggttgggctaaaggtgacactggcgtctcacgggctatgaagacggaatgcctcttaatgccggaattccaagacggaatgcctcttaatgccgggcaagtctcacatgaagctactcatcatttgcttcgtgtcctccgagctccgagagttggcaaagctgatgaaggagcagtagacagcgacccaagcacaccacttcagctagggaaagaccgatttaaggctgcaaggaaggagtcctgggagcatggctttccctgagccaaagccgcggcctccagagctgccgcagaaacggttgaagacgctggactgcgggcagggggcagtgcgagccgtacgatttaatgtggatggcaattactgcctgacgtgcggcagtgacaagacgctgaagctgtggaacccgcttcgggggacgctgctgcggacgtacagcggccacggctacgagctcctttgacaacagtagtctctgctccggcggcggggacaaggcggtggttctgtgggatgtggcatcagggcaggtcgtgcgcaaattccggggccacgcagggtcctccaaagtccagcctcctctgagtggcaataactttctcagaaggtgaacacggtgcagtttaatgaagaggccacagttatcctgtccggctctattgattccagtatccgctgttgggattgccgctcacggaggcctgagccagtgcagacgctggatgaggccagagatggcgtgtccagtgtgaaggtgtcagaccacgagatcctggcaggctccgtggatggccgcgtgagacgctatgacctaaggatggggcagctcttctcagactacgtgggcagccccatcacctgcacctgcttcagccgggatgggcagtgcaccctggtgtccagcctggactccacattgcggctcctggacaaagacacaggggagctgctgggcgagtacaagggc

SEQ ID NO: 200018 - DNA, 599 bp, Homo sapiens
  Payload ID: 19454
  Gene Name: WD repeat domain 83 opposite strand
  ENST ID: ENST00000222190
  CDS Start-End: 1-315
atgtccactaacaatatgtcggacccacggaggccgaacaaagtgctgaggtacaagcccccgccgagcgaatgtaacccggccttggacgacccgacgccggactacatgaacctgctgggcatgatcttcagcatgtgcggcctcatgcttaagtggtgtgcttgggtcgctgtctactgctccttcatcagctttgccaactctcggagctcggaggacacgaagcaaatgatgagtagcttcatgctgtccatctctgccgtggtgatgtcctatctgcagaatcctcagcccatgacgcccccatggtgataccagcctagaagggtcacattttggaccctgtctatccactaggcctgggctttggctgctaaacctgctgccttcagctgccatcctggacttccctgaatgaggccgtctcggtgcccccagctggatagagggaacctggccctttcctagggaacaccctaggcttacccctcctgcctcccttcccctgcctgctgctgggggagatgctgtccatgtttctaggggtattcatttgctttctcgttgaaacctgttgttaataaagtttttcactc

SEQ ID NO: 200019 - DNA, 2562 bp, Homo sapiens
  Payload ID: 19454
  Gene Name: WD repeat domain 83 opposite strand
  Uniprot ID: Q9Y284
  ENST ID: ENST00000596731
  CDS Start-End: 1954-2274
tttagaaatcattttatctttttttttttgagatggagtctcactttgtcgcccaggctggagtgcagtggcacaatctcggctcactgcaacctccaactcccgggttcaggcgattctcctgcctccgcctcccgagtggctgggattacaggctcccgtcaccacacctggctaatttttgcatttttagtagagacggggtttcaccatgttggccaggctgatctcaacctcctgacctcaagtgatctgcccaccttggcctcccaaagtgctgggattacaggtgtgagccaccgtgcccggccagattattattattttgtagacagtctgtctttcacccagcatggagtgcaatggtgcctcgaactcttggactcaagtgatccttccacttcagcctcccaagtagctgggattacagctgtgtgccactgtgcccagctgagagtaggttttaatctgagcatgggggcagctatgattccccgtagcacctggggtgagaccaggtcctggctccactcaccctgccaggatctcgtggtctgacaccttcacactggacacgccatctctggcctcatccagcgtctgcactggctcaggcctccgtgagcggcaatcccaacagcggatactggaatcaatagagcctgtgaggccagcatgatggtgaggtcaggtttggagggggagggcagcaccctgggcccccgtgcttaggccccagactcaccggacaggataactgtggcctcttcattaaactgcaccgtgttcaccttctgagaaagttattgccactcagaggaggctggactttggaggactgggataaaggcagggttcccagtgtcggttaaagcaagggcgaaggggaggtgaaaggttttgggggaacagcaaggacaggggttggtgactgcctagcctggcatgcggagtgggggatcgtcatctggggaagggatccttacggtgtaatgggggtggccgtgtcaccacctatgcgctaatacgggtcccctccactcaaatgagggtctccaggctttcactcacccctgcgtggccccggaatttgcgcacgacctgccctgatgccacatcccacagaaccaccgccttgtccccgccgccggagcagagactactgttgtcaaaggagctggagtaaaggaggaggaggatcagcatcgacctcggatcccagcctcagcgctcccatcccagcctggtccccggctcacccggccgcatccagcacctcgtagccgtggccgctgtacgtccgcagcagcgtcccccgaagcgggttccacagcttcagcgtcttgtcactgccgcacgtcaggcagtaattgccatccactggggaacaccaggcgggggttactgggccgtcgatctcaggaggcgggaggaggacccggaatgaagacgaaggcgctcaccattaaatcgtacggctcgcactgccccctgcccgcagtccagcgtcttcaaccgtttctgcggcagctctggaggccgcggctttggctcagggaaagccatgctcccaggactccttccttgcagccttaaatcggtctgtacggaaaattccgcgccttagaaacccacgcttgggtgtaaccttattattgttcttcctgacctacttcctgtttatcacttccgggttcatcattttggcatttcggtgatcgggttggaactattgaagcccgctttcaggttcttttccccattttccctttgaaaggaagacttctggcttctcctaaatctccgttctctgggtaaggggagtccaagcctctgtcatgaggaacggaaatgcgagggcctcgggtgttactctaaaatccgccctcagcttgcacgccggaagctgcgattcctgcagcggaagaggcgtgatctggccttcgactcgctatgtccactaacaatatgtcggacccacggaggccgaacaaagtgctgaggtacaagcccccgccgagcgaatgtaacccggccttggacgacccgacgccggactacatgaacctgctgggcatgatcttcagcatgtgcggcctcatgcttaagctgaagtggtgtgcttgggtcgctgtctactgctccttcatcagctttgccaactctcggagctcggaggacacgaagcaaatgatgagtagcttcatgctgtccatctctgccgtggtgatgtcctatctgcagaatcctcagcccatgacgcccccatggtgataccagcctagaagggtcacattttggaccctgtctatccactaggcctgggctttggctgctaaacctgctgccttcagctgccatcctggacttccctgaatgaggccgtctcggtgcccccagctggatagagggaacctggccctttcctagggaacaccctaggcttacccctcctgcctcccttcccctgcctgctgctgggggagatgctgtccatgtttctaggggtattcatttgctttctcgttgaaacctgttgttaataaagtttttcactctggc

SEQ ID NO: 200020 - DNA, 627 bp, Homo sapiens
  Payload ID: 19454
  Gene Name: WD repeat domain 83 opposite strand
  ENST ID: ENST00000598732
  CDS Start-End: 1-256
gtccactaacaatatgtcggacccacggaggccgaacaaagtgctgaggtacaagcccccgccgagcgaatgtaacccggccttggacgacccgacgccggactacatgaacctgctgggcatgatcttcagcatgtgcggcctcatgcttaagctgaagtggtgtgcttgggtcgctgtctactgctccttcatcagctttgccaactctcggagctcggaggacacgaagcaaatgatgagtagcttcatgtgagacttgccctacagaacaagtgactcttgagtaaggggtggggggaccccagcctggccatcctagactgacacctctctcctgtctcaggctgtccatctctgccgtggtgatgtcctatctgcagaatcctcagcccatgacgcccccatggtgataccagcctagaagggtcacattttggaccctgtctatccactaggcctgggctttggctgctaaacctgctgccttcagctgccatcctggacttccctgaatgaggccgtctcggtgcccccagctggatagagggaacctggccctttcctagggaacaccctaggcttacccctcctgcctcccttcccctgcctgctgctgggggagat

SEQ ID NO: 200021 - DNA, 2023 bp, Homo sapiens
  Payload ID: 19455
  Gene Name: WD repeat domain 86
  Uniprot ID: Q86TI4
  ENST ID: ENST00000334493
  CDS Start-End: 432-1562
cggccggggagggcgcggggcgctcggcttcccgtgttcctctccccgccccagccccgtgggcgcgagaggaggcggggggctccttgtgcaccagagacgcagctgccttgttcgcccggtggggtgtggatcctccgagcggtgctgggaagggggttctctctgcccgcgcgcccaggactctacccagggcggaggtcccgagtgggccgccccccgcagcgccctgggttcgcgggcccagaggctggaggcagcggggagctagggtccttcaccctcccctcgccgcgtgcctccgcaggagtcgggctccccgttccccgcgatggccgcgggccgcagtcgtacggagccgccgcgcggaccccggggcgcccctccctagcggggcgcagctccttcttgttccccgccctgccagcgggatggggggcggcgggtcggccctgagggtctgcgccgaccaccgcgggggcatcaactggctgagcctgagccccgacgggcagcgcctgctgacgggcagcgaggacggcacggcccggctctggagcaccgcggacggccagtgctgcgcgctcctgcaaggacatgaaagctatgtgaccttctgccagctggaggatgaggctgccttcacatgcagcgccgactgcaccatcaggaggtgggacgtgctgaccgggcagtgtctgcaggtgtaccgaggacacacgtccatcgtgaacaggatcctggttgccaacaaccagctcttcagcagctcctatgaccggacagctcgggtctggagtgtggacaaggggcagatgtcccgggagttccggggccaccgcaactgcgtgctgaccctagcctactctgccccgtgggacctccccagcactccctgcgcggaggaggccgcggccggggggcttctggtgaccggcagcacagatggcacagccaaggtgtggcaggtggccagcggctgctgccaccagacgctgcggggccacacgggtgcagtgctgtgcctagtgctagacacgcccggccacacggccttcacaggcagcaccgacgccaccatccgtgcctgggacatcctgagtggggagcagctgcgggtgttccgggagcaccggggctccgtcatctgtctggagctggtgaaccgactcgtgtactctggcagcgcggacaggaccgtcaagtgctggctggcagacacaggggagtgtgtgcgcacgttcacggcccacagacgcaacgtgagcgccctcaagtaccacgcgggcaccttgttcacgggcagcggggacgcttgcgcccgggccttcgacgcgcagtctggagagctgcggagggtgttccggggccacacattcatcatcaactgcatccaggtgcacggccaggtgctctacaccgcctcgcacgacggcgccctgcgcctctgggacgtgcgcgggctccgaggtgccccgcggccccctccgcccatgcgcagcctctcgcggctcttcagcaacaaggtgggctgcgccgccgcgcccctgcagccggcctgatcccgcggggcccctgcagacgccagcccagacacccagcggctcccagagcgccccgccctgctacccgcggtggtggcgcccgatggccggcgaggggcgaggagcgaggaagcccgggcgggaggagagcccgtcgcaggcgtctggtttttctttggtggccaggaggcgctgggagcgggagtgctcgccctggggaccgcccccttttcccttttagggtggctcctgtcctccctccccatccctgacctggcgaaaggcctagtcctggggaccctcccacctcaggggctgcaggcggactgccccagctcccccagccccacgaaactgggcctttcctgctgagaggaagtgactttttacagaagccactgaacctggttattttggcaaatcgtccgtctcgagggccttggggggaactgaaatatacagcctgaacgttaaaagtg

SEQ ID NO: 200022 - DNA, 1428 bp, Homo sapiens
  Payload ID: 19455
  Gene Name: WD repeat domain 86
  Uniprot ID: Q86TI4
  ENST ID: ENST00000477459
  CDS Start-End: 357-1190
ttccccgtccccagcgaagtcggcgccggaactgccctaatggaaaccagccgccgggcgctccgggagggctcaggccgaccccggggtccattagaggcgccccaggccgagggagcccgcggcggctggaaggacatgaaagctatgtgaccttctgccagctggaggatgaggctgccttcacatgcagcgccgactgcaccatcaggaggtgggacgtgctgaccgggcagtgtctgcaggtgtaccgaggacacacgtccatcgtgaacaggatcctggttgccaacaaccagctcttcagcagctcctatgaccggacagctcgggtctggagtgtggacaaggggcagatgtcccgggagttccggggccaccgcaactgcgtgctgaccctagcctactctgccccgtgggacctccccagcactccctgcgcggaggaggccgcggccggggggcttctggtgaccggcagcacagatggcacagccaaggtgtggcaggtggccagcggctgctgccaccagacgctgcggggccacacgggtgcagtgctgtgcctagtgctagacacgcccggccacacggccttcacaggcagcaccgacgccaccatccgtgcctgggacatcctgagtggggagcagctgcgggtgttccgggagcaccggggctccgtcatctgtctggagtgttcacgggcagcggggacgcttgcgcccgggccttcgacgcgcagtctggagagctgcggagggtgttccggggccacacattcatcatcaactgcatccaggtgcacggccaggtgctctacaccgcctcgcacgacggcgccctgcgcctctgggacgtgcgcgggctccgaggtgccccgcggccccctccgcccatgcgcagcctctcgcggctcttcagcaacaaggtgggctgcgccgccgcgcccctgcagccggcctgatcccgcggggcccctgcagacgccagcccagacacccagcggctcccagagcgccccgccctgctacccgcggtggtggcgcccgatggccggcgaggggcgaggagcgaggaagcccgggcgggaggagagcccgtcgcaggcgtctggtttttctttggtggccaggaggcgctgggagcgggagtgctcgccctggggaccgcccccttttcccttttagggtggctcctgtcctccctccccatccctgacctggcgaaaggcctagtcctggggaccctcccacctcaggggctgcaggcggactgccccagctcccccagccccacgaaactgggcctttcctgctgagaggaagtgactttttacagaagccactgaacctggttattttggcaaatcgtccgtctcgagggccttggggggaactgaaatatacagcctgaacgttaaaagtg

SEQ ID NO: 200023 - DNA, 1691 bp, Homo sapiens
  Payload ID: 19455
  Gene Name: WD repeat domain 86
  Uniprot ID: Q86TI4
  ENST ID: ENST00000469830
  CDS Start-End: 43-1491
agcggggcgcagctccttcttgttccccgccctgccagcgggatggggggcggcgggtcggccctgagggtctgcgccgaccaccgcgggggcatcaactggctgagcctgagccccgacgggcagcgcctgctgacgggcagcgaggacggcacggcccggctctggagcaccgcggacggccagtgctgcgcgctcctgcaaggacatgaaagctatgtgaccttctgccagctggaggatgaggctgccttcacatgcagcgccgactgcaccatcaggaggtgggacgtgctgaccgggcagtgtctgcaggtgtaccgaggacacacgtccatcgtgaacaggatcctggttgccaacaaccagctcttcagcagctcctatgaccggacagctcgggtctggagtgtggacaaggggcagatgtcccgggagttccggggccaccgcaactgcgtgctgaccctagcctactctgccccgtgggacctccccagcactccctgcgcggaggaggccgcggccggggggcttctggtgaccggcagcacagatggcacagccaaggtgtggcaggtggccagcggctgctgccaccagacgctgcggggccacacgggtgcagtgctgtgcctagtgctagacacgcccggccacacggccttcacaggcagcaccgacgccaccatccgtgcctgggacatcctgagtggggagcagctgcgggtgttccgggagcaccggggctccgtcatctgtctggagagggagaggtctggggggcttcagagctgccccagctgccgaccttccctgctcctcctcgcagctggtgaaccgactcgtgtactctggcagcgcggacaggaccgtcaagtgctggctggcagacacaggggagtgtgtgcgcacgttcacggcccacagacgcaacgtgagcgccctcaagtaccacgcgggcaccttgttcacgggcagcggggacgcttgcgcccgggccttcgacgcgcagtctggagagctgcggagggtgttccggggccacacattcatcatcaactgcatccaggtgcacggccaggtgctctacaccgcctcgcacgacggcgccctgcgcctctgggacgtgcgcgggctccgaggtgccccgcggccccctccgcccatgcgcagcctctcgcggctcttcagcaacaaggtgggctgcgccgccgcgcccctgcagccggcctgatcccgcggggcccctgcagacgccagcccagacacccagcggctcccagagcgccccgccctgctacccgcggtggtggcgcccgatggccggcgaggggcgaggagcgaggaagcccgggcgggaggagagcccgtcgcaggcgtctggtttttctttggtggccaggaggcgctgggagcgggagtgctcgccctggggaccgcccccttttcccttttagggtggctcctgtcctccctccccatccctgacctggcgaaaggcctagtcctggggaccctcccacctcaggggctgcaggcggactgccccagctcccccagccccacgaaactgggcctttcctgctgagaggaagtgactttttacagaagccactgaacctggttattttggcaaatcgtccgtctcgagggccttggggggaactgaaatatacagcctgaacgtt

SEQ ID NO: 200024 - DNA, 1542 bp, Homo sapiens
  Payload ID: 19455
  Gene Name: WD repeat domain 86
  ENST ID: ENST00000621812
  CDS Start-End: 335-1081
gcgccggaactgccctaatggaaaccagccgccgggcgctccgggagggctcaggccgaccccggggtccattagaggcgccccaggccgagggagcccgcggcggctggaaggacatgaaagctatgtgaccttctgccagctggaggatgaggctgccttcacatgcagcgccgactgcaccatcaggaggtgggacgtgctgaccgggcagtgtctgcaggtgtaccgaggacacacgtccatcgtgaacaggatcctggttgccaacaaccagctcttcagcagctcctatgaccggacagctcgggtctggagtgtggacaaggggcagatgtcccgggagttccggggccaccgcaactgcgtgctgaccctagcctactctgccccgtgggacctccccagcactccctgcgcggaggaggccgcggccggggggcttctggtgaccggcagcacagatggcacagccaaggtgtggcaggtggccagcggctgctgccaccagacgctgcggggccacacgggtgcagtgctgtgcctagtgctagacacgcccggccacacggccttcacaggcagcaccgacgccaccatccgtgcctgggacatcctgagtggggagcagctgcgggtgttccgggagcaccggggctccgtcatctgtctggagctggtgaaccgactcgtgtactctggcagcgcggacaggaccgtcaagtgctggctggcagacacaggggagtgtgtgcgcacgttcacggcccacagacgcaacgtgagcgccctcaagtaccacgcgggcaccttgttcacgggcagcggggacgcttgcgcccgggccttcgacgcgcagtctggagagctgcggagggtgttccggggccacacattcatcatcaactgcatccaggtgcacggccaggtgctctacaccgcctcgcacgacggcgccctgcgcctctgggacgtgcgcgggctccgaggtgccccgcggccccctccgcccatgcgcagcctctcgcggctcttcagcaacaaggtgggctgcgccgccgcgcccctgcagccggcctgatcccgcggggcccctgcagacgccagcccagacacccagcggctcccagagcgccccgccctgctacccgcggtggtggcgcccgatggccggcgaggggcgaggagcgaggaagcccgggcgggaggagagcccgtcgcaggcgtctggtttttctttggtggccaggaggcgctgggagcgggagtgctcgccctggggaccgcccccttttcccttttagggtggctcctgtcctccctccccatccctgacctggcgaaaggcctagtcctggggaccctcccacctcaggggctgcaggcggactgccccagctcccccagccccacgaaactgggcctttcctgctgagaggaagtgactttttacagaagccactgaacctggttattttggcaaatcgtccgtctcgagggccttggggggaactgaaatatacagcctgaacgttaaaagtg

SEQ ID NO: 200025 - DNA, 1905 bp, Homo sapiens
  Payload ID: 19455
  Gene Name: WD repeat domain 86
  Uniprot ID: Q86TI4
  ENST ID: ENST00000628331
  CDS Start-End: 834-1667
accgtattgttccgcgctcggccggggagggcgcggggcgctcggcttcccgtgttcctctccccgccccagccccgtgggcgcgagaggaggcggggggctccttgtgcaccagagacgcagctgccttgttcgcccggtggggtgtggatcctccgagcggtgctgggaagggggttctctctgcccgcgcgcccaggactctacccagggcggaggtcccgagtgggccgccccccgcagcgccctgggttcgcgggcccagaggctggaggcagcggggagctagggtccttcaccctcccctcgccgcgtgcctccgcaggagtcgggctccccgttccccgcgatggccgcgggccgcagtcgtacggagccgccgcgcggaccccggggcgcccctccctagcggggcgcagctccttcttgttccccgccctgccagcgggatggggggcggcgggtcggccctgagggtctgcgccgaccaccgcgggggcatcaactggctgagcctgagccccgacgggcagcgcctgctgacgggcagcgaggacggcacggcccggctctggagcaccgcggacggccagtgctgcgcgctcctgcaaggacatgaaagctatgtgaccttctgccagctggaggatgaggctgccttcacatgcagcgccgactgcaccatcaggaggtgggacgtgctgaccgggcagtgtctgcaggtgtaccgaggacacacgtccatcgtgaacaggatcctggttgccaacaaccagctcttcagcagctcctatgaccggacagctcgggtctggagtgtggacaaggggcagatgtcccgggagttccggggccaccgcaactgcgtgctgaccctagcctactctgccccgtgggacctccccagcactccctgcgcggaggaggccgcggccggggggcttctggtgaccggcagcacagatggcacagccaaggtgtggcaggtggccagcggctgctgccaccagacgctgcggggccacacgggtgcagtgctgtgcctagtgctagacacgcccggccacacggccttcacaggcagcaccgacgccaccatccgtgcctgggacatcctgagtggggagcagctgcgggtgttccgggagcaccggggctccgtcatctgtctggagtgttcacgggcagcggggacgcttgcgcccgggccttcgacgcgcagtctggagagctgcggagggtgttccggggccacacattcatcatcaactgcatccaggtgcacggccaggtgctctacaccgcctcgcacgacggcgccctgcgcctctgggacgtgcgcgggctccgaggtgccccgcggccccctccgcccatgcgcagcctctcgcggctcttcagcaacaaggtgggctgcgccgccgcgcccctgcagccggcctgatcccgcggggcccctgcagacgccagcccagacacccagcggctcccagagcgccccgccctgctacccgcggtggtggcgcccgatggccggcgaggggcgaggagcgaggaagcccgggcgggaggagagcccgtcgcaggcgtctggtttttctttggtggccaggaggcgctgggagcgggagtgctcgccctggggaccgcccccttttcccttttagggtggctcctgtcctccctccccatccctgacctggcgaaaggcctagtcctggggaccctcccacctcaggggctgcaggcggactgccccagctcccccagccccacgaaactgggcctttcctgctgagaggaagtgactttttacagaagccactgaacctggttattttggcaaatcgtccgtctcgagggccttggggggaactgaaatatacagcctgaacgttaaaagtg

SEQ ID NO: 200026 - DNA, 8847 bp, Homo sapiens
  Payload ID: 19456
  Gene Name: WD repeat domain 87
  Uniprot ID: Q6ZQQ6
  ENST ID: ENST00000303868
  CDS Start-End: 226-8847
acgcgcgttcagacccctggcctcgggaagtccgccggctgcggggttgggggccaaccgttctgtgggcggagtcctctcgcaacatccgccaggtagcttcttagttgctgcccctagctctaggagctcctgagtgcacacgccgtacccgtcccttgtcgggaatcctgtcgcaggtttttaagcaacagtcctcaggagggccaagggagtctgacggtgatgtcttcccccaggctcattcccctgtggaaagatttaaaactcctcctaaatgacaccataaataaaagcaagcaaccttcggaagacccaaagaactgcctgattgtgctgagtgaccggtcccaggctgtagcatggatgaagagcaaaactgaggacatggttgagaaaagaacattctccatgactgaacgattgccacccatccagtccatggtccatgcaggctcctttcatatcctcgtggtctactgtggtgacctgatcctgcgactctttggggaccactttcgggcattcaaacccctgggtaaagtgccctgccgcttcaacatcagctgcctctgctatgacccggaaatgaagatgcttctgtctggcatcctgggggcagtggtgacctgggtcattgagctaggtggcacgggcctccaaatagcccacatggtctccatgccaggtgatgagcttgtccaggacatcgtgctgaatggtcccagtggctccctcctggccctgtgtgagacggtggtgagggtccttatgcaccagggcaagggccagctgggagaggtaaagaggttcacgtccaccagcagcggctcctccatcacctgctgcttcacctgttttgatcagggctttctctatgctggaaaccaagctggggaaatccaagtttggagcctccagcagggccatccactccacagtttccaggcccatcaatcaggagtgatctgtatccgcagccgaccagaggcccacaccctgctaacagctggtagtgacagcctaatcaaggagtggaacctgacttcagggagcctgcttcggcggctagagcttggtgaggagctataccggctccagtttattgacagcattactttcttctgccaaactgcccatagtttttccttgcaccgcctgccctgcttctacagcctcttcaatgtctgtggctctgctccccagcagttgcgtcgggtctgctgtggaaataactggttccggatcctgtgtaccactgaggatggcttgttgcgctttgtgtccccagtaacaggggaccttctggttatcacctggcccttctcaatcctggaccaggctgtggattgggcctacgacccaggtaaagaggagctctttgtagcaacaggcagctcagaggttctggtatttgacacaacccgctgcccttgcccagccaagtatctcttaggcacctcaccaaattctcaggactttgtacaatgcctggcttatgggcatttcaacttggggcggggtctagagggactgatattctctgggcaccagagtggtgtgataagagtgctctcccagcacagctgtgctcgattagaaaaattcatgcactttggcgctgtactggcactctccacgctgtctggagggatttttggtggccaaggaaactctctgctctgttcctatggaatggatgactatgtgcacctgtcagaagctgtgcttgatggggtcaaagtacaactgcggcctctcgccagcattctcagcagctgtcacctaacacatctgatactcttgcccaagtctgtgggtgccatcacagagacaaactgcctgcgtctctggaagttccatgattttctgtcctctgggtcacagaatggcttgaaattcatagaaacactgcctctgcacctgtgtgccatcacatcctttgatgtctgcctctccttgagtctttttgtcacaggttctgccgatggctctgttcggatctgggacttccatggcagactcataggcattctggactcatcactgcactttggcccagtctgttttgcaaatgaccggggtgacctgcttgtgacttttaaccagagtctttacctagtgtcctgtttaaaattgcttcccccagccctgctgactcgcctttcctttatgagcatatcagatgaagtactggaagtccctaagcctttcataccaagcttcttcttctcctttgagaccatgtttgtgcccaagtacatctaccctggacaagcgcaacagaaattagtgggtctggagaaacttgtcaacaaccgggccattgcctttgaccattctgtgccacatgtgatagaagaagatgaggaagggagcccagtgttactgcgttcctccatgcattattctttgcaggacatggaagattggatgcaggtgagcaaacgttaccaatgccattatgtgcttcctccccagctacaactgactagctgggatggactcaacccctatcagatattgcgatactactttggtcatgggcgggaatggctttttgcccctgactgctatatccccaattcagtgattcgtgcccgtctttggccagagggcaccccaatatacctacagtgcaacctgcatgcaccccagcgggagctggaatgggacaggtctcaagaattctttttctggcacagcagggtaagagctataagtaatacagaatatccaaagaataaggaggaggatgaacacttcctagaaatgagactttccaaggatgtaacctacagtgtccttacagatggagcaaaccgaagttggctgggaagaaagatgagtgaaataaccattaatagcatgattgagacaatgctcaatattatggtccatgcttccttgctgaagtaccagtgctgtgttggtgcactagggcaaatctttgcctcttaccaggtgtccccagccctacgctctgagacagcccgtcggctactgaatgatacaaccaattccaacccgctgatccgagaactagcttgggaagggctgaagcgtctaggaatgattactcatctttttgccatgcctctggctcaaggattaatggacaaggatgaaagagtgaggatcaagaccctaagcctcatggctgagattggaatccactctaggacctcactcttacagctgacccaaaaacaagagacttttcgggagatgcagcagcagatgatcggggaggaacccctggaccatctactggggatgcgggccacagatctccaaatcctttccactcaagtggagcagagattgaatgaaaacctgaccctgtcacatagagatgaaaagccggctttttctttagatgtctcaatgccttctgaacttaaatcctccctgaaacctcctacagtttctgaagaatctgaagtggccatcaagcccagcaaaggccaaagacgaggccaagcaggggtcaaaaagcatagccaaaaatggttgcggggtctcaagaagacgaaagagagagactctaaacagatgagcacagagccaggcctcttagaggatgaaagtgggactgaggccgcaccaattgagatggaggaagcatccgtctattcccaatggtcttcaagcaccagtgtaataaagctctcaaaagatgttgattctcaagagaaagatatctcgaaggatcacattgcattgaccctgaagaggctgcagaaaatacgtgacaaaagagacaagaaagcaacagctcagaaactcaaaaagaagcacaaaaagaagggaaaagaagccaaagttataaatgaggaaactacacctcctgtaatggaacagccagttactaaaaaggttaaaatccaagggcggggagcctctggaatatctggccgcaggtcaaccgctggagatggctcatcatggagggacgatctatgtcgtcttatggccctgaggatatctggttcccaaacaaaaatgtcagaaaacctaaacgctgagctagtgacatttgctcaggagatgctggtagataggcaccccagctgggaactctttcaggagatctgccccctattgaagaaagaaagtaaggttctgcttgaggaccttgattgggatgtagtcccgccagagaagaaaccaatttttatccaggaaggagcaattagagaggacatgatacaaggtgtgacccaagaggtgatcagacacaaggaagtgatgccaagggaagaagaacaagcacaaaagaaagcaagagacatgctgggcttggaggaaacccaagtgattttgaaaaagggcaagaaagttatttttttagaaccaggtaatgtaaccatgggaaaagaaatatcaaagaaagaagagaagaaaacctttcagaagtcacctaagcaagggaggaaagctgtccagaaggaaagaaaagtaggaaaaataaagagggaaatgaccaaagaagagagggatatgagtgaggaagtggaggaaatggccacactagaggagaaagtggtcaaacaagaaggaaaactggttatgattgagaggacaccatcttggcaggactggaaaaaggcctgggatgagtggaaacaggtccatggtgagacaaggaaatcctggaaggcatggaaggaagaatgggagaagaggcttcttcaggaagaggagaaactacatcaggctggagagaagctatccccggaggaggaaatgcttcaggaggacaagaagctgaaatgggaggagtggaaacaagtctgggaaaatatgttatcatctaagtccaaggagcaacagtacaaggatgaggaagaagtgactttggaggaagaagtgtctcgggagggggaagaaaaagaacagcaggtcacagaagagcagagacacatccaagaagaacacaaatgggccagaatacacaggaaacgagcccgagctgaaaaaaaacgagcccaagaagagaggaaattagcacaagaagaagagaaacttgcacaagaagagagacagttggcccaggaagagagaaaactggcccaggcatacgtgaaaataacccaggatgacagggaaatggcccaggcagagggtaagtttgcccagaaagaggaaacactggcccaaagaggggagaagctaagccaggaggcggagaaattggcccagaaaaggaagaaactggccaagaaatgggagaaagtggctagagaagaagagaaactagcaaagaaaggagggaaactggctgaggtgaaaaacatattggcccagaaagtggaagaactgccccagagggaacaaaatctggactggcaagaaaaggagctggcccaggaattggaggaactggaatgggacatggaagaactgtcttggaaagaagaggaactgaatcaggaagaggggaaactggttgaggaaaagaagaaactggctgaggaagaggaggcattggcctggcaaagggagaaactgtctgaagaagagacaaaactggcccaggaagaagagttgctgatccaggaaaaggagaaactggcccagcacaaggaaaaaatgcctgaggaagaggaaagactgggacggaaaagggagcaattgattgagaagaagatgaaactggcccaaaaaagggaaagatggatcaacagcatggaagaactcacaaagaacaagatgatactgtaccagaagaagaatctggctcaggaaaagaagaatctggcccaggagaaggaaaaattggctcagaggaaagagaacctactctataataaagaaagactcacccacagcaaaaagcaattagtgcaagtaaagaacaaattgggaatgttcaacaagatactggctcaggtagaggagaagctgacacaggaaaaggagactgtgatcaagaagaaggagaaactggctgaaacagagaaaaaattggtccaagtagaggatagtttggccaaaaaacaggagaaattggcccaggaaaaaatgaaattagctctggagaaggcaatggtccaaggaaagaaacggctcagaggagagttggatattgctaaggaagaaaaggcattgaacctggaaatgaaaagactggctgaggagaagatgagactggttgagggaaaagaaacactgtctaagggagagactccagaaacttctagacaaaggaaaatgactcaagttgaacaagaactatttgagagaaaattgtcactagaggagaagatactgctacatgaagacaggatattggccatggaggaaagcgaaattgccaaaggaaaactggaatttactagaggacagagaatatttgtccaggggcaaagaaagttagccaaggcttcaaggaagttgattaaaaaaagggagagcctttccaaggaaccagcaaaactgaacaaaatcttaaaggcacttcaaaaactaaccagggatgaaaggaaactaacacaggaagaaataaaaatgacaaagatgaagagggcactctttgttaaggagcgcaggttgagtatagaacagagtaagctggatatcaaagagtgggatttttctgaaaaacgatcagaactgactaaagatgagaagaaactggctcggaagcagagaaaactggccaacaaaatgagaagaatgataaacaaagaagaaaaaatgactgaggaagagagcaaattggccagaaagcattcagaagtcatactggatgatgaagaggaaggaggaatagaagaagaagaggtaatcccattccttaaacgaaggtggagaaagaggaaagaggccaagagaggtgacaaaccaaaagaaaagttttccagtcaagtggatgaagtggaaagtgaagagcatttttctgaagaaatggaaagcctgttagatgaactagaaaagcaagagagtttgtcttctgaggaggaggaggaaagggaggaagaagaggaaagggaggaggaggaggaaagggaggaggaggaggaaaggaaggaggaggaggaaggggaggagaagcaagtggagaaagaagaggaggagaagaagaagaagaaaaaggaaaagaagaaggaggaggttcaggagaaggaagaagtgtttgaggagaaagaagaaattatgagtgaggaagagacagaaagtttgagtgacgaggaagaggaagaggagagctgctcattggaagaagaggtggacagggaaaaagagatcttaaaaaaagaaaaacaatttaagttacaagaacaaagaagaaagagcctaagaggaagggaaagagtcctttccattttaagaggagttcctcatggcaaaggcagggctataagactaggagttctaaaaagccctttgaagaaactgatgtcaacagctctggagatgaaagagaaaacaccagtgccagtgccggagaaacaaatatcctgggaagataaaaaggccacagtagttgaaatacccaggaaattcttagggacaatggataaagaaagagaagtgatgggaaaatatgaacccatacctccacatgttttgggtacagttttggagtcccaagcacaggacttaaagaccccatttatgtcccacatattaaggaggaccgtggaagctgaggaactccaacacaaaccactaggtgcctggtggaagtggtttttgcagcatccacctctgatgggacagactgaggtacagttacctctctcccaaatcccagctaaggaacaacatgcagacgtaagcctctcagatgtagagtggatccgccatgtcctagaacgaatggaagcgggagaacagctttccagggatggtttccatagactgtgccagctgctcaaagaccttgcctcaaagggaaacttagaatggctgcatctggccaaacatgaagccattgtgtaccgtcacagacaggccctggagtcacaagacacaaggatctcaagtagacagtccatgagtccaaaatacctgaaagtgattcctcctataaaagcaaaggaaaaggagagctggccaaaacctttggctgtccccacacaaaagtccccattagctaccaagaggattccagacccaagggctaaaaattggcatcttctaggagaaccttacagaagtgagagggcacagcagatatccattgctcacaaggagatggaaatgcaatacttttatcctgccaccagagacatttttccaagtgcccatgcctctgtggaaaaacaaaccctggcactgatgtttcaaaaggacttctgggattttaaggataaacgcaggtttcctaaactgcccaagttagagaagaagacacagcccatttctaaaaaaaaggaagagttgcctttgtgggagacatttgtggcactgtaccatgttttgcggatgctgcagcagcgatatccaaaagacagcactgcttggatggaacagttctaccagctcatggacctgtaccaacttaagtcccccagaatccagaagctgcttcaggagctgctaatgagagaggaacctcaaccccaagagatcatctacgaagaggccctaaaagccacagagctagttcccggggaacggctgttctgctgcctgttttgtggcagttctcatactcctagaagtcctcaggagttccagggtgcggtacccctcccatggcagaactgtgtgcgcaccatccttcccgtgggcattgcccggtatgggatcttagaacttgcctggaagagcctgcctgaagctgatcttcatctcaccaaggcactgacacacaccgttgctcccactctctaa

SEQ ID NO: 200027 - DNA, 9009 bp, Homo sapiens
  Payload ID: 19456
  Gene Name: WD repeat domain 87
  ENST ID: ENST00000447313
  CDS Start-End: 162-8900
gtgggcggagtcctctcgcaacatccgccaggtagcttcttagttgctgcccctagctctaggagctcctgagtgcacacgccgtacccgtcccttgtcgggaatcctgtcgcaggtttttaagcaacagtcctcaggagggccaagggagtctgacggtgatgtcttcccccaggctcattcccctgtggaaagatttaaaactcctcctaaatgacaccataaataaaagcaagcaaccttcggaagacccaaagaactgcctgattgtgctgagtgaccggtcccaggtactgttcaaagagtctcgctatcctcaaaatatgccgtgtgtatgctattacttcagtgatgcccacttcttcgcctccctctcttgggtgacatcaaacacaaaagaaatacaagctgtagcatggatgaagagcaaaactgaggacatggttgagaaaagaacattctccatgactgaacgattgccacccatccagtccatggtccatgcaggctcctttcatatcctcgtggtctactgtggtgacctgatcctgcgactctttggggaccactttcgggcattcaaacccctgggtaaagtgccctgccgcttcaacatcagctgcctctgctatgacccggaaatgaagatgcttctgtctggcatcctgggggcagtggtgacctgggtcattgagctaggtggcacgggcctccaaatagcccacatggtctccatgccaggtgatgagcttgtccaggacatcgtgctgaatggtcccagtggctccctcctggccctgtgtgagacggtggtgagggtccttatgcaccagggcaagggccagctgggagaggtaaagaggttcacgtccaccagcagcggctcctccatcacctgctgcttcacctgttttgatcagggctttctctatgctggaaaccaagctggggaaatccaagtttggagcctccagcagggccatccactccacagtttccaggcccatcaatcaggagtgatctgtatccgcagccgaccagaggcccacaccctgctaacagctggtagtgacagcctaatcaaggagtggaacctgacttcagggagcctgcttcggcggctagagcttggtgaggagctataccggctccagtttattgacagcattactttcttctgccaaactgcccatagtttttccttgcaccgcctgccctgcttctacagcctcttcaatgtctgtggctctgctccccagcagttgcgtcgggtctgctgtggaaataactggttccggatcctgtgtaccactgaggatggcttgttgcgctttgtgtccccagtaacaggggaccttctggttatcacctggcccttctcaatcctggaccaggctgtggattgggcctacgacccaggtaaagaggagctctttgtagcaacaggcagctcagaggttctggtatttgacacaacccgctgcccttgcccagccaagtatctcttaggcacctcaccaaattctcaggactttgtacaatgcctggcttatgggcatttcaacttggggcggggtctagagggactgatattctctgggcaccagagtggtgtgataagagtgctctcccagcacagctgtgctcgattagaaaaattcatgcactttggcgctgtactggcactctccacgctgtctggagggatttttggtggccaaggaaactctctgctctgttcctatggaatggatgactatgtgcacctgtcagaagctgtgcttgatggggtcaaagtacaactgcggcctctcgccagcattctcagcagctgtcacctaacacatctgatactcttgcccaagtctgtgggtgccatcacagagacaaactgcctgcgtctctggaagttccatgattttctgtcctctgggtcacagaatggcttgaaattcatagaaacactgcctctgcacctgtgtgccatcacatcctttgatgtctgcctctccttgagtctttttgtcacaggttctgccgatggctctgttcggatctgggacttccatggcagactcataggcattctggactcatcactgcactttggcccagtctgttttgcaaatgaccggggtgacctgcttgtgacttttaaccagagtctttacctagtgtcctgtttaaaattgcttcccccagccctgctgactcgcctttcctttatgagcatatcagatgaagtactggaagtccctaagcctttcataccaagcttcttcttctcctttgagaccatgtttgtgcccaagtacatctaccctggacaagcgcaacagaaattagtgggtctggagaaacttgtcaacaaccgggccattgcctttgaccattctgtgccacatgtgatagaagaagatgaggaagggagcccagtgttactgcgttcctccatgcattattctttgcaggacatggaagattggatgcaggtgagcaaacgttaccaatgccattatgtgcttcctccccagctacaactgactagctgggatggactcaacccctatcagatattgcgatactactttggtcatgggcgggaatggctttttgcccctgactgctatatccccaattcagtgattcgtgcccgtctttggccagagggcaccccaatatacctacagtgcaacctgcatgcaccccagcgggagctggaatgggacaggtctcaagaattctttttctggcacagcagggtaagagctataagtaatacagaatatccaaagaataaggaggaggatgaacacttcctagaaatgagactttccaaggatgtaacctacagtgtccttacagatggagcaaaccgaagttggctgggaagaaagatgagtgaaataaccattaatagcatgattgagacaatgctcaatattatggtccatgcttccttgctgaagtaccagtgctgtgttggtgcactagggcaaatctttgcctcttaccaggtgtccccagccctacgctctgagacagcccgtcggctactgaatgatacaaccaattccaacccgctgatccgagaactagcttgggaagggctgaagcgtctaggaatgattactcatctttttgccatgcctctggctcaaggattaatggacaaggatgaaagagtgaggatcaagaccctaagcctcatggctgagattggaatccactctaggacctcactcttacagctgacccaaaaacaagagacttttcgggagatgcagcagcagatgatcggggaggaacccctggaccatctactggggatgcgggccacagatctccaaatcctttccactcaagtggagcagagattgaatgaaaacctgaccctgtcacatagagatgaaaagccggctttttctttagatgtctcaatgccttctgaacttaaatcctccctgaaacctcctacagtttctgaagaatctgaagtggccatcaagcccagcaaaggccaaagacgaggccaagcaggggtcaaaaagcatagccaaaaatggttgcggggtctcaagaagacgaaagagagagactctaaacagatgagcacagagccaggcctcttagaggatgaaagtgggactgaggccgcaccaattgagatggaggaagcatccgtctattcccaatggtcttcaagcaccagtgtaataaagctctcaaaagatgttgattctcaagagaaagatatctcgaaggatcacattgcattgaccctgaagaggctgcagaaaatacgtgacaaaagagacaagaaagcaacagctcagaaactcaaaaagaagcacaaaaagaagggaaaagaagccaaagttataaatgaggaaactacacctcctgtaatggaacagccagttactaaaaaggttaaaatccaagggcggggagcctctggaatatctggccgcaggtcaaccgctggagatggctcatcatggagggacgatctatgtcgtcttatggccctgaggatatctggttcccaaacaaaaatgtcagaaaacctaaacgctgagctagtgacatttgctcaggagatgctggtagataggcaccccagctgggaactctttcaggagatctgccccctattgaagaaagaaagtaaggttctgcttgaggaccttgattgggatgtagtcccgccagagaagaaaccaatttttatccaggaaggagcaattagagaggacatgatacaaggtgtgacccaagaggtgatcagacacaaggaagtgatgccaagggaagaagaacaagcacaaaagaaagcaagagacatgctgggcttggaggaaacccaagtgattttgaaaaagggcaagaaagttatttttttagaaccaggtaatgtaaccatgggaaaagaaatatcaaagaaagaagagaagaaaacctttcagaagtcacctaagcaagggaggaaagctgtccagaaggaaagaaaagtaggaaaaataaagagggaaatgaccaaagaagagagggatatgagtgaggaagtggaggaaatggccacactagaggagaaagtggtcaaacaagaaggaaaactggttatgattgagaggacaccatcttggcaggactggaaaaaggcctgggatgagtggaaacaggtccatggtgagacaaggaaatcctggaaggcatggaaggaagaatgggagaagaggcttcttcaggaagaggagaaactacatcaggctggagagaagctatccccggaggaggaaatgcttcaggaggacaagaagctgaaatgggaggagtggaaacaagtctgggaaaatatgttatcatctaagtccaaggagcaacagtacaaggatgaggaagaagtgactttggaggaagaagtgtctcgggagggggaagaaaaagaacagcaggtcacagaagagcagagacacatccaagaagaacacaaatgggccagaatacacaggaaacgagcccgagctgaaaaaaaacgagcccaagaagagaggaaattagcacaagaagaagagaaacttgcacaagaagagagacagttggcccaggaagagagaaaactggcccaggcatacgtgaaaataacccaggatgacagggaaatggcccaggcagagggtaagtttgcccagaaagaggaaacactggcccaaagaggggagaagctaagccaggaggcggagaaattggcccagaaaaggaagaaactggccaagaaatgggagaaagtggctagagaagaagagaaactagcaaagaaaggagggaaactggctgaggtgaaaaacatattggcccagaaagtggaagaactgccccagagggaacaaaatctggactggcaagaaaaggagctggcccaggaattggaggaactggaatgggacatggaagaactgtcttggaaagaagaggaactgaatcaggaagaggggaaactggttgaggaaaagaagaaactggctgaggaagaggaggcattggcctggcaaagggagaaactgtctgaagaagagacaaaactggcccaggaagaagagttgctgatccaggaaaaggagaaactggcccagcacaaggaaaaaatgcctgaggaagaggaaagactgggacggaaaagggagcaattgattgagaagaagatgaaactggcccaaaaaagggaaagatggatcaacagcatggaagaactcacaaagaacaagatgatactgtaccagaagaagaatctggctcaggaaaagaagaatctggcccaggagaaggaaaaattggctcagaggaaagagaacctactctataataaagaaagactcacccacagcaaaaagcaattagtgcaagtaaagaacaaattgggaatgttcaacaagatactggctcaggtagaggagaagctgacacaggaaaaggagactgtgatcaagaagaaggagaaactggctgaaacagagaaaaaattggtccaagtagaggatagtttggccaaaaaacaggagaaattggcccaggaaaaaatgaaattagctctggagaaggcaatggtccaaggaaagaaacggctcagaggagagttggatattgctaaggaagaaaaggcattgaacctggaaatgaaaagactggctgaggagaagatgagactggttgagggaaaagaaacactgtctaagggagagactccagaaacttctagacaaaggaaaatgactcaagttgaacaagaactatttgagagaaaattgtcactagaggagaagatactgctacatgaagacaggatattggccatggaggaaagcgaaattgccaaaggaaaactggaatttactagaggacagagaatatttgtccaggggcaaagaaagttagccaaggcttcaaggaagttgattaaaaaaagggagagcctttccaaggaaccagcaaaactgaacaaaatcttaaaggcacttcaaaaactaaccagggatgaaaggaaactaacacaggaagaaataaaaatgacaaagatgaagagggcactctttgttaaggagcgcaggttgagtatagaacagagtaagctggatatcaaagagtgggatttttctgaaaaacgatcagaactgactaaagatgagaagaaactggctcggaagcagagaaaactggccaacaaaatgagaagaatgataaacaaagaagaaaaaatgactgaggaagagagcaaattggccagaaagcattcagaagtcatactggatgatgaagaggaaggaggaatagaagaagaagaggtaatcccattccttaaacgaaggtggagaaagaggaaagaggccaagagaggtgacaaaccaaaagaaaagttttccagtcaagtggatgaagtggaaagtgaagagcatttttctgaagaaatggaaagcctgttagatgaactagaaaagcaagagagtttgtcttctgaggaggaggaggaaagggaggaagaagaggaaagggaggaggaggaggaaagggaggaggaggaggaaaggaaggaggaggaggaaggggaggagaagcaagtggagaaagaagaggaggagaagaagaagaagaaaaaggaaaagaagaaggaggaggttcaggagaaggaagaagtgtttgaggagaaagaagaaattatgagtgaggaagagacagaaagtttgagtgacgaggaagaggaagaggagagctgctcattggaagaagaggtggacagggaaaaagagatcttaaaaaaagaaaaacaatttaagttacaagaacaaagaagaaagagcctaagaggaagggaaagagtcctttccattttaagaggagttcctcatggcaaaggcagggctataagactaggagttctaaaaagccctttgaagaaactgatgtcaacagctctggagatgaaagagaaaacaccagtgccagtgccggagaaacaaatatcctgggaagataaaaaggccacagtagttgaaatacccaggaaattcttagggacaatggataaagaaagagaagtgatgggaaaatatgaacccatacctccacatgttttgggtacagttttggagtcccaagcacaggacttaaagaccccatttatgtcccacatattaaggaggaccgtggaagctgaggaactccaacacaaaccactaggtgcctggtggaagtggtttttgcagcatccacctctgatgggacagactgaggtacagttacctctctcccaaatcccagctaaggaacaacatgcagacgtaagcctctcagatgtagagtggatccgccatgtcctagaacgaatggaagcgggagaacagctttccagggatggtttccatagactgtgccagctgctcaaagaccttgcctcaaagggaaacttagaatggctgcatctggccaaacatgaagccattgtgtaccgtcacagacaggccctggagtcacaagacacaaggatctcaagtagacagtccatgagtccaaaatacctgaaagtgattcctcctataaaagcaaaggaaaaggagagctggccaaaacctttggctgtccccacacaaaagtccccattagctaccaagaggattccagacccaagggctaaaaattggcatcttctaggagaaccttacagaagtgagagggcacagcagatatccattgctcacaaggagatggaaatgcaatacttttatcctgccaccagagacatttttccaagtgcccatgcctctgtggaaaaacaaaccctggcactgatgtttcaaaaggacttctgggattttaaggataaacgcaggtttcctaaactgcccaagttagagaagaagacacagcccatttctaaaaaaaaggaagagttgcctttgtgggagacatttgtggcactgtaccatgttttgcggatgctgcagcagcgatatccaaaagacagcactgcttggatggaacagttctaccagctcatggacctgtaccaacttaagtcccccagaatccagaagctgcttcaggagctgctaatgagagaggaacctcaaccccaagagatcatctacgaagaggccctaaaagccacagagctagttcccggggaacggctgttctgctgcctgttttgtggcagttctcatactcctagaagtcctcaggagttccagggtgcggtacccctcccatggcagaactgtgtgcgcaccatccttcccgtgggcattgcccggtatgggatcttagaacttgcctggaagagcctgcctgaagctgatcttcatctcaccaaggcactgacacacaccgttgctcccactctctaatttgggactgactggaggctgggacttttcattgccaactggagaaaggcctaattaccaggatctagaccttcatctctctctctctcttttttttttttttgagacg

SEQ ID NO: 200028 - DNA, 3788 bp, Homo sapiens
  Payload ID: 19456
  Gene Name: WD repeat domain 87
  ENST ID: ENST00000620076
  CDS Start-End: 726-2765
gtgggcggagtcctctcgcaacatccgccaggtagcttcttagttgctgcccctagctctaggagctcctgagtgcacacgccgtacccgtcccttgtcgggaatcctgtcgcaggtttttaagcaacagtcctcaggagggccaagggagtctgacggtgatgtcttcccccaggctcattcccctgtggaaagatttaaaactcctcctaaatgacaccataaataaaagcaagcaaccttcggaagacccaaagaactgcctgattgtgctgagtgaccggtcccaggtactgttcaaagagtctcgctatcctcaaaatatgccgtgtgtatgctattacttcagtgatgcccacttcttcgcctccctctcttgggtgacatcaaacacaaaagaaatacaagctgtagcatggatgaagagcaaaactgaggacatggttgagaaaagaacattctccatgactgaacgattgccacccatccagtccatggtccatgcaggctcctttcatatcctcgtggtctactgtggtgacctgatcctgcgactctttggggaccactttcgggcattcaaacccctgggtaaagtgccctgccgcttcaacatcagctgcctctgctatgacccggaaatgaagatgcttctgtctggcatcctgggggcagtggtgacctgggtcattgagctaggtggcacgggcctccaaatagcccacatggtctccatgccaggtgatgagcttgtccaggacatcgtgctgaatggtcccagtggctccctcctggccctgtgtgagacggtggtgagggtccttatgcaccagggcaagggccagctgggagaggtaaagaggttcacgtccaccagcagcggctcctccatcacctgctgcttcacctgttttgatcagggctttctctatgctggaaaccaagctggggaaatccaagtttggagcctccagcagggccatccactccacagtttccaggcccatcaatcaggagtgatctgtatccgcagccgaccagaggcccacaccctgctaacagctggtagtgacagcctaatcaaggagtggaacctgacttcagggagcctgcttcggcggctagagcttggtgaggagctataccggctccagtttattgacagcattactttcttctgccaaactgcccatagtttttccttgcaccgcctgccctgcttctacagcctcttcaatgtctgtggctctgctccccagcagttgcgtcgggtctgctgtggaaataactggttccggatcctgtgtaccactgaggatggcttgttgcgctttgtgtccccagtaacaggggaccttctggttatcacctggcccttctcaatcctggaccaggctgtggattgggcctacgacccaggtaaagaggagctctttgtagcaacaggcagctcagaggttctggtatttgacacaacccgctgcccttgcccagccaagtatctcttaggcacctcaccaaattctcaggactttgtacaatgcctggcttatgggcatttcaacttggggcggggtctagagggactgatattctctgggcaccagagtggtgtgataagagtgctctcccagcacagctgtgctcgattagaaaaattcatgcactttggcgctgtactggcactctccacgctgtctggagggatttttggtggccaaggaaactctctgctctgttcctatggaatggatgactatgtgcacctgtcagaagctgtgcttgatggggtcaaagtacaactgcggcctctcgccagcattctcagcagctgtcacctaacacatctgatactcttgcccaagtctgtgggtgccatcacagagacaaactgcctgcgtctctggaagttccatgattttctgtcctctgggtcacagaatggcttgaaattcatagaaacactgcctctgcacctgtgtgccatcacatcctttgatgtctgcctctccttgagtctttttgtcacaggttctgccgatggctctgttcggatctgggacttccatggcagactcataggcattctggactcatcactgcactttggcccagtctgttttgcaaatgaccggggtgacctgcttgtgacttttaaccagagtctttacctagtgtcctgtttaaaattgcttcccccagccctgctgactcgcctttcctttatgagcatatcagatgaagtactggaagtccctaagcctttcataccaagcttcttcttctcctttgagaccatgtttgtgcccaagtacatctaccctggacaagcgcaacagaaattagtgggtctggagaaacttgtcaacaaccgggccattgcctttgaccattctgtgccacatgtgatagaagaagatgaggaagggagcccagtgttactgcgttcctccatgcattattctttgcaggacatggaagattggatgcaggtgagcaaacgttaccaatgccattatgtgcttcctccccagctacaactgactagctgggatggactcaacccctatcagatattgcgatactactttggtcatgggcgggaatggctttttgcccctgactgctatatccccaattcagtgattcgtgcccgtctttggccagagggcaccccaatatacctacagtgcaacctgcatgcaccccagcgggagctggaatgggacaggtctcaaaattctttttctggcacagcagggtaagagctataagtaatacagaatatccaaagaataaggaggaggatgaacacttcctagaaatgagactttccaaggatgtaacctacagtgtccttacagatggagcaaaccgaagttggctgggaagaaagatgagtgaaataaccattaatagcatgattgagacaatgctcaatattatggtccatgcttccttgctgaagtaccagtgctgtgttggtgcactagggcaaatctttgcctcttaccaggtgtccccagccctacgctctgagacagcccgtcggctactgaatgatacaaccaattccaacccgctgatccgagaactagcttgggaagggctgaagcgtctaggaatgattactcatctttttgccatgcctctggctcaaggattaatggacaaggatgaaagagtgaggatcaagaccctaagcctcatggctgagattggaatccactctaggacctcactcttacagctgacccaaaaacaagagacttttcgggagatgcagcagcagatgatcggggaggaacccctggaccatctactggggatgcgggccacagatctccaaatcctttccactcaagtggagcagagattgaatgaaaacctgaccctgtcacatagagatgaaaagccggctttttctttagatgtctcaatgccttctgaacttaaatcctccctgaaacctcctacagtttctgaagaatctgaagtggccatcaagcccagcaaaggccaaagacgaggccaagcaggggtcaaaaagcatagccaaaaatggttgcggggtctcaagaagacgaaagagagagactctaaacagatgagcacagagccaggcctcttagaggatgaaagtgggactgaggccgcaccaattgagatggaggaagcatccgtctattcccaatggtcttcaagcaccagtgtaataaagctctcaaaagatgttgattctcaagagaaagatatctcgaaggatcacattgcattgaccctgaaga

SEQ ID NO: 200029 - DNA, 1718 bp, Homo sapiens
  Payload ID: 19457
  Gene Name: WD repeat domain 88
  Uniprot ID: Q6ZMY6
  ENST ID: ENST00000355868
  CDS Start-End: 77-1495
gggcgcgggcgcgggcgcgcggcgccaccgttcccatccaggcttgtcggcggccaccggcggaccgggcttcgagatggcctccccgccgcggtgctccccgacagcccatgacagggaatgcaagttgccgccaccctccgcccccgccagcgagtattgtcccggcaagctgtcctgggggaccatggcgagggccttaggccgcttcaagctgtcgatcccgcacacgcacctgctggccaccctcgaccccctggccttggacagggaaccaccaccgcatctgttgcctgagaagcaccaggtgccggagaaattgatctggggcgaccaggaccctctctccaagatcccatttaaaattctgagtgggcacgagcacgctgtgagcacctgccacttctgtgtggatgacacaaagctcctcagtggctcctatgactgcactgtgaagctgtgggatccggtggacggttctgtggttcgcgattttgagcacaggcccaaagctcctgttgtagagtgcagcatcaccggcgacagcagcagagtcattgccgcatcctatgataagacagtgagggcctgggacctggagacaggcaagctgctgtggaaggtcaggtatgataccttcatcgtctcctgtaagttttctcctgatggtaaatacgtggtctcaggcttcgacgtggatcatggaatctgcataatggacgccgagaacatcaccaccgtttccgtcatcaaagatcatcacacaaggtccatcacgtcatgctgctttgaccccgacagccagagggtggcttctgtctcattggacaggtgcatcaagatctgggatgttacatcccaggccacgctgctcaccatcactaaggcacattccaatgcaatctcaaactgctgttttaccttcagtggccatttcctgtgtacaagctcctgggataaaaacttaaaaatatggaacgtccacacaggggagtttcgaaactgtggagcctgtgtgactctgatgcagggccatgaaggttctgtcagttcctgtcactttgccagagacagctcttttctcatttctggagggtttgataggactgtggctatttgggatgtagcagaaggctaccggaagctctctttgaagggccataatgactgggtgatggatgttgccattagcaacaacaagaaatggatcctgtctgcttccaaggataggaccatgagactgtggaatattgaagaaattgatgaaattcctttggtaatcaagtacaaaaaggccgtgggcttaaagttgaaacagtgcgaaagatgtgacaggcctttctccatcttcaagagtgacacctcttctgaaatgttcacccaatgcgtgttctgccggatagatacaaggggcttgccagcagatacttcatcgtcatcatcatcatcggaaagggagaactcaccgccgccaaggggaagcaaggatgactgacagccacaggcccctttgagtgactccagcacaggctacctagcatgtaggtttcggggctttgcaggggctttctcttgggcccctcccaggctcagcaggcctgtcagactggggcaggacccaagccctggctggactcagcacagtgccacctcctcagctctcagcttggggagtgaacactttccgttttcatgcagaataaatctaattcctttgg

SEQ ID NO: 200030 - DNA, 1835 bp, Homo sapiens
  Payload ID: 19457
  Gene Name: WD repeat domain 88
  Uniprot ID: Q6ZMY6
  ENST ID: ENST00000361680
  CDS Start-End: 79-1359
gcgggcgcgggcgcgggcgcgcggcgccaccgttcccatccaggcttgtcggcggccaccggcggaccgggcttcgagatggcctccccgccgcggtgctccccgacagcccatgacagggaatgcaagttgccgccaccctccgcccccgccagcgagtattgtcccggcaagctgtcctgggggaccatggcgagggccttaggccgcttcaagctgtcgatcccgcacacgcacctgctggccaccctcgaccccctggccttggacagggaaccaccaccgcatctgttgcctgagaagcaccaggtgccggagaaattgatctggggcgaccaggaccctctctccaagatcccatttaaaattctgagtgggcacgagcacgctgtgagcacctgccacttctgtgtggatgacacaaagctcctcagtggctcctatgactgcactgtgaagctgtgggatccggtggacggttctgtggttcgcgattttgagcacaggcccaaagctcctgttgtagagtgcagcatcaccggcgacagcagcagagtcattgccgcatcctatgataagacagtgagggcctgggacctggagacaggcaagctgctgtggaaggtcaggtatgataccttcatcgtctcctgtaagttttctcctgatggtaaatacgtggtctcaggcttcgacgtggatcatggaatctgcataatggacgccgagaacatcaccaccgtttccgtcatcaaagatcatcacacaaggtccatcacgtcatgctgctttgaccccgacagccagagggtggcttctgtctcattggacaggtgcatcaagatctgggatgttacatcccaggccacgctgctcaccatcactaaggcacattccaatgcaatctcaaactgctgttttaccttcagtggccatttcctgtgtacaagctcctgggataaaaacttaaaaatatggaacgtccacacaggggagtttcgaaactgtggagcctgtgtgactctgatgcagggccatgaaggttctgtcagttcctgtcactttgccagagacagctcttttctcatttctggagggtttgataggactgtggctatttgggatgtagcagaaggctaccggaagctctctttgaagggccataatgactgggtgatggatgttgccattagcaacaacaagaaatggatcctgtctgcttccaaggataggaccatgagactgtggaatattgaagaaattgatgaaattcctttggtaatcaagtacaaaaaggccgtgggcttaaagttgaaacaggaaaagaaagaggcctacctgaagctgaagcaaggatgagcctgctgcatttgacttgctctgaatcaatcaacatgagaagcctgaggccaggcttccccgaggcctgccccagtgcgaaagatgtgacaggcctttctccatcttcaagagtgacacctcttctgaaatgttcacccaatgcgtgttctgccggatagatacaaggggcttgccagcagatacttcatcgtcatcatcatcatcggaaagggagaactcaccgccgccaaggggaagcaaggatgactgacagccacaggcccctttgagtgactccagcacaggctacctagcatgtaggtttcggggctttgcaggggctttctcttgggcccctcccaggctcagcaggcctgtcagactggggcaggacccaagccctggctggactcagcacagtgccacctcctcagctctcagcttggggagtgaacactttccgttttcatgcagaataaatctaattcctttgg

SEQ ID NO: 200031 - DNA, 651 bp, Homo sapiens
  Payload ID: 19457
  Gene Name: WD repeat domain 88
  ENST ID: ENST00000592765
  CDS Start-End: 81-575
gtgcgggcgcgggcgcgggcgcgcggcgccaccgttcccatccaggcttgtcggcggccaccggcggaccgggcttcgagatggcctccccgccgcggtgctccccgacagcccatgacagggaatgcaagttgccgccaccctccgcccccgccagcgagtattgtcccggcaagctgtcctgggggaccatggcgagggccttaggccgcttcaagctgtcgatcccgcacacgcacctgctggccaccctcgaccccctggccttggacagggaaccaccaccgcatctgttgcctgagaagcaccaggtgccggagaaattgatctggggcgaccaggaccctctctccaagatcccatttaaaattctgagtgggcacgagcacgctgtgagcacctgccacttctgtgtggatgacacaaagctcctcagtggctcctatgactgcactgtgaagctgtgggatccggtggacggttctgtggttcgcgattttgagcacaggcccaaagctcctgttgtagagtgcagcatcaccggcgacagcagcagtcattgccgcatcctatgataagacagtgagggcctgggacctggagacaggcaagctgctgtggaaggtcaggtatgataccttcatcgtctcc

SEQ ID NO: 200032 - DNA, 1687 bp, Homo sapiens
  Payload ID: 19458
  Gene Name: WD repeat domain 89
  Uniprot ID: Q96FK6
  ENST ID: ENST00000267522
  CDS Start-End: 247-1410
gccagaaagcagattttcacttgggaagagacgacccgtagtatgggatgtggtatgataccagcaactggtctattatatcatttaaaccacatggctatctaaagaggtatttggctattataaataaaatagtgatgaacacgtgtacaggtgtttgtacggacataagttgtcatttctcttgagtaaatacctaaaagtgggcttgctggagttttactacccttggatgctgctgttgacatggaaaagattgaggaacaatttgctaatctgcacattgttaaatgttccttaggaaccaaagagcccacttaccttcttggtatagacacatcaaagactgtccaagcaggaaaggaaaacttggttgctgttttatgttctaatggatcaatcagaatatatgataaagaaaggttaaatgtactacgagaatttagtggatatcctggacttcttaatggagtcagatttgcaaattcctgtgacagtgtatattcagcatgtactgatggcactgtgaaatgctgggatgctcgagtagccagagaaaaacctgttcagctcttcaagggttacccttccaatatttttatcagttttgatattaattgtaatgatcatattatttgtgctggtacagaaaaagttgatgatgatgcattgttggtgttttgggatgcaaggatgaattctcagaatttatctacaactaaagactcacttggtgcatattcagagacacatagtgatgatgtcactcaagtacgtttccatcccagcaatcccaacatggtagtctcaggttcatctgatggcctggtaaatgtatttgatattaatattgataatgaggaggatgcactggttacaacctgtaactcaatttcatcagtaagctgtattggttggtctgggaaaggttataaacagatttactgcatgacacatgatgaaggattttattggtgggatcttaatcatctggacactgatgaaccagttacacgtttgaacatccaggatgtcagagaagtagttaacatgaaagaagatgctttggactatttgattggtggcctatatcatgaaaagacagacacattgcatgttattggaggaacaaacaaaggaaggattcatttgatgaactgcagcatgtcaggactgacccatgtgactagccttcagggagggcatgctgctacagtccgttctttctgttggaatgtgcaagatgattctttgttgactggaggagaagatgcacagttgttactttggaaacctggagctatagagaagacctttacaaagaaagagagtatgaaaatagcatcctctgtgcaccaacgagtacgagttcatagtaatgattcttataaaagaaggaaaaagcagtgataatgcatttggcactttgtttggtaggttttatagtttcaaatagtccttcttgtttactacccatggtagacatgtttaaagctttatgtaaaaacaagccagttagcaaacagtcctggaaaaatatggtgagaatggtttaattccggtcttcacatattctaaaaaattttaaagcctctaagtataaaatcagtgagttgaaagtaaaatttcttatttaaagaacccatctgttaatgtagtaaatgttggctttaaagaaatagctccg

SEQ ID NO: 200033 - DNA, 2993 bp, Homo sapiens
  Payload ID: 19458
  Gene Name: WD repeat domain 89
  Uniprot ID: Q96FK6
  ENST ID: ENST00000394942
  CDS Start-End: 90-1253
accgctctaagccgccgcgcagcctgcgttttctccggtacaggttgaggctactaagagttttactacccttggatgctgctgttgacatggaaaagattgaggaacaatttgctaatctgcacattgttaaatgttccttaggaaccaaagagcccacttaccttcttggtatagacacatcaaagactgtccaagcaggaaaggaaaacttggttgctgttttatgttctaatggatcaatcagaatatatgataaagaaaggttaaatgtactacgagaatttagtggatatcctggacttcttaatggagtcagatttgcaaattcctgtgacagtgtatattcagcatgtactgatggcactgtgaaatgctgggatgctcgagtagccagagaaaaacctgttcagctcttcaagggttacccttccaatatttttatcagttttgatattaattgtaatgatcatattatttgtgctggtacagaaaaagttgatgatgatgcattgttggtgttttgggatgcaaggatgaattctcagaatttatctacaactaaagactcacttggtgcatattcagagacacatagtgatgatgtcactcaagtacgtttccatcccagcaatcccaacatggtagtctcaggttcatctgatggcctggtaaatgtatttgatattaatattgataatgaggaggatgcactggttacaacctgtaactcaatttcatcagtaagctgtattggttggtctgggaaaggttataaacagatttactgcatgacacatgatgaaggattttattggtgggatcttaatcatctggacactgatgaaccagttacacgtttgaacatccaggatgtcagagaagtagttaacatgaaagaagatgctttggactatttgattggtggcctatatcatgaaaagacagacacattgcatgttattggaggaacaaacaaaggaaggattcatttgatgaactgcagcatgtcaggactgacccatgtgactagccttcagggagggcatgctgctacagtccgttctttctgttggaatgtgcaagatgattctttgttgactggaggagaagatgcacagttgttactttggaaacctggagctatagagaagacctttacaaagaaagagagtatgaaaatagcatcctctgtgcaccaacgagtacgagttcatagtaatgattcttataaaagaaggaaaaagcagtgataatgcatttggcactttgtttggtaggttttatagtttcaaatagtccttcttgtttactacccatggtagacatgtttaaagctttatgtaaaaacaagccagttagcaaacagtcctggaaaaatatggtgagaatggtttaattccggtcttcacatattctaaaaaattttaaagcctctaagtataaaatcagtgagttgaaagtaaaatttcttatttaaagaacccatctgttaatgtagtaaatgttggctttaaagaaatagctccgataaggactttttagaaggaaatacttggtaaaacttaataaaacaggtggttggctgcattttttaagcccagttttttacattttaaattgtctttattgtgtataaaaccagattagactatattcttcatctgaggagcatctatatgtttaatacacctaatgtattatgctggagtatttaaatgtaagtattttaatgagtaaatagaattaaccttttttacaaatgaaatgataggcatctatgtaaagtgagaaaaatatgtttcgtaaatatttgcatctttaatattgttagtaagtagtaaacaggtgttttgctgattgaaaggaagttatcttggtaaattgagactcaaagtgaaatacaaaaatgaaaatatttataataggactcgacttggagaaattgctattcttcctgttgtccaaaccataaatctgaggataacctgggcttttctctttcctcttctcctaaccagtttttcaccaagtcctgtgccatttcacctcctaacgtctgtcagctatccttttgcctttacctcaccactattaccctagagaagactttcattatttctcatctggattaccagctcgatctctaatctgcttcagttcatccttcttgctacttctaggctaaacatcaaaaacagatctggtaggggcggggaaatgagggggaagaaacaaaaacgtgatggtgcctcatgctgcttaaaatcttcagtacattgatgttttgatggcggactacataagcgttaaaaattgtgtttttcagaatctttaaaatataagacagtgctatctagtgaataaaaaaattagtttgaaagatatctggagaaatcgcattcataaaacaattggaagtgaaactattaaaacaatagggctttttaaaattaaaaatatttaaaattcaaaagtaattaatagtgttggaagatgtaggtgagaaaatattcctgaaagtagaactgaaagagacaaagagaaaagatgaaagccacagaagataaatacaggggtcaaaaccagactaacagttttagaaagtgaaaaaagttaaaaaagaaatgggggcagtgggttattagaaataacataaatggctggtatggtttgtctgtgtcctcacccaaatttcatctcgaattgtaatccccataatccccatgtgtctagggagagacctggtgggaggtgattggatcatgggggtggtttcccctacgatgttctcctgatagtgggtgagttctcacaagatctgatggttttataaagggctctgcccctttaactcctcactctttctcctgaagccttgtgaagaaggtgctttgcttcccctttgcgttcccccatgattgtaagtttcttgaggcctccctggccatgctgaactcttcagtcaattaaacactttcctttataaatta

SEQ ID NO: 200034 - DNA, 976 bp, Homo sapiens
  Payload ID: 19458
  Gene Name: WD repeat domain 89
  ENST ID: ENST00000554717
  CDS Start-End: 297-976
aagccgccgcgcagcctgcgttttctccggtacaggttgaggctactaaggccagaaagcagattttcacttgggaagagacgacccgtagtatgggatgtggtatgataccagcaactggtctattatatcatttaaaccacatggctatctaaagaggtatttggctattataaataaaatagtgatgaacacgtgtacaggtgtttgtacggacataagttgtcatttctcttgagtaaatacctaaaagtgggcttgctggagttttactacccttggatgctgctgttgacatggaaaagattgaggaacaatttgctaatctgcacattgttaaatgttccttaggaaccaaagagcccacttaccttcttggtatagacacatcaaagactgtccaagcaggaaaggaaaacttggttgctgttttatgttctaatggatcaatcagaatatatgataaagaaaggttaaatgtactacgagaatttagtggatatcctggacttcttaatggagtcagatttgcaaattcctgtgacagtgtatattcagcatgtactgatggcactgtgaaatgctgggatgctcgagtagccagagaaaaacctgttcagctcttcaagggttacccttccaatatttttatcagttttgatattaattgtaatgatcatattatttgtgctggtacagaaaaagttgatgatgatgcattgttggtgttttgggatgcaaggatgaattctcagaatttatctacaactaaagactcacttggtgcatattcagagacacatagtgatgatgtcactcaagtacgtttccatcccagcaatcccaacatggtagtctcaggttcatctgatggcctggtaaatgtatttgatattaatattgataatgaggaggatgcactggttacaacctgtaactcaatttcatcagtaagctgtattggttggtctgggaa

SEQ ID NO: 200035 - DNA, 2935 bp, Homo sapiens
  Payload ID: 19458
  Gene Name: WD repeat domain 89
  Uniprot ID: Q96FK6
  ENST ID: ENST00000620954
  CDS Start-End: 33-1196
gagttttactacccttggatgctgctgttgacatggaaaagattgaggaacaatttgctaatctgcacattgttaaatgttccttaggaaccaaagagcccacttaccttcttggtatagacacatcaaagactgtccaagcaggaaaggaaaacttggttgctgttttatgttctaatggatcaatcagaatatatgataaagaaaggttaaatgtactacgagaatttagtggatatcctggacttcttaatggagtcagatttgcaaattcctgtgacagtgtatattcagcatgtactgatggcactgtgaaatgctgggatgctcgagtagccagagaaaaacctgttcagctcttcaagggttacccttccaatatttttatcagttttgatattaattgtaatgatcatattatttgtgctggtacagaaaaagttgatgatgatgcattgttggtgttttgggatgcaaggatgaattctcagaatttatctacaactaaagactcacttggtgcatattcagagacacatagtgatgatgtcactcaagtacgtttccatcccagcaatcccaacatggtagtctcaggttcatctgatggcctggtaaatgtatttgatattaatattgataatgaggaggatgcactggttacaacctgtaactcaatttcatcagtaagctgtattggttggtctgggaaaggttataaacagatttactgcatgacacatgatgaaggattttattggtgggatcttaatcatctggacactgatgaaccagttacacgtttgaacatccaggatgtcagagaagtagttaacatgaaagaagatgctttggactatttgattggtggcctatatcatgaaaagacagacacattgcatgttattggaggaacaaacaaaggaaggattcatttgatgaactgcagcatgtcaggactgacccatgtgactagccttcagggagggcatgctgctacagtccgttctttctgttggaatgtgcaagatgattctttgttgactggaggagaagatgcacagttgttactttggaaacctggagctatagagaagacctttacaaagaaagagagtatgaaaatagcatcctctgtgcaccaacgagtacgagttcatagtaatgattcttataaaagaaggaaaaagcagtgataatgcatttggcactttgtttggtaggttttatagtttcaaatagtccttcttgtttactacccatggtagacatgtttaaagctttatgtaaaaacaagccagttagcaaacagtcctggaaaaatatggtgagaatggtttaattccggtcttcacatattctaaaaaattttaaagcctctaagtataaaatcagtgagttgaaagtaaaatttcttatttaaagaacccatctgttaatgtagtaaatgttggctttaaagaaatagctccgataaggactttttagaaggaaatacttggtaaaacttaataaaacaggtggttggctgcattttttaagcccagttttttacattttaaattgtctttattgtgtataaaaccagattagactatattcttcatctgaggagcatctatatgtttaatacacctaatgtattatgctggagtatttaaatgtaagtattttaatgagtaaatagaattaaccttttttacaaatgaaatgataggcatctatgtaaagtgagaaaaatatgtttcgtaaatatttgcatctttaatattgttagtaagtagtaaacaggtgttttgctgattgaaaggaagttatcttggtaaattgagactcaaagtgaaatacaaaaatgaaaatatttataataggactcgacttggagaaattgctattcttcctgttgtccaaaccataaatctgaggataacctgggcttttctctttcctcttctcctaaccagtttttcaccaagtcctgtgccatttcacctcctaacgtctgtcagctatccttttgcctttacctcaccactattaccctagagaagactttcattatttctcatctggattaccagctcgatctctaatctgcttcagttcatccttcttgctacttctaggctaaacatcaaaaacagatctggtaggggcggggaaatgagggggaagaaacaaaaacgtgatggtgcctcatgctgcttaaaatcttcagtacattgatgttttgatggcggactacataagcgttaaaaattgtgtttttcagaatctttaaaatataagacagtgctatctagtgaataaaaaaattagtttgaaagatatctggagaaatcgcattcataaaacaattggaagtgaaactattaaaacaatagggctttttaaaattaaaaatatttaaaattcaaaagtaattaatagtgttggaagatgtaggtgagaaaatattcctgaaagtagaactgaaagagacaaagagaaaagatgaaagccacagaagataaatacaggggtcaaaaccagactaacagttttagaaagtgaaaaaagttaaaaaagaaatgggggcagtgggttattagaaataacataaatggctggtatggtttgtctgtgtcctcacccaaatttcatctcgaattgtaatccccataatccccatgtgtctagggagagacctggtgggaggtgattggatcatgggggtggtttcccctacgatgttctcctgatagtgggtgagttctcacaagatctgatggttttataaagggctctgcccctttaactcctcactctttctcctgaagccttgtgaagaaggtgctttgcttcccctttgcgttcccccatgattgtaagtttcttgaggcctccctggccatgctgaactcttcagtcaattaaacactttcctttataaatt

SEQ ID NO: 200036 - DNA, 5488 bp, Homo sapiens
  Payload ID: 19459
  Gene Name: WD repeat domain 90
  Uniprot ID: Q96KV7
  ENST ID: ENST00000293879
  CDS Start-End: 1-5247
atggcccgagcgtggcagcacccgttcctcaacgtcttcagacacttccgggtggacgagtggaagcgctccgccaagcagggggacgtggccgtggtcacggacaagaccctgaagggcgccgtgtatcgcattcggggctcagtctctgccgccaactacatccagctccctaagagcagcacccagtctctggggctgacgggacgatacctgtatgtgctctttcggcccctgcccagcaagcacttcgtcatccacctcgatgtgtcctccaaggacaaccaagtcatccgtgtgtctttctccaacctcttcaaggagtttaagtctacggccacgtggctccagtttcccttggtcctggaggccaggacacctcagagagatctggtgggtttggccccctccggagcccgctggacctgcctgcagctcgatctgcaggacgttctcctggtctacctgaaccggtgctacggccatctcaagagcatcaggctgtgcgccagcctgctggtcaggaacctgtacaccagtgacctgtgctttgagcctgccatctctggggcccagtgggcaaagctgcccgtgactcctatgcctcgggaaatggcattccctgtgcccaagggagagagctggcatgaccgctacatccacgtccggtttccaagtgagagcttgaaagtgccttccaagccgattgagaagagctgttcccctcctgaggcagtcctcctggggccggggccacagcctctcccttgcccggtggcctccagcaaacctgtgcggttcagtgtgtctccagtggtccagacgcccagccccacagcctccggccgggccgccttggcacccaggcccttcccggaggtcagcctgtcccaagagcgctcagacgcctccaacgcggatggccccggtttccatagccttgagccctgggcccagctggaggcctctgacatccacacggctgctgccggcacccacgtgttgactcacgagtcggctgaggtgcccgtggcccgcaccggctcctgcgaaggcttcctcccagacccagtcctgaggctcaagggcgtcatcggctttgggggccacggcaccagacaggccctgtggaccccagacggggcggctgtcgtgtacccctgccatgcggtcatcgtcgtcctgctcgtggacacgggggagcagcgcttcttccttggccacacagacaaggtctccgccctggcgctggatggcagcagctcactattggcctcggcccaggcaagggcccctagtgtgatgcggctctgggacttccagaccgggcggtgcttgtgcctgttccggagcccaatgcacgttgtctgctctctcagcttctctgacagcggggcccttctctgcggggttggcaaggaccaccacgggaggacgatggtggtggcctggggcaccggccaggtgggcctcggtggcgaggtggtcgttctggcaaaggcgcacactgactttgacgtccaggccttccgggtcaccttttttgatgaaaccaggatggcgtcgtgcgggcagggcagtgtgcggctctggcggctgcgtggcggggtgctgcgttcctgccccgtggacttaggggagcaccacgcgctgcagttcaccgacctggccttcaagcaggcccgggacggctgcccggagccctcggctgccatgctcttcgtgtgcagccgcagtggccacatcttggagattgactgtcagcgcatggtcgtgcggcatgcccgccgcctgctccccacacggactccaggcggtccccacccacagaagcagaccttcagctcaggccccggcattgccatcagcagcctcagcgtctccccggccatgtgtgctgtgggctctgaggacggcttcttgcggctctggcccctggacttctcctcggtgctcctggaggcagagcacgagggccccgtcagctcagtctgtgtcagccccgatggcctccgtgtgctgtctgccacctcctcgggccacctgggcttcctggacacgctgtcccgggtgtaccacatgctggctcgctcccacaccgccccggtgttggccctcgccatggagcagaggcggggacagctggccaccgtgtcccaggaccgtaccgtccgcatctgggacctggccaccctgcagcagctatacgacttcacatcatcagaggacgccccgtgcgctgtcaccttccaccccacaaggccaacctttttctgtggctttagcagtggggccgtgcgctccttcagcctggaggccgctgaggtcctggtggaacacacgtgccaccgaggagctgtcaccggcctgaccgccacccctgacggccgcctgctcttcagctcctgctcccagggctccctggcccagtacagctgtgcggacccccagtggcatgtcctccgagtggcagcggacatggtatgcccggatgcccccgcgagccccagcgccctggcagtcagcagggatggccgcctgctggcctttgtgggaccctccaggtgcacagtgacagtcatgggctcggcctcccttgatgagctgctgcgagttgacatcggcactctggacctggccagcagccgcctggactcagccatggctgtgtgctttggccctgcagctctgggccacctgctggtgtccacctcgtccaacagagtcgtggtgctggatgctgtgtcgggccgcatcatccgggagctgcccggtgtccaccctgagccctgcccctccttgacgctcagtgaggacgcccgcttcctgctgattgccgccggccggaccatcaaggtgtgggactacgccacacaggccagcccaggcccccaggtgtacatcggccactcggaacccgtgcaggctgtggccttctctcctgaccagcagcaggtcctcagcgcaggggacgccgtcttcctctgggatgtcctggcccctactgagagcgaccaaagcttccccggggcccccccagcctgcaagacaggcccgggcgcaggaccgctggaggacgcagcgtccagggccagcgagctcccccggcagcaggtccccaagccatgtcaggcatctccaccacggctgggcgtctgtgccaggcctcccgaaggtggcgatggcgccagggacaccaggaattcgggggccccacgcaccacctacctggcttcctgcaaggccttcacgcctgccagggtcagctgcagcccccactctgccaagggcacttgcccgcctcccgccagcggtgggtggctgcgtctgaaggctgtcgtcggttacagcgggaatgggcgggccaacatggtctggaggccggacacaggcttctttgcctacacgtgcggccgcctggtggtggtggaggacctgcactctggcgcccagcagcactggtccggccactctgcggagatctccacgctggccctcagccacagtgcccaggtcctggcctctgcctcgggccgaagcagcacgaccgcccattgtcagatccgcgtctgggacgtgtctggcggcctctgccagcatctcattttcccccatagcaccaccgtgctggccctggccttctcaccagatgacaggcttcttgtcacactgggggaccacgatggccgcaccctcgccctgtggggcacggccacctatgacctcgtgtcctccacccgcctcccggagccggtgcatggtgtggccttcaacccctgggacgccggcgagctcacctgtgtgggccagggcactgtcaccttctggctccttcagcagcgtggggcagacatcagccttcaggtgcgtcgagagccagtcccagaggcagtgggggctggagagctgacctcgctctgctacggggcacctcccctgctctattgtggcaccagctctggccaggtctgtgtctgggacacgcgtgccggccgctgcttcttgtcctgggaggcggatgacggtggcattgggctgttgctgttctcgggttctcgattggtcagcggcagcagcacggggcggctgcgcctgtgggccgtgggggctgtgtcggagctgaggtgcaagggctcaggcgccagttctgtgttcatggaacacgagctggtgctggacggggctgtggtgagtgccagcttcgatgacagcgtggacatgggcgtcgtgggcaccacggcgggcacgctgtggtttgtcagctgggccgagggcaccagcacacgtctcatcagtggccacaggagcaaggtgaacgaggtggtcttcagccccggggagtcccactgcgccacatgcagtgaggatgggagtgtgcgggtgtgggccttggccagcatggagcttgtgatccagttccaggtgctgaaccagagctgcctctgcctggcatggagccccccgtgctgtggccgccctgagcagcagcggctagcggctggctacggtgacggctccctgcgcatcttcagcgtctcccgcacggccatggagctcaagatgcacccccacccggtggcgctgaccactgttgccttctccaccgatggtcagactgtcctctctggagacaaggatgggctcgtggctgtgagccacccctgcacagggacaaccttccgtgtgctgagtgaccaccagggcgccccaatctctaccatctgtgtcacgtgcaaagagtgtgaagacttaggggtggagggcacagacctatggctggctgccagtggggaccagcgggtcagcgtctgggcctccgactggctgcggaaccactgtgagcttgtggactggttgagtttcccaatgcctgccaccacggagactcagggccacctgccaccctccctcgctgccttctgcccttgggatggggcgctcctgatgtacgtgggccccggtgtttacaaggaggtgatcatctacaacctctgccagaagcaggtggtggagaagataccactgcccttttttgccatgtccctgagcctgtcccccgggacccacctcctggctgttggctttgctgagtgcatgctgaggctggtagactgtgccatggggactgcccaagactttgccggccacgacaacgcagtgcacctgtgcaggtttacaccgtccgccaggctgctcttcacggccgcccgcaacgagatccttgtgtgggaggtccccggcctctgagatgcagcagggactgtggtggtgggcatcacgcctggtcatgccaggcacctggacacaggcttggcagaggcgccaggttgtcaatggcctcatgctgggacaggccaggattcacgtaaatcgcctggagcaagctgttgtaaatttggcgccctgtgaatactttcatacctgttgcccttttgcctaagaaatctttaatgtttctatcttgtaataaacatgggcatttattgca

SEQ ID NO: 200037 - DNA, 1454 bp, Homo sapiens
  Payload ID: 19459
  Gene Name: WD repeat domain 90
  Uniprot ID: Q96KV7
  ENST ID: ENST00000315764
  CDS Start-End: 314-1213
ctttcagcctcagtctgcagcctgctagggacgcacggccacactcctgtctttcagcctcagtctgcagcctgctagggacgcacggccacactcctgtctttcagcctcagtctgtagcctgctagggatgcacggccacgctcctgtctttgaggtgctgtcagaacagctttctcctcggtatcccgccgggtttgactggctagtgggcttgctttggtttggactcacccagatctagtgcagggacacacacgggggccggcattgctcctttccgccatgtggagttggccggggccagaggcacatgctctggtttggacagcccggccctgggggctggaataggaaatgcctgcgtccctttaccctgcccaggggccaacacccccagcctagctacggcttcccccaggtgaacgaggtggtcttcagccccggggagtcccactgcgccacatgcagtgaggatgggagtgtgcgggtgtgggccttggccagcatggagcttgtgatccagttccaggtgctgaaccagagctgcctctgcctggcatggagccccccgtgctgtggccgccctgagcagcagcggctagcggctggctacggtgacggctccctgcgcatcttcagcgtctcccgcacggccatggagctcaagatgcacccccacccggtggcgctgaccactgttgccttctccaccgatggtcagactgtcctctctggagacaaggatgggctcgtggctgtgagccacccctgcacagggacaaccttccgtgtgctgagtgaccaccagggcgccccaatctctaccatctgtgtcacgtgcaaagagactcagggccacctgccaccctccctcgctgccttctgcccttgggatggggcgctcctgatgtacgtgggccccggtgtttacaaggaggtgatcatctacaacctctgccagaagcaggtggtggagaagataccactgcccttttttgccatgtccctgagcctgtcccccgggacccacctcctggctgttggctttgctgagtgcatgctgaggctggtagactgtgccatggggactgcccaagactttgccggccacgacaacgcagtgcacctgtgcaggtttacaccgtccgccaggctgctcttcacggccgcccgcaacgagatccttgtgtgggaggtccccggcctctgagatgcagcagggactgtggtggtgggcatcacgcctggtcatgccaggcacctggacacaggcttggcagaggcgccaggttgtcaatggcctcatgctgggacaggccaggattcacgtaaatcgcctggagcaagctgttgtaaatttggcgccctgtgaatactttcatacctgttgcccttttgcctaagaaatctttaatgtttctatcttgtaataaacatgggcatttattgca

SEQ ID NO: 200038 - DNA, 399 bp, Homo sapiens
  Payload ID: 19459
  Gene Name: WD repeat domain 90
  ENST ID: ENST00000550739
  CDS Start-End: 1-399
gcccgggcgcaggaccgctggaggacgcagcgtccagggccagcgagctcccccggcagcaggtccccaagccatgtcaggcatctccaccacggctgggcgtctgtgccaggcctcccgaaggtggcgatggcgccagggacaccaggaattcgggggccccacgcaccacctacctggcttcctgcaaggccttcacgcctgccagggtcagctgcagcccccactctgccaaggctttggggcacaggtggccatgctgggccccagcagcatccgggtctccttcctcgcagggcacttgcccgcctcccgccagcggtgggtggctgcgtctgaaggctgtcgtcggttacagcgggaatgggcgggccaacatggtctggaggccggacacag

SEQ ID NO: 200039 - DNA, 396 bp, Homo sapiens
  Payload ID: 19459
  Gene Name: WD repeat domain 90
  ENST ID: ENST00000546896
  CDS Start-End: 1-348
gagaagataccactgcccttttttgccatgtccctgagcctgtcccccgggacccacctcctggctgttggctttgctggtttacaccgtccgccaggctgctcttcacggccgcccgcaacgagatccttgtgtgggaggtccccggcctctgagatgcagcagggactgtggtggtgggcatcacgcctggtcatgccaggcacctggacacaggcttggcagaggcgccaggttgtcaatggcctcatgctgggacaggccaggattcacgtaaatcgcctggagcaagctgttgtaaatttggcgccctgtgaatactttcatacctgttgcccttttgcctaagaaatctttaatgtttctatcttgtaataaacatgggcatttattgca

SEQ ID NO: 200040 - DNA, 5589 bp, Homo sapiens
  Payload ID: 19459
  Gene Name: WD repeat domain 90
  ENST ID: ENST00000549091
  CDS Start-End: 93-5345
caccgttgccaggcagccgttgcctggcgtcgcggggcgtactctgcgctgggcgcgcggaggcctaggcgggaagctcgagcggcggcgccatggcccgagcgtggcagcacccgttcctcaacgtcttcagacacttccgggtggacgagtggaagcgctccgccaagcagggggacgtggccgtggtcacggacaagaccctgaagggcgccgtgtatcgcattcggggctcagtctctgccgccaactacatccagctccctaagagcagcacccagtctctggggctgacgggacgatacctgtatgtgctctttcggcccctgcccagcaagcacttcgtcatccacctcgatgtgtcctccaaggacaaccaagtcatccgtgtgtctttctccaacctcttcaaggagtttaagtctacggccacgtggctccagtttcccttggtcctggaggccaggacacctcagagagatctggtgggtttggccccctccggagcccgctggacctgcctgcagctcgatctgcaggacgttctcctggtctacctgaaccggtgctacggccatctcaagagcatcaggctgtgcgccagcctgctggtcaggaacctgtacaccagtgacctgtgctttgagcctgccatctctggggcccagtgggcaaagctgcccgtgactcctatgcctcgggaaatggcattccctgtgcccaagggagagagctggcatgaccgctacatccacgtccggtttccaagtgagagcttgaaagtgccttccaagccgattgagaagagctgttcccctcctgaggcagtcctcctggggccggggccacagcctctcccttgcccggtggcctccagcaaacctgtgcggttcagtgtgtctccagtggtccagacgcccagccccacagcctccggccgggccgccttggcacccaggcccttcccggaggtcagcctgtcccaagagcgctcagacgcctccaacgcggatggccccggtttccatagccttgagccctgggcccagctggaggcctctgacatccacacggctgctgccggcacccacgtgttgactcacgagtcggctgaggtgcccgtggcccgcaccggctcctgcgaaggcttcctcccagacccagtcctgaggctcaagggcgtcatcggctttgggggccacggcaccagacaggccctgtggaccccagacggggcggctgtcgtgtacccctgccatgcggtcatcgtcgtcctgctcgtggacacgggggagcagcgcttcttccttggccacacagacaaggtctccgccctggcgctggatggcagcagctcactattggcctcggcccaggcaagggcccctagtgtgatgcggctctgggacttccagaccgggcggtgcttgtgcctgttccggagcccaatgcacgttgtctgctctctcagcttctctgacagcggggcccttctctgcggggttggcaaggaccaccacgggaggacgatggtggtggcctggggcaccggccaggtgggcctcggtggcgaggtggtcgttctggcaaaggcgcacactgactttgacgtccaggccttccgggtcaccttttttgatgaaaccaggatggcgtcgtgcgggcagggcagtgtgcggctctggcggctgcgtggcggggtgctgcgttcctgccccgtggacttaggggagcaccacgcgctgcagttcaccgacctggccttcaagcaggcccgggacggctgcccggagccctcggctgccatgctcttcgtgtgcagccgcagtggccacatcttggagattgactgtcagcgcatggtcgtgcggcatgcccgccgcctgctccccacacggactccaggcggtccccacccacagaagcagaccttcagctcaggccccggcattgccatcagcagcctcagcgtctccccggccatgtgtgctgtgggctctgaggacggcttcttgcggctctggcccctggacttctcctcggtgctcctggaggcagagcacgagggccccgtcagctcagtctgtgtcagccccgatggcctccgtgtgctgtctgccacctcctcgggccacctgggcttcctggacacgctgtcccgggtgtaccacatgctggctcgctcccacaccgccccggtgttggccctcgccatggagcagaggcggggacagctggccaccgtgtcccaggaccgtaccgtccgcatctgggacctggccaccctgcagcagctatacgacttcacatcatcagaggacgccccgtgcgctgtcaccttccaccccacaaggccaacctttttctgtggctttagcagtggggccgtgcgctccttcagcctggaggccgctgaggtcctggtggaacacacgtgccaccgaggagctgtcaccggcctgaccgccacccctgacggccgcctgctcttcagctcctgctcccagggctccctggcccagtacagctgtgcggacccccagtggcatgtcctccgagtggcagcggacatggtatgcccggatgcccccgcgagccccagcgccctggcagtcagcagggatggccgcctgctggcctttgtgggaccctccaggtgcacagtgacagtcatgggctcggcctcccttgatgagctgctgcgagttgacatcggcactctggacctggccagcagccgcctggactcagccatggctgtgtgctttggccctgcagctctgggccacctgctggtgtccacctcgtccaacagagtcgtggtgctggatgctgtgtcgggccgcatcatccgggagctgcccggtgtccaccctgagccctgcccctccttgacgctcagtgaggacgcccgcttcctgctgattgccgccggccggaccatcaaggtgtgggactacgccacacaggccagcccaggcccccaggtgtacatcggccactcggaacccgtgcaggctgtggccttctctcctgaccagcagcaggtcctcagcgcaggggacgccgtcttcctctgggatgtcctggcccctactgagagcgaccaaagcttccccggggcccccccagcctgcaagacaggcccgggcgcaggaccgctggaggacgcagcgtccagggccagcgagctcccccggcagcaggtccccaagccatgtcaggcatctccaccacggctgggcgtctgtgccaggcctcccgaaggtggcgatggcgccagggacaccaggaattcgggggccccacgcaccacctacctggcttcctgcaaggccttcacgcctgccagggtcagctgcagcccccactctgccaagggcacttgcccgcctcccgccagcggtgggtggctgcgtctgaaggctgtcgtcggttacagcgggaatgggcgggccaacatggtctggaggccggacacaggcttctttgcctacacgtgcggccgcctggtggtggtggaggacctgcactctggcgcccagcagcactggtccggccactctgcggagatctccacgctggccctcagccacagtgcccaggtcctggcctctgcctcgggccgaagcagcacgaccgcccattgtcagatccgcgtctgggacgtgtctggcggcctctgccagcatctcattttcccccatagcaccaccgtgctggccctggccttctcaccagatgacaggcttcttgtcacactgggggaccacgatggccgcaccctcgccctgtggggcacggccacctatgacctcgtgtcctccacccgcctcccggagccggtgcatggtgtggccttcaacccctgggacgccggcgagctcacctgtgtgggccagggcactgtcaccttctggctccttcagcagcgtggggcagacatcagccttcaggtgcgtcgagagccagtcccagaggcagtgggggctggagagctgacctcgctctgctacggggcacctcccctgctctattgtggcaccagctctggccaggtctgtgtctgggacacgcgtgccggccgctgcttcttgtcctgggaggcggatgacggtggcattgggctgttgctgttctcgggttctcgattggtcagcggcagcagcacggggcggctgcgcctgtgggccgtgggggctgtgtcggagctgaggtgcaagggctcaggcgccaggtccagttctgtgttcatggaacacgagctggtgctggacggggctgtggtgagtgccagcttcgatgacagcgtggacatgggcgtcgtgggcaccacggcgggcacgctgtggtttgtcagctgggccgagggcaccagcacacgtctcatcagtggccacaggagcaaggtgaacgaggtggtcttcagccccggggagtcccactgcgccacatgcagtgaggatgggagtgtgcgggtgtgggccttggccagcatggagcttgtgatccagttccaggtgctgaaccagagctgcctctgcctggcatggagccccccgtgctgtggccgccctgagcagcagcggctagcggctggctacggtgacggctccctgcgcatcttcagcgtctcccgcacggccatggagctcaagatgcacccccacccggtggcgctgaccactgttgccttctccaccgatggtcagactgtcctctctggagacaaggatgggctcgtggctgtgagccacccctgcacagggacaaccttccgtgtgctgagtgaccaccagggcgccccaatctctaccatctgtgtcacgtgcaaagagtgtgaagacttaggggtggagggcacagacctatggctggctgccagtggggaccagcgggtcagcgtctgggcctccgactggctgcggaaccactgtgagcttgtggactggttgagtttcccaatgcctgccaccacggagactcagggccacctgccaccctccctcgctgccttctgcccttgggatggggcgctcctgatgtacgtgggccccggtgtttacaaggaggtgatcatctacaacctctgccagaagcaggtggtggagaagataccactgcccttttttgccatgtccctgagcctgtcccccgggacccacctcctggctgttggctttgctgagtgcatgctgaggctggtagactgtgccatggggactgcccaagactttgccggccacgacaacgcagtgcacctgtgcaggtttacaccgtccgccaggctgctcttcacggccgcccgcaacgagatccttgtgtgggaggtccccggcctctgagatgcagcagggactgtggtggtgggcatcacgcctggtcatgccaggcacctggacacaggcttggcagaggcgccaggttgtcaatggcctcatgctgggacaggccaggattcacgtaaatcgcctggagcaagctgttgtaaatttggcgccctgtgaatactttcatacctgttgcccttttgcctaagaaatctttaatgtttctatcttgtaataaacatgggcatttattgcatta

SEQ ID NO: 200041 - DNA, 3133 bp, Homo sapiens
  Payload ID: 19459
  Gene Name: WD repeat domain 90
  ENST ID: ENST00000552728
  CDS Start-End: 1-1428
gctcgctcccacaccgccccggtgttggccctcgccatggagcagaggcggggacagctggccaccgtgtcccaggaccgtaccgtccgcatctgggacctggccaccctgcagcagctatacgacttcacatcatcagaggacgccccgtgcgctgtcaccttccaccccacaaggccaacctttttctgtggctttagcagtggggccgtgcgctccttcagcctggaggccgctgaggtcctggtggaacacacgtgccaccgaggagctgtcaccggcctgaccgccacccctgacggccgcctgctcttcagctcctgctcccagggctccctggcccagtacagctgtgcggacccccagtggcatgtcctccgagtggcagcggacatggtatgcccggatgcccccgcgagccccagcgccctggcagtcagcagggatggccgcctgctggcctttgtgggaccctccaggtgcacagtgacagtcatgggctcggcctcccttgatgagctgctgcgagttgacatcggcactctggacctggccagcagccgcctggactcagccatggctgtgtgctttggccctgcagctctgggccacctgctggtgtccacctcgtccaacagagtcgtggtgctggatgctgtgtcgggccgcatcatccgggagctgcccggtgtccaccctgagccctgcccctccttgacgctcagtgaggacgcccgcttcctgctgattgccgccggccggaccatcaaggtgtgggactacgccacacaggccagcccaggcccccaggtgtacatcggccactcggaacccgtgcaggctgtggccttctctcctgaccagcagcaggtcctcagcgcaggggacgccgtcttcctctgggatgtcctggcccctactgagagcgaccaaagcttccccggggcccccccagcctgcaagacaggcccgggcgcaggaccgctggaggacgcagcgtccagggccagcgagctcccccggcagcaggtccccaagccatgtcaggcatctccaccacggctgggcgtctgtgccaggcctcccgaaggtggcgatgggcacttgcccgcctcccgccagcggtgggtggctgcgtctgaaggctgtcgtcggttacagcgggaatgggcgggccaacatggtctggaggccggacacaggcttctttgcctacacgtgcggccgcctggtggtggtggaggacctgcactctggcgcccagcagcactggtccggccactctgcggagatctccacgctggccctcagccacagtgcccaggtcctggcctctgcctcgggccgaagcagcacgaccgcccattgtcagatccgcgtctgggacgtgtctggcggcctctgccagcatctcattttcccccatagcaccaccgtgctggccctggccttctcaccagatgacaggcttcttgtcacactgggggaccacgatggccgcaccctcgccctgtggggcacggccacctatgacctcgtgtcctccacccgcctcccggagccggtgcatggtgtggccttcaacccctgggacgccggcgagctcacctgtgtgggccagggcactgtcaccttctggctccttcagcagcgtggggcagacatcagccttcaggtgcgtcgagagccagtcccagaggcagtgggggctggagagctgacctcgctctgctacggggcacctcccctgctctattgtggcaccagctctggccaggtctgtgtctgggacacgcgtgccggccgctgcttcttgtcctgggaggcggatgacggtggcattgggctgttgctgttctcgggttctcgattggtcagcggcagcagcacggggcggctgcgcctgtgggccgtgggggctgtgtcggagctgaggtgcaagggctcaggcgccaggtgaacgaggtggtcttcagccccggggagtcccactgcgccacatgcagtgaggatgggagtgtgcgggtgtgggccttggccagcatggagcttgtgatccagttccaggtgctgaaccagagctgcctctgcctggcatggagccccccgtgctgtggccgccctgagcagcagcggctagcggctggctacggtgacggctccctgcgcatcttcagcgtctcccgcacggccatggagctcaagatgcacccccacccggtggcgctgaccactgttgccttctccaccgatggtcagactgtcctctctggagacaaggatgggctcgtggctgtgagccacccctgcacagggacaaccttccgtgtgctgagtgaccaccagggcgccccaatctctaccatctgtgtcacgtgcaaagagtgtgaagacttaggggtggagggcacagacctatggctggctgccagtggggaccagcgggtcagcgtctgggcctccgactggctgcggaaccactgtgagcttgtggactggttgagtttcccaatgcctgccaccacggagactcagggccacctgccaccctccctcgctgccttctgcccttgggatggggcgctcctgatgtacgtgggccccggtgtttacaaggaggtgatcatctacaacctctgccagaagcaggtggtggagaagataccactgcccttttttgccatgtccctgagcctgtcccccgggacccacctcctggctgttggctttgctgagtgcatgctgaggctggtagactgtgccatggggactgcccaagactttgccggccacgacaacgcagtgcacctgtgcaggtttacaccgtccgccaggctgctcttcacggccgcccgcaacgagatccttgtgtgggaggtccccggcctctgagatgcagcagggactgtggtggtgggcatcacgcctggtcatgccaggcacctggacacaggcttggcagaggcgccaggttgtcaatggcctcatgctgggacaggccaggattcacgtaaatcgcctggagcaagctgttgtaaatttggcgccctgtgaatactttcatacctgttgcccttttgcctaagaaatctttaatgtttctatcttgtaataaacatgggcatttattgca

SEQ ID NO: 200042 - DNA, 1672 bp, Homo sapiens
  Payload ID: 19459
  Gene Name: WD repeat domain 90
  ENST ID: ENST00000547944
  CDS Start-End: 388-1431
ggaatgcgactgcatggcgcgctcgctgcaacctcagtctgcagcctgctagggacgcacggccacactcctgtctttcagcctcagtctgcagcctgctagggacgcacggccacactcctgtctttcagcctcagtctgcagcctgctagggacgcacggccacactcctgtctttcagcctcagtctgtagcctgctagggatgcacggccacgctcctgtctttgaggtgctgtcagaacagctttctcctcggtatcccgccgggtttgactggctagtgggcttgctttggtttggactcacccagatctagtgcagggacacacacgggggccggcattgctcctttccgccatgtggagttggccggggccagaggcacatgctctggtttggacagcccggccctgggggctggaataggaaatgcctgcgtccctttaccctgcccaggggccaacacccccagcctagctacggcttcccccaggtgaacgaggtggtcttcagccccggggagtcccactgcgccacatgcagtgaggatgggagtgtgcgggtgtgggccttggccagcatggagcttgtgatccagttccaggtgctgaaccagagctgcctctgcctggcatggagccccccgtgctgtggccgccctgagcagcagcggctagcggctggctacggtgacggctccctgcgcatcttcagcgtctcccgcacggccatggagctcaagatgcacccccacccggtggcgctgaccactgttgccttctccaccgatggtcagactgtcctctctggagacaaggatgggctcgtggctgtgagccacccctgcacagggacaaccttccgtgtgctgagtgaccaccagggcgccccaatctctaccatctgtgtcacgtgcaaagagtgtgaagacttaggggtggagggcacagacctatggctggctgccagtggggaccagcgggtcagcgtctgggcctccgactggctgcggaaccactgtgagcttgtggactggttgagtttcccaatgcctgccaccacggagactcagggccacctgccaccctccctcgctgccttctgcccttgggatggggcgctcctgatgtacgtgggccccggtgtttacaaggaggtgatcatctacaacctctgccagaagcaggtggtggagaagataccactgcccttttttgccatgtccctgagcctgtcccccgggacccacctcctggctgttggctttgctgagtgcatgctgaggctggtagactgtgccatggggactgcccaagactttgccggccacgacaacgcagtgcacctgtgcaggtttacaccgtccgccaggctgctcttcacggccgcccgcaacgagatccttgtgtgggaggtccccggcctctgagatgcagcagggactgtggtggtgggcatcacgcctggtcatgccaggcacctggacacaggcttggcagaggcgccaggttgtcaatggcctcatgctgggacaggccaggattcacgtaaatcgcctggagcaagctgttgtaaatttggcgccctgtgaatactttcatacctgttgcccttttgcctaagaaatctttaatgtttctatcttgtaataaacatgggcatttattgca

SEQ ID NO: 200043 - DNA, 623 bp, Homo sapiens
  Payload ID: 19459
  Gene Name: WD repeat domain 90
  ENST ID: ENST00000551100
  CDS Start-End: 1-235
tgccagtggggaccagcgggtcagcgtctgggcctccgactggctgcggaaccactgtgagcttgtggactggttgagtttcccaatgcctgccaccacggagactcagggccacctgccaccctccctcgctgccttctgcccttgggatggggcgctcctgatgtacgtgggccccggtgtttacaaggaggtgatcatctacaacctctgccagaagcagagtgcatgctgaggctggtagactgtgccatggggactgcccaagactttgccggccacgacaacgcagtgcacctgtgcaggtttacaccgtccgccaggctgctcttcacggccgcccgcaacgagatccttgtgtgggaggtccccggcctctgagatgcagcagggactgtggtggtgggcatcacgcctggtcatgccaggcacctggacacaggcttggcagaggcgccaggttgtcaatggcctcatgctgggacaggccaggattcacgtaaatcgcctggagcaagctgttgtaaatttggcgccctgtgaatactttcatacctgttgcccttttgcctaagaaatctttaatgtttctatcttgtaataaacatgggcatttattgcat

SEQ ID NO: 200044 - DNA, 2340 bp, Homo sapiens
  Payload ID: 19459
  Gene Name: WD repeat domain 90
  ENST ID: ENST00000615333
  CDS Start-End: 65-2251
gtcgcggggcgtactctgcgctgggcgcgcggaggcctaggcgggaagctcgagcggcggcgccatggcccgagcgtggcagcacccgttcctcaacgtcttcagacacttccgggtggacgagtggaagcgctccgccaagcagggggacgtggccgtggtcacggacaagaccctgaagggcgccgtgtatcgcattcggggctcagtctctgccgccaactacatccagctccctaagagcagcacccagtctctggggctgacgggacgatacctgtatgtgctctttcggcccctgcccagcaagcacttcgtcatccacctcgatgtgtcctccaaggacaaccaagtcatccgtgtgtctttctccaacctcttcaaggagtttaagtctacggccacgtggctccagtttcccttggtcctggaggccaggacacctcagagagatctggtgggtttggccccctccggagcccgctggacctgcctgcagctcgatctgcaggacgttctcctggtctacctgaaccggtgctacggccatctcaagagcatcaggctgtgcgccagcctgctggtcaggaacctgtacaccagtgacctgtgctttgagcctgccatctctggggcccagtgggcaaagctgcccgtgactcctatgcctcgggaaatggcattccctgtgcccaagggagagagctggcatgaccgctacatccacgtccggtttccaagtgagagcttgaaagtgccttccaagccgattgagaagagctgttcccctcctgaggcagtcctcctggggccggggccacagcctctcccttgcccggtggcctccagcaaacctgtgcggttcagtgtgtctccagtggtccagacgcccagccccacagcctccggccgggccgccttggcacccaggcccttcccggaggtcagcctgtcccaagagcgctcagacgcctccaacgcggatggccccggtttccatagccttgagccctgggcccagctggaggcctctgacatccacacggctgctgccggcacccacgtgttgactcacgagtcggctgaggtgcccgtggcccgcaccggctcctgcgaaggcttcctcccagacccagtcctgaggctcaagggcgtcatcggctttgggggccacggcaccagacaggccctgtggaccccagacggggcggctgtcgtgtacccctgccatgcggtcatcgtcgtcctgctcgtggacacgggggagcagcgcttcttccttggccacacagacaaggtctccgccctggcgctggatggcagcagctcactattggcctcggcccaggcaagggcccctagtgtgatgcggctctgggacttccagaccgggcggtgcttgtgcctgttccggagcccaatgcacgttgtctgctctctcagcttctctgacagcggggcccttctctgcggggttggcaaggaccaccacgggaggacgatggtggtggcctggggcaccggccaggtgggcctcggtggcgaggtggtcgttctggcaaaggcgcacactgactttgacgtccaggccttccgggtcaccttttttgatgaaaccaggatggcgtcgtgcgggcagggcagtgtgcggctctggcggctgcgtggcggggtgctgcgttcctgccccgtggacttaggggagcaccacgcgctgcagttcaccgacctggccttcaagcaggcccgggacggctgcccggagccctcggctgccatgctcttcgtgtgcagccgcagtggccacatcttggagattgactgtcagcgcatggtcgtgcggcatgcccgccgcctgctccccacacggactccaggcggtccccacccacagaagcagaccttcagctcaggccccggcattgccatcagcagcctcagcgtctccccggccatgtgtgctgtgggctctgaggacggcttcttgcggctctggcccctggacttctcctcggtgctcctggaggcaggtgatgctgtgggcacgctctcccaactccgggagagcctcgcctggatgctggggcggggaaggcccagtccccggggctctgctgtcagccgccctggctcctggctgcacagggtgccacggccaagtggcatatccagagccctggggcggctgatgccagggcggcccgcggggcagcctcacggaagggcccggtgggacgtgggtagtgtgtgaagcccctcagcctgggtcccgcctagcctaagagtggtggcctcgagggagctgcatcttgcagccgtgtggagcctgggactttgagc

SEQ ID NO: 200045 - DNA, 4588 bp, Homo sapiens
  Payload ID: 19460
  Gene Name: WD repeat domain 91
  Uniprot ID: A4D1P6
  ENST ID: ENST00000354475
  CDS Start-End: 33-2276
accgcaccacccctaaagacgctagcgctgcgatggcggaggccgtggagcgcactgacgagctggtccgggagtacctgctcttccgcgggttcacgcacacactgcggcagctggacgccgagatcaaggcggacaaggagaaggggttccgggtggataagattgtggaccagctgcagcagttaatgcaggtgtatgacttggctgcccttcgggattattggagctacttggagcgtcggctcttcagccgcttggaggatatatacagacccacaatccacaagctgaaaaccagcctgtttcgattttatcttgtctacacaatccagacaaacagaaatgacaaggctcaggagttctttgcaaagcaggccacggaactccagaaccaggctgagtggaaggattggtttgtcctgcccttcctgccatccccggacaccaaccccacctttgctacctacttttctcgacagtgggctgacaccttcattgtgtccctgcacaacttcctgagcgtcctgtttcagtgcatgccagtccctgtgatcctgaactttgatgcggagtgtcagaggactaaccaggttcaagaagaaaatgaagttctgcgtcagaagctttttgcattgcaagctgaaatccaccgactgaagaaagaggagcaacagccagaagaggaagaggccttggtccaacacaaattgcctccttatgtctccaacatggaccgcctgggggactcggaacttgccatggtgtgcagccaaaggaatgcctccctctcccagtcacctcgtgtgggcttcctgtcctcgctgctgcctcagagtaagaagagcccctcaaggttgtcgcctgctcagggccctcctcaacctcagagctcggccaagaaagagtccttcggtggtcagggcaccaagggaaaggacccgacgtccggagccaaggatgggaagagcctcctcagcgggctggccactggggagtccggttggtcacagcaccggcagcggcgcctgcaggaccatggcaaggagaggaaggagcttttctccacaaccacttcccagtgtgcagagaagaaaccagaagccagtggcccagaggctgagccctgcccagagctccacacggagccagtggagccactgactcgggcatcctcggcaggccctgagggtggaggagtccgccccgagcagccctttattgtgctgggacaggaggagtacggggaacaccactcatccatcatgcactgcagagtggactgctctgggaggagagtcgccagcttagacgtagatggggtcatcaaagtgtggtccttcaaccccatcatgcagaccaaagcatcctccatttccaaatcaccgctgctgtctttggaatgggccaccaaacgggacagactgctcttgctgggcagtggtgtgggaacagtgcgtctctatgacacggaagccaagaagaatctctgtgaaatcaatatcaacgacaacatgcccagaatcctgtctcttgcgtgcagccccaacggggcctctttcgtctgttcggcagcagctccgagcctcacttcccaggtggacttctcagcaccagacatcggcagcaagggcatgaaccaggttcctggcaggctgctgctgtgggacacgaaaaccatgaagcagcagctccagttctccctggatccagaacccattgctatcaactgtacagccttcaatcacaacgggaacctgctggtcacaggggcagctgatggcgtcatccggctgtttgacatgcagcagcatgagtgcgcgatgagctggagggcccactacggggaggtctactctgtggagttcagctatgatgagaacaccgtgtacagcatcggcgaggacgggaagttcatccagtggaacatccacaagagtggcctcaaggtatccgagtacagcctcccctcagatgccacgggcccctttgtgctgtctggatacagcggctacaagcaggttcaagtccccaggggccgactcttcgcttttgactcggagggaaattacatgctgacatgttctgccacaggcggcgtcatctacaagctgggtggcgatgagaaggttctggagagctgcttgagcctaggtggccaccgagcccctgtggtcaccgtggactggagcactgccatggactgtgggacctgcctcaccgcctccatggatggcaagatcaagctgaccaccctcctggcccataaagcctgatgacttgccccaagggccacccgaggaagcagtattatctgcggtggggggaggagatataggacaggaaaaccacgtgctccactccagctccctgccagtgcagtgactctgcagggaaagactggcaaggaggctcaggtgcttccatctgtggtgactggaatgggacccacgtggagtaggtgacatatgcttcccagagactggtattgtggctgtgccaggagtacatgtgagactatgggaggaaagctccggaagaaggagaaacattgcagtggctactgtgttggcccagtagaaattgacagtattttgtatatatgtgcccatttatctttttcttttttaaaaaaagagaatactcttgtggtcccctgatgtctctttctaggatgtgtgtcactttgcttcagtgacagccctcccacccagcctggctctgctggccctgaactgaacctctccaggctctcctgttgctttgccatggagccaggtcagctctctgtctgttctgctgggtaacaaggtttggcagttcctgtttctctgggcttaagtcaaggccacagaattctttttcttccctgaaagctggcagcttttgttacagaagattctcaggatgaaggcaggggctgaggcctctgctactggctgcccctttccatccagtggctgctgtttcccaagacaggctaagcgtttcttatctgaaatgcttgggacaggagtgttacagattttggattttttcagactttggaatatttgcatatatacataatgaggtatcttggtaggtctcatgtctaaacatgaaattcattcatgttttatatataccttatacatgtagcctgaaggtaactctatacagtattttaaataattttgtacatgaaacaaagtattgattgtggtcaggtgtggtattttccacttgtggtgtcatgttggtgctcacagttttggggctgggcacggtggctcacgtctgtaatcccagcactttgggaggccaaggtgggtggatcacttaaggtcaggagcttgagaccagcctggccaacatggtgaaaccccatctctactaaaaataccaaaattagccaggcatggtggcaggtgcctataatcccagctactctggaggctggggcaggagaatcacttgagcccaggaggcggaggttgcagtgagccgagatcacgccactgggagaacccaactcaaaaaaaaaaaaagttttgggttatggagcatttttgattttggatctttgggttaaggacgctcaacctgtacctttttcatttggtggctcctctcattcctccaactgaacatctttgtggaaagatgatggctgcctgcacccactgctggcgaatggtgagaaggtagagcaagggggccaagttgctgctggtgggcacctggggttcaggccggcccaactgtggctgagccgatctgtagctgagctgagtgtcaaccagctgtgtccacaccctgcctgaggcctgccctctcctccctggctggggtgggaccttgaagaggcatatcttcccactaggtgaggaggaacaagagcctcactccccttctccctcttgcctttcacagctgaggcagagcttatgggaggagtcactatgggagtgatggacctgggctttggtctccagtgtttggcaggggcgaccttatcactgagctggggaaggcagctgccatgagtcattttaagtctctgagctccagcccagttctaggggcacaaggctggagtagggatactcctagttacctgcttgaggaaaagcacgaagaaattggtaccaaagtcttggctttgttctgggagttgagggaaaagtagggaggtatttaagtggcttgattatgagaaaacaccagagacagtagtaaatagttatttaccgatttttacccatttctaccctggtaatcctccctgcaaatgaagaaaaccaagacttctttatttattatctttccccatctgtattgaaacagtgatcttacttatctcacccagtgattctgtaggacatttaaaaagtggtcatgggtttcattggagtgagaatggtattaacgtttcctcttgtcatctcaaagttttctctccccttaataccatctctacagcttgctgagatgctttaaggatcacagagacacaaagaaaatttgaaccctacgcttctcccatcccacttcttactccatcccgggtgagcgctcgtcctcaaataaagcatgttggaacttc

SEQ ID NO: 200046 - DNA, 4500 bp, Homo sapiens
  Payload ID: 19460
  Gene Name: WD repeat domain 91
  ENST ID: ENST00000423565
  CDS Start-End: 50-2188
ggaagacctcatggcacattagagaaacccaaacttcccctgctctaaaatgattttccattgcgaggtggataagattgtggaccagctgcagcagttaatgcaggtgtatgacttggctgcccttcgggattattggagctacttggagcgtcggctcttcagccgcttggaggatatatacagacccacaatccacaagctgaaaaccagcctgtttcgattttatcttgtctacacaatccagacaaacagaaatgacaaggctcaggagttctttgcaaagcaggccacggaactccagaaccaggctgagtggaaggattggtttgtcctgcccttcctgccatccccggacaccaaccccacctttgctacctacttttctcgacagtgggctgacaccttcattgtgtccctgcacaacttcctgagcgtcctgtttcagtgcatgccagtccctgtgatcctgaactttgatgcggagtgtcagaggactaaccaggttcaagaagaaaatgaagttctgcgtcagaagctttttgcattgcaagctgaaatccaccgactgaagaaagaggagcaacagccagaagaggaagaggccttggtccaacacaaattgcctccttatgtctccaacatggaccgcctgggggactcggaacttgccatggtgtgcagccaaaggaatgcctccctctcccagtcacctcgtgtgggcttcctgtcctcgctgctgcctcagagtaagaagagcccctcaaggttgtcgcctgctcagggccctcctcaacctcagagctcggccaagaaagagtccttcggtggtcagggcaccaagggaaaggacccgacgtccggagccaaggatgggaagagcctcctcagcgggctggccactggggagtccggttggtcacagcaccggcagcggcgcctgcaggaccatggcaaggagaggaaggagcttttctccacaaccacttcccagtgtgcagagaagaaaccagaagccagtggcccagaggctgagccctgcccagagctccacacggagccagtggagccactgactcgggcatcctcggcaggccctgagggtggaggagtccgccccgagcagccctttattgtgctgggacaggaggagtacggggaacaccactcatccatcatgcactgcagagtggactgctctgggaggagagtcgccagcttagacgtagatggggtcatcaaagtgtggtccttcaaccccatcatgcagaccaaagcatcctccatttccaaatcaccgctgctgtctttggaatgggccaccaaacgggacagactgctcttgctgggcagtggtgtgggaacagtgcgtctctatgacacggaagccaagaagaatctctgtgaaatcaatatcaacgacaacatgcccagaatcctgtctcttgcgtgcagccccaacggggcctctttcgtctgttcggcagcagctccgagcctcacttcccaggtggacttctcagcaccagacatcggcagcaagggcatgaaccaggttcctggcaggctgctgctgtgggacacgaaaaccatgaagcagcagctccagttctccctggatccagaacccattgctatcaactgtacagccttcaatcacaacgggaacctgctggtcacaggggcagctgatggcgtcatccggctgtttgacatgcagcagcatgagtgcgcgatgagctggagggcccactacggggaggtctactctgtggagttcagctatgatgagaacaccgtgtacagcatcggcgaggacgggaagttcatccagtggaacatccacaagagtggcctcaaggtatccgagtacagcctcccctcagatgccacgggcccctttgtgctgtctggatacagcggctacaagcaggttcaagtccccaggggccgactcttcgcttttgactcggagggaaattacatgctgacatgttctgccacaggcggcgtcatctacaagctgggtggcgatgagaaggttctggagagctgcttgagcctaggtggccaccgagcccctgtggtcaccgtggactggagcactgccatggactgtgggacctgcctcaccgcctccatggatggcaagatcaagctgaccaccctcctggcccataaagcctgatgacttgccccaagggccacccgaggaagcagtattatctgcggtggggggaggagatataggacaggaaaaccacgtgctccactccagctccctgccagtgcagtgactctgcagggaaagactggcaaggaggctcaggtgcttccatctgtggtgactggaatgggacccacgtggagtaggtgacatatgcttcccagagactggtattgtggctgtgccaggagtacatgtgagactatgggaggaaagctccggaagaaggagaaacattgcagtggctactgtgttggcccagtagaaattgacagtattttgtatatatgtgcccatttatctttttcttttttaaaaaaagagaatactcttgtggtcccctgatgtctctttctaggatgtgtgtcactttgcttcagtgacagccctcccacccagcctggctctgctggccctgaactgaacctctccaggctctcctgttgctttgccatggagccaggtcagctctctgtctgttctgctgggtaacaaggtttggcagttcctgtttctctgggcttaagtcaaggccacagaattctttttcttccctgaaagctggcagcttttgttacagaagattctcaggatgaaggcaggggctgaggcctctgctactggctgcccctttccatccagtggctgctgtttcccaagacaggctaagcgtttcttatctgaaatgcttgggacaggagtgttacagattttggattttttcagactttggaatatttgcatatatacataatgaggtatcttggtaggtctcatgtctaaacatgaaattcattcatgttttatatataccttatacatgtagcctgaaggtaactctatacagtattttaaataattttgtacatgaaacaaagtattgattgtggtcaggtgtggtattttccacttgtggtgtcatgttggtgctcacagttttggggctgggcacggtggctcacgtctgtaatcccagcactttgggaggccaaggtgggtggatcacttaaggtcaggagcttgagaccagcctggccaacatggtgaaaccccatctctactaaaaataccaaaattagccaggcatggtggcaggtgcctataatcccagctactctggaggctggggcaggagaatcacttgagcccaggaggcggaggttgcagtgagccgagatcacgccactgggagaacccaactcaaaaaaaaaaaaagttttgggttatggagcatttttgattttggatctttgggttaaggacgctcaacctgtacctttttcatttggtggctcctctcattcctccaactgaacatctttgtggaaagatgatggctgcctgcacccactgctggcgaatggtgagaaggtagagcaagggggccaagttgctgctggtgggcacctggggttcaggccggcccaactgtggctgagccgatctgtagctgagctgagtgtcaaccagctgtgtccacaccctgcctgaggcctgccctctcctccctggctggggtgggaccttgaagaggcatatcttcccactaggtgaggaggaacaagagcctcactccccttctccctcttgcctttcacagctgaggcagagcttatgggaggagtcactatgggagtgatggacctgggctttggtctccagtgtttggcaggggcgaccttatcactgagctggggaaggcagctgccatgagtcattttaagtctctgagctccagcccagttctaggggcacaaggctggagtagggatactcctagttacctgcttgaggaaaagcacgaagaaattggtaccaaagtcttggctttgttctgggagttgagggaaaagtagggaggtatttaagtggcttgattatgagaaaacaccagagacagtagtaaatagttatttaccgatttttacccatttctaccctggtaatcctccctgcaaatgaagaaaaccaagacttctttatttattatctttccccatctgtattgaaacagtgatcttacttatctcacccagtgattctgtaggacatttaaaaagtggtcatgggtttcattggagtgagaatggtattaacgtttcctcttgtcatctcaaagttttctctccccttaataccatctctacagcttgctgagatgctttaaggatcacagagacacaaagaaaatttgaaccctacgcttctcccatcccacttcttactccatcccgggtgagcgctcgtcctcaaataaagcatgttggaacttc

SEQ ID NO: 200047 - DNA, 2626 bp, Homo sapiens
  Payload ID: 19461
  Gene Name: WD repeat domain 92
  Uniprot ID: Q96MX6
  ENST ID: ENST00000295121
  CDS Start-End: 118-1191
ggggcagaatacggaaagcgggagggacaaattgccaatgtttggagtctggtttccaggttgccgtttttgggggctctgggtgtggcggttgccgtagctgaaattggctgcaccatgtcggccttcgagaagcctcagatcatcgcccatatccagaagggcttcaactacacggtgtttgactgtaagtgggtgccctgcagcgccaaatttgtgaccatgggcaacttcgcacggggcaccggcgtcattcagctgtacgagatccagcacggggacctgaagctgcttcgggagattgaaaaggccaaacctattaaatgtggaacatttggtgcaacatctttacagcagagatatttagctactggagattttggtggaaaccttcatatatggaatttagaagctccagagatgccagtatattctgtaaagggccataaagaaattataaatgccatagatggcataggtggactaggaattggagaaggagcacctgaaattgtgactggcagccgagatggaactgtgaaggtgtgggacccaaggcaaaaagatgatcctgttgctaatatggaacctgtacaaggagaaaacaagagagactgttggactgtggcatttggcaatgcttataatcaagaagaacgtgttgtttgtgctggctatgacaatggggatatcaaactatttgatctcagaaatatggcattacggtgggagacaaacatcaaaaatggggtgtgtagcttggagtttgacagaaaagacataagtatgaataagttagtagccacatctctggaaggaaagttccatgtttttgacatgagaacacagcatccaaccaaaggttttgcctctgtttcagaaaaggctcataaatctactgtgtggcaggtccgacacctgccgcagaacagggagctctttctgacagctggaggcgccggcggccttcacctctggaagtatgaataccctattcagcggtcaaagaaagattctgagggaatagaaatgggagtcgcaggttctgtaagccttctgcagaatgttacgttgtccacccagcccatttcaagtttggattggagtccagataaaaggggtctctgcgtctgtagttcatttgaccaaacggtgagagtactgatcgttacaaagctcaataaaatttgacttcaagactttggacttgaggctgggcacggtggctcactcctgtaatcccagcactttgggaggccgaggcgggtggatcagaaggtcaggagatcgagaccatcctggctaacatggtgaaaccccgtctctactaaaaatataaaaaaaaatttgctgggtgtcatggcgggcatctgtagtcctagctacttgggaggctgaggcaggagaatggcgtgaacccgggaggcggaggttgcagtgagccgagattgtgccactgcactccagcctgggcaactgagcaagactgtctcaaaaaaaaaaaaaaaaaaaaagactttggacttgaaaccttccagaggaacactcacacaatttaagataggttctggagtcctctgaccctcattgaacaaagctggatttggctgatgataaaagaccccagccacaagcctctgggccagcctccagcctctctcggggcttgtttgctgacttgctgctgcacgtgggtatcagaagcaccaagtaaactatctccagggccagttcttttctctcccttccatttctaagtcaatagttgtctataattaaacatatttcagatttgttctgtgtccctgaagttccatattttatctttatgcttgtgttatgttttagtgtctataatgttgtggtgggaatcatttcatttggtttaaaagagtttgccttggaaaaactgaattaaccttcataaatacattttgagagatttcagtgtgagtaattttctggacataatattattgtataaaatatcaaaatggtgggccaggcgtggtagctcacgcctgtaattccagcactttgggaggctgaggcgggtgaatcacgaggtcaggaattcgagaccagcctggccaacatggtcaaaacccgtctctactaaaaatacaaaaaattagctgggcttagtggcgggcgcctgtaatcacagctacttgggaggctgaggcaggagaatcacttgaacccaggaggtggagattgcagtgagctgagattgcgccactgcactccagccctggcgacagagtgagactccgtctcaaaaaaaaaaaaaacaaatatatatatatatatctctctctctcaaaacggcacggttggtctagatttgggtagctattttctgcaatttaattcataaaacaaaatgctttgattttaaagagctcttttttacttaaaatacaggaactgaattggtgagacttttggtttttgactgtggtaagtgatggtgaaatgtacaagattgtaggggttttgtagtcttatttttggtcatactttaaaaatgcattttatgaataaacttctgtttttgagatctacagaagctttgattctgttaccttaacagtagtaataaagttaacattgtcacatcatt

SEQ ID NO: 200048 - DNA, 1401 bp, Homo sapiens
  Payload ID: 19461
  Gene Name: WD repeat domain 92
  ENST ID: ENST00000406245
  CDS Start-End: 221-784
gcggttgccgtagctgaaattggctgcaccatgtcggccttcgagaagcctcagatcatcgcccatatccagaagggcttcaactacacggtgtttgactattgaaaaggccaaacctattaaatgtggaacatttggtgcaacatctttacagcagagatatttagctactggagattttggtggaaaccttcatatatggaatttagaagctccagagatgccagtatattctgtaaagggccataaagaaattataaatgccatagatggcataggtggactaggaattggagaaggagcacctgaaattgtgactggcagccgagatggaactgtgaaggtgtgggacccaaggcaaaaagatgatcctgttgctaatatggaacctgtacaaggagaaaacaagagagactgttggactgtggcatttggcaatgcttataatcaagaagaacgtgttgtttgtgctggctatgacaatggggatatcaaactatttgatctcagaaatatggcattacggtgggagacaaacatcaaaaatggggtgtgtagcttggagtttgacagaaaagacataagtatgaataagttagtagccacatctctggaaggaaagttccatgtttttgacatgagaacacagcatccaaccaaaggttttgcctctgtttcagaaaaggctcataaatctactgtgtggcaggtccgacacctgccgcagaacagggagctctttctgacagctggaggcgccggcggccttcacctctggaagtagtaagtctgccagtgcacactgctccttttaaagttacctgtgggtgtaaagtaggattagattgaacttttttttcttttttttcctgctttgacttagttcattttgatatgatttaaaatttcatggtgttacataacttgttttctaagcattttgtatgaatatactttacacttagtagagtgtacactaatcttcttttgatacattttagtatatcattttagttgtgtcttctaagtatgaaaaagttggcccaagacttttatcagatactatcttgaagtgattagaacactcactgcctctaaaagatggggaaagggttccttgcctaaatttagataacatcattgtgatagaccccaacagagcctgaggctgctgattggtctccaggaaagatcttatcactgaatttgctttctgcatatctaggcagggtgagttacaatgaaagcttttactatgcacaccactttctgaatcccaagggcgctaacatcacagatactagatcatttaaaaggtctgatatcattgctcagggttggcctgtgaaaaggaaacaaaacaaaacaaaacaaaaattaaaggtctgataaaaattgtga

SEQ ID NO: 200049 - DNA, 1517 bp, Homo sapiens
  Payload ID: 19461
  Gene Name: WD repeat domain 92
  Uniprot ID: Q96MX6
  ENST ID: ENST00000409164
  CDS Start-End: 40-906
ctgggtgtggcggttgccgtagctgaaattggctgcaccatgtcggccttcgagaagcctcagatcatcgcccatatccagaagggcttcaactacacggtgtttgactgtaagtgggtgccctgcagcgccaaatttgtgaccatgggcaacttcgcacggggcaccggcgtcattcagctgtacgagatccagcacggggacctgaagctgcttcgggagattgaaaaggccaaacctattaaatgtggaacatttggtgcaacatctttacagcagagatatttagctactggagattttggtggaaaccttcatatatggaatttagaagctccagagatgccagtatattctgtaaagggccataaagaaattataaatgccatagatggcataggtggactaggaattggagaaggagcacctgaaattgtgactggcagccgagatggaactgtgaaggtgtgggacccaaggcaaaaagatgatcctgttgctaatatggaacctgtacaaggagaaaacaagagagactgttggactgtggcatttggcaatgcttataatcaagaagaacgtgttgtttgtgctggctatgacaatggggatatcaaactatttgatctcagaaatatggcattacggtgggagacaaacatcaaaaatggggtgtgtagcttggagtttgacagaaaagacataagtatgaataagttagtagccacatctctggaaggaaagttccatgtttttgacatgagaacacagcatccaaccaaaggttttgcctctgtttcagaaaaggctcataaatctactgtgtggcaggtccgacacctgccgcagaacagggagctctttctgacagctggaggcgccggcggccttcacctctggaagtagtaagtctgccagtgcacactgctccttttaaagttacctgtgggtgtaaagtaggattagattgaacttttttttcttttttttcctgctttgacttagttcattttgatatgatttaaaatttcatggtgttacataacttgttttctaagcattttgtatgaatatactttacacttagtagagtgtacactaatcttcttttgatacattttagtatatcattttagttgtgtcttctaagtatgaaaaagttggcccaagacttttatcagatactatcttgaagtgattagaacactcactgcctctaaaagatggggaaagggttccttgcctaaatttagataacatcattgtgatagaccccaacagagcctgaggctgctgattggtctccaggaaagatcttatcactgaatttgctttctgcatatctaggcagggtgagttacaatgaaagcttttactatgcacaccactttctgaatcccaagggcgctaacatcacagatactagatcatttaaaaggtctgatatcattgctcagggttggcctgtgaaaaggaaacaaaacaaaacaaaacaaaaattaaaggtctgataaaaa

SEQ ID NO: 200050 - DNA, 523 bp, Homo sapiens
  Payload ID: 19461
  Gene Name: WD repeat domain 92
  ENST ID: ENST00000457114
  CDS Start-End: 1-278
tcagaaatatggcattacggtgggagacaaacatcaaaaatggggtgtgtagcttggagtttgacagaaaagacataagtatgaataagttagtagccacatctctggaaggaaagttccatgtttttgacatgagaacacagcatccaaccaaaggttttgcctctgtttcagaaaaggctcataaatctactgtgtggcaggtccgacacctgccgcagaacagggagctctttctgacagctggaggcgccggcggccttcacctctggaagtagtctaacatctccaccctgtgacgccttcccatagaaatggtacacaaaaggtccttaggcttgggtccgtgtaatggagctcgagggttagaagctggcatcagtttttcattctggaagtgtttagatgaagttctgcaaatgttacttacagccattgcctttgcacattgtttgcctgtgatatccagcaatctatatctggagaaaaattacaataaataaaagattgccaaaagcaccaa

SEQ ID NO: 200051 - DNA, 2409 bp, Homo sapiens
  Payload ID: 19462
  Gene Name: WD repeat domain 93
  Uniprot ID: Q6P2C0
  ENST ID: ENST00000268130
  CDS Start-End: 102-2162
cggacttccggttcaagccggaagttgtggttaccaaggcgacgcaacgccgcccggccagcttttcagtttcatagaggttcccagtgccaccttctgtgatgtcattcccaagaggaagtcagacccagaaaataaagcaccccattggtacacgaaagggaccattggaggtgccacccccaacagagaaggactggcctaaagacgatgaacaggatcatgtcctcgtggatccagatgaggagctggattccttgcctcagccttatcgaatgatcaacaagctggtgaaccttctgtttgaccagtcttgggaaattattgaagagagaaacgcactgagggaagctgagagcagccagatccagcccaccgtctaccctccacttggagaaatccagctcaacaaaatgccaaattgtatggctgtttcccaagactatgtgtttattggaggagccaaaggattctcaatttataatctgtacagtgctaaacaaatatatgcgtgggagaagcttaaggttgatgtcacttccatctgggccacagatttagggaatgaaatactcattgctcctgtggatgaaatgggtatcattagactcttttatttttataaggaaggactttacctagtcaaagccatcaatgaagtggatgataccagcaagcaaactacctgtataaagatggagatctctcaaggaggggactttgcagccttcctcctacaaggagccggagatatttggctggatgtgtataaattgcccaaggagacttggctcaagaaactagagcacccccaactcacttcaaatccaaagaaaaaagtcagacagccgcaactgaactcccttggtcccatttctgcagatcctttagaaatggatgcaaatgttagttttaaaggagacattaaattgagtcttccagtttacataatgaagatcaaaccacctaagcctgttacaggcaccacattcaaaagccccctggaagtctttgcaaagatcaaggactgctacggactgggctccgggcagaatcatttcatcaaggacagtcagtgggagcagcaagctgagatcttcaacgcttcctacaagaagtacctagatagggagtgggaggaagagccactcagtacggccaccttctatttccttcttcctagctgcctatttgcaatgccaccggaagtcaagggcccctcaggaatggcctgtgtccttggtatacactggaccagaagtcacaatttcttcctgtattcactaaaccgaactctaaaggataaagctgaccccgagggtgtgtggccctgtgctgcgcccattgcagtctctcagctcagctgctcctcctcctacctggtgctggcctgcgaggatggtgtgctcacgctgtgggacctggccaaaggattccctcttggggtcgctgctcttcctcagggatgtttctgccaaagcattcacttcctaaaatatttctcggtccacaaaggacagaatatgtatcctgaaggtcaagtgaaatcccaaatgaaatgtgtggtgctgtgcacagacgcctccctccatctggtggaggctagcgggacccaaggacccaccatcagtgtgcttgttgagaggcctgtaaagcacctggataaaaccatctgtgccgtggccccagtcccagccttacctggcatggtgctcatcttttccaagaatggctctgtgtgccttatggatgtggccaagcgtgaaatcatctgtgcctttgcccctccgggagcctttcctctggaggtcccctggaagccagtgtttgctgtgtctccagaccatccatgtttcctgctccgaggagactattcacatgaaactgcgtccaccgacgatgctggaatccaatattctgttttctattttaattttgaggcctgcccactcctggaaaatatctcaaaaaattgtaccattcctcaaagggacttggataacatggccttcccccaagcactgccactggagaagagatgtgagcgtttcctccagaagagctatcggaagctggagaagaacccagagaaggaggaggagcactgggcccggcttcagaggtactccttgtcgctccagagagagaacttcaagaagtgaggctgccaccgccctgggatctctgaaaaggaggtttcagccacgaggcagctgctcccaggacactgaggccaagagaaatgtaacagagccacagctccacaggcctgcactcggagtctggggcctctgcagagccagcaaggggaaaagtataatctgggggaccttcaaccactaagcctcttgtcagagccctcaggcaggcagatgtgtcacccaaataaacagtgatattgtctccaga

SEQ ID NO: 200052 - DNA, 1886 bp, Homo sapiens
  Payload ID: 19462
  Gene Name: WD repeat domain 93
  ENST ID: ENST00000558000
  CDS Start-End: 55-576
cgccgcccggccagcttttcagtttcatagaggttcccagtgccaccttctgtgatgtcattcccaagaggaagtcagacccagaaaataaagcaccccattggtacacgaaagggaccattggaggtgccacccccaacagagaaggactggcctaaagacgatgaacaggatcatgtcctcgtggatccagatgaggagctggattccttgcctcagccttatcgaatgatcaacaagctggtgaaccttctgtttgaccagtcttgggaaattattgaagagagaaacgcactgagggaagctgagagcagccagatccagcccaccgtctaccctccacttggagaaatccagctcaacaaaatgccaaattgtatggctgtttcccaagactatgtgtttattggaggagccaaaggattctcaatttataatctgtacagtgctaaacaaatatatgcgtgggagaagcttaaggttgatgtcacttccatctgggccacagatttagggaatgaaatactcattgctcctgtggatgaaatgggtattgttcttcatcttcctttttagcctcatttacaggtacctgtagactgttgtcaatttaatctccttttgaggtattggtggggccaggcatggagacttctccctggtcatgtaatagtaactatatgtacagaacaggtatggtgggtcagatactgttctaccatttcacatgtgctagcccatttaatcctcatggcagccttaggggggaagtaaaattttttattcctgttcagaagaggcaactgacttatggaagctaaataacttatttgaggtaacatggaaagtcaggcttcaaaccaggcagtatggccctggagtccacacccttccagcactcagcagtcctctcatacaaaccagagcttgctctttttccctcagcctgaggatgaaccaggcctccatgaggagtatggtatcgaaaactgtagacagtgtcctagataggtgagctgttactcttggttgccccccaaaagctaggctccctctagcctgtccttatgtttgggtgaaacagactgttacctctggatttgaggagctttcctactttgtggaggatgagaaggcaaatgtcagcattggctggaagtgagtgaggtggctgtgtcatattgtggcaggcagagcggaaagtgcctgctcacttggagatcatctgtgaaggcatgcatctctctagacctcaggctctgctcaaccagcacaggcacactgaagaactttctgcaggagagtgacctgaccagactggcatttaagaagggcactctagcaggagtttgaaaaaggcaaaatgagaggcagaaaaactatgcagtcattaaggagagaaaattctgaacatctgaaccaagacaggggctgttaaaatgaaaagaaaggccaggtgtggtggctcatgcctgtaatcccagcactttgggaagcccaggcaggtggatcacttgaggtcaggagtttgacaccagcctggccaacatggtgaaaccccgtctttacgaaaaatacaaaaaaaaaaaaaaaaaaattagccaggcgtggtgggcacccaggtgctcgggaggctgaggaaggagaattgcttgaacccaggaggcggagattacagtgagctgagatcgcaccattgcactccagcatgggtgacagaatgagactccatctcaaaaaaaaagaaaagaaaaagtgtactatggttatgtaagatgttaacattaggggaagcaagacaagggatacaaagaaactctgtactatttttgtaacttttttataagtctaaaattagttcaaaataaaaagcttaaaaaatgaaa

SEQ ID NO: 200053 - DNA, 2293 bp, Homo sapiens
  Payload ID: 19462
  Gene Name: WD repeat domain 93
  Uniprot ID: Q6P2C0
  ENST ID: ENST00000560294
  CDS Start-End: 70-2046
accaaggcgacgcaacgccgcccggccagcttttcagtttcatagaggttcccagtgccaccttctgtgatgtcattcccaagaggaagtcagacccagaaaataaagcaccccattggtacacgaaagggaccattggaggtgccacccccaacagagaaggactggcctaaagacgatgaacaggatcatgtcctcgtggatccagatgaggagctggattccttgcctcagccttatcgaatgatcaacaagctggtgaaccttctgtttgaccagtcttgggaaattattgaagagagaaacgcactgagggaagctgagagcagccagatccagcccaccgtctaccctccacttggagaaatccagctcaacaaaatgccaaattgtatggctgtttcccaagactatgtgtttattggaggagccaaaggattctcaatttataatctgtacagtgctaaacaaatatatgcgtgggagaagcttaaggttgatgtcacttccatctgggccacagatttagggaatgaaatactcattgctcctgtggatgaaatgggtatcattagactcttttatttttataaggaaggactttacctagtcaaagccatcaatgaagtggatgataccagcaagcaaactacctgtataaagatggagatctctcaaggaggggactttgcagccttcctcctacaaggagccggagatatttggctggatgtgtataaattgcccaaggagacttggctcaagaaactagagcacccccaactcacttcaaatccaaagaaaaaagtcagacagccgcaactgaactcccttggtcccatttctgcagatcctttagaaatggatgcaaatgttagttttaaaggagacattaaattgagtcttccagtttacataatgaagatcaaaccacctaagcctgttacaggcaccacattcaaaagccccctggaagtctttgcaaagatcaaggactgctacggactgggctccgggcagaatcatttcatcaaggacagtcagtgggagcagcaagctgagatcttcaacgcttcctacaagaagtacctagatagggagtgggaggaagagccactcagtacggccaccttctatttccttcttcctagctgcctatttgcaatgccaccggaagtcaagggcccctcaggaatggcctgtgtccttggtatacactggaccagaagtcacaatttcttcctgtattcactaaaccgaactctaaaggataaagctgaccccgagggtgtgtggccctgtgctgcgcccattgcagtctctcagctcagctgctcctcctcctacctggtgctggcctgcgaggatggtgtgctcacgctgtgggacctggccaaaggacagaatatgtatcctgaaggtcaagtgaaatcccaaatgaaatgtgtggtgctgtgcacagacgcctccctccatctggtggaggctagcgggacccaaggacccaccatcagtgtgcttgttgagaggcctgtaaagcacctggataaaaccatctgtgccgtggccccagtcccagccttacctggcatggtgctcatcttttccaagaatggctctgtgtgccttatggatgtggccaagcgtgaaatcatctgtgcctttgcccctccgggagcctttcctctggaggtcccctggaagccagtgtttgctgtgtctccagaccatccatgtttcctgctccgaggagactattcacatgaaactgcgtccaccgacgatgctggaatccaatattctgttttctattttaattttgaggcctgcccactcctggaaaatatctcaaaaaattgtaccattcctcaaagggacttggataacatggccttcccccaagcactgccactggagaagagatgtgagcgtttcctccagaagagctatcggaagctggagaagaacccagagaaggaggaggagcactgggcccggcttcagaggtactccttgtcgctccagagagagaacttcaagaagtgaggctgccaccgccctgggatctctgaaaaggaggtttcagccacgaggcagctgctcccaggacactgaggccaagagaaatgtaacagagccacagctccacaggcctgcactcggagtctggggcctctgcagagccagcaaggggaaaagtataatctgggggaccttcaaccactaagcctcttgtcagagccctcaggcaggcagatgtgtcacccaaataaacagtgatattgtctccaga

SEQ ID NO: 200054 - DNA, 6916 bp, Homo sapiens
  Payload ID: 19463
  Gene Name: WD repeat domain 97
  Uniprot ID: A6NE52
  ENST ID: ENST00000323662
  CDS Start-End: 26-4894
gggctctgggaccgcagttgctgaaatggaggcagaggtgtgggaggcagaaggctacaacctagttctggactcggacctgtatgatgcggatggctatgatgtcccagaccctgggctgctcaccgaaaagaatgagttgactttcacggagccgtcgcaggtcctgccctttttgaccagcagccaacagtggcaaagcctgaccccgcgcgcccgcgcccgccggctgtggctgcttctgcgcaccagcctccacgaagtcgtggaaaaggagaagagagccgagctgcgcgcggcgcgcctgacgcatgggctggaaccactgcgccgcctggaggtggcagccgggctgcgctcggtggcgcaggacccggtgggtggacgcttcgtggtgctggacggcgcgggccgcctgcacctgcacaaggaagacggctgggcacaggagacgctgctggcgcctgtccggcttacggggctggtgaccgtgctgggcccgctgggtgccgtgggccgttttgtaggctggggccccgcggggctggcaattctgaggcccaacctcagcctgctgtggctgagcgagcagggggtgggcagggccccgggttgggcgcccacctgctgcctgccggttcccgacctcaggctgctgctcgttgcggagatgaacagcagcctggcgctctggcagttccgttcaggtggtcgccgcctggtgctgcgagggtcagcactgcacccgcccccgagcccaacaggcaggctcatgcgtctggctgtggcgccggttcctccccaccacgtcctgcgctgcttcgcggcctatggctcggccgtgctcaccttcgatctgcatgcctggactctcgtagatgtgcgccgggatttgcacaaaaccaccatctcggacctggcttactgcgaggaagtagaggcaatggtgacagcttcccgggacagcaccgtgaaggtgtgggaggctgactggcagatccggatggtgttcgtgggccacacaggcccggtgacggctatgactgtgctcccgaacacgaccctggtgttgtcggcctcgcaggacgggacgctacgcacctgggacctgcaggcggcggcgcaggtgggcgaggtagcgctgggcttctggggccaggacaagctgtcccggcgcgtgggccgtctgctggcgccggtgcgcccgggctggccggtgctgtccctgtgcgcgagcagcatgcagctgtggcgcgtacgcgagctctactcgccgttggcgcaactgcccgccaaggtgctccacgtgcaggtggcgcccgcgttgcccgcgcctgcgcaccagtcgctgcctacgcgcctcgtgtgcgcgtgcgccgacggctcggtctacctcctgtcggcggccaccgggcgcatagtgagctcactgctgctggagccggaggactgcgcggcagccgtggcctactgcctgccgcgcgaggcgctgtggctgctgaccagggctgggcacctggtccgcgccaacgcggcgcgctgccccatgagcgtgctgcaccgcgtgtgcccgccgccgccccctgcgccgcagccttgctgtctgcacctgtacagccacctcacggatctcgaaggcgccttctcctcctgggagatcgtgcgccagcactggggcgagttgcgctgcagctctgtggcctgcgcctggaagaacaagaaccggtacctgccagtggtggggcacacggacggcacgctgtcggtgctggagtggctctcgtcgaagactgtcttccaaacggaggcgcacagcccgggcccggttgtcgccatcgcatccacctggaacagcattgtgtcttcgggtggggacctgacggtgaagatgtggcgcgtcttcccctatgccgaagagagcctgagcctgctgcgcaccttctcctgctgctacccggccgtggcgctctgtgcgctaggcagacgcgtcaccgcgggctttgaggacccagacagcgctacctacggcctggtgcagtttggcctgggcgacagtccgcgattagaccaccggccccaggacgaccccacggaccacatcactggcctgtgctgctgccccacgctcaaactgtatgcctgctccagcctggactgcaccgttcgcatctggactgctgagaaccgcctcctgcggctcctgcagctgaatggtgcccctcaggccctggctttctgcagcaacagtggagacctggtgctggcgctgggatcccgcctctgcctggtgtcccacaggctctacctgcctacatcctacctagttaagaagatgtgccggaaggccccagacgtggtggacgaccctccgctgccactgatgagccaggagtcactgacttccgcccaactgcagaggctcaccaacctccatggggcagccagcctcagcgaggccttgtctctcatccatcgtcggagggcaacatctcagcacctggtgccgaaggaggacttggacgccatagtggcccgggaccgagaccttcagcagttgaggctggggctagtggtcccagcagcccagcccccaccctcctggcagcagcgccaggaaggctttgacaattacctccgtctgatctacggctctggcctgctgggcatgcagtctggaagggggtcccagcagtggagtgccgggaccctcagagtggagagagagacccgggatgtgtgtgctgtaccccaagctgcccactgtcttgcccgggctgaggtcagcactgcagcccaaacagtgccaacagccctgtccccacaggacctgggagccctgggccagcacttctcccagtctccccgagtcacagtgccgatcccacccacccaccgtagggtgcacagcaaggcatcccagcttctggcccgctcctcactgagccactacctgggcatcagtctggatctgcagctgcagttggagcagctccgagggaggacgaccatggccctggacctgccatcctcccacttgcagtgcaggatcccactgctgccaaagagatgggacaaggaacctctctctagcctcaggggcttctttcctgccaccgtgcagccccacaagcactgcctgaggcccatctgcttccccggctatgtgcccaactccgcggtgctacagcagatgtggctaaatgcggagccaggggcaagccaggatgccctgtggttgtggcgccccaggccatcccaaacccagtggcagaggaagctgctccaatggatgggggagaagcctggggaggagggggaggaagacaagaaggaagaggaggaggagaaggaagacgaggagctggactgggccttggcttccctgagcccgcactccaaccagcagctggattcctgggaactggaggatcagagtgctgtggactggacccaggagccccggcggcgcagctgcaaggttgccaggacccaccctcatccctggcaccgtcatgggagtttgctcttggatgagcattacgggcatctgcccaagtttctgcatttcttcatctaccagacctggttcaaaaagttgttccccatcttcagcctgcaggcatacccggaggcgggcacgatcgagggcctggcctcgctgttggtggccctgctggagaagaccacgtgggtcgaccgtgtgcacatcctgcaggtgctactgagactgctgcccaacatgagcagtgatctccaaggccagctgcagggcctgctcgtacacttgctcaacctggaccagccccccagcctccaggaccagacacagaagaagttcgtgatactggcgctgcagctgctcctggcctgctccctggagtcccgggatgtggtgctggagctcatgtcctacttcctctactctcccgtgcactgccggccagagctcaagaagctgctgcacgggctgggccttcaggacccagagggcttcctattcaaggagatgatgacctgggtccagggcccagacctggactccaaggccggcctgcgcacttgctgccaccagaaactggaggacatgatccaggagcttcaggagaccccatcgcagacgtcagtggtctctggggcacccacacgcgcctccgtgataccctcgggcacctcctggtcggcctccggcatcttcgggaggctctcgcaggtctcagaggtgcctttgatggtggtctcacctgcggagccgcactctttagccccggagctccaggcccagcggatgctggcacccaagcgcagctgggggacccctcagctccgtctcagagtgctctccgagacgctgaagagcttctgcctggagcccgaggcccgcctgcaccctgccgggcctgctcagctgcccggagagccgccgccgctggaggagaccgactggtcgcactcgcagctgctggacttgggccccatcgacgcgctcaacttcttctgtgagcagctgcgggcgcagcagcggagttcgctccaggagaaggctgcgcacccacacccgccagagccctacacggtggcgccggtgcccgacatggtggtgccacctccgcgggagcactggtaccaccccatcctccggctgcaggaggccaagccgcagaggtccgcgaggtccgcgatgagactgaggggccccatgcggtcccggctctgtgcgggccgcaccctggacggccccatccggacgctgaagctgccgttgccgcgtgtggagccgcagcctttccccctggactggcctatgcccccgcgcccgctgcccccgcggctcctgcagccggccctgcagcgctactttctgccagcggacgcggaccctgacacctacagctgaccggactggtggcctcagcccgcctggctctggggcctgtcattggtatttggccaaggcctgcatcgggaataaagtccagagaatttctttctgcaggatgccgcctgctttggagggccccggggtgcgcacggcgtgtgggcgtgcggcctgaacccacagtggcggcggaaggcaggagccggaggcctggcggaggtggccatcgtgggcaccagcgttcccggaggggtggccggcctagggcagaggagacccatagcggggtaccatccgctgggcactgagcaaacgttttctgctcaagtactaggtgttgagatgcgggctgaccttagagaacgtgtcctgggccagcccacagcctggtgtggaggggagtccgggagggcctgggcggtcccaggatgagccttccgggtcgatgcaggtgagaccaggagtttgcagaccttgctttcgttacttttattctggcaaagagaagaattgacaaaggcaccaggagcttttttctgagcggcaacgcagagcatcctctgacccctttagcctgaaagtccctaggggaggggcttggtccggaagggctcggcctctgggccgggcccctctgccctgtgtggcctggcagggcgcaagacctgtgcacagagttcttggggcagctctggggggaatccccggcttttacacctgtcttttgtgttgtctgagcagtgatttccctcctgtatctgtagcctctgactttactagtttcttcttgatggctctggttagaatcgcttctccacaccttccctgtcaccccaaactgtgcggtggctcttgttatggggccaccaaatggctgctctttcccaggccggtgcttgacacagtggtgccaccatcccaagagcatgggtgcgcaggaccgtgcgggacagccaagttgctgggcccagctgaacctgcctcttcacctccaggcactaccgcatcctcccactgcagaaggccaaggttcacaggtgtgcgatgagactgaggactgagtctgtcactagaggacttgacactttttataaaaaaaatgagtaaacctagatacctcgatcagtgtctagcgatgtcaaggcccccagtttgggttcaagcctgctgggacagtcctgcagctgctgggtcacagagtggccaaggccctctgatttttggtcaggacacagaaagatagcagggggcagggggggatctgagggaccccacatgacttacaatcagacaaggtaggtcagaggatttctttatggctatctgttttgttttgttttgttttgttttgttttttgagatggagtttcagtcttgttgcccaggctggagtgcaatggcgtgatctcggctcactgcaacctctgcctcccggattcaagcaattctccttcctcagcctcctgagtagctgggattacaggcatgtgccaccacgcccagctaattttgtatttttagtagagatggggtttcatcacgttgaccaggctggtctcgaactcctgacctcaggtgatccgcctgcctcagcctctcaaagtgctgggattacaagcatgagccactgtgcccagccttctttatggctatctccaagacagcaaaggcaggggaaagtcctgccttggggagaaaaaggagggtgggaaaaggtcaaagagaaagatgctgttgtctgagtcttgcctctgaggcctaagttccccaacattataacaagggatatgggagttataagccaggaactgtggatggaaaccaatgacagatatcataatatcacacccacacatcaggcaagagacttgttccttaaaaattatctagtttagccgagcgtggtggctcacacctgtaatcccagctacttgggaggctgaggcaggagaatcacttgaacccaggaggtggaggttgcagcaagcagagatcacaccactgcactacagcctcggcaatagagcgagactctgtgtc

SEQ ID NO: 200055 - DNA, 7119 bp, Homo sapiens
  Payload ID: 19463
  Gene Name: WD repeat domain 97
  ENST ID: ENST00000534167
  CDS Start-End: 26-2539
gggctctgggaccgcagttgctgaaatggaggcagaggtgtgggaggcagaaggctacaacctagttctggactcggacctgtatgatgcggatggctatgatgtcccagaccctgggctgctcaccgaaaagaatgagttgactttcacggagccgtcgcaggtcctgccctttttgaccagcagccaacagtggcaaagcctgaccccgcgcgcccgcgcccgccggctgtggctgcttctgcgcaccagcctccacgaagtcgtggaaaaggagaagagagccgagctgcgcgcggcgcgcctgacgcatgggctggaaccactgcgccgcctggaggtggcagccgggctgcgctcggtggcgcaggacccggtgggtggacgcttcgtggtgctggacggcgcgggccgcctgcacctgcacaaggaagacggctgggcacaggagacgctgctggcgcctgtccggcttacggggctggtgaccgtgctgggcccgctgggtgccgtgggccgttttgtaggctggggccccgcggggctggcaattctgaggcccaacctcagcctgctgtggctgagcgagcagggggtgggcagggccccgggttgggcgcccacctgctgcctgccggttcccgacctcaggctgctgctcgttgcggagatgaacagcagcctggcgctctggcagttccgttcaggtggtcgccgcctggtgctgcgagggtcagcactgcacccgcccccgagcccaacaggcaggctcatgcgtctggctgtggcgccggttcctccccaccacgtcctgcgctgcttcgcggcctatggctcggccgtgctcaccttcgatctgcatgcctggactctcgtagatgtgcgccgggatttgcacaaaaccaccatctcggacctggcttactgcgaggaagtagaggcaatggtgacagcttcccgggacagcaccgtgaaggtgtgggaggctgactggcagatccggatggtgttcgtgggccacacaggcccggtgacggctatgactgtgctcccgaacacgaccctggtgttgtcggcctcgcaggacgggacgctacgcacctgggacctgcaggcggcggcgcaggtgggcgaggtagcgctgggcttctggggccaggacaagctgtcccggcgcgtgggccgtctgctggcgccggtgcgcccgggctggccggtgctgtccctgtgcgcgagcagcatgcagctgtggcgcgtacgcgagctctactcgccgttggcgcaactgcccgccaaggtgctccacgtgcaggtggcgcccgcgttgcccgcgcctgcgcaccagtcgctgcctacgcgcctcgtgtgcgcgtgcgccgacggctcggtctacctcctgtcggcggccaccgggcgcatagtgagctcactgctgctggagccggaggactgcgcggcagccgtggcctactgcctgccgcgcgaggcgctgtggctgctgaccagggctgggcacctggtccgcgccaacgcggcgcgctgccccatgagcgtgctgcaccgcgtgtgcccgccgccgccccctgcgccgcagccttgctgtctgcacctgtacagccacctcacggatctcgaaggcgccttctcctcctgggagatcgtgcgccagcactggggcgagttgcgctgcagctctgtggcctgcgcctggaagaacaagaaccggtacctgccagtggtggggcacacggacggcacgctgtcggtgctggagtggctctcgtcgaagactgtcttccaaacggaggcgcacagcccgggcccggttgtcgccatcgcatccacctggaacagcattgtgtcttcgggtggggacctgacggtgaagatgtggcgcgtcttcccctatgccgaagagagcctgagcctgctgcgcaccttctcctgctgctacccggccgtggcgctctgtgcgctaggcagacgcgtcaccgcgggctttgaggacccagacagcgctacctacggcctggtgcagtttggcctgggcgacagtccgcgattagaccaccggccccaggacgaccccacggaccacatcactggcctgtgctgctgccccacgctcaaactgtatgcctgctccagcctggactgcaccgttcgcatctggactgctgagaaccgcctcctgcggctcctgcagctgaatggtgcccctcaggccctggctttctgcagcaacagtggagacctggtgctggcgctgggatcccgcctctgcctggtgtcccacaggctctacctgcctacatcctacctagttaagaagatgtgccggaaggccccagacgtggtggacgaccctccgctgccactgatgagccaggagtcactgacttccgcccaactgcagaggctcaccaacctccatggggcagccagcctcaggtcccatgcaggcctgctcagccctcctggaggccctcctttcccactctgggtgggggcctggcggtgtggggccctctggagttgatacaagcctgcctgagccctggcacacccgtttggggttggtccttgtcccagcctctgccccagcccactggcatgccacccagcatcccacctgtgcctgtccctgtttgcagcgaggccttgtctctcatccatcgtcggagggcaacatctcagcacctggtgccgaaggaggacttggacgccatagtggcccgggaccgagaccttcagcagttgaggctggggctagtggtcccagcagcccagcccccaccctcctggcagcagcgccaggaaggctttgacaattacctccgtctgatctacggctctggcctgctgggcatgcagtctggaagggggtcccagcagtggagtgccgggaccctcagagtggagagagagacccgggatgtgtgtgctgtaccccaagctgcccactgtcttgcccgggctgaggtcagcactgcagcccaaacagtgccaacagccctgtccccacaggacctgggagccctgggccagcacttctcccagtctccccgagtcacagtgccgatcccacccacccaccgtagggtgcacagcaaggcatcccagcttctggcccgctcctcactgagccactacctgggcatcagtctggatctgcagctgcagttggagcagctccgagggaggacgaccatggccctggacctgccatcctcccacttgcagtgcaggatcccactgctgccaaagagatgggacaaggaacctctctctagcctcaggggcttctttcctgccaccgtgcagccccacaagcactgcctgaggcccatctgcttccccggctatgtgcccaactccgcggtgctacagcagatgtggctaaatgcggagccaggggcaagccaggatgccctgtggttgtggcgccccaggccatcccaaacccagtggcagaggaagctgctccaatggatgggggagaagcctggggaggagggggaggaagacaagaaggaagaggaggaggagaaggaagacgaggagctggactgggccttggcttccctgagcccgcactccaaccagcagctggattcctgggaactggaggatcagagtgctgtggactggacccaggagccccggcggcgcagctgcaaggttgccaggacccaccctcatccctggcaccgtcatgggagtttgctcttggatgagcattacgggcatctgcccaagtttctgcatttcttcatctaccagacctggttcaaaaagttgttccccatcttcagcctgcaggcatacccggaggcgggcacgatcgagggcctggcctcgctgttggtggccctgctggagaagaccacgtgggtcgaccgtgtgcacatcctgcaggtgctactgagactgctgcccaacatgagcagtgatctccaaggccagctgcagggcctgctcgtacacttgctcaacctggaccagccccccagcctccaggaccagacacagaagaagttcgtgatactggcgctgcagctgctcctggcctgctccctggagtcccgggatgtggtgctggagctcatgtcctacttcctctactctcccgtgcactgccggccagagctcaagaagctgctgcacgggctgggccttcaggacccagagggcttcctattcaaggagatgatgacctgggtccagggcccagacctggactccaaggccggcctgcgcacttgctgccaccagaaactggaggacatgatccaggagcttcaggagaccccatcgcagacgtcagtggtctctggggcacccacacgcgcctccgtgataccctcgggcacctcctggtcggcctccggcatcttcgggaggctctcgcaggtctcagaggtgcctttgatggtggtctcacctgcggagccgcactctttagccccggagctccaggcccagcggatgctggcacccaagcgcagctgggggacccctcagctccgtctcagagtgctctccgagacgctgaagagcttctgcctggagcccgaggcccgcctgcaccctgccgggcctgctcagctgcccggagagccgccgccgctggaggagaccgactggtcgcactcgcagctgctggacttgggccccatcgacgcgctcaacttcttctgtgagcagctgcgggcgcagcagcggagttcgctccaggagaaggctgcgcacccacacccgccagagccctacacggtggcgccggtgcccgacatggtggtgccacctccgcgggagcactggtaccaccccatcctccggctgcaggaggccaagccgcagaggtccgcgaggtccgcgatgagactgaggggccccatgcggtcccggctctgtgcgggccgcaccctggacggccccatccggacgctgaagctgccgttgccgcgtgtggagccgcagcctttccccctggactggcctatgcccccgcgcccgctgcccccgcggctcctgcagccggccctgcagcgctactttctgccagcggacgcggaccctgacacctacagctgaccggactggtggcctcagcccgcctggctctggggcctgtcattggtatttggccaaggcctgcatcgggaataaagtccagagaatttctttctgcaggatgccgcctgctttggagggccccggggtgcgcacggcgtgtgggcgtgcggcctgaacccacagtggcggcggaaggcaggagccggaggcctggcggaggtggccatcgtgggcaccagcgttcccggaggggtggccggcctagggcagaggagacccatagcggggtaccatccgctgggcactgagcaaacgttttctgctcaagtactaggtgttgagatgcgggctgaccttagagaacgtgtcctgggccagcccacagcctggtgtggaggggagtccgggagggcctgggcggtcccaggatgagccttccgggtcgatgcaggtgagaccaggagtttgcagaccttgctttcgttacttttattctggcaaagagaagaattgacaaaggcaccaggagcttttttctgagcggcaacgcagagcatcctctgacccctttagcctgaaagtccctaggggaggggcttggtccggaagggctcggcctctgggccgggcccctctgccctgtgtggcctggcagggcgcaagacctgtgcacagagttcttggggcagctctggggggaatccccggcttttacacctgtcttttgtgttgtctgagcagtgatttccctcctgtatctgtagcctctgactttactagtttcttcttgatggctctggttagaatcgcttctccacaccttccctgtcaccccaaactgtgcggtggctcttgttatggggccaccaaatggctgctctttcccaggccggtgcttgacacagtggtgccaccatcccaagagcatgggtgcgcaggaccgtgcgggacagccaagttgctgggcccagctgaacctgcctcttcacctccaggcactaccgcatcctcccactgcagaaggccaaggttcacaggtgtgcgatgagactgaggactgagtctgtcactagaggacttgacactttttataaaaaaaatgagtaaacctagatacctcgatcagtgtctagcgatgtcaaggcccccagtttgggttcaagcctgctgggacagtcctgcagctgctgggtcacagagtggccaaggccctctgatttttggtcaggacacagaaagatagcagggggcagggggggatctgagggaccccacatgacttacaatcagacaaggtaggtcagaggatttctttatggctatctgttttgttttgttttgttttgttttgttttttgagatggagtttcagtcttgttgcccaggctggagtgcaatggcgtgatctcggctcactgcaacctctgcctcccggattcaagcaattctccttcctcagcctcctgagtagctgggattacaggcatgtgccaccacgcccagctaattttgtatttttagtagagatggggtttcatcacgttgaccaggctggtctcgaactcctgacctcaggtgatccgcctgcctcagcctctcaaagtgctgggattacaagcatgagccactgtgcccagccttctttatggctatctccaagacagcaaaggcaggggaaagtcctgccttggggagaaaaaggagggtgggaaaaggtcaaagagaaagatgctgttgtctgagtcttgcctctgaggcctaagttccccaacattataacaagggatatgggagttataagccaggaactgtggatggaaaccaatgacagatatcataatatcacacccacacatcaggcaagagacttgttccttaaaaattatctagtttagccgagcgtggtggctcacacctgtaatcccagctacttgggaggctgaggcaggagaatcacttgaacccaggaggtggaggttgcagcaagcagagatcacaccactgcactacagcctcggcaatagagcgagactctgtgtc

SEQ ID NO: 200056 - DNA, 1832 bp, Homo sapiens
  Payload ID: 19464
  Gene Name: WD repeat domain, phosphoinositide interacting 1
  Uniprot ID: Q5MNZ9
  ENST ID: ENST00000262139
  CDS Start-End: 1-1341
atggaggccgaggccgcggacgctcccccgggcggggttgagtcggcgctcagctgcttctctttcaaccaggactgcacatccctagcaactggaactaaagccgggtataagctgttttctctgagttctgtggagcagctggatcaagtccacggaagcaatgaaatcccggacgtctacatcgtggagcgcctcttctccagcagcctggtggtggtagtcagtcacacaaaaccacggcagatgaacgtgtatcacttcaagaaaggcacagagatctgtaattacagctactccagcaacatcttgtccataaggctgaaccggcaaaggctgctggtttgcctagaagagtccatttatattcacaacattaaagacatgaagctgttgaagaccctcctggatattcctgcaaacccaacaggtctatgtgctctctctatcaaccattccaattcttacctggcctatcctggaagcctgacttcaggggagattgtgctttatgatggaaactccctgaaaacagtctgcactattgctgcccatgagggaacactagctgccatcaccttcaatgcctcaggctccaaactagcaagtgcgtctgaaaaaggcacagtcatccgggtgttctctgtccctgatgggcaaaagctctatgagttccggagagggatgaaaaggtatgtgacaatcagctctctagtgttcagtatggattcacaattcctctgcgcctccagtaacaccgagacggtacacatcttcaagctggaacaggtcaccaacagtcgaccagaagagccttcgacctggagtggctacatgggaaagatgtttatggctgctaccaactacctccctacccaggtgtcagacatgatgcatcaggacagggcttttgccactgcacgcttgaacttctccggacagaggaacatctgtaccctctcaacgatccagaagttgccacggctgctagttgcgtcatccagtggacacctttatatgtacaatttggatcctcaggatggaggagagtgtgtcttaatcaaaacccacagcttgcttggctcaggaacaacagaagagaataaagaaaatgacctcagaccttccttacctcagtcttatgcagcgaccgtagccagaccaagtgcatcttcagcctccacggtgccaggttattctgaggacggcggggcgctgcgaggagaagttattcctgaacatgagtttgcgacgggaccagtgtgtcttgatgatgagaatgagtttcctcctataatcttgtgccgtggaaatcagaagggcaaaacgaagcagtcatgatgagaagcacacctcagaaatcaggacatcccccctatcaggtggttttggagaaaacaaggaaggcggaagaatggagtgcaattgtgtgagcagaaaggggggcaggaatcccgggtgctccactgcttaaaccacaggacctggttaactcctcaccaagcttcccacgaccctggttgccaatgggcgcgggagacattgtatacacatcatgctatttaaaatacgttcaaactatagtgtaaatgctaattaaccatattggtatataaccggaattttatattaaaaggggcctcctttttaaatatatgccgtgtaaaaaatgtacttataggaacatctctttgaattgtatttcttgtatattacatacttagagagagactcttttagccaggcaaagtcttttttggctgtggctggaataaatcatttattacttgggagtcccattttggacactaataataaaatcatggcaatgc

SEQ ID NO: 200057 - DNA, 1575 bp, Homo sapiens
  Payload ID: 19464
  Gene Name: WD repeat domain, phosphoinositide interacting 1
  ENST ID: ENST00000546360
  CDS Start-End: 222-1316
gggctgctgaggtggctgtcgccggctccgagctgcggcttcccgggccgagcccccgatggaggccgaggccgcggacgctcccccgggcggggttgagtcggcgctcagctgcttctctttcaaccaggactgcacatgaaatcccggacgtctacatcgtggagcgcctcttctccagcagcctggtggtggtagtcagtcacacaaaaccacggcagatgaacgtgtatcacttcaagaaaggcacagagatctgtaattacagctactccagcaacatcttgtccataaggctgaaccggcaaaggctgctggtttgcctagaagagtccatttatattcacaacattaaagacatgaagctgttgaagaccctcctggatattcctgcaaacccaacaggtctatgtgctctctctatcaaccattccaattcttacctggcctatcctggaagcctgacttcaggggagattgtgctttatgatggaaactccctgaaaacagtctgcactattgctgcccatgagggaacactagctgccatcaccttcaatgcctcaggctccaaactagcaagtgcgtctgaaaaaggcacagtcatccgggtgttctctgtccctgatgggcaaaagctctatgagttccggagagggatgaaaaggtatgtgacaatcagctctctagtgttcagtatggattcacaattcctctgcgcctccagtaacaccgagacggtacacatcttcaagctggaacaggtcaccaacagtcgaccagaagagccttcgacctggagtggctacatgggaaagatgtttatggctgctaccaactacctccctacccaggtgtcagacatgatgcatcaggacagggcttttgccactgcacgcttgaacttctccggacagaggaacatctgtaccctctcaacgatccagaagttgccacggctgctagttgcgtcatccagtggacacctttatatgtacaatttggatcctcaggatggaggagagtgtgtcttaatcaaaacccacagcttgcttggctcaggaacaacagaagagaataaagaaaatgacctcagaccttccttacctcagtcttatgcagcgaccgtagccagaccaagtgcatcttcagcctccacggtgccaggttattctgaggacggcggggcgctgcgaggagaagttattcctgaacatgagtttgcgacgggaccagtgtgtcttgatgatgagaatgagtttcctcctataatcttgtgccgtggaaatcagaagggcaaaacgaagcagtcatgatgagaagcacacctcagaaatcaggacatcccccctatcaggtggttttggagaaaacaaggaaggcggaagaatggagtgcaattgtgtgagcagaaaggggggcaggaatcccgggtgctccactgcttaaaccacaggacctggttaactcctcaccaagcttcccacgaccctggttgccaatgggcgcgggagacattgtatacacatcatgctatttaaaatacgttcaaactatagtgtaaatgctaattaa

SEQ ID NO: 200058 - DNA, 1886 bp, Homo sapiens
  Payload ID: 19464
  Gene Name: WD repeat domain, phosphoinositide interacting 1
  ENST ID: ENST00000589316
  CDS Start-End: 79-1188
cccgtggagccggcgcgggcgggctgctgaggtggctgtcgccggctccgagctgcggcttcccgggccgagcccccgatggaggccgaggccgcggacgctcccccgggcggggttgagtcggcgctcagctgcttctctttcaaccaggactgcacatccctagcaactggaactaaagccgggtataagctgttttctctgagttctgtggagcagctggatcaagtccacggaagcaatgaaatcccggacgtctacatcgtggagcgcctcttctccagcagcctggtggtggtagtcagtcacacaaaaccacggcagatgaacgtgtatcacttcaagaaaggcacagagatctgtaattacagctactccagcaacatcttgtccataaggctgaaccggcaaaggctgctggtttgcctagaagagtccatttatattcacaacattaaagacatgaagctgttgaagaccctcctggatattcctgcaaacccaacaggtctatgtgctctctctatcaaccattccaattcttacctggcctatcctggaagcctgacttcaggggagattgtgctttatgatggaaactccctgaaaacagtctgcactattgctgcccatgagggaacactagctgccatcaccttcaatgcctcaggctccaaactagcaagtgcgtctgaaaaaggcacagtcatccgggtgttctctgtccctgatgggcaaaagctctatgagttccggagagggatgaaaaggtatgtgacaatcagctctctagtgttcagtatggattcacaattcctctgcgcctccagtaacaccgagacggtacacatcttcaagctggaacaggtcaccaacaggcaatcgaccagaagagccttcgacctggagtggctacatgggaaagatgtttatggctgctaccaactacctccctacccaggtgtcagacatgatgcatcaggacagggcttttgccactgcacgcttgaacttctccggacagaggaacatctgtaccctctcaacgatccagaagttgccacggctgctagttgcgtcatccagtggacacctttatatgtacaatttggatcctcaggatggaggagagtgtgtcttaatcaaaacccacagcttgcttggctcaggaacaacagaagagaataaagaaaatgacctcagaccttccttacctcagtcttatgcagcgaccgtagccagaccaagtgcatcttcagcctccacggtgccaggttattctgaggacggcggggcgctgcgaggagaagttattcctgaacatgagtttgcgacgggaccagtgtgtcttgatgatgagaatgagtttcctcctataatcttgtgccgtggaaatcagaagggcaaaacgaagcagtcatgatgagaagcacacctcagaaatcaggacatcccccctatcaggtggttttggagaaaacaaggaaggcggaagaatggagtgcaattgtgtgagcagaaaggggggcaggaatcccgggtgctccactgcttaaaccacaggacctggttaactcctcaccaagcttcccacgaccctggttgccaatgggcgcgggagacattgtatacacatcatgctatttaaaatacgttcaaactatagtgtaaatgctaattaaccatattggtatataaccggaattttatattaaaaggggcctcctttttaaatatatgccgtgtaaaaaatgtacttataggaacatctctttgaattgtatttcttgtatattacatacttagagagagactcttttagccaggcaaagtcttttttggctgtggctggaataaatcatttattacttgggagtcccattttg

SEQ ID NO: 200059 - DNA, 494 bp, Homo sapiens
  Payload ID: 19464
  Gene Name: WD repeat domain, phosphoinositide interacting 1
  ENST ID: ENST00000585393
  CDS Start-End: 1-163
cgtagccagaccaagtgcatcttcagcctccacggtgccaggttattctgaggacggcggggcgctgcgaggagaagttattcctgaacatgagtttgcgacgggaccagtgtgtcttgatgatgagaatgagtttcctcctgtgagcattaggaacccataatcttgtgccgtggaaatcagaagggcaaaacgaagcagtcatgatgagaagcacacctcagaaatcaggacatcccccctatcaggtggttttggagaaaacaaggaaggcggaagaatggagtgcaattgtgtgagcagaaaggggggcaggaatcccgggtgctccactgcttaaaccacaggacctggttaactcctcaccaagcttcccacgaccctggttgccaatgggcgcgggagacattgtatacacatcatgctatttaaaatacgttcaaactatagtgtaaatgctaattaaccatattggtatataaccggaattttat

SEQ ID NO: 200060 - DNA, 624 bp, Homo sapiens
  Payload ID: 19464
  Gene Name: WD repeat domain, phosphoinositide interacting 1
  ENST ID: ENST00000592645
  CDS Start-End: 1-247
agaagagaataaagaaaatgacctcagaccttccttacctcagtcttatgcagcgaccgtagccagaccaagtgcatcttcagcctccacggtgccaggttattctgaggacggcggggcgctgcgaggagaagttattcctgaacatgagtttgcgacgggaccagtgtgtcttgatgatgagaatgagtttcctcctataatcttgtgccgtggaaatcagaagggcaaaacgaagcagtcatgatgagaagcacacctcagaaatcaggacatcccccctatcaggtggttttggagaaaacaaggaaggcggaagaatggagtgcaattgtgggacaggaggaactctttaacttcttttaaatgcagtcatttcacccttaaaaggagaggaaggggattgggccacagacttatccatggactcgtctgctctgagatctggaaaacgacctaactttggtctaaatctgtgctcctcaaggcattgtttgatagaaatgtaggatttcaggatctactcgagccctactgagacggaatccggattctcacaagatcccaggtgatttgtttgcatattaaagatggagaccagtgagtacactggtttgtggaagg

SEQ ID NO: 200061 - DNA, 742 bp, Homo sapiens
  Payload ID: 19464
  Gene Name: WD repeat domain, phosphoinositide interacting 1
  ENST ID: ENST00000591744
  CDS Start-End: 1-618
gtgacaatcagctctctagtgttcagtatggattcacaattcctctgcgcctccagtaacaccgagacggtacacatcttcaagctggaacaggtcaccaacagtcgaccagaagagccttcgacctggagtggctacatgggaaagatgtttatggctgctaccaactacctccctacccaggtgtcagacatgatgcatcaggacagggcttttgccactgcacgcttgaacttctccggacagaggaacatctgtaccctctcaacgatccagaagttgccacggctgctagttgcgtcatccagtggacacctttatatgtacaatttggatcctcaggatggaggagagtgtgtcttaatcaaaacccacagcttgcttggctcaggaacaacagaagagaataaagaaaatgacctcagaccttccttacctcagtcttatgcagcgaccgtagccagaccaagtgcatcttcagcctccacggtgccaggttattctgaggacggcggggcgctgcgaggagaagttattcctgaacatgagtttgcgacgggaccagtgtgtcttgatgatgagaatgagtttcctcctgtgagcattaggaacccgtaactgggcggctcagtctgtgtgcttagaaggaaaccttcgcctcatacgagaggcagagtccctttccctgttttctaatctataacaactaattctctgctctagtatttggaaagccatagga

SEQ ID NO: 200062 - DNA, 4476 bp, Homo sapiens
  Payload ID: 19465
  Gene Name: WD repeat domain, phosphoinositide interacting 2
  Uniprot ID: Q9Y4P8
  ENST ID: ENST00000288828
  CDS Start-End: 233-1597
tgcgccgctcgaggccgtgcgtcgcgggggcggggccgcgcaggcgtaccgggtgccccggctctggagcataaacaagagcggggacgggatgaggcggcggttgatcccagggtggcgagtggcggcgaccgaggcggcgagcggggcccggcgccgaccctgagtgcagcctgacccgccctcgcgcgcgcgccctccccggccgggcccactcgccgcgcgcccagccatgaacctggcgagccagagcggggaggccggcgccggccagctgctcttcgccaacttcaaccaggacaacacagaagtgaaaggggcatcaagagcagctggtcttggccgtcgcgctgttgtctggtccctagctgttggtagtaagtccggttataaatttttctccctttcttctgtggataagctggaacagatctatgaatgcaccgatacggaagatgtgtgcattgtagagagattgttctccagcagcctagtggccatcgtcagccttaaagcaccaaggaagctaaaggtttgccactttaagaagggaactgagatctgcaactacagctactccaacacgattctggctgtgaagctcaacaggcagaggctgatagtatgcctggaggagtccctgtacatccacaacattcgggacatgaaggtgctgcatacgatcagggagacgcctccaaaccctgcaggcctgtgtgcgctgtcaatcaacaacgacaactgctacttggcgtacccagggagcgcgaccatcggagaggtgcaggtcttcgataccattaatttgagagctgcaaacatgattccggctcacgacagtcctttagcggcactggcctttgacgcaagtggaactaaacttgccacggcttcggagaaggggaccgtgattagggtattttccattccagaaggacaaaaactctttgagtttcggagaggagtaaagaggtgcgtgagcatctgctccctggccttcagcatggacggcatgttcctctccgcctccagcaacactgagaccgtgcacatcttcaaactcgagactgtgaaagaaaaacccccagaggagcccaccacctggaccgggtacttcgggaaagtgctcatggcctccaccagctacctgccttcccaagtgacagaaatgttcaaccagggcagagccttcgccacggtccgcctgccattctgcggccacaaaaacatctgctcgctagccacaattcagaagatcccgcggttgttggtgggtgccgccgacgggtacctgtacatgtacaacctggacccccaggagggcggcgagtgtgccctgatgaagcagcaccggctggacggcagtctggaaacgaccaatgagatcttggactctgcctctcacgactgccccttagtcactcagacatacggcgcagctgcaggaaaaggtacttacgtgccttcatccccaacgagacttgcctacacagacgacctgggtgctgtgggtggcgcctgcctggaggacgaggccagcgccctgcgcctggatgaggacagcgagcacccgcccatgattcttcggactgactgaacttgacctgtgacctctgacccggggagcagagaacactggcttcacagaggactttgtgcattgctgctatgaactttgacctgagtcgggggagaggatggcagagactttattaaaaaaaaaaaaagattgtagtggtagtctaactccataacgctgaggaaatacatcattttcacttcagtggcttttaaatcctgcttatgaattttagctttttgtttgtttgttttctctttttgccaaaattaactgtttggtgaagcccgcaaaacctcctcgctttgcatgcatgaacgtgccaagccagcataggggagctagaagccactttccagccacctgccgttgggttttttcatatctgtacataatgccgagtgcgtaaggaaaccgtggcgtcgcgcacagtgggtctgcttgtcaaggccagttctgcagtgacaggcccaggggctgcccaccaggtgtgctgggcagacttcagctgggacagaagtccgatctccctagggccccacctggaccattttccctccgttttattttgttaattaaattctttccaaattggatcgctctgggatttcttccatggtggacttttgtttctgatcttgttttccctgtggatattggaggacagcgaggttctttctgatactaaaaacctttctttcaggcagcaaatgaacttgaaaggttgcctggactcgctggagcaaaggaaagcgattttgtttgtataattaaatgatctgttcttctacttcactcttcctgttgaaaaactgtgtgatttttttttttttttaagtaaagtttgtagctcctcccatgcccaggaaagcacagaactcaagtgtggtggccgtctgagctgtcctttcgctggccccgctgtccgcaggggcttcctacctgtgtgagaggtcgtagcgggagacagcaacagagagtaggcggctgggccacgtccttcacagggcgtcatgtgcctttctattttcatcttagaaaatttcctcagcaaaccgatgagagattgtggttgcaagcttcagtatttgcctcgcttcccttcccttttcatatttacagaattaaaacaacctcaagtacctcagactctgcattccaaaccaaggcacccagcagccaaagtgtcgagggcatttaagtggcattaatggcaggagagatggttttagaatctatggagtggtggaagttacggatagaagggaaaaggcaaaaactatttaccctgcctttgcaggctggggtttttgaaccgaggaaggctgggacgcctgtttccagatggttgtcatggtcacgctgggcgaagagctggaggggagttgtcccctcagctgagcggctgcggtgaaatgccccagtgttcctgggttggctttacggcaaactaaatgcaggggacgctggagtccgactcacctacaccggcttcctcccagccgctggtgtgcggcacacacaacatctgcattaggcagaggtgcaagtgggctgattgaacttttccttcaaaacctgcttgtctgtcctggacctttgatgaaatgggatcccggtcacgcaggctgagacagtggggaccgccgaggccagagtgggctatgcttgagcagggatgagaagggccgcggcagcacgcagccttgacccacgcctgcgtcttgtggtgcaaggccagagggctctctctagaacctgaccgtgcactccatctcctgggagccacttttggcaagagtgagtgtggggggaaaaagtgtgcacaagagatacggaaccctgagctagggtttcctgtcaccaaagagtgagctgcatttccagttctgcgttaaagtatcgtttgttctggtgcctgcctgtggtggtgatttggagactcaaatttcctttgccaggtctcttttgtctttctttgggattggtagtatagaagatgctgggaattgtcttcctcgctcagcctcggcttcccgcactgtaagatgaggcagttgcagaggaggcctcggacgtcctgtgaccctcggcccacactcccccttgggtggccctggcagggctggctaggtgcgttccctgcagaccacgggaagccctgtgcttgcctgggtcagggctaagctgtgcgccctagaggagggaggaggactgcagattcttggtcgagaagaatgaagaggatttctgtgtttgctgagcagccattgtggagggttacccgcctccactttcccgttgcccatttcactgccaccagctcctcttcctctgctcgaacctatgagtcccagcctcactggcggcctcagacatgctcaggagtgacggggacagagggaggccgctgagttgcccgttagaactcttactgctgcgccagtgacccaggtggagagggaccctgaaccaaacagaacgtgtgctaattttccgaactccaaactgtacactcatattcatttttaaattgtatttttccaaacttcaaaaaggacgatgagcgtgggggataggaaacaaaacctgtaaacgttgtgaatgggctcagtggactctgggaccaaaccttctgtaatctctaaaacaatgggaccaagagctggatggaacctggagtcaaaaagaactgcttcagtccccgctgtaccgcctgcctagctgtgggagcaggcagggcgcctgggagcctgcgttttctggaccgttccatgggactcatccctacctcacagggctgttgtgaggtgttgtgtgactgcgtgtcctgcaaacgcccagctcggtgcccagccagcggtgggcacccaataaacgctacaacataaatgtgt

SEQ ID NO: 200063 - DNA, 1948 bp, Homo sapiens
  Payload ID: 19465
  Gene Name: WD repeat domain, phosphoinositide interacting 2
  Uniprot ID: Q9Y4P8
  ENST ID: ENST00000382384
  CDS Start-End: 148-1425
gacgggatgaggcggcggttgatcccagggtggcgagtggcggcgaccgaggcggcgagcggggcccggcgccgaccctgagtgcagcctgacccgccctcgcgcgcgcgccctccccggccgggcccactcgccgcgcgcccagccatgaacctggcgagccagagcggggaggccggcgccggccagctgctcttcgccaacttcaaccaggacaacacgtccctagctgttggtagtaagtccggttataaatttttctccctttcttctgtggataagctggaacagatctatgaatgcaccgatacggaagatgtgtgcattgtagagagattgttctccagcagcctagtggccatcgtcagccttaaagcaccaaggaagctaaaggtttgccactttaagaagggaactgagatctgcaactacagctactccaacacgattctggctgtgaagctcaacaggcagaggctgatagtatgcctggaggagtccctgtacatccacaacattcgggacatgaaggtgctgcatacgatcagggagacgcctccaaaccctgcaggcctgtgtgcgctgtcaatcaacaacgacaactgctacttggcgtacccagggagcgcgaccatcggagaggtgcaggtcttcgataccattaatttgagagctgcaaacatgattccggctcacgacagtcctttagcggcactggcctttgacgcaagtggaactaaacttgccacggcttcggagaaggggaccgtgattagggtattttccattccagaaggacaaaaactctttgagtttcggagaggagtaaagaggtgcgtgagcatctgctccctggccttcagcatggacggcatgttcctctccgcctccagcaacactgagaccgtgcacatcttcaaactcgagactgtgaaagaaaaacccccagaggagcccaccacctggaccgggtacttcgggaaagtgctcatggcctccaccagctacctgccttcccaagtgacagaaatgttcaaccagggcagagccttcgccacggtccgcctgccattctgcggccacaaaaacatctgctcgctagccacaattcagaagatcccgcggttgttggtgggtgccgccgacgggtacctgtacatgtacaacctggacccccaggagggcggcgagtgtgccctgatgaagcagcaccggctggacggcagtctggaaacgaccaatgagatcttggactctgcctctcacgactgccccttagtcactcagacatacggcgcagctgcaggaaaagcctacacagacgacctgggtgctgtgggtggcgcctgcctggaggacgaggccagcgccctgcgcctggatgaggacagcgagcacccgcccatgattcttcggactgactgaacttgacctgtgacctctgacccggggagcagagaacactggcttcacagaggactttgtgcattgctgctatgaactttgacctgagtcgggggagaggatggcagagactttattaaaaaaaaaaaaagattgtagtggtagtctaactccataacgctgaggaaatacatcattttcacttcagtggcttttaaatcctgcttatgaattttagctttttgtttgtttgttttctctttttgccaaaattaactgtttggtgaagcccgcaaaacctcctcgctttgcatgcatgaacgtgccaagccagcataggggagctagaagccactttccagccacctgccgttgggttttttcatatctgtacataatgccgagtgcgtaaggaaaccgtggcgtcgcgcacagtgggtctgcttgtcaaggccagttctgcagtgacaggcccaggggctgcccaccaggtgtgctgggcagacttcagctgggacagaagtccgatctccctagggcccca

SEQ ID NO: 200064 - DNA, 2112 bp, Homo sapiens
  Payload ID: 19465
  Gene Name: WD repeat domain, phosphoinositide interacting 2
  Uniprot ID: Q9Y4P8
  ENST ID: ENST00000401525
  CDS Start-End: 225-1535
tcgaggccgtgcgtcgcgggggcggggccgcgcaggcgtaccgggtgccccggctctggagcataaacaagagcggggacgggatgaggcggcggttgatcccagggtggcgagtggcggcgaccgaggcggcgagcggggcccggcgccgaccctgagtgcagcctgacccgccctcgcgcgcgcgccctccccggccgggcccactcgccgcgcgcccagccatgaacctggcgagccagagcggggaggccggcgccggccagctgctcttcgccaacttcaaccaggacaacacgtccctagctgttggtagtaagtccggttataaatttttctccctttcttctgtggataagctggaacagatctatgaatgcaccgatacggaagatgtgtgcattgtagagagattgttctccagcagcctagtggccatcgtcagccttaaagcaccaaggaagctaaaggtttgccactttaagaagggaactgagatctgcaactacagctactccaacacgattctggctgtgaagctcaacaggcagaggctgatagtatgcctggaggagtccctgtacatccacaacattcgggacatgaaggtgctgcatacgatcagggagacgcctccaaaccctgcaggcctgtgtgcgctgtcaatcaacaacgacaactgctacttggcgtacccagggagcgcgaccatcggagaggtgcaggtcttcgataccattaatttgagagctgcaaacatgattccggctcacgacagtcctttagcggcactggcctttgacgcaagtggaactaaacttgccacggcttcggagaaggggaccgtgattagggtattttccattccagaaggacaaaaactctttgagtttcggagaggagtaaagaggtgcgtgagcatctgctccctggccttcagcatggacggcatgttcctctccgcctccagcaacactgagaccgtgcacatcttcaaactcgagactgtgaaagaaaaacccccagaggagcccaccacctggaccgggtacttcgggaaagtgctcatggcctccaccagctacctgccttcccaagtgacagaaatgttcaaccagggcagagccttcgccacggtccgcctgccattctgcggccacaaaaacatctgctcgctagccacaattcagaagatcccgcggttgttggtgggtgccgccgacgggtacctgtacatgtacaacctggacccccaggagggcggcgagtgtgccctgatgaagcagcaccggctggacggcagtctggaaacgaccaatgagatcttggactctgcctctcacgactgccccttagtcactcagacatacggcgcagctgcaggaaaaggtacttacgtgccttcatccccaacgagacttgcctacacagacgacctgggtgctgtgggtggcgcctgcctggaggacgaggccagcgccctgcgcctggatgaggacagcgagcacccgcccatgattcttcggactgactgaacttgacctgtgacctctgacccggggagcagagaacactggcttcacagaggactttgtgcattgctgctatgaactttgacctgagtcgggggagaggatggcagagactttattaaaaaaaaaaaaagattgtagtggtagtctaactccataacgctgaggaaatacatcattttcacttcagtggcttttaaatcctgcttatgaattttagctttttgtttgtttgttttctctttttgccaaaattaactgtttggtgaagcccgcaaaacctcctcgctttgcatgcatgaacgtgccaagccagcataggggagctagaagccactttccagccacctgccgttgggttttttcatatctgtacataatgccgagtgcgtaaggaaaccgtggcgtcgcgcacagtgggtctgcttgtcaaggccagttctgcagtgacaggcccaggggctgcccaccaggtgtgctgggcagacttcagctgggacagaagtccgatctccctagggccccacctggaccattttccctccgttttattttgttaattaaattctttccaaattgg

SEQ ID NO: 200065 - DNA, 1663 bp, Homo sapiens
  Payload ID: 19465
  Gene Name: WD repeat domain, phosphoinositide interacting 2
  Uniprot ID: Q9Y4P8
  ENST ID: ENST00000404704
  CDS Start-End: 175-1506
cggctctggagcataaacaagagcggggacgggatgaggcggcggttgatcccagggtggcgagtggcggcgaccgaggcggcgagcggggcccggcgccgaccctgagtgcagcctgacccgccctcgcgcgcgcgccctccccggccgggcccactcgccgcgcgcccagccatgaacctggcgagccagagcggggaggccggcgccggccagctgctcttcgccaacttcaaccaggacaacacagaagtgaaaggggcatcaagagcagctggtcttggccgtcgcgctgttgtctggtccctagctgttggtagtaagtccggttataaatttttctccctttcttctgtggataagctggaacagatctatgaatgcaccgatacggaagatgtgtgcattgtagagagattgttctccagcagcctagtggccatcgtcagccttaaagcaccaaggaagctaaaggtttgccactttaagaagggaactgagatctgcaactacagctactccaacacgattctggctgtgaagctcaacaggcagaggctgatagtatgcctggaggagtccctgtacatccacaacattcgggacatgaaggtgctgcatacgatcagggagacgcctccaaaccctgcaggcctgtgtgcgctgtcaatcaacaacgacaactgctacttggcgtacccagggagcgcgaccatcggagaggtgcaggtcttcgataccattaatttgagagctgcaaacatgattccggctcacgacagtcctttagcggcactggcctttgacgcaagtggaactaaacttgccacggcttcggagaaggggaccgtgattagggtattttccattccagaaggacaaaaactctttgagtttcggagaggagtaaagaggtgcgtgagcatctgctccctggccttcagcatggacggcatgttcctctccgcctccagcaacactgagaccgtgcacatcttcaaactcgagactgtgaaagaaaaacccccagaggagcccaccacctggaccgggtacttcgggaaagtgctcatggcctccaccagctacctgccttcccaagtgacagaaatgttcaaccagggcagagccttcgccacggtccgcctgccattctgcggccacaaaaacatctgctcgctagccacaattcagaagatcccgcggttgttggtgggtgccgccgacgggtacctgtacatgtacaacctggacccccaggagggcggcgagtgtgccctgatgaagcagcaccggctggacggcagtctggaaacgaccaatgagatcttggactctgcctctcacgactgccccttagtcactcagacatacggcgcagctgcaggaaaagcctacacagacgacctgggtgctgtgggtggcgcctgcctggaggacgaggccagcgccctgcgcctggatgaggacagcgagcacccgcccatgattcttcggactgactgaacttgacctgtgacctctgacccggggagcagagaacactggcttcacagaggactttgtgcattgctgctatgaactttgacctgagtcgggggagaggatggcagagactttattaaaaaaaaaaaaagattgtagtggtagtctaactccataa

SEQ ID NO: 200066 - DNA, 1504 bp, Homo sapiens
  Payload ID: 19465
  Gene Name: WD repeat domain, phosphoinositide interacting 2
  Uniprot ID: Q9Y4P8
  ENST ID: ENST00000484262
  CDS Start-End: 233-1387
acagaactgactgaaaggaacctttgtctttcgtgtgaatgctcgtgaggggccatccttagagtggaaatgctcctgaggctccagcgaatcaagaccctcagacccccgggctgtccccaccccatgaccacatgttccgcaggcaccctcagcgctgtgccctgcgtgtcgcccaggcaggtgtttgtttttgagcgcagattctgcctgtggccatagccatgtggagatgttcacgcatgtacttccctttgtgatttcagccgatacggaagatgtgtgcattgtagagagattgttctccagcagcctagtggccatcgtcagccttaaagcaccaaggaagctaaaggtttgccactttaagaagggaactgagatctgcaactacagctactccaacacgattctggctgtgaagctcaacaggcagaggctgatagtatgcctggaggagtccctgtacatccacaacattcgggacatgaaggtgctgcatacgatcagggagacgcctccaaaccctgcaggcctgtgtgcgctgtcaatcaacaacgacaactgctacttggcgtacccagggagcgcgaccatcggagaggtgcaggtcttcgataccattaatttgagagctgcaaacatgattccggctcacgacagtcctttagcggcactggcctttgacgcaagtggaactaaacttgccacggcttcggagaaggggaccgtgattagggtattttccattccagaaggacaaaaactctttgagtttcggagaggagtaaagaggtgcgtgagcatctgctccctggccttcagcatggacggcatgttcctctccgcctccagcaacactgagaccgtgcacatcttcaaactcgagactgtgaaagaaaaacccccagaggagcccaccacctggaccgggtacttcgggaaagtgctcatggcctccaccagctacctgccttcccaagtgacagaaatgttcaaccagggcagagccttcgccacggtccgcctgccattctgcggccacaaaaacatctgctcgctagccacaattcagaagatcccgcggttgttggtgggtgccgccgacgggtacctgtacatgtacaacctggacccccaggagggcggcgagtgtgccctgatgaagcagcaccggctggacggcagtctggaaacgaccaatgagatcttggactctgcctctcacgactgccccttagtcactcagacatacggcgcagctgcaggaaaagcctacacagacgacctgggtgctgtgggtggcgcctgcctggaggacgaggccagcgccctgcgcctggatgaggacagcgagcacccgcccatgattcttcggactgactgaacttgacctgtgacctctgacccggggagcagagaacactggcttcacagaggactttgtgcattgctgctatgaactttgacctgagtcgggggagaggatggcagagactttatt

SEQ ID NO: 200067 - DNA, 1535 bp, Homo sapiens
  Payload ID: 19466
  Gene Name: WD repeat, sterile alpha motif and U-box domain containing 1
  Uniprot ID: Q8N9V3
  ENST ID: ENST00000358147
  CDS Start-End: 146-1300
ctgttccctctgctctgggtctccgccggcgcccgccccgccagcctcacctgcgcggcacgtgacccgcaccgcccgtgggcaccttgaaggcggatcccgcgcgcccccgctcctgcaggctgtttttcttcaaataaagaacatggtgaaactgattcacacattagctgatcatggtgacgatgtcaactgctgtgccttctccttttccctcttggctacttgctccttggacaaaacaattcgcctgtactcgttacgtgactttactgaactgccacattctccattgaagtttcatacctatgctgtccactgctgctgtttctccccttcaggacatattttggcatcgtgttcaacagatggtaccactgtcctatggaatactgaaaatggacagatgctggcagtgatggaacagcctagtggcagccctgtgagggtttgccagttttccccagactccacgtgtttggcatcaggggcagctgatggaactgtggttttgtggaatgcacagtcatacaaattatatagatgtggtagtgttaaagatggctccttggcggcatgtgcattttctcctaatggaagcttctttgtcactggctcctcatgtggtgatttaacagtgtgggatgataaaatgaggtgtctgcatagtgaaaaagcacatgatcttggaattacctgctgcgatttttcttcacagccagtttctgatggagaacaaggtcttcagttttttcgactggcatcatgtggtcaggattgccaagtcaaaatttggattgtttcttttacccatatcttagcaaggcgcacagaacatcagctgaagcaatttaccgaagattggtcagaggaggatgtctcaacatggctttgtgcacaagatttaaaagatcttgttggtattttcaagatgaataacattgatggaaaagaactgttgaatcttacaaaagaaagtctggctgatgatttgaaaattgaatctctaggactgcgtagtaaagtgctgaggaaaattgaagagctcaggaccaaggttaaatccctttcttcaggaattcctgatgaatttatatgtccaataactagagaacttatgaaagatccggtcatcgcatcagatggctattcatatgaaaaggaagcaatggaaaattggatcagcaaaaagaaacgtacaagtcccatgacaaatcttgttcttccttcagcggtacttacaccaaataggactctgaaaatggccatcaatagatggctggagacacaccaaaagtaaaattgttgatattgtattatttatattttcagtgatctcatttgaatgatttataggtaaatactaatcagacattattaaaagcaaaacaggaaaaaggtaaacttcttaaatttagttacctataaaaattgtcaattttcattctttaaaaaacacatggacttactataaaagcctttttgtactagtgaaaagaatcttcagctatatagaaataaagttatactttaaa

SEQ ID NO: 200068 - DNA, 1912 bp, Homo sapiens
  Payload ID: 19466
  Gene Name: WD repeat, sterile alpha motif and U-box domain containing 1
  Uniprot ID: Q8N9V3
  ENST ID: ENST00000359774
  CDS Start-End: 242-1672
ggggcctactccctccgctctgggtcacagcgggcgttcggggggcggggcctgttccctccgctctgggtccccgcgggcgttcgggggcggggcctgttccctctgctctgggtctccgccggcgcccgccccgccagcctcacctgcgcggcacgtgacccgcaccgcccgtgggcaccttgaaggcggatcccgcgcgcccccgctcctgcaggctgtttttcttcaaataaagaacatggtgaaactgattcacacattagctgatcatggtgacgatgtcaactgctgtgccttctccttttccctcttggctacttgctccttggacaaaacaattcgcctgtactcgttacgtgactttactgaactgccacattctccattgaagtttcatacctatgctgtccactgctgctgtttctccccttcaggacatattttggcatcgtgttcaacagatggtaccactgtcctatggaatactgaaaatggacagatgctggcagtgatggaacagcctagtggcagccctgtgagggtttgccagttttccccagactccacgtgtttggcatcaggggcagctgatggaactgtggttttgtggaatgcacagtcatacaaattatatagatgtggtagtgttaaagatggctccttggcggcatgtgcattttctcctaatggaagcttctttgtcactggctcctcatgtggtgatttaacagtgtgggatgataaaatgaggtgtctgcatagtgaaaaagcacatgatcttggaattacctgctgcgatttttcttcacagccagtttctgatggagaacaaggtcttcagttttttcgactggcatcatgtggtcaggattgccaagtcaaaatttggattgtttcttttacccatatcttaggttttgaattaaaatataaaagtacactgagtgggcactgtgctcctgttctggcttgtgctttttcccatgatgggcagatgctagtctcagggtcagtggataagtctgtcatagtatatgatactaatactgagaatatacttcacacattgactcagcacaccaggtatgtcacaacttgtgcttttgcacctaatacccttttacttgctactggttcaatggacaaaacagtgaacatctggcaatttgacctggaaacactttgccaagcaaggcgcacagaacatcagctgaagcaatttaccgaagattggtcagaggaggatgtctcaacatggctttgtgcacaagatttaaaagatcttgttggtattttcaagatgaataacattgatggaaaagaactgttgaatcttacaaaagaaagtctggctgatgatttgaaaattgaatctctaggactgcgtagtaaagtgctgaggaaaattgaagagctcaggaccaaggttaaatccctttcttcaggaattcctgatgaatttatatgtccaataactagagaacttatgaaagatccggtcatcgcatcagatggctattcatatgaaaaggaagcaatggaaaattggatcagcaaaaagaaacgtacaagtcccatgacaaatcttgttcttccttcagcggtacttacaccaaataggactctgaaaatggccatcaatagatggctggagacacaccaaaagtaaaattgttgatattgtattatttatattttcagtgatctcatttgaatgatttataggtaaatactaatcagacattattaaaagcaaaacaggaaaaaggtaaacttcttaaatttagttacctataaaaattgtcaattttcattctttaaaaaacacatggacttactataaaagcctttttgtactagtgaaaagaatcttcagctatatagaaataaagttatactttaaattgca

SEQ ID NO: 200069 - DNA, 1812 bp, Homo sapiens
  Payload ID: 19466
  Gene Name: WD repeat, sterile alpha motif and U-box domain containing 1
  Uniprot ID: Q8N9V3
  ENST ID: ENST00000392796
  CDS Start-End: 150-1580
agcggcggtggcggcaggtggggaagcgcggctgggcctgctcgcgcggggcgtctgagccctccatttcccggttctaaccgcgcagcagggcccaaccgggaccttgagtgcggcgaggcgtggctgtttttcttcaaataaagaacatggtgaaactgattcacacattagctgatcatggtgacgatgtcaactgctgtgccttctccttttccctcttggctacttgctccttggacaaaacaattcgcctgtactcgttacgtgactttactgaactgccacattctccattgaagtttcatacctatgctgtccactgctgctgtttctccccttcaggacatattttggcatcgtgttcaacagatggtaccactgtcctatggaatactgaaaatggacagatgctggcagtgatggaacagcctagtggcagccctgtgagggtttgccagttttccccagactccacgtgtttggcatcaggggcagctgatggaactgtggttttgtggaatgcacagtcatacaaattatatagatgtggtagtgttaaagatggctccttggcggcatgtgcattttctcctaatggaagcttctttgtcactggctcctcatgtggtgatttaacagtgtgggatgataaaatgaggtgtctgcatagtgaaaaagcacatgatcttggaattacctgctgcgatttttcttcacagccagtttctgatggagaacaaggtcttcagttttttcgactggcatcatgtggtcaggattgccaagtcaaaatttggattgtttcttttacccatatcttaggttttgaattaaaatataaaagtacactgagtgggcactgtgctcctgttctggcttgtgctttttcccatgatgggcagatgctagtctcagggtcagtggataagtctgtcatagtatatgatactaatactgagaatatacttcacacattgactcagcacaccaggtatgtcacaacttgtgcttttgcacctaatacccttttacttgctactggttcaatggacaaaacagtgaacatctggcaatttgacctggaaacactttgccaagcaaggcgcacagaacatcagctgaagcaatttaccgaagattggtcagaggaggatgtctcaacatggctttgtgcacaagatttaaaagatcttgttggtattttcaagatgaataacattgatggaaaagaactgttgaatcttacaaaagaaagtctggctgatgatttgaaaattgaatctctaggactgcgtagtaaagtgctgaggaaaattgaagagctcaggaccaaggttaaatccctttcttcaggaattcctgatgaatttatatgtccaataactagagaacttatgaaagatccggtcatcgcatcagatggctattcatatgaaaaggaagcaatggaaaattggatcagcaaaaagaaacgtacaagtcccatgacaaatcttgttcttccttcagcggtacttacaccaaataggactctgaaaatggccatcaatagatggctggagacacaccaaaagtaaaattgttgatattgtattatttatattttcagtgatctcatttgaatgatttataggtaaatactaatcagacattattaaaagcaaaacaggaaaaaggtaaacttcttaaatttagttacctataaaaattgtcaattttcattctttaaaaaacacatggacttactataaaagcctttttgtactagtgaaaagaatcttcagctatatagaaataaagttatacttt

SEQ ID NO: 200070 - DNA, 1600 bp, Homo sapiens
  Payload ID: 19466
  Gene Name: WD repeat, sterile alpha motif and U-box domain containing 1
  ENST ID: ENST00000409124
  CDS Start-End: 112-1401
gccccgccagcctcacctgcgcggcacgtgacccgcaccgcccgtgggcaccttgaaggcggatcccgcgcgcccccgctcctgcaggctgtttttcttcaaataaagaacatggtgaaactgattcacacattagctgatcatggtgacgatgtcaactgctgtgccttctccttttccctcttggctacttgctccttggacaaaacaattcgcctgtactcgttacgtgactttactgaactgccacattctccattgaagtttcatacctatgctgtccactgctgctgtttctccccttcaggacatattttggcatcgtgttcaacagatggtaccactgtcctatggaatactgaaaatggacagatgctggcagtgatggaacagcctagtggcagccctgtgagggtttgccagttttccccagactccacgtgtttggcatcaggggcagctgatggaactgtggttttgtggaatgcacagtcatacaaattatatagatgtggtagtgttaaagatggctccttggcggcatgtgcattttctcctaatggaagcttctttgtcactggctcctcatgtggtgatttaacagtgtgggatgataaaatgaggtgtctgcatagtgaaaaagcacatgatcttggaattacctgctgcgatttttcttcacagccagtttctgatggagaacaaggtcttcagttttttcgactggcatcatgtggtcaggattgccaagtcaaaatttggattgtttcttttacccatatcttaggttttgaattaaaatataaaagtacactgagtgggcactgtgctcctgttctggcttgtgctttttcccatgatgggcagatgctagtctcagggtcagtggataagtctgtcatagtatatgatactaatactgagaatatacttcacacattgactcagcacaccaggtatgtcacaacttgtgcttttgcacctaatacccttttacttgctactggttcaatggacaaaacagtgaacatctggcaatttgacctggaaacactttgccaagcaaggcgcacagaacatcagctgaagcaatttaccgaagattggtcagaggaggatgtctcaacatggctttgtgcacaagatttaaaagatcttgttggtattttcaagatgaataacattgatggaaaagaactgttgaatcttacaaaagaaagtctggctgatgatttgaaaattgatggctattcatatgaaaaggaagcaatggaaaattggatcagcaaaaagaaacgtacaagtcccatgacaaatcttgttcttccttcagcggtacttacaccaaataggactctgaaaatggccatcaatagatggctggagacacaccaaaagtaaaattgttgatattgtattatttatattttcagtgatctcatttgaatgatttataggtaaatactaatcagacattattaaaagcaaaacaggaaaaaggtaaacttcttaaatttagttacctataaaaattgtcaattttcattctttaaaaaacacatggacttactataaaagcctttttgtactagtgaaaaga

SEQ ID NO: 200071 - DNA, 1920 bp, Homo sapiens
  Payload ID: 19466
  Gene Name: WD repeat, sterile alpha motif and U-box domain containing 1
  Uniprot ID: Q8N9V3
  ENST ID: ENST00000409990
  CDS Start-End: 258-1688
gctcctgcaggtgagagcggccgcgcccacgggccggctcagcggcggtggcggcaggtggggaagcgcggctgggcctgctcgcgcggggcgtctgagccctccatttcccggttctaaccgcgcagcagggcccaaccgggaccttgagtgcggcgaggcgtggttcgtgcacccttggcccggggctagggcgggcgtgtcggcgtcgggtggaaggaagccccttgcgggctgtttttcttcaaataaagaacatggtgaaactgattcacacattagctgatcatggtgacgatgtcaactgctgtgccttctccttttccctcttggctacttgctccttggacaaaacaattcgcctgtactcgttacgtgactttactgaactgccacattctccattgaagtttcatacctatgctgtccactgctgctgtttctccccttcaggacatattttggcatcgtgttcaacagatggtaccactgtcctatggaatactgaaaatggacagatgctggcagtgatggaacagcctagtggcagccctgtgagggtttgccagttttccccagactccacgtgtttggcatcaggggcagctgatggaactgtggttttgtggaatgcacagtcatacaaattatatagatgtggtagtgttaaagatggctccttggcggcatgtgcattttctcctaatggaagcttctttgtcactggctcctcatgtggtgatttaacagtgtgggatgataaaatgaggtgtctgcatagtgaaaaagcacatgatcttggaattacctgctgcgatttttcttcacagccagtttctgatggagaacaaggtcttcagttttttcgactggcatcatgtggtcaggattgccaagtcaaaatttggattgtttcttttacccatatcttaggttttgaattaaaatataaaagtacactgagtgggcactgtgctcctgttctggcttgtgctttttcccatgatgggcagatgctagtctcagggtcagtggataagtctgtcatagtatatgatactaatactgagaatatacttcacacattgactcagcacaccaggtatgtcacaacttgtgcttttgcacctaatacccttttacttgctactggttcaatggacaaaacagtgaacatctggcaatttgacctggaaacactttgccaagcaaggcgcacagaacatcagctgaagcaatttaccgaagattggtcagaggaggatgtctcaacatggctttgtgcacaagatttaaaagatcttgttggtattttcaagatgaataacattgatggaaaagaactgttgaatcttacaaaagaaagtctggctgatgatttgaaaattgaatctctaggactgcgtagtaaagtgctgaggaaaattgaagagctcaggaccaaggttaaatccctttcttcaggaattcctgatgaatttatatgtccaataactagagaacttatgaaagatccggtcatcgcatcagatggctattcatatgaaaaggaagcaatggaaaattggatcagcaaaaagaaacgtacaagtcccatgacaaatcttgttcttccttcagcggtacttacaccaaataggactctgaaaatggccatcaatagatggctggagacacaccaaaagtaaaattgttgatattgtattatttatattttcagtgatctcatttgaatgatttataggtaaatactaatcagacattattaaaagcaaaacaggaaaaaggtaaacttcttaaatttagttacctataaaaattgtcaattttcattctttaaaaaacacatggacttactataaaagcctttttgtactagtgaaaagaatcttcagctatatagaaataaagttatacttt

SEQ ID NO: 200072 - DNA, 4196 bp, Homo sapiens
  Payload ID: 19467
  Gene Name: WDFY family member 4
  ENST ID: ENST00000265453
  CDS Start-End: 1-3815
agcgagacttccagtccgaggtcctgctttctgctatggaactattccacatgacaagtggaggtgatgcagcgatgttcagagacggcaaagagcctcagccaagtgcagaagctgctgctgccccttctcttgccaacatctcctgcttcacccagaagctggtggagaagctgtacagtgggatgttctcggcagaccccaggcatatcctcctcttcatcctggagcacatcatggtggtcattgagactgcctcttctcaaagggacactgtcctcagcactttatacagcagtttaaataaagtcattctttattgcctatccaagccccagcagtccctctccgaatgcctcggccttctcagcatcctgggctttctgcaggagcactgggatgttgtctttgccacctacaattccaacatcagcttcctcctgtgtctcatgcattgccttttgctactcaatgagagaagttacccagaaggatttggattggagcccaagcctagaatgtctacttatcatcaagtcttcctttccccaaatgaagacgtgaaagaaaaaagagaagacttaccaagtttgagtgatgtccaacacaacatccagaagacagtgcagactctctggcagcagctggtggcacaaaggcagcagaccctggaggatgccttcaagatcgatctctctgtgaaacctggagagagggaagtgaagattgaagaggtcacaccgctctgggaggagacgatgctcaaggcctggcagcattacttagcatctgagaagaagtcactggcaagtcgttcaaatgttgcacaccacagcaaagtcactttgtggagtggaagcctgtcctcagccatgaagctgatgcccgggcggcaggccaaggaccctgagtgcaagacagaggattttgtgtcatgtatagagaactacagaagaagaggacaagagctatatgcatctttatacaaagaccatgtgcaaaggcgaaaatgtggcaacatcaaggcagccaacgcctgggccaggatccaggagcagctttttggggagctgggcttgtggagccagggggaagaaaccaagccctgttccccatgggaactcgactggagagaaggaccagctcgaatgaggaaacgcatcaaacgcttgtctcctttggaggccctgagctcaggaaggcacaaggaaagccaagacaaaaatgatcatatttctcaaacaaatgctgaaaaccaagatgaactgacactgagggaggctgagggcgagccggacgaggtgggggtggactgcacccagctgaccttcttcccagccttacacgaaagtctgcactcagaagacttcttggaactgtgtcgggaaagacaagttattttacaagagcttcttgataaagaaaaggtgacgcagaagttctccctggtgattgtgcagggccacctggtgtcagaaggggtcctgctttttggccaccaacacttctacatctgcgagaacttcacactgtctcccacgggtgatgtctactgtacccgtcactgcttatccaacatcagcgatccgttcattttcaacctgtgcagcaaagacaggtccactgaccattactcgtgccagtgccacagctacgctgacatgcgggagctacggcaggctcgcttcctcctgcaggacatcgccctggagatcttcttccacaatggatattccaagtttcttgtcttctacaacaatgatcggagtaaggcctttaaaagcttctgctctttccaacccagcctgaaggggaaagccacctcggaggacaccctcagtctaaggagataccccggctctgacaggatcatgctgcagaagtggcagaaaagggacatcagcaattttgagtatctcatgtacctcaacaccgcggctgggagaacctgcaatgactacatgcagtacccagtgttcccctgggtcctcgcagactacacctcagagacattgaacttggcaaatccgaagattttccgggatctttcaaagcccatgggggctcagaccaaggaaaggaagctgaaatttatccagaggtttaaagaagttgagaaaactgaaggagacatgactgtccagtgccactactacacccactactcctcggccatcatcgtggcctcctacctggtccggatgccacccttcacccaggccttctgcgctctgcagggcggaagcttcgacgtggcagacagaatgttccacagtgtgaagagcacgtgggagtcggcctccagagagaacatgagtgacgtcagggagctgaccccagagttcttctacctgcctgagttcttaaccaactgcaacggggtagagttcggctgcatgcaggacgggactgtgctaggagacgtgcagctccctccctgggctgatggggaccctcggaaattcatcagcctgcacagaaaggccctggaaagtgactttgtcagtgccaacctccaccattggatagaccttatttttgggtacaagcagcaggggccagccgcagtggatgctgttaatatcttccacccctacttctacggtgacagaatggacctcagcagcatcactgaccccctcatcaaaagcaccatcctggggtttgtcagcaactttggacaggtgcccaaacagctctttaccaaacctcacccagccaggactgcagcagggaagcctctgcctggaaaggatgtctccacccccgtgagcctgcctggccacccacagccctttttctacagcctgcagtcgctgaggccctcccaggtcacggtcaaagatatgtacctcttttctctaggctcagagtcccccaaaggggccattggccacattgtctctactgagaagaccattctggctgtagagaggaacaaagtgctgctgcctcctctctggaacaggaccttcagctggggctttgatgacttcagctgctgcttggggagctacggctccgacaaggtcctgatgacattcgagaacctggctgcctggggccgctgtctgtgcgccgtgtgcccatccccaacaacgattgtcacctctgggaccagcactgtggtgtgtgtgtgggagctcagcatgaccaaaggccgcccgaggggcttgcgcctccggcaggccttgtatggacacacacaggctgtcacgtgcctggcagcgtcagtcaccttcagcctcctggtgagcggctcccaggactgcacctgtatcctgtgggatctggaccacctcacccacgtgacccgcctgcccgcccatcgggaaggcatctcagccatcaccatcagtgacgtctcaggcaccattgtctcctgtgcgggagcacacttgtccctgtggaatgtcaatggacagcccctggccagcatcaccacagcctggggcccagaaggagccataacctgctgctgcctgatggagggcccagcatgggacacaagccagatcatcatcaccgggagtcaagacggcatggtccgggtttggaagactgaggatgtgaagatgtctgttcctggacggccagcaggagaggagcccccggctcagcctccaagcccaagaggccacaagtgggagaagaacctggccttgagtcgagagctggacgttagcattgctttgacagggaagcccagcaaaaccagccccgcagtgactgctctggccgtgtccagaaaccacaccaaactcctggttggtgatgagagggggagaatattctgctggtctgcagatgggtaggaagagagaggcagcagaggctctggcacaacagtgccaggctgagggtggcagaggtgactggggcctgagctctgcctacagaagaaacccccagggcctccttccccacagttctcaaggaagggcctctggcaatcacagctctgcagcccaaccctctccatggccgatgggacttctatgaaaaggatgagcacacacactcggagggctgagcagcacgctggaaactgtgacttggtgatgcccagctgcacacgaaattacacatgactcaccttattaagggctattgcactgaaaaaaaaaaagatgggtcgcttactggaaattattgtattgtctttattttattaaagcaactatgttttaaatgca

SEQ ID NO: 200073 - DNA, 9962 bp, Homo sapiens
  Payload ID: 19467
  Gene Name: WDFY family member 4
  Uniprot ID: Q6ZS81
  ENST ID: ENST00000325239
  CDS Start-End: 28-9582
ctgaattcagatctgctttgccacggcatggaggcagaagatctttcaaaggctgaagacagaaatgaagacccaggttccaaaaatgaagggcagcttgctgctgtgcagcctgatgtcccacatggagggcagtcctccagccccacagctctctgggacatgctggaaaggaagtttctggaataccagcagttgactcacaagagccccattgagcgtcagaagagcctgttgagtcttctccccctattcctaaaggcctgggaacactccgtggggatcatctgctttcccagtctccaaaggctggctgaagacgtgtctgaccagcttgcccagcaactccagaaggcccttgtggggaagcctgcggagcaagctcggttggcagctggacagttgctgtggtggaagggggacgtggatcaggatggctacttgctcctgaagtcagtgtacgtgctcacggggacagactcggagacgctgggcagggttgctgagtctgggcttccagccctgctcctacagtgcctttacctcttctttgtctttcctctggacaaagatgagcttcttgagagtgatcttcaagttcaaaagatgttcgtgcagatgttgctcaatatttgcagtgactctcagggcctggagggactcctctcaggaagtgagctgcagtctctgctgattgccacgacctgccttcgggagcacagctgctgcttctggaaggaacccaccttctgcgtgctaagggcaatctccaaggcccagaacctcagcatcatccagtacctgcaggccacagactgtgtcaggctctccctccagaacctctccaggctcacggacactctccctgcccctgaagtgagcgaggctgtaagcctgatcttgggattcgtgaaggactcctaccccgtctcctcggctctgttcctggagtttgagaattcagagggctatcctctgctgctcaaagtgttacttcggtatgatgggctgacccagagcgaagtggacccgcatctggaggagctccttgggctggtggtgtggctgacaacctgtgggaggtcagagctgaaggtgtttgacagcatcacttaccctcagcttgaaggcttcaagttccatcatgaggcatctggggtgactgttaagaatcttcaggccttccaggtcctacagaatgttttccacaaagccagtgactctgtcctctgcatacaagtcttgtcagtcatcaggaccatgtgggcctggaatgctcgaaacttcttcctgctggagtggaccctgcagcccatctcgcagtttgtagagatcatgcccctgaagccggccccagtgcaggaacacttcttccagcttctagaggccctggtgttcgagctgcactacgtgcctcatgagatcctgcgaaaggtacagcatctgatcaaggagagccctgggccatcctgcaccctcatggccctgcagagcatcctcagcatcgctggtggggaccccctcttcaccgacatcttccgggactcagggctcctgggcctgctactggcacagcttcggaagcaagccaagatcatgaggaagtcaggaaacaaagtgtccactcctggtgttcaggatccagaaagagaactcacctgtgtgatgctgaggattgtagtcacacttctgaaaggctcggtgaggaatgcagttgtcctgaaggaccacggcatggtgcccttcatcaagatcttcctggatgacgagtgctaccgggaggcctcgctcagcatcttggagcagctctcagccatcaacgccgaggagtacatgagcatcattgtgggtgctctatgctcatccactcaaggggagctgcagctgaaactggatctcctgaagtctctgctccggatcctggtgacccccaagggtcgtgctgccttcagagtctccagcgggttcaacgggctgctgtctctgctctctgacctggaaggctccctccaggagcccccgctgcaggcatggggagcagtatcccccagacagaccctggagctggttttgtacactctctgtgctgtgtccgcagcgctgcactgggaccctgtcaatggctacttcttcaggaggaatgggctctttgagaagctggccgaggacctctgcctgctgggctgttttggagccctggaggaagagggcaacctgctgcgctcttgggtggacacaaaggccaggccatttgcagatttgctgggcactgccttttcctccagcggctcactcccaccccggatacagagctgcctccagatccttggctttctggacagcatggccagcggcaccctccacttgcgtggggacctgaaggagtccctgaggaccaagcaggggccggttgtggatgttcagaagggagaaactggcagtgacccccaacgcaacttcaagcagtggccagacctggaggagaggatggatgagggagatgctgcaatcatgcatcccggggtcgtgtgcatcatggtgaggctgctgcctcggttgtaccatgaagatcacccacagctttccgaggagatccagtgctccctggccagtcatatccagtccctggtgaagtcggagaagaaccgccaggtcatgtgcgaagcaggcttgcttgggaccctcatggcctcctgccacagggccctggtcaccagtggcagccccctccactcacgcctcatcaggatctttgagaagctcgcttcccaggccattgaaccggatgtgctaagacagtttctaggtcttggaattccctcatctctgtcggccacaacaaaaatccttgattcatctcacacacacagaggcaaccctgggtgctcagggtcacagactgcacagggcttggctgaggggccctggccagctgccccagatgctgggctgcaccctggagtcacacaggccccgcagcccttgggggaatcccaggattcaactactgctcttcagacggcgctgagcctcatctccatgacctccccacgcaacctgcagcctcagagggcagccctggccccatcgtttgtggaatttgacatgtccgtggaaggttatggctgtttgtttattccaaccctgtccacagttatgggaaccagcactgagtactctgtctctggaggaattgggacaggtgccaccagaccgttccctcctcctggaggtctgaccttctcctgctggttcctgatcagccggcatggagctgccactgagggccacccgctgcgcttcctgacgttggtgcgccacctggccaggactgagcaaccctttgtttgcttctccgtcagcctctgcccagacgacctctccttggttgtttctacagaagagaaggagtttcagcctctggatgtcatggaacctgaggatgactccgagccttctgcaggatgccagcttcaggtcaggtgtggccagctcctggcttgtggtcagtggcatcacttggctgtggttgtcactaaggaaatgaaaaggcattgtacagtttccacctgtctggatggacaggtcattggctctgccaagatgttatacatccaggctctaccagggcctttcctttctatggatccatccgcatttgtggatgtttatggatatattgctactcctcgagtctggaaacaaaagtcttcattaatctggcgtcttggccccacatacctctttgaagaagccatttcaatggaaactctggaagttattaacaaacttggcccaagatattgtggtaacttccaagctgtgcatgtccaaggggaggacctggacagtgaagccacgccctttgttgcagaagaaagagtttcttttggacttcacatagccagctcctctatcaccagtgtagcggacatcagaaatgcttacaatgaggtggacagccgcctgatcgccaaagagatgaacatttcatcccgtgacaatgccatgcccgtgttcttgctgaggaattgtgctggccacctgtcagggtctctgcggaccattggagctgttgctgtgggtcaattaggggtgagggtattccactccagccctgctgccagcagcctggacttcattggcgggcctgccatcctcctgggcctcatctccttagcgacagatgaccataccatgtatgcggctgtgaaagttctgcactcggtcctgaccagtaatgccatgtgtgacttcctgatgcaacacatctgtgggtaccagataatggcgtttctcctgaggaagaaggcctctctcctgaaccatcgaatttttcagctgatcctctcagtggctggcactgtggagctgggcttcaggtcatctgctatcaccaacactggtgtcttccagcacatcctctgcaatttcgagctctggatgaatactgcagacaatctggagctcagcctcttttcccatcttttggaaatccttcaatcaccaagggaaggacccaggaatgctgaagctgcccaccaggcacagcttatacccaagctcatcttcctattcaatgagccgagcctcatcccctccaagatctccaccatcattggcatcctggcctgtcagctgaggggccacttcagcacccaggacttgctcaggattgggctgtttgttgtgtacaccctcaagccttcgtcggtgaatgagaggcagatctgcatggacggagccctggacccttccctgcctgctggaagccaaacatctggaaagacaatctggctcagaaaccagttgctggagatgctgctcagtgtaatatcttccccccagcttcatctgtcctctgagtcaaaggaagagatgtttctgaaactggggcctgactggttcctgctgctcctgcagggccacctgcatgccagcaccactgtgctggcattgaagctgctgctgtactttctggcaagcccctccctccgcacacggtttagagatggcctgtgtgcaggatcctgggtggaacgcagcactgagggcgtggatattgtaatggacaacctgaagagccagtcaccactgcctgagcaaagcccatgcctgcttcctgggttccgtgtcttgaatgactttctggcccaccacgtccacattccagaggtctacctcatcgtctccaccttcttcctgcagacaccactcacagagctgatggacgggcccaaagacagccttgatgccatgcttcagtggctcctgcagaggcaccaccaggaagaagtcctccaggctgggctgtgcacagaaggtgccttgctcctcctggaaatgctgaaggccaccatgagccagcccctggcaggttctgaggatggtgcctgggcacagaccttcccggccagcgtgctgcagttcctcagcctcgtccaccgcacctacccccaggacccagcgtggcgagccccggagttcctccagaccttggccatagccgccttccccctgggagcccaaaagggggttggggctgagtccacccggaacaccagcagtcctgaggccgcagctgaaggcgacagcacagtggagggtctccaggctcccaccaaggcacatcccgcccggaggaagctgagggagttcacgcagctcctcttgagggagctcctgcttggagcctccagccccaagcagtggctgcccctggaggtgctcctggaggcttctccagaccacgccaccagccaacagaagcgagacttccagtccgaggtcctgctttctgctatggaactattccacatgacaagtggaggtgatgcagcgatgttcagagacggcaaagagcctcagccaagtgcagaagctgctgctgccccttctcttgccaacatctcctgcttcacccagaagctggtggagaagctgtacagtgggatgttctcggcagaccccaggcatatcctcctcttcatcctggagcacatcatggtggtcattgagactgcctcttctcaaagggacactgtcctcagcactttatacagcagtttaaataaagtcattctttattgcctatccaagccccagcagtccctctccgaatgcctcggccttctcagcatcctgggctttctgcaggagcactgggatgttgtctttgccacctacaattccaacatcagcttcctcctgtgtctcatgcattgccttttgctactcaatgagagaagttacccagaaggatttggattggagcccaagcctagaatgtctacttatcatcaagtcttcctttccccaaatgaagacgtgaaagaaaaaagagaagacttaccaagtttgagtgatgtccaacacaacatccagaagacagtgcagactctctggcagcagctggtggcacaaaggcagcagaccctggaggatgccttcaagatcgatctctctgtgaaacctggagagagggaagtgaagattgaagaggtcacaccgctctgggaggagacgatgctcaaggcctggcagcattacttagcatctgagaagaagtcactggcaagtcgttcaaatgttgcacaccacagcaaagtcactttgtggagtggaagcctgtcctcagccatgaagctgatgcccgggcggcaggccaaggaccctgagtgcaagacagaggattttgtgtcatgtatagagaactacagaagaagaggacaagagctatatgcatctttatacaaagaccatgtgcaaaggcgaaaatgtggcaacatcaaggcagccaacgcctgggccaggatccaggagcagctttttggggagctgggcttgtggagccagggggaagaaaccaagccctgttccccatgggaactcgactggagagaaggaccagctcgaatgaggaaacgcatcaaacgcttgtctcctttggaggccctgagctcaggaaggcacaaggaaagccaagacaaaaatgatcatatttctcaaacaaatgctgaaaaccaagatgaactgacactgagggaggctgagggcgagccggacgaggtgggggtggactgcacccagctgaccttcttcccagccttacacgaaagtctgcactcagaagacttcttggaactgtgtcgggaaagacaagttattttacaagagcttcttgataaagaaaaggtgacgcagaagttctccctggtgattgtgcagggccacctggtgtcagaaggggtcctgctttttggccaccaacacttctacatctgcgagaacttcacactgtctcccacgggtgatgtctactgtacccgtcactgcttatccaacatcagcgatccgttcattttcaacctgtgcagcaaagacaggtccactgaccattactcgtgccagtgccacagctacgctgacatgcgggagctacggcaggctcgcttcctcctgcaggacatcgccctggagatcttcttccacaatggatattccaagtttcttgtcttctacaacaatgatcggagtaaggcctttaaaagcttctgctctttccaacccagcctgaaggggaaagccacctcggaggacaccctcagtctaaggagataccccggctctgacaggatcatgctgcagaagtggcagaaaagggacatcagcaattttgagtatctcatgtacctcaacaccgcggctgggagaacctgcaatgactacatgcagtacccagtgttcccctgggtcctcgcagactacacctcagagacattgaacttggcaaatccgaagattttccgggatctttcaaagcccatgggggctcagaccaaggaaaggaagctgaaatttatccagaggtttaaagaagttgagaaaactgaaggagacatgactgtccagtgccactactacacccactactcctcggccatcatcgtggcctcctacctggtccggatgccacccttcacccaggccttctgcgctctgcagggcggaagcttcgacgtggcagacagaatgttccacagtgtgaagagcacgtgggagtcggcctccagagagaacatgagtgacgtcagggagctgaccccagagttcttctacctgcctgagttcttaaccaactgcaacggggtagagttcggctgcatgcaggacgggactgtgctaggagacgtgcagctccctccctgggctgatggggaccctcggaaattcatcagcctgcacagaaaggccctggaaagtgactttgtcagtgccaacctccaccattggatagaccttatttttgggtacaagcagcaggggccagccgcagtggatgctgttaatatcttccacccctacttctacggtgacagaatggacctcagcagcatcactgaccccctcatcaaaagcaccatcctggggtttgtcagcaactttggacaggtgcccaaacagctctttaccaaacctcacccagccaggactgcagcagggaagcctctgcctggaaaggatgtctccacccccgtgagcctgcctggccacccacagccctttttctacagcctgcagtcgctgaggccctcccaggtcacggtcaaagatatgtacctcttttctctaggctcagagtcccccaaaggggccattggccacattgtctctactgagaagaccattctggctgtagagaggaacaaagtgctgctgcctcctctctggaacaggaccttcagctggggctttgatgacttcagctgctgcttggggagctacggctccgacaaggtcctgatgacattcgagaacctggctgcctggggccgctgtctgtgcgccgtgtgcccatccccaacaacgattgtcacctctgggaccagcactgtggtgtgtgtgtgggagctcagcatgaccaaaggccgcccgaggggcttgcgcctccggcaggccttgtatggacacacacaggctgtcacgtgcctggcagcgtcagtcaccttcagcctcctggtgagcggctcccaggactgcacctgtatcctgtgggatctggaccacctcacccacgtgacccgcctgcccgcccatcgggaaggcatctcagccatcaccatcagtgacgtctcaggcaccattgtctcctgtgcgggagcacacttgtccctgtggaatgtcaatggacagcccctggccagcatcaccacagcctggggcccagaaggagccataacctgctgctgcctgatggagggcccagcatgggacacaagccagatcatcatcaccgggagtcaagacggcatggtccgggtttggaagactgaggatgtgaagatgtctgttcctggacggccagcaggagaggagcccccggctcagcctccaagcccaagaggccacaagtgggagaagaacctggccttgagtcgagagctggacgttagcattgctttgacagggaagcccagcaaaaccagccccgcagtgactgctctggccgtgtccagaaaccacaccaaactcctggttggtgatgagagggggagaatattctgctggtctgcagatgggtaggaagagagaggcagcagaggctctggcacaacagtgccaggctgagggtggcagaggtgactggggcctgagctctgcctacagaagaaacccccagggcctccttccccacagttctcaaggaagggcctctggcaatcacagctctgcagcccaaccctctccatggccgatgggacttctatgaaaaggatgagcacacacactcggagggctgagcagcacgctggaaactgtgacttggtgatgcccagctgcacacgaaattacacatgactcaccttattaagggctattgcactgaaaaaaaaaaagatgggtcgcttactggaaattattgtattgtctttattttattaaagcaactatgttttaaatgc

SEQ ID NO: 200074 - DNA, 2193 bp, Homo sapiens
  Payload ID: 19467
  Gene Name: WDFY family member 4
  Uniprot ID: Q6ZS81
  ENST ID: ENST00000360890
  CDS Start-End: 144-2108
gtgaaacggcgctgaggactgacgatgtggggccgggtcctcttcccccgagcctgaggggctgcagctggggatagggggcccatgccttctgatgtctacaggcgctgacggccacccctccagatctgctttgccacggcatggaggcagaagatctttcaaaggctgaagacagaaatgaagacccaggttccaaaaatgaagggcagcttgctgctgtgcagcctgatgtcccacatggagggcagtcctccagccccacagctctctgggacatgctggaaaggaagtttctggaataccagcagttgactcacaagagccccattgagcgtcagaagagcctgttgagtcttctccccctattcctaaaggcctgggaacactccgtggggatcatctgctttcccagtctccaaaggctggctgaagacgtgtctgaccagcttgcccagcaactccagaaggcccttgtggggaagcctgcggagcaagctcggttggcagctggacagttgctgtggtggaagggggacgtggatcaggatggctacttgctcctgaagtcagtgtacgtgctcacggggacagactcggagacgctgggcagggttgctgagtctgggcttccagccctgctcctacagtgcctttacctcttctttgtctttcctctggacaaagatgagcttcttgagagtgatcttcaagttcaaaagatgttcgtgcagatgttgctcaatatttgcagtgactctcagggcctggagggactcctctcaggaagtgagctgcagtctctgctgattgccacgacctgccttcgggagcacagctgctgcttctggaaggaacccaccttctgcgtgctaagggcaatctccaaggcccagaacctcagcatcatccagtacctgcaggccacagactgtgtcaggctctccctccagaacctctccaggctcacggacactctccctgcccctgaagtgagcgaggctgtaagcctgatcttgggattcgtgaaggactcctaccccgtctcctcggctctgttcctggagtttgagaattcagagggctatcctctgctgctcaaagtgttacttcggtatgatgggctgacccagagcgaagtggacccgcatctggaggagctccttgggctggtggtgtggctgacaacctgtgggaggtcagagctgaaggtgtttgacagcatcacttaccctcagcttgaaggcttcaagttccatcatgaggcatctggggtgactgttaagaatcttcaggccttccaggtcctacagaatgttttccacaaagccagtgactctgtcctctgcatacaagtcttgtcagtcatcaggaccatgtgggcctggaatgctcgaaacttcttcctgctggagtggaccctgcagcccatctcgcagtttgtagagatcatgcccctgaagccggccccagtgcaggaacacttcttccagcttctagaggccctggtgttcgagctgcactacgtgcctcatgagatcctgcgaaaggtacagcatctgatcaaggagagccctgggccatcctgcaccctcatggccctgcagagcatcctcagcatcgctggtggggaccccctcttcaccgacatcttccgggactcagggctcctgggcctgctactggcacagcttcggaagcaagccaagatcatgaggaagtcaggaaacaaagtgtccactcctggtgttcaggatccagaaagagaactcacctgtgtgatgctgaggattgtagtcacacttctgaaaggctcggtgaggaatgcagttgtcctgaaggaccacggcatggtgcccttcatcaagatcttcctggatgacgagtgctaccgggaggcctcgctcagcatcttggagcagctctcagccatcaacgccgaggagtacatgagcatcattgtgggtgctctatgctcatccactcaaggggagctgcagctgaaactggatctcctgaaggtgatttcaagtcctcctttgagattggcttccctgtggatatgcaccaagcgatccacatttgctcaggcatttgtattcatgtaattcagttagccactgtatgtggcaggcagtaccctgtattaggtagcgtcaggtgctgtaacaaataaatcccatatcctcagta

SEQ ID NO: 200075 - DNA, 2609 bp, Homo sapiens
  Payload ID: 19467
  Gene Name: WDFY family member 4
  ENST ID: ENST00000374161
  CDS Start-End: 1-1657
agatgacactgtggtttgggctgaagaatgtgttgcctgcgcaaattggctctggatgaatactgcagacaatctggagctcagcctcttttcccatcttttggaaatccttcaatcaccaagggaaggacccaggaatgctgaagctgcccaccaggcacagcttatacccaagctcatcttcctattcaatgagccgagcctcatcccctccaagatctccaccatcattggcatcctggcctgtcagctgaggggccacttcagcacccaggacttgctcaggattgggctgtttgttgtgtacaccctcaagccttcgtcggtgaatgagaggcagatctgcatggacggagccctggacccttccctgcctgctggaagccaaacatctggaaagacaatctggctcagaaaccagttgctggagatgctgctcagtgtaatatcttccccccagcttcatctgtcctctgagtcaaaggaagagatgtttctgaaactggggcctgactggttcctgctgctcctgcagggccacctgcatgccagcaccactgtgctggcattgaagctgctgctgtactttctggcaagcccctccctccgcacacggtttagagatggcctgtgtgcaggatcctgggtggaacgcagcactgagggcgtggatattgtaatggacaacctgaagagccagtcaccactgcctgagcaaagcccatgcctgcttcctgggttccgtgtcttgaatgactttctggcccaccacgtccacattccagaggtctacctcatcgtctccaccttcttcctgcagacaccactcacagagctgatggacgggcccaaagacagccttgatgccatgcttcagtggctcctgcagaggcaccaccaggaagaagtcctccaggctgggctgtgcacagaaggtgccttgctcctcctggaaatgctgaaggccaccatgagccagcccctggcaggttctgaggatggtgcctgggcacagaccttcccggccagcgtgctgcagttcctcagcctcgtccaccgcacctacccccaggacccagcgtggcgagccccggagttcctccagaccttggccatagccgccttccccctgggagcccaaaagggggttggggctgagtccacccggaacaccagcagtcctgaggccgcagctgaaggcgacagcacagtggagggtctccaggctcccaccaaggcacatcccgcccggaggaagctgagggagttcacgcagctcctcttgagggagctcctgcttggagcctccagccccaagcagtggctgcccctggaggtgctcctggaggcttctccagaccacgccaccagccaacagaagcgagacttccagtccgaggtcctgctttctgctatggaactattccacatgacaagtggaggtgatgcagcgatgttcagagacggcaaagagcctcagccaagtgcagaagctgctgctgccccttctcttgccaacatctcctgcttcacccagaagctggtggagaagctgtacagtgggatgttctcggcagaccccaggcatatcctcctcttcatcctggagcacatcatggtgatctcagccccattacaagctagagacttttcctgacaagcctccaggaaacctttgctcaaaccctccctgtgatggggaaccccctaaaattcaagttgtcccacccagggggatgtctgtgattcttggaaagaactttctgttatcaagctgggatctacctccagcaactcctgccagcagtcctggttatgccctctgcagcagaattaggaggaccactctccttcctcttcacatctcatagagagtgaaattggctcccagcacccttctgactgcagagtcacccacagacctcaggactgggcctcttcacagtttctagagccatcttcacttgtctgatgagcaggtccaagcaaacctggaaagacttgaattcaaaggcttcttcaggaacaactccaagagaggagaaatagcccttgtcagctctgtgagggttaaaatcagattcctggcaagttgtgttgtaaatggaaagaagctgctgagctccctatggctaaagcatggactcccagctaatatcccaaacataggtgccagtgggggccaccgtgctttcagggggaccaggcctgagggctcggctccccacatatccaccagcctcctctcttgcttgctgtctgtgatgcctgcccctcttaacctctgtttgagacccatctgaggagcaggagaggaacatgataaagaaatgaatcccaaaccccaacaggtttaaacagaccttcacttcatgagtagaaacattgcgttacctgtgaaattctaagggagtagcctataacaaattcattttctatcggactgaaaaactttgtgcatactctttgtattatggattcttttcatggaagccaaacagatgtttggagatgtatggaccagtccatgctaaggctacaaatcagggtcttctacttctccctctaagtttcttttgaattaaaatcttctggactccgtctccagt

SEQ ID NO: 200076 - DNA, 1349 bp, Homo sapiens
  Payload ID: 19468
  Gene Name: WDYHV motif containing 1
  Uniprot ID: Q96HA8
  ENST ID: ENST00000287387
  CDS Start-End: 126-743
cctctccccccgggctccgcccaccccacgccgggaacccacgcgggccactacaagcccgccctttcctacgtctggtccagtcggtcttcctccggcccgggccctggcccagctagccggccatggaaggtaatggccccgctgctgtccactaccagccggccagccccccgcgggacgcctgcgtctacagcagctgctactgtgaagaaaatatttggaagctctgtgaatacatcaaaaaccatgaccagtatcctttagaagaatgttatgctgtcttcatatctaatgagaggaagatgatacctatctggaaacaacaggcgagacctggagatggacctgtgatctgggattaccatgttgttttgcttcatgtttcaagtggaggacagaacttcatttatgatctcgatactgtcttgccatttccctgcctctttgacacttatgtagaagatgcctttaagtctgatgatgacattcacccacagtttaggaggaaatttagagtgatccgtgcagattcatatttgaagaactttgcttctgaccgatctcacatgaaagactccagtgggaattggagagagcctccgccgccatatccctgcattgagactggagattccaaaatgaacctgaacgatttcatcagtatggatcccaaggtaggatggggcgccgtctacacactatccgaatttacacatcggtttggcagtaaaaactgctgaacttggtctcaagatgtggaactgtggagaaattctaggacatgaacaagctatcctttcatcgaggacagcaaacattatggtacagttggcttggaattatgtctttctcttttaatttgattgagtggaaatctgagtgaatacaaatataaatgaacaacataaaaacttttgttttgacatgtcaaattgaaacttgataaagtgcgtacttgctaagatattcctgtggctcatgcgttacaacacgaggacttaagccagtaatcgtttttgttcagatagaggtgtggaggtagagccagcccctcatgtctgttttggatgttttgtgtctctccagctacattgtaagttccttgagggcagggccatggcccattgctctgtgaatctcaaatgcccataaaaggtgcccataaaatgttttcttgaacatttgaatgtgctgttgtctggaaaggggtaatattgtgagctgaatcagcaataagtattagtctttttggactatggtattgttaaaaagactgcagccctctcagacttgagcgttaattggcttatttatttatggctttaaataaaatcgatttaacgtta

SEQ ID NO: 200077 - DNA, 869 bp, Homo sapiens
  Payload ID: 19468
  Gene Name: WDYHV motif containing 1
  ENST ID: ENST00000523356
  CDS Start-End: 38-628
cttcctccggcccgggccctggcccagctagccggccatggaaggtaatggccccgctgctgtccactaccagccggccagccccccgcgggacgcctgcgtctacagcagctgctactgtgaagaaaatatttggaagctctgtgaatacatcaaaaaccatgaccagtatcctttagaagaatgttatgctgtcttcatatctaatgagaggaagatgatacctatctggaaacaacaggcgagacctggagatggacctgtgatctgggattaccatgttgttttgcttcatgtttcaagtggaggacagaacttcatttatgatctcgatactgtcttgccatttccctgcctctttgacacttatgtagaagatgcctttaagtctgatgatgacattcacccacagtttaggaggaaatttagagtgatccgtgcagattcatatttgaagaactttgcttctgaccgatctcacatgaaagactccagtgggaattggagagagcctccgccgccatatccctgcattgagactggaggcatcaatccagttgataatttcctgacatttaagaagataaagggtccttcaccctattactattgtttggcattcatatgagtttgaagtattatttacgtttattccaaaatgaacctgaacgatttcatcagtatggatcccaaggtaggatggggcgccgtctacacactatccgaatttacacatcggtttggcagtaaaaactgctgaacttggtctcaagatgtggaactgtggagaaattctaggacatgaacaagctatcctttcatcgaggacagcaaacattatggtacagttggcttggaattatgtcttt

SEQ ID NO: 200078 - DNA, 880 bp, Homo sapiens
  Payload ID: 19468
  Gene Name: WDYHV motif containing 1
  ENST ID: ENST00000518125
  CDS Start-End: 101-274
aaacaacaggcgagacctggagatggacctgtgatctgggaaatttagagtgatccgtgcagattcatatttgaagaactttgcttctgaccgatctcacatgaaagactccagtgggaattggagagagcctccgccgccatatccctgcattgagactggagattccaaaatgaacctgaacgatttcatcagtatggatcccaaggtaggatggggcgccgtctacacactatccgaatttacacatcggtttggcagtaaaaactgctgaacttggtctcaagatgtggaactgtggagaaattctaggacatgaacaagctatcctttcatcgaggacagcaaacattatggtacagttggcttggaattatgtctttctcttttaatttgattgagtggaaatctgagtgaatacaaatataaatgaacaacataaaaacttttgttttgacatgtcaaattgaaacttgataaagtgcgtacttgctaagatattcctgtggctcatgcgttacaacacgaggacttaagccagtaatcgtttttgttcagatagaggtgtggaggtagagccagcccctcatgtctgttttggatgttttgtgtctctccagctacattgtaagttccttgagggcagggccatggcccattgctctgtgaatctcaaatgcccataaaaggtgcccataaaatgttttcttgaacatttgaatgtgctgttgtctggaaaggggtaatattgtgagctgaatcagcaataagtattagtctttttggactatggtattgttaaaaagactgcagccctctcagacttgagcgttaattggcttatttatttatggctttaaataaaatcgatttaacgtta

SEQ ID NO: 200079 - DNA, 949 bp, Homo sapiens
  Payload ID: 19468
  Gene Name: WDYHV motif containing 1
  ENST ID: ENST00000519199
  CDS Start-End: 1-191
ggtccagtcggtcttcctccggcccgggccctggcccagctagccggccatggaaggtaatggccccgctgctgtccactaccagccggccagccccccgcgggacgcctgcgtctacagcagctgctactgtgaagaaaatatttggaagctctgtgaatacatcaaaaaccatgaccagtatcctttagaagaatgttatgctgtcttcatatctaatgagaggaagatgatacctatctggaaacaacaggcgagacctggagatggacctgtgatctgggctgacccccagaagcctcctttgttactagtttggagcagatccttgcagacgttttcctctgcattcacatgcatgcaaatgtacttctgaatgcgcacgattaccatgttgttttgcttcatgtttcaagtggaggacagaacttcatttatgatctcgatactgtcttgccatttccctgcctctttgacacttatgtagaagatgcctttaagtctgatgatgacattcacccacagtttaggaggaaatttagagtgatccgtgcagattcatatttgaagaactttgcttctgaccgatctcacatgaaagactccagtgggaattggagagagcctccgccgccatatccctgcattgagactggagattccaaaatgaacctgaacgatttcatcagtatggatcccaaggtaggatggggcgccgtctacacactatccgaatttacacatcggtttggcagtaaaaactgctgaacttggtctcaagatgtggaactgtggagaaattctaggacatgaacaagctatcctttcatcgaggacagcaaacattatggtacagttggcttggaattatgtctttctcttttaatttgattgagtggaaatctgagtgaatacaaatataaatgaacaacataaaaacttttgtttt

SEQ ID NO: 200080 - DNA, 1491 bp, Homo sapiens
  Payload ID: 19468
  Gene Name: WDYHV motif containing 1
  Uniprot ID: Q96HA8
  ENST ID: ENST00000523984
  CDS Start-End: 229-666
ctctccccccgggctccgcccaccccacgccgggaacccacgcgggccactacaagcccgccctttcctacgtctggtccagtcggtcttcctccggcccgggccctggcccagctagccggccatggaagtgaagaaaatatttggaagctctgtgaatacatcaaaaaccatgaccagtatcctttagaagaatgttatgctgtcttcatatctaatgagaggaagatgatacctatctggaaacaacaggcgagacctggagatggacctgtgatctgggattaccatgttgttttgcttcatgtttcaagtggaggacagaacttcatttatgatctcgatactgtcttgccatttccctgcctctttgacacttatgtagaagatgcctttaagtctgatgatgacattcacccacagtttaggaggaaatttagagtgatccgtgcagattcatatttgaagaactttgcttctgaccgatctcacatgaaagactccagtgggaattggagagagcctccgccgccatatccctgcattgagactggagattccaaaatgaacctgaacgatttcatcagtatggatcccaaggtaggatggggcgccgtctacacactatccgaatttacacatcggtttggcagtaaaaactgctgaacttggtctcaagatgtggaactgtggagaaattctaggacatgaacaagctatcctttcatcgaggacagcaaacattatggtacagttggcttggaattatgtctttctcttttaatttgattgagtggaaatctgagtgaatacaaatataaatgaacaacataaaaacttttgttttgacatgtcaaattgaaacttgataaagtgcgtacttgctaagatattcctgtggctcatgcgttacaacacgaggacttaagccagtaatcgtttttgttcagatagaggtgtggaggtagagccagcccctcatgtctgttttggatgttttgtgtctctccagctacattgtaagttccttgagggcagggccatggcccattgctctgtgaatctcaaatgcccataaaaggtgcccataaaatgttttcttgaacatttgaatgtgctgttgtctggaaaggggtaatattgtgagctgaatcagcaataagtattagtctttttggactatggtattgttaaaaagactgcagccctctcagacttgagcgttaattggcttatttatttatggctttaaataaaatcgatttaacgttagttttgttttgaagatttttgtgtcacccttgatgatctgaaatacctaaatatgcctcaattgtagatgagaaccagggctttaaaaaatatttattacatgtgccttctggaagacatcttggttatttggctttaatcatatcattccaaatgaaagatatttggcattacattggcatatagtaccagctctcatgttttcatgattctacttta

SEQ ID NO: 200081 - DNA, 341 bp, Homo sapiens
  Payload ID: 19468
  Gene Name: WDYHV motif containing 1
  ENST ID: ENST00000522194
  CDS Start-End: 80-341
gccactacaagcccgccctttcctacgtctggtccagtcggtcttcctccggcccgggccctggcccagctagccggccatggaaggtaatggccccgctgctgtccactaccagccggccagccccccgcgggacgcctgcgtctacagcagctgctactgtgaagaaaatatttggaagctctgtgaatacatcaaaaaccatgaccagtatcctttagaagaatgttatgctgtcttcatatctaatgagaggaagatgatacctatctggaaacaacaggcgagacctggagatggacctgtgatctgggtaagacagttaatacagagagtattga

SEQ ID NO: 200082 - DNA, 3436 bp, Homo sapiens
  Payload ID: 19469
  Gene Name: WEE1 G2 checkpoint kinase
  Uniprot ID: P30291
  ENST ID: ENST00000299613
  CDS Start-End: 756-2054
atgtaactgaacaatgggcctcgtctggaacttcatcttacaaaggggccgatcggcccgtccgggtggccaaggatttgccgcccgttgagtccgggccgccccgagcgtgtcagccccgagtgcggcaccgataacgcggttcgcgaggatgctggagggtgccggcccggccacctgacactcccgagccataggatgccttttaaacgcggcgatcgggcctgtaatttgggcggcgcgggcagaaggagtttaaagaaaaataattgtcccgccctgatcgtgtcgtgtcgtgtggcgtggatgggggaaaggtctggggcatgcagggagactacgcttggacttgggagtaaaggctggccttccaagcatttacagtcctacagactcatcctaagtccaggcagtactgaggcctgtttctggacaaggtcttggcccagcatttgtttttatcgtgggtttgcggtgcccagagtttggccggcctccgtgtgattaggaacatcctaccgtagataaggtatcttaaagaaggaggtgttcagcacctgtgttttgaaaggccttcgagtactgcgcagatgaccacttttaaaactgcagattttaaagctgatacttccagagattaagacaagcctcgcatttgtaaggttaacagggaagatgcaccttttaaaagtttgctctccaaagctcggggaattgattccagctctgttaaactccggggtagttctctcttcatggatacagaaaaatcaggaaaaagggaatttgatgtgcgacagactcctcaagtgaatattaatccttttactccggattctttgttgcttcattcctcaggacagtgtcgtcgtagaaagagaacgtattggaatgattcctgtggtgaagacatggaagccagtgattatgagcttgaagatgaaacaagacctgctaagagaattacaattactgaaagcaatatgaagtcccggtatacaacagaatttcatgagctagagaaaatcggctctggagaatttggttctgtatttaagtgtgtgaagaggctggatggatgcatttatgccattaagcgatcaaaaaagccattggcgggctctgttgatgagcagaacgctttgagagaagtatatgctcatgcagtgcttggacagcattctcatgtagttcgatatttctctgcgtgggcagaagatgatcatatgcttatacagaatgaatattgtaatggtggaagtttagctgatgctataagtgaaaactacagaatcatgagttactttaaagaagcagagttgaaggatctccttttgcaagttggccgaggcttgaggtatattcattcaatgtctttggttcacatggatataaaacctagtaatattttcatatctcgaacctcaatcccaaatgctgcctctgaagaaggagacgaagatgattgggcatccaacaaagttatgtttaaaataggtgatcttgggcatgtaacaaggatctccagtccacaagttgaagagggcgatagtcgttttcttgcaaatgaagttttacaggagaattatacccatctaccaaaagcagatatttttgcgcttgccctcacagtggtatgtgctgctggtgctgaacctcttccgagaaatggagatcaatggcatgaaatcagacagggtagattacctcggataccacaagtgctttcccaagaatttacagagttgctaaaagttatgattcatccagatccagagagaagaccttcagcaatggcactggtaaagcattcagtattgctgtccgcttctagaaagagtgcagaacaattacgaatagaattgaatgccgaaaagttcaaaaattcacttttacaaaaagaactcaagaaagcacagatggcaaaagctgcagctgaggaaagagcactcttcactgaccggatggccactaggtccaccacccagagtaatagaacatctcgacttattggaaagaaaatgaaccgctctgtcagccttactatatactgagctactcctttcccacctccccctgaacactgtgacaagaggaagctaggttgaaatcactgatagaatccagtttgcaattactttctcgattggtgtcagtagttttactgattaggacttttattgtgaattacagttgaaagctgtattttgatgattgctatgtcaggctttcatctaatcttaccagtctgtcttctgtaggatgtgtcactgttggatgttacaccagcctttccagggttaaccactgtggtggtgtgctgcttatagtttgctgttgcattgtaataaaaggtgtctttccctgtagtgacctgtaaaaagtactcaagggctttattacagacataccctccctttgaaaagggacatgctaaaagactcattactactcagccttcaatgtacctgtgtgtccatcttatatttcttttttttttaattgtgaattagacttgtatatcccactgggagcactttgtaggcattgcatgaaccatgggatgatgattctgtggaggtattgccttgtgaatttgctgctattttagttttgtctttgctgtaaacttgtagcattaaacaatcattgttgttaataggtcttctttttgaaacaattatgtgaaatgtatagctgcttttgatgaaaagcagctatttgcctttttttttttttcctttgaactttgaagctagtgcattggaaaaatgcaccctttccctcctttggaatgctgtattaatgtagtataataattactggttttgtaacttgttctggtaatgtccttcccggactctttttaaatgtctccccctaagttttatacttgattgtattattagtctgtttttaaatgttttgcccggtttttctcttcaatatttgtgtatataaaccgatcttcgtgatactgtacatagctgtttgaaatgccagaatgacttctgacattccaagtttttcacaaaatatattttatctgtgattagccatttgactaataatactggctaacagatgttgaaaaaaattgtctgtttgttttctcattaattttggtctaaaacatgtttgcacttgtctttgacttgtgttttattaacattgattggcatattaaaagtcactctgagcttaccttaattgtctaaatccttgtgatgcctgttttctaatattttatctctattattgctatactataaaatgtatagtgtgtataatgtactattataaaagcagagggcacattttgattgaatatgaatatcacattgcatgttatgcatgtgacttgctagaaatgtagcatgatgtaatttaaaatatcttcaaattattaagtgaatataatatgattcataacttt

SEQ ID NO: 200083 - DNA, 2799 bp, Homo sapiens
  Payload ID: 19469
  Gene Name: WEE1 G2 checkpoint kinase
  Uniprot ID: P30291
  ENST ID: ENST00000450114
  CDS Start-End: 254-2194
ctgagactggacctgaggagacctcagcctcggtgctcgggccgccccgcctctgccggaaagtccgcgccgccgctgccgccaccgtccgcagcccgagcgccccggagccgcaggccgccgccgcgcagagacgccgcggctgcgactaggcgcgcccagccgcacgtggcggacccgcccccaggcccgcagtgtcctggaccccgcaggcctccgctctcctgtcctcggccccgtccccagggccgcgatgagcttcctgagccgacagcagccgccgccaccccgccgcgccggggcggcctgcaccttgcggcagaagctgatcttctcgccctgcagcgactgtgaggaggaggaagaagaggaggaggaggagggcagcggccacagcaccggggaggactcggcctttcaagagcccgactcgccgctgccgcccgcgcggagccccacggagcccgggcccgagcgccgccgctcgcccgggccggcccccggcagccccggcgagctggaggaggacctgttgctgcccggcgcctgcccgggcgcggacgaggcgggcggtggggcggagggcgactcgtgggaggaggagggcttcggctcctcgtcgccggtcaagtcgccggcggccccctacttcctgggtagctctttctcgccggtgcgctgcggcggcccaggagatgcgtcgccgcggggttgcggggcgcgccgggcgggcgaaggccgccgctcgccgcggccggaccacccgggcaccccgccacacaagaccttccgcaagctgcgactcttcgacaccccgcacacgcccaagagtttgctctccaaagctcggggaattgattccagctctgttaaactccggggtagttctctcttcatggatacagaaaaatcaggaaaaagggaatttgatgtgcgacagactcctcaagtgaatattaatccttttactccggattctttgttgcttcattcctcaggacagtgtcgtcgtagaaagagaacgtattggaatgattcctgtggtgaagacatggaagccagtgattatgagcttgaagatgaaacaagacctgctaagagaattacaattactgaaagcaatatgaagtcccggtatacaacagaatttcatgagctagagaaaatcggctctggagaatttggttctgtatttaagtgtgtgaagaggctggatggatgcatttatgccattaagcgatcaaaaaagccattggcgggctctgttgatgagcagaacgctttgagagaagtatatgctcatgcagtgcttggacagcattctcatgtagttcgatatttctctgcgtgggcagaagatgatcatatgcttatacagaatgaatattgtaatggtggaagtttagctgatgctataagtgaaaactacagaatcatgagttactttaaagaagcagagttgaaggatctccttttgcaagttggccgaggcttgaggtatattcattcaatgtctttggttcacatggatataaaacctagtaatattttcatatctcgaacctcaatcccaaatgctgcctctgaagaaggagacgaagatgattgggcatccaacaaagttatgtttaaaataggtgatcttgggcatgtaacaaggatctccagtccacaagttgaagagggcgatagtcgttttcttgcaaatgaagttttacaggagaattatacccatctaccaaaagcagatatttttgcgcttgccctcacagtggtatgtgctgctggtgctgaacctcttccgagaaatggagatcaatggcatgaaatcagacagggtagattacctcggataccacaagtgctttcccaagaatttacagagttgctaaaagttatgattcatccagatccagagagaagaccttcagcaatggcactggtaaagcattcagtattgctgtccgcttctagaaagagtgcagaacaattacgaatagaattgaatgccgaaaagttcaaaaattcacttttacaaaaagaactcaagaaagcacagatggcaaaagctgcagctgaggaaagagcactcttcactgaccggatggccactaggtccaccacccagagtaatagaacatctcgacttattggaaagaaaatgaaccgctctgtcagccttactatatactgagctactcctttcccacctccccctgaacactgtgacaagaggaagctaggttgaaatcactgatagaatccagtttgcaattactttctcgattggtgtcagtagttttactgattaggacttttattgtgaattacagttgaaagctgtattttgatgattgctatgtcaggctttcatctaatcttaccagtctgtcttctgtaggatgtgtcactgttggatgttacaccagcctttccagggttaaccactgtggtggtgtgctgcttatagtttgctgttgcattgtaataaaaggtgtctttccctgtagtgacctgtaaaaagtactcaagggctttattacagacataccctccctttgaaaagggacatgctaaaagactcattactactcagccttcaatgtacctgtgtgtccatcttatatttcttttttttttaattgtgaattagacttgtatatcccactgggagcactttgtaggcattgcatgaaccatgggatgatgattctgtggaggtattgccttgtgaatttgctgctattttagttttgtctttgctgtaaacttgtagcattaaacaatcattgttgttaa

SEQ ID NO: 200084 - DNA, 465 bp, Homo sapiens
  Payload ID: 19469
  Gene Name: WEE1 G2 checkpoint kinase
  ENST ID: ENST00000527848
  CDS Start-End: 1-300
atgattcatccagatccagagagaagaccttcagcaatggcactggtaaagcattcagtattgctgtccgcttctagaaagagtgcagaacaattacgaatagaattgaatgccgaaaagttcaaaaattcacttttacaaaaagaactcaagaaagcacagatggcaaaagctgcagctgaggaaagagcactcttcactgaccggatggccactaggtccaccacccagaatgaccctaattttcagtgcaaattcaaaggtctctggagtaaggaaaaatatctatgtatgccctaggaagattcaccaggaaaagatggcatgttgtgtccaaacttcattaaactaagagtcaaagaaacttcggccagtccagcccatgaagaaaaatacctcaaaggaacatttacatcacagttcacattgtttagttttatatggttaataaacattttgaagagc

SEQ ID NO: 200085 - DNA, 990 bp, Homo sapiens
  Payload ID: 19469
  Gene Name: WEE1 G2 checkpoint kinase
  ENST ID: ENST00000530712
  CDS Start-End: 347-990
aaaaacaaaaacaaacaaaaaaaaagccaacctgataatactggtttactctgagaaagaaacaggtggattgctgaggtgtatgattgagagagagactttacattttattttgtacccatgcaaatgtattacctattgaaaaaacaataaaattttgatttcacaagcaggttgaagggagaaggtcctataaaataacactttcttggttgagattggttggttgagactcatttggtaaagatggaagaaagaaaatatttcagaaagaagaaaatgctaatattttctatctttgttaggtggaagtttagctgatgctataagtgaaaactacagaatcatgagttactttaaagaagcagagttgaaggatctccttttgcaagttggccgaggcttgaggtatattcattcaatgtctttggttcacatggatataaaacctagtaatattttcatatctcgaacctcaatcccaaatgctgcctctgaagaaggagacgaagatgattgggcatccaacaaagttatgtttaaaataggtgatcttgggcatgtaacaaggatctccagtccacaagttgaagagggcgatagtcgttttcttgcaaatgaagttttacaggagaattatacccatctaccaaaagcagatatttttgcgcttgccctcacagtggtatgtgctgctggtgctgaacctcttccgagaaatggagatcaatggcatgaaatcagacagggtagattacctcggataccacaagtgctttcccaagaatttacagagttgctaaaagttatgattcatccagatccagagagaagaccttcagcaatggcactggtaaagcattcagtattgctgtccgcttctagaaagagtgcagaacaattacgaatagaattgaatgccgaaaagttcaaaaattcacttttacaaaaagaactcaagaaagcacagatggcaaaagctgcagctga

SEQ ID NO: 200086 - DNA, 573 bp, Homo sapiens
  Payload ID: 19469
  Gene Name: WEE1 G2 checkpoint kinase
  ENST ID: ENST00000524612
  CDS Start-End: 87-573
acattcttttagttctctagcttgtcgtctctccctcctctcccctaaggatgaaacaaaacaggcatgtatagattcaagtttggatgtcttgtatagctttcagtttcggtggaagtttagctgatgctataagtgaaaactacagaatcatgagttactttaaagaagcagagttgaaggatctccttttgcaagttggccgaggcttgaggtatattcattcaatgtctttggttcacatggatataaaacctagtaatattttcatatctcgaacctcaatcccaaatgctgcctctgaagaaggagacgaagatgattgggcatccaacaaagttatgtttaaaataggtgatcttgggcatgtaacaaggatctccagtccacaagttgaagagggcgatagtcgttttcttgcaaatgaagttttacaggagaattatacccatctaccaaaagcagatatttttgcgcttgccctcacagtggtatgtgctgctggtgctgaacctcttccgagaaatggagatcaatggcatgaaatcagacagggtagattacctcggatac

SEQ ID NO: 200087 - DNA, 838 bp, Homo sapiens
  Payload ID: 19469
  Gene Name: WEE1 G2 checkpoint kinase
  ENST ID: ENST00000530175
  CDS Start-End: 1-437
ctgatgctataagtgaaaactacagaatcatgagttactttaaagaagcagagttgaaggatctccttttgcaagttggccgaggcttgaggtatattcattcaatgtctttggttcacatggatataaaacctagtaatattttcatatctcgaacctcaatcccaaatgctgcctctgaagaaggagacgaagatgattgggcatccaacaaagttatgtttaaaataggtgatcttgggcatgtaacaaggatctccagtccacaagttgaagagggcgatagtcgttttcttgcaaatgaagttttacaggagtggtatgtgctgctggtgctgaacctcttccgagaaatggagatcaatggcatgaaatcagacagggtagattacctcggataccacaagtgctttcccaagaatttacagagttgctaaaagttatgattcatccagatccagagagaagaccttcagcaatggcactggtaaagcattcagtattgctgtccgcttctagaaagagtgcagaacaattacgaatagaattgaatgccgaaaagttcaaaaattcacttttacaaaaagaactcaagaaagcacagatggcaaaagctgcagctgaggaaagagcactcttcactgaccggatggccactaggtccaccacccagagtaatagaacatctcgacttattggaaagaaaatgaaccgctctgtcagccttactatatactgagctactcctttcccacctccccctgaacactgtgacaagaggaagctaggttgaaatcactgatagaatccagtttgcaattactttctcgattggtgt

SEQ ID NO: 200088 - DNA, 3061 bp, Homo sapiens
  Payload ID: 19470
  Gene Name: WEE1 homolog 2 (S. pombe)
  Uniprot ID: P0C1S8
  ENST ID: ENST00000397541
  CDS Start-End: 407-2110
aatttcttttcaatattagcttattcccaaattggctaatgggtatttttaaagccatgctaaattaaaggaattcaattttctcactagtatttggtaacacatgggagactatgtgtcatatccagaagagttctgtacatgaactgcatttaattgctccgagagtcactggagctttctttaatcagaatggaaatcaggataagctgaggtcttatagattggtggtacttaaggcagaaaattaacaccgtgttttgtagctgttagttggtagagggaaattcaggctaccgtcgcgaaacctgcaggttaagttattttctcctccctgcttctgtaggttcacagcgttcccttctgatagagctttttgtctgtgttgtaaagctctttggctgagatggatgacaaagatattgacaaagaactaaggcagaaattaaacttttcctattgtgaggagactgagattgaagggcagaagaaagtagaagaaagcagggaggcttcgagccaaaccccagagaagggtgaagtgcaggattcagaggcaaagggtacaccaccttggactccccttagcaacgtgcatgagctcgacacatcttcggaaaaagacaaagaaagtccagatcagattttgaggactccagtgtcacaccctctcaaatgtcctgagacaccagcccaaccagacagcaggagcaagctgctgcccagtgacagcccctctactcccaaaaccatgctgagccggttggtgatttctccaacagggaagcttccttccagaggccctaagcatttgaagctcacacctgctcccctcaaggatgagatgacctcattggctctggtcaatattaatcccttcactccagagtcctataaaaaattatttcttcaatctggtggcaagaggaaaataagaggagatcttgaggaagctggtccagaggaaggcaagggagggctgcctgccaagagatgtgttttacgagaaaccaacatggcttcccgctatgaaaaagaattcttggaggttgaaaaaattggggttggcgaatttggtacagtctacaagtgcattaagaggctggatggatgtgtttatgcaataaagcgctctatgaaaacttttacagaattatcaaatgagaattcggctttgcatgaagtttatgctcacgcagtgcttgggcatcacccccatgtggtacgttactattcctcatgggcagaagatgaccacatgatcattcagaatgaatactgcaatggtgggagtttgcaagctgctatatctgaaaacactaagtctggcaatcattttgaagagccaaaactcaaggacatccttctacagatttcccttggccttaattacatccacaactctagcatggtacacctggacatcaaacctagtaatatattcatttgtcacaagatgcaaagtgaatcctctggagtcatagaagaagttgaaaatgaagctgattggtttctctctgccaatgtgatgtataaaattggtgacctgggccacgcaacatcaataaacaaacccaaagtggaagaaggagatagtcgcttcctggctaatgagattttgcaagaggattaccggcaccttcccaaagcagacatatttgccttgggattaacaattgcagtggctgcaggagcagagtcattgcccaccaatggtgctgcatggcaccatatccgcaagggtaactttccggacgttcctcaggagctctcagaaagcttttccagtctgctcaagaacatgatccaacctgatgccgaacagagaccttctgcagcagctctggccagaaatacagttctccggccttccctgggaaaaacagaagagctccaacagcagctgaatttggaaaagttcaagactgccacactggaaagggaactgagagaagcccagcaggcccagtcaccccagggatatacccatcatggtgacactggggtctctgggacccacacaggatcaagaagcacaaaacgcctggtgggaggaaagagtgcaaggtcttcaagctttacctcaggagagcgtgagcctctgcattaaaggaagaaaaggaaaacagcccttggtttggcctatggattacgaggttgctgttgctgattccccaccaaagatcccagggactcgttgtacatagaaaggaatagaatttagtttagagttgaagtcacagcttacagaaaatgtgcctggatttccacagcgcttcccaggttatatgatgctgttcctaagagagaattcccagcttctttgaggaagtgggtctcctaatgtataccctttctgatattgtatttattaaataaatggtttcaccattatgtgaggtgggtaaaagttagactgcatgcaacttggacatctctgagctggttgttaacttgcagaacaaaaatgctgtggggagaggcttcagggaaaacttgatgtgcctgtggttgttctccatctatttgccctgcctctcttgctgttctggttggtttgatattctgggtctcaccaatttctcttgatttttgtgagaatttggctttgtttcctgttttttaaaatcatattttatctaaatcctttttctgtacacatttttaaaggaagagaatactgtatttttaaataaaggtttttatcttgtccaaagcctaattacaggtaaaatatcctttgtaaaatgtaactaacaaagaatgagaaatttatgtcggagaacattttatgaataaaagggtaagagaattgagtgggtcagtagtaacaggtcttggtggcaagtctcagcttcacagttccaacagttaatgatggtcaggatctgctagaaaattatgttggtcataaaggtatttgataagctctgtttgtgtcatcttagtgaatgcaacctgttaatgataatggctttttcgctgcttgattttcttcttttcctcatttttaaaagctaattaagtttttttaattgaataaaccctaatactattcttt

SEQ ID NO: 200089 - DNA, 610 bp, Homo sapiens
  Payload ID: 19470
  Gene Name: WEE1 homolog 2 (S. pombe)
  ENST ID: ENST00000493845
  CDS Start-End: 1-610
gtctacaagtgcattaagaggctggatggatgtgtttatgcaataaagcgctctatgaaaacttttacagaattatcaaatgagaattcggctttgcatgaagtttatgctcacgcagtgcttgggcatcacccccatgtggtacgttactattcctcatgggcagaagatgaccacatgatcattcagaatgaatactgcaatggtgggagtttgcaagctgctatatctgaaaacactaagtctggcaatcattttgaagagccaaaactcaaggacatccttctacagatttcccttggccttaattacatccacaactctagcatggtacacctggacatcaaacctagtaatatattcatttgtcacaagatgcaaagtgaatcctctggagtcatagaagaagttgaaaatgaagctgattggtttctctctgccaatgtgatgtataaaattggtgacctgggccacgcaacatcaataaacaaacccaaagtggaagaaggagatagtcgcttcctggctaatgagattttgcaagagaacatgatccaacctgatgccgaacagagaccttctgcagcagctctggccagaaatacagttc

SEQ ID NO: 200090 - DNA, 610 bp, Homo sapiens; identical to SEQ ID NO: 200089
  Payload ID: 19470
  Gene Name: WEE1 homolog 2 (S. pombe)
  ENST ID: ENST00000576319
  CDS Start-End: 1-610

SEQ ID NO: 200091 - DNA, 3061 bp, Homo sapiens; identical to SEQ ID NO: 200088
  Payload ID: 19470
  Gene Name: WEE1 homolog 2 (S. pombe)
  Uniprot ID: P0C1S8
  ENST ID: ENST00000574659
  CDS Start-End: 407-2110

SEQ ID NO: 200092 - DNA, 1557 bp, Homo sapiens
  Payload ID: 19471
  Gene Name: Werner helicase interacting protein 1
  Uniprot ID: Q96S55
  ENST ID: ENST00000380764
  CDS Start-End: 249-1094
caaatgatgtgcgagatgtcataaaacaagctcaaaatgaaaagagctttttcaaaaggaaaaccatcctttttattgatgagattcatcggttcaataaatctcagcaggacactttccttcctcacgtggaatgtgggacgatcactctgattggggcaaccactgaaaacccttccttccaggtcaacgctgctcttctgagccgctgtcgagtgattgttcttgagaagcttccagtagaggcaatggtgactattttaatgcgagcgatcaactccctgggaatccacgtcctagactctagccgtcccactgaccctctgagccacagcagcaacagcagctcagagcccgccatgttcatagaggataaagcagtagacaccctggcttacctcagtgacggtgacgcccgagctgggttgaacggactgcagctggcggtgctggctaggttaagctctaggaagatgttctgtaagaagagtgggcaatcctattctcccagtagagttctgatcacagagaatgacgtgaaggagggcctacagcgatcccacattttatatgaccgggcaggtgaggagcattacaactgcatctccgccctgcacaagtccatgcggggctcagaccagaacgcctccctctactggctggctcgcatgctcgagggaggagaggacccactctacgtggcacggaggcttgtcaggtttgccagcgaggacataggtctggcagacccgtctgcgttaacacaagcggttgctgcctaccaaggctgtcattttataggcatgcctgaatgtgaggtgcttctggcccagtgtgtggtctactttgccagagccccaaagtccattgaggtgtacagcgcctacaacaacgtcaaagcctgcctgaggaaccaccaggggccactgccccccgtgcccctgcacctgaggaacgcgcccactaggctgatgaaggatttgggctatggcaaaggctacaagtacaaccccatgtacagcgagcctgtggatcaggagtacctgcctgaagagttgaggggggtagatttcttcaagcagaggaggtgctgactcctcagggcacgacagcagaaggatgttgcttttttaagggagggccagaaagaaagttagtggattgcaaagttggttgcctggtggaagttagaacagaccaacattttgtgccagaaatttaagagttccataggtggaggcgcagttctttcgaataaatgtgtaactttgaaattgtgttcatttgcactcggtgcagcggttatgcttatgaaaatacctggcagctttgtgcaatgaattaatgttataaggaattatctattttgtcatagtatttaagtcataatgtcatttcagaattcagttctgtaggattttcttttctttaaaaaatgtatattctgggtagttttaattggtaaaaaaatgtaattgtgatttaatactgcatagtgttttgggtattttttttatatgcaaaggtcttacgagccaataaaactatttcaaagta

SEQ ID NO: 200093 - DNA, 3239 bp, Homo sapiens
  Payload ID: 19471
  Gene Name: Werner helicase interacting protein 1
  Uniprot ID: Q96S55
  ENST ID: ENST00000380769
  CDS Start-End: 232-1569
gcggccgccgccgcggcggggagcgcgtctccgcgcagctgggacgaggcggaggcgcaggaggaggaggaggccgtgggcgacggcgatggcgacggggacgcggacgcggacggcgaggacgacccggggcactgggacgcggacgctgccgaagccgccaccgccttcggggccagtggcgggggccgcccgcacccccgggcgctggctgccgaggagatccgacagatgctacagggcaagccgctggccgacacgatgcgtcctgacacgctgcaggattacttcgggcagagcaaggccgtgggccaggataccctgctgcgctcgctcctggagaccaacgaaatcccctcgcttatcctgtgggggccgccgggctgcggcaagaccactctggctcacatcatagccagcaacagcaagaaacatagcataaggtttgtgacattatctgcaacaaatgccaagacaaatgatgtgcgagatgtcataaaacaagctcaaaatgaaaagagctttttcaaaaggaaaaccatcctttttattgatgagattcatcggttcaataaatctcagcaggacactttccttcctcacgtggaatgtgggacgatcactctgattggggcaaccactgaaaacccttccttccaggtcaacgctgctcttctgagccgctgtcgagtgattgttcttgagaagcttccagtagaggcaatggtgactattttaatgcgagcgatcaactccctgggaatccacgtcctagactctagccgtcccactgaccctctgagccacagcagcaacagcagctcagagcccgccatgttcatagaggataaagcagtagacaccctggcttacctcagtgacggtgacgcccgagctgggttgaacggactgcagctggcggtgctggctaggttaagctctaggaagatgttctgtaagaagagtgggcaatcctattctcccagtagagttctgatcacagagaatgacgtgaaggagggcctacagcgatcccacattttatatgaccgggcaggtgaggagcattacaactgcatctccgccctgcacaagtccatgcggggctcagaccagaacgcctccctctactggctggctcgcatgctcgagggaggagaggacccactctacgtggcacggaggcttgtcaggtttgccagcgaggacataggtctggcagacccgtctgcgttaacacaagcggttgctgcctaccaaggctgtcattttataggcatgcctgaatgtgaggtgcttctggcccagtgtgtggtctactttgccagagccccaaagtccattgaggtgtacagcgcctacaacaacgtcaaagcctgcctgaggaaccaccaggggccactgccccccgtgcccctgcacctgaggaacgcgcccactaggctgatgaaggatttgggctatggcaaaggctacaagtacaaccccatgtacagcgagcctgtggatcaggagtacctgcctgaagagttgaggggggtagatttcttcaagcagaggaggtgctgactcctcagggcacgacagcagaaggatgttgcttttttaagggagggccagaaagaaagttagtggattgcaaagttggttgcctggtggaagttagaacagaccaacattttgtgccagaaatttaagagttccataggtggaggcgcagttctttcgaataaatgtgtaactttgaaattgtgttcatttgcactcggtgcagcggttatgcttatgaaaatacctggcagctttgtgcaatgaattaatgttataaggaattatctattttgtcatagtatttaagtcataatgtcatttcagaattcagttctgtaggattttcttttctttaaaaaatgtatattctgggtagttttaattggtaaaaaaatgtaattgtgatttaatactgcatagtgttttgggtattttttttatatgcaaaggtcttacgagccaataaaactatttcaaagtactcttcgattctgtcatggttttcctgcctggatgctaggtaccagcgttgtcaccattgcatttggtgggtggatactgggaaggagaaatcaccccagatgggaagagtggggagcttaagttaagaagtcagtgttatcttgttgaaagttaactctgatctctttaaaggaatacataaaggaattctttaaatggcttgtggaagactccagtagtcccatgcccattttttcccacttgtcctggtttcttcttgcagctccatatttctaaacagtcgtttttcttttactttatgtgtgtcctgaacacaaaatacgccactccttctgctcagttaagagttatttgtccctactgctacttcctctccctctccttagttgcatgtcgtgcatatgcccacaaggatggccccttcaggtagtcggttctcctcctgctgttgcgtgatccctcctggggtcctcctgccatgtctggaaggctgccggctgttggcctgggacgtcctctgcctttattctgagtgagatgcccattttctggatgctccatcccgccttactggtttattccgctatttcagtgcaacccatcctctagtagttttatcaggctggagggactgtatgttgcagaggcttggcccgactggcctccctccttctgtctggagtggttgcactgcagtgtgcagttgccatccccagaatctcccttcatcatcaccctggagctttcctctgcttctccctgcaccccatctgatgacaggactgactgctttctggcacaggtggcatgtaccctctagtagctttatggagcaggggtgtgtggaggaaaagtatttttagacctcaggagactcaaaatgcttttattgtaccttcagacgtgtctgagggtttggctagtaataaattgtaggtaagaaattacttgtgcattgttttacactttcccacattgttgtcaagtttgaaggcatcctgatgtgtgtggtcttttgtttgtaacctctatcaacttgtagactcttctgtctttgctccccgtgttttaaaagtctgcactgggtacttgttgggcctttcaatctggaaactcctttcagttctagggaagtttctttttttattcaataaatttatttatttatgagaccaactcttgctctttttcccaggctggagggc

SEQ ID NO: 200094 - DNA, 2595 bp, Homo sapiens
  Payload ID: 19471
  Gene Name: Werner helicase interacting protein 1
  Uniprot ID: Q96S55
  ENST ID: ENST00000380771
  CDS Start-End: 210-2132
gaggcgctgccagcggccggccgagggcgggcggacgcgggagctgcggacgtgaggcatgagcggcgccctcctccggcccgcgagcgtcctgctggttccccgagcgagggtctcgcggcgcggggcctagcggagggcatcgaaggcctccgcgtgcgcacgggttgctgcggccgcgccgggcgccggggagggcggcggccgccatggaggtgagcgggccggaagacgaccccttcctttcgcagctgcaccaggtgcagtgccccgtgtgccagcagatgatgcccgccgcgcacatcaactcgcacctggaccgctgtctgctgctccacccggcggggcacgcggagcccgcggccgggtcgcaccgcgccggggagcgggccaaggggccctcgccgcccggcgccaagaggcggcggctgtcggagagctcggcgctgaagcagccagccaccccgacggcagccgagagcagcgagggcgagggtgaggagggcgacgacggcggcgagaccgagagccgcgagagctacgacgcgccgcccacacccagcggcgcccgccttatccccgacttcccggtggcccgctccagcagccccgggaggaaggggtcggggaagaggccggcggccgccgccgcggcggggagcgcgtctccgcgcagctgggacgaggcggaggcgcaggaggaggaggaggccgtgggcgacggcgatggcgacggggacgcggacgcggacggcgaggacgacccggggcactgggacgcggacgctgccgaagccgccaccgccttcggggccagtggcgggggccgcccgcacccccgggcgctggctgccgaggagatccgacagatgctacagggcaagccgctggccgacacgatgcgtcctgacacgctgcaggattacttcgggcagagcaaggccgtgggccaggataccctgctgcgctcgctcctggagaccaacgaaatcccctcgcttatcctgtgggggccgccgggctgcggcaagaccactctggctcacatcatagccagcaacagcaagaaacatagcataaggtttgtgacattatctgcaacaaatgccaagacaaatgatgtgcgagatgtcataaaacaagctcaaaatgaaaagagctttttcaaaaggaaaaccatcctttttattgatgagattcatcggttcaataaatctcagcaggtcaacgctgctcttctgagccgctgtcgagtgattgttcttgagaagcttccagtagaggcaatggtgactattttaatgcgagcgatcaactccctgggaatccacgtcctagactctagccgtcccactgaccctctgagccacagcagcaacagcagctcagagcccgccatgttcatagaggataaagcagtagacaccctggcttacctcagtgacggtgacgcccgagctgggttgaacggactgcagctggcggtgctggctaggttaagctctaggaagatgttctgtaagaagagtgggcaatcctattctcccagtagagttctgatcacagagaatgacgtgaaggagggcctacagcgatcccacattttatatgaccgggcaggtgaggagcattacaactgcatctccgccctgcacaagtccatgcggggctcagaccagaacgcctccctctactggctggctcgcatgctcgagggaggagaggacccactctacgtggcacggaggcttgtcaggtttgccagcgaggacataggtctggcagacccgtctgcgttaacacaagcggttgctgcctaccaaggctgtcattttataggcatgcctgaatgtgaggtgcttctggcccagtgtgtggtctactttgccagagccccaaagtccattgaggtgtacagcgcctacaacaacgtcaaagcctgcctgaggaaccaccaggggccactgccccccgtgcccctgcacctgaggaacgcgcccactaggctgatgaaggatttgggctatggcaaaggctacaagtacaaccccatgtacagcgagcctgtggatcaggagtacctgcctgaagagttgaggggggtagatttcttcaagcagaggaggtgctgactcctcagggcacgacagcagaaggatgttgcttttttaagggagggccagaaagaaagttagtggattgcaaagttggttgcctggtggaagttagaacagaccaacattttgtgccagaaatttaagagttccataggtggaggcgcagttctttcgaataaatgtgtaactttgaaattgtgttcatttgcactcggtgcagcggttatgcttatgaaaatacctggcagctttgtgcaatgaattaatgttataaggaattatctattttgtcatagtatttaagtcataatgtcatttcagaattcagttctgtaggattttcttttctttaaaaaatgtatattctgggtagttttaattggtaaaaaaatgtaattgtgatttaatactgcatagtgttttgggtattttttttatatgcaaaggtcttacgagccaataaaactatttcaaagta

SEQ ID NO: 200095 - DNA, 2670 bp, Homo sapiens
  Payload ID: 19471
  Gene Name: Werner helicase interacting protein 1
  Uniprot ID: Q96S55
  ENST ID: ENST00000380773
  CDS Start-End: 210-2207
gaggcgctgccagcggccggccgagggcgggcggacgcgggagctgcggacgtgaggcatgagcggcgccctcctccggcccgcgagcgtcctgctggttccccgagcgagggtctcgcggcgcggggcctagcggagggcatcgaaggcctccgcgtgcgcacgggttgctgcggccgcgccgggcgccggggagggcggcggccgccatggaggtgagcgggccggaagacgaccccttcctttcgcagctgcaccaggtgcagtgccccgtgtgccagcagatgatgcccgccgcgcacatcaactcgcacctggaccgctgtctgctgctccacccggcggggcacgcggagcccgcggccgggtcgcaccgcgccggggagcgggccaaggggccctcgccgcccggcgccaagaggcggcggctgtcggagagctcggcgctgaagcagccagccaccccgacggcagccgagagcagcgagggcgagggtgaggagggcgacgacggcggcgagaccgagagccgcgagagctacgacgcgccgcccacacccagcggcgcccgccttatccccgacttcccggtggcccgctccagcagccccgggaggaaggggtcggggaagaggccggcggccgccgccgcggcggggagcgcgtctccgcgcagctgggacgaggcggaggcgcaggaggaggaggaggccgtgggcgacggcgatggcgacggggacgcggacgcggacggcgaggacgacccggggcactgggacgcggacgctgccgaagccgccaccgccttcggggccagtggcgggggccgcccgcacccccgggcgctggctgccgaggagatccgacagatgctacagggcaagccgctggccgacacgatgcgtcctgacacgctgcaggattacttcgggcagagcaaggccgtgggccaggataccctgctgcgctcgctcctggagaccaacgaaatcccctcgcttatcctgtgggggccgccgggctgcggcaagaccactctggctcacatcatagccagcaacagcaagaaacatagcataaggtttgtgacattatctgcaacaaatgccaagacaaatgatgtgcgagatgtcataaaacaagctcaaaatgaaaagagctttttcaaaaggaaaaccatcctttttattgatgagattcatcggttcaataaatctcagcaggacactttccttcctcacgtggaatgtgggacgatcactctgattggggcaaccactgaaaacccttccttccaggtcaacgctgctcttctgagccgctgtcgagtgattgttcttgagaagcttccagtagaggcaatggtgactattttaatgcgagcgatcaactccctgggaatccacgtcctagactctagccgtcccactgaccctctgagccacagcagcaacagcagctcagagcccgccatgttcatagaggataaagcagtagacaccctggcttacctcagtgacggtgacgcccgagctgggttgaacggactgcagctggcggtgctggctaggttaagctctaggaagatgttctgtaagaagagtgggcaatcctattctcccagtagagttctgatcacagagaatgacgtgaaggagggcctacagcgatcccacattttatatgaccgggcaggtgaggagcattacaactgcatctccgccctgcacaagtccatgcggggctcagaccagaacgcctccctctactggctggctcgcatgctcgagggaggagaggacccactctacgtggcacggaggcttgtcaggtttgccagcgaggacataggtctggcagacccgtctgcgttaacacaagcggttgctgcctaccaaggctgtcattttataggcatgcctgaatgtgaggtgcttctggcccagtgtgtggtctactttgccagagccccaaagtccattgaggtgtacagcgcctacaacaacgtcaaagcctgcctgaggaaccaccaggggccactgccccccgtgcccctgcacctgaggaacgcgcccactaggctgatgaaggatttgggctatggcaaaggctacaagtacaaccccatgtacagcgagcctgtggatcaggagtacctgcctgaagagttgaggggggtagatttcttcaagcagaggaggtgctgactcctcagggcacgacagcagaaggatgttgcttttttaagggagggccagaaagaaagttagtggattgcaaagttggttgcctggtggaagttagaacagaccaacattttgtgccagaaatttaagagttccataggtggaggcgcagttctttcgaataaatgtgtaactttgaaattgtgttcatttgcactcggtgcagcggttatgcttatgaaaatacctggcagctttgtgcaatgaattaatgttataaggaattatctattttgtcatagtatttaagtcataatgtcatttcagaattcagttctgtaggattttcttttctttaaaaaatgtatattctgggtagttttaattggtaaaaaaatgtaattgtgatttaatactgcatagtgttttgggtattttttttatatgcaaaggtcttacgagccaataaaactatttcaaagta

SEQ ID NO: 200096 - DNA, 2651 bp, Homo sapiens
  Payload ID: 19471
  Gene Name: Werner helicase interacting protein 1
  Uniprot ID: Q96S55
  ENST ID: ENST00000618555
  CDS Start-End: 192-2189
ggccgagggcgggcggacgcgggagctgcggacgtgaggcatgagcggcgccctcctccggcccgcgagcgtcctgctggttccccgagcgagggtctcgcggcgcggggcctagcggagggcatcgaaggcctccgcgtgcgcacgggttgctgcggccgcgccgggcgccggggagggcggcggccgccatggaggtgagcgggccggaagacgaccccttcctttcgcagctgcaccaggtgcagtgccccgtgtgccagcagatgatgcccgccgcgcacatcaactcgcacctggaccgctgtctgctgctccacccggcggggcacgcggagcccgcggccgggtcgcaccgcgccggggagcgggccaaggggccctcgccgcccggcgccaagaggcggcggctgtcggagagctcggcgctgaagcagccagccaccccgacggcagccgagagcagcgagggcgagggtgaggagggcgacgacggcggcgagaccgagagccgcgagagctacgacgcgccgcccacacccagcggcgcccgccttatccccgacttcccggtggcccgctccagcagccccgggaggaaggggtcggggaagaggccggcggccgccgccgcggcggggagcgcgtctccgcgcagctgggacgaggcggaggcgcaggaggaggaggaggccgtgggcgacggcgatggcgacggggacgcggacgcggacggcgaggacgacccggggcactgggacgcggacgctgccgaagccgccaccgccttcggggccagtggcgggggccgcccgcacccccgggcgctggctgccgaggagatccgacagatgctacagggcaagccgctggccgacacgatgcgtcctgacacgctgcaggattacttcgggcagagcaaggccgtgggccaggataccctgctgcgctcgctcctggagaccaacgaaatcccctcgcttatcctgtgggggccgccgggctgcggcaagaccactctggctcacatcatagccagcaacagcaagaaacatagcataaggtttgtgacattatctgcaacaaatgccaagacaaatgatgtgcgagatgtcataaaacaagctcaaaatgaaaagagctttttcaaaaggaaaaccatcctttttattgatgagattcatcggttcaataaatctcagcaggacactttccttcctcacgtggaatgtgggacgatcactctgattggggcaaccactgaaaacccttccttccaggtcaacgctgctcttctgagccgctgtcgagtgattgttcttgagaagcttccagtagaggcaatggtgactattttaatgcgagcgatcaactccctgggaatccacgtcctagactctagccgtcccactgaccctctgagccacagcagcaacagcagctcagagcccgccatgttcatagaggataaagcagtagacaccctggcttacctcagtgacggtgacgcccgagctgggttgaacggactgcagctggcggtgctggctaggttaagctctaggaagatgttctgtaagaagagtgggcaatcctattctcccagtagagttctgatcacagagaatgacgtgaaggagggcctacagcgatcccacattttatatgaccgggcaggtgaggagcattacaactgcatctccgccctgcacaagtccatgcggggctcagaccagaacgcctccctctactggctggctcgcatgctcgagggaggagaggacccactctacgtggcacggaggcttgtcaggtttgccagcgaggacataggtctggcagacccgtctgcgttaacacaagcggttgctgcctaccaaggctgtcattttataggcatgcctgaatgtgaggtgcttctggcccagtgtgtggtctactttgccagagccccaaagtccattgaggtgtacagcgcctacaacaacgtcaaagcctgcctgaggaaccaccaggggccactgccccccgtgcccctgcacctgaggaacgcgcccactaggctgatgaaggatttgggctatggcaaaggctacaagtacaaccccatgtacagcgagcctgtggatcaggagtacctgcctgaagagttgaggggggtagatttcttcaagcagaggaggtgctgactcctcagggcacgacagcagaaggatgttgcttttttaagggagggccagaaagaaagttagtggattgcaaagttggttgcctggtggaagttagaacagaccaacattttgtgccagaaatttaagagttccataggtggaggcgcagttctttcgaataaatgtgtaactttgaaattgtgttcatttgcactcggtgcagcggttatgcttatgaaaatacctggcagctttgtgcaatgaattaatgttataaggaattatctattttgtcatagtatttaagtcataatgtcatttcagaattcagttctgtaggattttcttttctttaaaaaatgtatattctgggtagttttaattggtaaaaaaatgtaattgtgatttaatactgcatagtgttttgggtattttttttatatgcaaaggtcttacgagccaataaaactatttcaaagt

SEQ ID NO: 200097 - DNA, 5215 bp, Homo sapiens
  Payload ID: 19472
  Gene Name: Werner syndrome, RecQ helicase-like
  Uniprot ID: Q14191
  ENST ID: ENST00000298139
  CDS Start-End: 250-4548
ggagctgatgtgtactgtgtgcgccggggaggcgccggcttgtactcggcagcgcgggaataaagtttgctgatttggtgtctagcctggatgcctgggttgcaggccctgcttgtggtggcgctccacagtcatccggctgaagaagacctgttggactggatcttctcgggttttctttcagatattgttttgtatttacccatgaagacattgttttttggactctgcaaataggacatttcaaagatgagtgaaaaaaaattggaaacaactgcacagcagcggaaatgtcctgaatggatgaatgtgcagaataaaagatgtgctgtagaagaaagaaaggcatgtgttcggaagagtgtttttgaagatgacctccccttcttagaattcactggatccattgtgtatagttacgatgctagtgattgctctttcctgtcagaagatattagcatgagtctatcagatggggatgtggtgggatttgacatggagtggccaccattatacaatagagggaaacttggcaaagttgcactaattcagttgtgtgtttctgagagcaaatgttacttgttccacgtttcttccatgtcagtttttccccagggattaaaaatgttgcttgaaaataaagcagttaaaaaggcaggtgtaggaattgaaggagatcagtggaaacttctacgtgactttgatatcaaattgaagaattttgtggagttgacagatgttgccaataaaaagctgaaatgcacagagacctggagccttaacagtctggttaaacacctcttaggtaaacagctcctgaaagacaagtctatccgctgtagcaattggagtaaatttcctctcactgaggaccagaaactgtatgcagccactgatgcttatgctggttttattatttaccgaaatttagagattttggatgatactgtgcaaaggtttgctataaataaagaggaagaaatcctacttagcgacatgaacaaacagttgacttcaatctctgaggaagtgatggatctggctaagcatcttcctcatgctttcagtaaattggaaaacccacggagggtttctatcttactaaaggatatttcagaaaatctatattcactgaggaggatgataattgggtctactaacattgagactgaactgaggcccagcaataatttaaacttattatcctttgaagattcaactactgggggagtacaacagaaacaaattagagaacatgaagttttaattcacgttgaagatgaaacatgggacccaacacttgatcatttagctaaacatgatggagaagatgtacttggaaataaagtggaacgaaaagaagatggatttgaagatggagtagaagacaacaaattgaaagagaatatggaaagagcttgtttgatgtcgttagatattacagaacatgaactccaaattttggaacagcagtctcaggaagaatatcttagtgatattgcttataaatctactgagcatttatctcccaatgataatgaaaacgatacgtcctatgtaattgagagtgatgaagatttagaaatggagatgcttaagcatttatctcccaatgataatgaaaacgatacgtcctatgtaattgagagtgatgaagatttagaaatggagatgcttaagtctttagaaaacctcaatagtggcacggtagaaccaactcattctaaatgcttaaaaatggaaagaaatctgggtcttcctactaaagaagaagaagaagatgatgaaaatgaagctaatgaaggggaagaagatgatgataaggactttttgtggccagcacccaatgaagagcaagttacttgcctcaagatgtactttggccattccagttttaaaccagttcagtggaaagtgattcattcagtattagaagaaagaagagataatgttgctgtcatggcaactggatatggaaagagtttgtgcttccagtatccacctgtttatgtaggcaagattggccttgttatctctccccttatttctctgatggaagaccaagtgctacagcttaaaatgtccaacatcccagcttgcttccttggatcagcacagtcagaaaatgttctaacagatattaaattaggtaaataccggattgtatacgtaactccagaatactgttcaggtaacatgggcctgctccagcaacttgaggctgatattggtatcacgctcattgctgtggatgaggctcactgtatttctgagtgggggcatgattttagggattcattcaggaagttgggctccctaaagacagcactgccaatggttccaatcgttgcacttactgctactgcaagttcttcaatccgggaagacattgtacgttgcttaaatctgagaaatcctcagatcacctgtactggttttgatcgaccaaacctgtatttagaagttaggcgaaaaacagggaatatccttcaggatctgcagccatttcttgtcaaaacaagttcccactgggaatttgaaggtccaacaatcatctactgtccttctagaaaaatgacacaacaagttacaggtgaacttaggaaactgaatctatcctgtggaacataccatgcgggcatgagttttagcacaaggaaagacattcatcataggtttgtaagagatgaaattcagtgtgtcatagctaccatagcttttggaatgggcattaataaagctgacattcgccaagtcattcattacggtgctcctaaggacatggaatcatattatcaggagattggtagagctggtcgtgatggacttcaaagttcttgtcacgtcctctgggctcctgcagacattaacttaaataggcaccttcttactgagatacgtaatgagaagtttcgattatacaaattaaagatgatggcaaagatggaaaaatatcttcattctagcagatgtaggagacaaatcatcttgtctcattttgaggacaaacaagtacaaaaagcctccttgggaattatgggaactgaaaaatgctgtgataattgcaggtccagattggatcattgctattccatggatgactcagaggatacatcctgggactttggtccacaagcatttaagcttttgtctgctgtggacatcttaggcgaaaaatttggaattgggcttccaattttatttctccgaggatctaattctcagcgtcttgccgatcaatatcgcaggcacagtttatttggcactggcaaggatcaaacagagagttggtggaaggctttttcccgtcagctgatcactgagggattcttggtagaagtttctcggtataacaaatttatgaagatttgcgcccttacgaaaaagggtagaaattggcttcataaagctaatacagaatctcagagcctcatccttcaagctaatgaagaattgtgtccaaagaagttgcttctgcctagttcgaaaactgtatcttcgggcaccaaagagcattgttataatcaagtaccagttgaattaagtacagagaagaagtctaacttggagaagttatattcttataaaccatgtgataagatttcttctgggagtaacatttctaaaaaaagtatcatggtacagtcaccagaaaaagcttacagttcctcacagcctgttatttcggcacaagagcaggagactcagattgtgttatatggcaaattggtagaagctaggcagaaacatgccaataaaatggatgttcccccagctattctggcaacaaacaagatactggtggatatggccaaaatgagaccaactacggttgaaaacgtaaaaaggattgatggtgtttctgaaggcaaagctgccatgttggcccctctgttggaagtcatcaaacatttctgccaaacaaatagtgttcagacagacctcttttcaagtacaaaacctcaagaagaacagaagacgagtctggtagcaaaaaataaaatatgcacactttcacagtctatggccatcacatactctttattccaagaaaagaagatgcctttgaagagcatagctgagagcaggattctgcctctcatgacaattggcatgcacttatcccaagcggtgaaagctggctgcccccttgatttggagcgagcaggcctgactccagaggttcagaagattattgctgatgttatccgaaaccctcccgtcaactcagatatgagtaaaattagcctaatcagaatgttagttcctgaaaacattgacacgtaccttatccacatggcaattgagatccttaaacatggtcctgacagcggacttcaaccttcatgtgatgtcaacaaaaggagatgttttcccggttctgaagagatctgttcaagttctaagagaagcaaggaagaagtaggcatcaatactgagacttcatctgcagagagaaagagacgattacctgtgtggtttgccaaaggaagtgataccagcaagaaattaatggacaaaacgaaaaggggaggtctttttagttaagctggcaattaccagaacaattatgtttcttgctgtattataagaggatagctatattttatttctgaagagtaaggagtagtattttggcttaaaaatcattctaattacaaagttcactgtttattgaagaactggcatcttaaatcagccttccgcaattcatgtagtttctgggtcttctgggagcctacgtgagtacatcacctaacagaatattaaattagacttcctgtaagattgctttaagaaactgttactgtcctgttttctaatctctttattaaaacagtgtatttggaaaatgttatgtgctctgatttgatatagataacagattagtagttacatggtaattatgtgatataaaatattcatatattatcaaaattctgttttgtaaatgtaagaaagcatagttattttacaaattgtttttactgtcttttgaagaagttcttaaatacgttgttaaatggtattagttgaccagggcagtgaaaatgaaaccgcattttgggtgccattaaatagggaaaaaacatgtaaaaaatgtaaaatggagaccaattgcactaggcaagtgtatattttgtattttatatacaatttctattatttttcaagtaataaaacaatgtttttcatactgaatattatatatata

SEQ ID NO: 200098 - DNA, 5695 bp, Homo sapiens
  Payload ID: 19473
  Gene Name: widely interspaced zinc finger motifs
  Uniprot ID: O95785
  ENST ID: ENST00000263381
  CDS Start-End: 215-2599
aaagggacaatgtcccccgagcggtggaggcggcggcggctgcggaggccgcggcaccggcaccgggagcggcagcggcggtagcggcagcgacggccgcaccaaggaggggagctccgagccccggcacctggccggcggcgccgcctccccggcccacaatgccccgctgagccggtgcagcagctgagtggatccaagcagagaaaatccgatggaggggtctctggcaggcagcctggctgcaccagatcgtccccaaggcccagagagactgcctggcccggcgccaagggagaacatcgagggtggggccgaagctgctgagggggaaggtggcatcttccggtccacccgttacctgcctgtcaccaaggagggcccccgagacattctggatggcagaggtggcatctctgtggccaactttgacccaggcaccttcagcctgatgcgctgtgacttctgcggggctggcttcgacacacgggccggcctctccagccacgcccgggcccacctacgtgacttcggtatcaccaactgggagctcactgtctcacccatcaacatcctgcaggagctgctggccacctctgctgctgagcagccccccagccccctgggccgagagcctgggggtccgcctggcagcttcctgacctcccgtcggccccgcttacctctcacggtgccctttccacccacctgggctgaggaccctgggccagcctatggagatgcctcaggcccagagccagcacgagacatccgctgcgagttctgtggtgagttcttcgagaaccgcaagggcctctcgagccacgcgcgctcccatctgcggcaaatgggcgtgaccgagtggtacgtcaatggctcgcccatcgacacgctgcgggagatcctgaagagacggacccagtctcggcctggtggacctcccaacccaccagggccaagcccaaaagccctggccaagatgatgggcggcgcaggtcctggcagctcactggaagcccgcagcccctcggaccttcacatctcacccttggccaagaagttgccaccaccaccgggcagccccctgggccactcaccaactgcctctcctcctcctacggcccgaaagatgttcccaggcctggctgcaccctccttgcccaagaagctgaagcctgaacaaatacgggtggagatcaagcgggagatgctgccgggggcccttcatggggaactgcacccatctgagggtccctggggggcaccacgggaagacatgacacccctgaacctgtcgtcccgggcagagccggtgcgcgacatccgctgtgagttctgcggcgagttcttcgagaaccgcaagggcctgtcgagtcacgcgcgctcacacctgcggcagatgggtgtgaccgagtggtccgtcaatggttcgcccatcgacacactgcgagagatcctcaagaagaagtccaagccgtgcctcatcaagaaggagccaccggctggagacctggcccctgccctggctgaggacgggcctcccaccgtggcccctgggcccgtgcagtccccactgccgctgtcgcccctggctggccggccaggcaaaccaggtgcagggccggcccaggttcctcgtgagctcagcctgacgcccatcactggggccaagccctcagccactggctacctgggctcagtggcagccaagcggcccctgcaggaggaccgcctcctcccagcagaggtcaaggccaagacctacatccagactgaactgcccttcaaggcaaagacccttcatgagaagacctcccactcctccaccgaggcctgctgcgagctgtgtggcctttactttgaaaaccgcaaggccctggccagccacgcacgggcacacctgcggcagttcggcgtgaccgagtggtgcgtcaatggctcgcccatcgagacactgagcgagtggatcaaacaccggccccagaaggtgggcgcctaccgcagctacatccagggcggccgccccttcaccaagaagttccgcagtgccggccatggccgtgacagtgacaagcggccgtccctggggctggcacccgggggcctggccgtggtcggccgcagtgccggaggggagccagggcccgaggctggccgggcagccgacggtggtgagcggcctctggcagccagcccgccaggcaccgtgaaggctgaggagcaccagcggcagaacatcaacaaatttgaacgccgacaagcccgccctccagatgcctccgcagcccggggaggcgaggacaccaatgacctacagcagaagctggaggaggtgcggcaacccccaccccgagtccggccagtcccctccctggtgccccggcccccccagacatcacttgtcaagttcgtgggcaacatctacaccctcaaatgcaggttctgtgaggtggaattccagggccccctctccatccaggaagagtgggtgcggcacttacagcggcacatcctggagatgaacttctccaaagcggaccccccacctgaggagtcccaggccccgcaggcacagacagcggcggcagaggctccctaacacaaaagcattccagatcccctctcgtgccacctctgtctcctcttcttcctcctctgtgtccttgtccctcttcctctttctttccgtttccaaaggagcaagccaaaacctcaaaccggcgccccttgggggccgggcacactacagccagggcgccgggagccagctagctgcccttcccccagcccgaggactctggggccacagggtgtcttccttcagcccatgcccacctggtccagcaggggcagcagccaggtctctgatggcagccggtctggtcacaggggaggacagcactcccccgtctagcagccaggcagggcgatgtctgccatccgtggccatttgcaaagaccccaaagacccctgttctggttccctctctcccccatgaatatcctctcacacacatgtacatgcgaacacacacaacacgcacctcgtgagacccgggacctgccccggacccccagttcctgggttgaacgaccacatcatgccacggtgcttgctcaggggaagccacgctccctctgtggggcctgctggggcctgggagccccccactgagcccacaatgccacggaaatccttgttggctgcccccgagaggggccttcccagctgggaagagctcagagctgacagctgcctcctgccatgtcaaggccccccaaagagcctcaggggctctggggccctggagggtggggttggggggtgggactctcctcccccactcctgctccctctcccttttcactgttgctttctatgtatagctccctagacctttcacttttttaaaaacgcgttttgtgtagagaataaggaacgtggatctttttattttgcaatcctgggccagctagaagccaggagctgattgaccttttaacttttttcagtggccacattttggttatcgatgtacctagaagtatgtaaattagattaaatttctcttctggaaacaccctggggcaggcggccagcgtgtgtttttctgtcaagtggacaggctggcattggctggcagccggggctgggatcggggcctcctctgtccagagcgccatggaggccctgggttttccagttggccgccaagccgaccagacgcagctggggatgagcccaagttcccagctgttggctctttaggccatggctgggagggggtctctggctggctggcaaagcggctccagtgagcagatgaaccagggttctgggcagcctgtctgggaagggagccaggatcaagaagcagttgaggctagaggagcttatcaaaggcaggagctaccagcgagggtgtcagggacccgttgggagcatttgggtgggggccagtggggttgtagagagctggaactcacctgcttttaatacatgtgacttctagtgagacacatgcacccctgacccaaggaacatgcggggaaaagaggagccactggctcctttgcgatgttatttattttctcgctctgcaaatgtttattgaacatttctgagattttaagagattttgttggctgctccttcttgtttattgcatgtggtttttcagctcatcgtttttactaaacggtcaagtgctggagagtgggaacgacctcatggcgtgtggacagaaggggccacctctacccccagccctgctttctgggccctcccaccataccccttcctgggaaggagggattaacaggctgcaataacgcccacaagggtggtcttggcccacacgtctgctcctgtggggtcaggacgcacatctcgcctggtggcagaaggccgcaaccacttctctccatcctgtgctgtgggtgggtggatgtatccaggacttaggaagcagggagagcatcttgtgagctgactcaaaggtgtttcttcctctttcaacttttcataagtcagtttttatttttttattttattttttgagacagggtctcattttgttgcccaagctggagtgcagtgtagggacctcggctcgctgcagtctctgcctcctgggttcaagtgattctcctgcctcagccatccaggtagctgggatcacaggcatgcaccaccacccctggcttatatctgtaatttttgtagagacgggggtttcaccatgttgcccgggctggtcttgaactcctgagctcaagtgatcagcctcccaaagtgctgggattacaggcgtgagccactatgcccggcccgtaagtcagtttttgaaatataaaagtggtataggctagatgtgacaaaaaacagtcaaatgatacaagagcttataaagtcatatggcaagttcctccccaccaatcatgcagtgaagtgagggtcatgtgtgtccttggaagagtcacctccagttcttgcagggggatgttttcctaaaactttctgagcattgctcttctctgctcaagccacttcaatacacctcaggcagcaaagtctcagcttttgagccgtggtctctgagggtgttggatgtgaacgaaatcaaatcggtacaatgatgactgtggcaagtgcgatgaaggaacgaacctgcagggcgcagaagacgtgtcctggggccctgccttggtttggaagacaggcaggcatccctgaggctgatggggagatgaaccccgaagccagagtgcttatccgtcagatctctgcttcatgtttggagtttgctcacttaacacatcagaagtggctttgttccgtatggcagcaagttctgcagaagcctcatttgggtggggggagttttattaaaacagtttatcatggagaattccaactatacaaaagtagagcaaacagtaaaatggactctcatctatccatcaccaacccatgaccaatgtcttcagctgtcagagatttatcttatagctccttgcttcctcctcctctctctacctgtctgaattgtgtgaagcacatcctggccataagatcagttaacttcttagtatttcagtatgtttctctcaacgttgtaaatgccactattacacctaaagaaatcaacaatatcaaaaagaaacagcataccttaaaaaaagttttaaaaca

SEQ ID NO: 200099 - DNA, 4067 bp, Homo sapiens
  Payload ID: 19473
  Gene Name: widely interspaced zinc finger motifs
  ENST ID: ENST00000389282
  CDS Start-End: 1-2499
atggacttgggctctccctcgctccctaagaagagcctgcctgtccctggggccctggagcaggtggccagtcggctgagcagcaaagtggctgcagaggttcctcatggcagcaaacaggagctgcaggacctcaaggcccagagcctgaccacctgcgaggtctgcggtgcctgctttgagacccgaaagggcctgtccagccacgcgcgctcccacctgcggcagctgggagtggcagagtcggaaagcagcggcgcacccatcgacctcctctacgagcttgtgaagcagaagggtctgcctgacgcccaccttgggctgcccccaggcctggctaagaagtccagctcactgaaggaggtggtcgccggggccccccggcccggcttgctcagcctggccaagcccttggatgcccctgctgtcaacaaagccatcaagtcgcctcccggcttctcggccaagggcctgggccacccgcccagctctccactcctcaaaaagacaccactggccctggcgggctcccctacccctaagaatcctgaggacaagagcccccagctgtccctgagcccccggccggcctccccaaaggcacagtggcctcagtctgaggatgaggggcccttgaacctcacctcaggcccagagccagcacgagacatccgctgcgagttctgtggtgagttcttcgagaaccgcaagggcctctcgagccacgcgcgctcccatctgcggcaaatgggcgtgaccgagtggtacgtcaatggctcgcccatcgacacgctgcgggagatcctgaagagacggacccagtctcggcctggtggacctcccaacccaccagggccaagcccaaaagccctggccaagatgatgggcggcgcaggtcctggcagctcactggaagcccgcagcccctcggaccttcacatctcacccttggccaagaagttgccaccaccaccgggcagccccctgggccactcaccaactgcctctcctcctcctacggcccgaaagatgttcccaggcctggctgcaccctccttgcccaagaagctgaagcctgaacaaatacgggtggagatcaagcgggagatgctgccgggggcccttcatggggaactgcacccatctgagggtccctggggggcaccacgggaagacatgacacccctgaacctgtcgtcccgggcagagccggtgcgcgacatccgctgtgagttctgcggcgagttcttcgagaaccgcaagggcctgtcgagtcacgcgcgctcacacctgcggcagatgggtgtgaccgagtggtccgtcaatggttcgcccatcgacacactgcgagagatcctcaagaagaagtccaagccgtgcctcatcaagaaggagccaccggctggagacctggcccctgccctggctgaggacgggcctcccaccgtggcccctgggcccgtgcagtccccactgccgctgtcgcccctggctggccggccaggcaaaccaggtgcagggccggcccaggttcctcgtgagctcagcctgacgcccatcactggggccaagccctcagccactggctacctgggctcagtggcagccaagcggcccctgcaggaggaccgcctcctcccagcagaggtcaaggccaagacctacatccagactgaactgcccttcaaggcaaagacccttcatgagaagacctcccactcctccaccgaggcctgctgcgagctgtgtggcctttactttgaaaaccgcaaggccctggccagccacgcacgggcacacctgcggcagttcggcgtgaccgagtggtgcgtcaatggctcgcccatcgagacactgagcgagtggatcaaacaccggccccagaaggtgggcgcctaccgcagctacatccagggcggccgccccttcaccaagaagttccgcagtgccggccatggccgtgacagtgacaagcggccgtccctggggctggcacccgggggcctggccgtggtcggccgcagtgccggaggggagccagggcccgaggctggccgggcagccgacggtggtgagcggcctctggcagccagcccgccaggcaccgtgaaggctgaggagcaccagcggcagaacatcaacaaatttgaacgccgacaagcccgccctccagatgcctccgcagcccggggaggcgaggacaccaatgacctacagcagaagctggaggaggtgcggcaacccccaccccgagtccggccagtcccctccctggtgccccggcccccccagacatcacttgtcaagttcgtgggcaacatctacaccctcaaatgcaggttctgtgaggtggaattccagggccccctctccatccaggaagagtgggtgcggcacttacagcggcacatcctggagatgaacttctccaaagcggaccccccacctgaggagtcccaggccccgcaggcacagacagcggcggcagaggctccctaacacaaaagcattccagatcccctctcgtgccacctctgtctcctcttcttcctcctctgtgtccttgtccctcttcctctttctttccgtttccaaaggagcaagccaaaacctcaaaccggcgccccttgggggccgggcacactacagccagggcgccgggagccagctagctgcccttcccccagcccgaggactctggggccacagggtgtcttccttcagcccatgcccacctggtccagcaggggcagcagccaggtctctgatggcagccggtctggtcacaggggaggacagcactcccccgtctagcagccaggcagggcgatgtctgccatccgtggccatttgcaaagaccccaaagacccctgttctggttccctctctcccccatgaatatcctctcacacacatgtacatgcgaacacacacaacacgcacctcgtgagacccgggacctgccccggacccccagttcctgggttgaacgaccacatcatgccacggtgcttgctcaggggaagccacgctccctctgtggggcctgctggggcctgggagccccccactgagcccacaatgccacggaaatccttgttggctgcccccgagaggggccttcccagctgggaagagctcagagctgacagctgcctcctgccatgtcaaggccccccaaagagcctcaggggctctggggccctggagggtggggttggggggtgggactctcctcccccactcctgctccctctcccttttcactgttgctttctatgtatagctccctagacctttcacttttttaaaaacgcgttttgtgtagagaataaggaacgtggatctttttattttgcaatcctgggccagctagaagccaggagctgattgaccttttaacttttttcagtggccacattttggttatcgatgtacctagaagtatgtaaattagattaaatttctcttctggaaacaccctggggcaggcggccagcgtgtgtttttctgtcaagtggacaggctggcattggctggcagccggggctgggatcggggcctcctctgtccagagcgccatggaggccctgggttttccagttggccgccaagccgaccagacgcagctggggatgagcccaagttcccagctgttggctctttaggccatggctgggagggggtctctggctggctggcaaagcggctccagtgagcagatgaaccagggttctgggcagcctgtctgggaagggagccaggatcaagaagcagttgaggctagaggagcttatcaaaggcaggagctaccagcgagggtgtcagggacccgttgggagcatttgggtgggggccagtggggttgtagagagctggaactcacctgcttttaatacatgtgacttctagtgagacacatgcacccctgacccaaggaacatgcggggaaaagaggagccactggctcctttgcgatgttatttattttctcgctctgcaaatgtttattgaacatttctgagattttaagagattttgttggctgctccttcttgtttattgc

SEQ ID NO: 200100 - DNA, 4466 bp, Homo sapiens
  Payload ID: 19473
  Gene Name: widely interspaced zinc finger motifs
  Uniprot ID: O95785
  ENST ID: ENST00000545156
  CDS Start-End: 1-2898
atggacttgggctctccctcgctccctaagaagagcctgcctgtccctggggccctggagcaggtggccagtcggctgagcagcaaagtggctgcagaggttcctcatggcagcaaacaggagctgcaggacctcaaggcccagagcctgaccacctgcgaggtctgcggtgcctgctttgagacccgaaagggcctgtccagccacgcgcgctcccacctgcggcagctgggagtggcagagtcggaaagcagcggcgcacccatcgacctcctctacgagcttgtgaagcagaagggtctgcctgacgcccaccttgggctgcccccaggcctggctaagaagtccagctcactgaaggaggtggtcgccggggccccccggcccggcttgctcagcctggccaagcccttggatgcccctgctgtcaacaaagccatcaagtcgcctcccggcttctcggccaagggcctgggccacccgcccagctctccactcctcaaaaagacaccactggccctggcgggctcccctacccctaagaatcctgaggacaagagcccccagctgtccctgagcccccggccggcctccccaaaggcacagtggcctcagtctgaggatgaggggcccttgaacctcactttagatagtgacgggggcagagagctggactgccagctgtgcggtgcctggtttgagacccgcaagggcctgtctagccacgcccgtgcccacctgcgccacctgggcgtcagcgatccggacgccaagggatcccccatagacgtgctccacgggctcatcaggagggacggcgtccagatccgcctcccacccaggcgcggcgccctggcccacccggggcggccgcctcccacctccgcggccctctccttgcttccccccccaccgccggccaagaaggccaagctgaaggccgcgggtatggccagcccctgggggaagcaggacctctcggccgccgcagccgccggcattttctgggcctctgatgtggagccgtctcctctcaacctctcctcaggcccagagccagcacgagacatccgctgcgagttctgtggtgagttcttcgagaaccgcaagggcctctcgagccacgcgcgctcccatctgcggcaaatgggcgtgaccgagtggtacgtcaatggctcgcccatcgacacgctgcgggagatcctgaagagacggacccagtctcggcctggtggacctcccaacccaccagggccaagcccaaaagccctggccaagatgatgggcggcgcaggtcctggcagctcactggaagcccgcagcccctcggaccttcacatctcacccttggccaagaagttgccaccaccaccgggcagccccctgggccactcaccaactgcctctcctcctcctacggcccgaaagatgttcccaggcctggctgcaccctccttgcccaagaagctgaagcctgaacaaatacgggtggagatcaagcgggagatgctgccgggggcccttcatggggaactgcacccatctgagggtccctggggggcaccacgggaagacatgacacccctgaacctgtcgtcccgggcagagccggtgcgcgacatccgctgtgagttctgcggcgagttcttcgagaaccgcaagggcctgtcgagtcacgcgcgctcacacctgcggcagatgggtgtgaccgagtggtccgtcaatggttcgcccatcgacacactgcgagagatcctcaagaagaagtccaagccgtgcctcatcaagaaggagccaccggctggagacctggcccctgccctggctgaggacgggcctcccaccgtggcccctgggcccgtgcagtccccactgccgctgtcgcccctggctggccggccaggcaaaccaggtgcagggccggcccaggttcctcgtgagctcagcctgacgcccatcactggggccaagccctcagccactggctacctgggctcagtggcagccaagcggcccctgcaggaggaccgcctcctcccagcagaggtcaaggccaagacctacatccagactgaactgcccttcaaggcaaagacccttcatgagaagacctcccactcctccaccgaggcctgctgcgagctgtgtggcctttactttgaaaaccgcaaggccctggccagccacgcacgggcacacctgcggcagttcggcgtgaccgagtggtgcgtcaatggctcgcccatcgagacactgagcgagtggatcaaacaccggccccagaaggtgggcgcctaccgcagctacatccagggcggccgccccttcaccaagaagttccgcagtgccggccatggccgtgacagtgacaagcggccgtccctggggctggcacccgggggcctggccgtggtcggccgcagtgccggaggggagccagggcccgaggctggccgggcagccgacggtggtgagcggcctctggcagccagcccgccaggcaccgtgaaggctgaggagcaccagcggcagaacatcaacaaatttgaacgccgacaagcccgccctccagatgcctccgcagcccggggaggcgaggacaccaatgacctacagcagaagctggaggaggtgcggcaacccccaccccgagtccggccagtcccctccctggtgccccggcccccccagacatcacttgtcaagttcgtgggcaacatctacaccctcaaatgcaggttctgtgaggtggaattccagggccccctctccatccaggaagagtgggtgcggcacttacagcggcacatcctggagatgaacttctccaaagcggaccccccacctgaggagtcccaggccccgcaggcacagacagcggcggcagaggctccctaacacaaaagcattccagatcccctctcgtgccacctctgtctcctcttcttcctcctctgtgtccttgtccctcttcctctttctttccgtttccaaaggagcaagccaaaacctcaaaccggcgccccttgggggccgggcacactacagccagggcgccgggagccagctagctgcccttcccccagcccgaggactctggggccacagggtgtcttccttcagcccatgcccacctggtccagcaggggcagcagccaggtctctgatggcagccggtctggtcacaggggaggacagcactcccccgtctagcagccaggcagggcgatgtctgccatccgtggccatttgcaaagaccccaaagacccctgttctggttccctctctcccccatgaatatcctctcacacacatgtacatgcgaacacacacaacacgcacctcgtgagacccgggacctgccccggacccccagttcctgggttgaacgaccacatcatgccacggtgcttgctcaggggaagccacgctccctctgtggggcctgctggggcctgggagccccccactgagcccacaatgccacggaaatccttgttggctgcccccgagaggggccttcccagctgggaagagctcagagctgacagctgcctcctgccatgtcaaggccccccaaagagcctcaggggctctggggccctggagggtggggttggggggtgggactctcctcccccactcctgctccctctcccttttcactgttgctttctatgtatagctccctagacctttcacttttttaaaaacgcgttttgtgtagagaataaggaacgtggatctttttattttgcaatcctgggccagctagaagccaggagctgattgaccttttaacttttttcagtggccacattttggttatcgatgtacctagaagtatgtaaattagattaaatttctcttctggaaacaccctggggcaggcggccagcgtgtgtttttctgtcaagtggacaggctggcattggctggcagccggggctgggatcggggcctcctctgtccagagcgccatggaggccctgggttttccagttggccgccaagccgaccagacgcagctggggatgagcccaagttcccagctgttggctctttaggccatggctgggagggggtctctggctggctggcaaagcggctccagtgagcagatgaaccagggttctgggcagcctgtctgggaagggagccaggatcaagaagcagttgaggctagaggagcttatcaaaggcaggagctaccagcgagggtgtcagggacccgttgggagcatttgggtgggggccagtggggttgtagagagctggaactcacctgcttttaatacatgtgacttctagtgagacacatgcacccctgacccaaggaacatgcggggaaaagaggagccactggctcctttgcgatgttatttattttctcgctctgcaaatgtttattgaacatttctgagattttaagagattttgttggctgctccttcttgtttattgc

SEQ ID NO: 200101 - DNA, 4609 bp, Homo sapiens
  Payload ID: 19473
  Gene Name: widely interspaced zinc finger motifs
  ENST ID: ENST00000599910
  CDS Start-End: 150-3056
agaagcaggcggtgattgaaatgtgttgccggccttgtggggttccctaggtctgcggaacggcaccgtcgggggacggttggataacaggatgatactggagggattcttgtggttggagatcaggcctgggttctgaggaaaacgcaatggtggccatggacttgggctctccctcgctccctaagaagagcctgcctgtccctggggccctggagcaggtggccagtcggctgagcagcaaagtggctgcagaggttcctcatggcagcaaacaggagctgcaggacctcaaggcccagagcctgaccacctgcgaggtctgcggtgcctgctttgagacccgaaagggcctgtccagccacgcgcgctcccacctgcggcagctgggagtggcagagtcggaaagcagcggcgcacccatcgacctcctctacgagcttgtgaagcagaagggtctgcctgacgcccaccttgggctgcccccaggcctggctaagaagtccagctcactgaaggaggtggtcgccggggccccccggcccggcttgctcagcctggccaagcccttggatgcccctgctgtcaacaaagccatcaagtcgcctcccggcttctcggccaagggcctgggccacccgcccagctctccactcctcaaaaagacaccactggccctggcgggctcccctacccctaagaatcctgaggacaagagcccccagctgtccctgagcccccggccggcctccccaaaggcacagtggcctcagtctgaggatgaggggcccttgaacctcactttagatagtgacgggggcagagagctggactgccagctgtgcggtgcctggtttgagacccgcaagggcctgtctagccacgcccgtgcccacctgcgccacctgggcgtcagcgatccggacgccaagggatcccccatagacgtgctccacgggctcatcaggagggacggcgtccagatccgcctcccacccaggcgcggcgccctggcccacccggggcggccgcctcccacctccgcggccctctccttgcttccccccccaccgccggccaagaaggccaagctgaaggccgcgggtatggccagcccctgggggaagcaggacctctcggccgccgcagccgccggcattttctgggcctctgatgtggagccgtctcctctcaacctctcctcaggcccagagccagcacgagacatccgctgcgagttctgtggtgagttcttcgagaaccgcaagggcctctcgagccacgcgcgctcccatctgcggcaaatgggcgtgaccgagtggtacgtcaatggctcgcccatcgacacgctgcgggagatcctgaagagacggacccagtctcggcctggtggacctcccaacccaccagggccaagcccaaaagccctggccaagatgatgggcggcgcaggtcctggcagctcactggaagcccgcagcccctcggaccttcacatctcacccttggccaagaagttgccaccaccaccgggcagccccctgggccactcaccaactgcctctcctcctcctacggcccgaaagatgttcccaggcctggctgcaccctccttgcccaagaagctgaagcctgaacaaatacgggtggagatcaagcgggagatgctgccgggggcccttcatggggaactgcacccatctgagggtccctggggggcaccacgggaagacatgacacccctgaacctgtcgtcccgggcagagccggtgcgcgacatccgctgtgagttctgcggcgagttcttcgagaaccgcaagggcctgtcgagtcacgcgcgctcacacctgcggcagatgggtgtgaccgagtggtccgtcaatggttcgcccatcgacacactgcgagagatcctcaagaagaagtccaagccgtgcctcatcaagaaggagccaccggctggagacctggcccctgccctggctgaggacgggcctcccaccgtggcccctgggcccgtgcagtccccactgccgctgtcgcccctggctggccggccaggcaaaccaggtgcagggccggcccaggttcctcgtgagctcagcctgacgcccatcactggggccaagccctcagccactggctacctgggctcagtggcagccaagcggcccctgcaggaggaccgcctcctcccagcagaggtcaaggccaagacctacatccagactgaactgcccttcaaggcaaagacccttcatgagaagacctcccactcctccaccgaggcctgctgcgagctgtgtggcctttactttgaaaaccgcaaggccctggccagccacgcacgggcacacctgcggcagttcggcgtgaccgagtggtgcgtcaatggctcgcccatcgagacactgagcgagtggatcaaacaccggccccagaaggtgggcgcctaccgcagctacatccagggcggccgccccttcaccaagaagttccgcagtgccggccatggccgtgacagtgacaagcggccgtccctggggctggcacccgggggcctggccgtggtcggccgcagtgccggaggggagccagggcccgaggctggccgggcagccgacggtggtgagcggcctctggcagccagcccgccaggcaccgtgaaggctgaggagcaccagcggcagaacatcaacaaatttgaacgccgacaagcccgccctccagatgcctccgcagcccggggaggcgaggacaccaatgacctacagcagaagctggaggaggtgcggcaacccccaccccgagtccggccagtcccctccctggtgccccggcccccccagacatcacttgtcaagttcgtgggcaacatctacaccctcaaatgcaggttctgtgaggtggaattccagggccccctctccatccaggaagagtgggtgcggcacttacagcggcacatcctggagatgaacttctccaaagcggaccccccacctgaggagtcccaggccccgcaggcacagacagcggcggcagaggctccctaacacaaaagcattccagatcccctctcgtgccacctctgtctcctcttcttcctcctctgtgtccttgtccctcttcctctttctttccgtttccaaaggagcaagccaaaacctcaaaccggcgccccttgggggccgggcacactacagccagggcgccgggagccagctagctgcccttcccccagcccgaggactctggggccacagggtgtcttccttcagcccatgcccacctggtccagcaggggcagcagccaggtctctgatggcagccggtctggtcacaggggaggacagcactcccccgtctagcagccaggcagggcgatgtctgccatccgtggccatttgcaaagaccccaaagacccctgttctggttccctctctcccccatgaatatcctctcacacacatgtacatgcgaacacacacaacacgcacctcgtgagacccgggacctgccccggacccccagttcctgggttgaacgaccacatcatgccacggtgcttgctcaggggaagccacgctccctctgtggggcctgctggggcctgggagccccccactgagcccacaatgccacggaaatccttgttggctgcccccgagaggggccttcccagctgggaagagctcagagctgacagctgcctcctgccatgtcaaggccccccaaagagcctcaggggctctggggccctggagggtggggttggggggtgggactctcctcccccactcctgctccctctcccttttcactgttgctttctatgtatagctccctagacctttcacttttttaaaaacgcgttttgtgtagagaataaggaacgtggatctttttattttgcaatcctgggccagctagaagccaggagctgattgaccttttaacttttttcagtggccacattttggttatcgatgtacctagaagtatgtaaattagattaaatttctcttctggaaacaccctggggcaggcggccagcgtgtgtttttctgtcaagtggacaggctggcattggctggcagccggggctgggatcggggcctcctctgtccagagcgccatggaggccctgggttttccagttggccgccaagccgaccagacgcagctggggatgagcccaagttcccagctgttggctctttaggccatggctgggagggggtctctggctggctggcaaagcggctccagtgagcagatgaaccagggttctgggcagcctgtctgggaagggagccaggatcaagaagcagttgaggctagaggagcttatcaaaggcaggagctaccagcgagggtgtcagggacccgttgggagcatttgggtgggggccagtggggttgtagagagctggaactcacctgcttttaatacatgtgacttctagtgagacacatgcacccctgacccaaggaacatgcggggaaaagaggagccactggctcctttgcgatgttatttattttctcgctctgcaaatgtttattgaacatttctgagattttaagagattttgttggctgctc

SEQ ID NO: 200102 - DNA, 603 bp, Homo sapiens
  Payload ID: 19473
  Gene Name: widely interspaced zinc finger motifs
  ENST ID: ENST00000596159
  CDS Start-End: 203-603
gtcccccctacctcggcgcgtcccgcggggtctcctgccccggggtgcacgggcggagggctcatcccccggaccctggacccccgaggagtgggcccgcgcggcgcagcccccacctctgcgacccctggggggcgtccgggcccacaatgccccgctgagccggtgcagcagctgagtggatccaagcagagaaaatccgatggaggggtctctggcaggcagcctggctgcaccagatcgtccccaaggcccagagagactgcctggcccggcgccaagggagaacatcgagggtggggccgaagctgctgagggggaaggtggcatcttccggtccacccgttacctgcctgtcaccaaggagggcccccgagacattctggatggcagaggtggcatctctgtggccaactttgacccaggcaccttcagcctgatgcgctgtgacttctgcggggctggcttcgacacacgggccggcctctccagccacgcccgggcccacctacgtgacttcggtatcaccaactgggagctcactgtctcacccatcaacatcctgcaggagctgctggccacctctgctgctgagcagccccc

SEQ ID NO: 200103 - DNA, 3644 bp, Homo sapiens
  Payload ID: 19473
  Gene Name: widely interspaced zinc finger motifs
  Uniprot ID: O95785
  ENST ID: ENST00000599686
  CDS Start-End: 148-2655
ccgccgccgccgcccccacccccgccgccgccgccaccaccaccgccaccgccaccgccgccgcgggacgggcccaaggccgagccggagccggggcccgggcccgcgtccgctcccgcgcccggcctgggttctgaggaaaacgcaatggtggccatggacttgggctctccctcgctccctaagaagagcctgcctgtccctggggccctggagcaggtggccagtcggctgagcagcaaagtggctgcagaggttcctcatggcagcaaacaggagctgcaggacctcaaggcccagagcctgaccacctgcgaggtctgcggtgcctgctttgagacccgaaagggcctgtccagccacgcgcgctcccacctgcggcagctgggagtggcagagtcggaaagcagcggcgcacccatcgacctcctctacgagcttgtgaagcagaagggtctgcctgacgcccaccttgggctgcccccaggcctggctaagaagtccagctcactgaaggaggtggtcgccggggccccccggcccggcttgctcagcctggccaagcccttggatgcccctgctgtcaacaaagccatcaagtcgcctcccggcttctcggccaagggcctgggccacccgcccagctctccactcctcaaaaagacaccactggccctggcgggctcccctacccctaagaatcctgaggacaagagcccccagctgtccctgagcccccggccggcctccccaaaggcacagtggcctcagtctgaggatgaggggcccttgaacctcacctcaggcccagagccagcacgagacatccgctgcgagttctgtggtgagttcttcgagaaccgcaagggcctctcgagccacgcgcgctcccatctgcggcaaatgggcgtgaccgagtggtacgtcaatggctcgcccatcgacacgctgcgggagatcctgaagagacggacccagtctcggcctggtggacctcccaacccaccagggccaagcccaaaagccctggccaagatgatgggcggcgcaggtcctggcagctcactggaagcccgcagcccctcggaccttcacatctcacccttggccaagaagttgccaccaccaccgggcagccccctgggccactcaccaactgcctctcctcctcctacggcccgaaagatgttcccaggcctggctgcaccctccttgcccaagaagctgaagcctgaacaaatacgggtggagatcaagcgggagatgctgccgggggcccttcatggggaactgcacccatctgagggtccctggggggcaccacgggaagacatgacacccctgaacctgtcgtcccgggcagagccggtgcgcgacatccgctgtgagttctgcggcgagttcttcgagaaccgcaagggcctgtcgagtcacgcgcgctcacacctgcggcagatgggtgtgaccgagtggtccgtcaatggttcgcccatcgacacactgcgagagatcctcaagaagaagtccaagccgtgcctcatcaagaaggagccaccggctggagacctggcccctgccctggctgaggacgggcctcccaccgtggcccctgggcccgtgcagtccccactgccgctgtcgcccctggctggccggccaggcaaaccaggtgcagggccggcccaggttcctcgtgagctcagcctgacgcccatcactggggccaagccctcagccactggctacctgggctcagtggcagccaagcggcccctgcaggaggaccgcctcctcccagcagaggtcaaggccaagacctacatccagactgaactgcccttcaaggcaaagacccttcatgagaagacctcccactcctccaccgaggcctgctgcgagctgtgtggcctttactttgaaaaccgcaaggccctggccagccacgcacgggcacacctgcggcagttcggcgtgaccgagtggtgcgtcaatggctcgcccatcgagacactgagcgagtggatcaaacaccggccccagaaggtgggcgcctaccgcagctacatccagggcggccgccccttcaccaagaagttccgcagtgccggccatggccgtgacagtgacaagcggccgtccctggggctggcacccgggggcctggccgtggtcggccgcagtgccggaggggagccagggcccgaggctggccgggcagccgacggtggtgagcggcctctggcagccagcccgccaggcaccgtgaaggctgaggagcaccagcggcagaacatcaacaaatttgaacgccgacaagcccgccctccagatgcctccgcagcccggggaggcgaggacaccaatgacctacagcagaagctggaggaggtgcggcaacccccaccccgagtccggccagtcccctccctggtgccccggcccccccagacatcacttgtcaagttcgtgggcaacatctacaccctcaaatgcaggttctgtgaggtggaattccagggccccctctccatccaggaagagtgggtgcggcacttacagcggcacatcctggagatgaacttctccaaagcggaccccccacctgaggagtcccaggccccgcaggcacagacagcggcggcagaggctccctaacacaaaagcattccagatcccctctcgtgccacctctgtctcctcttcttcctcctctgtgtccttgtccctcttcctctttctttccgtttccaaaggagcaagccaaaacctcaaaccggcgccccttgggggccgggcacactacagccagggcgccgggagccagctagctgcccttcccccagcccgaggactctggggccacagggtgtcttccttcagcccatgcccacctggtccagcaggggcagcagccaggtctctgatggcagccggtctggtcacaggggaggacagcactcccccgtctagcagccaggcagggcgatgtctgccatccgtggccatttgcaaagaccccaaagacccctgttctggttccctctctcccccatgaatatcctctcacacacatgtacatgcgaacacacacaacacgcacctcgtgagacccgggacctgccccggacccccagttcctgggttgaacgaccacatcatgccacggtgcttgctcaggggaagccacgctccctctgtggggcctgctggggcctgggagccccccactgagcccacaatgccacggaaatccttgttggctgcccccgagaggggccttcccagctgggaagagctcagagctgacagctgcctcctgccatgtcaaggccccccaaagagcctcaggggctctggggccctggagggtggggttggggggtgggactctcctcccccactcctgctccctctcccttttcactgttgctttctatgtatagctccctagacctttcacttttttaaaaacgcgttttgtgtagagaataaggaacgtggatctttttattttgcaatcctgggccagctagaagccaggagctgattgaccttttaacttttttcagtggccacattttggttatcgatgtacctagaagtatgtaaattagattaaatttctcttctggaaacaccctggg

SEQ ID NO: 200104 - DNA, 1230 bp, Homo sapiens
  Payload ID: 19474
  Gene Name: Williams Beuren syndrome chromosome region 22
  Uniprot ID: O43709
  ENST ID: ENST00000265758
  CDS Start-End: 59-904
gacataaaaaccgggtgccggcaggcgccagtcgcaggtgtgctgctgaggcgtgagaatggcgtcccgcggccggcgtccggagcatggcggacccccagagctgttttatgacgagacagaagcccggaaatacgttcgcaactcacggatgattgatatccagaccaggatggctgggcgagcattggagcttctttatctgccagagaataagccctgttacctgctggatattggctgtggcactgggctgagtggaagttatctgtcagatgaagggcactattgggtgggcctggatatcagccctgccatgctggatgaggctgtggaccgagagatagagggagacctgctgctgggggatatgggccagggcatcccattcaagccaggcacatttgatggttgcatcagcatttctgctgtgcagtggctctgtaatgctaacaagaagtctgaaaaccctgccaagcgcctgtactgcttttttgcttctcttttttctgttctcgtccggggatcccgagctgtcctgcagctgtaccctgagaactcagagcagttggagctgatcacaacccaggccacaaaggcaggcttctccggtggcatggtggtagactaccctaacagtgccaaagcaaagaaattctacctctgcttgttttctgggccttcgacctttataccagaggggctgagtgaaaatcaggatgaagttgaacccagggagtctgtgttcaccaatgagaggttcccattaaggatgtcgaggcggggaatggtgaggaagagtcgggcatgggtgctggagaagaaggagcggcacaggcgccagggcagggaagtcagacctgacacccagtacaccggccgcaagcgcaagccccgcttctaagtcaccacgcggttctggaaaggcacttgcctctgcacttttctatattgttcagctgacaaagtagtattttagaaaagttctaaagttataaaaatgttttctgcagtaaaaaaaaagttctctgggccgggcgtggtggctcacacctgtaatcccagcaccttgggaggctgaggtgggaggatcatttgaggccaggagtttgagacctgcctgggcaacataatgaaacttcctttccagggaggaaaaaaaaaaaaaaaaaaagctctgagagcatcttattttgtttaaaggcaagaaataaaatttccttttgtgga

SEQ ID NO: 200105 - DNA, 577 bp, Homo sapiens
  Payload ID: 19474
  Gene Name: Williams Beuren syndrome chromosome region 22
  ENST ID: ENST00000428163
  CDS Start-End: 20-442
gtgctgctgaggcgtgagaatggcgtcccgcggccggcgtccggagcatggcggacccccagagctgttttatgacgagacagaagcccggaaatacgttcgcaactcacggatgattgatatccagaccaggatggctgggcgagcattggagcttctttatctgccagagaataagccctgttacctgctggatattggctgtggcactgggctgagtggaagttatctgtcagatgaagggcactattgggtgggcctggatatcagccctgccatgctggatgaggctgtggaccgagagatagagggagacctgctgctgggggatatgggccagggcatcccattcaagccaggcacatttgatggttgcatcaggtccggggatcccgagctgtcctgcagctgtaccctgagaactcagagcagttggagctgatcacaacccaggccacaaaggcaggcttctccggtggcatggtggtagactaccctaacagtgccaaagcaaagaaattctacctctgcttgttttctgggccttcgacctttataccagaggggctgagtgaaa

SEQ ID NO: 200106 - DNA, 1074 bp, Homo sapiens
  Payload ID: 19474
  Gene Name: Williams Beuren syndrome chromosome region 22
  ENST ID: ENST00000432522
  CDS Start-End: 56-478
ataaaaaccgggtgccggcaggcgccagtcgcaggtgtgctgctgaggcgtgagaatggcgtcccgcggccggcgtccggagcatggcggacccccagagctgttttatgacgagacagaagcccggaaatacgttcgcaactcacggatgattgatatccagaccaggatggctgggcgagcattggagcttctttatctgccagagaataagccctgttacctgctggatattggctgtggcactgggctgagtggaagttatctgtcagatgaagggcactattgggtgggcctggatatcagccctgccatgctggcatttctgctgtgcagtggctctgtaatgctaacaagaagtctgaaaaccctgccaagcgcctgtactgcttttttgcttctcttttttctgttctcgtccggggatcccgagctgtcctgcagctgtaccctgagaactcagagcagttggagctgatcacaacccaggccacaaaggcaggcttctccggtggcatggtggtagactaccctaacagtgccaaagcaaagaaattctacctctgcttgttttctgggccttcgacctttataccagaggggctgagtgaaaatcaggatgaagttgaacccagggagtctgtgttcaccaatgagaggtaaagcaactgctgaagcctgccccggctgcagcgggggctgccacatttgttagacatggactttctctctgccctcacccaagcctctcaggtcacatgcagcagggacaccaaggtgacggtagaaacatcaggtcccatttggactgtgcctgtttggggctaggggtttggggtcctggatgtctgggtgcagccatgcagcctggactccctttgtgagcccacacatgccccttccccttgccacgcctggcaggctgtctccttcttttctgatgctgccctccacctgcatctgggaccctctcccttgggtgctgtggctctcccttccttcctgcatcctcatcttgactctcctgggtcactgctgtcggcacacagacatgctgcacaatttctccttttc

SEQ ID NO: 200107 - DNA, 2496 bp, Homo sapiens
  Payload ID: 19474
  Gene Name: Williams Beuren syndrome chromosome region 22
  ENST ID: ENST00000436944
  CDS Start-End: 48-419
gtgctgctgaggcgtgagaatggcgtcccgcggccggcgtccggagcatggcggacccccagagctgttttatgacgagacagaagcccggaaatacgttcgcaagtgaggggagcctgaatactgcggggcgtccgggggtcgggaagcggcaagttgcccctgttgctggcgttgcccggaaaggccgtagaatttggggctcacggatgattgatatccagaccaggatggctgggcgagcattggagcttctttatctgccagagaataagccctgttacctgctggatattggctgtggcactgggctgagtggaagttatctgtcagatgaagggcactattgggtgggcctggatatcagccctgccatgctgggtccggggatcccgagctgtcctgcagctgtaccctgagaactcagagcagttggagctgatcacaacccaggccacaaaggcaggcttctccggtggcatggtggtagactaccctaacagtgccaaagcaaagaaattctacctctgcttgttttctgggccttcgacctttataccagaggggctgagtgaaaatcaggatgaagttgaacccagggagtctgtgttcaccaatgagaggttcccattaaggatgtcgaggcggggaatggtgaggaagagtcgggcatgggtgctggagaagaaggagcggcacaggcgccagggcagccccaagcctgcctcgaacacctgtgtgccacatccttcagggagcacccctgcccggcttcacgtgaacacagaaatggccaaatgtcctccaggagaggaaaagggcccacggataagaggaggagccgctggccgccggcgaaagtgagtccaactgggaggcatcaggagacaggggtcttgagtccacctttgccgctgacatttatgtgacctcagcctggtgttttcccctctctgggactcttccttccctaaaacctgccttacaaggggtctgtgtccaaatactgtccagacccagcactaggggtcatggacgtagggaacatggtgagggggtcatggcaggagggatggggcctacactcaccccagaggcaaagatggcggggttcccactctccagcatgtcctccagctcctcactggtcgtggtcctgccggctgcaagcgagtggggtcacactgagcccagccctcttcggggagttcagcagcagcattgggccccgccccctccgtcccaggcccgggctccccccagccccgagctcagcggcagcctcaggccccgcccccccggcccttaacacagcagccgcctcaggcccccgcccctccagccccaaactcagcagctgcctcgggccacccgcctcgggcccctaactaagcagcagccttgagccacgcactcagcagcagactcgggccccgcccctccaggctccaggccccgccccaggccccacccccagctcactgatctccagctgcctctggatgcggcctttgcagcgctcgcggtagtcggactgcgtggcgttgtactccgacatgacctccacaaactttctggacagcgtggagtgctgggggcccgagatggaggtgcaggggtcaggccctgcggggaccgacccagagactcaggtgcccgcccatcctagactccgtggccgcacctgtgtcttccggatcctcaggtcagcggaggagcggttcaggccttcctcttgctcgatggactgctcgatgcctgggggcacaggtggctgctaagtcataaccaggccccttcaaccccgtcccctacccgcacacccagcatctatccaccttcccacatcccctagggtatgtgtgtggcctgtggctggtgggatcagtgccaggcaccgatggaggaggggcctacagaagcccttccagctgtgacgctgtgtggtgtgtgcatgtgtgtaaatgcacacccactccaagctctgcgtgtgtgtgaggtctggtagctccggccaccctatgcctgggtaccactccttttctgctcagaaaggctgtgtacgagggaccatgcccacagcggggagagccaggtggcccctcctgcagggcatgtggccccgaggccttggcactcatggggtgcacgtgtctgttcacccagaataccgggcttctgcaagagaccaggaagtactggccacttcttcaaccctctttagcagaggtgaggggcagtgcccatccagagtggagccctccctcgccaaagccttaggtgggtgtgtccctgggcccagcccagagtctggcaccaacgggccttgccaagtagctgctgagtgaatgggcacatgacgccaccctcagaaaggaaagcaagatccggcgcaccccctcagggcgagcaaaaccccatgggctccgcagaggaagcaggcctagaatgccccccacccacccccagacaagcctgactcactctttaacttgg

SEQ ID NO: 200108 - DNA, 538 bp, Homo sapiens
  Payload ID: 19474
  Gene Name: Williams Beuren syndrome chromosome region 22
  ENST ID: ENST00000421304
  CDS Start-End: 270-538
acataaaaaccgggtgccggcaggcgccagtcgcaggtgtgctgctgaggcgtgagaatggcgtcccgcggccggcgtccggagcatggcggacccccagagctgttttatgacgagacagaagcccggaaatacgttcgcaagtgaggggagcctgaatactgcggggcgtccgggggtcgggaagcggcaagttgcccctgttgctggcgttgcccggaaaggccgtagaatttgggggtgcgggaagggaaggacccggctcacggatgattgatatccagaccaggatggctgggcgagcattggagcttctttatctgccagagaataagccctgttacctgctggatattggctgtggcactgggctgagtggaagttatctgtcagatgaagggcactattgggtgggcctggatatcagccctgccatgctggatgaggctgtggaccgagagatagagggagacctgctgctgggggatatgggccagggcatcccattcaagccaggcacatttgatggttgcatcag

SEQ ID NO: 200109 - DNA, 632 bp, Homo sapiens
  Payload ID: 19474
  Gene Name: Williams Beuren syndrome chromosome region 22
  ENST ID: ENST00000441822
  CDS Start-End: 54-632
gcaggtgtgctgctgaggcgtgagaatggcgtcccgcggccggcgtccggagcatggcggacccccagagctgttttatgacgagacagaagcccggaaatacgttcgcaagtgaggggagcctgaatactgcggggcgtccgggggtcgggaagcggcaagttgcccctgttgctggcgttgcccggaaaggccgtagaatttggggctcacggatgattgatatccagaccaggatggctgggcgagcattggagcttctttatctgccagagaataagccctgttacctgctggatattggctgtggcactgggctgagtggaagttatctgtcagatgaagggcactattgggtgggcctggatatcagccctgccatgctggatgaggctgtggaccgagagatagagggagacctgctgctgggggatatgggccagggcatcccattcaagccaggcacatttgatggttgcatcagcatttctgctgtgcagtggctctgtaatgctaacaagaagtctgaaaaccctgccaagcgcctgtactgcttttttgcttctcttttttctgttctcgtccggggatcccgagctgtcctgcagctgtaccctgagaactcagagcag

SEQ ID NO: 200110 - DNA, 452 bp, Homo sapiens
  Payload ID: 19474
  Gene Name: Williams Beuren syndrome chromosome region 22
  ENST ID: ENST00000453316
  CDS Start-End: 1-196
gtccggggatcccgagctgtcctgcagctgtaccctgagaactcagagcaggttcccattaaggatgtcgaggcggggaatggtgaggaagagtcgggcatgggtgctggagaagaaggagcggcacaggcgccagggcagggaagtcagacctgacacccagtacaccggccgcaagcgcaagccccgcttctaagtcaccacgcggttctggaaaggcacttgcctctgcacttttctatattgttcagctgacaaagtagtattttagaaaagttctaaagttataaaaatgttttctgcagtaaaaaaaaagttctctgggccgggcgtggtggctcacacctgtaatcccagcaccttgggaggctgaggtgggaggatcatttgaggccaggagtttgagacctgcctgggcaacataatgaaacttcctttccagggaggaaaaa

SEQ ID NO: 200111 - DNA, 1260 bp, Homo sapiens
  Payload ID: 19474
  Gene Name: Williams Beuren syndrome chromosome region 22
  ENST ID: ENST00000430270
  CDS Start-End: 29-232
atggcgtcccgcggccggcgtccggagcatggcggacccccagagctgttttatgacgagacagaagcccggaaatacgttcgcaagtgaggggagcctgaatactgcggggcgtccgggggtcgggaagcggcaagttgcccctgttgctggcgttgcccggaaaggccgtagaatttgggggtgcgggaagggaaggacccgggtgggtgccgatttctgtctctggtaaatcaactttaagttgccgacctctctgggcctcggtacctcagcgttgagctcacggatgattgatatccagaccaggatggctgggcgagcattggagcttctttatctgccagagaataagccctgttacctgctggatattggctgtggcactgggctgagtggaagttatctgtcagatgaagggcactattgggtgggcctggatatcagccctgccatgctggatgaggctgtggaccgagagatagagggagacctgctgctgggggatatgggccagggcatcccattcaagccaggcacatttgatggttgcatcagcatttctgctgtgcagtggctctgtaatgctaacaagaagtctgaaaaccctgccaagcgcctgtactgcttttttgcttctcttttttctgttctcgtccggggatcccgagctgtcctgcagctgtaccctgagaactcagagcagttggagctgatcacaacccaggccacaaaggcaggcttctccggtggcatggtggtagactaccctaacagtgccaaagcaaagaaattctacctctgcttgttttctgggccttcgacctttataccagaggggctgagtgaaaatcaggatgaagttgaacccagggagtctgtgttcaccaatgagaggttcccattaaggatgtcgaggcggggaatggtgaggaagagtcgggcatgggtgctggagaagaaggagcggcacaggcgccagggcagggaagtcagacctgacacccagtacaccggccgcaagcgcaagccccgcttctaagtcaccacgcggttctggaaaggcacttgcctctgcacttttctatattgttcagctgacaaagtagtattttagaaaagttctaaagttataaaaatgttttctgcagtaaaaaaaaagttctctgggccgggcgtggtggctcacacctgtaatcccagcaccttgggaggctgaggtgggaggatcatttgaggccaggagtttgagacctgcct

SEQ ID NO: 200112 - DNA, 691 bp, Homo sapiens
  Payload ID: 19474
  Gene Name: Williams Beuren syndrome chromosome region 22
  ENST ID: ENST00000442099
  CDS Start-End: 1-385
catttctgctgtgcagtggctctgtaatgctaacaagaagtctgaaaaccctgccaagcgcctgtactgcttttttgcttctcttttttctgttctcgtccggggatcccgagctgtcctgcagctgtaccctgagaactcagagcagttggagctgatcacaacccaggccacaaaggcaggcttctccggtggcatggtggtagactaccctaacagtgccaaagcaaagaaattctacctctgcttgttttctgggccttcgacctttataccagaggttcccattaaggatgtcgaggcggggaatggtgaggaagagtcgggcatgggtgctggagaagaaggagcggcacaggcgccagggcagggaagtcagacctgacacccagtacaccggccgcaagcgcaagccccgcttctaagtcaccacgcggttctggaaaggcacttgcctctgcacttttctatattgttcagctgacaaagtagtattttagaaaagttctaaagttataaaaatgttttctgcagtaaaaaaaaagttctctgggccgggcgtggtggctcacacctgtaatcccagcaccttgggaggctgaggtgggaggatcatttgaggccaggagtttgagacctgcctgggcaacataatgaaacttcctttccagggaggaaaaaaaaaaaaaaa

SEQ ID NO: 200113 - DNA, 1219 bp, Homo sapiens
  Payload ID: 19474
  Gene Name: Williams Beuren syndrome chromosome region 22
  Uniprot ID: O43709
  ENST ID: ENST00000423497
  CDS Start-End: 1-897
atggcgtcccgcggccggcgtccggagcatggcggacccccagagctgttttatgacgagacagaagcccggaaatacgttcgcaactcacggatgattgatatccagaccaggatggctgggcgagcattggagcttctttatctgccagagaataagccctgttacctgctggatattggctgtggcactgggctgagtggaagttatctgtcagatgaagggcactattgggtgggcctggatatcagccctgccatgctggatgaggctgtggaccgagagatagagggagacctgctgctgggggatatgggccagggcatcccattcaagccaggcacatttgatggttgcatcagcatttctgctgtgcagtggctctgtaatgctaacaagaagtctgaaaaccctgccaagcgcctgtactgcttttttgcttctcttttttctgttctcgtccggggatcccgagctgtcctgcagctgtaccctgagaactcagagcagttggagctgatcacaacccaggccacaaaggcaggcttctccggtggcatggtggtagactaccctaacagtgccaaagcaaagaaattctacctctgcttgttttctgggccttcgacctttataccagaggggctgagtgaaaatcaggatgaagttgaacccagggagtctgtgttcaccaatgagagggaaggtggagcatttgagagaaggggcatccgaggccaccagactcggaggttcccattaaggatgtcgaggcggggaatggtgaggaagagtcgggcatgggtgctggagaagaaggagcggcacaggcgccagggcagggaagtcagacctgacacccagtacaccggccgcaagcgcaagccccgcttctaagtcaccacgcggttctggaaaggcacttgcctctgcacttttctatattgttcagctgacaaagtagtattttagaaaagttctaaagttataaaaatgttttctgcagtaaaaaaaaagttctctgggccgggcgtggtggctcacacctgtaatcccagcaccttgggaggctgaggtgggaggatcatttgaggccaggagtttgagacctgcctgggcaacataatgaaacttcctttccagggaggaaaaaaaaaaaaaaaaaaagctctgagagcatcttattttgtttaaaggcaagaaataaaatttccttttg

SEQ ID NO: 200114 - DNA, 895 bp, Homo sapiens
  Payload ID: 19474
  Gene Name: Williams Beuren syndrome chromosome region 22
  ENST ID: ENST00000421744
  CDS Start-End: 54-356
aaaaaccgggtgccggcaggcgccagtcgcaggtgtgctgctgaggcgtgagaatggcgtcccgcggccggcgtccggagcatggcggacccccagagctgttttatgacgagacagaagcccggaaatacgttcgcaactcacggatgattgatatccagaccaggatggctgggcgagcattggagcttctttatctgccagagaataagccctgttacctgctggatattggctgtggcactgggctgagtggaagttatctgtcagatgaagggcactattgggtgggcctggatatcagccctgccatgctgggtccggggatcccgagctgtcctgcagctgtaccctgagaactcagagcagttggagctgatcacaacccaggccacaaaggcaggcttctccggtggcatggtggtagactaccctaacagtgccaaagcaaagaaattctacctctgcttgttttctgggccttcgacctttataccagaggggctgagtgaaaatcaggatgaagttgaacccagggagtctgtgttcaccaatgagaggatccttcttgtccttacactggtgtcttcaaacgacatgtcctaaaagtaaatgtgggtaagttgaatgacctgagcatccattcctcagctattcaaaaagtaggggtagtgccacctatcttggcagtgtgttgagggtgcccagcacgtaccttgccatccctcgttctgtaggctctcacttccagttcctcagatgaggtacagggcagggaggagcttctcccgttactgtcatctcagtctaaccacattcaggacacttgtttattttaaataaacaggtgaattaagaaaaagttttttaagtctttacctaatcagtctccagg

SEQ ID NO: 200115 - DNA, 738 bp, Homo sapiens
  Payload ID: 19474
  Gene Name: Williams Beuren syndrome chromosome region 22
  ENST ID: ENST00000430446
  CDS Start-End: 1-119
gtggcactgggctgagtggaagttatctgtcagatgaagggcactattgggtgggcctggatatcagccctgccatgctgggtccggggatcccgagctgtcctgcagctgtaccctgagaactcagagcagttggagctgatcacaacccaggccacaaaggcaggcttctccggtggcatggtggtagactaccctaacagtgccaaagcaaagaaattctacctctgcttgttttctgggccttcgacctttataccagaggggctgagtgaaaatcaggatgaagttgaacccagggagtctgtgttcaccaatgagaggttcccattaaggatgtcgaggcggggaatggtgaggaagagtcgggcatgggtgctggagaagaaggagcggcacaggcgccagggcagggaagtcagacctgacacccagtacaccggccgcaagcgcaagccccgcttctaagtcaccacgcggttctggaaaggcacttgcctctgcacttttctatattgttcagctgacaaagtagtattttagaaaagttctaaagttataaaaatgttttctgcagtaaaaaaaaagttctctgggccgggcgtggtggctcacacctgtaatcccagcaccttgggaggctgaggtgggaggatcatttgaggccaggagtttgagacctgcctgggcaacataatgaaacttcctttccagggaggaaaaaaaaaaaaaaaaaaa

SEQ ID NO: 200116 - DNA, 941 bp, Homo sapiens
  Payload ID: 19475
  Gene Name: Williams Beuren syndrome chromosome region 27
  Uniprot ID: Q8N6F8
  ENST ID: ENST00000297873
  CDS Start-End: 51-788
gccccgagtcctgttgcccacacgcccgaggcgcgctggattggcggagcatggcccaggaggagggtgggagcctgcccgaggtgcgggcgcgggtcagggccgcgcatggcatccccgacctggcccaaaagctccatttctatgaccgctgggctccggactacgaccaggatgtggccaccctgctgtaccgtgcgccccgcctcgcagtggactgcctcacacaagcccttccaggcccgccccacagtgccctgatcctggacgtggcctgtggcacaggcctagtggctgccgagctgcgggctccaggcttcctccagctgcatggggtggatgggagcccagggatgctggaacaggcccaggcccccggcctctatcagcgcctcagcctctgcaccctgggccaggagcctctgcccagcccggaagggaccttcgacgcggtgctgatagtcggtgccctcagtgacggccaggtgccctgcaatgcgatacctgagctacatgtcaccaagccaggtgggctggtgtgtctgaccaccaggaccaactcgtccaaccttcaatacaaggaggctctggaggccaccctggacaggctggagcaggctgggatgtgggaaggcctggtggcctggcctgtggaccgcctgtggaccgctgggagctggctacctccgagctggaggtggtatccggcatctctgccaaggatggcttcatctccggcattgtctacctgtaccgaaagtggaaggcgacccaggttgaggaagtgagatccagcccccagcccccagctggcccctgactccatgtggccttagctgggcccatctgctgggcctcctctgcctcccctgtaaaatgggacctccgaaccaaccctgcccctcagaaatgccctgcctattaaatgagctcccagaaaa

SEQ ID NO: 200117 - DNA, 539 bp, Homo sapiens
  Payload ID: 19475
  Gene Name: Williams Beuren syndrome chromosome region 27
  ENST ID: ENST00000458679
  CDS Start-End: 32-304
acacgcccgaggcgcgctggattggcggagcatggcccaggaggagggtgggagcctgcccgaggtgcgggcgcgggtcagggccgcgcatggcatccccgacctggcccaaaagctccatttctatgaccgctgggctccggactacgaccaggatgtggccaccctgctgtaccgtgcgccccgcctcgcagtggactgcctcacacaagcccttccaggcccgccccacagtgccctgatcctggacgtggcctgtggcacaggcctagtggctgccgagggaccttcgacgcggtgctgatagtcggtgccctcagtgacggccaggtgccctgcaatgcgatacctgagctacatgtcaccaagccagggacaaccatccccagcagagatggcccaggactgtggctcctgcccctcccccacctcacctacccctctcccccaggtgggctggtgtgtctgaccaccaggaccaactcgtccaaccttcaatacaaggaggctctggaggccaccctggacaggctggagca

SEQ ID NO: 200118 - DNA, 592 bp, Homo sapiens
  Payload ID: 19476
  Gene Name: Williams-Beuren syndrome chromosome region 16
  ENST ID: ENST00000615250
  CDS Start-End: 132-592
attagccgggcgtggtggcgtacgcctgtggtcccagctactcgggaggctgagacacgagagtcacttgaacccaggagggggaggttgcagtgagcctgtcgataggtttgaggggacctgggcaggggatgcgaaggcagcagggaatcgtccactccagctcgctgtcgctggaggacggcctggggcggcgtgggagcagaccggagcggagacggctgcagcaaggccagatttcatctgctgcttgcggctatggattcacactgctgtcctctaagactgcggatgttacgaaagtctgggggatgggactcaacaaagattctcagcttggatttcacaggagccggaaagataaaacgaggggctacgagtatgtgttggagccctcacccgtctccctgcctctggacagacctcaggagacacgggtgctgcaggtctcctgcggccgagctcactctcttgtgttgactgacagggaaggagtcttcagcatgggaaacaattcttatgggcaatgtggaagaaaggtggtcgaaaatgaaatttacagtgaaagtcacagagtccacaggatgcagga

SEQ ID NO: 200119 - DNA, 2419 bp, Homo sapiens
  Payload ID: 19476
  Gene Name: Williams-Beuren syndrome chromosome region 16
  Uniprot ID: Q96I51
  ENST ID: ENST00000614461
  CDS Start-End: 145-1509
acgcctccctgagccttgggctgccgtcagcgcctttgccttcaaccaggagtaaaagtggccgtagcctcttccggcgaggactggtgttaagggtcacgcaagatggcggcgcccagaggctgctgaggcgcggaacggaggatggcgctggtggcgttggtggctggggctcggctggggcggcggctgagcgggccggggctggggcgagggcactggacggcggccgggcgctcccggagccggcgcgaagcggcagaagccgaggcggaggtgcccgtggtccagtacgtgggcgagcgcgctgcccgcgccgatcgcgtcttcgtgtggggcttcagcttctcgggggcgctgggcgtgccttcctttgtggtgcccagctccgggcccgggccccgcgccggcgcccgaccgcgccgcaggatccagcccgtgccctatcgcctggagctggaccaaaagatttcatctgctgcttgcggctatggattcacactgctgtcctctaagactgcggatgttacgaaagtctgggggatgggactcaacaaagattctcagcttggatttcacaggagccggaaagataaaacgaggggctacgagtatgtgttggagccctcacccgtctccctgcctctggacagacctcaggagacacgggtgctgcaggtctcctgcggccgagctcactctcttgtgttgactgacagggaaggagtcttcagcatgggaaacaattcttatgggcaatgtggaagaaaggtggtcgaaaatgaaatttacagtgaaagtcacagagtccacaggatgcaggacttcgatggccaggtggtccaggtcgcctgtggtcaggatcatagtctgttcctgacggataaaggagaagtctattcttgtggatggggtgctgatgggcaaacaggtctgggtcactacaatatcaccagctcgcccaccaagctgggtggagacctggcgggagtgaacgttatccaagttgccacctacggtgattgctgcctggccgtgtccgccgacggaggactttttggttggggaaactcggagtacctgcagctggcctctgtcactgactccacacaggtgaatgtgccccgctgcttacacttctcaggagtggggaaggtgcgacaggctgcatgcggtggcacgggctgtgcagtgttaaacggagaaggacatgtttttgtctggggctatggaattcttgggaaaggtccaaacctagtggaaagtgccgtccctgaaatgattccacccactctctttggcttgacggagttcaacccagaaatccaggtttcccgcatccgatgtggactcagccactttgctgcactgaccaacaaaggagagctgtttgtatggggcaagaacatccgagggtgcctgggaatcggtcgcctggaggaccagtatttcccatggagggcacctgccccatccgccagcgccaagacaacaggcccactcctctgattacctccgggggatggacggcaaacaggtaaggagttccatgcaactgcggatggagcccctctgagaaacacatgcccctccaagtggggtctggggcctggagagaccctcccacccagcagaccaggagatagctgggggacaagggcagacggcccctgcctgggaaaaaccacactcacaccccaccccgaagagctgtggagaccaaaccaagactacgctacacacagaacgccgagaagataaaccaagctttacacgagcaggatggggatgggaaaactaaaggggccccctgtgaccgaggagcagggtccccagggggcagctcccacggagcgggcttgaacagggaccacccctgcagagccagccagggcggagagccataccctggccccagcgcgccccgacacacatgcttttctccatgacacgaggccagtccccaggagcagccccaggagcacaacctgagatttctaagcttgcaggttacaaaaaacaaaaaaaacagagaagctgcctgcgtaaaaagtgccacccacggaggcaggacacaggcagcgtgtggcccattcagcaggcccaggtcttcagggtgaggctgctggcgagggcaggggagagggggcattctggttaaaagcaagaaattccaaatactcctccctcgggatcaacatccccccaaataagggcgcccagggatcttgcctggggaaagtggggtgcagaaggcatgacccacgccacagcgggctctcagcacccttcccacgtcccatgtcacaggctctttgagctgctggctttgttctctcaagtcaggtctgagggaacccatcggcttctgtaataatcgtattgcctatatacttgaattaaaaatatatggtggctc

SEQ ID NO: 200120 - DNA, 2300 bp, Homo sapiens
  Payload ID: 19476
  Gene Name: Williams-Beuren syndrome chromosome region 16
  Uniprot ID: Q96I51
  ENST ID: ENST00000610322
  CDS Start-End: 57-1451
gttaagggtcacgcaagatggcggcgcccagaggctgctgaggcgcggaacggaggatggcgctggtggcgttggtggctggggctcggctggggcggcggctgagcgggccggggctggggcgagggcactggacggcggccgggcgctcccggagccggcgcgaagcggcagaagccgaggcggaggtgcccgtggtccagtacgtgggcgagcgcgctgcccgcgccgatcgcgtcttcgtgtggggcttcagcttctcgggggcgctgggcgtgccttcctttgtggtgcccagctccgggcccgggccccgcgccggcgcccgaccgcgccgcaggatccagcccgtgccctatcgcctggagctggaccaaaagatttcatctgctgcttgcggctatggattcacactgctgtcctctaagactgcggatgttacgaaagtctgggggatgggactcaacaaagattctcagcttggatttcacaggagccggaaagataaaacgaggggctacgagtatgtgttggagccctcacccgtctccctgcctctggacagacctcaggagacacgggtgctgcaggtctcctgcggccgagctcactctcttgtgttgactgacagggaaggagtcttcagcatgggaaacaattcttatgggcaatgtggaagaaaggtggtcgaaaatgaaatttacagtgaaagtcacagagtccacaggatgcaggacttcgatggccaggtggtccaggtcgcctgtggtcaggatcatagtctgttcctgacggataaaggagaagtctattcttgtggatggggtgctgatgggcaaacaggtctgggtcactacaatatcaccagctcgcccaccaagctgggtggagacctggcgggagtgaacgttatccaagttgccacctacggtgattgctgcctggccgtgtccgccgacggaggactttttggttggggaaactcggagtacctgcagctggcctctgtcactgactccacacaggtgaatgtgccccgctgcttacacttctcaggagtggggaaggtgcgacaggctgcatgcggtggcacgggctgtgcagtgttaaacggagaaggacatgtttttgtctggggctatggaattcttgggaaaggtccaaacctagtggaaagtgccgtccctgaaatgattccacccactctctttggcttgacggagttcaacccagaaatccaggtttcccgcatccgatgtggactcagccactttgctgcactgaccaacaaaggagagctgtttgtatggggcaagaacatccgagggtgcctgggaatcggtcgcctggaggaccagtatttcccatggagggtgacgatgcctggggagcctgtggacgtggcatgtggcgtggaccacatggtgaccctggccaagtcattcatctaaacctccctcacctgcttgggcggccccgtcccgggaaccactggcactccttggcagaggccagcgcgtggccagccccccggggttcttggatggtggtggcggaggaccctgcgtgcagtgtgacgctctgtcctgaatcccttagcgggtacctaccaggaggatcagggcaaggtccctctccagctgcaggtgaggcctgcggaactcagcttggatggcagcctttggtgggccgctgtggcccgcacgtctctgttctctccaagtaacatgcgacggtgtctggtgtcacgtctcgcctgagaagcccgtcttaggaaagcttagcttgaacacagtgctcgggaggtttctgctctgtctgtcatggcagtctcttggtttgtgtctggccaaggccatgcgtgtgcctcggaccgagccccagcttaggcgagggagtcaggctggcttcggccctcggttttcattcaggccaccctgctcatggcccttcctggccgcctgccacaccgcaagctcgctggggggacactagaagcaccgtggcctgggattccatctggagctgtccgcaggcaccagccccagcctcccaccacgctcactgcctggcttggaaaagttaagaagcccctcaggaagagaatcgaggccaagttcctctgcgccgagggccccgagcatatccgccaaggctcagctgcagtgccaggcggaggaggaagatccagaaattgtgaacaatgtttgatttagtagcgtgacttgcctttccctttaaaaacatcttttacaaatctgtcttggaataaagtctattttctgccttttggtttttaa

SEQ ID NO: 200121 - DNA, 1409 bp, Homo sapiens
  Payload ID: 19476
  Gene Name: Williams-Beuren syndrome chromosome region 16
  Uniprot ID: Q96I51
  ENST ID: ENST00000618035
  CDS Start-End: 145-1221
acgcctccctgagccttgggctgccgtcagcgcctttgccttcaaccaggagtaaaagtggccgtagcctcttccggcgaggactggtgttaagggtcacgcaagatggcggcgcccagaggctgctgaggcgcggaacggaggatggcgctggtggcgttggtggctggggctcggctggggcggcggctgagcgggccggggctggggcgagggcactggacggcggccgggcgctcccggagccggcgcgaagcggcagaagccgaggcggaggtgcccgtggtccagtacgtgggcgagcgcgctgcccgcgccgatcgcgtcttcgtgtggggcttcagcttctcgggggcgctgggcgtgccttcctttgtggtgcccagctccgggcccgggccccgcgccggcgcccgaccgcgccgcaggatccagcccgtgccctatcgcctggagctggaccaaaagatttcatctgctgcttgcggctatggattcacactgctgtcctctaagactgcggatgttacgaaagtctgggggatgggactcaacaaagattctcagcttggatttcacaggagccggaaagataaaacgaggggctacgagtatgtgttggagccctcacccgtctccctgcctctggacagacctcaggagacacgggtgctgcaggtctcctgcggccgagctcactctcttgtgttgactgacagggaaggagtcttcagcatgggaaacaattcttatgggcaatgtggaagaaaggtggtcgaaaatgaaatttacagtgaaagtcacagagtccacaggatgcaggacttcgatggccaggtggtccaggtcgcctgtggtcaggatcatagtctgttcctgacggataaaggagaagtctattcttgtggatggggtgctgatgggcaaacaggtctgggtcactacaatatcaccagctcgcccaccaagctgggtggagacctggcgggagtgaacgttatccaagttgccacctacggtgattgctgcctggccgtgtccgccgacggaggactttttggttggggaaactcggagtacctgcagctggcctctgtcactgactccacacaggtgaatgtgccccgctgcttacacttctcaggagtggggaaggtgcgacaggctgcatgcggtggcacgggctgtgcagtgttaaacgatacatggccacagagctgagtcatcctagagcaaacctctggagtggagagcgaactacttcattcccctcccttagcctgggccagagagactccagctctgccttctccagccaaaaaatcaaaggcagatgggagaacagccttcagctttggataacgatgaaatatctggcaccactgatgaatattaaactttctataacc

SEQ ID NO: 200122 - DNA, 3884 bp, Homo sapiens
  Payload ID: 19477
  Gene Name: Williams-Beuren syndrome chromosome region 17
  Uniprot ID: Q6IS24
  ENST ID: ENST00000333538
  CDS Start-End: 635-2431
tggaggatgcgggctccccgagcgggcttcccctctgcccggcgcgatggagcgggtcggtgagcggaacaaaggcgcctgcccgggggagcgggtcttccgctgaagagcgcgggtggcgcgccgcgacggccgcctgcgggccaaggtgggaggctgtgcggccccaggcgcggcgcgctccgccgtgggcgggcggcgatccctgagtccggcacctgtgcgccgctccctctgtgcctcccgggcagccccgcctgccggcctcggagtccgcggcgccggcggctagaggtccagaggcgaaccacttgctggtgcagaagagaaaccctcaaatccctggcctttcgcggagacgcctggacggggccgtgcgccgtggactgagcaggcgtctcggggagcacttctgcagagcgaggacttccatgtgagcgattccgttctccccaccaccaatccgacctcccagccgtctccgccgcccgagcatccttgaggtgggacgagcaggggcttggatccctgccggccgtctggtgtgtgaggcttgcacggcccctggctgccccgcgcctcgccggagcccgagggggcgcaggtccggggcgagggccggccgggctgtttgatggcttcactgagaagagtcaaagtgctgttggtgttgaacttgatcgcggtagccggcttcgtgctcttcctggccaagtgccggcccatcgcggtgcgcagcggagacgccttccacgagatccggccgcgcgccgaggtggccaacctcagcgcgcacagcgccagccccatccaggatgcggtcctgaagcgcctgtcgctgctggaggacatcgtgtaccggcagctgaatggcttatccaaatcccttgggctcattgaaggttatggtgggcggggtaaagggggccttccggctactctttccccggctgaagaagaaaaggctaagggaccccatgagaagtatggctacaattcatacctcagtgaaaaaatttcactggaccgttccattccggattatcgtcccaccaagtgtaaggagctcaagtactccaaggacctgccccagatatccatcatattcatcttcgtgaacgaggccctgtcggtgatcctgcggtccgtgcacagtgccgtcaatcacacgcccacacacctgctgaaggaaatcattctggtggatgacaacagcgacgaagaggagctgaaggtccccctagaggagtatgtccacaaacgctaccccgggctggtgaaggtggtaagaaatcagaagagggaaggcctgatccgcgctcgcattgagggctggaaggtggctaccgggcaggtcactggcttctttgatgcccacgtggaattcaccgctggctgggctgagccggttctatcccgcatccaggaaaaccggaagcgtgtgatcctcccctccattgacaacatcaaacaggacaactttgaggtgcagcggtacgagaactcggcccacgggtacagctgggagctgtggtgcatgtacatcagccccccaaaagactggtgggacgccggagacccttctctccccatcaggaccccagccatgataggctgctcgttcgtggtcaacaggaagttcttcggtgaaattggtcttctggatcctggcatggatgtatacggaggagaaaatattgaactgggaatcaaggtatggctctgtgggggcagcatggaggtccttccttgctcacgggtggcccacattgagcggaagaagaagccatataatagcaacattggcttctacaccaagaggaatgctcttcgcgttgctgaggtctggatggacgattacaagtctcatgtgtacatagcgtggaacctgccgctggagaatccgggaattgacatcggtgatgtctccgaaagaagagcattaaggaaaagtttaaagtgtaagaatttccagtggtacctggaccatgtttacccagaaatgagaagatacaataataccgttgcttacggggagcttcgcaacaacaaggcaaaagacgtctgcttggaccaggggccgctggagaaccacacagcaatattgtatccgtgccatggctggggaccacagcttgcccgctacaccaaggaaggcttcctgcacttgggtgccctggggaccaccacactcctccctgacacccgctgcctggtggacaactccaagagtcggctgccccagctcctggactgcgacaaggtcaagagcagcctgtacaagcgctggaacttcatccagaatggagccatcatgaacaagggcacgggacgctgcctggaggtggagaaccggggcctggctggcatcgacctcatcctccgcagctgcacaggtcagaggtggaccattaagaactccatcaagtagagggagggagctggggcactggagcctggcccccaggacatggctgctccccccaacatctggaccagctgccctggcggagagacagcaaggggccggcaggtgctcgatgggccccccagggcttctccagggcagcacagggaccccggatgaagactctgtcccccctcaggcattcagctgcccacaagtttcctgcaccctggaaaagccccccacccttcctctgggaaactgacagctgtcttccacagcctctgatgtggacctggtactgaggagcaagactgtccagttctcctccacatctcccatcccagaatcaggatctgggactggcagggtcccctcctgtgtctcatctcttgcagcagcagctgctgaactccagccatcaacacggtgggaggcagcgggggcttcagccatgtcctagctccccgccctaaaaggaggcagtgaggaccaggcactatttcctccgaggttacttctacccagatgacacctgcctgttcacgccccaaggcagctactgcccctaacccttcccaccagggtagctttgggcactgcagctctggacttttctggcccctcctgagatgacctgatggagctgatgctttctctcctaatccctgggcactaggctcttatcagtgtgcttgggccagctctcctgcctgtgtctagaggaagccagagacagaaataggctaagcctgcagtaggatctcagccacaagggccccgcaggatggagctgggtcaaggaccagggagccctgactcccagaggctgccaccggggagaagcagcggtcctccatccagaacctaagggctgaagcaaaggctgccaggacccttgaagatgcttttggctcacctcatttcaccccacgctctgctggctggcagaggagaaggcagtcgtttcctctctgaagagtatttttttcgattgccctctggttagggtgcacatataaatcagagttaatatatgaacgcgtgtgcatgcacaagtgtgtgtgtgcctgcgtgctgtgcgtggcagggtgtgtgtgtgtgtgtctggctgtgcgttccggagtgtgtgacgatgctgacctagctgtgtggccttgggcttgctgcttcattactcacctggatggggacgagggatgagaagggtgtgggtttggccccatgtcactggccggaaggatgtgtctcagccctgccctgtggggtgcccccgatgggaggctgtcccatctcccagtccccatctctttttccccacactgtccctggccaagccctgcccagagctgaaccctgtagctgcccccttgccctgtgtgggattcgcagtgtctcatttggtgacgtcttactggtgatcatctcctcaccccatctcccaccttgtggaataaatacatgttagcacttccca

SEQ ID NO: 200123 - DNA, 566 bp, Homo sapiens
  Payload ID: 19477
  Gene Name: Williams-Beuren syndrome chromosome region 17
  ENST ID: ENST00000447516
  CDS Start-End: 1-566
ttgttggatttcaaaaccaagacgacaccacctcttggtgtgctggcagacacagagagaggactgtctgtcttccctcctgtgtccctctctgccacagctgaaatggctgatcttttcagaatcactgactgggggatgttcatgagcttggacaggataacaaatggaggcttatccaaatcccttgggctcattgaaggttatggtgggcggggtaaagggggccttccggctactctttccccggctgaagaagaaaaggctaagggaccccatgagaagtatggctacaattcatacctcagtgaaaaaatttcactggaccgttccattccggattatcgtcccaccaagtgtaaggagctcaagtactccaaggacctgccccagatatccatcatattcatcttcgtgaacgaggccctgtcggtgatcctgcggtccgtgcacagtgccgtcaatcacacgcccacacacctgctgaaggaaatcattctggtggatgacaacagcgacgaagaggagctgaaggtccccctagaggagtatgtccacaaacgcta

SEQ ID NO: 200124 - DNA, 3012 bp, Homo sapiens
  Payload ID: 19477
  Gene Name: Williams-Beuren syndrome chromosome region 17
  ENST ID: ENST00000618959
  CDS Start-End: 1-1560
ggcttatccaaatcccttgggctcattgaaggttatggtgggcggggtaaagggggccttccggctactctttccccggctgaagaagaaaaggctaagggaccccatgagaagtatggctacaattcatacctcagtgaaaaaatttcactggaccgttccattccggattatcgtcccaccaagtgtaaggagctcaagtactccaaggacctgccccagatatccatcatattcatcttcgtgaacgaggccctgtcggtgatcctgcggtccgtgcacagtgccgtcaatcacacgcccacacacctgctgaaggaaatcattctggtggatgacaacagcgacgaagaggagctgaaggtccccctagaggagtatgtccacaaacgctaccccgggctggtgaaggtggtaagaaatcagaagagggaaggcctgatccgcgctcgcattgagggctggaaggtggctaccgggcaggtcactggcttctttgatgcccacgtggaattcaccgctggctgggctgagccggttctatcccgcatccaggaaaaccggaagcgtgtgatcctcccctccattgacaacatcaaacaggacaactttgaggtgcagcggtacgagaactcggcccacgggtacagctgggagctgtggtgcatgtacatcagccccccaaaagactggtgggacgccggagacccttctctccccatcaggaccccagccatgataggctgctcgttcgtggtcaacaggaagttcttcggtgaaattggtcttctggatcctggcatggatgtatacggaggagaaaatattgaactgggaatcaaggtatggctctgtgggggcagcatggaggtccttccttgctcacgggtggcccacattgagcggaagaagaagccatataatagcaacattggcttctacaccaagaggaatgctcttcgcgttgctgaggtctggatggacgattacaagtctcatgtgtacatagcgtggaacctgccgctggagaatccgggaattgacatcggtgatgtctccgaaagaagagcattaaggaaaagtttaaagtgtaagaatttccagtggtacctggaccatgtttacccagaaatgagaagatacaataataccgttgcttacggggagcttcgcaacaacaaggcaaaagacgtctgcttggaccaggggccgctggagaaccacacagcaatattgtatccgtgccatggctggggaccacagcttgcccgctacaccaaggaaggcttcctgcacttgggtgccctggggaccaccacactcctccctgacacccgctgcctggtggacaactccaagagtcggctgccccagctcctggactgcgacaaggtcaagagcagcctgtacaagcgctggaacttcatccagaatggagccatcatgaacaagggcacgggacgctgcctggaggtggagaaccggggcctggctggcatcgacctcatcctccgcagctgcacaggtcagaggtggaccattaagaactccatcaagtagagggagggagctggggcactggagcctggcccccaggacatggctgctccccccaacatctggaccagctgccctggcggagagacagcaaggggccggcaggtgctcgatgggccccccagggcttctccagggcagcacagggaccccggatgaagactctgtcccccctcaggcattcagctgcccacaagtttcctgcaccctggaaaagccccccacccttcctctgggaaactgacagctgtcttccacagcctctgatgtggacctggtactgaggagcaagactgtccagttctcctccacatctcccatcccagaatcaggatctgggactggcagggtcccctcctgtgtctcatctcttgcagcagcagctgctgaactccagccatcaacacggtgggaggcagcgggggcttcagccatgtcctagctccccgccctaaaaggaggcagtgaggaccaggcactatttcctccgaggttacttctacccagatgacacctgcctgttcacgccccaaggcagctactgcccctaacccttcccaccagggtagctttgggcactgcagctctggacttttctggcccctcctgagatgacctgatggagctgatgctttctctcctaatccctgggcactaggctcttatcagtgtgcttgggccagctctcctgcctgtgtctagaggaagccagagacagaaataggctaagcctgcagtaggatctcagccacaagggccccgcaggatggagctgggtcaaggaccagggagccctgactcccagaggctgccaccggggagaagcagcggtcctccatccagaacctaagggctgaagcaaaggctgccaggacccttgaagatgcttttggctcacctcatttcaccccacgctctgctggctggcagaggagaaggcagtcgtttcctctctgaagagtatttttttcgattgccctctggttagggtgcacatataaatcagagttaatatatgaacgcgtgtgcatgcacaagtgtgtgtgtgcctgcgtgctgtgcgtggcagggtgtgtgtgtgtgtgtctggctgtgcgttccggagtgtgtgacgatgctgacctagctgtgtggccttgggcttgctgcttcattactcacctggatggggacgagggatgagaagggtgtgggtttggccccatgtcactggccggaaggatgtgtctcagccctgccctgtggggtgcccccgatgggaggctgtcccatctcccagtccccatctctttttccccacactgtccctggccaagccctgcccagagctgaaccctgtagctgcccccttgccctgtgtgggattcgcagtgtctcatttggtgacgtcttactggtgatcatctcctcaccccatctcccaccttgtggaataaatacatgttagcacttccc

SEQ ID NO: 200125 - DNA, 854 bp, Homo sapiens
  Payload ID: 19478
  Gene Name: Williams-Beuren syndrome chromosome region 28
  Uniprot ID: Q6UE05
  ENST ID: ENST00000320531
  CDS Start-End: 37-834
gcttctcccagctggagtaggtgggggaggccagacatggaggcccttcctccagtcagatccagccttttggggatcctgttgcaggttacgaggctctcagtgctgttggttcagaaccgagatcacctctataatttcctgctcctcaagatcaacctcttcaaccactgggtgtcagggctggcccaggaggcccgggggtcctgtaactggcaggcccacctacccctgggagctgcagcctgccccctgggccaggctctctgggctgggctggctctgatacaggtccccgtatggctggtgctacagggacccaggctgatgtgggctggcatgtggggcagcaccaagggcctgggcctggccttgctcagtgcctgggagcagctgggcctgtctgtggccatctggacagatctgtttttgtcatgtctgcacggcctgatgttggtggccttgctcttggtggtagtgacctggagggtgtgtcagaagtcccactgcttccgactgggcaggcagctcagtaaggccttgcaagtgaactgcgtggtaaggaagctcctggtacagctgagacgtctgtattggtgggtggagactatgactgccctcacctcctggcacctggcctatctcatcacctggaccacctgcctggcctcccacctgctgcaggctgcctttgagcacacgacccagctggccgaggcccaggaggttgaaccccaggaggtctcagggtcttccttgctgccctcactgtctgcgtcctcggactcagagtctggaacagttttgccagagcaagaaactcccagagaataaatgtatccccatctgcctct

SEQ ID NO: 200126 - DNA, 961 bp, Homo sapiens
  Payload ID: 19478
  Gene Name: Williams-Beuren syndrome chromosome region 28
  Uniprot ID: Q6UE05
  ENST ID: ENST00000426490
  CDS Start-End: 24-206
ggagtaggtgggggaggccagacatggaggcccttcctccagtcagatccagccttttggggatcctgttgcaggttacgaggctctcagtgctgagacagggtctcgctctgtcgcccagcctggagcgcagtggtgccggctcagctcgttgcagcctccaactcccggtctcaagcaatcctcccccctcagcctccaagtagccgggactatagttggttcagaaccgagatcacctctataatttcctgctcctcaagatcaacctcttcaaccactgggtgtcagggctggcccaggaggcccgggggtcctgtaactggcaggcccacctacccctgggagctgcagcctgccccctgggccaggctctctgggctgggctggctctgatacaggtccccgtatggctggtgctacagggacccaggctgatgtgggctggcatgtggggcagcaccaagggcctgggcctggccttgctcagtgcctgggagcagctgggcctgtctgtggccatctggacagatctgtttttgtcatgtctgcacggcctgatgttggtggccttgctcttggtggtagtgacctggagggtgtgtcagaagtcccactgcttccgactgggcaggcagctcagtaaggccttgcaagtgaactgcgtggtaaggaagctcctggtacagctgagacgtctgtattggtgggtggagactatgactgccctcacctcctggcacctggcctatctcatcacctggaccacctgcctggcctcccacctgctgcaggctgcctttgagcacacgacccagctggccgaggcccaggaggttgaaccccaggaggtctcagggtcttccttgctgccctcactgtctgcgtcctcggactcagagtctggaacagttttgccagagcaagaaactcccagagaataaatgtatccccatctgcc

SEQ ID NO: 200127 - DNA, 3122 bp, Homo sapiens
  Payload ID: 19479
  Gene Name: Wilms tumor 1
  ENST ID: ENST00000332351
  CDS Start-End: 286-1839
tgagtgaatggagcggccgagcctcctggctcctcctcttccccgcgccgccggcccctcttatttgagctttgggaagctgagggcagccaggcagctggggtaaggagttcaaggcagcgcccacacccgggggctctccgcaacccgaccgcctgtccgctcccccacttcccgccctccctcccacctactcattcacccacccacccacccagagccgggacggcagcccaggcgcccgggccccgccgtctcctcgccgcgatcctggacttcctcttgctgcaggacccggcttccacgtgtgtcccggagccggcgtctcagcacacgctccgctccgggcctgggtgcctacagcagccagagcagcagggagtccgggacccgggcggcatctgggccaagttaggcgccgccgaggccagcgctgaacgtctccagggccggaggagccgcggggcgtccgggtctgagccgcagcaaatgggctccgacgtgcgggacctgaacgcgctgctgcccgccgtcccctccctgggtggcggcggcggctgtgccctgcctgtgagcggcgcggcgcagtgggcgccggtgctggactttgcgcccccgggcgcttcggcttacgggtcgttgggcggccccgcgccgccaccggctccgccgccacccccgccgccgccgcctcactccttcatcaaacaggagccgagctggggcggcgcggagccgcacgaggagcagtgcctgagcgccttcactgtccacttttccggccagttcactggcacagccggagcctgtcgctacgggcccttcggtcctcctccgcccagccaggcgtcatccggccaggccaggatgtttcctaacgcgccctacctgcccagctgcctcgagagccagcccgctattcgcaatcagggttacagcacggtcaccttcgacgggacgcccagctacggtcacacgccctcgcaccatgcggcgcagttccccaaccactcattcaagcatgaggatcccatgggccagcagggctcgctgggtgagcagcagtactcggtgccgcccccggtctatggctgccacacccccaccgacagctgcaccggcagccaggctttgctgctgaggacgccctacagcagtgacaatttataccaaatgacatcccagcttgaatgcatgacctggaatcagatgaacttaggagccaccttaaagggagttgctgctgggagctccagctcagtgaaatggacagaagggcagagcaaccacagcacagggtacgagagcgataaccacacaacgcccatcctctgcggagcccaatacagaatacacacgcacggtgtcttcagaggcattcaggatgtgcgacgtgtgcctggagtagccccgactcttgtacggtcggcatctgagaccagtgagaaacgccccttcatgtgtgcttacccaggctgcaataagagatattttaagctgtcccacttacagatgcacagcaggaagcacactggtgagaaaccataccagtgtgacttcaaggactgtgaacgaaggttttctcgttcagaccagctcaaaagacaccaaaggagacatacaggtgtgaaaccattccagtgtaaaacttgtcagcgaaagttctcccggtccgaccacctgaagacccacaccaggactcatacaggtaaaacaagtgaaaagcccttcagctgtcggtggccaagttgtcagaaaaagtttgcccggtcagatgaattagtccgccatcacaacatgcatcagagaaacatgaccaaactccagctggcgctttgaggggtctccctcggggaccgttcagtgtcccaggcagcacagtgtgtgaactgctttcaagtctgactctccactcctcctcactaaaaaggaaacttcagttgatcttcttcatccaacttccaagacaagataccggtgcttctggaaactaccaggtgtgcctggaagagttggtctctgccctgcctacttttagttgactcacaggccctggagaagcagctaacaatgtctggttagttaaaagcccattgccatttggtgtggattttctactgtaagaagagccatagctgatcatgtccccctgacccttcccttctttttttatgctcgttttcgctggggatggaattattgtaccattttctatcatggaatatttataggccagggcatgtgtatgtgtctgctaatgtaaactttgtcatggtttccatttactaacagcaacagcaagaaataaatcagagagcaaggcatcgggggtgaatcttgtctaacattcccgaggtcagccaggctgctaacctggaaagcaggatgtagttctgccaggcaacttttaaagctcatgcatttcaagcagctgaagaaaaaatcagaactaaccagtacctctgtatagaaatctaaaagaattttaccattcagttaattcaatgtgaacactggcacactgctcttaagaaactatgaagatctgagatttttttgtgtatgtttttgactcttttgagtggtaatcatatgtgtctttatagatgtacatacctccttgcacaaatggaggggaattcattttcatcactgggagtgtccttagtgtataaaaaccatgctggtatatggcttcaagttgtaaaaatgaaagtgactttaaaagaaaataggggatggtccaggatctccactgataagactgtttttaagtaacttaaggacctttgggtctacaagtatatgtgaaaaaaatgagacttactgggtgaggaaatccattgtttaaagatggtcgtgtgtgtgtgtgtgtgtgtgtgtgtgtgtgtgttgtgttgtgttttgttttttaagggagggaatttattatttaccgttgcttgaaattactgtgtaaatatatgtctgataatgatttgctctttgacaactaaaattaggactgtataagtactagatgcatcactgggtgttgatcttacaagatattgatgataacacttaaaattgtaacctgcatttttcactttgctctcaattaaagtctattcaaaaggaaa

SEQ ID NO: 200128 - DNA, 3032 bp, Homo sapiens
  Payload ID: 19479
  Gene Name: Wilms tumor 1
  ENST ID: ENST00000379077
  CDS Start-End: 43-996
gggccccgccgtctcctcgccgcgatcctggacttcctcttgctgcaggacccggcttccacgtgtgtcccggagccggcgtctcagcacacgctccgctccgggcctgggtgcctacagcagccagagcagcagggagtccgggacccgggcggcatctgggccaagttaggcgccgccgaggccagcgctgaacgtctccagggccggaggagccgcggggcgtccgggtctgagccgcagcaaatgggctccgacgtgcgggacctgaacgcgctgctgcccgccgtcccctccctgggtggcggcggcggctgtgccctgcctgtgagcggcgcggcgcagtgggcgccggtgctggactttgcgcccccgggcgcttcggcttacgggtcgttgggcggccccgcgccgccaccggctccgccgccacccccgccgccgccgcctcactccttcatcaaacaggagccgagctggggcggcgcggagccgcacgaggagcagtgcctgagcgccttcactgtccacttttccggccagttcactggcacagccggagcctgtcgctacgggcccttcggtcctcctccgcccagccaggcgtcatccggccaggccaggatgtttcctaacgcgccctacctgcccagctgcctcgagagccagcccgctattcgcaatcagggttacagcacggtcaccttcgacgggacgcccagctacggtcacacgccctcgcaccatgcggcgcagttccccaaccactcattcaagcatgaggatcccatgggccagcagggctcgctgggtgagcagcagtactcggtgccgcccccggtctatggctgccacacccccaccgacagctgcaccggcagccaggctttgctgctgaggacgccctacagcagtgacaatttataccaaatgacatcccagcttgaatgcatgacctggaatcagatgaacttaggagccaccttaaaggggtaaggttttctctattccattgcctttccacagtaacttatacctgtttgaaccatttcaaaggtgcttagaacttatgaagaaagtacagttttagaagaaagggcaaagctctctgtgacattagaacgctttcctccttcccctagttgagttgctgctgggagctccagctcagtgaaatggacagaagggcagagcaaccacagcacagggtacgagagcgataaccacacaacgcccatcctctgcggagcccaatacagaatacacacgcacggtgtcttcagaggcattcaggatgtgcgacgtgtgcctggagtagccccgactcttgtacggtcggcatctgagaccagtgagaaacgccccttcatgtgtgcttacccaggctgcaataagagatattttaagctgtcccacttacagatgcacagcaggaagcacactggtgagaaaccataccagtgtgacttcaaggactgtgaacgaaggttttctcgttcagaccagctcaaaagacaccaaaggagacatacaggtgtgaaaccattccagtgtaaaacttgtcagcgaaagttctcccggtccgaccacctgaagacccacaccaggactcatacaggtaaaacaagtgaaaagcccttcagctgtcggtggccaagttgtcagaaaaagtttgcccggtcagatgaattagtccgccatcacaacatgcatcagagaaacatgaccaaactccagctggcgctttgaggggtctccctcggggaccgttcagtgtcccaggcagcacagtgtgtgaactgctttcaagtctgactctccactcctcctcactaaaaaggaaacttcagttgatcttcttcatccaacttccaagacaagataccggtgcttctggaaactaccaggtgtgcctggaagagttggtctctgccctgcctacttttagttgactcacaggccctggagaagcagctaacaatgtctggttagttaaaagcccattgccatttggtgtggattttctactgtaagaagagccatagctgatcatgtccccctgacccttcccttctttttttatgctcgttttcgctggggatggaattattgtaccattttctatcatggaatatttataggccagggcatgtgtatgtgtctgctaatgtaaactttgtcatggtttccatttactaacagcaacagcaagaaataaatcagagagcaaggcatcgggggtgaatcttgtctaacattcccgaggtcagccaggctgctaacctggaaagcaggatgtagttctgccaggcaacttttaaagctcatgcatttcaagcagctgaagaaaaaatcagaactaaccagtacctctgtatagaaatctaaaagaattttaccattcagttaattcaatgtgaacactggcacactgctcttaagaaactatgaagatctgagatttttttgtgtatgtttttgactcttttgagtggtaatcatatgtgtctttatagatgtacatacctccttgcacaaatggaggggaattcattttcatcactgggagtgtccttagtgtataaaaaccatgctggtatatggcttcaagttgtaaaaatgaaagtgactttaaaagaaaataggggatggtccaggatctccactgataagactgtttttaagtaacttaaggacctttgggtctacaagtatatgtgaaaaaaatgagacttactgggtgaggaaatccattgtttaaagatggtcgtgtgtgtgtgtgtgtgtgtgtgtgtgtgtgtgttgtgttgtgttttgttttttaagggagggaatttattatttaccgttgcttgaaattactgtgtaaatatatgtctgataatgatttgctctttgacaactaaaattaggactgtataagtactagatgcatcactgggtgttgatcttacaagatattgatgataacacttaaaattgtaacctgcatttttcactttgctctcaattaaagtctattcaaaaggaaa

SEQ ID NO: 200129 - DNA, 2466 bp, Homo sapiens
  Payload ID: 19479
  Gene Name: Wilms tumor 1
  Uniprot ID: P19544
  ENST ID: ENST00000379079
  CDS Start-End: 275-1183
gctttcaccactgcccctcccggggggacctgaaggagagggtttgaggccggtctttgcccgccgaggtctgcgtgtccggtctgggaggaggcctaggagggctcgcgggccacgggcatccttgggcccgagttctggggtgcggacggacgtctcgagagtgggtgccgcgactcgggacccacggccctcgccgggcacggacagttgcggagcagggctctgaggattgtgcagtgccctgggtccctgcctactcctgggctcaggaatggagaagggttacagcacggtcaccttcgacgggacgcccagctacggtcacacgccctcgcaccatgcggcgcagttccccaaccactcattcaagcatgaggatcccatgggccagcagggctcgctgggtgagcagcagtactcggtgccgcccccggtctatggctgccacacccccaccgacagctgcaccggcagccaggctttgctgctgaggacgccctacagcagtgacaatttataccaaatgacatcccagcttgaatgcatgacctggaatcagatgaacttaggagccaccttaaagggagttgctgctgggagctccagctcagtgaaatggacagaagggcagagcaaccacagcacagggtacgagagcgataaccacacaacgcccatcctctgcggagcccaatacagaatacacacgcacggtgtcttcagaggcattcaggatgtgcgacgtgtgcctggagtagccccgactcttgtacggtcggcatctgagaccagtgagaaacgccccttcatgtgtgcttacccaggctgcaataagagatattttaagctgtcccacttacagatgcacagcaggaagcacactggtgagaaaccataccagtgtgacttcaaggactgtgaacgaaggttttctcgttcagaccagctcaaaagacaccaaaggagacatacaggtgtgaaaccattccagtgtaaaacttgtcagcgaaagttctcccggtccgaccacctgaagacccacaccaggactcatacaggtgaaaagcccttcagctgtcggtggccaagttgtcagaaaaagtttgcccggtcagatgaattagtccgccatcacaacatgcatcagagaaacatgaccaaactccagctggcgctttgaggggtctccctcggggaccgttcagtgtcccaggcagcacagtgtgtgaactgctttcaagtctgactctccactcctcctcactaaaaaggaaacttcagttgatcttcttcatccaacttccaagacaagataccggtgcttctggaaactaccaggtgtgcctggaagagttggtctctgccctgcctacttttagttgactcacaggccctggagaagcagctaacaatgtctggttagttaaaagcccattgccatttggtgtggattttctactgtaagaagagccatagctgatcatgtccccctgacccttcccttctttttttatgctcgttttcgctggggatggaattattgtaccattttctatcatggaatatttataggccagggcatgtgtatgtgtctgctaatgtaaactttgtcatggtttccatttactaacagcaacagcaagaaataaatcagagagcaaggcatcgggggtgaatcttgtctaacattcccgaggtcagccaggctgctaacctggaaagcaggatgtagttctgccaggcaacttttaaagctcatgcatttcaagcagctgaagaaaaaatcagaactaaccagtacctctgtatagaaatctaaaagaattttaccattcagttaattcaatgtgaacactggcacactgctcttaagaaactatgaagatctgagatttttttgtgtatgtttttgactcttttgagtggtaatcatatgtgtctttatagatgtacatacctccttgcacaaatggaggggaattcattttcatcactgggagtgtccttagtgtataaaaaccatgctggtatatggcttcaagttgtaaaaatgaaagtgactttaaaagaaaataggggatggtccaggatctccactgataagactgtttttaagtaacttaaggacctttgggtctacaagtatatgtgaaaaaaatgagacttactgggtgaggaaatccattgtttaaagatggtcgtgtgtgtgtgtgtgtgtgtgtgtgtgtgtgtgttgtgttgtgttttgttttttaagggagggaatttattatttaccgttgcttgaaattactgtgtaaatatatgtctgataatgatttgctctttgacaactaaaattaggactgtataagtactagatgcatcactgggtgttgatcttacaagatattgatgataacacttaaaattgtaacctgcatttttcactttgctctcaattaaagtctattcaaaaggaaa

SEQ ID NO: 200130 - DNA, 2114 bp, Homo sapiens
  Payload ID: 19479
  Gene Name: Wilms tumor 1
  ENST ID: ENST00000448076
  CDS Start-End: 191-1735
agctggggtaaggagttcaaggcagcgcccacacccgggggctctccgcaacccgaccgcctgtccgctcccccacttcccgccctccctcccacctactcattcacccacccacccacccagagccgggacggcagcccaggcgcccgggccccgccgtctcctcgccgcgatcctggacttcctcttgctgcaggacccggcttccacgtgtgtcccggagccggcgtctcagcacacgctccgctccgggcctgggtgcctacagcagccagagcagcagggagtccgggacccgggcggcatctgggccaagttaggcgccgccgaggccagcgctgaacgtctccagggccggaggagccgcggggcgtccgggtctgagccgcagcaaatgggctccgacgtgcgggacctgaacgcgctgctgcccgccgtcccctccctgggtggcggcggcggctgtgccctgcctgtgagcggcgcggcgcagtgggcgccggtgctggactttgcgcccccgggcgcttcggcttacgggtcgttgggcggccccgcgccgccaccggctccgccgccacccccgccgccgccgcctcactccttcatcaaacaggagccgagctggggcggcgcggagccgcacgaggagcagtgcctgagcgccttcactgtccacttttccggccagttcactggcacagccggagcctgtcgctacgggcccttcggtcctcctccgcccagccaggcgtcatccggccaggccaggatgtttcctaacgcgccctacctgcccagctgcctcgagagccagcccgctattcgcaatcagggttacagcacggtcaccttcgacgggacgcccagctacggtcacacgccctcgcaccatgcggcgcagttccccaaccactcattcaagcatgaggatcccatgggccagcagggctcgctgggtgagcagcagtactcggtgccgcccccggtctatggctgccacacccccaccgacagctgcaccggcagccaggctttgctgctgaggacgccctacagcagtgacaatttataccaaatgacatcccagcttgaatgcatgacctggaatcagatgaacttaggagccaccttaaagggagttgctgctgggagctccagctcagtgaaatggacagaagggcagagcaaccacagcacagggtacgagagcgataaccacacaacgcccatcctctgcggagcccaatacagaatacacacgcacggtgtcttcagaggcattcaggatgtgcgacgtgtgcctggagtagccccgactcttgtacggtcggcatctgagaccagtgagaaacgccccttcatgtgtgcttacccaggctgcaataagagatattttaagctgtcccacttacagatgcacagcaggaagcacactggtgagaaaccataccagtgtgacttcaaggactgtgaacgaaggttttctcgttcagaccagctcaaaagacaccaaaggagacatacaggtgtgaaaccattccagtgtaaaacttgtcagcgaaagttctcccggtccgaccacctgaagacccacaccaggactcatacaggtgaaaagcccttcagctgtcggtggccaagttgtcagaaaaagtttgcccggtcagatgaattagtccgccatcacaacatgcatcagagaaacatgaccaaactccagctggcgctttgaggggtctccctcggggaccgttcagtgtcccaggcagcacagtgtgtgaactgctttcaagtctgactctccactcctcctcactaaaaaggaaacttcagttgatcttcttcatccaacttccaagacaagataccggtgcttctggaaactaccaggtgtgcctggaagagttggtctctgccctgcctacttttagttgactcacaggccctggagaagcagctaacaatgtctggttagttaaaagcccattgccatttggtgtggattttctactgtaagaagagccatagctgatcatgtccccctgacccttcccttctttttttatgctcgttttcgctggggatggaattattgtaccattttctatcat

SEQ ID NO: 200131 - DNA, 2768 bp, Homo sapiens
  Payload ID: 19479
  Gene Name: Wilms tumor 1
  ENST ID: ENST00000452863
  CDS Start-End: 1-1494
ctgcaggacccggcttccacgtgtgtcccggagccggcgtctcagcacacgctccgctccgggcctgggtgcctacagcagccagagcagcagggagtccgggacccgggcggcatctgggccaagttaggcgccgccgaggccagcgctgaacgtctccagggccggaggagccgcggggcgtccgggtctgagccgcagcaaatgggctccgacgtgcgggacctgaacgcgctgctgcccgccgtcccctccctgggtggcggcggcggctgtgccctgcctgtgagcggcgcggcgcagtgggcgccggtgctggactttgcgcccccgggcgcttcggcttacgggtcgttgggcggccccgcgccgccaccggctccgccgccacccccgccgccgccgcctcactccttcatcaaacaggagccgagctggggcggcgcggagccgcacgaggagcagtgcctgagcgccttcactgtccacttttccggccagttcactggcacagccggagcctgtcgctacgggcccttcggtcctcctccgcccagccaggcgtcatccggccaggccaggatgtttcctaacgcgccctacctgcccagctgcctcgagagccagcccgctattcgcaatcagggttacagcacggtcaccttcgacgggacgcccagctacggtcacacgccctcgcaccatgcggcgcagttccccaaccactcattcaagcatgaggatcccatgggccagcagggctcgctgggtgagcagcagtactcggtgccgcccccggtctatggctgccacacccccaccgacagctgcaccggcagccaggctttgctgctgaggacgccctacagcagtgacaatttataccaaatgacatcccagcttgaatgcatgacctggaatcagatgaacttaggagccaccttaaagggccacagcacagggtacgagagcgataaccacacaacgcccatcctctgcggagcccaatacagaatacacacgcacggtgtcttcagaggcattcaggatgtgcgacgtgtgcctggagtagccccgactcttgtacggtcggcatctgagaccagtgagaaacgccccttcatgtgtgcttacccaggctgcaataagagatattttaagctgtcccacttacagatgcacagcaggaagcacactggtgagaaaccataccagtgtgacttcaaggactgtgaacgaaggttttctcgttcagaccagctcaaaagacaccaaaggagacatacaggtgtgaaaccattccagtgtaaaacttgtcagcgaaagttctcccggtccgaccacctgaagacccacaccaggactcatacaggtgaaaagcccttcagctgtcggtggccaagttgtcagaaaaagtttgcccggtcagatgaattagtccgccatcacaacatgcatcagagaaacatgaccaaactccagctggcgctttgaggggtctccctcggggaccgttcagtgtcccaggcagcacagtgtgtgaactgctttcaagtctgactctccactcctcctcactaaaaaggaaacttcagttgatcttcttcatccaacttccaagacaagataccggtgcttctggaaactaccaggtgtgcctggaagagttggtctctgccctgcctacttttagttgactcacaggccctggagaagcagctaacaatgtctggttagttaaaagcccattgccatttggtgtggattttctactgtaagaagagccatagctgatcatgtccccctgacccttcccttctttttttatgctcgttttcgctggggatggaattattgtaccattttctatcatggaatatttataggccagggcatgtgtatgtgtctgctaatgtaaactttgtcatggtttccatttactaacagcaacagcaagaaataaatcagagagcaaggcatcgggggtgaatcttgtctaacattcccgaggtcagccaggctgctaacctggaaagcaggatgtagttctgccaggcaacttttaaagctcatgcatttcaagcagctgaagaaaaaatcagaactaaccagtacctctgtatagaaatctaaaagaattttaccattcagttaattcaatgtgaacactggcacactgctcttaagaaactatgaagatctgagatttttttgtgtatgtttttgactcttttgagtggtaatcatatgtgtctttatagatgtacatacctccttgcacaaatggaggggaattcattttcatcactgggagtgtccttagtgtataaaaaccatgctggtatatggcttcaagttgtaaaaatgaaagtgactttaaaagaaaataggggatggtccaggatctccactgataagactgtttttaagtaacttaaggacctttgggtctacaagtatatgtgaaaaaaatgagacttactgggtgaggaaatccattgtttaaagatggtcgtgtgtgtgtgtgtgtgtgtgtgtgtgtgtgtgttgtgttgtgttttgttttttaagggagggaatttattatttaccgttgcttgaaattactgtgtaaatatatgtctgataatgatttgctctttgacaactaaaattaggactgtataagtactagatgcatcactgggtgttgatcttacaagatattgatgataacacttaaaattgtaacctgcatttttcactttgctctcaattaaagtctattc

SEQ ID NO: 200132 - DNA, 2421 bp, Homo sapiens
  Payload ID: 19479
  Gene Name: Wilms tumor 1
  Uniprot ID: P19544
  ENST ID: ENST00000530998
  CDS Start-End: 275-1141
gctttcaccactgcccctcccggggggacctgaaggagagggtttgaggccggtctttgcccgccgaggtctgcgtgtccggtctgggaggaggcctaggagggctcgcgggccacgggcatccttgggcccgagttctggggtgcggacggacgtctcgagagtgggtgccgcgactcgggacccacggccctcgccgggcacggacagttgcggagcagggctctgaggattgtgcagtgccctgggtccctgcctactcctgggctcaggaatggagaagggttacagcacggtcaccttcgacgggacgcccagctacggtcacacgccctcgcaccatgcggcgcagttccccaaccactcattcaagcatgaggatcccatgggccagcagggctcgctgggtgagcagcagtactcggtgccgcccccggtctatggctgccacacccccaccgacagctgcaccggcagccaggctttgctgctgaggacgccctacagcagtgacaatttataccaaatgacatcccagcttgaatgcatgacctggaatcagatgaacttaggagccaccttaaagggccacagcacagggtacgagagcgataaccacacaacgcccatcctctgcggagcccaatacagaatacacacgcacggtgtcttcagaggcattcaggatgtgcgacgtgtgcctggagtagccccgactcttgtacggtcggcatctgagaccagtgagaaacgccccttcatgtgtgcttacccaggctgcaataagagatattttaagctgtcccacttacagatgcacagcaggaagcacactggtgagaaaccataccagtgtgacttcaaggactgtgaacgaaggttttctcgttcagaccagctcaaaagacaccaaaggagacatacaggtgtgaaaccattccagtgtaaaacttgtcagcgaaagttctcccggtccgaccacctgaagacccacaccaggactcatacaggtaaaacaagtgaaaagcccttcagctgtcggtggccaagttgtcagaaaaagtttgcccggtcagatgaattagtccgccatcacaacatgcatcagagaaacatgaccaaactccagctggcgctttgaggggtctccctcggggaccgttcagtgtcccaggcagcacagtgtgtgaactgctttcaagtctgactctccactcctcctcactaaaaaggaaacttcagttgatcttcttcatccaacttccaagacaagataccggtgcttctggaaactaccaggtgtgcctggaagagttggtctctgccctgcctacttttagttgactcacaggccctggagaagcagctaacaatgtctggttagttaaaagcccattgccatttggtgtggattttctactgtaagaagagccatagctgatcatgtccccctgacccttcccttctttttttatgctcgttttcgctggggatggaattattgtaccattttctatcatggaatatttataggccagggcatgtgtatgtgtctgctaatgtaaactttgtcatggtttccatttactaacagcaacagcaagaaataaatcagagagcaaggcatcgggggtgaatcttgtctaacattcccgaggtcagccaggctgctaacctggaaagcaggatgtagttctgccaggcaacttttaaagctcatgcatttcaagcagctgaagaaaaaatcagaactaaccagtacctctgtatagaaatctaaaagaattttaccattcagttaattcaatgtgaacactggcacactgctcttaagaaactatgaagatctgagatttttttgtgtatgtttttgactcttttgagtggtaatcatatgtgtctttatagatgtacatacctccttgcacaaatggaggggaattcattttcatcactgggagtgtccttagtgtataaaaaccatgctggtatatggcttcaagttgtaaaaatgaaagtgactttaaaagaaaataggggatggtccaggatctccactgataagactgtttttaagtaacttaaggacctttgggtctacaagtatatgtgaaaaaaatgagacttactgggtgaggaaatccattgtttaaagatggtcgtgtgtgtgtgtgtgtgtgtgtgtgtgtgtgtgttgtgttgtgttttgttttttaagggagggaatttattatttaccgttgcttgaaattactgtgtaaatatatgtctgataatgatttgctctttgacaactaaaattaggactgtataagtactagatgcatcactgggtgttgatcttacaagatattgatgataacacttaaaattgtaacctgcatttttcactttgctctcaattaaagtctattcaaaagg

SEQ ID NO: 200133 - DNA, 578 bp, Homo sapiens
  Payload ID: 19479
  Gene Name: Wilms tumor 1
  ENST ID: ENST00000527775
  CDS Start-End: 186-578
agattcatttcgcttgcccgcgctgctcctgcggaagagctgcagtttatttttggggggtgaacaaccttctctgtcgatcaggttacagcacggtcaccttcgacgggacgcccagctacggtcacacgccctcgcaccatgcggcgcagttccccaaccactcattcaagcatgaggatcccatgggccagcagggctcgctgggtgagcagcagtactcggtgccgcccccggtctatggctgccacacccccaccgacagctgcaccggcagccaggctttgctgctgaggacgccctacagcagtgacaatttataccaaatgacatcccagcttgaatgcatgacctggaatcagatgaacttaggagccaccttaaagggagttgctgctgggagctccagctcagtgaaatggacagaagggcagagcaaccacagcacagggtacgagagcgataaccacacaacgcccatcctctgcggagcccaatacagaatacacacgcacggtgtcttcagaggcattcaggatgtgcgacgtgtgcctggagtagccccgactcttgtacgg

SEQ ID NO: 200134 - DNA, 551 bp, Homo sapiens
  Payload ID: 19479
  Gene Name: Wilms tumor 1
  ENST ID: ENST00000527882
  CDS Start-End: 1-535
cttaggagccaccttaaagggagttgctgctgggagctccagctcagtgaaatggacagaagggcagagcaaccacagcacagggtacgagagcgataaccacacaacgcccatcctctgcggagcccaatacagaatacacacgcacggtgtcttcagaggcattcaggatgtgcgacgtgtgcctggagtagccccgactcttgtacggtcggcatctgagaccagtgagaaacgccccttcatgtgtgcttacccaggctgcaataagagatattttaagctgtcccacttacagatgcacagcaggaagcacactggtgtgaaaccattccagtgtaaaacttgtcagcgaaagttctcccggtccgaccacctgaagacccacaccaggactcatacaggtaaaacaagtgaaaagcccttcagctgtcggtggccaagttgtcagaaaaagtttgcccggtcagatgaattagtccgccatcacaacatgcatcagagaaacatgaccaaactccagctggcgctttgaggggtctccctcgggg

SEQ ID NO: 200135 - DNA, 718 bp, Homo sapiens
  Payload ID: 19479
  Gene Name: Wilms tumor 1
  ENST ID: ENST00000526685
  CDS Start-End: 643-718
cacctacagcacaggctggctaccaagagttaagctgatctggaaaactgacctgtcatttaagcagagtgaggccacagatatgtaatccccacttctgaggacatgacatctcttcttgcgtcatcacttttttggtgctatctggtaaaaactgagtcatgaggtgccgacaaattcagtgcacttaacgtgaagcttgaggcattctgctcattcctgagatacctgcagctgtcagccctgccgtctagatggtaaacaacttgccgaggatgaaaccctgccactgtggtcttcctcggcttgtctgagcgagacctagaccgtgacggtgcacgcctacgagaatcggaggatgagggaggggctgcgaggtggcggccaggatccaggggcctcgccctccgcagaaccctgcatctaaagtggccccatggagggaggcaaaaaccaactatttttgttctccacagcacagggtacgagagcgataaccacacaacgcccatcctctgcggagcccaatacagaatacacacgcacggtgtcttcagaggcattcaggatgtgcgacgtgtgcctggagtagccccgactcttgtacggtcggcatctgagaccagtgagaaacgccccttcatgtgtgcttacccaggctgcaataagagatattttaagctgtcccacttacagatgcacagcaggaagcacactg

SEQ ID NO: 200136 - DNA, 1622 bp, Homo sapiens
  Payload ID: 19480
  Gene Name: Wilms tumor 1 associated protein
  Uniprot ID: Q15007
  ENST ID: ENST00000337387
  CDS Start-End: 125-580
ggccggcggcagagctgtccggctgcgcggtggcccggggggcccgggcggcagggcaagcagcgcggcctcggcctatgcgaccggtggcgccggcgcggcttctgcctggagaggattcaagatgaccaacgaagaacctcttcccaagaaggttcgattgagtgaaacagacttcaaagttatggcaagagatgagttaattctaagatggaaacaatatgaagcatatgtacaagctttggagggcaagtacacagatcttaactctaatgatgtaactggcctaagagagtctgaagaaaaactaaagcaacaacagcaggagtctgcacgcagggaaaacatccttgtaatgcgactagcaaccaaggaacaagagatgcaagagtgtactactcaaatccagtacctcaagcaagtccagcagccgagcgttgcccaactgagatcaacaatggtagacccagcgatcaacttgtttttcctaaaaatgaaaggtgaactggaacagactaaagacaaactggaacaagcccaaaatgaactgagtgcctggaagtttacgcctgataggtaaacaaatcatactccccagtcaagacttccctgacagtcccactacgagaaagctgtggtgggacagccaagtactcgtttccacaccaagactcagactttttgagccaaaaaaaagccacattcttacactgtccagcttgtaatggttaatgtaaaacttaccagatgaaccttgtgtttcagcttttttcttttccccttccccttgcttcagaggcctgatggcgtcggactattccgaagaagtggccacctccgaaaaattccccttctagaacatgtagacacttgagaaatgtttctgtttgaagaaaatagagggagaaacagaagtcttaagtctgtggcacactgtgtcttcagacagtttgaaggaatgaaaacctagagattttaaatcatgaattgaacatgtaaaattccagtaaaatgtaaaaacggaatatgcatcgctcttaaccttgagcatagtgacttagagacactgtgtatcagttttgccaataagactgtggacttcatgattgttgttgaacttctgggtcaaaactcaaatgaggtgaattttgcctttaaagggtttatttgctgagaaccaactttcaatagtcatgagagaatcaaataatagatgtccgtacaagtagcgcatatatttaaccatttagtttggggctctatattacttgcttgagccttaatcaatgtggttttattcaatggtttgttctttgaatggttgcaaaaactgtagataatcttactgaggactgtacaaacatgaaggtgtggtatcaaacttcaggttgaaactgtttgaagcattataaacattcatttcacaactagattgtataaggatattagctgtgatgagactcactgcattattttttttagtgaattttatgaaatccccgttccattcaacaggcacatgtttaaaagagctttgtcgttggtgttaatgggggaatgtgttccttcattgtatttgggccttttgtattgcactcttgatattaaattaaatgtgcctt

SEQ ID NO: 200137 - DNA, 3656 bp, Homo sapiens
  Payload ID: 19480
  Gene Name: Wilms tumor 1 associated protein
  Uniprot ID: Q15007
  ENST ID: ENST00000358372
  CDS Start-End: 1758-2948
ttactttgtttccttttttatttacttttttggctatgtaaaactaaaagttcaaagacagagaaatcttgtctccaccccccactctttataggcaactaaaaatgttaagtttccaggatatccttccaattcctccccgaaaataagcatatacacataaatattcatattaaatataaatatatatttttatgtatttaagtaaatacataaaagcatatatgcttatttttgcttttgaatacagtgaatacttactacacttaaatatttaagtgaatacttaatacaacctgagactcattccaaagcaacacacgattatttcctgaatctttttaatggttgcattgtgttctactgtatggatgcaccattcccaatcagttccctattaacggatatttgggttatccctaacttttgctatgacaaatagcactgcaataaccttgtatacctattgtttccatgtgtggagctgcaccttcagaataaggttagggttagaagtataactgcaaggtataagaataaacacaagtaattttgtactccgtggaacttgaaccatttttccactcccaccaggaaaggtaatttcaacgtgtatttccattgtaagtgaggtggagcgactttctatgtttaaagaccattacggtattttttctgagaatcatctgttcatgtccttccccattttctcctttggcttttgcactttttgttttcaatttttgagagctcttgtgatacgagttgcaaagattttctccagaccgatctgattcactggaaatatactacgaccatctggaatgtactttaatcttatcctaataaatcaccttactacaagacactcctttggggatgaacaggtttgataaagccggctaaggacagaccaatcaaaagaattacgtgctcttctagtaagtgtttagagactgtttcacgttctccaggtaacaccgccattactcggcggtccagatggcagtcttacttcagggagtctactccacttgcaggacctctttgattgagttcactaaacctcacagggccgccttccccgtgttccagttagcaaggggccctcaacgccgcggacacagcgcaacctccgacgccagagaacaatagctcctcgatgcgtctccagagatgtcaaggaggaacgaacccagcggccaggagactgcgcctcacgactgatgagagggaaggcatcggtttctaagttctcaaaacttacaggtgagcttctgctaagagtaaacgcccgcggctcgccgcccacggcctctctcttgaggtggcacctggtcctccgacacgcggaagcatcacggatgagcgtcacgaacacagagcggccaatcacgcgccgccttcgcccagatccctccgcacgaggcagccccgcagccgcaggtggccccggcgagtacttccaccttcccttcccgtgatgccctggggctgacctccgacctcgctggcccgcccctcccctcggccgcttcccttactgagcttgctgagctccggggcccgcggagctcgcgccaggctcctgggaaaggacggggagtgttaccggggagcagctgctccattgtgcctcgaggccccgatcgggctaggccgacggcctccctcccttcacctttcctctcctggcggggttcggcggcgggcgagtgactgcggccacgcctgaaaggcgactctcctgattcaagatgaccaacgaagaacctcttcccaagaaggttcgattgagtgaaacagacttcaaagttatggcaagagatgagttaattctaagatggaaacaatatgaagcatatgtacaagctttggagggcaagtacacagatcttaactctaatgatgtaactggcctaagagagtctgaagaaaaactaaagcaacaacagcaggagtctgcacgcagggaaaacatccttgtaatgcgactagcaaccaaggaacaagagatgcaagagtgtactactcaaatccagtacctcaagcaagtccagcagccgagcgttgcccaactgagatcaacaatggtagacccagcgatcaacttgtttttcctaaaaatgaaaggtgaactggaacagactaaagacaaactggaacaagcccaaaatgaactgagtgcctggaagtttacgcctgatagccaaacagggaaaaagttaatggcgaagtgtcgaatgcttatccaggagaatcaagagcttggaaggcagctgtcccagggacgtattgcacaacttgaagcagagttggctttacagaagaaatacagtgaggagcttaaaagcagtcaggatgaactgaatgacttcatcatccagcttgatgaagaagtagagggtatgcagagtaccattctagttctgcagcagcagctgaaggagacacgccagcagttggctcagtaccagcagcagcagtctcaggcctctgccccaagtaccagcaggactacagcttctgaacctgtagaacagtcagaggccacaagtaaagactgcagtcgtctgacaaacggaccaagtaatggtagctcctcccgccagaggacgtctgggtctggatttcacagggagggcaacacaaccgaagatgactttccttcttctccagggaatggtaataagtcctccaacagctcagaggagagaactggcagaggaggtagtggttacgtaaatcaactcagtgcggggtatgaaagtgtagactctcccacgggcagtgaaaactctctcacacaccaatcaaatgacacagactccagtcatgaccctcaagaggagaaagcagtgagtgggaaaggtaatcgaactgtgggttcccgccacgttcagaatggcttggactcaagtgtaaatgtacagggttcagttttgtaatattttttcagcaaatttttatacagtgtcatttaatttgggagaggatactgtccagaaaattaatgcatacttttgtcacaatttgcctttttgtgggtgtacgttttggtttttttttgttgttttttttctttgttttttttttcttttctttttttttttttttttttttttttgcttcaatacttctgccgctttggaaattgtaacagttaattactttgaatgttgctaaaaggacattttgtgtagggtcaagttatttttatatgagttaatgtgaaattgtaaatggaaatttttccttaaaatacaacacaatgatgtctgtataaatctgtctgtttagaatctgtgctgtgtaagggcattcgtactcatgctgttactgtacttatgcaccattcagacttgttagagtagatgtgggtttatgactgccaagtttgcccagtacagtagttttttatcactaaaagttggactcattgatggagtcctgtagtagtttcagtgttagatacagttttttccaccatacatctgtgcattttctctttaggtgactgtttaagaaatttgtgtgcatagttactcagtttttatgaactgttgtatcctgttaatgcatattgctctgtgactccagtatatcttacctgtactgaccaaacctaaataaagatttttattgtaactccttaa

SEQ ID NO: 200138 - DNA, 2109 bp, Homo sapiens
  Payload ID: 19480
  Gene Name: Wilms tumor 1 associated protein
  Uniprot ID: Q15007
  ENST ID: ENST00000621533
  CDS Start-End: 213-1403
ggtttcctccctcagcgccattttgtggcagcgagacccacaaataaaggggagcgcaggggttgcggcgggactaggagcgcggcggggccggcggcagagctgtccggctgcgcggtggcccggggggcccgggcggcagggcaagcagcgcggcctcggcctatgcgaccggtggcgccggcgcggcttctgcctggagaggattcaagatgaccaacgaagaacctcttcccaagaaggttcgattgagtgaaacagacttcaaagttatggcaagagatgagttaattctaagatggaaacaatatgaagcatatgtacaagctttggagggcaagtacacagatcttaactctaatgatgtaactggcctaagagagtctgaagaaaaactaaagcaacaacagcaggagtctgcacgcagggaaaacatccttgtaatgcgactagcaaccaaggaacaagagatgcaagagtgtactactcaaatccagtacctcaagcaagtccagcagccgagcgttgcccaactgagatcaacaatggtagacccagcgatcaacttgtttttcctaaaaatgaaaggtgaactggaacagactaaagacaaactggaacaagcccaaaatgaactgagtgcctggaagtttacgcctgatagccaaacagggaaaaagttaatggcgaagtgtcgaatgcttatccaggagaatcaagagcttggaaggcagctgtcccagggacgtattgcacaacttgaagcagagttggctttacagaagaaatacagtgaggagcttaaaagcagtcaggatgaactgaatgacttcatcatccagcttgatgaagaagtagagggtatgcagagtaccattctagttctgcagcagcagctgaaggagacacgccagcagttggctcagtaccagcagcagcagtctcaggcctctgccccaagtaccagcaggactacagcttctgaacctgtagaacagtcagaggccacaagtaaagactgcagtcgtctgacaaacggaccaagtaatggtagctcctcccgccagaggacgtctgggtctggatttcacagggagggcaacacaaccgaagatgactttccttcttctccagggaatggtaataagtcctccaacagctcagaggagagaactggcagaggaggtagtggttacgtaaatcaactcagtgcggggtatgaaagtgtagactctcccacgggcagtgaaaactctctcacacaccaatcaaatgacacagactccagtcatgaccctcaagaggagaaagcagtgagtgggaaaggtaatcgaactgtgggttcccgccacgttcagaatggcttggactcaagtgtaaatgtacagggttcagttttgtaatattttttcagcaaatttttatacagtgtcatttaatttgggagaggatactgtccagaaaattaatgcatacttttgtcacaatttgcctttttgtgggtgtacgttttggtttttttttgttgttttttttctttgttttttttttcttttctttttttttttttttttttttttttgcttcaatacttctgccgctttggaaattgtaacagttaattactttgaatgttgctaaaaggacattttgtgtagggtcaagttatttttatatgagttaatgtgaaattgtaaatggaaatttttccttaaaatacaacacaatgatgtctgtataaatctgtctgtttagaatctgtgctgtgtaagggcattcgtactcatgctgttactgtacttatgcaccattcagacttgttagagtagatgtgggtttatgactgccaagtttgcccagtacagtagttttttatcactaaaagttggactcattgatggagtcctgtagtagtttcagtgttagatacagttttttccaccatacatctgtgcattttctctttaggtgactgtttaagaaatttgtgtgcatagttactcagtttttatgaactgttgtatcctgttaatgcatattgctctgtgactccagtatatcttacctgtactgaccaaacctaaataaagatttttattgtaactcctt

SEQ ID NO: 200139 - DNA, 1623 bp, Homo sapiens
  Payload ID: 19480
  Gene Name: Wilms tumor 1 associated protein
  ENST ID: ENST00000614346
  CDS Start-End: 345-857
atccctccgcacgaggcagccccgcagccgcaggtggccccggcgagtacttccaccttcccttcccgtgatgccctggggctgacctccgacctcgctggcccgcccctcccctcggccgcttcccttactgagcttgctgagctccggggcccgcggagctcgcgccaggctcctgggaaaggacggggagtgttaccggggagcagctgctccattgtgcctcgaggccccgatcgggctaggccgacggcctccctcccttcacctttcctctcctggcggggttcggcggcgggcgagtgactgcggccacgcctgaaaggcgactctcctgattcaagatgaccaacgaagaacctcttcccaagaaggttcgattgagtgaaacagacttcaaagttatggcaagagatgagttaattctaagatggaaacaatatgaagcatatgtacaagctttggagggcaagtacacagatcttaactctaatgatgtaactggcctaagagagtctgaagaaaaactaaagcaacaacagcaggagtctgcacgcagggaaaacatccttgtaatgcgactagcaaccaaggaacaagagatgcaagagtgtactactcaaatccagtacctcaagcaagtccagcagccgagcgttgcccaactgagatcaacaatggtagacccagcgatcaacttgtttttcctaaaaatgaaaggtgaactggaacagactaaagacaaactggaacaagcccaaaatgaactgagtgcctggaagtttacgcctgatagaggcctgatggcgtcggactattccgaagaagtggccacctccgaaaaattccccttctagaacatgtagacacttgagaaatgtttctgtttgaagaaaatagagggagaaacagaagtcttaagtctgtggcacactgtgtcttcagacagtttgaaggaatgaaaacctagagattttaaatcatgaattgaacatgtaaaattccagtaaaatgtaaaaacggaatatgcatcgctcttaaccttgagcatagtgacttagagacactgtgtatcagttttgccaataagactgtggacttcatgattgttgttgaacttctgggtcaaaactcaaatgaggtgaattttgcctttaaagggtttatttgctgagaaccaactttcaatagtcatgagagaatcaaataatagatgtccgtacaagtagcgcatatatttaaccatttagtttggggctctatattacttgcttgagccttaatcaatgtggttttattcaatggtttgttctttgaatggttgcaaaaactgtagataatcttactgaggactgtacaaacatgaaggtgtggtatcaaacttcaggttgaaactgtttgaagcattataaacattcatttcacaactagattgtataaggatattagctgtgatgagactcactgcattattttttttagtgaattttatgaaatccccgttccattcaacaggcacatgtttaaaagagctttgtcgttggtgttaatgggggaatgtgttccttcattgtatttgggccttttgtattgcactcttgatattaaattaaatgtgccttg

SEQ ID NO: 200140 - DNA, 1430 bp, Homo sapiens
  Payload ID: 19480
  Gene Name: Wilms tumor 1 associated protein
  ENST ID: ENST00000631126
  CDS Start-End: 147-659
ggcgggactaggagcgcggcggggccggcggcagagctgtccggctgcgcggtggcccggggggcccgggcggcagggcaagcagcgcggcctcggcctatgcgaccggtggcgccggcgcggcttctgcctggagaggattcaagatgaccaacgaagaacctcttcccaagaaggttcgattgagtgaaacagacttcaaagttatggcaagagatgagttaattctaagatggaaacaatatgaagcatatgtacaagctttggagggcaagtacacagatcttaactctaatgatgtaactggcctaagagagtctgaagaaaaactaaagcaacaacagcaggagtctgcacgcagggaaaacatccttgtaatgcgactagcaaccaaggaacaagagatgcaagagtgtactactcaaatccagtacctcaagcaagtccagcagccgagcgttgcccaactgagatcaacaatggtagacccagcgatcaacttgtttttcctaaaaatgaaaggtgaactggaacagactaaagacaaactggaacaagcccaaaatgaactgagtgcctggaagtttacgcctgatagaggcctgatggcgtcggactattccgaagaagtggccacctccgaaaaattccccttctagaacatgtagacacttgagaaatgtttctgtttgaagaaaatagagggagaaacagaagtcttaagtctgtggcacactgtgtcttcagacagtttgaaggaatgaaaacctagagattttaaatcatgaattgaacatgtaaaattccagtaaaatgtaaaaacggaatatgcatcgctcttaaccttgagcatagtgacttagagacactgtgtatcagttttgccaataagactgtggacttcatgattgttgttgaacttctgggtcaaaactcaaatgaggtgaattttgcctttaaagggtttatttgctgagaaccaactttcaatagtcatgagagaatcaaataatagatgtccgtacaagtagcgcatatatttaaccatttagtttggggctctatattacttgcttgagccttaatcaatgtggttttattcaatggtttgttctttgaatggttgcaaaaactgtagataatcttactgaggactgtacaaacatgaaggtgtggtatcaaacttcaggttgaaactgtttgaagcattataaacattcatttcacaactagattgtataaggatattagctgtgatgagactcactgcattattttttttagtgaattttatgaaatccccgttccattcaacaggcacatgtttaaaagagctttgtcgttggtgttaatgggggaatgtgttccttcattgtatttgggccttttgtattgcactcttgatattaaattaaatgtgccttgaaata

SEQ ID NO: 200141 - DNA, 667 bp, Homo sapiens
  Payload ID: 19481
  Gene Name: Wilms tumor 1 interacting protein
  ENST ID: ENST00000585928
  CDS Start-End: 1-602
tcccgctgccccctggccgggagggcggcccaagcgcggccgagcggcggctggaggcgctcacccgggagctggagcgggcgctcgaggcgcgcacggcgcgggactacttcggcatttgcatcaagtgtgggcttggcatctacggagcccagcaggcgtgccaggcaatggggagtctttatcacactgactgcttcacctgcgactcgtgtgggagacgactccgtgggaaggcgttctacaacgtgggtgagaaagtgtactgccaggaggacttcctgtactccgggttccagcagacggccgacaaatgcagcgtgtgtggacatctcatcatggaaatgatcctgcaggccctgggcaagtcctaccacccaggctgcttccggtgctccgtgtgcaatgagtgcctggacggggttcccttcaccgtggacgtggagaacaacatctactgcgtgcgagactatcacacggtttttgcaccaaaatgcgcctcctgtgcccgtcctatcctccctgcacagggctgcgagacaaccatccgtgtggtgtccatggacagagactaccacgtggcatgttaccactgtgagtgatctgcaccccctggaagaggtggtctcctgttttgtctttaaaaaccatcacgtgaccgggcgcg

SEQ ID NO: 200142 - DNA, 13665 bp, Homo sapiens
  Payload ID: 19481
  Gene Name: Wilms tumor 1 interacting protein
  Uniprot ID: A6NIX2
  ENST ID: ENST00000590071
  CDS Start-End: 338-1630
ccacattccagaggccgcagcgccgtctccttcctcgcattcctgcccccgcaaaggagtccctccgccccgcgcgaggccgcggcgaggagggggcgcggcccggcgcctgggagcttacattcctccgccgcgcgcgccgccgagcagggcgccgcgtcccccggcccgcgcgtggccgccggaacgaccccggcccggcgccggccccgccccgccccgcgcccaggggtcccggggcgggctccgggcttcgggcggacgatgcggcggcccggccggagcggcggcgggaagcggaggcggaggtgacgcgccagggccggcgggccgggccatgcagcgctccagggcgggcgcggacgaggcggccctactcctggccgggctggccctgcgggagctggagcccgggtgcggctctcccggtcgggggcggcgggggccgcggcctgggcctggagacgaggcggcgcccgcgctgggccgcagagggaagggcagcggcggccccgaggccggggcggacggactgagccgcggggagcggggtccccggcgcgcggcggttccggagctcagcgcgcagcctgcgggcagcccacgggccagcctggcggggtccgacggcggcggcggtggcggcagcgcccgatccagcggcatcagcctgggctacgaccagcgccacggcagcccgcgctccggtcgctcggacccgcgtcccggtcccgggccgccttcggtgggcagcgcccgctccagcgtttccagcctcggctcccggggctcggccggcgcctacgctgacttcctcccgcccggcgcctgccccgcgcccgctcgctccccggagcctgcggggccggctcccttcccgctgcctgcactcccgctgccccctggccgggagggcggcccaagcgcggccgagcggcggctggaggcgctcacccgggagctggagcgggcgctcgaggcgcgcacggcgcgggactacttcggcatttgcatcaagtgtgggcttggcatctacggagcccagcaggcgtgccaggcaatggggagtctttatcacactgactgcttcacctgcgactcgtgtgggagacgactccgtgggaaggcgttctacaacgtgggtgagaaagtgtactgccaggaggacttcctgtactccgggttccagcagacggccgacaaatgcagcgtgtgtggacatctcatcatggaaatgatcctgcaggccctgggcaagtcctaccacccaggctgcttccggtgctccgtgtgcaatgagtgcctggacggggttcccttcaccgtggacgtggagaacaacatctactgcgtgcgagactatcacacggtttttgcaccaaaatgcgcctcctgtgcccgtcctatcctccctgcacagggctgcgagacaaccatccgtgtggtgtccatggacagagactaccacgtggcatgttaccactgtgaggactgcgggctgcagctgagcggggaggagggacgccgttgctatcccctggcgggccacctactgtgtcgtcgttgccacctgcggcgcctccaacctgggcctcttccctcacccactgtgcacgtcactgagctctgagcaggggaaaacccgtccctgggccggggtgggtgtgggtgtggagggagggcccgcgtgggtggccctggtcagcgtcaggggagctccctccaatcagtttcccaccgagctgctgtctgcaggggccggacccccgcgtggaagcttctatttattcaccgtctgtgcctgctcaagtcacttccctgcgggccctgcctcccacccaccccatcaccagctttccacttggaggccccctgtgccctgcagcctcagggtaggccgtgggtcaccaggctggagagggcccctgccttggccaggggtgcgaggtgacccggctgcattgctgggtgggagctgctgtctgttgttcaggggcctggcccccgccctcccccccgaccccgacctcgcaaagcgcactcccgggcagggtgtggtctggaaggcggggctggcggggacatgggtgttcctgcatctcctagcgcagttcctgctggtgggtggaagggtgcctggtttaggcggggtcccaggagggggtgaggggtgacacccttggggagggggcctgcaaagggcactgcctgtggccacgtggtgtctgtgggaattggtcctggggactttgatgggtgtttgcggccccagttgccgccctgctccctcttccagggctcctggcttgggccccccgacccccctgctcagctcgggaaaatccccgtgcggctccagccccgggtcacgctcaggagcgatgagaggggcgccctggccacgcttcaggaaagcctgtgtctgcgcgcggggcaaggggctccacgacaaaaggacaagatttgacttaaattaagtttttcccttgaggatattttcattttctttaaaagaatataattttcttctaagatcttggaccagccttgttatttttaaagcaaatgccggcaaactcacaagtgtctagtttgtctgttacggagctggttttcaggtggtaagaaccttgtggtttcaggacttttgtcctgaaattcctctaaaacttcgccacgcgtgtccacctttcagactttagggtagtgtggggttccgtgtgtgtccgggtgttaagggcggtcgccccatgaaatgcagtgtggaggtccctccgtgctccccgggacacactgacgggaatgtggggtctggacatgggaggccctggtcctgatgcggaatccccaggggttcaggggacatctggactgaagtcactcgcccctgggagagcctggacccacctcttggctgctgctctccccttcctcccccaccgtcaggtgtgagttctgtgaatcactcgcggggctgggctaggctccgggaaccagcagggctgtccaggccgagcccaagggaacaaacaccaggaggcgcccgcagggaagtggcggcttcggagtccagcagggccgaggcatggcgcgggcgccacctggtgggctgagccggcaagtacaggggtggtcagggagccttagccagggacttacacagcgtggagagcgctgcatcttagagtggggccttcagcaggaccaggggccacttcttggaggaggtgatcccactggggccagagagtaaagtccaggcgtggaggctccggtgctggctctctcctgctagctgagctgctttttcttttcttttctttttttttttttgagacggagtgtcattgtgtcacccaggctggagtgcagtggcacaatcttggctcactgcagcctccgcctcccgggttcaagcaattctcctgctttagtctcccgagtagctgggactacaggcgcacgccaccacgcccggctaattttgtatttttagtagagatggggtttcaccatgttggtcaggctggtctccaactgctgacctcaggggcgatccacccacctcagcctcccaaagtgctgggattacaggtgtgtaccactgtgcccggctttttttttttttttttttgagacagggtctcgttctgtcgcccaggctggagtgcgttggcacaatctgggcctactgcaacctctgcctccagggttcaagtaattctcatgcctcagcctccccagtagctgagactacaggtgtgccccatgacgcccagctattttttttttttttttttttaaagacagagtctagctctgtcgcccaggctggagtgcagtggcgtgatctgggctgactgcaacctctgcctcccacgttcaagcattctgcctcagccttccaagtgctgggattacaagtgtgcgccaccaggcctggctaatttttgtatttttagtagagtcggggtttcaccatgttggccagactggtctggaactcctggcctcaagcgatccatccgccttgaccttccaaagttctgggattacaggcgtgagccactgtgcctggccttactttttgtatttttagttgagagggggtttcagcatgttggccaggttggtgtcaaactcctgacctcaagcgagcccaccttggcctcccagagtgttgggattacaggcttgagccaccgtgcctggcctgggctcctttgccttctaactggtcagttgcaaagctgtcctctgaactgtcctctctgcttcctccctcaaacctgctttgagccgggtttctccttgttgccaacccggtccttctcctccccttcctttgcatgtgccatggtgggccctgtgcttatatccatggggttgcttcactgaaccctgctccatcccggtcaccatgcacgctcctgccagctggcctgagtcatcacagcttggagtccccccaaccccacccaagtaacacactttgtcaaaggtcgcagtcaagggactgcataggcccttggggcagtggcctcaccaggccacactctgccctttctttctgggcccctgggccccgcattgccttctgtcagggctggtggccactgctccacctcctcccccggagctgtgcatggcagttccctccgtgggagccactctcccggggtttcttcctctatgaagaaaccttggcctctatgaagtcaggccccagttgtgacacctcacttgacacccagaagtcttggcctctgctctccaagctcatttgccaacagcagtatctccatttcatgcccaggggtgacactgaccccatgattatagagatggaggatgctgtgtgagaactgggctgagccatgccagtggcctgtgaccctccagccctggatgccaccccccacctgcccaaggggacccccactgatgtggtctctgctgacacctgtgcctgtgcctggggtccctgtcatccttccctggtctgagtggcaagtctcctgccatccctgtccccgctatgcggtgagctcttcagcttgggcccgcctggtggctcacgctactctccaccgtgcctggattagggcgagtgctgaggctggagctgaccctgccctggccttcagggtcttggcttagttccacctgcactggtccaagtccagcctggttgcctagtgaaggatccacagtgggtacataaagggccaagcgctgtccacgtggacacatcctatgtgggcgtgagtgctccctgcaatccccagacaagcctgcctctcagcggggctcagctcagagacatagaccctggagggctgagtctgcctgtgtgcgtgtgtgtgtgcatgtgtgtgtgtgtgagagagagacagggatggggggagagtgtgtgtatcaatgagagagacggagaaagtcgtgtgtgaaagggattgaatatttcagaaaatgaatgagagagattgggagagatggtgggaggtggagtgggagagagacctgttgtttaagagggagactgagtgactccgagaatgagggggaaagatacggagacaggataagctgcagagagagagggagagagggattgaactggagcgagaccaacagagccctgacgctgggatttgggaggatttggtgggttctcagtgaccccactgaggcctgacccaccagtggaaaaggctcacctcctgtaagtgaccacactgtggggtgtaattgtgtgtttgtttgtgtgtgtgtgtgtgtgtctgtgtgtgtgttggcgtcgccctgatggcctcttggagggtcctggggtgggtgggtcttgggcatggggtgccctctgccctcattctttcttcatccgggctccctgcccctgttggggtgggaagcacagatgtcagcttgctgagctgcaggtaccatgacaatcccaagtggaactgctcttggggggctgtgtggggaggggccactgggcaggatttatgagacctgggcagaggtgtggggagcagtgtgggccagagggtgactgggggttggggtgagttgggtagggtgcagctgtgctcatccctcccacccagccccaccctgaggctggtctctagctcgtgagcagaggccgagagaaggcccttccccatcacggggtcctgtctcgtccggtctggcagccctcatctggccaggaggccagcaaggacttccggtgccacactcgggaggggtgagggctttgctggctgcagggttaggagtaggcgcagcctgtggggcccaggagaaccttggggtggggatcaagaacaggtctgggagaggggggagcatcagggccacctgcagcctccacccagcccagctctggaggctttgcccccaccccgcccccatggtaggcgtgttccctagaggctggtggggacctgggagaggggcatgtgcacacatttcatggggatgatgggggactctgggagccagcctgggtgggggctcagaggtgggaggggccctgaggcctgaggtggtggaaggagctcacctatctcaggcccaggcccttgccaggttcctagtccctggccggataccccagggtggcctgggatcctggagagtgctcaggaaactcaggaggagtgtggacgcggctcctctccttccacccacttccctggccctgagggcattgctgggccaccatcccagacctggggcatgtgtcacagggctgccaggagggcatagggcccaaggattccccagggatgccagcccccctgtgggccctcaggactggtagccctgggccccctggcgctttgtagggaggtgctcagcagtgatggttgtgtgcctgtcacacccacccacctgtgcctccccccacctgccacgcccattgtcctacacccagcgcacactcctctccacgctgcgcacgtgaacccgcccgggtcacacacctgccctgccatggtgacaggactgtgtgggatctctgcctccctgcctgaagttcctgccattgggacctgtcacaggcacacaggacacagctggctcaccctcttctctgacagcacctgggccatccctgatagtgatcagccctgctgaggaagggttagggtgggctgcaggctggaggccagggagaggccctggaccgggcctggcatttactcaccctcctcccatcccacactgtcccggagcctccatctccacctgagccagctgggttgatgcggatttccaggcatcctcagcgggacccatggcctggggtcaccaccttcctgagctgcgtggatctcagccaggacttctcgtccctgagaacagattggggctgggagtcccagcccgtccctggaccagccctgccatcagcttgcccagcctagttccctttctcttctgcgctctgaatgtgcactccgcgtgttcagatgctcatggtttctgatgagaagttggctgtgtctctcacggagcctctctcggaggtgatgagtgacttttctcttgctgccgtcaagattcctggctgtggattggatggatgggaagctctgtccctgaacagcccttgtgactatggggctgtccttccacagtgtgcactgagggtgcaggccaaaccttttaaagaataaacagaaagaaatcggctctttcacttcttgcaagttggtgaaaacagactcttccagggaattttaactttttatcatcctatttactctggaaagccttgtctcgtgttttagagcttgtagggtttaataaaactagttaacagccaggcacggtggttcacgcctgtaatcccagcactttgggaggccgtggcggataggtcacttgaggtcaggagttcgagacaatcctggccaacatggcgaaaccccgtctctactaaaattacaaaaactagccaggtgtggtggtgggcacctgtagtcccagctactggggaggaggctgaggcacgagaatcgcttgaactggggagactgaggttgcagtgagccgagttcacaccactgcactccagcctgggtgacagagctagacgctatctcaaaaataaataaataaataaataaataaataaataaatgaatataaataaaactggttaaaaattgagtctccctgaagtaggtgctctttcccgtgaaaactacttttttggtttggtttgaaggtaagaaagagcgggagaaactttgctcttttcatttaataattgtgttcagcctggccgggcgcggtggctcacgcctgtaatcccagcactttgggaggccgaggtgggcggatcacctgaggtcgggagtttgagaccaacctgaccaatatggagaaaccctgtctctactaaaaatacaaaatttttagccgggcatggtggcgcatgcctgtaatcccagctactcgggaggctgaggcagaagaagcgcttgaacccgggaggcggaggttgcagtcagccgagatcgtgccattgcactccagcctgggcaacaagagtgaactccgtctcaaaaaaaaaaaaaaaaaaaaaaattgtattcggcctatgatgaaatattttattattagatagcagtgtcactaataagttttaagttgtccagagttaattgtgaatatcagaacaggattcttataacaaaagcagttgtcttaagatgaatggctcatatttgggtgcagtatttgatgcccaaaagaacaaacataaaccaaaaaaaaaaaaaaaaaaattccagactgtcccctttggatgccagttgaatctgtgtcttgtgccccctgagggtctgcccggtcacatccccttgtcttctctagggttcacggggatccttctcatcctcttctaggtaccaggttccattagttttgtctgtcagtcttgtcaccagggagctggagacctggaggggagccctgatgtctgggacagtgcttgtcagtggatgggcttttgcatagggggatggggtagggagtgagtcattgcattatagacttggactaggtggatgctatttttcatggtggtggtgatgggagaagctgttgggttatttcacagaggaagcccgagctccctgctgaagatgataaatgatgcacagatttcaatccatcctacggcttcagcctccagtcctggtcccacacatctcctggagcagagcctgattcccagcctctgtagctggttgaggagcaaataggtttccctgtcctgactccaccttggagcaccttcccttgagacccaccaggctctctttcagtcacagcatcttcctcctgctccatgtggttgaaatctcaggtcctctaaggatccctcctcattctctgttagtgtgaggtgggacttttttttttgttttgagatggagtcttgctctgtcgcccaggctggagttcagtggcaggatttcagctcagtacagcctcggcctcccgggttcaagtgactctccggcctcagcctcccaagtagctgggattacaggcacctgccatcactcccagctaattttttatatttttagtgaatacagggtttcatcatgttggccaggctggtctctaactcctgaccttaagtgatctacccgcctcagcctcctaaagtgctaggattataggtgtgagccactgcacctggcctgtgaggtgggaagtttcaatactcccttagccttggtttggtcaccagaaggaggggacatgagtgaaggtcccagtccaccctatgcaagcagaagcctctttggttttagttttaaaggtgcattgacccatgtacctttgcatggacatgttcttatttggggttacctttgtgttgactttgtgtggccaggaccctggagatgaggccaggatggccgactccaaccccttagctgcttccttgccctgtatggagcagctcagcctgggatgcaggagcagctgtgtccctccgctcccgccaggcctctccccctgccttctgggactggaagttcctaggagtccggaagtgctgagctgcaggaggcttctcatggccccaggacacacccatcaccccatctatattgagatgttatctagagagacgcctgtagtaaaatccgctctgtgacggtggtgtataaacattttctgtgcaaggaccttgccctccttttcaaaaaagtaagtatgactcccacatgaaaattttcttctacaacacgacatacgttcattgtggtacatttaggaaatttaaatgatttatttcttataaaacatcatctgtttttctactggacctggcttttataaatcatgcggtgataaataatatggcagttagagctgggtgcacttggctcctgcctgtggtcccagctggctgggaggcagaggcaggaggattgcttgaggccaggattccaggctgcagggagctatgactgccagtgcactccagccagggtaacacagcgagaccctgtgttagcctgttttcacgctgctgataaagacatccccaagactgggaagaaaaagaggtttaattggatttacagttccacatggctggggaggcctcagcctcccacatggctggggaggcctcccaccaaaaggcactttcatggtggcggcaagagaaaaatgacagagatgcaaaagcagaaacccccgataaaaccatcagatcttgtgagacttattcactaccatgagaacagtgtgggggaaactgcccccatgattcagattctctcccactgggtccctcccacaaaatgtgggaattaagggagtacagttcaagatgagatttgggtggagacacagagccaaacgatatcattctgcccctggccccttcaaatctcatgtcctcacatttcaaaaccaatcatgacttcccaacagtcccccaaattcttaactcatttcagcattaacccaaatccagagtccaaagtctaatctgagacaaggcaaggcccttccacctatgagcctgtaaaatcaaaagcaagttagttacttcctagatacaatgggggtacaggtattgggtgaatacggccattccaaatgggagaaattggccaaaacaaaggggttacaggacccatgcaagtccaaaatccagcggggcagtcaaattttgaagctccaaagtgatttcctttgactccatgtctcatatccaagtcacagtgatgcaagaggtgtgttcccatagtcgtaggcagctccacccctgtggctttgcagggcatagctcccctgctggcttctttcatgggctggcattgagtgtctgcggcttttccaggcaccttgtacaagctgtcagtgtatctaccattctgatgtttggaggatggtggccttcttcttacagctctactaggcagtaccccagtagggatactgtgtttgggctctgaccccacatttcccttctgcactgccctagcagaggttctccaagagggcccctcccctgcagcaaacttttgcctgggcatccaggcattttcatacatcttctgaaatctagatggaggttcccaaacctcaattcttgacttctgtacacccgcaggctcaacaccacatggtagctgccaaggttggggtttgcactctctgaaaccatgggctgagctgtaccttggccccttttagcaatggctggagtggctgggacacaaggcagcaagtcctaggctgcacacaacatggggactttgggtccagcccacaaaaccattttttgctcctaggcttctgggtctgtgatgggaagaccaatgacatgccctggagacattttccccattgtcttggggttaaacattcccctccttgttacttatgcaaatttctgcagccagcttgaatttcttctaaaaaaatgggtgtttctttactgcatcgtcaggctgcaaattttccaattttttatgctctgtttcccttttaaaatggaatgtttttaaacccaagtcacctcttgaacgcttttctgcttagaaatttcttctgccagataccctaaattatctctctcaagttcaaagttccacaaatctctagggcaggggcaaaatgccgccaatctctttgcttaaacataacaagaatcacctttgctccagttcccaacaagttcctcatctccatctgagaccacatcagcctggaccttagtattcatatcactatcagcatttttatcaaatattaaacaaatttctaggaggttccaaactttcccacattttcctatattcttctgagccctccaaactgttccaacctctgcctgttacccagttccaaagttgcttccacattttcgggtatgttttcagcaacaccccactcccagtaccaatttactgtattagtttgttttcatgctgctgataaagacatacctgtgactgggaagaaaaagaggtttaatgggacttgtagctccacatggctgggaggcctcagaatcatggcctgaggcaaaagttatgtggtagcggcaagagaaaatgaagggtgcaaaagcggaaaccctcgataaaaccatgagatctcgtgagacatattcactaccatgagaacaatatgggggaaactgcccccatgattcaaaatatttcccattgggtccctcccacaacacgtgagaattatgggagtacaattcaagatgagatttcggtggggacacagagccaaaccgtatcagaccccgtctctacaaaaacaaaaacaaaataaaaaaaagtagctacgtgtttgggcctggctttcattatttaccaaggatcaagacctgaacatgaaaatggcaggccaagggttcctgcctttggatgcacatggccaccttgcccactagaacatctgtgccaagcagtgttcccatcaatcataggaaaataccatttcccgcatccttaccaaccctaggtattgccaataagaaaacaaagtctgtatcaatttgatgaaaataatttgaatgtgtgcatttgatgagctgtgagaatgagaatcttttgcatgcattggccatgggcttcccttttgtgagttgcctgtgaatgtccttttcccagtttactagtttgggattgaatattcttacacatttatttggtgaagaacttttatttcaaattatgaaagaaaaaaatacttgctagaattctgatttgaagtgctttcaaattctgtgttaatttggagctgacaccctttaatattgagtcctggctttgagggtctggtgcgtttcctccattcactgaagttttattttacatctctcagtaaagctttatggattagggtcttcagaagccttacttgtttttctggctctattttcttgtccagaaactccaccactgtgctaaagagacagtggtggaggtgctgggcgtgctgcttttctcctggctctaatgggaaggccaagaggcaggtcagggtcagactccaccttgagtctggcattggctgttggcatcatgaggaccccacgtattgtactttgataaagttaataaatggaattctcctttacctcaa

SEQ ID NO: 200143 - DNA, 2907 bp, Homo sapiens
  Payload ID: 19482
  Gene Name: wingless-type MMTV integration site family member 2
  Uniprot ID: P09544
  ENST ID: ENST00000265441
  CDS Start-End: 301-1383
agcagagcggacggggcgcgcgggaggcgcgcagagctttcgggctgcaggcgctcgctgcgcctggggaattgggctgtgggcgaggcggtccgggctggcctttatcgctcgctgggcccatcgtttgaaactttatcagcgagtctcgccactcgtcgcagacgcgagcggggggcgggggcgcggcgaggcgccggcggccgtgacgaggcgctcccggagctgagcgcttctgctctgggcacgcatggcgcccgcacacggagtctgacctgatgcagacgcaagggggttaatatgaacgcccctctcggtggaatctggctctggctccctctgctcttgacctggctcacccccgaggtcaactcttcatggtggtacatgagagctacaggtggctcctccagggtgatgtgcgataatgtgccaggcctggtgagcagccagcggcagctgtgtcaccgacatccagatgtgatgcgtgccattagccagggcgtggccgagtggacagcagaatgccagcaccagttccgccagcaccgctggaattgcaacaccctggacagggatcacagcctttttggcagggtcctactccgaagtagtcgggaatctgcctttgtttatgccatctcctcagctggagttgtatttgccatcaccagggcctgtagccaaggagaagtaaaatcctgttcctgtgatccaaagaagatgggaagcgccaaggacagcaaaggcatttttgattggggtggctgcagtgataacattgactatgggatcaaatttgcccgcgcatttgtggatgcaaaggaaaggaaaggaaaggatgccagagccctgatgaatcttcacaacaacagagctggcaggaaggctgtaaagcggttcttgaaacaagagtgcaagtgccacggggtgagcggctcatgtactctcaggacatgctggctggccatggccgacttcaggaaaacgggcgattatctctggaggaagtacaatggggccatccaggtggtcatgaaccaggatggcacaggtttcactgtggctaacgagaggtttaagaagccaacgaaaaatgacctcgtgtattttgagaattctccagactactgtatcagggaccgagaggcaggctccctgggtacagcaggccgtgtgtgcaacctgacttcccggggcatggacagctgtgaagtcatgtgctgtgggagaggctacgacacctcccatgtcacccggatgaccaagtgtgggtgtaagttccactggtgctgcgccgtgcgctgtcaggactgcctggaagctctggatgtgcacacatgcaaggcccccaagaacgctgactggacaaccgctacatgaccccagcaggcgtcaccatccaccttcccttctacaaggactccattggatctgcaagaacactggacctttgggttctttctggggggatatttcctaaggcatgtggcctttatctcaacggaagccccctcttcctccctgggggccccaggatgggggggccacacgctgcacctaaagcctaccctattctatccatctcctggtgttctgcagtcatctcccctcctggcgagttctctttggaaatagcatgacaggctgttcagccgggagggtggtgggcccagaccactgtctccacccaccttgacgtttcttctttctagagcagttggccaagcagaaaaaaaagtgtctcaaaggagctttctcaatgtcttcccacaaatggtcccaattaagaaattccatacttctctcagatgggaacagtaaagaaagcagaatcaactgcccctgacttaactttaacttttgaaaagaccaagacttttgtctgatcaagtggttttacagctaccacccttaggggtaattggtaattacctggagaagaatggctttcaatacccttttaagtttaaaatgtgtatttttcaaggcatttattgccatattaaaatctgatgtaacaaggtggggacgtgtgtcctttggtactatggtgtgttgtatctttgtaagagcaaaagcctcagaaagggattgctttgcattactgtccccttgatataaaaaatctttagggaatgagagttccttctcacttagaatccgaagggaattaaaaagaagatgaatggtctggcaatattctgtaactattgggtgaatatggtggaaaataatttagtggatggaatatcagaagtatatctgtacagatcaagaaaaaaagggagaataaaattcctatctcatattatgcatgtgacccatggaatctcataactgaaagacttgaaggatgaaaattttggggatacaagattggtgaactaaaatgctgacagagaggtttccagagctaactcgtgcctggggcggccttacaataagcagatgcctgaaagaagtcggccacgtccgccgtctgctaatgcccatcacccttcaagcccagtttaaagacctgtcatatttaattgtatttatttgatgcttacaagatgatgtgatactgtagcctaaagcaaatgacacatagcattgcttataaagttggtaaccctgctatattatattgcaaacaaatcgtaacttggagactatgtttaagggactcaactgtaattatgggagcatcagtatgcaaatagtggttggcttctgccatcagccaaaagatgacattcagggaaaatggagaggctgcctgcaccgtttttttatgttaaatgaaagaaaggtgaaatagctacttctcgtcttcttgaaaaatttggttcttattctgtatatgacttccttacagtgctacattaacaggatatttcattacatgcatctggtatcaaa

SEQ ID NO: 200144 - DNA, 1768 bp, Homo sapiens
  Payload ID: 19482
  Gene Name: wingless-type MMTV integration site family member 2
  ENST ID: ENST00000449446
  CDS Start-End: 126-458
gggcgggggcgcggcgaggcgccggcggccgtgacgaggcgctcccggagctgagcgcttctgctctgggcacgcatggcgcccgcacacggagtctgacctgatgcagacgcaagggggttaatatgaacgcccctctcggtggaatctggctctggctccctctgctcttgacctggctcacccccgaggtcaactcttcatggtggtacatgagagctacaggtggctcctccagggtgatgtgcgataatgtgccaggcctggtgagcagccagcggcagctgtgtcaccgacatccagatgtgatgcgtgccattagccagggcgtggccgagtggacagcagaatgccagcaccagttccgccagcaccgctggaattgcaacaccctggacagggatcacagcctttttggcagggtcctactccgaaggcctgtagccaaggagaagtaaaatcctgttcctgtgatccaaagaagatgggaagcgccaaggacagcaaaggcatttttgattggggtggctgcagtgataacattgactatgggatcaaatttgcccgcgcatttgtggatgcaaaggaaaggaaaggaaaggatgccagagccctgatgaatcttcacaacaacagagctggcaggaaggctgtaaagcggttcttgaaacaagagtgcaagtgccacggggtgagcggctcatgtactctcaggacatgctggctggccatggccgacttcaggaaaacgggcgattatctctggaggaagtacaatggggccatccaggtggtcatgaaccaggatggcacaggtttcactgtggctaacgagaggtttaagaagccaacgaaaaatgacctcgtgtattttgagaattctccagactactgtatcagggaccgagaggcaggctccctgggtacagcaggccgtgtgtgcaacctgacttcccggggcatggacagctgtgaagtcatgtgctgtgggagaggctacgacacctcccatgtcacccggatgaccaagtgtgggtgtaagttccactggtgctgcgccgtgcgctgtcaggactgcctggaagctctggatgtgcacacatgcaaggcccccaagaacgctgactggacaaccgctacatgaccccagcaggcgtcaccatccaccttcccttctacaaggactccattggatctgcaagaacactggacctttgggttctttctggggggatatttcctaaggcatgtggcctttatctcaacggaagccccctcttcctccctgggggccccaggatgggggggccacacgctgcacctaaagcctaccctattctatccatctcctggtgttctgcagtcatctcccctcctggcgagttctctttggaaatagcatgacaggctgttcagccgggagggtggtgggcccagaccactgtctccacccaccttgacgtttcttctttctagagcagttggccaagcagaaaaaaaagtgtctcaaaggagctttctcaatgtcttcccacaaatggtcccaattaagaaattccatacttctctcagatgggaacagtaaagaaagcagaatcaactgcccctgacttaactttaacttttgaaaagaccaagacttttgtctgatcaagtggttttacagctaccacccttaggggtaattggtaattacctggagaagaatggctttcaatacccttttaagtttaaaatgtgtatttttcaaggcatttattgccatatt

SEQ ID NO: 200145 - DNA, 513 bp, Homo sapiens
  Payload ID: 19482
  Gene Name: wingless-type MMTV integration site family member 2
  ENST ID: ENST00000491214
  CDS Start-End: 53-513
gcatggcgcccgcacacggagtctgacctgatgcagacgcaagggggttaatatgaacgcccctctcggtggaatctggctctggctccctctgctcttgacctggctcacccccgaggtcaactcttcatggtggtacatgagagctacaggtggctcctccagggtgatgtgcgataatgtgccaggcctggtgagcagccagcggcagctgtgtcaccgacatccagatgtgatgcgtgccattagccagggcgtggccgagtggacagcagaatgccagcaccagttccgccagcaccgctggaattgcaacaccctggacagggatcacagcctttttggcagggtcctactccgaagctgtaaagcggttcttgaaacaagagtgcaagtgccacggggtgagcggctcatgtactctcaggacatgctggctggccatggccgacttcaggaaaacgggcgattatctctggaggaagtacaatggggccatccaggtggtcatga

SEQ ID NO: 200146 - DNA, 1185 bp, Homo sapiens
  Payload ID: 19483
  Gene Name: wingless-type MMTV integration site family, member 1
  Uniprot ID: P04628
  ENST ID: ENST00000293549
  CDS Start-End: 37-1149
caactgcagcacagagcgggcaaagccaggcaggccatggggctctgggcgctgttgcctggctgggtttctgctacgctgctgctggcgctggccgctctgcccgcagccctggctgccaacagcagtggccgatggtggggtattgtgaacgtagcctcctccacgaacctgcttacagactccaagagtctgcaactggtactcgagcccagtctgcagctgttgagccgcaaacagcggcgtctgatacgccaaaatccggggatcctgcacagcgtgagtggggggctgcagagtgccgtgcgcgagtgcaagtggcagttccggaatcgccgctggaactgtcccactgctccagggccccacctcttcggcaagatcgtcaaccgaggctgtcgagaaacggcgtttatcttcgctatcacctccgccggggtcacccattcggtggcgcgctcctgctcagaaggttccatcgaatcctgcacgtgtgactaccggcggcgcggccccgggggccccgactggcactgggggggctgcagcgacaacattgacttcggccgcctcttcggccgggagttcgtggactccggggagaaggggcgggacctgcgcttcctcatgaaccttcacaacaacgaggcaggccgtacgaccgtattctccgagatgcgccaggagtgcaagtgccacgggatgtccggctcatgcacggtgcgcacgtgctggatgcggctgcccacgctgcgcgccgtgggcgatgtgctgcgcgaccgcttcgacggcgcctcgcgcgtcctgtacggcaaccgcggcagcaaccgcgcttcgcgggcggagctgctgcgcctggagccggaagacccggcccacaaaccgccctccccccacgacctcgtctacttcgagaaatcgcccaacttctgcacgtacagcggacgcctgggcacagcaggcacggcagggcgcgcctgtaacagctcgtcgcccgcgctggacggctgcgagctgctctgctgcggcaggggccaccgcacgcgcacgcagcgcgtcaccgagcgctgcaactgcaccttccactggtgctgccacgtcagctgccgcaactgcacgcacacgcgcgtactgcacgagtgtctgtgaggcgctgcgcggactcgcccccaggaacgctctcct

SEQ ID NO: 200147 - DNA, 1278 bp, Homo sapiens
  Payload ID: 19483
  Gene Name: wingless-type MMTV integration site family, member 1
  ENST ID: ENST00000613114
  CDS Start-End: 199-1278
gcggtgccgcccgccgtggccgcctcagcccaccagccgggaccgcgagccatgctgtccgccgcccgcccccagggttgttaaagccagactgcgaactctcgccactgccgccaccgccgcgtcccgtcccaccgtcgcgggcaacaaccaaagtcgccgcaactgcagcacagagcgggcaaagccaggcaggccatggggctctgggcgctgttgcctggctgggtttctgctacgctgctgctggcgctggccgctctgcccgcagccctggctgccaacagcagtggccgatggtggggtattgtgaacgtagcctcctccacgaacctgcttacagactccaagagtctgcaactggtactcgagcccagtctgcagctgttgagccgcaaacagcggcgtctgatacgccaaaatccggggatcctgcacagcgtgagtggggggctgcagagtgccgtgcgcgagtgcaagtggcagttccggaatcgccgctggaactgtcccactgctccagggccccacctcttcggcaagatcgtcaaccgaggctgtcgagaaacggcgtttatcttcgctatcacctccgccggggtcacccattcggtggcgcgctcctgctcagaaggttccatcgaatcctgcacgtgtgactaccggcggcgcggccccgggggccccgactggcactgggggggctgcagcgacaacattgacttcggccgcctcttcggccgggagttcgtggactccggggagaaggggcgggacctgcgcttcctcatgaaccttcacaacaacgaggcaggccgtacgaccgtattctccgagatgcgccaggagtgcaagtgccacgggatgtccggctcatgcacggtgcgcacgtgctggatgcggctgcccacgctgcgcgccgtgggcgatgtgctgcgcgaccgcttcgacggcgcctcgcgcgtcctgtacggcaaccgcggcagcaaccgcgcttcgcgggcggagctgctgcgcctggagcccgacctcgtctacttcgagaaatcgcccaacttctgcacgtacagcggacgcctgggcacagcaggcacggcagggcgcgcctgtaacagctcgtcgcccgcgctggacggctgcgagctgctctgctgcggcaggggccaccgcacgcgcacgcagcgcgtcaccgagcgctgcaactgcaccttccactggtgctgccacgtcagctgccgcaactgcacgcacacgcgcgtactgcacgagtgtctgtga

SEQ ID NO: 200148 - DNA, 2547 bp, Homo sapiens
  Payload ID: 19484
  Gene Name: wingless-type MMTV integration site family, member 10A
  Uniprot ID: Q9GZT5
  ENST ID: ENST00000258411
  CDS Start-End: 634-1887
cctcagcagggacgctcccacccccagtccccagcggacgcagtggcctcgggactcgtacacgcctccacgccccgccgcgtgacgtcacgtggggtagagccctgagacactaaatggcgggggggtggggggaggaaagggaaggcggcagagctccccgagccgggacagtcacttactctacaggcagtggggcccgacacagacagcgccgcccccgccagccagcctcgcacgccctcggaagcgcaggctcccggcgctgcgctggagggttccccggcaccccagcctcccgtccccagcccgctgcacctccgggccccccttacccttgagaggcaccgggagttgtcgcgggggggcctcgggaaattccccggacccctgtgccaggaggtgcccggttcgcccgctcttcaccccccgccccccccgagggcggtgcccgggggtgctgccccatggagcggggaggcgggcgccgtctgctccgggagccctgacccgagtcggagctgtgtgtcgcagccgccccgaccccccgccgatcatgcgccggcgcccctggctctccagtcccactgggctgtgagccccccactcccagcccgtcagggcctgcgcgccatgggcagcgcccaccctcgcccctggctgcggctccgaccccagccccagccgcggccagcgctctgggtgctcctgttcttcctactgctgctggctgctgccatgcccaggtcagcacccaatgacattctggacctccgcctccccccggagcccgtgctcaatgccaacacagtgtgcctaacattgccaggcctgagccggcggcagatggaggtgtgtgtgcgtcaccctgatgtggctgcctcagccatacagggcatccagatcgccatccacgaatgccaacaccaattcagggaccagcgctggaactgctcaagcctggagactcgcaacaagatcccctatgagagtcccatcttcagcagaggtttccgagagagcgcttttgcctacgccatcgcagcagctggcgtggtgcacgccgtgtccaatgcgtgtgccctgggcaaactgaaggcctgtggctgtgatgcgtcccggcgaggggacgaggaggccttccgtaggaagctgcaccgcttacaactggatgcactgcagcgtggtaagggcctgagccatggggtcccggaacacccagccctgcccacagccagcccaggcctgcaggactcctgggagtggggcggctgcagccccgacatgggcttcggggagcgcttttctaaggactttctggactcccgggagcctcacagagacatccacgcgagaatgaggcttcacaacaaccgagttgggaggcaggcagtgatggagaacatgcggcggaagtgcaagtgccacggcacgtcaggcagctgccagctcaagacgtgctggcaggtgacgcccgagttccgcaccgtgggggcgctgctgcgcagccgcttccaccgcgccacgctcatccggccgcacaaccgcaacggcggccagctggagccgggcccagcgggggcaccctcgccggctccgggcgctcccgggccgcgccgacgggccagccccgccgacctggtctacttcgaaaagtctcccgacttctgcgagcgcgagccgcgcctggactcggcgggcaccgtgggccgcctgtgcaacaagagcagcgccggctcggatggctgcggcagcatgtgctgcggccgcggccacaacatcctgcgccagacgcgcagcgagcgctgccactgccgcttccactggtgctgtttcgtggtctgcgaagagtgccgcatcaccgagtgggtcagcgtctgcaagtgagcggcccggggtcccctgggccctgatcgaggtcccctcctggagcctggccctctgaggcttacggtcttggcaaggcagcatcgccttggctcttgggaagaggagattggaccacatgatcttataggaacccctcagctctgaggtctgtgatcgccggacagtccaggcctgtctgaaccccaccactcacttctgtgggctctaggactgactgggttcttcctccctccccgaagcccagacagttcagttgggctgggggttgctccacaccctaaaacaagcctcagccaggcaacccgtcagtctgtctccatcctttcaccccttccctggagatgggaggtggggaatgaatggaagctgacgggcagagagaggaggattaaaaaaaagaaatagacataactgagctgaagtaattccataaagggcccagacagcctcctccaccattcccttcatcattcatttaacaaatatttattttgcactctctttgcggcactctgggggcggtggggtgcgtgggggtggcaatgcaaggcactgaggccacagatgtgagtaagcgagacacaacacttgtcctcttggaggttacattcttgctggggggaggcatgggcaataaacaagtaaatatacaaacaa

SEQ ID NO: 200149 - DNA, 636 bp, Homo sapiens
  Payload ID: 19484
  Gene Name: wingless-type MMTV integration site family, member 10A
  ENST ID: ENST00000458582
  CDS Start-End: 1-636
gtcagcacccaatgacattctggacctccgcctccccccggagcccgtgctcaatgccaacacagtgtgcctaacattgccaggcctgagccggcggcagatggaggtgtgtgtgcgtcaccctgatgtggctgcctcagccatacagggcatccagatcgccatccacgaatgccaacaccaattcagggaccagcgctggaactgctcaagcctggagactcgcaacaagatcccctatgagagtcccatcttcagcagaggcagtgatggagaacatgcggcggaagtgcaagtgccacggcacgtcaggcagctgccagctcaagacgtgctggcaggtgacgcccgagttccgcaccgtgggggcgctgctgcgcagccgcttccaccgcgccacgctcatccggccgcacaaccgcaacggcggccagctggagccgggcccagcgggggcaccctcgccggctccgggcgctcccgggccgcgccgacgggccagccccgccgacctggtctacttcgaaaagtctcccgacttctgcgagcgcgagccgcgcctggactcggcgggcaccgtgggccgcctgtgcaacaagagcagcgccggctcggatggctgcggcagcatgtgct

SEQ ID NO: 200150 - DNA, 2274 bp, Homo sapiens
  Payload ID: 19485
  Gene Name: wingless-type MMTV integration site family, member 10B
  Uniprot ID: O00744
  ENST ID: ENST00000301061
  CDS Start-End: 350-1519
ggaggggctgcagctccgtcagcccggcagagccaccctgagctcggtgagagcaaagccagagcccccagtcctttgctcgccggcttgctagctctctcgatcactccctcccttcctccctcccttcctcccggcggccgcggcggcgctggggaagcggtgaagaggagtggcccggccctggaagaatgcggctctgacaaggggacagaacccagcgcagtctccccacggtttaagcagcactagtgaagcccaggcaacccaaccgtgcctgtctcggaccccgcacccaaaccactggaggtcctgatcgatctgcccaccggagcctccgggcttcgacatgctggaggagccccggccgcggcctccgccctcgggcctcgcgggtctcctgttcctggcgttgtgcagtcgggctctaagcaatgagattctgggcctgaagttgcctggcgagccgccgctgacggccaacaccgtgtgcttgacgctgtccggcctgagcaagcggcagctaggcctgtgcctgcgcaaccccgacgtgacggcgtccgcgcttcagggtctgcacatcgcggtccacgagtgtcagcaccagctgcgcgaccagcgctggaactgctccgcgcttgagggcggcggccgcctgccgcaccacagcgccatcctcaagcgcggtttccgagaaagtgctttttccttctccatgctggctgctggggtcatgcacgcagtagccacggcctgcagcctgggcaagctggtgagctgtggctgtggctggaagggcagtggtgagcaggatcggctgagggccaaactgctgcagctgcaggcactgtcccgaggcaagagtttcccccactctctgcccagccctggccctggctcaagccccagccctggcccccaggacacatgggaatggggtggctgtaaccatgacatggactttggagagaagttctctcgggatttcttggattccagggaagctccccgggacatccaggcacgaatgcgaatccacaacaacagggtggggcgccaggtggtaactgaaaacctgaagcggaaatgcaagtgtcatggcacatcaggcagctgccagttcaagacatgctggagggcggccccagagttccgggcagtgggggcggcgttgagggagcggctgggccgggccatcttcattgatacccacaaccgcaattctggagccttccagccccgtctgcgtccccgtcgcctctcaggagagctggtctactttgagaagtctcctgacttctgtgagcgagaccccactatgggctccccagggacaaggggccgggcctgcaacaagaccagccgcctgttggatggctgtggcagcctgtgctgtggccgtgggcacaacgtgctccggcagacacgagttgagcgctgccattgccgcttccactggtgctgctatgtgctgtgtgatgagtgcaaggttacagagtgggtgaatgtgtgtaagtgagggtcagccttaccttggggctggggaagaggactgtgtgagaggggcgccttttcagccctttgctctgatttccttccaaggtcactcttggtccctggaagcttaaagtatctacctggaaacagctttaggggtggtgggggtcaggtggactctgggatgtgtagccttctccccaacaattggagggtcttgaggggaagctgccacccctcttctgctccttagacacctgaatggactaagatgaaatgcactgtattgctcctcccacttctcaactccagagcccctttaaccctgattcatactccttttggctggggagtccctatagtttcaccactcctctcccttgagggataaccccaggcactgtttggagccataagatctgtatctagaaagagatcacccactcctatgtactatccccaaactcctttactgcagcctgggctccctcttgtgggataatgggagacagtggtagagaggtttttcttgggaaagagacagagtgctgaggggcactctcccctgaatcctcagagagttgtctgtccaggcccttagggaagttgtctccttccattcagatgttaatggggaccctccaaaggaaggggttttcccatgactcttggagcctctttttccttcttcagcaggaagggtgggaagggataatttatcatactgagacttgttcttggttcctgtttgaaactaaaataaattaagttactgga

SEQ ID NO: 200151 - DNA, 1802 bp, Homo sapiens
  Payload ID: 19485
  Gene Name: wingless-type MMTV integration site family, member 10B
  Uniprot ID: O00744
  ENST ID: ENST00000407467
  CDS Start-End: 85-660
acccaaccgtgcctgtctcggaccccgcacccaaaccactggaggtcctgatcgatctgcccaccggagcctccgggcttcgacatgctggaggagccccggccgcggcctccgccctcgggcctcgcgggtctcctgttcctggcgttgtgcagtcgggctctaagcaatgagattctgggcctgaagttgcctggcgagccgccgctgacggccaacaccgtgtgcttgacgctgtccggcctgagcaagcggcagctaggcctgtgcctgcgcaaccccgacgtgacggcgtccgcgcttcagggtctgcacatcgcggtccacgagtgtcagcaccagctgcgcgaccagcgctggaactgctccgcgcttgagggcggcggccgcctgccgcaccacagcgccatcctcaagcgcggtttccgagaaagtgctttttccttctccatgctggctgctggggtcatgcacgcagtagccacggcctgcagcctgggcaagctggtgagctgtggctgtggctggaagggcagtggtgagcaggatcggctgagggccaaactgctgcagctgcaggcactgtcccgagggaagctccccgggacatccaggcacgaatgcgaatccacaacaacagggtggggcgccaggtggtaactgaaaacctgaagcggaaatgcaagtgtcatggcacatcaggcagctgccagttcaagacatgctggagggcggccccagagttccgggcagtgggggcggcgttgagggagcggctgggccgggccatcttcattgatacccacaaccgcaattctggagccttccagccccgtctgcgtccccgtcgcctctcaggagagctggtctactttgagaagtctcctgacttctgtgagcgagaccccactatgggctccccagggacaaggggccgggcctgcaacaagaccagccgcctgttggatggctgtggcagcctgtgctgtggccgtgggcacaacgtgctccggcagacacgagttgagcgctgccattgccgcttccactggtgctgctatgtgctgtgtgatgagtgcaaggttacagagtgggtgaatgtgtgtaagtgagggtcagccttaccttggggctggggaagaggactgtgtgagaggggcgccttttcagccctttgctctgatttccttccaaggtcactcttggtccctggaagcttaaagtatctacctggaaacagctttaggggtggtgggggtcaggtggactctgggatgtgtagccttctccccaacaattggagggtcttgaggggaagctgccacccctcttctgctccttagacacctgaatggactaagatgaaatgcactgtattgctcctcccacttctcaactccagagcccctttaaccctgattcatactccttttggctggggagtccctatagtttcaccactcctctcccttgagggataaccccaggcactgtttggagccataagatctgtatctagaaagagatcacccactcctatgtactatccccaaactcctttactgcagcctgggctccctcttgtgggataatgggagacagtggtagagaggtttttcttgggaaagagacagagtgctgaggggcactctcccctgaatcctcagagagttgtctgtccaggcccttagggaagttgtctccttccattcagatgttaatggggaccctccaaaggaaggggttttcccatgactcttggagcctctttttccttcttcagcaggaagggtgggaaggga

SEQ ID NO: 200152 - DNA, 1817 bp, Homo sapiens
  Payload ID: 19485
  Gene Name: wingless-type MMTV integration site family, member 10B
  ENST ID: ENST00000403957
  CDS Start-End: 305-826
ggtgagagcaaagccagagcccccagtcctttgctcgccggcttgctagctctctcgatcactccctcccttcctccctcccttcctcccggcggccgcggcggcgctggggaagcggtgaagaggagtggcccggccctggaagaatgcggctctgacaaggggacagaacccagcgcagtctccccacggtttaagcagcactagtgaagcccaggcaacccaaccgtgcctgtctcggaccccgcacccaaaccactggaggtcctgatcgatctgcccaccggagcctccgggcttcgacatgctggaggagccccggccgcggcctccgccctcgggcctcgcgggtctcctgttcctggcgttgtgcagtcgggctctaagcaatgagattctgggcctgaagttgcctggcgagccgccgctgacggccaacaccgtgtgcttgacgctgtccggcctgagcaagcggcagctaggcctgtgcctgcgcaaccccgacgtgacggcgtccgcgcttcagggtctgcacatcgcggtccacgagtgtcagcaccagctgcgcgaccagcgctggaactgctccgcgcttgagggcggcggccgcctgccgcaccacagcgccatcctcaagcgcggtttccgagaaagtgctttttccttctccatgctggctgctggggtcatgcacgcagtagccacggcctgcagcctgggcaagctggtgagctgtggctgtggctggaagggcagtgggaagctccccgggacatccaggcacgaatgcgaatccacaacaacagggtggggcgccaggtggtaactgaaaacctgaagcggaaatgcaagtgtcatggcacatcaggcagctgccagttcaagacatgctggagggcggccccagagttccgggcagtgggggcggcgttgagggagcggctgggccgggccatcttcattgatacccacaaccgcaattctggagccttccagccccgtctgcgtccccgtcgcctctcaggagagctggtctactttgagaagtctcctgacttctgtgagcgagaccccactatgggctccccagggacaaggggccgggcctgcaacaagaccagccgcctgttggatggctgtggcagcctgtgctgtggccgtgggcacaacgtgctccggcagacacgagttgagcgctgccattgccgcttccactggtgctgctatgtgctgtgtgatgagtgcaaggttacagagtgggtgaatgtgtgtaagtgagggtcagccttaccttggggctggggaagaggactgtgtgagaggggcgccttttcagccctttgctctgatttccttccaaggtcactcttggtccctggaagcttaaagtatctacctggaaacagctttaggggtggtgggggtcaggtggactctgggatgtgtagccttctccccaacaattggagggtcttgaggggaagctgccacccctcttctgctccttagacacctgaatggactaagatgaaatgcactgtattgctcctcccacttctcaactccagagcccctttaaccctgattcatactccttttggctggggagtccctatagtttcaccactcctctcccttgagggataaccccaggcactgtttggagccataagatctgtatctagaaagagatcacccactcctatgtactatccccaaactcctttactgcagcctgggctccctcttgtgggataatgggagacagtggtagagaggtttttcttgggaaagagacagagtgctgaggggcactc

SEQ ID NO: 200153 - DNA, 623 bp, Homo sapiens
  Payload ID: 19485
  Gene Name: wingless-type MMTV integration site family, member 10B
  ENST ID: ENST00000413630
  CDS Start-End: 228-623
tctttaagacctccaagcctcagggactctgggaatcaaggggtgtttcttcttgttttgtttgaggaggaatgagaagggtcagtagggtggcaccggtgggttaggagcccgaagaagggcgtcacttggttccccaagcgagccgccctattcctgaacccgcatcaagtctcccgtcccgcaggtcctgatcgatctgcccaccggagcctccgggcttcgacatgctggaggagccccggccgcggcctccgccctcgggcctcgcgggtctcctgttcctggcgttgtgcagtcgggctctaagcaatgagattctgggcctgaagttgcctggcgagccgccgctgacggccaacaccgtgtgcttgacgctgtccggcctgagcaagcggcagctaggcctgtgcctgcgcaaccccgacgtgacggcgtccgcgcttcagggtctgcacatcgcggtccacgagtgtcagcaccagctgcgcgaccagcgctggaactgctccgcgcttgagggcggcggccgcctgccgcaccacagcgccatcctcaagcgcgggcctggtgtaggggaaggcttggacacccaaatggtttccgagaaagtgctttttcct

SEQ ID NO: 200154 - DNA, 559 bp, Homo sapiens
  Payload ID: 19485
  Gene Name: wingless-type MMTV integration site family, member 10B
  ENST ID: ENST00000420388
  CDS Start-End: 254-559
caagtgtttgtgagtctgtgtgtctgagtttgcaagtgagtgtgtgtctgtgtgccgggcgttgtgtctgattgggcaaggttccaggggtgctcgcttgagtcctgagctgggacaacgccttgactcttcttctttaagacctccaagcctcagggactctgggaatcaaggggtgtttcttcttgttttgtttgaggaggaatgagaagggtcctgatcgatctgcccaccggagcctccgggcttcgacatgctggaggagccccggccgcggcctccgccctcgggcctcgcgggtctcctgttcctggcgttgtgcagtcgggctctaagcaatgagattctgggcctgaagttgcctggcgagccgccgctgacggccaacaccgtgtgcttgacgctgtccggcctgagcaagcggcagctaggcctgtgcctgcgcaaccccgacgtgacggcgtccgcgcttcagggtctgcacatcgcggtccacgagtgtcagcaccagctgcgcgaccagcgctggaactgctccgcgcttgagggcggcggccgc

SEQ ID NO: 200155 - DNA, 1930 bp, Homo sapiens
  Payload ID: 19486
  Gene Name: wingless-type MMTV integration site family, member 11
  Uniprot ID: O96014
  ENST ID: ENST00000322563
  CDS Start-End: 126-1190
cttaacccgccgcctccgctctccccggctgcaggcggcgtgcaggaccagcggcggccgtgcaggcggaggacttcggcgcggctcctcctgggtgtgaccccgggcgcgcccgccgcgcgacgatgagggcgcggccgcaggtctgcgaggcgctgctcttcgccctggcgctccagaccggcgtgtgctatggcatcaagtggctggcgctgtccaagacaccatcggccctggcactgaaccagacgcaacactgcaagcagctggagggtctggtgtctgcacaggtgcagctgtgccgcagcaacctggagctcatgcacacggtggtgcacgccgcccgcgaggtcatgaaggcctgtcgccgggcctttgccgacatgcgctggaactgctcctccattgagctcgcccccaactatttgcttgacctggagagagggacccgggagtcggccttcgtgtatgcgctgtcggccgccgccatcagccacgccatcgcccgggcctgcacctccggcgacctgcccggctgctcctgcggccccgtcccaggtgagccacccgggcccgggaaccgctggggaggatgtgcggacaacctcagctacgggctcctcatgggggccaagttttccgatgctcctatgaaggtgaaaaaaacaggatcccaagccaataaactgatgcgtctacacaacagtgaagtggggagacaggctctgcgcgcctctctggaaatgaagtgtaagtgccatggggtgtctggctcctgctccatccgcacctgctggaaggggctgcaggagctgcaggatgtggctgctgacctcaagacccgatacctgtcggccaccaaggtagtgcaccgacccatgggcacccgcaagcacctggtgcccaaggacctggatatccggcctgtgaaggactcggaactcgtctatctgcagagctcacctgacttctgcatgaagaatgagaaggtgggctcccacgggacacaagacaggcagtgcaacaagacatccaacggaagcgacagctgcgaccttatgtgctgcgggcgtggctacaacccctacacagaccgcgtggtcgagcggtgccactgtaagtaccactggtgctgctacgtcacctgccgcaggtgtgagcgtaccgtggagcgctatgtctgcaagtgaggccctgccctccgccccacgcaggagcgaggactctgctcaaggaccctcagcaactggggccaggggcctggagacactccatggagctctgcttgtgaattccagatgccaggcatgggaggcggcttgtgctttgccttcacttggaagccaccaggaacagaaggtctggccaccctggaaggagggcaggacatcaaaggaaaccgacaagattaaaaataacttggcagcctgaggctctggagtgcccacaggctggtgtaaggagcggggcttgggatcggtgagactgatacagacttgacctttcagggccacagagaccagcctccgggaaggggtctgcccgccttcttcagaatgttctgcgggaccccctggcccaccctggggtctgagcctgctgggcccaccacatggaatcactagcttgggttgtaaatgttttcttttgttttttgctttttcttcctttgggatgtggaagctacagaaatatttataaaacatagctttttctttggggtggcacttctcaattcctctttatatattttatatatataaatatatatgtatatatataatgatctctattttaaaactagctttttaagcagctgtatgaaataaatgctgagtgagccccagcccgcccctgcagttcccggcctcgtcaagtgaactcggcagaccctggggctggcagagggagctctccagtttccaggcaa

SEQ ID NO: 200156 - DNA, 453 bp, Homo sapiens
  Payload ID: 19486
  Gene Name: wingless-type MMTV integration site family, member 11
  ENST ID: ENST00000529461
  CDS Start-End: 438-453
agctcgggcgagcggcgagcacaggccacgggagctgagcgcagcagagagcagccggagtccgcgcctgactccgcgcgggtcctgagccggccgcagcttgccaggatccccggcgtccttctcgcgccgcttcacgaagagggcgccttcgccgctcgcccagccggagtgcgcacgggcccgctggaaaccgcactcgccgctccctgggcaggccggggcacccgggcacgcagggcgcgcctggcgagcgccccgggagggataagccccagctccgggtcctcgactctgctgcctcgcctggactcctgattcctcattcctctcctttccgtcccaggcggcgtgcaggaccagcggcggccgtgcaggcggaggacttcggcgcggctcctcctgggtgtgaccccgggcgcgcccgccgcgcgacgatgagggcgcggccgc

SEQ ID NO: 200157 - DNA, 789 bp, Homo sapiens
  Payload ID: 19486
  Gene Name: wingless-type MMTV integration site family, member 11
  ENST ID: ENST00000621122
  CDS Start-End: 1-789
atgagggcgcggccgcaggtctgcgaggcgctgctcttcgccctggcgctccagaccggcgtgtgctatggcatcaagtggctggcgctgtccaagacaccatcggccctggcactgaaccagacgcaacactgcaagcagctggagggtctggtgtctgcacaggtgcagctgtgccgcagcaacctggagctcatgcacacggtggtgcacgccgcccgcgaggtcatgaaggcctgtcgccgggcctttgccgacatgcgctggaactgctcctccattgagctcgcccccaactatttgcttgacctggagagagggacccgggagtcggccttcgtgtatgcgctgtcggccgccgccatcagccacgccatcgcccgggcctgcacctccggcgacctgcaggagctgcaggatgtggctgctgacctcaagacccgatacctgtcggccaccaaggtagtgcaccgacccatgggcacccgcaagcacctggtgcccaaggacctggatatccggcctgtgaaggactcggaactcgtctatctgcagagctcacctgacttctgcatgaagaatgagaaggtgggctcccacgggacacaagacaggcagtgcaacaagacatccaacggaagcgacagctgcgaccttatgtgctgcgggcgtggctacaacccctacacagaccgcgtggtcgagcggtgccactgtaagtaccactggtgctgctacgtcacctgccgcaggtgtgagcgtaccgtggagcgctatgtctgcaagtga

SEQ ID NO: 200158 - DNA, 3147 bp, Homo sapiens
  Payload ID: 19487
  Gene Name: wingless-type MMTV integration site family, member 16
  Uniprot ID: Q9UBV4
  ENST ID: ENST00000222462
  CDS Start-End: 291-1388
agaagtttctcacctaggaatgcgaggggcgctcccgcatctcctgcacatctccacccctgcgcaggaggagatccccaggctgctctctccatctctcctacagctccctgcaaacgagggggaagctgctgagagtccctatcactgctggccttttaatgttgtatgcaaggaggaagagggcgagggataacttggtgctggacaactgacctgcggcccgaagggcctctggggagggggtgcaaaagaggagcggctgggctgggggactccatgcgggggcgatggacagggcggcgctcctgggactggcccgcttgtgcgcgctgtgggcagccctgctcgtgctgttcccctacggagcccaaggaaactggatgtggttgggcattgcctccttcggggttccagagaagctgggctgcgccaatttgccgctgaacagccgccagaaggagctgtgcaagaggaaaccgtacctgctgccgagcatccgagagggcgcccggctgggcattcaggagtgcgggagccagttcagacacgagagatggaactgcatgatcaccgccgccgccactaccgccccgatgggcgccagccccctctttggctacgagctgagcagcggcaccaaagagacagcatttatttatgctgtgatggctgcaggcctggtgcattctgtgaccaggtcatgcagtgcaggcaacatgacagagtgttcctgtgacaccaccttgcagaacggcggctcagcaagtgaaggctggcactgggggggctgctccgatgatgtccagtatggcatgtggttcagcagaaagttcctagatttccccatcggaaacaccacgggcaaagaaaacaaagtactattagcaatgaacctacataacaatgaagctggaaggcaggctgtcgccaagttgatgtcagtagactgccgctgccacggagtttccggctcctgtgctgtgaaaacatgctggaaaaccatgtcttcttttgaaaagattggccatttgttgaaggataaatatgaaaacagtatccagatatcagacaaaacaaagaggaaaatgcgcaggagagaaaaagatcagaggaaaataccaatccataaggatgatctgctctatgttaataagtctcccaactactgtgtagaagataagaaactgggaatcccagggacacaaggcagagaatgcaaccgtacatcagagggtgcagatggctgcaacctcctctgctgtggccgaggttacaacacccatgtggtcaggcacgtggagaggtgtgagtgtaagttcatctggtgctgctatgtccgttgcaggaggtgtgaaagcatgactgatgtccacacttgcaagtaaccactccatccagccttgggcaagatgcctcagcaatatacaatggcattgcaaccagagaggtgcccatccctgtgcagcgctagtaaagttgactcttgcagtggaatccctagaaccttggacctgagagtttcccttacctgatcgacatattttcctttatctgatcaacccatcaatcatgtggatttcttgggattctaatgttgaaaaggtttatattcaccttttgatgatttggggaatatatattgacatacaaggaagataatctgtttcctaagcaagaaataacaggaaagatcccttatgccaggaggcctgccatactcaggataagatccttgaatatggaacttagttacaggactcaataatggtgggtgaacattagtcatttttaaaagacacctcttatagcaataaggagacattaacatgaatctcatttattctctcagtattttaactgaagaaattatactgtttgtgtgtggatagaagatgttgaaaagttaacataagcattgggtgctgacttaccctttcatgtacttccaaagaaaggtaatcaaaaagaatcttcttaagtgatataatatccctaaaaaaatgatcattacagatgtttagtgacaaagaatcaatatgtaaaaagtataatgaatgatttagattttaagtgccttttcactgggagaatctggaaaaacctccataaggtatatagcaatctttgatctttagattcatacttttatcacagatcagtttcaactgttaaaaacccacctctgagatactggggggaggatcctgaaacatgcgggaaaaggagaggtaaacagtggaggtaaaaatataatttcatacattgtaaagaaaagcaccctttaaatgtgtaaagacagtgttttgtaaagaattttgtttaaaaagtttctattttgtaaatacagtacttaagttatatgatttatattaaaacatttattgacaaagcctaagagctaaggcagtaaaattatctcataaataatattagcttattttttttcatactattaatgctatttttttggacatcgaagagaatttaacttagcagttagttatatggatgtgtatttcttgctaaaatgacagttttatatgttatagattaaaatatgttgcaaaatatcaaaaatttgtgttatttcagcagtaagattaattgaattctcttttcacattagttatgcttaactcataaggttattataataaattatattagtaaaagtcttaactggaaaaaagaatctaaatcagaatagtgatcaatttgtggatttgatatcctggatatttattatattttatgtaatgctgcatttctatttgaatgttaagtggtctttcttgtttttaatattcatgcatgtatattcatcatattttacaaggttcctggtaaaaattacagggctctatttaaggatgtattttaatgtaaatgcttatgttttttatgaattgttaaatatttcagtattatatagaaaaaaatagatttttaaaattcagaatggacaaagagaatattcattttcttattaataagataaagaaatgtttccctgccccacagtcttcattctatttctctttaattttattcactgaggcagagaaacaatttttgaaaaagagcaaacccatggaaaatgtctcagatctaatattaaaatcaagactaagcatttaactgtga

SEQ ID NO: 200159 - DNA, 1230 bp, Homo sapiens
  Payload ID: 19487
  Gene Name: wingless-type MMTV integration site family, member 16
  ENST ID: ENST00000361301
  CDS Start-End: 50-1117
agcctgcaaaaaccacagagggcaaagccagaaagatggaaaggcacccatgcagctcaccacttgcctcagggagaccctcttcacaggggcttctcaaaagacctccctatggtggttgggcattgcctccttcggggttccagagaagctgggctgcgccaatttgccgctgaacagccgccagaaggagctgtgcaagaggaaaccgtacctgctgccgagcatccgagagggcgcccggctgggcattcaggagtgcgggagccagttcagacacgagagatggaactgcatgatcaccgccgccgccactaccgccccgatgggcgccagccccctctttggctacgagctgagcagcggcaccaaagagacagcatttatttatgctgtgatggctgcaggcctggtgcattctgtgaccaggtcatgcagtgcaggcaacatgacagagtgttcctgtgacaccaccttgcagaacggcggctcagcaagtgaaggctggcactgggggggctgctccgatgatgtccagtatggcatgtggttcagcagaaagttcctagatttccccatcggaaacaccacgggcaaagaaaacaaagtactattagcaatgaacctacataacaatgaagctggaaggcaggctgtcgccaagttgatgtcagtagactgccgctgccacggagtttccggctcctgtgctgtgaaaacatgctggaaaaccatgtcttcttttgaaaagattggccatttgttgaaggataaatatgaaaacagtatccagatatcagacaaaacaaagaggaaaatgcgcaggagagaaaaagatcagaggaaaataccaatccataaggatgatctgctctatgttaataagtctcccaactactgtgtagaagataagaaactgggaatcccagggacacaaggcagagaatgcaaccgtacatcagagggtgcagatggctgcaacctcctctgctgtggccgaggttacaacacccatgtggtcaggcacgtggagaggtgtgagtgtaagttcatctggtgctgctatgtccgttgcaggaggtgtgaaagcatgactgatgtccacacttgcaagtaaccactccatccagccttgggcaagatgcctcagcaatatacaatggcattgcaaccagagaggtgcccatccctgtgcagcgctagtaaagttgactcttgcagtggaatccc

SEQ ID NO: 200160 - DNA, 2819 bp, Homo sapiens
  Payload ID: 19488
  Gene Name: wingless-type MMTV integration site family, member 2B
  ENST ID: ENST00000256640
  CDS Start-End: 1146-2045
aacagagaacagaaaccacctcacagcattgttgtgagccttaaatgagcaaatttaagacttaaaactggtcattgacataagccttcaaaaagtgatagctattagtattatgtagctcctagaacagtggctgacatatagtagatgctcataactgttaaaaaggggccaggaggattctatctatttatgcattcatccatttaattatgcttcagaaatgtcttgctctttttatactgtcgatgctgtaaaatacaaaacccataataagccaagtaagcaagcaagagccagcactctgggaggaaaacaaagagattttcttcattgaaatatccatgccacagttcctactaggtgccaggcactgtgataggcactaggatagagaaataagttacaggcctttagggattttaggtgctggtgggagagacaaacatgaaacgcagtgttatgtggattataataaatagagcaacaagctgtggctgcacagttaacccccagtggagtcaggaaaggtctcacagaggaagggacacttgtcttggtcttgaaggagaggtagatgctcccaggtgaagaagagaatgaagggcattccaaggaatgaggatagcatatacagtgcaccaagttgccagcaggcaccgtgtttctggtgagaagcctgggatggaagtctagatcaggagaagtaagcaggaactcgacaggaaagggcatggtctgcccaggcaaagaatttgtgcccttatttggtgggccactggaagcctgaattgaggagcatcatgagcacaggcacatttaccaagaagctaatgaggtttaagcttcgaggcccatcactggcatggccccttccaaaccctgaagagcccaagcaatgtggttgtaaaatttgcaaaataagattaaatcttaactgcaatctgttaacactgctgtctcctttcactctttctcctatatcacactttcccacatgttggatggccttggagtggtagccataagcatttttggaattcaactaaaagtacattggggcactgggggcacgagtgatctgtgacaatatccctggtttggtgagccggcagcggcagctgtgccagcgttacccagacatcatgcgttcagtgggcgagggtgcccgagaatggatccgagagtgtcagcaccaattccgccaccaccgctggaactgtaccaccctggaccgggaccacaccgtctttggccgtgtcatgctcagaagtagccgagaggcagcttttgtatatgccatctcatcagcaggggtagtccacgctattactcgcgcctgtagccagggtgaactgagtgtgtgcagctgtgacccctacacccgtggccgacaccatgaccagcgtggggactttgactggggtggctgcagtgacaacatccactacggtgtccgttttgccaaggccttcgtggatgccaaggagaagaggcttaaggatgcccgggccctcatgaacttacataataaccgctgtggtcgcacggctgtgcggcggtttctgaagctggagtgtaagtgccatggcgtgagtggttcctgtactctgcgcacctgctggcgtgcactctcagatttccgccgcacaggtgattacctgcggcgacgctatgatggggctgtgcaggtgatggccacccaagatggtgccaacttcaccgcagcccgccaaggctatcgccgtgccacccggactgatcttgtctactttgacaactctccagattactgtgtcttggacaaggctgcaggttccctaggcactgcaggccgtgtctgcagcaagacatcaaaaggaacagacggttgtgaaatcatgtgctgtggccgagggtacgacacaactcgagtcacccgtgttacccagtgtgagtgcaaattccactggtgctgtgctgtacggtgcaaggaatgcagaaatactgtggacgtccatacttgcaaagcccccaagaaggcagagtggctggaccaaacctgaacacacagatacctcactcatccctccaattcaagcctctcaactcaaaagcacaagatccttgcatgcacaccttcctccaccctccaccctgggctgctaccgcttctatttaaggatgtagagagtaatccatagggaccatggtgtcctggctggttccttagccctgggaaggagttgtcaggggatataagaaactgagcaagctccctgatttcccgctctggagatttgaagggagagtagaagagatagggggtctttagagtgaaatgagttgcactaaagtacgtagttgaggctccttttttctttcctttgcaccagcttcccgatacttcttggtgtgcaagaggaagggtacctgtagagagcttctttttgtttctacctggccaaagttagatgggacaaagatgaatggcatgtcccttctctgaagtccgtttgagcagaactacctggtaccccgaaagaaaatcttaggctaccacattctattattgagagcctgagatgttagccatagtggacaaggttccattcacatgctcatatgtttataaactgtgttttgtagaagaaaaagaatcataacaatacaaacacacattcattctctctttttctctctaccattctcaacctgtattggacagcactgcctcttttgcttacttgctgcctgttcaaactgaggtggaatgcagtggttcccatgcttaacaaatcattaaaacaccctagaacactcctaggatagattaatgt

SEQ ID NO: 200161 - DNA, 3818 bp, Homo sapiens
  Payload ID: 19488
  Gene Name: wingless-type MMTV integration site family, member 2B
  Uniprot ID: Q93097
  ENST ID: ENST00000369684
  CDS Start-End: 486-1661
gagcaggtgggggtgcagcgcggtggcgcgcgggagccccgaggggcggaggcggctgctacacctagggcgtcgcggagcgccccgggcttggcgcgggcggagccgccctaagggccgcgcgtgtccccggcctcggccccgccccgtcccgtccaatgagagcccgcggccgaaggggctgtccgcacactaggcccgcagctcccttcagcgccgcagaccccctgacaccgcacccggtcctcaggcagcgcgccccagaccccgggttcggcacgccgtcgtcggcttccggacatcgcaacttgcgcccctctcggggatcctcctcccgggctctggaccccaggtgatcctaggtccccagccgccggcgaacaccatggccccccaggggggtgaggtaggagcagcctgagtacccccagaaggtgccccgtccacgcccctccgggctgcgcggcgggagtcttcggggagctatgctgagaccgggtggtgcggaggaagctgcgcagctcccgcttcggcgcgccagcgccccggtccctgtgccgtcgcccgcggcccccgacggctcccgggcttcggcccgcctaggtcttgcctgccttctgctcctgctgctgctgacgctgccggcccgcgtagacacgtcctggtggtacattggggcactgggggcacgagtgatctgtgacaatatccctggtttggtgagccggcagcggcagctgtgccagcgttacccagacatcatgcgttcagtgggcgagggtgcccgagaatggatccgagagtgtcagcaccaattccgccaccaccgctggaactgtaccaccctggaccgggaccacaccgtctttggccgtgtcatgctcagaagtagccgagaggcagcttttgtatatgccatctcatcagcaggggtagtccacgctattactcgcgcctgtagccagggtgaactgagtgtgtgcagctgtgacccctacacccgtggccgacaccatgaccagcgtggggactttgactggggtggctgcagtgacaacatccactacggtgtccgttttgccaaggccttcgtggatgccaaggagaagaggcttaaggatgcccgggccctcatgaacttacataataaccgctgtggtcgcacggctgtgcggcggtttctgaagctggagtgtaagtgccatggcgtgagtggttcctgtactctgcgcacctgctggcgtgcactctcagatttccgccgcacaggtgattacctgcggcgacgctatgatggggctgtgcaggtgatggccacccaagatggtgccaacttcaccgcagcccgccaaggctatcgccgtgccacccggactgatcttgtctactttgacaactctccagattactgtgtcttggacaaggctgcaggttccctaggcactgcaggccgtgtctgcagcaagacatcaaaaggaacagacggttgtgaaatcatgtgctgtggccgagggtacgacacaactcgagtcacccgtgttacccagtgtgagtgcaaattccactggtgctgtgctgtacggtgcaaggaatgcagaaatactgtggacgtccatacttgcaaagcccccaagaaggcagagtggctggaccaaacctgaacacacagatacctcactcatccctccaattcaagcctctcaactcaaaagcacaagatccttgcatgcacaccttcctccaccctccaccctgggctgctaccgcttctatttaaggatgtagagagtaatccatagggaccatggtgtcctggctggttccttagccctgggaaggagttgtcaggggatataagaaactgagcaagctccctgatttcccgctctggagatttgaagggagagtagaagagatagggggtctttagagtgaaatgagttgcactaaagtacgtagttgaggctccttttttctttcctttgcaccagcttcccgatacttcttggtgtgcaagaggaagggtacctgtagagagcttctttttgtttctacctggccaaagttagatgggacaaagatgaatggcatgtcccttctctgaagtccgtttgagcagaactacctggtaccccgaaagaaaatcttaggctaccacattctattattgagagcctgagatgttagccatagtggacaaggttccattcacatgctcatatgtttataaactgtgttttgtagaagaaaaagaatcataacaatacaaacacacattcattctctctttttctctctaccattctcaacctgtattggacagcactgcctcttttgcttacttgctgcctgttcaaactgaggtggaatgcagtggttcccatgcttaacaaatcattaaaacaccctagaacactcctaggatagattaatgtagtaagtctggctaggccttgtgttgccttttttttttttttttttttcttttcttttcttctcttcccatgcactattctggaggtttgccaggtttggggagacatggagtaaaagaaagataggcaactcatggatggtgggagagcaggtaagcaggtctgatctcaagggcccacatgaggcatcagtatatattaggcaggtagggatctctggctttggtaattctttatgagaggatcctagcctttgaagctgggagcaggagtcagtggctacagtgggaaggagtactgcaggttggggccaaagtgatacacagcttagaaggcagccttcctccacttactcaacaaatctttatttagtgactctccaagtcctagtgattattattattgttcactccacatttggcttaatgggtaatgctattacccattgcctaactaggtttgcagtagtggaatctccagagatagcaggcttagtaagctggaggtaggacatgaagtcccccaaaacttgatgtcctatttttatgtgagttggacagtggttatcttttgcctgttgatatcttaaagcagcagagtggtatagaaatttgcggttatgacagacccgggttaaaaatcacagctgtgccatttgctttgatattttgagcaaggtagctaaattttctgagcttctattttctcatctgtaaaatgaggatacgtacctgttcttttttttctttctttttatttcttttagagatagggtctcgctttgttgcccaggctggagtgcactggcatgatcatggctcactgcagcctcaaattcccaggctcaagcaatcctcccacctcagcctccccattagctgggactacagggccatgccatcatgcccagctaatttaaacatagttttcagagatggagctcactatgttgcccaggctggtcttgaattcttggtctcaagcaatcctcccactgcagccttccaaagtgctgggcgtacaagcgcaagccactgtgcccagctgtcagacgctgagttttaattatgcaccaaactccagcccgcagatcctcttcaccaaagcccctggctggtctagcccatcatgacttctctaggaacagtccttctttaggactataaagtattaacaaaagtctgtagattaaggagcctgcataaagaattctggatacaggcccctgtctttccaaagttcctctccaatatcccttggggtcctcatgtttttgaagcagcttcactctgcacaggcagcaggaggttgggggagccatagctctgggccacgggggcagatttatttggatgataggactaatatttgtgtaacctgctg

SEQ ID NO: 200162 - DNA, 10879 bp, Homo sapiens
  Payload ID: 19488
  Gene Name: wingless-type MMTV integration site family, member 2B
  Uniprot ID: Q93097
  ENST ID: ENST00000369686
  CDS Start-End: 105-1223
aagcaatgtggttgtaaaatttgcaaaataagattaaatcttaactgcaatctgttaacactgctgtctcctttcactctttctcctatatcacactttcccacatgttggatggccttggagtggtagccataagcatttttggaattcaactaaaaactgaaggatccttgaggacggcagtacctggcatacctacacagtcagcgttcaacaagtgtttgcaaaggtacattggggcactgggggcacgagtgatctgtgacaatatccctggtttggtgagccggcagcggcagctgtgccagcgttacccagacatcatgcgttcagtgggcgagggtgcccgagaatggatccgagagtgtcagcaccaattccgccaccaccgctggaactgtaccaccctggaccgggaccacaccgtctttggccgtgtcatgctcagaagtagccgagaggcagcttttgtatatgccatctcatcagcaggggtagtccacgctattactcgcgcctgtagccagggtgaactgagtgtgtgcagctgtgacccctacacccgtggccgacaccatgaccagcgtggggactttgactggggtggctgcagtgacaacatccactacggtgtccgttttgccaaggccttcgtggatgccaaggagaagaggcttaaggatgcccgggccctcatgaacttacataataaccgctgtggtcgcacggctgtgcggcggtttctgaagctggagtgtaagtgccatggcgtgagtggttcctgtactctgcgcacctgctggcgtgcactctcagatttccgccgcacaggtgattacctgcggcgacgctatgatggggctgtgcaggtgatggccacccaagatggtgccaacttcaccgcagcccgccaaggctatcgccgtgccacccggactgatcttgtctactttgacaactctccagattactgtgtcttggacaaggctgcaggttccctaggcactgcaggccgtgtctgcagcaagacatcaaaaggaacagacggttgtgaaatcatgtgctgtggccgagggtacgacacaactcgagtcacccgtgttacccagtgtgagtgcaaattccactggtgctgtgctgtacggtgcaaggaatgcagaaatactgtggacgtccatacttgcaaagcccccaagaaggcagagtggctggaccaaacctgaacacacagatacctcactcatccctccaattcaagcctctcaactcaaaagcacaagatccttgcatgcacaccttcctccaccctccaccctgggctgctaccgcttctatttaaggatgtagagagtaatccatagggaccatggtgtcctggctggttccttagccctgggaaggagttgtcaggggatataagaaactgagcaagctccctgatttcccgctctggagatttgaagggagagtagaagagatagggggtctttagagtgaaatgagttgcactaaagtacgtagttgaggctccttttttctttcctttgcaccagcttcccgatacttcttggtgtgcaagaggaagggtacctgtagagagcttctttttgtttctacctggccaaagttagatgggacaaagatgaatggcatgtcccttctctgaagtccgtttgagcagaactacctggtaccccgaaagaaaatcttaggctaccacattctattattgagagcctgagatgttagccatagtggacaaggttccattcacatgctcatatgtttataaactgtgttttgtagaagaaaaagaatcataacaatacaaacacacattcattctctctttttctctctaccattctcaacctgtattggacagcactgcctcttttgcttacttgctgcctgttcaaactgaggtggaatgcagtggttcccatgcttaacaaatcattaaaacaccctagaacactcctaggatagattaatgtagtaagtctggctaggccttgtgttgccttttttttttttttttttttcttttcttttcttctcttcccatgcactattctggaggtttgccaggtttggggagacatggagtaaaagaaagataggcaactcatggatggtgggagagcaggtaagcaggtctgatctcaagggcccacatgaggcatcagtatatattaggcaggtagggatctctggctttggtaattctttatgagaggatcctagcctttgaagctgggagcaggagtcagtggctacagtgggaaggagtactgcaggttggggccaaagtgatacacagcttagaaggcagccttcctccacttactcaacaaatctttatttagtgactctccaagtcctagtgattattattattgttcactccacatttggcttaatgggtaatgctattacccattgcctaactaggtttgcagtagtggaatctccagagatagcaggcttagtaagctggaggtaggacatgaagtcccccaaaacttgatgtcctatttttatgtgagttggacagtggttatcttttgcctgttgatatcttaaagcagcagagtggtatagaaatttgcggttatgacagacccgggttaaaaatcacagctgtgccatttgctttgatattttgagcaaggtagctaaattttctgagcttctattttctcatctgtaaaatgaggatacgtacctgttcttttttttctttctttttatttcttttagagatagggtctcgctttgttgcccaggctggagtgcactggcatgatcatggctcactgcagcctcaaattcccaggctcaagcaatcctcccacctcagcctccccattagctgggactacagggccatgccatcatgcccagctaatttaaacatagttttcagagatggagctcactatgttgcccaggctggtcttgaattcttggtctcaagcaatcctcccactgcagccttccaaagtgctgggcgtacaagcgcaagccactgtgcccagctgtcagacgctgagttttaattatgcaccaaactccagcccgcagatcctcttcaccaaagcccctggctggtctagcccatcatgacttctctaggaacagtccttctttaggactataaagtattaacaaaagtctgtagattaaggagcctgcataaagaattctggatacaggcccctgtctttccaaagttcctctccaatatcccttggggtcctcatgtttttgaagcagcttcactctgcacaggcagcaggaggttgggggagccatagctctgggccacgggggcagatttatttggatgataggactaatatttgtgtaacctgctgagacctgtgtgggagagtttagggtggtttttcttttggtgaggggatttgctctggtttcacatccattaacacaaaacatgagctagtcagggcccttgtggtctgcggtaaggggatgcctgtggagaaatgggcctgagtgagtcaggccaagagaatgtcttccttcagaatggagtcaactggataactgatgagccaatggtgggattaaggagggggaaatgggaggggaagagaacagctgacatcttgaggaaagctttggggtagtggagaggtaagggggtcatggtcagtctgaactcaacaatagggctgaatgaatttaccaaaggaagctgccttatattatatgccaggctgctggggaaagcctcaggtcctggccagcccctgttctcacaagaacatgcaggttaccacataaataatggcatatgccttccataggacgtcaacctgacttaaatctacctataccctactctctattctttggtttttggttctcatccctgtggaaggaaatgggcctcttctggcatctcatgctactctgtgcttttccttgggctccaaattctagctcataaagatgcaagttttgcaatttcctataaatggttaagaaaagagcaagctgtccagagagtgagaagtttgaaaagagaggtgcataagagagaaatgatgtccatttgagccccaccacggaggttatgtggtcccaaaaggaatgatggccaagcaattaatttttcctcctagttcttagcttgcttctgcattgattggctttacacaactggcatttagtctgcattacacaaatagacactaatttatttggaacaagcagcaaaatgagaactttatttggtgcagtcagggctccatttagttccctcactctgcttctaatcaccccttctcccagccctcttctatttgatagaggtctgtccctcagatcagcaatgtcttagcccctctcctctcttccattccttcctgttggtactcatttcttctaacttttaataaacatttaggtataatacattacagtaagtgctatttagatacaaacttaaaacatactatatattttaaggatctaagaatcctttagagaaggcacatgactgaagtacctcagctgcgcagcctgtagccagtttttttaatgtaaaagtaagaatgccagccttaacctagccctgcagataaaagctaacttttattaataccagccctgaataatggcactaatccacactcttccttagagtgatgctggaaaaataaaatcaggggcttcagattaaaaaaaaaaacaaaaaacaaaaaacaaaaacaaacattgcctggccctgagggtctgtttgcaaaacttcttgtagatctaatttctgaacactcactgcttcatttctattcctcctgttgcagggagtaatttcttctcctttgtctcacttcccttatcaagaacaccaaccagtaagtctttgccaaattctcagacccactcaggacacgagtctctacatggcttaacagaagagagataattaggatttttttttcctcagtctttctgaggtttttatttaaatgcactcagtggtcatagggcagaagctcaagctagctggggcgaagggaggacgccagggagagtatgtttctcatccctgggaggcattcagcctagctcctgcagccaaattacagcaccagagaacaatgtgatgcattcctgggcaggtcggtgggaccctgggcgcctgggccttgtggagagaggtgccagacacagagttctccgtaagcaatcctgcagagccgccccctgggtgcagaaatgaaatacgggagagcttcacattacacagagacctgtagctcacacctggttattgatggccttggtggaggcctctgccccgaccctccacttgggaactgcctgctactacgggggttgggcatctttgaagcaatgttggataacaagaaagagatgcttccttttcactctttgccctccctgtcagcctgagcacaaccatgaggttacacacacacacacagaggtgtacatatacagacacatagagaacttctctcaggctgcataggagttctgctcatcctcctctccccaacaattaaaaaaaaaagcaattagatttcgatccagtacttcaaaaaggataccaatagggtctggctttaatcaaggaatatctacaaagtcacattaccaacctgcaggcaactctttggtttggggaccagaactcctctggtgggtggttgggggaaggatgcaggaagggcatggtgaggagagatcagtggtgaagaattaccatcaaagcagagtggctgagactgtataagttcgcaaggctggttcatgccagagatagtgagatgtgcaccctatgtgctgagaatgatggagcagtctcctatgactgcatggggtataactgccaagcctactgctcatgacctgtggttgtttttaactcttaactgggttagaaaactggagagctttggattccagggatgatctccataagagagaagcactggaaaagaccaagtggtggctttattagggtaaatatatcacagttgctacagtgaattgagctttctcagaagctattattttctttgggtgattggcaggtatagggcaatagccagtggggtgtcagtaatatgccctgtccctgacctcaaaggtaaagggatagaaaagagagggcgttgacaaactcattttcccacttcccactcatggcttatattatctctgagcatctcggtggctattcctcatttacttaagatgttttagtcattctggatgtgcaaatgcaaggcaagcattctcccactggccccctaacggttaactatcctggcttaaaattttcctttgctcacttccattctatgagtatatcgatggagcagctggacattagagttctttctctttgaccaaaggagccaaaatgcggtgacttgacttcaaccccaacagcccctgtaagtagccctggccaaacagaaaggctaagctgaatgaagaaaaaaggaagacaatttcatctacagttgtcctttttgacagcttccaaggggggtttgcctaggaataacaatattcataagaagctttttcatatgcaaaatgctttagcatatatgtaatcctcacaacaaccctgtgaggtaggggttactgtcactttacagatgctgttcagaaaaatttggtgatttgtccaaggtcacatgaacagtgcgtggctcagccagaactcaaacctaggtcttctgacttcaaatcctgtgtattctcctcaaagcctgaggatgcccagggttgggggcaccagagtcccagcaccttcaaaacagaaattgatacaaaatgttcaagccctgtaggagtcccaggacagccaagagagtatatctgagcacagtttacaaaggaacagcctaggccctcctgaaccttatcaaccaatggctcttttgccatttctgccactattaccaccagtaccatgtgaccactatacaacatattccacatttaaacaactctggctcctaattctactccttttttccccttcagattaacattaaaaattttatctagtccttttgaaattatgctaaatgtatagacacagtagaagtagtcatgacagaaaattattaaggctttgaaaatatgtatcagaggccgggtgcagtggctcatgcctgtaatcccagcactttgggaggccgaggtggggcagatcacgaggtcaggagattgagaccatcctggctaacacggtgaaaccctgtctctactaaaaatacaaaaaaattagccgggcctggtggcgggcgcctgtagtcccagctactggggaggctgaggcaggagaatggcgtgaacccaggaggcagagcttgcagtgagccaagatgcaccactgcactccagcctgggagacagagcgagactccgtcacaaaaaaaaaaaaaaagaaggtatgtattagaattttctttgagatttcactccttttaaaaatgacgtcaactcctgggttaggaaagcaagatgagggaataagtgtcctaagaaactcccatcccaagccagacagatgcctacccgtggcctggcaaaggtcctgggatctcaagctgatgcaagcaatttgtgtacaccaaggcaaggggtctcaatcctgcagagaaacccatgagatgaggcagacagcagattttcacttgatcaaacacttgctgctctcaacccctctttgttttcccatccaaaatctggacctctgtttaggcgcaagacagtgagtaagagcagctccaaaagatgacgtatgcaaggggaactcttctgttcaatcctgtaatgttttctgttagagacagcataggctacctatcctaatcctgcaccccaactgttaagacagaagggaaaagtacaatgttcatcaatcatagctctgggatgctgcagctccctgacctgggcccctacttgagctaggagaagaacacctcatgaaaacagtctacctatagtcaggacttccccaaggcagactttattttttggtccatcgatcttggctctcactgttctccctgcttcccacccccaactgcctctgcatgtgggctcagaagtcatcatctaaagaattccattgctcacctcctgcatagcagcacagccccatgaggccacacaccagatggaggggataaaagtacgaggtcatggcttcttgcaagaggctttttcttaaactaaccctgactcctggaaaagaggcagagcaggagagtgttgaatgagctgctgatgacagcagcttcataggtcttgtgtataaaggaaggaaaaagctaacttggctttccgtggaaatttacctactcccattttcaggtctactcctggtctcacatctacttcttgaaggtgtctaagtagaatgcagagattgtcaagctagagggttaactccttcccaattgtagggatctattcagcaggctgccacacacatgctgaggtggaggccaaccctgaacacatgcgctgcttctttaggaatgtaactatgaagtaaaaggaaacagtaaggaaggtgaactggaactctggggaaactgaaaaggtcatcaataggccttcaaaatatttgtgtgtaataagtagacacaagaggctggaggaagatgatcattcctagaataattatgcttactgggtgacaatatacagaagcaacaattacaataaaatgaaacagtttaatggactaggaagcagaagtctgagaataaaggaattaggttaatgagattaagcagagatggcattccacaggaggtgacttttgagttgaatttttaaaagatagctttatgtgttttatgaactgactgagggcagtcagaagaaggcattctaaatagagggaactggtatgtgctgaaacttagaagcaggaatgtacaagcaatatataaggaatttcaagcaagtacacattatatacactggggaatacagagaaattagaatgctgagatcagggcttaaataatgtgaggtgactgtgtgcacctagactgtcaaatggttcagcatcccctatagagccacatagtatcttgatttatgtcagtaaacatcagggcacctatggaaaagcacaaggatgagtccatttgttacagacccagggactaacagagatctacactgtaaagttcaacaaaatgctacatatcattaactacagctccttatcatttgagattctgggctaagtaagagatatcaaatatcctatccagtactgtgatacattaatgtaggcttacaggcccagaacctggcataaatcaagccaaacccttaagaaattagaatgtgaaaagaaaataatttaaaatagaaaatacatgctgcttttcctcactcccaaacttaaaacttgactggtcctacatattctacttggtatattgaatttttgcagctagcagatttatcgtatctgaggccatagtgaatagaagagctgcaaaagagctttagagactgcaaaaccagctcactaataaatgaggaactttattctaatttactaccaggggctgaagtagcagccaaagaaggagacaaattctaacttcatgatctctagttaggtgtctattttcctgcatttgctaaaggtaaaaatcgctacttatggggcttttgtcatacttcttaaccaaacttccctaacttctgaggataaaaaccataagggcaatcttattcttccaaagcagttccctggtgccactttcagaaacagagtattgaactatgggtctgacccagtgtggcactgagtgtgtgtgtgtttgtgtgtttgtgtgtgtgtgtacactgaataagccaaaacgtgtgccatattctaggtttctgctttacttaactggcaaaatttggtgctgtaagggaggcagccacaaaaccagtgatagcatttgttagtatcatcttagttctcttccctcccctaggtagtttataaagggtgatttctgaaacccttcacaaaagaaaagctcaagggtttacattcaactgtgacagcactatgaattcattaagaagcatgtttcaggttgcactgtaatttccctatgtaatacaaacccatggaatctgacataagctgattgctcatgctggttgttttatttacatttctgaatggaaaggatttcaatactcataaaatatctaactggcttatttttcatctgttctcccagagaagctattataagataggcatagagacagaagtctcaacttgtataactggttaagcaaccagggaaatgttattgctcaaaatgcaattttaaaaaattcaatatggaacttgaggccaaaaaaacagaaggttactctcaatgccatccaaaagataaaagttaaaaaaaaaaaaaaaaaaaaaggtaactatgctcattattttcaaccaagttctatggaggtggtaccttcacaggagctcagtggaactggggtttacttacatcttttttctgggaacctaatgttagcagacacagttgctagtttgaacaggaatgcagatgaatggatgaaagtgggctccctaccacccagaaatatgaatgtgcctccttaccaatatgctacaaatcagacctctgaattagaagatgccatcatgcaactaacttactatctggagatgtgtattttgttaacctaggcaaagaataacaatttctgcttattccagtaggtgtgacaagctcagagaagtgagcgacaagctagagaagtaataattaccaataaagtaaattccaaagccgaa

SEQ ID NO: 200163 - DNA, 3355 bp, Homo sapiens
  Payload ID: 19489
  Gene Name: wingless-type MMTV integration site family, member 3
  Uniprot ID: P56703
  ENST ID: ENST00000225512
  CDS Start-End: 164-1231
tgctccgcgctgggctcgggaggggggcggctgcgggtggaggtgcgcttctgacaagcccgaaagtcatttccaatctcaagtggactttgttccaactattgggggcgtcgctccccctcttcatggtcgcgggcaaacttcctcctcggcgcctcttctaatggagccccacctgctcgggctgctcctcggcctcctgctcggtggcaccagggtcctcgctggctacccaatttggtggtccctggccctgggccagcagtacacatctctgggctcacagcccctgctctgcggctccatcccaggcctggtccccaagcaactgcgcttctgccgcaattacatcgagatcatgcccagcgtggccgagggcgtgaagctgggcatccaggagtgccagcaccagttccggggccgccgctggaactgcaccaccatagatgacagcctggccatctttgggcccgtcctcgacaaagccacccgcgagtcggccttcgttcacgccatcgcctcggccggcgtggccttcgccgtcacccgctcctgcgccgagggcacctccaccatttgcggctgtgactcgcatcataaggggccgcctggcgaaggctggaagtggggcggctgcagcgaggacgctgacttcggcgtgttagtgtccagggagttcgcggatgcgcgcgagaacaggccggacgcgcgctcggccatgaacaagcacaacaacgaggcgggccgcacgactatcctggaccacatgcacctcaaatgcaagtgccacgggctgtcgggcagctgtgaggtgaagacctgctggtgggcgcagcctgacttccgtgccatcggtgacttcctcaaggacaagtatgacagcgcctcggagatggtagtagagaagcaccgtgagtcccgaggctgggtggagaccctccgggccaagtactcgctcttcaagccacccacggagagggacctggtctactacgagaactcccccaacttttgtgagcccaacccagagacgggttcctttggcacaagggaccggacttgcaatgtcacctcccacggcatcgatggctgcgatctgctctgctgtggccggggccacaacacgaggacggagaagcggaaggaaaaatgccactgcatcttccactggtgctgctacgtcagctgccaggagtgtattcgcatctacgacgtgcacacctgcaagtagggcaccagggcgctgggaaggggtgaagtgtgtggctgggcggattcagcgaagtctcatgggaagcaggacctagagccgggcacagccctcagcgtcagacagcaaggaactgtcaccagccgcacgcgtggtaaatgacccagacccaactcgcctgtggacggggaggctctccctctctctcatcttacatttctcaccctactctggatggtgtgtggtttttaaagaagggggctttctttttagttctctagggtctgataggaacagacctgaggcttatctttgcacatgttaaagaaaataaaaatgaaaaaaaatttgactccaacagaacaggctgggctaatgtgagctctcagcctggcagtcaagacatcagcatgggcaaggttctgtttccaaactgctgcttctggtgacattccaagacgcctggagggtgggagtcaggaagtaggacacacccctgcagtctccttttcttggtccactcccattcaaatttgagctaatttctcattctgataaaagccataggtttagctaggatgaagtggtaggaaggtccgtggcagttgttagagtaggatttggagtttggaagaactggcagctcagggtggcctggtcagccgtttgaagagcagccatgtgttcttctcagtctcattttctctataaccctgttctgcacgaggggcagtcagatctcaaaatctttttctaccattctgcagtttccaccgtcaatgcagttttttttttgtttttttgtttttttttttttttggtggtagtggaccttgtaaataggctatgtaagggggcaagtcttctctagctcaaatggcttcctaaataaataagcggtatcttcagaaggggccattcagtccttcccagccctgctcacctgcagattctctgtacaaataactccaggtagagcagttggactccaggtcaccttagtataagttagacaaagggtccgtgagggagtagccatcaattcctgaaattccaactttgtgactagcagatggggaggatgaaaaccatccctttgcttcctctccaatacggacccatcttactgtgtcctttcctctctggggccaatgtgagtaaacacagacacagagttctttcccccagctcttcctccctcacctgcatgctgagatagcttccatccatgcagttcccaaggatctggattagaagttcaaaggggaaccagcagtcacctactcccttaggtgaagcatctcacggctgagttctccctgaggcatactggtccagctgagcgtcctagagaaagctagcaaaagggaggcacatggatttcacagtatgaattggttcaacaactgtcttagggagaatcagaaagaagagatgcagcaggggaatgagcagaacaaagatttttctttctcccccttctctctggggtctacctaaccctgacctaaaataccagggcagcgatctcccagctggtgcaggtgggcttgccaagatggtcgtccaggagcccgccttcacttctaaatctgctggccacaagccctgctaaagatacacatctcaccccctccgccaagtctgaaatgcccctccccatctcaccttagactgaaaagttttaaatcatgtcaactggataatacttgctttatgtgagaatacttcagcagaatggatacgaattttcaaaacaatcttttcatatctatgtattctatattaaaagtgataaagtcatgtttctggggcgtattcaagtagctgacaagtaattatttaataatagtacatgagtgcattgtaatgattctcgccgtagtcaggtaatagtatccaaccgaaatttcctaccaacctgctgtatccaaagttttgtaaaaagttgtagaagttgttgatctttttgattttatattcaaaaagtctctttttataaatattatttattatacaatgtatatacctttgagttaactaagattatatattatataaatatatatatatttggagaaaatatatttcatcatgcagtttttttctgttaagtcattaaagagaaggtaaacaaacctaaaa

SEQ ID NO: 200164 - DNA, 3352 bp, Homo sapiens
  Payload ID: 19489
  Gene Name: wingless-type MMTV integration site family, member 3
  ENST ID: ENST00000611547
  CDS Start-End: 164-1231
tgctccgcgctgggctcgggaggggggcggctgcgggtggaggtgcgcttctgacaagcccgaaagtcatttccaatctcaagtggactttgttccaactattgggggcgtcgctccccctcttcatggtcgcgggcaaacttcctcctcggcgcctcttctaatggagccccacctgctcgggctgctcctcggcctcctgctcggtggcaccagggtcctcgctggctacccaatttggtggtccctggccctgggccagcagtacacatctctgggctcacagcccctgctctgcggctccatcccaggcctggtccccaagcaactgcgcttctgccgcaattacatcgagatcatgcccagcgtggccgagggcgtgaagctgggcatccaggagtgccagcaccagttccggggccgccgctggaactgcaccaccatagatgacagcctggccatctttgggcccgtcctcgacaaagccacccgcgagtcggccttcgttcacgccatcgcctcggccggcgtggccttcgccgtcacccgctcctgcgccgagggcacctccaccatttgcggctgtgactcgcatcataaggggccgcctggcgaaggctggaagtggggcggctgcagcgaggacgctgacttcggcgtgttagtgtccagggagttcgcggatgcgcgcgagaacaggccggacgcgcgctcggccatgaacaagcacaacaacgaggcgggccgcacgactatcctggaccacatgcacctcaaatgcaagtgccacgggctgtcgggcagctgtgaggtgaagacctgctggtgggcgcagcctgacttccgtgccatcggtgacttcctcaaggacaagtatgacagcgcctcggagatggtagtagagaagcaccgtgagtcccgaggctgggtggagaccctccgggccaagtactcgctcttcaagccacccacggagagggacctggtctactacgagaactcccccaacttttgtgagcccaacccagagacgggttcctttggcacaagggaccggacttgcaatgtcacctcccacggcatcgatggctgcgatctgctctgctgtggccggggccacaacacgaggacggagaagcggaaggaaaaatgccactgcatcttccactggtgctgctacgtcagctgccaggagtgtattcgcatctacgacgtgcacacctgcaagtagggcaccagggcgctgggaaggggtgaagtgtgtggctgggcggattcagcgaagtctcatgggaagcaggacctagagccgggcacagccctcagcgtcagacagcaaggaactgtcaccagccgcacgcgtggtaaatgacccagacccaactcgcctgtggacggggaggctctccctctctctcatcttacatttctcaccctactctggatggtgtgtggtttttaaagaagggggctttctttttagttctctagggtctgataggaacagacctgaggcttatctttgcacatgttaaagaaaataaaaatgaaaaaaaatttgactccaacagaacaggctgggctaatgtgagctctcagcctggcagtcaagacatcagcatgggcaaggttctgtttccaaactgctgcttctggtgacattccaagacgcctggagggtgggagtcaggaagtaggacacacccctgcagtctccttttcttggtccactcccattcaaatttgagctaatttctcattctgataaaagccataggtttagctaggatgaagtggtaggaaggtccgtggcagttgttagagtaggatttggagtttggaagaactggcagctcagggtggcctggtcagccgtttgaagagcagccatgtgttcttctcagtctcattttctctataaccctgttctgcacgaggggcagtcagatctcaaaatctttttctaccattctgcagtttccaccgtcaatgcagttttttttttgtttttttgttttttttttttttttggtggtagtggaccttgtaaataggctatgtaagggggcaagtcttctctagctcaaatggcttcctaaataaataagcggtatcttcagaaggggccattcagtccttcccagccctgctcacctgcagattctctgtacaaataactccaggtagagcagttggactccaggtcaccttagtataagttagacaaagggtccgtgagggagtagccatcaattcctgaaattccaactttgtgactagcagatggggaggatgaaaaccatccctttgcttcctctccaatacggacccatcttactgtgtcctttcctctctggggccaatgtgagtaaacacagacacagagttctttcccccagctcttcctccctcacctgcatgctgagatagcttccatccatgcagttcccaaggatctggattagaagttcaaaggggaaccagcagtcacctactcccttaggtgaagcatctcacggctgagttctccctgaggcatactggtccagctgagcgtcctagagaaagctagcaaaagggaggcacatggatttcacagtatgaattggttcaacaactgtcttagggagaatcagaaagaagagatgcagcaggggaatgagcagaacaaagatttttctttctcccccttctctctggggtctacctaaccctgacctaaaataccagggcagcgatctcccagctggtgcaggtgggcttgccaagatggtcgtccaggagcccgccttcacttctaaatctgctggccacaagccctgctaaagatacacatctcaccccctccgccaagtctgaaatgcccctccccatctcaccttagactgaaaagttttaaatcatgtcaactggataatacttgctttatgtgagaatacttcagcagaatggatacgaattttcaaaacaatcttttcatatctatgtattctatattaaaagtgataaagtcatgtttctggggcgtattcaagtagctgacaagtaattatttaataatagtacatgagtgcattgtaatgattctcgccgtagtcaggtaatagtatccaaccgaaatttcctaccaacctgctgtatccaaagttttgtaaaaagttgtagaagttgttgatctttttgattttatattcaaaaagtctctttttataaatattatttattatacaatgtatatacctttgagttaactaagattatatattatataaatatatatatatttggagaaaatatatttcatcatgcagtttttttctgttaagtcattaaagagaaggtaaacaaacct

SEQ ID NO: 200165 - DNA, 3356 bp, Homo sapiens
  Payload ID: 19489
  Gene Name: wingless-type MMTV integration site family, member 3
  Uniprot ID: P56703
  ENST ID: ENST00000616347
  CDS Start-End: 164-1231
tgctccgcgctgggctcgggaggggggcggctgcgggtggaggtgcgcttctgacaagcccgaaagtcatttccaatctcaagtggactttgttccaactattgggggcgtcgctccccctcttcatggtcgcgggcaaacttcctcctcggcgcctcttctaatggagccccacctgctcgggctgctcctcggcctcctgctcggtggcaccagggtcctcgctggctacccaatttggtggtccctggccctgggccagcagtacacatctctgggctcacagcccctgctctgcggctccatcccaggcctggtccccaagcaactgcgcttctgccgcaattacatcgagatcatgcccagcgtggccgagggcgtgaagctgggcatccaggagtgccagcaccagttccggggccgccgctggaactgcaccaccatagatgacagcctggccatctttgggcccgtcctcgacaaagccacccgcgagtcggccttcgttcacgccatcgcctcggccggcgtggccttcgccgtcacccgctcctgcgccgagggcacctccaccatttgcggctgtgactcgcatcataaggggccgcctggcgaaggctggaagtggggcggctgcagcgaggacgctgacttcggcgtgttagtgtccagggagttcgcggatgcgcgcgagaacaggccggacgcgcgctcggccatgaacaagcacaacaacgaggcgggccgcacgactatcctggaccacatgcacctcaaatgcaagtgccacgggctgtcgggcagctgtgaggtgaagacctgctggtgggcgcagcctgacttccgtgccatcggtgacttcctcaaggacaagtatgacagcgcctcggagatggtagtagagaagcaccgtgagtcccgaggctgggtggagaccctccgggccaagtactcgctcttcaagccacccacggagagggacctggtctactacgagaactcccccaacttttgtgagcccaacccagagacgggttcctttggcacaagggaccggacttgcaatgtcacctcccacggcatcgatggctgcgatctgctctgctgtggccggggccacaacacgaggacggagaagcggaaggaaaaatgccactgcatcttccactggtgctgctacgtcagctgccaggagtgtattcgcatctacgacgtgcacacctgcaagtagggcaccagggcgctgggaaggggtgaagtgtgtggctgggcggattcagcgaagtctcatgggaagcaggacctagagccgggcacagccctcagcgtcagacagcaaggaactgtcaccagccgcacgcgtggtaaatgacccagacccaactcgcctgtggacggggaggctctccctctctctcatcttacatttctcaccctactctggatggtgtgtggtttttaaagaagggggctttctttttagttctctagggtctgataggaacagacctgaggcttatctttgcacatgttaaagaaaataaaaatgaaaaaaaatttgactccaacagaacaggctgggctaatgtgagctctcagcctggcagtcaagacatcagcatgggcaaggttctgtttccaaactgctgcttctggtgacattccaagacgcctggagggtgggagtcaggaagtaggacacacccctgcagtctccttttcttggtccactcccattcaaatttgagctaatttctcattctgataaaagccataggtttagctaggatgaagtggtaggaaggtccgtggcagttgttagagtaggatttggagtttggaagaactggcagctcagggtggcctggtcagccgtttgaagagcagccatgtgttcttctcagtctcattttctctataaccctgttctgcacgaggggcagtcagatctcaaaatctttttctaccattctgcagtttccaccgtcaatgcagttttttttttgtttttttgttttttttttttttttggtggtagtggaccttgtaaataggctatgtaagggggcaagtcttctctagctcaaatggcttcctaaataaataagcggtatcttcagaaggggccattcagtccttcccagccctgctcacctgcagattctctgtacaaataactccaggtagagcagttggactccaggtcaccttagtataagttagacaaagggtccgtgagggagtagccatcaattcctgaaattccaactttgtgactagcagatggggaggatgaaaaccatccctttgcttcctctccaatacggacccatcttactgtgtcctttcctctctggggccaatgtgagtaaacacagacacagagttctttcccccagctcttcctccctcacctgcatgctgagatagcttccatccatgcagttcccaaggatctggattagaagttcaaaggggaaccagcagtcacctactcccttaggtgaagcatctcacggctgagttctccctgaggcatactggtccagctgagcgtcctagagaaagctagcaaaagggaggcacatggatttcacagtatgaattggttcaacaactgtcttagggagaatcagaaagaagagatgcagcaggggaatgagcagaacaaagatttttctttctcccccttctctctggggtctacctaaccctgacctaaaataccagggcagcgatctcccagctggtgcaggtgggcttgccaagatggtcgtccaggagcccgccttcacttctaaatctgctggccacaagccctgctaaagatacacatctcaccccctccgccaagtctgaaatgcccctccccatctcaccttagactgaaaagttttaaatcatgtcaactggataatacttgctttatgtgagaatacttcagcagaatggatacgaattttcaaaacaatcttttcatatctatgtattctatattaaaagtgataaagtcatgtttctggggcgtattcaagtagctgacaagtaattatttaataatagtacatgagtgcattgtaatgattctcgccgtagtcaggtaatagtatccaaccgaaatttcctaccaacctgctgtatccaaagttttgtaaaaagttgtagaagttgttgatctttttgattttatattcaaaaagtctctttttataaatattatttattatacaatgtatatacctttgagttaactaagattatatattatataaatatatatatatttggagaaaatatatttcatcatgcagtttttttctgttaagtcattaaagagaaggtaaacaaacctaaaa

SEQ ID NO: 200166 - DNA, 2932 bp, Homo sapiens
  Payload ID: 19490
  Gene Name: wingless-type MMTV integration site family, member 3A
  Uniprot ID: P56704
  ENST ID: ENST00000284523
  CDS Start-End: 79-1137
agctcccagggcccggccccccccggcgctcacgctctcggggcggactcccggccctccgcgccctctcgcgcggcgatggccccactcggatacttcttactcctctgcagcctgaagcaggctctgggcagctacccgatctggtggtcgctggctgttgggccacagtattcctccctgggctcgcagcccatcctgtgtgccagcatcccgggcctggtccccaagcagctccgcttctgcaggaactacgtggagatcatgcccagcgtggccgagggcatcaagattggcatccaggagtgccagcaccagttccgcggccgccggtggaactgcaccaccgtccacgacagcctggccatcttcgggcccgtgctggacaaagctaccagggagtcggcctttgtccacgccattgcctcagccggtgtggcctttgcagtgacacgctcatgtgcagaaggcacggccgccatctgtggctgcagcagccgccaccagggctcaccaggcaagggctggaagtggggtggctgtagcgaggacatcgagtttggtgggatggtgtctcgggagttcgccgacgcccgggagaaccggccagatgcccgctcagccatgaaccgccacaacaacgaggctgggcgccaggccatcgccagccacatgcacctcaagtgcaagtgccacgggctgtcgggcagctgcgaggtgaagacatgctggtggtcgcaacccgacttccgcgccatcggtgacttcctcaaggacaagtacgacagcgcctcggagatggtggtggagaagcaccgggagtcccgcggctgggtggagaccctgcggccgcgctacacctacttcaaggtgcccacggagcgcgacctggtctactacgaggcctcgcccaacttctgcgagcccaaccctgagacgggctccttcggcacgcgcgaccgcacctgcaacgtcagctcgcacggcatcgacggctgcgacctgctgtgctgcggccgcggccacaacgcgcgagcggagcggcgccgggagaagtgccgctgcgtgttccactggtgctgctacgtcagctgccaggagtgcacgcgcgtctacgacgtgcacacctgcaagtaggcaccggccgcggctccccctggacggggcgggccctgcctgagggtgggcttttccctgggtggagcaggactcccacctaaacggggcagtactcctccctgggggcgggactcctccctgggggtggggctcctacctgggggcagaactcctacctgaaggcagggctcctccctggagctagtgtctcctctctggtggctgggctgctcctgaatgaggcggagctccaggatggggaggggctctgcgttggcttctccctggggacggggctcccctggacagaggcggggctacagattgggcggggcttctcttgggtgggacagggcttctcctgcgggggcgaggcccctcccagtaagggcgtggctctgggtgggcggggcactaggtaggcttctacctgcaggcggggctcctcctgaaggaggcggggctctaggatggggcacggctctggggtaggctgctccctgagggcggagcgcctccttaggagtggggttttatggtggatgaggcttcttcctggatggggcagagcttctcctgaccagggcaaggccccttccacgggggctgtggctctgggtgggcgtggcctgcataggctccttcctgtgggtggggcttctctgggaccaggctccaatggggcggggcttctctccgcgggtgggactcttccctgggaaccgccctcctgattaaggcgtggcttctgcaggaatcccggctccagagcaggaaattcagcccaccagccacctcatccccaaccccctgtaaggttccatccacccctgcgtcgagctgggaaggttccatgaagcgagtcgggtccccaacccgtgcccctgggatccgagggcccctctccaagcgcctggctttggaatgctccaggcgcgccgacgcctgtgccaccccttcctcagcctggggtttgaccacccacctgaccaggggccctacctggggaaagcctgaagggcctcccagcccccaaccccaagaccaagcttagtcctgggagaggacagggacttcgcagaggcaagcgaccgaggccctcccaaagaggcccgccctgcccgggctcccacaccgtcaggtactcctgccagggaactggcctgctgcgccccaggccccgcccgtctctgctctgctcagctgcgcccccttctttgcagctgcccagcccctcctccctgccctcgggtctccccacctgcactccatccagctacaggagagatagaagcctctcgtcccgtccctccctttcctccgcctgtccacagccccttaagggaaaggtaggaagagaggtccagccccccaggctgcccagagctgctggtctcatttgggggcgttcgggaggtttggggggcatcaaccccccgactgtgctgctcgcgaaggtcccacagccctgagatgggccggcccccttcctggcccctcatggcgggactggagaaatggtccgctttcctggagccaatggcccggcccctcctgactcatccgcctggcccgggaatgaatggggaggccgctgaacccacccggcccatatccctggttgcctcatggccagcgcccctcagcctctgccactgtgaaccggctcccaccctcaaggtgcggggagaagaagcggccaggcggggcgccccaagagcccaaaagagggcacaccgccatcctctgcctcaaattctgcgtttttggttttaatgttatatctgatgctgctatatccactgtccaacgg

SEQ ID NO: 200167 - DNA, 3845 bp, Homo sapiens
  Payload ID: 19491
  Gene Name: wingless-type MMTV integration site family, member 4
  Uniprot ID: P56705
  ENST ID: ENST00000290167
  CDS Start-End: 45-1100
gcggccgcagccgctgccccgggccgggcgcccgcggcggcaccatgagtccccgctcgtgcctgcgttcgctgcgcctcctcgtcttcgccgtcttctcagccgccgcgagcaactggctgtacctggccaagctgtcgtcggtggggagcatctcagaggaggagacgtgcgagaaactcaagggcctgatccagaggcaggtgcagatgtgcaagcggaacctggaagtcatggactcggtgcgccgcggtgcccagctggccattgaggagtgccagtaccagttccggaaccggcgctggaactgctccacactcgactccttgcccgtcttcggcaaggtggtgacgcaagggactcgggaggcggccttcgtgtacgccatctcttcggcaggtgtggcctttgcagtgacgcgggcgtgcagcagtggggagctggagaagtgcggctgtgacaggacagtgcatggggtcagcccacagggcttccagtggtcaggatgctctgacaacatcgcctacggtgtggccttctcacagtcgtttgtggatgtgcgggagagaagcaagggggcctcgtccagcagagccctcatgaacctccacaacaatgaggccggcaggaaggccatcctgacacacatgcgggtggaatgcaagtgccacggggtgtcaggctcctgtgaggtaaagacgtgctggcgagccgtgccgcccttccgccaggtgggtcacgcactgaaggagaagtttgatggtgccactgaggtggagccacgccgcgtgggctcctccagggcactggtgccacgcaacgcacagttcaagccgcacacagatgaggacctggtgtacttggagcctagccccgacttctgtgagcaggacatgcgcagcggcgtgctgggcacgaggggccgcacatgcaacaagacgtccaaggccatcgacggctgtgagctgctgtgctgtggccgcggcttccacacggcgcaggtggagctggctgaacgctgcagctgcaaattccactggtgctgcttcgtcaagtgccggcagtgccagcggctcgtggagttgcacacgtgccgatgaccgcctgcctagccctgcgccggcaaccacctagtggcccagggaaggccgataatttaaacagtctcccaccacctaccccaagagatactggttgtattttttgttctggtttggtttttgggtcctcatgttatttattgccgaaaccaggcaggcaaccccaagggcaccaaccagggcctccccaaagcctgggcctttgtggctgccactgaccaaagggaccttgctcgtgccgctggctgcccgcatgtggctgccactgaccactcagttgttatctgtgtccgtttttctacttgcagacctaaggtggagtaacaaggagtattaccaccacatggctactgaccgtgtcatcggggaagagggggccttatggcagggaaaataggtaccgacttgatggaagtcacaccctctggaaaaaagaactcttaactctccagcacacatacacatggactcctggcagcttgagcctagaagccatgtctctcaaatgccctgagaaagggaacaagcagataccaggtcaagggcaccaggttcatttcagcccttacatggacagctagaggttcgatatctgtgggtccttccaggcaagaagagggagatgagagcaagagacgactgaagtcccaccctagaacccagcctgccccagcctgcccctgggaagaggaaacttaaccactccccagacccacctaggcaggcatataggctgccatcctggaccagggatcccggctgtgcctttgcagtcatgcccgagtcacctttcacagcgctgttcctccatgaaactgaaacacacacacacacacacacacacacacacacacacacacacggacacacacacacacctgcgagagagagggaggaaagggctgtgcctttgcagtcatgcccctgagtcacctttcacagcactgttcctccatgaaactgaaaaaggaaaacacacacacacacacctgcgagagggagggaggaaagggctgtgcaataaagtcctctcccattatcttactcaacacaatttattgagcaaatactacgtgttctaggccctgtacaggccatctcacttgatggccacaacagtcctgggaagcagacaaaccaagaatgctaatgcccatctgacatcagagacggcagtgctccccagacctctcacagcaagctggatggacaggcagggccagaagagtcctccagccaagcctcctccttggttcttgtacccaaaggtagagaaactgcaggtcttcttgggtctgagcctggggcaggggttctggctggacgaaaaggggcagggaagcagcaggagccagagaccacaggctgagctggagcccacatggttcctaagggcagaacaggctctgaggaaagatgtgaacagctggaaggctgacagtgaggtctcagcagtgtggtgcacccctccccagcacatccgagtccctggggtcccaggtaccataggtactgcaagatttcccaagagacagcaccagcaacctgggcctgaccctgtacaaccgccaaaccatcacgagccccgcccaggcttgtgagaaggacatgcatggatcaagaccttgcccttgacccatctgcttctcagatgggctcccaatcaccagaggaagttgctgtaagcccactttccagactgcccccacactggggctctaagtttcaggtcggagattttatgctctgtgatcccccacttggggttcccagactccaagctcctggctcctgtgttcagtggctgaattcaacgtccgagattcggaatatgggctccagcctgcagaaactcttctccaggcattgtggtttgtgcctcctagtgttggctccctcatgaaaagagggtcaacacccttggcccccagccaagatctctgctcaatgtccatacaaggaggaagccaaaaccaagtgaggtgctggagccacattcaaatgtggttgataatcttggggcaggccagctctgatgtggatgaaagctgatccaactgtcgccacagctgcccagctgggtccgctgctcccctggctggctgttcagctgtctactaagcccaaaaaaaatactatgcctcactagcagaggctagacccagaaagagggaacaatgaggacccctcccctcccagaggaaagagctgagccactctccccatccagggaacagtaggtccaggctggatgctggtatgatgggaactgcccttttcacctgccagggagttcctaaagctgatcttcctggggttctgaaggttgcgacctaggttaatgagaccaaattctaggaaccactgcccaggccaaccaccgccagtgctgcagagatcaaagaaatccacagccacaggaaaaggagcttctttggacatgcccagctccaaactgtcccagggggaactggcacagcccttacatagcccaccccctcttggcctcaccgtggcctggaaattggccagagggtccacatcctgcccaaaccactctcctctcgtcccaaggcaaaggtgatgccctgaggcctagggctggataaagcccagctctggatgctgctaacccactctgctgccccaccccatcctccaatttttatactaggctctttgccattgtgacgtcccatgacatagtctgatgcacgataaaacaattatttctttatcttgcaa

SEQ ID NO: 200168 - DNA, 482 bp, Homo sapiens
  Payload ID: 19491
  Gene Name: wingless-type MMTV integration site family, member 4
  ENST ID: ENST00000441048
  CDS Start-End: 327-482
tggtgagtgagccaagagagcttccctaaactcctcctgtcctcccaatcacagcgtcttaagcccacttcccggatgagaaaacggaggctcagagtcaagaccctgctgcctggggcgcgcccagaccttgtggctagccagaagcgaggtttcggattcccacagtctcgggccactgtcccaagctgcccaaagctggggaggccccgtccagctcccggaaggctgtagggaggtacctggccaagctgtcgtcggtggggagcatctcagaggaggagacgtgcgagaaactcaagggcctgatccagaggcaggtgcagatgtgcaagcggaacctggaagtcatggactcggtgcgccgcggtgcccagctggccattgaggagtgccagtaccagttccggaaccggcgctggaactgctccacactcgactccttgcccgtcttcggcaaggtggtgacgcaaggtggcaaa

SEQ ID NO: 200169 - DNA, 680 bp, Homo sapiens
  Payload ID: 19491
  Gene Name: wingless-type MMTV integration site family, member 4
  ENST ID: ENST00000415567
  CDS Start-End: 1-451
gtacctggccaagctgtcgtcggtggggagcatctcagaggaggagacgtgcgagaaactcaagggcctgatccagaggcaggtgcagatgtgcaagcggaacctggaagtcatggactcggtgcgccgcggtgcccagctggccattgaggagtgccagtaccagttccggaaccggcgctggaactgctccacactcgactccttgcccgtcttcggcaaggtggtgacgcaaggtggcaaagcctggcatggaggagacagtggatgtcatctactgacagaaagcaggtcaggggagaggactcaaaggcgcaaggaaggaggtagcctggggcaatgctggcctgaagccatcgtgggtactcaggaccccatgagaagccctccttacctttgggggaggaaccaagggggcacccacaccggctcagcatctgagggacactgagattcctactaggcctgggtggtacctgctctggactaaagtctgactggtggagtcgaacgtccaatcccctttggagagggacatgtcaaggtgccgagactaagccagtcacactcggcaggtgccagtcacacctggagaaggaggctgagctctgcccactcatcaaactcctcccttttacgtttttggttttcttccctagtaaaattcctcttggaaactt

SEQ ID NO: 200170 - DNA, 6176 bp, Homo sapiens
  Payload ID: 19492
  Gene Name: wingless-type MMTV integration site family, member 5A
  Uniprot ID: P41221
  ENST ID: ENST00000264634
  CDS Start-End: 658-1800
actaactcgcggctgcaggatcagcgtctggaagcagacgtttcggctacagacccagagaggaggagctggagatcaggaggcgtgagccgccaagagtttgcagaatctgtggtgtgaatgaactgggggcacctgggcgcacagatcgccccccttcccccgccccgggccacagttgagtagtggtacatttttttcaccctcttgtgaagaatttctttttattattatttgtcgtaaggtcttttgcacaatcacgcccacatttggggttggaaagccctaattaccgccgtcgctgatggacgttggaaacggagcgcctctccgtggaacagttgcctgcgcgccctcgccggaccggcggctccctagttgcgccccgaccaggccctgcccttgctgccggctcgcgcgcgtccgcgccccctccattcctgggcgcatcccagctctgccccaactcgggagtccaggcccgggcgccagtgcccgcttcagctccggttcactgcgcccgccggacgcgcgccggaggactccgcagccctgctcctgaccgtccccccaggcttaacccggtcgctccgctcggattcctcggctgcgctcgctcgggtggcgacttcctccccgcgccccctccccctcgccatgaagaagtccattggaatattaagcccaggagttgctttggggatggctggaagtgcaatgtcttccaagttcttcctagtggctttggccatatttttctccttcgcccaggttgtaattgaagccaattcttggtggtcgctaggtatgaataaccctgttcagatgtcagaagtatatattataggagcacagcctctctgcagccaactggcaggactttctcaaggacagaagaaactgtgccacttgtatcaggaccacatgcagtacatcggagaaggcgcgaagacaggcatcaaagaatgccagtatcaattccgacatcgaaggtggaactgcagcactgtggataacacctctgtttttggcagggtgatgcagataggcagccgcgagacggccttcacatacgcggtgagcgcagcaggggtggtgaacgccatgagccgggcgtgccgcgagggcgagctgtccacctgcggctgcagccgcgccgcgcgccccaaggacctgccgcgggactggctctggggcggctgcggcgacaacatcgactatggctaccgctttgccaaggagttcgtggacgcccgcgagcgggagcgcatccacgccaagggctcctacgagagtgctcgcatcctcatgaacctgcacaacaacgaggccggccgcaggacggtgtacaacctggctgatgtggcctgcaagtgccatggggtgtccggctcatgtagcctgaagacatgctggctgcagctggcagacttccgcaaggtgggtgatgccctgaaggagaagtacgacagcgcggcggccatgcggctcaacagccggggcaagttggtacaggtcaacagccgcttcaactcgcccaccacacaagacctggtctacatcgaccccagccctgactactgcgtgcgcaatgagagcaccggctcgctgggcacgcagggccgcctgtgcaacaagacgtcggagggcatggatggctgcgagctcatgtgctgcggccgtggctacgaccagttcaagaccgtgcagacggagcgctgccactgcaagttccactggtgctgctacgtcaagtgcaagaagtgcacggagatcgtggaccagtttgtgtgcaagtagtgggtgccacccagcactcagccccgctcccaggacccgcttatttatagaaagtacagtgattctggtttttggtttttagaaatattttttatttttccccaagaattgcaaccggaaccattttttttcctgttaccatctaagaactctgtggtttattattaatattataattattatttggcaataatgggggtgggaaccaagaaaaatatttattttgtggatctttgaaaaggtaatacaagacttcttttgatagtatagaatgaaggggaaataacacataccctaacttagctgtgtggacatggtacacatccagaaggtaaagaaatacattttctttttctcaaatatgccatcatatgggatgggtaggttccagttgaaagagggtggtagaaatctattcacaattcagcttctatgaccaaaatgagttgtaaattctctggtgcaagataaaaggtcttgggaaaacaaaacaaaacaaaacaaacctcccttccccagcagggctgctagcttgctttctgcattttcaaaatgataatttacaatggaaggacaagaatgtcatattctcaaggaaaaaaggtatatcacatgtctcattctcctcaaatattccatttgcagacagaccgtcatattctaatagctcatgaaatttgggcagcagggaggaaagtccccagaaattaaaaaatttaaaactcttatgtcaagatgttgatttgaagctgttataagaattaggattccagattgtaaaaagatccccaaatgattctggacactagatttttttgtttggggaggttggcttgaacataaatgaaaatatcctgttattttcttagggatacttggttagtaaattataatagtaaaaataatacatgaatcccattcacaggttctcagcccaagcaacaaggtaattgcgtgccattcagcactgcaccagagcagacaacctatttgaggaaaaacagtgaaatccaccttcctcttcacactgagccctctctgattcctccgtgttgtgatgtgatgctggccacgtttccaaacggcagctccactgggtcccctttggttgtaggacaggaaatgaaacattaggagctctgcttggaaaacagttcactacttagggatttttgtttcctaaaacttttattttgaggagcagtagttttctatgttttaatgacagaacttggctaatggaattcacagaggtgttgcagcgtatcactgttatgatcctgtgtttagattatccactcatgcttctcctattgtactgcaggtgtaccttaaaactgttcccagtgtacttgaacagttgcatttataaggggggaaatgtggtttaatggtgcctgatatctcaaagtcttttgtacataacatatatatatatatacatatatataaatataaatataaatatatctcattgcagccagtgatttagatttacagtttactctggggttatttctctgtctagagcattgttgtccttcactgcagtccagttgggattattccaaaagttttttgagtcttgagcttgggctgtggccctgctgtgatcataccttgagcacgacgaagcaaccttgtttctgaggaagcttgagttctgactcactgaaatgcgtgttgggttgaagatatcttttttcttttctgcctcacccctttgtctccaacctccatttctgttcactttgtggagagggcattacttgttcgttatagacatggacgttaagagatattcaaaactcagaagcatcagcaatgtttctcttttcttagttcattctgcagaatggaaacccatgcctattagaaatgacagtacttattaattgagtccctaaggaatattcagcccactacatagatagcttttttttttttttttttaataaggacacctctttccaaacagtgccatcaaatatgttcttatctcagacttacgttgttttaaaagtttggaaagatacacatctttcataccccccttaggcaggttggctttcatatcacctcagccaactgtggctcttaatttattgcataatgatattcacatcccctcagttgcagtgaattgtgagcaaaagatcttgaaagcaaaaagcactaattagtttaaaatgtcacttttttggtttttattatacaaaaaccatgaagtactttttttatttgctaaatcagattgttcctttttagtgactcatgtttatgaagagagttgagtttaacaatcctagcttttaaaagaaactatttaatgtaaaatattctacatgtcattcagatattatgtatatcttctagcctttattctgtacttttaatgtacatatttctgtcttgcgtgatttgtatatttcactggtttaaaaaacaaacatcgaaaggcttatgccaaatggaagatagaatataaaataaaacgttacttgtatattggtaagtggtttcaattgtccttcagataattcatgtggagatttttggagaaaccatgacggatagtttaggatgactacatgtcaaagtaataaaagagtggtgaattttaccaaaaccaagctatttggaagcttcaaaaggtttctatatgtaatggaacaaaaggggaattctcttttcctatatatgttccttacaaaaaaaaaaaaaaaagaaatcaagcagatggcttaaagctggttataggattgctcacattcttttagcattatgcatgtaacttaattgttttagagcgtgttgctgttgtaacatcccagagaagaatgaaaaggcacatgcttttatccgtgaccagatttttagtccaaaaaaatgtatttttttgtgtgtttaccactgcaactattgcacctctctatttgaatttactgtggaccatgtgtggtgtctctatgccctttgaaagcagtttttataaaaagaaagcccgggtctgcagagaatgaaaactggttggaaactaaaggttcattgtgttaagtgcaattaatacaagttattgtgcttttcaaaaatgtacacggaaatctggacagtgctccacagattgatacattagcctttgctttttctctttccggataaccttgtaacatattgaaaccttttaaggatgccaagaatgcattattccacaaaaaaacagcagaccaacatatagagtgtttaaaatagcatttctgggcaaattcaaactcttgtggttctaggactcacatctgtttcagtttttcctcagttgtatattgaccagtgttctttattgcaaaaacatatacccgatttagcagtgtcagcgtattttttcttctcatcctggagcgtattcaagatcttcccaatacaagaaaattaataaaaaatttatatataggcagcagcaaaagagccatgttcaaaatagtcattatgggctcaaatagaaagaagacttttaagttttaatccagtttatctgttgagttctgtgagctactgacctcctgagactggcactgtgtaagttttagttgcctaccctagctcttttctcgtacaattttgccaataccaagtttcaatttgtttttacaaaacattattcaagccactagaattatcaaatatgacgctatagcagagtaaatactctgaataagagaccggtactagctaactccaagagatcgttagcagcatcagtccacaaacacttagtggcccacaatatatagagagatagaaaaggtagttataacttgaagcatgtatttaatgcaaataggcacgaaggcacaggtctaaaatactacattgtcactgtaagctatacttttaaaatatttattttttttaaagtattttctagtcttttctctctctgtggaatggtgaaagagagatgccgtgttttgaaagtaagatgatgaaatgaatttttaattcaagaaacattcagaaacataggaattaaaacttagagaaatgatctaatttccctgttcacacaaactttacactttaatctgatgattggatattttattttagtgaaacatcatcttgttagctaactttaaaaaatggatgtagaatgattaaaggttggtatgatttttttttaatgtatcagtttgaacctagaatattgaattaaaatgctgtctcagtattttaaaagcaaaaaaggaatggaggaaaattgcatcttagaccatttttatatgcagtgtacaatttgctgggctagaaatgagataaagattatttatttttgttcatatcttgtacttttctattaaaatcattttatgaaatcc

SEQ ID NO: 200171 - DNA, 6042 bp, Homo sapiens
  Payload ID: 19492
  Gene Name: wingless-type MMTV integration site family, member 5A
  Uniprot ID: P41221
  ENST ID: ENST00000474267
  CDS Start-End: 523-1665
agtctgcggccactgggcagaacggcaagggagagggggaagggcggagggacgcagcctgggggcgatttgccgggcggagacgctctttttcagacaccctcctcaggtcttttgcacaatcacgcccacatttggggttggaaagccctaattaccgccgtcgctgatggacgttggaaacggagcgcctctccgtggaacagttgcctgcgcgccctcgccggaccggcggctccctagttgcgccccgaccaggccctgcccttgctgccggctcgcgcgcgtccgcgccccctccattcctgggcgcatcccagctctgccccaactcgggagtccaggcccgggcgccagtgcccgcttcagctccggttcactgcgcccgccggacgcgcgccggaggactccgcagccctgctcctgaccgtccccccaggcttaacccggtcgctccgctcggattcctcggctgcgctcgctcgggtggcgacttcctccccgcgccccctccccctcgccatgaagaagtccattggaatattaagcccaggagttgctttggggatggctggaagtgcaatgtcttccaagttcttcctagtggctttggccatatttttctccttcgcccaggttgtaattgaagccaattcttggtggtcgctaggtatgaataaccctgttcagatgtcagaagtatatattataggagcacagcctctctgcagccaactggcaggactttctcaaggacagaagaaactgtgccacttgtatcaggaccacatgcagtacatcggagaaggcgcgaagacaggcatcaaagaatgccagtatcaattccgacatcgaaggtggaactgcagcactgtggataacacctctgtttttggcagggtgatgcagataggcagccgcgagacggccttcacatacgcggtgagcgcagcaggggtggtgaacgccatgagccgggcgtgccgcgagggcgagctgtccacctgcggctgcagccgcgccgcgcgccccaaggacctgccgcgggactggctctggggcggctgcggcgacaacatcgactatggctaccgctttgccaaggagttcgtggacgcccgcgagcgggagcgcatccacgccaagggctcctacgagagtgctcgcatcctcatgaacctgcacaacaacgaggccggccgcaggacggtgtacaacctggctgatgtggcctgcaagtgccatggggtgtccggctcatgtagcctgaagacatgctggctgcagctggcagacttccgcaaggtgggtgatgccctgaaggagaagtacgacagcgcggcggccatgcggctcaacagccggggcaagttggtacaggtcaacagccgcttcaactcgcccaccacacaagacctggtctacatcgaccccagccctgactactgcgtgcgcaatgagagcaccggctcgctgggcacgcagggccgcctgtgcaacaagacgtcggagggcatggatggctgcgagctcatgtgctgcggccgtggctacgaccagttcaagaccgtgcagacggagcgctgccactgcaagttccactggtgctgctacgtcaagtgcaagaagtgcacggagatcgtggaccagtttgtgtgcaagtagtgggtgccacccagcactcagccccgctcccaggacccgcttatttatagaaagtacagtgattctggtttttggtttttagaaatattttttatttttccccaagaattgcaaccggaaccattttttttcctgttaccatctaagaactctgtggtttattattaatattataattattatttggcaataatgggggtgggaaccaagaaaaatatttattttgtggatctttgaaaaggtaatacaagacttcttttgatagtatagaatgaaggggaaataacacataccctaacttagctgtgtggacatggtacacatccagaaggtaaagaaatacattttctttttctcaaatatgccatcatatgggatgggtaggttccagttgaaagagggtggtagaaatctattcacaattcagcttctatgaccaaaatgagttgtaaattctctggtgcaagataaaaggtcttgggaaaacaaaacaaaacaaaacaaacctcccttccccagcagggctgctagcttgctttctgcattttcaaaatgataatttacaatggaaggacaagaatgtcatattctcaaggaaaaaaggtatatcacatgtctcattctcctcaaatattccatttgcagacagaccgtcatattctaatagctcatgaaatttgggcagcagggaggaaagtccccagaaattaaaaaatttaaaactcttatgtcaagatgttgatttgaagctgttataagaattaggattccagattgtaaaaagatccccaaatgattctggacactagatttttttgtttggggaggttggcttgaacataaatgaaaatatcctgttattttcttagggatacttggttagtaaattataatagtaaaaataatacatgaatcccattcacaggttctcagcccaagcaacaaggtaattgcgtgccattcagcactgcaccagagcagacaacctatttgaggaaaaacagtgaaatccaccttcctcttcacactgagccctctctgattcctccgtgttgtgatgtgatgctggccacgtttccaaacggcagctccactgggtcccctttggttgtaggacaggaaatgaaacattaggagctctgcttggaaaacagttcactacttagggatttttgtttcctaaaacttttattttgaggagcagtagttttctatgttttaatgacagaacttggctaatggaattcacagaggtgttgcagcgtatcactgttatgatcctgtgtttagattatccactcatgcttctcctattgtactgcaggtgtaccttaaaactgttcccagtgtacttgaacagttgcatttataaggggggaaatgtggtttaatggtgcctgatatctcaaagtcttttgtacataacatatatatatatatacatatatataaatataaatataaatatatctcattgcagccagtgatttagatttacagtttactctggggttatttctctgtctagagcattgttgtccttcactgcagtccagttgggattattccaaaagttttttgagtcttgagcttgggctgtggccctgctgtgatcataccttgagcacgacgaagcaaccttgtttctgaggaagcttgagttctgactcactgaaatgcgtgttgggttgaagatatcttttttcttttctgcctcacccctttgtctccaacctccatttctgttcactttgtggagagggcattacttgttcgttatagacatggacgttaagagatattcaaaactcagaagcatcagcaatgtttctcttttcttagttcattctgcagaatggaaacccatgcctattagaaatgacagtacttattaattgagtccctaaggaatattcagcccactacatagatagcttttttttttttttttttaataaggacacctctttccaaacagtgccatcaaatatgttcttatctcagacttacgttgttttaaaagtttggaaagatacacatctttcataccccccttaggcaggttggctttcatatcacctcagccaactgtggctcttaatttattgcataatgatattcacatcccctcagttgcagtgaattgtgagcaaaagatcttgaaagcaaaaagcactaattagtttaaaatgtcacttttttggtttttattatacaaaaaccatgaagtactttttttatttgctaaatcagattgttcctttttagtgactcatgtttatgaagagagttgagtttaacaatcctagcttttaaaagaaactatttaatgtaaaatattctacatgtcattcagatattatgtatatcttctagcctttattctgtacttttaatgtacatatttctgtcttgcgtgatttgtatatttcactggtttaaaaaacaaacatcgaaaggcttatgccaaatggaagatagaatataaaataaaacgttacttgtatattggtaagtggtttcaattgtccttcagataattcatgtggagatttttggagaaaccatgacggatagtttaggatgactacatgtcaaagtaataaaagagtggtgaattttaccaaaaccaagctatttggaagcttcaaaaggtttctatatgtaatggaacaaaaggggaattctcttttcctatatatgttccttacaaaaaaaaaaaaaaaagaaatcaagcagatggcttaaagctggttataggattgctcacattcttttagcattatgcatgtaacttaattgttttagagcgtgttgctgttgtaacatcccagagaagaatgaaaaggcacatgcttttatccgtgaccagatttttagtccaaaaaaatgtatttttttgtgtgtttaccactgcaactattgcacctctctatttgaatttactgtggaccatgtgtggtgtctctatgccctttgaaagcagtttttataaaaagaaagcccgggtctgcagagaatgaaaactggttggaaactaaaggttcattgtgttaagtgcaattaatacaagttattgtgcttttcaaaaatgtacacggaaatctggacagtgctccacagattgatacattagcctttgctttttctctttccggataaccttgtaacatattgaaaccttttaaggatgccaagaatgcattattccacaaaaaaacagcagaccaacatatagagtgtttaaaatagcatttctgggcaaattcaaactcttgtggttctaggactcacatctgtttcagtttttcctcagttgtatattgaccagtgttctttattgcaaaaacatatacccgatttagcagtgtcagcgtattttttcttctcatcctggagcgtattcaagatcttcccaatacaagaaaattaataaaaaatttatatataggcagcagcaaaagagccatgttcaaaatagtcattatgggctcaaatagaaagaagacttttaagttttaatccagtttatctgttgagttctgtgagctactgacctcctgagactggcactgtgtaagttttagttgcctaccctagctcttttctcgtacaattttgccaataccaagtttcaatttgtttttacaaaacattattcaagccactagaattatcaaatatgacgctatagcagagtaaatactctgaataagagaccggtactagctaactccaagagatcgttagcagcatcagtccacaaacacttagtggcccacaatatatagagagatagaaaaggtagttataacttgaagcatgtatttaatgcaaataggcacgaaggcacaggtctaaaatactacattgtcactgtaagctatacttttaaaatatttattttttttaaagtattttctagtcttttctctctctgtggaatggtgaaagagagatgccgtgttttgaaagtaagatgatgaaatgaatttttaattcaagaaacattcagaaacataggaattaaaacttagagaaatgatctaatttccctgttcacacaaactttacactttaatctgatgattggatattttattttagtgaaacatcatcttgttagctaactttaaaaaatggatgtagaatgattaaaggttggtatgatttttttttaatgtatcagtttgaacctagaatattgaattaaaatgctgtctcagtattttaaaagcaaaaaaggaatggaggaaaattgcatcttagaccatttttatatgcagtgtacaatttgctgggctagaaatgagataaagattatttatttttgttcatatcttgtacttttctattaaaatcattttatgaaatcca

SEQ ID NO: 200172 - DNA, 959 bp, Homo sapiens
  Payload ID: 19492
  Gene Name: wingless-type MMTV integration site family, member 5A
  ENST ID: ENST00000482079
  CDS Start-End: 318-959
ccagggctttgactcaacagaattgagacacgtttgtaatcgctggcgtgccccgcgcacaggatcccagcgaaatcagatttcctggtgaggttgcgtgggtggattaatttggaaaaagaaactgcctatatcttgccatcaaaaaactcacggaggagaagcgcagtcaatcaacagtaaacttaagagaccccggatgcttccgttgtttaaacttgtatgcttgaaaattatctgagaggcaataaacatctgctcctttcttccctctccagaagtccattggaatattaagcccaggagttgctttggggatggctggaagtgcaatgtcttccaagttcttcctagtggctttggccatatttttctccttcgcccaggttgtaattgaagccaattcttggtggtcgctaggtatgaataaccctgttcagatgtcagaagtatatattataggagcacagcctctctgcagccaactggcaggactttctcaaggacagaagaaactgtgccacttgtatcaggaccacatgcagtacatcggagaaggcgcgaagacaggcatcaaagaatgccagtatcaattccgacatcgaaggtggaactgcagcactgtggataacacctctgtttttggcagggtgatgcagataggcagccgcgagacggccttcacatacgcggtgagcgcagcaggggtggtgaacgccatgagccgggcgtgccgcgagggcgagctgtccacctgcggctgcagccgcgccgcgcgccccaaggacctgccgcgggactggctctggggcggctgcggcgacaacatcgactatggctaccgctttgccaaggagttcgtggacgcccgcgagcgggagcgcatccacgccaagggctcctacgagagtgctcgcatcctcatgaacctgcacaacaacgaggccggccgcagggtg

SEQ ID NO: 200173 - DNA, 1299 bp, Homo sapiens
  Payload ID: 19492
  Gene Name: wingless-type MMTV integration site family, member 5A
  Uniprot ID: P41221
  ENST ID: ENST00000497027
  CDS Start-End: 103-1200
actcgcctccgtgctcctctcgcccatggaattaattctggctccacttgttgctcggcccagaagtccattggaatattaagcccaggagttgctttggggatggctggaagtgcaatgtcttccaagttcttcctagtggctttggccatatttttctccttcgcccaggttgtaattgaagccaattcttggtggtcgctaggtatgaataaccctgttcagatgtcagaagtatatattataggagcacagcctctctgcagccaactggcaggactttctcaaggacagaagaaactgtgccacttgtatcaggaccacatgcagtacatcggagaaggcgcgaagacaggcatcaaagaatgccagtatcaattccgacatcgaaggtggaactgcagcactgtggataacacctctgtttttggcagggtgatgcagataggcagccgcgagacggccttcacatacgcggtgagcgcagcaggggtggtgaacgccatgagccgggcgtgccgcgagggcgagctgtccacctgcggctgcagccgcgccgcgcgccccaaggacctgccgcgggactggctctggggcggctgcggcgacaacatcgactatggctaccgctttgccaaggagttcgtggacgcccgcgagcgggagcgcatccacgccaagggctcctacgagagtgctcgcatcctcatgaacctgcacaacaacgaggccggccgcaggacggtgtacaacctggctgatgtggcctgcaagtgccatggggtgtccggctcatgtagcctgaagacatgctggctgcagctggcagacttccgcaaggtgggtgatgccctgaaggagaagtacgacagcgcggcggccatgcggctcaacagccggggcaagttggtacaggtcaacagccgcttcaactcgcccaccacacaagacctggtctacatcgaccccagccctgactactgcgtgcgcaatgagagcaccggctcgctgggcacgcagggccgcctgtgcaacaagacgtcggagggcatggatggctgcgagctcatgtgctgcggccgtggctacgaccagttcaagaccgtgcagacggagcgctgccactgcaagttccactggtgctgctacgtcaagtgcaagaagtgcacggagatcgtggaccagtttgtgtgcaagtagtgggtgccacccagcactcagccccgctcccaggacccgcttatttatagaaagtacagtgattctggtttttggtttttagaaatattttttattttt

SEQ ID NO: 200174 - DNA, 829 bp, Homo sapiens
  Payload ID: 19492
  Gene Name: wingless-type MMTV integration site family, member 5A
  ENST ID: ENST00000614415
  CDS Start-End: 440-829
attaattctggctccacttgttgctcggcccaggttggggagaggacggagggtggccgcagcgggttcctgagtgaattacccaggagggactgagcacagcaccaactagaggggggccagggggtgcgggactcgagcgagcaggaaggaggcagcgcctggcaccagggctttgactcaacagaattgagacacgtttgtaatcgctggcgtgccccgcgcacaggatcccagcgaaatcagatttcctggtgaggttgcgtgggtggattaatttggaaaaagaaactgcctatatcttgccatcaaaaaactcacggaggagaagcgcagtcaatcaacagtaaacttaagagaccccggatgcttccgttgtttaaacttgtatgcttgaaaattatctgagaggcaataaacatctgctcctttcttccctctccagaagtccattggaatattaagcccaggagttgctttggggatggctggaagtgcaatgtcttccaagttcttcctagtggctttggccatatttttctccttcgcccaggttgtaattgaagccaattcttggtggtcgctaggtatgaataaccctgttcagatgtcagaagacgtcggagggcatggatggctgcgagctcatgtgctgcggccgtggctacgaccagttcaagaccgtgcagacggagcgctgccactgcaagttccactggtgctgctacgtcaagtgcaagaagtgcacggagatcgtggaccagtttgtgtgcaagtagtgggtgccacccagcactcagccccgctcccaggacccgcttatttatag

SEQ ID NO: 200175 - DNA, 2184 bp, Homo sapiens
  Payload ID: 19493
  Gene Name: wingless-type MMTV integration site family, member 5B
  Uniprot ID: Q9H1J7
  ENST ID: ENST00000310594
  CDS Start-End: 146-1225
tattcttccaaatggaaactgctaatttttgaagcagaaggttgacagcttcagtaagatctcaagagagcgagaagactggaatcagggaaccctactctggaaactgtcagtcccagggcactggggagggctgaggccgaccatgcccagcctgctgctgctgttcacggctgctctgctgtccagctgggctcagcttctgacagacgccaactcctggtggtcattagctttgaacccggtgcagagacccgagatgtttatcatcggtgcccagcccgtgtgcagtcagcttcccgggctctcccctggccagaggaagctgtgccaattgtaccaggagcacatggcctacataggggagggagccaagactggcatcaaggaatgccagcaccagttccggcagcggcggtggaattgcagcacagcggacaacgcatctgtctttgggagagtcatgcagataggcagccgagagaccgccttcacccacgcggtgagcgccgcgggcgtggtcaacgccatcagccgggcctgccgcgagggcgagctctccacctgcggctgcagccggacggcgcggcccaaggacctgccccgggactggctgtggggcggctgtggggacaacgtggagtacggctaccgcttcgccaaggagtttgtggatgcccgggagcgagagaagaactttgccaaaggatcagaggagcagggccgggtgctcatgaacctgcaaaacaacgaggccggtcgcagggctgtgtataagatggcagacgtagcctgcaaatgccacggcgtctcggggtcctgcagcctcaagacctgctggctgcagctggccgagttccgcaaggtcggggaccggctgaaggagaagtacgacagcgcggccgccatgcgcgtcacccgcaagggccggctggagctggtcaacagccgcttcacccagcccaccccggaggacctggtctatgtggaccccagccccgactactgcctgcgcaacgagagcacgggctccctgggcacgcagggccgcctctgcaacaagacctcggagggcatggatggctgtgagctcatgtgctgcgggcgtggctacaaccagttcaagagcgtgcaggtggagcgctgccactgcaagttccactggtgctgcttcgtcaggtgtaagaagtgcacggagatcgtggaccagtacatctgtaaatagcccggagggcctgctcccggcccccctgcactctgcctcacaaaggtctatattatataaatctatataaatctattttatatttgtataagtaaatgggtgggtgctatacaatggaaagatgaaaatggaaaggaagagcttatttaagagacgctggagatctctgaggagtggactttgctggttctctcctcttggtgggtgggagacagggctttttctctccctctggcgaggactctcaggatgtagggacttggaaatatttactgtctgtccaccacggcctggaggagggaggttgtggttggatggaggagatgatcttgtctggaagtctagagtctttgttggttagaggactgcctgtgatcctggccactaggccaagaggccctatgaaggtggcgggaactcagcttcaacctcgatgtcttcagggtcttgtccagaatgtagatgggttccgtaagaggcctggtgctctcttactctttcatccacgtgcacttgtgcggcatctgcagtttacaggaacggctccttccctaaaatgagaagtccaaggtcatctctggcccagtgaccacagagagatctgcacctcccggacttcaggcctgcctttccagcgagaattcttcatcctccacggttcactagctcctacctgaagaggaaagggggccatttgacctgacatgtcaggaaagccctaaactgaatgtttgcgcctgggctgcagaagccagggtgcatgaccaggctgcgtggacgttatactgtcttcccccacccccggggaggggaagcttgagctgctgctgtcactcctccaccgagggaggcctcacaaaccacaggacgctgcaacgggtcaggctggcgggcccggcgtgctcatcatctctgccccaggtgtacggtttctctctgacattaaatgcccttcatgg

SEQ ID NO: 200176 - DNA, 2303 bp, Homo sapiens
  Payload ID: 19493
  Gene Name: wingless-type MMTV integration site family, member 5B
  Uniprot ID: Q9H1J7
  ENST ID: ENST00000397196
  CDS Start-End: 233-1312
ggctctagttaccgtgtcagcctgtcctgggggcagtcacagccacagtgaccattagcaggcacccaggcctgtctttggctcggaaacggtggcccccaatgtagcctagtttgaacctaggaactgcaggaccagagagattccactggagcctgatggacgggtgacagagggaaccctactctggaaactgtcagtcccagggcactggggagggctgaggccgaccatgcccagcctgctgctgctgttcacggctgctctgctgtccagctgggctcagcttctgacagacgccaactcctggtggtcattagctttgaacccggtgcagagacccgagatgtttatcatcggtgcccagcccgtgtgcagtcagcttcccgggctctcccctggccagaggaagctgtgccaattgtaccaggagcacatggcctacataggggagggagccaagactggcatcaaggaatgccagcaccagttccggcagcggcggtggaattgcagcacagcggacaacgcatctgtctttgggagagtcatgcagataggcagccgagagaccgccttcacccacgcggtgagcgccgcgggcgtggtcaacgccatcagccgggcctgccgcgagggcgagctctccacctgcggctgcagccggacggcgcggcccaaggacctgccccgggactggctgtggggcggctgtggggacaacgtggagtacggctaccgcttcgccaaggagtttgtggatgcccgggagcgagagaagaactttgccaaaggatcagaggagcagggccgggtgctcatgaacctgcaaaacaacgaggccggtcgcagggctgtgtataagatggcagacgtagcctgcaaatgccacggcgtctcggggtcctgcagcctcaagacctgctggctgcagctggccgagttccgcaaggtcggggaccggctgaaggagaagtacgacagcgcggccgccatgcgcgtcacccgcaagggccggctggagctggtcaacagccgcttcacccagcccaccccggaggacctggtctatgtggaccccagccccgactactgcctgcgcaacgagagcacgggctccctgggcacgcagggccgcctctgcaacaagacctcggagggcatggatggctgtgagctcatgtgctgcgggcgtggctacaaccagttcaagagcgtgcaggtggagcgctgccactgcaagttccactggtgctgcttcgtcaggtgtaagaagtgcacggagatcgtggaccagtacatctgtaaatagcccggagggcctgctcccggcccccctgcactctgcctcacaaaggtctatattatataaatctatataaatctattttatatttgtataagtaaatgggtgggtgctatacaatggaaagatgaaaatggaaaggaagagcttatttaagagacgctggagatctctgaggagtggactttgctggttctctcctcttggtgggtgggagacagggctttttctctccctctggcgaggactctcaggatgtagggacttggaaatatttactgtctgtccaccacggcctggaggagggaggttgtggttggatggaggagatgatcttgtctggaagtctagagtctttgttggttagaggactgcctgtgatcctggccactaggccaagaggccctatgaaggtggcgggaactcagcttcaacctcgatgtcttcagggtcttgtccagaatgtagatgggttccgtaagaggcctggtgctctcttactctttcatccacgtgcacttgtgcggcatctgcagtttacaggaacggctccttccctaaaatgagaagtccaaggtcatctctggcccagtgaccacagagagatctgcacctcccggacttcaggcctgcctttccagcgagaattcttcatcctccacggttcactagctcctacctgaagaggaaagggggccatttgacctgacatgtcaggaaagccctaaactgaatgtttgcgcctgggctgcagaagccagggtgcatgaccaggctgcgtggacgttatactgtcttcccccacccccggggaggggaagcttgagctgctgctgtcactcctccaccgagggaggcctcacaaaccacaggacgctgcaacgggtcaggctggcgggcccggcgtgctcatcatctctgccccaggtgtacggtttctctctgacattaaatgcccttcatggaggttttgctccctttccttatttggacccac

SEQ ID NO: 200177 - DNA, 530 bp, Homo sapiens
  Payload ID: 19493
  Gene Name: wingless-type MMTV integration site family, member 5B
  ENST ID: ENST00000539198
  CDS Start-End: 177-530
ataactctcttcccctctcagagcctcgggccccgcagacgccgaggtgggcgctcgtgccaggatcgcggggcgcgggtacgggctccttgggcgccccgagggggctgctggccgggggaaccctactctggaaactgtcagtcccagggcactggggagggctgaggccgaccatgcccagcctgctgctgctgttcacggctgctctgctgtccagctgggctcagcttctgacagacgccaactcctggtggtcattagctttgaacccggtgcagagacccgagatgtttatcatcggtgcccagcccgtgtgcagtcagcttcccgggctctcccctggccagaggaagctgtgccaattgtaccaggagcacatggcctacataggggagggagccaagactggcatcaaggaatgccagcaccagttccggcagcggcggtggaattgcagcacagcggacaacgcatctgtctttgggagagtcatgcagataggcagccgagagaccgccttcacccac

SEQ ID NO: 200178 - DNA, 1437 bp, Homo sapiens
  Payload ID: 19493
  Gene Name: wingless-type MMTV integration site family, member 5B
  Uniprot ID: Q9H1J7
  ENST ID: ENST00000537031
  CDS Start-End: 243-1322
aaatgctccagatcctcagtgttcaagaacctcaggaagcttcgcagtcctgcctcgtgcctgcttgaacagctggatgtgggcaggaggctgtgggagcgggccatgccagcagaatcccgccttactctggggacttactcttgtcacagcccctggtgtcctgagggtcatttcagtgtcatggaaccctactctggaaactgtcagtcccagggcactggggagggctgaggccgaccatgcccagcctgctgctgctgttcacggctgctctgctgtccagctgggctcagcttctgacagacgccaactcctggtggtcattagctttgaacccggtgcagagacccgagatgtttatcatcggtgcccagcccgtgtgcagtcagcttcccgggctctcccctggccagaggaagctgtgccaattgtaccaggagcacatggcctacataggggagggagccaagactggcatcaaggaatgccagcaccagttccggcagcggcggtggaattgcagcacagcggacaacgcatctgtctttgggagagtcatgcagataggcagccgagagaccgccttcacccacgcggtgagcgccgcgggcgtggtcaacgccatcagccgggcctgccgcgagggcgagctctccacctgcggctgcagccggacggcgcggcccaaggacctgccccgggactggctgtggggcggctgtggggacaacgtggagtacggctaccgcttcgccaaggagtttgtggatgcccgggagcgagagaagaactttgccaaaggatcagaggagcagggccgggtgctcatgaacctgcaaaacaacgaggccggtcgcagggctgtgtataagatggcagacgtagcctgcaaatgccacggcgtctcggggtcctgcagcctcaagacctgctggctgcagctggccgagttccgcaaggtcggggaccggctgaaggagaagtacgacagcgcggccgccatgcgcgtcacccgcaagggccggctggagctggtcaacagccgcttcacccagcccaccccggaggacctggtctatgtggaccccagccccgactactgcctgcgcaacgagagcacgggctccctgggcacgcagggccgcctctgcaacaagacctcggagggcatggatggctgtgagctcatgtgctgcgggcgtggctacaaccagttcaagagcgtgcaggtggagcgctgccactgcaagttccactggtgctgcttcgtcaggtgtaagaagtgcacggagatcgtggaccagtacatctgtaaatagcccggagggcctgctcccggcccccctgcactctgcctcacaaaggtctatattatataaatctatataaatctattttatatttgtataagtaaatgggtgggtgctatacaat

SEQ ID NO: 200179 - DNA, 508 bp, Homo sapiens
  Payload ID: 19493
  Gene Name: wingless-type MMTV integration site family, member 5B
  ENST ID: ENST00000542408
  CDS Start-End: 41-379
actgtcagtcccagggcactggggagggctgaggccgaccatgcccagcctgctgctgctgttcacggctgctctgctgtccagctgggctcagcttctgacagacgccaactcctggtggtcattagctttgaacccggtgcagagacccgagatgtttatcatcggtgcccagcccgtgtgcagtcagcttcccgggctctcccctggccagaggaagctgtgccaattgtaccaggagcacatggcctacataggggagggagccaagactggcatcaaggaatgccagcaccagttccggcagcggcggtggaattgcagcacagcggacaacgcatctgtctttgggagagtcatgcagataggctgtgtataagatggcagacgtagcctgcaaatgccacggcgtctcggggtcctgcagcctcaagacctgctggctgcagctggccgagttccgcaaggtcggggaccggctgaaggagaagtacgacagcgcggccgc

SEQ ID NO: 200180 - DNA, 1304 bp, Homo sapiens
  Payload ID: 19493
  Gene Name: wingless-type MMTV integration site family, member 5B
  ENST ID: ENST00000543071
  CDS Start-End: 544-1304
caattcaccaaaatgttttaatcctacaaaggagagcctgagggtcagagaaataagtctctgggctggaatgagaggtaggcacgtgggggagtggataggatgggccccatttctttggatgttctgcagcaaggacaggtatgctttacaacagccgaagtggcctcccggctgccgaacggaggaacgccgcaagctccgctcttgaaattacttgttttcatttctctttgtggtttctcagctcattatttctttggaaattaggtcctgtgcagggttcccacagtttggggtaagagacagaagtcctagggtgggaagatgagcagtgggaggcggaggctggaaagaggccgagcttctttgtggggaacacgcagcacgtaagcatcagtgcaactttctccgcctcaccccggctcctggtctgcccttatccgctgagtttccacactgactctccatttctgttttctccagggaaccctactctggaaactgtcagtcccagggcactggggagggctgaggccgaccatgcccagcctgctgctgctgttcacggctgctctgctgtccagctgggctcagcttctgacagacgccaactcctggtggtcattagctttgaacccggtgcagagacccgagatgtttatcatcggtgcccagcccgtgtgcagtcagcttcccgggctctcccctggccagaggaagctgtgccaattgtaccaggagcacatggcctacataggggagggagccaagactggcatcaaggaatgccagcaccagttccggcagcggcggtggaattgcagcacagcggacaacgcatctgtctttgggagagtcatgcagataggcagccgagagaccgccttcacccacgcggtgagcgccgcgggcgtggtcaacgccatcagccgggcctgccgcgagggcgagctctccacctgcggctgcagccggacggcgcggcccaaggacctgccccgggactggctgtggggcggctgtggggacaacgtggagtacggctaccgcttcgccaaggagtttgtggatgcccgggagcgagagaagaactttgccaaaggatcagaggagcagggccgggtgctcatgaacctgcaaaacaacgaggccggtcgcagggctgtgtataagatggcagacgtagcctgcaaatgccacggcgtctcggggtcctgcagcctcaagacctgctggctgcagctggccgagttccgcaaggtcggggaccggctgaaggagaagtacgacagcgcggccgc

SEQ ID NO: 200181 - DNA, 661 bp, Homo sapiens
  Payload ID: 19493
  Gene Name: wingless-type MMTV integration site family, member 5B
  ENST ID: ENST00000545811
  CDS Start-End: 190-661
ccgccggccgccccctgcgcccccgcgggccgcgcctcgcccgccgacccagcgcagccgggcgcaggaagagccgggccgggccgagcggcgcccggagcccgcgggcctgacacgcggcgggacatgcagggaaccctactctggaaactgtcagtcccagggcactggggagggctgaggccgaccatgcccagcctgctgctgctgttcacggctgctctgctgtccagctgggctcagcttctgacagacgccaactcctggtggtcattagctttgaacccggtgcagagacccgagatgtttatcatcggtgcccagcccgtgtgcagtcagcttcccgggctctcccctggccagaggaagctgtgccaattgtaccaggagcacatggcctacataggggagggagccaagactggcatcaaggaatgccagcaccagttccggcagcggcggtggaattgcagcacagcggacaacgcatctgtctttgggagagtcatgcagataggcagccgagagaccgccttcacccacgcggtgagcgccgcgggcgtggtcaacgccatcagccgggcctgccgcgagggcgagctctccacctgcggctgcagccggacggcgcggcccaaggacctgccccgggactggctgt

SEQ ID NO: 200182 - DNA, 1703 bp, Homo sapiens
  Payload ID: 19494
  Gene Name: wingless-type MMTV integration site family, member 6
  Uniprot ID: Q9Y6F9
  ENST ID: ENST00000233948
  CDS Start-End: 218-1315
tccgcaggagacacaggcgctggctgccccgtccgctctccgcctccgccgcgccctcctcgcccgggatgggcccccccgccgccgccggatccctcgcctcccggccgccgccgttgcgctcgccgcgctcgcactgaagcccgggccctcgcgcgccgcggttcgccccgcagcctcgccccctgcccacccgggcggccgtagggcggtcacgatgctgccgcccttaccctcccgcctcgggctgctgctgctgctgctcctgtgcccggcgcacgtcggcggactgtggtgggctgtgggcagccccttggttatggaccctaccagcatctgcaggaaggcacggcggctggccgggcggcaggccgagttgtgccaggctgagccggaagtggtggcagagctagctcggggcgcccggctcggggtgcgagagtgccagttccagttccgcttccgccgctggaattgctccagccacagcaaggcctttggacgcatcctgcaacaggacattcgggagacggccttcgtgttcgccatcactgcggccggcgccagccacgccgtcacgcaggcctgttctatgggcgagctgctgcagtgcggctgccaggcgccccgcgggcgggcccctccccggccctccggcctgcccggcacccccggaccccctggccccgcgggctccccggaaggcagcgccgcctgggagtggggaggctgcggcgacgacgtggacttcggggacgagaagtcgaggctctttatggacgcgcggcacaagcggggacgcggagacatccgcgcgttggtgcaactgcacaacaacgaggcgggcaggctggccgtgcggagccacacgcgcaccgagtgcaaatgccacgggctgtcgggatcatgcgcgctgcgcacctgctggcagaagctgcctccatttcgcgaggtgggcgcgcggctgctggagcgcttccacggcgcctcacgcgtcatgggcaccaacgacggcaaggccctgctgcccgccgtccgcacgctcaagccgccgggccgagcggacctcctctacgccgccgattcgcccgacttctgcgcccccaaccgacgcaccggctcccccggcacgcgcggtcgcgcctgcaatagcagcgccccggacctcagcggctgcgacctgctgtgctgcggccgcgggcaccgccaggagagcgtgcagctcgaagagaactgcctgtgccgcttccactggtgctgcgtagtacagtgccaccgctgccgtgtgcgcaaggagctcagcctctgcctgtgacccgccgcccggccgctagactgacttcgcgcagcggtggctcgcacctgtgggacctcagggcaccggcaccgggcgcctctcgccgctcgagcccagcctctccctgccaaagcccaactcccagggctctggaaatggtgaggcgaggggcttgagaggaacgcccacccacgaaggcccagggcgccagacggccccgaaaaggcgctcggggagcgtttaaaggacactgtacaggccctccctccccttggcctctaggaggaaacagttttttagactggaaaaaagccagtctaaaggcctctggatactgggctccccagaactgctggccacaggatggtgggtgaggttagtatcaataaagatatttaaaccacca

SEQ ID NO: 200183 - DNA, 4041 bp, Homo sapiens
  Payload ID: 19495
  Gene Name: wingless-type MMTV integration site family, member 7A
  Uniprot ID: O00755
  ENST ID: ENST00000285018
  CDS Start-End: 306-1355
gaggggcgggggctggaggcagcagcgcccccgcactccccgcgtctcgcacacttgcaccggtcgctcgcgcgcagcccggcgtcgccccacgccgcgctcgctcctccctccctcctcccgctccgtggctcccgtgctcctggcgaggctcaggcgcggagcgcgcggacgggcgcaccgacagacggccccggggacgcctcggctcgcgcctcccgggcgggctatgttgattgccccgccggggccggcccgcgggatcagcacagcccggcccgcggccccggcggccaatcgggactatgaaccggaaagcgcggcgctgcctgggccacctctttctcagcctgggcatggtctacctccggatcggtggcttctcctcagtggtagctctgggcgcaagcatcatctgtaacaagatcccaggcctggctcccagacagcgggcgatctgccagagccggcccgacgccatcatcgtcataggagaaggctcacaaatgggcctggacgagtgtcagtttcagttccgcaatggccgctggaactgctctgcactgggagagcgcaccgtcttcgggaaggagctcaaagtggggagccgggaggctgcgttcacctacgccatcattgccgccggcgtggcccacgccatcacagctgcctgtacccagggcaacctgagcgactgtggctgcgacaaagagaagcaaggccagtaccaccgggacgagggctggaagtggggtggctgctctgccgacatccgctacggcatcggcttcgccaaggtctttgtggatgcccgggagatcaagcagaatgcccggactctcatgaacttgcacaacaacgaggcaggccgaaagatcctggaggagaacatgaagctggaatgtaagtgccacggcgtgtcaggctcgtgcaccaccaagacgtgctggaccacactgccacagtttcgggagctgggctacgtgctcaaggacaagtacaacgaggccgttcacgtggagcctgtgcgtgccagccgcaacaagcggcccaccttcctgaagatcaagaagccactgtcgtaccgcaagcccatggacacggacctggtgtacatcgagaagtcgcccaactactgcgaggaggacccggtgaccggcagtgtgggcacccagggccgcgcctgcaacaagacggctccccaggccagcggctgtgacctcatgtgctgtgggcgtggctacaacacccaccagtacgcccgcgtgtggcagtgcaactgtaagttccactggtgctgctatgtcaagtgcaacacgtgcagcgagcgcacggagatgtacacgtgcaagtgagccccgtgtgcacaccaccctcccgctgcaagtcagattgctgggaggactggaccgtttccaagctgcgggctccctggcaggatgctgagcttgtcttttctgctgaggagggtacttttcctgggtttcctgcaggcatccgtgggggaaaaaaaatctctcagagccctcaactattctgttccacacccaatgctgctccaccctcccccagacacagcccaggtccctccgcggctggagcgaagccttctgcagcaggaactctggacccctgggcctcatcacagcaatatttaacaatttattctgataaaaataatattaatttatttaattaaaaagaattcttccacctcgtcgggatccgttttctgcaatcaaagtggactgcttgctttcctagcaggatgattttgttgctaggacaaggagccgtgtagaagtgtacataactattctttatgcagatatttctactagctgattttgcaggtacccaccttgcagcactagatgtttaagtacaagaggagacatcttttatgcatatatagatatacacacacacatttttttttttttttttgctgtttgctgctacttatccagaaatttaagctggtccagatttggagacgttttttccagagtatgttttccatccttttgccctccccagttcaaacttcaccattagaaaaatccagtttggaataaatagagaggaaaaataataaattcccagcagtttccatctttcggaaagtgagccaccggataagagagaatattttgtaagagactatttttatatgaatattttatttatatcgagtctactgtatcattccacggcctgtgcttcttcttaattctggtactcacttaggggtaaggaggggcgatgcctggttgtggcgtcaggccccatggggccccttgcacagctggattcttgagttctgtttgccaagtgggcacaagctgcccctggatgcctggggttgaggcatcatctcatccatgttagccgggaaagaaatcaaatccccagcctcagcctgttaagctcaggcctttcaagcagggccactgagtggtagcttcgaaatgagtcactgtggtgggtggtcatcgtgcccctcacagggacttgaccgtcatcctgcagcagaggccagttcagggagccccacacctcaccaagacactagccattgcctgcgtgtcctggaaggtgagatgtagtcctcaggtgaggtgacccaaagcagatggggtgaggggccgatgagcagccgggcccagcggggcttcctggatatcctgctcccaaggccaagcagcagagagaggttcaagtgaggccactttgctttgggtccagctacacccagagcctcagcctagaaagctgtcctccagcaggctgggggtgttctaatatgtgtccgtttgcatttccggtgtgtgtgtgtgtgtgtgtgtgtgtgtgtgtgtgtgtgtgtgtgtgtactgtatcttcttagggacttgagtgtagtcacgtgactttgcgccttgcagcgcctccgccgtactcgtgtgtgtatgtgtctgtgtgtttccgtgctacccaagcgtctgtttctctccgtgtgcctgggagatcaggtctcaggcatggagctgcatgcctttgcatctgctgctccccagagtctctgcttgcatgtgagggctggtggtatgaggcagacagcagagattgtgtgtgattgtgttgaaccgccaagagaaggcacctctgaactctgtccccacacccatgggtgaaaaccagacacctctgagaccacagcacagccccatggccccacctgctgggagcccttcagtatctaggctgtgtctgactcctcagtgtccacactgagcctggatcacagcatgggcaaataaaagtgactggatggttgcatggtttcttcccttggacatttttttccatttttcttttacttgggtgtctggaggagtgggcatgtgaaggggccatggagtgaatggatggagggatggatgaatgtgtgagtaggtaggtaggtgaatgggtagatgtgtggatggataagtaggtgggtgggtgaatggataaatggatggatgggtagatggatggatgaagggataaacagatgggtggatggattgataagtgagcggatgaatggatgaatagctaggaaagtgggtgggtggatgagggtgggttgatgaggtaggtacacctacagataggtaagtgagcagtttcttgggagtccacaggtcacattttatctttgctttggaaaacctagcagatctgccatgatcaggatggcttcccgaccttgcaacccttctgcttctgacctccttggcacctgggaatgggggagattctgaccagcctccccagatgagtgttcaatgatagttacataaacacagtctcagaagagtcatccctgtgtcctccctcactgtgggttcccagctctggggcctgccctctctcgggtgccctgttcagctgtgctctgagccccagtttctccacctgtgaaatcagaataacacctacctcacagggctgttgtgaggatcctcccagtaatgactgtatggcactttgagttgcaaagcaatggatgaa

SEQ ID NO: 200184 - DNA, 3919 bp, Homo sapiens
  Payload ID: 19496
  Gene Name: wingless-type MMTV integration site family, member 7B
  Uniprot ID: P56706
  ENST ID: ENST00000339464
  CDS Start-End: 376-1425
attggccgccgcggcgctcggcgaggcgctcacggcctcaggcggctgcgcctagtgcaggctgcacccgcccgccagccgcgcccgggcccccggcccgcgcttgcaggggtccacggtcgctcaaccgggcttcgaggtcgcggcccccagcctgggtcaattccccgggctcacgcggcggtggcggcggcggcatcccgggctcaccatggtggcagcgcgcgccgagtgcccgcgcgtcgccggccgcccgagccgcagcgcgggctgagcgcagtctgcccgcagccccctggcccctgcccggccctgccgggcccgcgcgtcccctccggccgccgctgtctatggcgcagcccccctccctggatcatgcacagaaactttcgcaagtggattttctacgtgtttctctgctttggcgtcctgtacgtgaagctcggagcactgtcatccgtggtggccctgggagccaacatcatctgcaacaagattcctggcctagccccgcggcagcgtgccatctgccagagtcggcccgatgccatcattgtgattggggagggggcgcagatgggcatcaacgagtgccagtaccagttccgcttcggacgctggaactgctctgccctcggcgagaagaccgtcttcgggcaagagctccgagtagggagccgtgaggctgccttcacgtacgccatcaccgcggctggcgtggcgcacgccgtcaccgctgcctgcagccaagggaacctgagcaactgcggctgcgaccgcgagaagcagggctactacaaccaagccgagggctggaagtggggcggctgctcggccgacgtgcgttacggcatcgacttctcccggcgcttcgtggacgctcgggagatcaagaagaacgcgcggcgcctcatgaacctgcataacaatgaggccggcaggaaggttctagaggaccggatgcagctggagtgcaagtgccacggcgtgtctggctcctgcaccaccaaaacctgctggaccacgctgcccaagttccgagaggtgggccacctgctgaaggagaagtacaacgcggccgtgcaggtggaggtggtgcgggccagccgtctgcggcagcccaccttcctgcgcatcaaacagctgcgcagctatcagaagcccatggagacagacctggtgtacattgagaagtcgcccaactactgcgaggaggacgcggccacgggcagcgtgggcacgcagggccgtctctgcaaccgcacgtcgcccggcgcggacggctgtgacaccatgtgctgcggccgaggctacaacacccaccagtacaccaaggtgtggcagtgcaactgcaaattccactggtgctgcttcgtcaagtgcaacacctgcagcgagcgcaccgaggtcttcacctgcaagtgaggccaggcccggaggcggccgcgggcaccctggaacccggcggcattttgcacatccactcctcaccttccctgccttggtgctgccagcagcagacatagacgggtgcagaagcggggagctccaggtgcaggagggcaccggccggggcccacgccctctgcccgcctccctggggctccttcctgccacctcctcccatcacctcctgcggcagaacagcacccgtgacccacccagagagcaaggccaggggtcttggtgctccccgacggggcccggcaagttctctttcttctctctgggaaaatgaacgtccaggacacacctgtatcccagagagcaaagtgatgaggagactgagcgtccccagccccacctggcggcatggacacagaaaagctacgccggctggcctctccagaccagttcccaggctgggtctgccgctgggccctggggcggtggggacagatgttgacacaaattatttatgttttcttagtatcagaagaggattctcggcactaacacatagccagtcctaactccgtactctgtgtcagcccatcccctagacaccctctgtttcctttcccggccccacctggccggccctctgcccctgcagagctgaggcagcctggggttgatggggaccacgcggtgcctgcaggtcctagaagtgagctgggcaggggctcttcagaccacacagccctgaccgggccttggaggagagccatggacaggctcctccatgccgtctttccttcttttgaaaatcctatcaatggctgggcgcggtggctcacacctgtaatcccagcactttgggagaccgaggcaggtggatcacctgaggtcaggagttcgagaccagcctggccaacgtggtgaaaccctgtctctactaaaaatacaaaaattagctgggcgtggtggcgtgcacctgtaatcccagctactcaggaggctgagacaggacacttgcttgaacccgggaggtggaggttgcaatgagccaagattgtgccactgtattccaacttgggtgacagagcacgactctgtctcaaaaaaagaaaagaaaataatatcaagcaaatcaaaatatcacccacgtcaggttccaggagtccttcgttccctccctcatcctgtcaccctcccggcctggcacctccagtttacagagacccccttccccctggagccagcctgacccctgggacagtgctgccgcgggggtcaggcaggtggtgagtggtcagggatgtttgtcccacttgacagatgggaactctgaggcccagagtggcacaaggacctaccagagaccctgcagctgtgactggaggcttccacctttctcctgcccagcctggggctctggacctgggagaacacatcaggatgcccggggtggcagtaggtagctcccatgccttgaggcacttggctgctccctccaccccctgacagcctcattggggcctgcactcccctcggtgcctttgaggcttcgcctagccctgtcctggtccttttaccctgaccccagtgctgagaaaatctggatccagagctggacatgtcctttctggatgctcccacccctgtctctgaggagcatgagtgacagagggaggaacttgtccgaggccagagaggatggtctgcagctggctcctggtgcacccccactgcccacggcctggcccccatttagggtgtgttctcttggaagcccgtaggaatgtgttcttgagcagccgacaagccaagggcctgggctcagcctggggcaagtgggtccctcctgggctctggccctgtggtccagcccatgtgcctctaaccatgcctggacgctctgagtctccgggccaccgtgaatgccccaccctcagcctggccccatccccttaccttccccaagtcccagaacacacctgagtccataggcccggcagcctctgcaaggaacctggttaacttatgttgttatatagcgtcgaaatgtctatagtgtctttaaattattgtgacctacactgggtaccggagagggggatggctgcggcccccatccctcatcccccatcccatcccatccctcatctcatccctcatcccatcccccatcccatccctgaccccatcccccatcccatccctcatccctattccccatacccaccccccatcccatcccccatctcccgaaccaggctcctcctgcttcaacagacccttggggcccctgatgccaccgagacactcgcactgtcccttggctgccgggcaccccactgagcccctgcccaccccaaagtctgccagcaacaggccctttgcctgggtgagacgggggtcagggtggcccagatgggggtgatggcgaccaaggtgctgcgtccccacccttctgacggcagcctcccctggaggggagtgctcggcccaataaaagctggaatcggaaaagtga

SEQ ID NO: 200185 - DNA, 2285 bp, Homo sapiens
  Payload ID: 19496
  Gene Name: wingless-type MMTV integration site family, member 7B
  ENST ID: ENST00000409496
  CDS Start-End: 479-1540
gggtgtcccagccaaggcaacttgggcaagccctggaggcggctcccaccgcacgctccggtcagcctcccctttaaaaaaacccgccgggggaggaggcggatgtaggggcggcccgtccaatggcagctgcgcgcctcgggagacttggagaagtgagccagagcgagcgacagagccggttcgcaccgacagacggacggaggtccagaccgcagccaaggcgcgcccgctgcccccggccgggtccccgccccgcactccagccccagctcccgccgctgccccagacccagcgccatgcgcggccctagcggcggggcacgggcgacaactgcgcccgggcccacgagacccggcccctagcgcccagcgccgccgccctgcatcggggagctccgcggggaccccggcctcagctggcccaggcgcccggcccgcggagcctgttcagccccgccaggcacgccggcccaccatgcttctactgtcgccgcgcagcgcgctcgtctccgtctattgcccgcagatctttctcctcctgtccagcggcagctacttagcactgtcatccgtggtggccctgggagccaacatcatctgcaacaagattcctggcctagccccgcggcagcgtgccatctgccagagtcggcccgatgccatcattgtgattggggagggggcgcagatgggcatcaacgagtgccagtaccagttccgcttcggacgctggaactgctctgccctcggcgagaagaccgtcttcgggcaagagctccgagtagggagccgtgaggctgccttcacgtacgccatcaccgcggctggcgtggcgcacgccgtcaccgctgcctgcagccaagggaacctgagcaactgcggctgcgaccgcgagaagcagggctactacaaccaagccgagggctggaagtggggcggctgctcggccgacgtgcgttacggcatcgacttctcccggcgcttcgtggacgctcgggagatcaagaagaacgcgcggcgcctcatgaacctgcataacaatgaggccggcaggaaggttctagaggaccggatgcagctggagtgcaagtgccacggcgtgtctggctcctgcaccaccaaaacctgctggaccacgctgcccaagttccgagaggtgggccacctgctgaaggagaagtacaacgcggccgtgcaggtggaggtggtgcgggccagccgtctgcggcagcccaccttcctgcgcatcaaacagctgcgcagctatcagaagcccatggagacagacctggtgtacattgagaagtcgcccaactactgcgaggaggacgcggccacgggcagcgtgggcacgcagggccgtctctgcaaccgcacgtcgcccggcgcggacggctgtgacaccatgtgctgcggccgaggctacaacacccaccagtacaccaaggtgtggcagtgcaactgcaaattccactggtgctgcttcgtcaagtgcaacacctgcagcgagcgcaccgaggtcttcacctgcaagtgaggccaggcccggaggcggccgcgggcaccctggaacccggcggcattttgcacatccactcctcaccttccctgccttggtgctgccagcagcagacatagacgggtgcagaagcggggagctccaggtgcaggagggcaccggccggggcccacgccctctgcccgcctccctggggctccttcctgccacctcctcccatcacctcctgcggcagaacagcacccgtgacccacccagagagcaaggccaggggtcttggtgctccccgacggggcccggcaagttctctttcttctctctgggaaaatgaacgtccaggacacacctgtatcccagagagcaaagtgatgaggagactgagcgtccccagccccacctggcggcatggacacagaaaagctacgccggctggcctctccagaccagttcccaggctgggtctgccgctgggccctggggcggtggggacagatgttgacacaaattatttatgttttcttagtatcagaagaggattctcggcactaacacatagccagtcctaactccgtactctgtgtcagcccatcccctagacaccctctgtttcctttcccggccccacctggccggccctctgcccctgcagagctgaggcagcctggggttgatggggaccacgcggtgcctgcaggtcctagaagtgagctgggcaggggctcttcagaccacacagccctgaccgggccttggaggagagcca

SEQ ID NO: 200186 - DNA, 2202 bp, Homo sapiens
  Payload ID: 19496
  Gene Name: wingless-type MMTV integration site family, member 7B
  ENST ID: ENST00000410089
  CDS Start-End: 456-1457
ctggcgcggcccggcgggcgggcgcccggcgagccgcgctagctgctctctgcggtagctgctccgagtcgtatttccacattcctgaacccagccgagtccttacctgttgagccgcgatctcctttagacagaatctgtctcggcttcgctcgaagtgggggtggagaaacggcgtgacggagagggggtgcggtgcacctcgcctggggcgcccaccgcccgctgctggccccgcgctcctcgcacctgcggggacccgggccccgccgcgccctgcgcgcctactgtgcgccgccggctgccccgaggcgagccccgtccaggccacaggcaaggcggtgaacagacccgcgggaggggcaggtgcaggtaccactggtgggagacgcggcttcccaggcggagaggtggaagcaggcgctgggaatcgtctctccatcaccctccatcccatgtctgccccgccattttacagagcactgtcatccgtggtggccctgggagccaacatcatctgcaacaagattcctggcctagccccgcggcagcgtgccatctgccagagtcggcccgatgccatcattgtgattggggagggggcgcagatgggcatcaacgagtgccagtaccagttccgcttcggacgctggaactgctctgccctcggcgagaagaccgtcttcgggcaagagctccgagtagggagccgtgaggctgccttcacgtacgccatcaccgcggctggcgtggcgcacgccgtcaccgctgcctgcagccaagggaacctgagcaactgcggctgcgaccgcgagaagcagggctactacaaccaagccgagggctggaagtggggcggctgctcggccgacgtgcgttacggcatcgacttctcccggcgcttcgtggacgctcgggagatcaagaagaacgcgcggcgcctcatgaacctgcataacaatgaggccggcaggaaggttctagaggaccggatgcagctggagtgcaagtgccacggcgtgtctggctcctgcaccaccaaaacctgctggaccacgctgcccaagttccgagaggtgggccacctgctgaaggagaagtacaacgcggccgtgcaggtggaggtggtgcgggccagccgtctgcggcagcccaccttcctgcgcatcaaacagctgcgcagctatcagaagcccatggagacagacctggtgtacattgagaagtcgcccaactactgcgaggaggacgcggccacgggcagcgtgggcacgcagggccgtctctgcaaccgcacgtcgcccggcgcggacggctgtgacaccatgtgctgcggccgaggctacaacacccaccagtacaccaaggtgtggcagtgcaactgcaaattccactggtgctgcttcgtcaagtgcaacacctgcagcgagcgcaccgaggtcttcacctgcaagtgaggccaggcccggaggcggccgcgggcaccctggaacccggcggcattttgcacatccactcctcaccttccctgccttggtgctgccagcagcagacatagacgggtgcagaagcggggagctccaggtgcaggagggcaccggccggggcccacgccctctgcccgcctccctggggctccttcctgccacctcctcccatcacctcctgcggcagaacagcacccgtgacccacccagagagcaaggccaggggtcttggtgctccccgacggggcccggcaagttctctttcttctctctgggaaaatgaacgtccaggacacacctgtatcccagagagcaaagtgatgaggagactgagcgtccccagccccacctggcggcatggacacagaaaagctacgccggctggcctctccagaccagttcccaggctgggtctgccgctgggccctggggcggtggggacagatgttgacacaaattatttatgttttcttagtatcagaagaggattctcggcactaacacatagccagtcctaactccgtactctgtgtcagcccatcccctagacaccctctgtttcctttcccggccccacctggccggccctctgcccctgcagagctgaggcagcctggggttgatggggaccacgcggtgcctgcaggtcctagaagtgagctgggcaggggctcttcagaccacacagccctgaccgggccttggaggagagcca

SEQ ID NO: 200187 - DNA, 714 bp, Homo sapiens
  Payload ID: 19496
  Gene Name: wingless-type MMTV integration site family, member 7B
  ENST ID: ENST00000410058
  CDS Start-End: 52-669
cgcgtcccctccggccgccgctgtctatggcgcagcccccctccctggatcatgcacagaaactttcgcaagtggattttctacgtgtttctctgctttggcgtcctgtacgtgaagctcggagcactgtcatccgtggtggccctgggagccaacatcatctgcaacaagattcctggcctagccccgcggcagcgtgccatctgccagagtcggcccgatgccatcattgtgattggggagggggcgcagatgggcatcaacgagtgccagtaccagttccgcttcggacgctggaactgctctgccctcggcgagaagaccgtcttcgggcaagagctccgagtagggagccgtgaggctgccttcacgtacgccatcaccgcggctggcgtggcgcacgccgtcaccgctgcctgcagccaagggaacctgagcaactgcggctgcgaccgcgagaagcagggctactacaaccaagccgagggctggaagtggggcggctgctcggccgacgtgcgttacggcatcgacttctcccggcgcttcgtggacgctcgggagatcaagaagaacgcgcggcgcctcatgaacctgcataacaatgaggccggcaggaagggcctacttggacaacccagggtgacctcctctccgttgtttccttgaccacatctgtaaaggccctacttccaaataaagtcacttgccgag

SEQ ID NO: 200188 - DNA, 521 bp, Homo sapiens
  Payload ID: 19496
  Gene Name: wingless-type MMTV integration site family, member 7B
  ENST ID: ENST00000428540
  CDS Start-End: 351-521
gccgcgatctcctttagacagaatctgtctcggcttcgctcgaagtgggggtggagaaacggcgtgacggagagggggtgcggtgcacctcgcctggggcgcccaccgcccgctgctggccccgcgctcctcgcacctgcggggacccgggccccgccgcgccctgcgcgcctactgtgcgccgccggctgccccgaggcgagccccgtccaggccacagagcactgtcatccgtggtggccctgggagccaacatcatctgcaacaagattcctggcctagccccgcggcagcgtgccatctgccagagtcggcccgatgccatcattgtgattggggagggggcgcagatgggcatcaacgagtgccagtaccagttccgcttcggacgctggaactgctctgccctcggcgagaagaccgtcttcgggcaagagctccgagtagggagccgtgaggctgccttcacgtacgccatcaccgcggctggcgtggcgcacgccgtcaccgctgcctgcagc

SEQ ID NO: 200189 - DNA, 1597 bp, Homo sapiens
  Payload ID: 19497
  Gene Name: wingless-type MMTV integration site family, member 8A
  Uniprot ID: Q9H1J5
  ENST ID: ENST00000361560
  CDS Start-End: 101-1168
cagaattttctcacataaatactgaggaagaccctgccctctcctcacttctctggacttggccctgagctggacctggtccactggggtaggcagggcgatggggaacctgtttatgctctgggcagctctgggcatatgctgtgctgcattcagtgcctctgcctggtcagtgaacaatttcctgataacaggtcccaaggcctatctgacctacacgactagtgtggccttgggtgcccagagtggcatcgaggagtgcaagttccagtttgcttgggaacgctggaactgccctgaaaatgctcttcagctctccacccacaacaggctgagaagtgctaccagagagacttccttcatacatgctatcagctctgctggagtcatgtacatcatcaccaagaactgtagcatgggtgacttcgaaaactgtggctgtgatgggtcaaacaatggaaaaacaggaggccatggctggatctggggaggctgcagcgacaatgtggaatttggggaaaggatctccaaactctttgtggacagtttggagaaggggaaggatgccagagccctgatgaatcttcacaacaacagggccggcagactggcagtgagagccaccatgaaaaggacatgcaaatgtcatggcatctctgggagctgcagcatacagacatgctggctgcagctggctgaattccgggagatgggagactacctaaaggccaagtatgaccaggcgctgaaaattgaaatggataagcggcagctgagagctgggaacagcgccgagggccactgggtgcccgctgaggccttccttcctagcgcagaggcggaactgatctttttagaggaatcaccagattactgtacctgcaattccagcctgggcatctatggcacagagggtcgtgagtgcctacagaacagccacaacacatccaggtgggagcgacgtagctgtgggcgcctgtgcactgagtgtgggctgcaggtggaagagaggaaaactgaggtcataagcagctgtaactgcaaattccagtggtgctgtacggtcaagtgtgaccagtgtaggcatgtggtgagcaagtattactgcgcacgctccccaggcagtgcccagtccctggggagagtttggtttggggtctatatctagagggaccttcaaagtatttgttcctttaaatttcagaccatgtccaacccagctgtgctgctgggaatcaggagaatagaagcaaaaaacgaaagagttctgttcagacttctgaagagcagcctgtggctacaaatctatgctgataaatgagattgagaactcaactgtattttgccataaatgcttctaagatatatccagctgggacttctattactccctttggaaaccttaagatcaaaaagggaataagaaacccttcttctgtatcccaataatccaccaggataaaggagaaactagaaatatgcaactcccttgatttcagtgtttggcaggtaacaaaaaattgagacccagacactggtcaacaggaaaacaatacagactcccagaattagaaagtgttattttaatgcaacctag

SEQ ID NO: 200190 - DNA, 1498 bp, Homo sapiens
  Payload ID: 19497
  Gene Name: wingless-type MMTV integration site family, member 8A
  Uniprot ID: Q9H1J5
  ENST ID: ENST00000398754
  CDS Start-End: 6-1061
gggcgatggggaacctgtttatgctctgggcagctctgggcatatgctgtgctgcattcagtgcctctgcctggtcagtgaacaatttcctgataacaggtcccaaggcctatctgacctacacgactagtgtggccttgggtgcccagagtggcatcgaggagtgcaagttccagtttgcttgggaacgctggaactgccctgaaaatgctcttcagctctccacccacaacaggctgagaagtgctaccagagagacttccttcatacatgctatcagctctgctggagtcatgtacatcatcaccaagaactgtagcatgggtgacttcgaaaactgtggctgtgatgggtcaaacaatggaaaaacaggaggccatggctggatctggggaggctgcagcgacaatgtggaatttggggaaaggatctccaaactctttgtggacagtttggagaaggggaaggatgccagagccctgatgaatcttcacaacaacagggccggcagactggcagtgagagccaccatgaaaaggacatgcaaatgtcatggcatctctgggagctgcagcatacagacatgctggctgcagctggctgaattccgggagatgggagactacctaaaggccaagtatgaccaggcgctgaaaattgaaatggataagcggcagctgagagctgggaacagcgccgagggccactgggtgcccgctgaggccttccttcctagcgcagaggcggaactgatctttttagaggaatcaccagattactgtacctgcaattccagcctgggcatctatggcacagagggtcgtgagtgcctacagaacagccacaacacatccaggtgggagcgacgtagctgtgggcgcctgtgcactgagtgtgggctgcaggtggaagagaggaaaactgaggtcataagcagctgtaactgcaaattccagtggtgctgtacggtcaagtgtgaccagtgtaggcatgtggtgagcaagtattactgcgcacgctccccaggcagtgcccagtccctgggtaagggcagtgcctgataataccccacacaagttcacttgattaattgcatcagtggaaggggacatagcttctctcttagagagaacagattggaaagcaatcggaaaattgcagttttggtctgtagtcctcatgatatctgctatcagtggggaaaatggaggcccaagattctacagcatattcctggcggggctgaaattggaacctgggcctcctgactttggcagacccccatttcatctttcctgcaaactactttcccatctttgtgcctgtacttatgcagctttctacagggagagtttggtttggggtctatatctagagggaccttcaaagtatttgttcctttaaatttcagaccatgtccaacccagctgtgctgctgggaatcaggagaatagaagcaaaaaacgaaagagttctgttcagacttctgaagagcagc

SEQ ID NO: 200191 - DNA, 1193 bp, Homo sapiens
  Payload ID: 19497
  Gene Name: wingless-type MMTV integration site family, member 8A
  ENST ID: ENST00000504809
  CDS Start-End: 114-1193
ggaagaccctgccctctcctcacttctctggacttggccctgagctggacctggtccactggggtaggcagggcgatggggaacctgtttatgctctgggcagctctgggcatatgctgtgctgcattcagtgcctctgcctggtaagtcctttcccaaccctcactccttgccaaggaggcccccattgtctcatccccattcacctctgcctcactttttctctttttggtaggtcagtgaacaatttcctgataacaggtcccaaggcctatctgacctacacgactagtgtggccttgggtgcccagagtggcatcgaggagtgcaagttccagtttgcttgggaacgctggaactgccctgaaaatgctcttcagctctccacccacaacaggctgagaagtgctaccagagagacttccttcatacatgctatcagctctgctggagtcatgtacatcatcaccaagaactgtagcatgggtgacttcgaaaactgtggctgtgatgggtcaaacaatggaaaaacaggaggccatggctggatctggggaggctgcagcgacaatgtggaatttggggaaaggatctccaaactctttgtggacagtttggagaaggggaaggatgccagagccctgatgaatcttcacaacaacagggccggcagactggcagtgagagccaccatgaaaaggacatgcaaatgtcatggcatctctgggagctgcagcatacagacatgctggctgcagctggctgaattccgggagatgggagactacctaaaggccaagtatgaccaggcgctgaaaattgaaatggataagcggcagctgagagctgggaacagcgccgagggccactgggtgcccgctgaggccttccttcctagcgcagaggcggaactgatctttttagaggaatcaccagattactgtacctgcaattccagcctgggcatctatggcacagagggtcgtgagtgcctacagaacagccacaacacatccaggtgggagcgacgtagctgtgggcgcctgtgcactgagtgtgggctgcaggtggaagagaggaaaactgaggtcataagcagctgtaactgcaaattccagtggtgctgtacggtcaagtgtgaccagtgtaggcatgtgaccatgtccaacccagctgtgctgctgggaatcagg

SEQ ID NO: 200192 - DNA, 1543 bp, Homo sapiens
  Payload ID: 19497
  Gene Name: wingless-type MMTV integration site family, member 8A
  ENST ID: ENST00000506684
  CDS Start-End: 237-1346
agtccctcctcccagatcccccactgggccggtggctcctgcagccctgccagttaggaacaaatgagaagagctgctgatttcctcccttggacattcagaattttctcacataaatactgaggaagaccctgccctctcctcacttctctggacttggccctgagctggacctggtccactggggtaggcagggcgatggggaacctgtttatgctctgggcagctctgggcatatgctgtgctgcattcagtgcctctgcctggtaagtcctttcccaaccctcactccttgccaaggaggcccccattgtctcatccccattcacctctgcctcactttttctctttttggtaggtcagtgaacaatttcctgataacaggtcccaaggcctatctgacctacacgactagtgtggccttgggtgcccagagtggcatcgaggagtgcaagttccagtttgcttgggaacgctggaactgccctgaaaatgctcttcagctctccacccacaacaggctgagaagtgctaccagagagacttccttcatacatgctatcagctctgctggagtcatgtacatcatcaccaagaactgtagcatgggtgacttcgaaaactgtggctgtgatgggtcaaacaatggaaaaacaggaggccatggctggatctggggaggctgcagcgacaatgtggaatttggggaaaggatctccaaactctttgtggacagtttggagaaggggaaggatgccagagccctgatgaatcttcacaacaacagggccggcagactggcagtgagagccaccatgaaaaggacatgcaaatgtcatggcatctctgggagctgcagcatacagacatgctggctgcagctggctgaattccgggagatgggagactacctaaaggccaagtatgaccaggcgctgaaaattgaaatggataagcggcagctgagagctgggaacagcgccgagggccactgggtgcccgctgaggccttccttcctagcgcagaggcggaactgatctttttagaggaatcaccagattactgtacctgcaattccagcctgggcatctatggcacagagggtcgtgagtgcctacagaacagccacaacacatccaggtgggagcgacgtagctgtgggcgcctgtgcactgagtgtgggctgcaggtggaagagaggaaaactgaggtcataagcagctgtaactgcaaattccagtggtgctgtacggtcaagtgtgaccagtgtaggcatgtggtgagcaagtattactgcgcacgctccccaggcagtgcccagtccctgggtaagggcagtgcctgataataccccacacaagttcacttgattaattgcatcagtggaaggggacatagcttctctcttagagagaacagattggaaagcaatcggaaaattgcagttttggtctgtagtcctcatgatatctgctatcagtggggaaaatggaggcccaagattctacagcatattcctggcggggctgaaattggaacctg

SEQ ID NO: 200193 - DNA, 2112 bp, Homo sapiens
  Payload ID: 19498
  Gene Name: wingless-type MMTV integration site family, member 8B
  Uniprot ID: Q93098
  ENST ID: ENST00000343737
  CDS Start-End: 129-1184
cgcttacacaccaaggaagttgggctttgagaattccatcccactggcactgaggagaatatttctccgtcttgcttacccatctcccagttttttggaattttctctagctgttactccagaggattatgtttctttcaaagccttctgtgtacatctgtcttttcacctgtgtcctccaactcagccacagctggtcggtgaacaatttcctgatgactggtccaaaggcttacctgatttactccagcagtgtggcagctggtgcccagagtggtattgaagaatgcaagtatcagtttgcctgggaccgctggaactgccctgagagagccctgcagctgtccagccatggtgggcttcgcagtgccaatcgggagacagcatttgtgcatgccatcagttctgctggagtcatgtacaccctgactagaaactgcagccttggagattttgataactgtggctgtgatgactcccgcaacgggcaactggggggacaaggctggctgtggggaggctgcagtgacaatgtgggcttcggagaggcgatttccaagcagtttgtcgatgccctggaaacaggacaggatgcacgggcagccatgaacctgcacaacaacgaggctggccgcaaggcggtgaagggcaccatgaaacgcacgtgcaagtgccacggcgtgtctggcagctgcaccacgcagacctgttggctgcagctgcccgagttccgcgaggtgggcgcgcacctgaaggagaagtaccacgcagcactcaaggtggacctgctgcagggtgctggcaacagcgcggccggccgcggcgccatcgccgacacctttcgctccatctctacccgggagctggtgcacctggaggactccccggactactgcctggagaacaaaacgctagggctgctgggcaccgaaggccgagagtgcctaaggcgcgggcgggccctgggtcgctgggaacgccgcagctgccgccggctctgcggggactgcgggctggcggtggaggagcgccgggccgagaccgtgtccagctgcaactgcaagttccactggtgctgcgcagtccgctgcgagcagtgccgccggagggtcaccaagtacttctgtagccgcgcagagcggccgcgggggggcgctgcgcacaaacccgggagaaaaccctaagggtttcctctgccccctccttttcccactggttcttggcttcctttagagaccccggtaattgtggaacctagggaatggggaacccgctctcccagacctagggatcctgagagggagagactgcaatttctccaaagcttgccactttccagcctgtttccccaattcctctgtgctctcctagagctctgtctgaatcctcgcagccacacctaggtctgagaactcaggctttgagttactgatcttccttggattaggagaacaggtgttcctcctcccctctcctagcagccctaatgtctgacctagcctatcaagccttaggcgctggaagaacccttctcagacacgcaggacccaggtaaagtcaaagctttgcccttttgcccactgtctgctaccagggctcacccactgctgcacctctcttctgcacagctcctcccctgctacctgctgagccagattccccaggaatcttgaatgctttctctcctcttctccctttcctttcccagaaaaactgaggaaactggccccggaaaagcatgtctttggggttggttcctagaggcagaggttgaagatggaagagggagctctggagtgctaacttgaacaccaagggtgctactcatccctatggtatcatatcatgaatggactttactagtggggcaatgactttcctagacaataacccgagggactccagatacataccccgaaggtctaggaaatacgttaagggcagattacagtcatttcctaccctttaaaggtaacttctcccttctcctgacctacttcctcctagcaaccaactttacctcttcttctccaaaggatctttgttcctctgagccaagactgaggtaaataaagccactttcctcttcagatcctggtctgcacctctaga

SEQ ID NO: 200194 - DNA, 3971 bp, Homo sapiens
  Payload ID: 19499
  Gene Name: wingless-type MMTV integration site family, member 9A
  Uniprot ID: O14904
  ENST ID: ENST00000272164
  CDS Start-End: 12-1109
ggcgcggcaagatgctggatgggtccccgctggcgcgctggctggccgcggccttcgggctgacgctgctgctcgccgcgctgcgcccttcggccgcctacttcgggctgacgggcagcgagcccctgaccatcctcccgctgaccctggagccagaggcggctgcccaggcgcactacaaggcctgcgaccggctgaagctggagcggaagcagcggcgcatgtgccgccgggacccgggcgtggcagagacgctggtggaggccgtgagcatgagtgcgctcgagtgccagttccagttccgctttgagcgctggaactgcacgctggagggccgctaccgggccagcctgctcaagcgaggcttcaaggagactgccttcctctatgccatctcctcggctggcctgacgcacgcactggccaaggcgtgcagcgcgggccgcatggagcgctgtacctgcgatgaggcacccgacctggagaaccgtgaggcctggcagtgggggggctgcggagacaaccttaagtacagcagcaagttcgtcaaggaattcctgggcagacggtcaagcaaggatctgcgagcccgtgtggacttccacaacaacctcgtgggtgtgaaggtgatcaaggctggggtggagaccacctgcaagtgccacggcgtgtcaggctcatgcacggtgcggacctgctggcggcagttggcgcctttccatgaggtgggcaagcatctgaagcacaagtatgagacggcactcaaggtgggcagcaccaccaatgaagctgccggcgaggcaggtgccatctccccaccacggggccgtgcctcgggggcaggtggcagcgacccgctgccccgcactccagagctggtgcacctggatgactcgcctagcttctgcctggctggccgcttctccccgggcaccgctggccgtaggtgccaccgtgagaagaactgcgagagcatctgctgtggccgcggccataacacacagagccgggtggtgacaaggccctgccagtgccaggtgcgttggtgctgctatgtggagtgcaggcagtgcacgcagcgtgaggaggtctacacctgcaagggctgagttcccaggccctgccagccctgctgcacagggtgcaggcattgcacacggtgtgaagggtctacacctgcacaggctgagttcctgggctcgaccagcccagctgcgtggggtacaggcattgcacacagtgtgaatgggtctacacctgcatgggctgagtccctgggctcagacctagcagcgtggggtgagtccctgggctcagtcctagctgcatggggtgcaggcattgcacagagcatgaatgggcctacacctgccaaggctgaatccctgggcccagtcagccctgctgcacatggcacaggcattgcacacggtgtgaggagtgtacacctgcaagggctgaggccctgggcccagtcagccctgctgctcagagtgcaggcattgcacatggtgtgagaaggtctacacctgcaagggacgagtccccgggcctggccaaccctgctgtgcagggtgagggccatgcatgcagtatgaggggtctacacctgcaaggactgagaggcttttctagcacgtcggggcgtacagctggagcagggtgccgggggtcctctgggttggctgtccaagccctgtatctccccctctccaggacccagaggcgggggttggctctggtctggcgtatgcaacctctctgcttgtgccctgggcctcagcttcctccctctgacccgagagcattgcaccaatgctttctgagctttctcccatccctaacacaccagtccctgggaagcggctccccatgccagtccattggctttccctccccacctcctctgaggcatgggtggcaggtgcaccttggtgaccatgcggcctccgtgtgggccacccgttggggactggcctggcccaggctgccccaacaccagcactgtcttcagagactcaaaccactagaagaggacgcagcctgttctgcactcccagggcccggccgtgcgggtgcccaggctcggggggacactgccgacctctgacgttgagcacttctctttggagtaaatatcagtgacttttaaattattatgattatttaactaatataataattattattttctccatccctgccacctccccggctgcagctccccgctctcggccaagccccagtctgggagggccccgccttccgtccctgacatattccctcctaaccctgcctctgatctgcttagttgtttgaaaccactaaatcgagatagatgtgtgtagttaaggaaatacagtgagctgcgtctggccacagcccttggggcttctggaagccagctcccccagccccatgccagccagccactgccacgtggtgggccagccggcggcccctgccctgcaccctgtgggcagacgcccggcctccaggcagctcagtgcagattctcgagctgggggtggtggagaggggcgggcatggtgagggggcagggcagccctttgattggttcatgtcatgtcatgaggaagctgcttgctttgtgtcactgggggacagattgggacagatgccggtggaggcagtcttgggctcgcatctggccatggaacgccatgctttatggccctgctgttgtgtgtgctggggacagggtgacctgcactgacctggcttggtttgagggtgtagtgtgtgtgtgtgttgtgagagtgtgtgtgctggcgtggtcagtgtgcatacgtgtgcgtatgttgtgagtgttgtgagtgcgtgtgtgctggcgtggtcaatgtgtgtaagcgtgtgttgtataaatgcatgctggcatggtctgtgtgtgtgtgtgtgtgtgtgtgtgtgtgtgtgtgtatactggcatggtcagcttggctgtgctgtgctgtcagtggcatggcggtgccttaggttcccagagcctctcgccctgggctccgtcttgtgggtgtcctgatggctgtgggctgggttctgggcgggttgctggtatggatacaggaactactgagtgaataggtgtctcagagccctaagggtctccagaaagccggggtgtctgtgtttttaaaagaaaacctatttatgttgctgtgggtctctgccgtccctgtgttatagtacataagaacctttattctcctgtggttcagagagcaccccgacatgtgcctgcagctgcatccccgtaccacagtgtgggtgcaagacgctgggtttgtcctttgtctggtgaagcctggctagaaggggtgggggtggtagcccctgccctctgcagtgtccgcatccactggtccctgagcagcatagctggccacaccctcatgacatgacaagactgtcactcagtcactattgggtctatgaagggcgtcaagtcagaggaaggtttttatttttaatcaaataccacatttagctctatgtcataaatattcagaaaactatttttttaaacaaggcagaccaaaaatgtctgctagctagttggtttctatacaaatacatattcgaatgtcttgctggatgaagaggccgctcagccggagcctcctgtttcatgcgcttctcttctgaggggcagtagaggagaaagggctgttgggaggggttcagcccgctccttggccaggggatcccagccaccttctctgcaccaggccctgccttgagggacctggacccccaggtggcttctggccaggtgtgggtgggtgggaggggccctgtctgtgctccgagtctccgtgcgtgcaatgatttctctacctcatctgtgtggcccgtcccagagggactgtggagaatgtatttatttaacagctttgtgtcacagaaccagaaacaaatggaaacattaaataaatgtattttaaattata

SEQ ID NO: 200195 - DNA, 1376 bp, Homo sapiens
  Payload ID: 19500
  Gene Name: wingless-type MMTV integration site family, member 9B
  Uniprot ID: O14905
  ENST ID: ENST00000290015
  CDS Start-End: 54-1127
tgcgagcttgagcggcgcgaggagatgctagagggcgcagcgccgccagcaccatgcgccccccgcccgcgctggccctggccgggctctgcctgctggcgctgcccgccgccgccgcctcctacttcggcctgaccgggcgggaagtcctgacgcccttcccaggattgggcactgcggcagccccggcacagggcggggcccacctgaagcagtgtgacctgctgaagctgtcccggcggcagaagcagctctgccggagggagcccggcctggctgagaccctgagggatgctgcgcacctcggcctgcttgagtgccagtttcagttccggcatgagcgctggaactgtagcctggagggcaggatgggcctgctcaagagaggcttcaaagagacagctttcctgtacgcggtgtcctctgccgccctcacccacaccctggcccgggcctgcagcgctgggcgcatggagcgctgcacctgtgatgactctccggggctggagagccggcaggcctggcagtggggcgtgtgcggtgacaacctcaagtacagcaccaagtttctgagcaacttcctggggtccaagagaggaaacaaggacctgcgggcacgggcagacgcccacaatacccacgtgggcatcaaggctgtgaagagtggcctcaggaccacgtgtaagtgccatggcgtatcaggctcctgtgccgtgcgcacctgctggaagcagctctccccgttccgtgagacgggccaggtgctgaaactgcgctatgactcggctgtcaaggtgtccagtgccaccaatgaggccttgggccgcctagagctgtgggcccctgccaggcagggcagcctcaccaaaggcctggccccaaggtctggggacctggtgtacatggaggactcacccagcttctgccggcccagcaagtactcacctggcacagcaggtagggtgtgctcccgggaggccagctgcagcagcctgtgctgcgggcggggctatgacacccagagccgcctggtggccttctcctgccactgccaggtgcagtggtgctgctacgtggagtgccagcaatgtgtgcaggaggagcttgtgtacacctgcaagcactaggcctactgcccagcaagccagtctggcactgccaggacctcctgtggcacccttcaagctgcccagccggccctctgggcagactgtcatcacatgcatgcataaaccggcatgtgtgccaatgcacacgagtgtgccactcaccaccattccttggccagccttttgcctccctcgatactcaacaaagagaagcaaagcctcctcccttaacccaagcatccccaaccttgttgaggacttggagag

SEQ ID NO: 200196 - DNA, 2654 bp, Homo sapiens
  Payload ID: 19500
  Gene Name: wingless-type MMTV integration site family, member 9B
  ENST ID: ENST00000393461
  CDS Start-End: 54-1043
tgcgagcttgagcggcgcgaggagatgctagagggcgcagcgccgccagcaccatgcgccccccgcccgcgctggccctggccgggctctgcctgctggcgctgcccgccgccgccgcctcctacttcggcctgaccgggcgggaagtcctgacgcccttcccaggattgggcactgcggcagccccggcacagggcggggcccacctgaagcagtgtgacctgctgaagctgtcccggcggcagaagcagctctgccggagggagcccggcctggctgagaccctgagggatgctgcgcacctcggcctgcttgagtgccagtttcagttccggcatgagcgctggaactgtagcctggagggcaggatgggcctgctcaagagaggcttcaaagagacagctttcctgtacgcggtgtcctctgccgccctcacccacaccctggcccgggcctgcagcgctgggcgcatggagcgctgcacctgtgatgactctccggggctggagagccggcaggcctggcagtggggcgtgtgcggtgacaacctcaagtacagcaccaagtttctgagcaacttcctggggtccaagagaggaaacaaggacctgcgggcacgggcagacgcccacaatacccacgtgggcatcaaggctgtgaagagtggcctcaggaccacgtgtaagtgccatggcgtatcaggctcctgtgccgtgcgcacctgctggaagcagctctccccgttccgtgagacgggccaggtgctgaaactgcgctatgactcggctgtcaaggtgtccagtgccaccaatgaggccttgggccgcctagagctgtgggcccctgccaggcagggcagcctcaccaaaggcctggccccaaggtctggggacctggtgtacatggaggactcacccagcttctgccggcccagcaagtactcacctggcacagcaggttggagtgcagtggcaagatctcagctcatcacaacctccacctcccggattcaagcgattctcccgtctcagctgcctgagtaactgggattacaggcatgcaccaccacgcctgactaattttgtatttttggctaattttgtatttttagtagagatgaggtttctccatgttggtcaggctggtctcgaactcccgacctcaggtgatccacccgcctcggcctcccaaagtgctgggattaccggtgtgagccactgcgcctggccagcatttttttttttgagacagagtctcgctctgtcacccaggctggagtgcactggcatgatctctgctcactgcaacctccacctcccaggttcaagtgactctcttggctcagcctcccaagtagctgggactacaggcgtgcaccaccacgctcagctaatttttgtattttcagtagagatggacttttatcatgttggccaggctggtctcgaactcctggtctcaagtgatctgccagcctcagtctcccagggtgctgggattacaggtatgagccactgtgcccggccgccttagcattttgtgtatgttttgagtgacagccatctgtcaatattggcatcttttgttttattggatgaatgaatgaacaaatgaatttataaatcttgttctccatactgtttacccatcctcatttccctcacttggcagtgtcttgccatagcaggcttcctggtgtagctggcaccacatccctccctgacacacggcctccttattgcccctgctacttgcctttttctctcctccctttccttcccttcattccccctggcttccccttcccaactctcagaatccctggctgcctcaaccacaagaacaaagctgtgcagaagcctgaacctggagcttctgcaagatgaggtggggaatgagctaacccagctggaaagcagcctgctgatccctgggagagacggcgcttgggccaacccaccctccccaaggtggtcccctgcctcagctccacccgcttccccagatgaacttctttctctccctccagcgcttcagaggatgcacagctgtgtgtacttgaccctgagcctgggctagtgctggggacatagccagtctggctgatacccatatcagtacagaaagctgtcctcacccacttcatgcactagttgcattggtatgaagcattagctttataactatcccatttactgcaggcataaacctatatcaattggtggggatggaggttaaatgagagaagacatcaaagatgcatagaactattgggcccctttcaattaataaataaaatttgtaggaggccattagtttgtactgtgctcctgtaatggacccaacagaccaaacaaatatggagtcactcatgctaaatgcaattaacttgggagtatactcctaagttgcaaaaagtggtaacaaatagctgagttttggggcagttacagcagctgagcatctgtcaatgtaggtggccaggtgattcaattaaggatgctgtaaccaattaagctgtatctacacctcacttctgttttctatctacaaatactgcgtgatcatgttgctggttggagttctttgaataagctgtggttcggagggatgcccaattctagaatcatgaataaaagcctattaagatcttt

SEQ ID NO: 200197 - DNA, 543 bp, Homo sapiens
  Payload ID: 19500
  Gene Name: wingless-type MMTV integration site family, member 9B
  ENST ID: ENST00000575372
  CDS Start-End: 146-543
agcaaaccgggaagcagcatgtgcgtggaagctgggcctgagccctgacgcttcagctgagctccctgggtgatggctccttccacaagttctaacgtcccactgaaagcaagctgcaatttctgttgcttcttgtatcaattgcatgaaaggacgggcagtttcttttgatcctctggcatgccaaggcctgaatgccagtcctgggagccttaccagccctctaagaagaatcagaagcctgaccgggcgggaagtcctgacgcccttcccaggattgggcactgcggcagccccggcacagggcggggcccacctgaagcagtgtgacctgctgaagctgtcccggcggcagaagcagctctgccggagggagcccggcctggctgagaccctgagggatgctgcgcacctcggcctgcttgagtgccagtttcagttccggcatgagcgctggaactgtagcctggagggcaggatgggcctgctcaagagaggcttcaaagagacagctttcctgtacgcggtgtcctctgccgccct

SEQ ID NO: 200198 - DNA, 1376 bp, Homo sapiens; identical to SEQ ID NO: 200195
  Payload ID: 19500
  Gene Name: wingless-type MMTV integration site family, member 9B
  Uniprot ID: O14905
  ENST ID: ENST00000613753
  CDS Start-End: 54-1127

SEQ ID NO: 200199 - DNA, 543 bp, Homo sapiens; identical to SEQ ID NO: 200197
  Payload ID: 19500
  Gene Name: wingless-type MMTV integration site family, member 9B
  ENST ID: ENST00000633753
  CDS Start-End: 146-543

SEQ ID NO: 200200 - DNA, 2654 bp, Homo sapiens; identical to SEQ ID NO: 200196
  Payload ID: 19500
  Gene Name: wingless-type MMTV integration site family, member 9B
  ENST ID: ENST00000633488
  CDS Start-End: 54-1043

SEQ ID NO: 200201 - DNA, 1849 bp, Homo sapiens
  Payload ID: 19501
  Gene Name: Wiskott-Aldrich syndrome
  Uniprot ID: P42768
  ENST ID: ENST00000376701
  CDS Start-End: 76-1584
gctgctcattgcggaagttcctcttcttaccctgcacccagagcctcgccagagaagacaagggcagaaagcaccatgagtgggggcccaatgggaggaaggcccgggggccgaggagcaccagcggttcagcagaacataccctccaccctcctccaggaccacgagaaccagcgactctttgagatgcttggacgaaaatgcttgacgctggccactgcagttgttcagctgtacctggcgctgccccctggagctgagcactggaccaaggagcattgtggggctgtgtgcttcgtgaaggataacccccagaagtcctacttcatccgcctttacggccttcaggctggtcggctgctctgggaacaggagctgtactcacagcttgtctactccacccccacccccttcttccacaccttcgctggagatgactgccaagcggggctgaactttgcagacgaggacgaggcccaggccttccgggccctcgtgcaggagaagatacaaaaaaggaatcagaggcaaagtggagacagacgccagctacccccaccaccaacaccagccaatgaagagagaagaggagggctcccacccctgcccctgcatccaggtggagaccaaggaggccctccagtgggtccgctctccctggggctggcgacagtggacatccagaaccctgacatcacgagttcacgataccgtgggctcccagcacctggacctagcccagctgataagaaacgctcagggaagaagaagatcagcaaagctgatattggtgcacccagtggattcaagcatgtcagccacgtggggtgggacccccagaatggatttgacgtgaacaacctcgacccagatctgcggagtctgttctccagggcaggaatcagcgaggcccagctcaccgacgccgagacctctaaacttatctacgacttcattgaggaccagggtgggctggaggctgtgcggcaggagatgaggcgccaggagccacttccgccgcccccaccgccatctcgaggagggaaccagctcccccggccccctattgtggggggtaacaagggtcgttctggtccactgccccctgtacctttggggattgccccacccccaccaacaccccggggacccccacccccaggccgagggggccctccaccaccaccccctccagctactggacgttctggaccactgccccctccaccccctggagctggtgggccacccatgccaccaccaccgccaccaccgccaccgccgcccagctccgggaatggaccagcccctcccccactccctcctgctctggtgcctgccgggggcctggcccctggtgggggtcggggagcgcttttggatcaaatccggcagggaattcagctgaacaagacccctggggccccagagagctcagcgctgcagccaccacctcagagctcagagggactggtgggggccctgatgcacgtgatgcagaagagaagcagagccatccactcctccgacgaaggggaggaccaggctggcgatgaagatgaagatgatgaatgggatgactgagtggctgagttacttgctgccctgtgctcctccccgcaggacatggctccccctccacctgctctgtgcccaccctccactctcctcttccaggcccccaaccccccatttcttccccaccaacccctccaatgctgttatccctgcctggtcctcacactcacccaacaatcccaaggccctttttatacaaaaattctcagttctcttcactcaaggatttttaaagaaaaataaaagaattgtctttctgtctctctataaa

SEQ ID NO: 200202 - DNA, 933 bp, Homo sapiens
  Payload ID: 19501
  Gene Name: Wiskott-Aldrich syndrome
  ENST ID: ENST00000450772
  CDS Start-End: 284-933
tcaagactaagtcaaaggaggagagggcaacgcggtgggcaggagagaggccaacggccgcccggggcgaggggagccggtaggacgggaccaggactggccgacccggccccgcgcggggaagggggcgccttcctcccacaacacaaaacgtggaaatggggttttgccatgttgcccaggctcgtcttgaactcctgacctcaagtgatccactcgtctcggcctcccaaagtgctgggattacagagcctcgccagagaagacaagggcagaaagcaccatgagtgggggcccaatgggaggaaggcccgggggccgaggagcaccagcggttcagcagaacataccctccaccctcctccaggaccacgagaaccagcgactctttgagatgcttggacgaaaatgcttgacgctggccactgcagttgttcagctgtacctggcgctgccccctggagctgagcactggaccaaggagcattgtggggctgtgtgcttcgtgaaggataacccccagaagtcctacttcatccgcctttacggccttcaggctggtcggctgctctgggaacaggagctgtactcacagcttgtctactccacccccacccccttcttccacaccttcgctggagatgactgccaagcggggctgaactttgcagacgaggacgaggcccaggccttccgggccctcgtgcaggagaagatacaaaaaaggaatcagaggcaaagtggagacagacgccagctacccccaccaccaacaccagccaatgaagagagaagaggagggctcccacccctgcccctgcatccaggtggagaccaaggaggccctccagtgggtccgctctccctggggctggcgacagtggacatccagaaccctgacatcacgagttcacgataccgtgggctcccagc

SEQ ID NO: 200203 - DNA, 4435 bp, Homo sapiens
  Payload ID: 19502
  Gene Name: Wiskott-Aldrich syndrome-like
  Uniprot ID: O00401
  ENST ID: ENST00000223023
  CDS Start-End: 334-1851
atgttggattgtgcggccgccgccgccgctgcgggagggttgggggaggagttgggagtttagcgcagtcgccggagtgcgaggacaacgaccatccggccctagcctggccgggcgggtgccgggagcttccctttctcagcgcggcgcgaaggtggctcgccgtcagcgcctgcttccctcgacctcgtcctcctccccgctccggaggagctgcgagatgtggcgcctctgactccacttctccccgcccctgtcaccgagagggggaacgagctctcgcccactcgccggaggagacggccctggactcccaaccccgccggcgaaaccatgagctccgtccagcagcagccgccgccgccgcggagggtcaccaacgtggggtccctgttgctcaccccgcaggagaacgagtccctcttcactttcctcggcaagaaatgtgtgactatgtcttcagcagtggtgcagttatatgcagcagatcggaactgtatgtggtcaaagaagtgcagtggtgttgcttgtcttgttaaggacaatccacagagatcttattttttaagaatatttgacattaaggatgggaaactattgtgggaacaagagctatacaataactttgtatataatagtcctagaggatattttcatacctttgctggagatacttgtcaagttgctcttaattttgccaatgaagaagaagcaaaaaaatttcgaaaagcagttacagaccttttgggccgtcgacaaaggaaatctgagaaaagacgagatcccccaaatggtcctaatctacccatggctacagttgatataaaaaatccagaaatcacaacaaatagattttatggtccacaagtcaacaacatctcccataccaaagaaaagaagaagggaaaagctaaaaagaagagattaaccaaggcagatataggaacaccaagcaatttccagcacattggacatgttggttgggatccaaatacaggctttgatctgaataatttggatccagaattgaagaatcttttcgatatgtgtggaatctcagaggcacaacttaaagacagagaaacatcaaaagttatatatgactttattgaaaaaacaggaggtgttgaagctgttaaaaatgaactgcggaggcaagcaccaccacctccaccaccatcaaggggagggccacctcctcctcctccccctccacacaactcaggtcctcctcctcctcctgctaggggaagaggcgctcctcccccaccaccttcaagagctcccacagctgcacctccaccaccgcctccttccaggccaagtgtagcagtccctccaccaccgccaaataggatgtaccctcctccacctccagcccttccctcctcagcaccttcagggcctccaccaccacctccatctgtgttgggggtagggccagtggcaccacccccaccgcctccacctccacctcctcctgggccaccgcccccgcctggcctgccttctgatggggaccatcaggttccaactactgcaggaaacaaagcagctcttttagatcaaattagagagggtgctcagctaaaaaaagtggagcagaacagtcggccagtgtcctgctctggacgagatgcactgttagaccagatacgacagggtatccaactaaaatctgtggctgatggccaagagtctacaccaccaacacctgcacccacttcaggaattgtgggtgcattaatggaagtgatgcagaaaaggagcaaagccattcattcttcagatgaagatgaagatgaagatgatgaagaagattttgaggatgatgatgagtgggaagactgatctatatattatatatatatatatatttttaaggtgaaatactaaacactactttctgtctgtggattctgtaaaattatcatgtaaatgttctaccaatttgctgtatatttttgttgccttttttgcttttttttaatctgtgcaatacctcatttaatctgtaaaggtttgtcgtaatcctctacaaagctactccctgttattgtgtgcaagtttacaccaggatgctcacttgatttgtgaatatttttcattccatcaacaagggagtttaaatactatatgtgagactgacaaaaaccttaatgtaatttacttataatgccagaaggaaaacactattttcataccctactttttctgtacctaaattttcttaaaaaaaaatctagtatagcactacattcttttttaagtgatgcagaccttagtttctttagcccctttattttgaatacaatgctacatatgaatgttgaagctgatacattgcacagttctgtagacatcactacaccgatgtagtttctcaaattttagcaatatgctctacataaaatcactacagagatactagtggggaagacgattaacacacctcttacagtaatactgcctgttattggtatagcagtggtatttgcagactgggatcataaggagcccttaaatacttgttattgactggggttatttttatgctgtagcaaatgtgacaggctctttttagcaaaatttttgaaaatttttttggtattactctgaaacaaaatttaagttggagtttcagggatttagggagtagttttcattctacatgaactgaggtaatattatggtaactccaatatttggttaaaaaaactatacaaatcagaatagtactaaaatactgtagaattttagcatttttattttgcactttgtgtggattgaggtgttcagaaataccaaccataaaaatgtaatctagttggcaaaggtgtgcgctaaaacacggaaccgaacatgcattgatttggataacttttgagggtttttgtcaaatagcatgtgaagagttacatttttcttaaaagattggtggtcccaatgtcagagttcttggaacagataactgaatgatagattttttttttttaaagataaaactttacaacctgcacatttgttatgcatactaaatggtgtgttaaaattagggtttctttgcctctctacactacactaatctgcctaaaggtggttgtttcatatttataatgctaattatcatacctacctactttaaattttaggtagaaaattatctgatttaaatacaaacatatttttctcacattgagtaatatgcataatgtagttccaaatgtatttcattactatagtcacaatatccaactaaaaattacgctatctagaattgtaccaaccaaaatctcgtattggcagatcttgacaggctggacctgcaagatgtggcttgaattttaaccatttattacataatctctagtgatcatgcatctagttatcataagaaataatttaaaaggttttgttgctgaaagcagtaagtggtgcagtaaaatacttaagttattcaaagaatgttatctttcttgcaagagtaatttaagcacatgggaaagattctagactttttgtttcttgcaacaacagtgccctctgctgctagaaacctttttctacttactatcatttttattgtggcttgagctcagtcaatctggtgcagatgaggctggacaactactaaccaataaaatcaggagtttgtacaaaagttaaatggaacattataattattttaagtaatgttaattgaaaaaattttttctttttgacaatataaaaaacattttaaatttcctagaaatgtcttcagggtaatgccaatttaagatctctcttaacttgtggccaagaaattctagattttccagctgactttggtataatatatatttatcaggaacttctctcagcagagagtacccattcttcgagttcaaagcacaattttaaacatgtaaaatggatatataatttgccaaaggtaattaatttattctttttttcttaaagaagaaaaagacattggttgttgttacaaaaagtctaaattactgttggttgaaacacagcagctgtggagttcagtccaggcatgaagactaaatctgctttaccaagtaaggtgtaaggttgcatgtttcagtcctctaccatcctgcactgtgagcagcactatacctgtgcgttgtctgaaagccttccgtatattctccagctaaatggtcgtctggtagcctttgcatttaacaaactagcatgaggctttttatatctaaatgctacgtgatagacaatttcagctagccacatattgtatgtatgagattcataaagactttcaatcatttcattttcagacaactgaaattttgtttagtatgtgaattctttttttgaaatgtatagtgaataggatgttgcactggtggcaattcatcatggagcataataaaattaatttgacccaaatagaataaaataa

SEQ ID NO: 200204 - DNA, 10452 bp, Homo sapiens
  Payload ID: 19503
  Gene Name: WNK lysine deficient protein kinase 1
  Uniprot ID: Q9H4A3
  ENST ID: ENST00000315939
  CDS Start-End: 644-7792
ccggcccttcgcctctgggcgatgggcgacctgtgaggccggtccccatcgctgggggcgcgtgtgggaggaggcggccgcccgagtgaccgggagccgggccgcggccttccctcgcccgcctcggcccctcccactcctctgccccggggccgccaccgcccgggcgtcggacctggtcccgtgctcgcggtgccgccgccctctgggcctagcccgcccagctcggcgagcggcggcagtgggagccgcgtccgccgcatccgcctcgactcggtgccggcccctggccctcccctcatgactgcggcgcctctgctgccaccgcccgcccggccgccgctcgccgcaggatggatgcggaccgtgcggcgctaacccccgtggctcagctcccgaatcgcccgccttcgagccctcctcgtgagccgcagcagcctcggtgccagcccccgccgcagctgggcccagcggtccgcctgtccctcgttgcggcttgtcggtgctgagtgaggcgtcgtccgggtcggcgcgaacccgcccggccgcggttccctgcagacctctgcgcgggcggctcggcccttcacgcccttttcgttcacgaatccgagcccgctcgcctctctccagcgaaccgaccatgtctggcggcgccgcagagaagcagagcagcactcccggttccctgttcctctcgccgccggctcctgcccccaagaatggctccagctccgattcctccgtgggggagaaactgggagccgcggccgccgacgctgtgaccggcaggaccgaggagtacaggcgccgccgccacactatggacaaggacagccgtggggcggccgcgaccactaccaccactgagcaccgcttcttccgccggagcgtcatctgtgactccaatgccactgcactggagcttcccggccttcctctttccctgccccagcccagcatccccgcggctgtcccgcagagtgctccaccggagccccaccgggaagagaccgtgaccgccaccgccacttcccaggtagcccagcagcctccagccgctgccgcccctggggaacaggccgtcgcgggccctgccccctcgactgtccccagcagtaccagcaaagaccgcccagtgtcccagcctagccttgtggggagcaaagaggagccgccgccggcgagaagtggcagcggcggcggcagcgccaaggagccacaggaggaacggagccagcagcaggatgatatcgaagagctggagaccaaggccgtgggaatgtctaacgatggccgctttctcaagtttgacatcgaaatcggcagaggctcctttaagacggtctacaaaggtctggacactgaaaccaccgtggaagtcgcctggtgtgaactgcaggatcgaaaattaacaaagtctgagaggcagagatttaaagaagaagctgaaatgttaaaaggtcttcagcatcccaatattgttagattttatgattcctgggaatccacagtaaaaggaaagaagtgcattgttttggtgactgaacttatgacgtctggaacacttaaaacgtatctgaaaaggtttaaagtgatgaagatcaaagttctaagaagctggtgccgtcagatccttaaaggtcttcagtttcttcatactcgaactccacctatcattcaccgcgatcttaaatgtgacaacatctttatcaccggccctactggctcagtcaagattggagacctcggtctggcaaccctgaagcgggcttcttttgccaagagtgtgataggtaccccagagttcatggcccctgagatgtatgaggagaaatatgatgaatccgttgacgtttatgcttttgggatgtgcatgcttgagatggctacatctgaatatccttactcggagtgccaaaatgctgcacagatctaccgtcgcgtgaccagtggggtgaagccagccagttttgacaaagtagcaattcctgaagtgaaggaaattattgaaggatgcatacgacaaaacaaagatgaaagatattccatcaaagaccttttgaaccatgccttcttccaagaggaaacaggagtacgggtagaattagcagaagaagatgatggagaaaaaatagccataaaattatggctacgtattgaagatattaagaaattaaagggaaaatacaaagataatgaagctattgagttttcttttgatttagagagagatgtcccagaagatgttgcacaagaaatggtagagtctgggtatgtctgtgaaggtgatcacaagaccatggctaaagctatcaaagacagagtatcattaattaagaggaaacgagagcagcggcagttggtacgggaggagcaagaaaaaaaaaagcaggaagagagcagtctcaaacagcaggtagaacaatccagtgcttcccagacaggaatcaagcagctcccttctgctagcaccggcatacctactgcttctaccacttcagcttcagtttctacacaagtagaacctgaagaacctgaggcagatcaacatcaacaactacagtaccagcaacccagtatatctgtgttatctgatgggacggttgacagtggtcagggatcctctgtcttcacagaatctcgagtgagcagccaacagacagtttcatatggttcccaacatgaacaggcacattctacaggcacagtcccagggcatataccttctactgtccaagcacagtctcagccccatggggtatatccaccctcaagtgtggcacaggggcagagccagggtcagccatcctcaagtagcttaacaggggtttcatcttcccaacccatacaacatcctcagcagcagcagggaatacagcagacagcccctcctcaacagacagtgcagtattcactttcacagacatcaacctccagtgaggccactactgcacagccagtgagtcagcctcaagctccacaagtcttgcctcaagtatcagctggaaaacagcttccagtttcccagccagtaccaactatccaaggcgaacctcagatcccagttgcgacacaaccctcggttgttccagtccactctggtgctcatttccttccagtgggacagccgctccctactcccttgctccctcagtaccctgtctctcagattcccatatcaactcctcatgtgtctacggctcagacaggtttctcatcccttcccatcacaatggcagctggcattactcagcctctgctcacgttggcttcatctgctacaacagctgcgatcccgggggtatcaactgtggttcctagtcagcttccaacccttctgcagcctgtgactcagctgccaagtcaggttcacccacagctcctacaaccagcagttcagtccatgggaataccagctaaccttggacaagctgctgaggttccactttcctctggagatgttctgtaccagggcttcccacctcgactgccaccacagtacccaggagattcaaatattgctccctcttccaacgtggcttctgtttgcatccattctacagtcctatcccctcccatgccgacagaagtactggctacacctgggtactttcccacagtggtgcagccttatgtggaatcaaatcttttagttcctatgggtggtgtaggaggacaggttcaagtgtcccagccaggagggagtttagcacaagcccccactacatcctcccagcaagcagttttggagagtactcagggagtctctcaggttgctcctgcagagccagttgcagtagcacagacccaagctacccagccgaccactttggcttcctctgtagacagtgcacattcagatgttgcttcaggtatgagtgatggcaatgagaacgtcccatcttccagtggaaggcatgaaggaagaactacaaaacggcattaccgaaaatctgtaaggagtcgctctcgacatgaaaaaacttcacgcccaaaattaagaattttgaatgtttcaaataaaggagaccgagtagtagaatgtcaattagagactcataataggaaaatggttacattcaaatttgacctagatggtgacaaccccgaggagatagcaacaattatggtgaacaatgactttattctagcaatagagagagagtcgtttgtggatcaagtgcgagaaattattgaaaaagctgatgaaatgctcagtgaggatgtcagtgtggaaccagagggtgatcagggattggagagtctacaaggaaaggatgactatggcttttcaggttctcagaaattggaaggagagttcaaacaaccaattcctgcgtcttccatgccacagcaaataggcattcctaccagttctttaactcaagttgttcattctgcgggaaggcggtttatagtgagtcctgtgccagaaagccgattacgagaatcaaaagttttccccagtgaaataacagatacagttgctgcctctacagctcagagccctggaatgaacttgtctcactctgcatcatcccttagtctacaacaggccttttctgaacttagacgtgcccaaatgacagaaggacccaacacagcacctccaaactttagtcatacaggaccaacatttccagtagtacctcctttcttaagtagcattgctggagtcccaaccacagcagcagccacagcaccagtccctgcaacaagcagccctcctaatgacatttccacatcagtaattcagtctgaggttacagtgcccactgaagaggggattgctggagttgccaccagcacaggtgtggtaacttcaggtggtctccccataccacctgtgtctgaatcaccagtactttccagcgtagtttcaagtatcacaatacctgcagttgtctcaatatctactacatccccgtcacttcaagtccccacatccacatctgagatcgttgtttctagtacagcactgtatccttcagtaacagtttcagcaacttcagcctctgcagggggcagtactgctaccccaggtcctaagcctccagctgtagtatctcagcaggcagcaggcagcactactgtgggagccacattaacatcagtttctaccaccacttcattcccaagcacagcttcacagctgtgcattcagcttagcagcagtacttctactcctactttagctgaaaccgtggtagttagcgcacactcactagataagacatctcatagcagtacaactggattggctttctccctctctgcaccatcttcctcttcctctcctggagcaggagtgtctagttatatttctcagcctggtgggctgcatcctttggtcattccatcagtgatagcttctactcctattcttccccaagcagcaggacctacttctacacctttattaccccaagtacctagtatcccacccttggtacagcctgttgccaatgtgcctgctgtacagcagacactaattcatagtcagcctcaaccagctttgcttcccaaccagccccatactcattgtcctgaagtagattctgatacacaacccaaagctcctggaattgatgacataaagactctagaagaaaagctgcggtctctgttcagtgaacacagctcatctggagctcagcatgcctctgtctcactggagacctcactagtcatagagagcactgtcacaccaggcatcccaactactgctgttgcaccaagcaaactcctgacttctaccacaagtacttgcttaccaccaaccaatttaccactaggaacagttgctttgccagttacaccagtggtcacacctgggcaagtttctaccccagtcagcactactacatcaggagtgaaacctggaactgctccctccaagccacctctaactaaggctccggtgctgccagtgggtactgaacttccagcaggtactctacccagcgagcagctgccaccttttccaggaccttctctaacccagtcccagcaacctctagaggatcttgatgctcaattgagaagaacacttagtccagagatgatcacagtgacttctgcggttggtcctgtgtccatggcggctccaacagcaatcacagaagcaggaacacagcctcagaagggtgtttctcaagtcaaagaaggccctgtcctagcaactagttcaggagctggtgtttttaagatgggacgatttcaggtttctgttgcagcagacggtgcccagaaagagggtaaaaataagtcagaagatgcaaagtctgttcattttgaatccagcacctcagagtcctcagtgctatcaagtagtagtccagagagtaccttggtgaaaccagagccgaatggcataaccatccctggtatctcttcagatgtgccagagagtgcccacaaaactactgcctcagaggcaaagtcagacactgggcagcctaccaaggttggacgttttcaggtgacaactacagcaaacaaagtgggtcgtttctctgtatcaaaaactgaggacaagatcactgacacaaagaaagaaggaccagtggcatctcctccttttatggatttggaacaagctgttcttcctgctgtgataccaaagaaagagaagcctgaactgtcagagccttcacatctaaatgggccgtcttctgacccggaggccgcttttttaagtagggatgtggatgatggttccggtagtccacactcgccccatcagctgagctcaaagagccttcctagccagaatctaagtcaaagccttagtaattcatttaactcctcttacatgagtagcgacaatgagtcagatatcgaagatgaagacttaaagttagagctgcgacgactacgagataaacatctcaaagagattcaggacctgcagagtcgccagaagcatgaaattgaatctttgtataccaaactgggcaaggtgccccctgctgttattattcccccagctgctcccctttcagggagaagacgacgacccactaaaagcaaaggcagcaaatctagtcgaagcagttccttggggaataaaagcccccagctttcaggtaacctgtctggtcagagtgcagcttcagtcttgcacccccagcagaccctccaccctcctggcaacatcccagagtccgggcagaatcagctgttacagccccttaagccatctccctccagtgacaacctctattcagccttcaccagtgatggtgccatttcagtaccaagcctttctgctccaggtcaaggaaccagcagcacaaacactgttggggcaacagtgaacagccaagccgcccaagctcagcctcctgccatgacgtccagcaggaagggcacattcacagatgacttgcacaagttggtagacaattgggcccgagatgccatgaatctctcaggcaggagaggaagcaaagggcacatgaattacgagggccctggaatggcaaggaagttctctgcacctgggcaactgtgcatctccatgacctcgaacctgggtggctctgcccccatctctgcagcatcagctacctctctaggtcacttcaccaagtctatgtgccccccacagcagtatggctttccagctaccccatttggcgctcaatggagtgggacgggtggcccagcaccacagccacttggccagttccaacctgtgggaactgcctccttgcagaatttcaacatcagcaatttgcagaaatccatcagcaaccccccaggctccaacctgcggaccacttagacctagagacattaactgaatagatctgggggcaggagatggaatgctgagggggtgggtgggggtgggaagtagcctatatactaactactagtgctgcatttaactggttatttcttgccagaggggaatgtttttaatactgcattgagccctcagaatggagagtctcccccgctccagttattggaatgggagaggaaggaaagaacagcttttttgtcaaggggcagcttcagaccatgctttcctgtttatctatactcagtaatgaggatgagggctaggaaagtcttgttcataaggaagctggagaactcaatgtaaaatcaaacccatctgtaatttcgagtgggtggagctcttgcttttggtacatgccctgaatccctcactccctcaagaatccgaaccacaggacaaaaaccacctactgggctctctcctaccctgccctcctcccttttttttacccctctcttttttattttttctttgctctttagaacccagtgaaaaataccagggtactggggtgcaactctttcttatgataggtcattagtgctttaagcaaaagatattagcagctttgactgcagcattagcaattaggaaaaaaaaaaaattaagttccctgcggacatgtaactttgccatcagttttgatgtggaaacactgtgatatataaaatgttgttggacaacagtagttttaagagtaaaatatgaaacgtttaaaaagttccaaaaaaagctagctctgtcctttacttattgagacactttaactttttcctttgtatttccattgtattagataaataaatgtgaatgtaaaattgtataaattactgtacttgaatacttctgtttcccagtgttgcttgctggacattttagtgccttggacttctattgcttctgccattagcatcaacttaccagaccccagatcaataaagggcatgtggaaggaaatcgtaggtccatgtgaccccagcagtccagcagtggttatgccaaagggaaattgaaaaagtatttttttaagtcattcaacaactttgtctagagcaggtgtaagatgagtagggtgggaagttaggttggcatcagtggttaaaaacagaaagttctgtttcgggaatagtgaggagggggtgttgtaacaaaattggacaacttaaaagaatggtgtgtgctgggtgaaagacaaagactaaagaatgaggaaacaaacgtgatgcctggccagtgactgtcatataaacctttcttatttgagctaggcttgaacagacgtgacctagaagaaactgaacataaagagaagggggtggggggctagttttcaagttggggaacctgatagtgaaaagtcacagatggagaaaattgctctcagaaaaactgtttggattgctttcctcttgttgcacatgtaccatgcatttctcagcttggggtactacattttgtggaaagttaatctatctatctttccacatctgaattaatcattctaggaaagaatacttattcctactcatttcctttatgatgtccaaatggttgcaggatcataatctattgtgccacctttatttctagaagtacaactaatatgttcacattttcaaataaataatactccccgtaagtaataactgcaaccaatcagtgttattcagtgctatgcctccttgtaatgggtagttattaattattttcagagctttccggaaatactgtcctaactggctatgtttaggatctttgttatctctgaagacaaagaaagaagctaggactcttaattttggggtgcttcttgactcttagttgggaaactgaaaatatttccaaccttttacccacgtcaatggcatattctgggaatcaccaccaccaccaccactaccacagaaagaggctggaggctcctgtaccctgttcattccttaagggccctgcttcccttagtaagtaagtaagttggtctacggccctaaatatgcaaatgagagctgaaggtttttaaaaggtagaaaggaaaagggcaagggcttccacccctgctttaaaatgatttatttattctctgcttgtatttcttgtggagagagtaaggatagaaccaacaaggggctgagtagctgagaaaggggccacccaagagtgaaacatactttataccagaggagcagtggagcctcatgcagcacattatcatttgttatttgggtttaataataattttgacatcttttcactcatacacaaaaaaagtcagaactggtgttatttactgttgatttcatcctcctgtgtatgaaataacaagcctagaggaatgaactagtgctactgaactgtttaaattatttttgtgttaatagtacactttgagtatctttttccacattaaaaactttctgaattataaatgttttccttacattatttaacaatgtacactgttaaaaataaaaataaaaattcaaactttgggggtttctcagcagccgttaattgtacattttgcactaactctgggtgttgcgcttcttgtaagattgcgctttgtgcttcagtttgttacctttgtagacttatttaatgaaaccattcaaataaaccaaacttgcttttgttga

SEQ ID NO: 200205 - DNA, 11208 bp, Homo sapiens
  Payload ID: 19503
  Gene Name: WNK lysine deficient protein kinase 1
  Uniprot ID: Q9H4A3
  ENST ID: ENST00000340908
  CDS Start-End: 644-8548
ccggcccttcgcctctgggcgatgggcgacctgtgaggccggtccccatcgctgggggcgcgtgtgggaggaggcggccgcccgagtgaccgggagccgggccgcggccttccctcgcccgcctcggcccctcccactcctctgccccggggccgccaccgcccgggcgtcggacctggtcccgtgctcgcggtgccgccgccctctgggcctagcccgcccagctcggcgagcggcggcagtgggagccgcgtccgccgcatccgcctcgactcggtgccggcccctggccctcccctcatgactgcggcgcctctgctgccaccgcccgcccggccgccgctcgccgcaggatggatgcggaccgtgcggcgctaacccccgtggctcagctcccgaatcgcccgccttcgagccctcctcgtgagccgcagcagcctcggtgccagcccccgccgcagctgggcccagcggtccgcctgtccctcgttgcggcttgtcggtgctgagtgaggcgtcgtccgggtcggcgcgaacccgcccggccgcggttccctgcagacctctgcgcgggcggctcggcccttcacgcccttttcgttcacgaatccgagcccgctcgcctctctccagcgaaccgaccatgtctggcggcgccgcagagaagcagagcagcactcccggttccctgttcctctcgccgccggctcctgcccccaagaatggctccagctccgattcctccgtgggggagaaactgggagccgcggccgccgacgctgtgaccggcaggaccgaggagtacaggcgccgccgccacactatggacaaggacagccgtggggcggccgcgaccactaccaccactgagcaccgcttcttccgccggagcgtcatctgtgactccaatgccactgcactggagcttcccggccttcctctttccctgccccagcccagcatccccgcggctgtcccgcagagtgctccaccggagccccaccgggaagagaccgtgaccgccaccgccacttcccaggtagcccagcagcctccagccgctgccgcccctggggaacaggccgtcgcgggccctgccccctcgactgtccccagcagtaccagcaaagaccgcccagtgtcccagcctagccttgtggggagcaaagaggagccgccgccggcgagaagtggcagcggcggcggcagcgccaaggagccacaggaggaacggagccagcagcaggatgatatcgaagagctggagaccaaggccgtgggaatgtctaacgatggccgctttctcaagtttgacatcgaaatcggcagaggctcctttaagacggtctacaaaggtctggacactgaaaccaccgtggaagtcgcctggtgtgaactgcaggatcgaaaattaacaaagtctgagaggcagagatttaaagaagaagctgaaatgttaaaaggtcttcagcatcccaatattgttagattttatgattcctgggaatccacagtaaaaggaaagaagtgcattgttttggtgactgaacttatgacgtctggaacacttaaaacgtatctgaaaaggtttaaagtgatgaagatcaaagttctaagaagctggtgccgtcagatccttaaaggtcttcagtttcttcatactcgaactccacctatcattcaccgcgatcttaaatgtgacaacatctttatcaccggccctactggctcagtcaagattggagacctcggtctggcaaccctgaagcgggcttcttttgccaagagtgtgataggtaccccagagttcatggcccctgagatgtatgaggagaaatatgatgaatccgttgacgtttatgcttttgggatgtgcatgcttgagatggctacatctgaatatccttactcggagtgccaaaatgctgcacagatctaccgtcgcgtgaccagtggggtgaagccagccagttttgacaaagtagcaattcctgaagtgaaggaaattattgaaggatgcatacgacaaaacaaagatgaaagatattccatcaaagaccttttgaaccatgccttcttccaagaggaaacaggagtacgggtagaattagcagaagaagatgatggagaaaaaatagccataaaattatggctacgtattgaagatattaagaaattaaagggaaaatacaaagataatgaagctattgagttttcttttgatttagagagagatgtcccagaagatgttgcacaagaaatggtagagtctgggtatgtctgtgaaggtgatcacaagaccatggctaaagctatcaaagacagagtatcattaattaagaggaaacgagagcagcggcagttggtacgggaggagcaagaaaaaaaaaagcaggaagagagcagtctcaaacagcaggtagaacaatccagtgcttcccagacaggaatcaagcagctcccttctgctagcaccggcatacctactgcttctaccacttcagcttcagtttctacacaagtagaacctgaagaacctgaggcagatcaacatcaacaactacagtaccagcaacccagtatatctgtgttatctgatgggacggttgacagtggtcagggatcctctgtcttcacagaatctcgagtgagcagccaacagacagtttcatatggttcccaacatgaacaggcacattctacaggcacagtcccagggcatataccttctactgtccaagcacagtctcagccccatggggtatatccaccctcaagtgtgcctcgtcgtggccgtagcatgtcggtttgtgttcccatctttctgctgttgcctctgtgtcccgcatctctcccagtgctcttccaccccaccgccagtactgtctgcacctctttctccttccctcctccggactgccccgaggaaacttttgccgaaaagctttctaaagcattggagagtgtcctgcctatgcactctgcctctcagcgcaagcaccgacgctccagcctgccttccctctttgtcagtactcctcagtccatggcgcatccgtgtggggggaccccaacatacccagaatcacagatatttttcccaactattcatgaacgtccagtttctttttcaccacctcccacctgcccaccgaaagtagccatttcccagcggcgtaagagcacctccttcctggaagcccaaactcaccacttccaacccctgctgaggactgttggccaaagtcttcttccacctggtggcagcccaactaactggacaccagaggccgtagttatgttgggtactacagccagtagagtaactggagagtcatgtgagatacaggtccatcctatgtttgaaccatctcaagtttacagtgactatagacctggactagtacttccagaagaagctcactattttattcctcaggaagcagtgtatgtagctggggtacattaccaggcccgggtggcagaacagtatgagggcattccatacaactcatcagtactgtcaagtcctatgaaacagatacctgaacagaagccagtacaagggggccctacttcaagttctgtctttgaatttccatctggacaggctttcctggtaggacaccttcagaatctaagattagattctggattgggtccgggatctcccctctctagtatttctgcacctatcagtacagatgctacacgtttgaaatttcaccctgtctttgttcctcattctgcgcctgctgtgttaactcataacaatgagagcagaagcaactgtgtatttgaatttcatgttcacacaccaagctcctcttcaggagaaggaggtggaattttacctcagcgtgtttaccgaaatcggcaggttgcagtggacttgaatcaagaagaactgcctcctcaatcagttggattacatggctacttgcagcctgtgactgaagaaaagcataattaccatgccccagaattgaccgtttctgtggtagagcctatcggacagaactggccaataggaagcccagaatattccagtgattcctcacaaatcacttcttcagaccccagtgattttcagtcacctccccctacagggggagcagctgcaccttttggctctgacgtctcaatgccctttatccatctgcctcagacagtgttacaagaatccccacttttcttctgtttcccccaaggaaccacatctcagcaggtcttaactgcctcattttcttcaggaggatctgcacttcatccacaggcacaggggcagagccagggtcagccatcctcaagtagcttaacaggggtttcatcttcccaacccatacaacatcctcagcagcagcagggaatacagcagacagcccctcctcaacagacagtgcagtattcactttcacagacatcaacctccagtgaggccactactgcacagccagtgagtcagcctcaagctccacaagtcttgcctcaagtatcagctggaaaacagagtactcagggagtctctcaggttgctcctgcagagccagttgcagtagcacagacccaagctacccagccgaccactttggcttcctctgtagacagtgcacattcagatgttgcttcaggtatgagtgatggcaatgagaacgtcccatcttccagtggaaggcatgaaggaagaactacaaaacggcattaccgaaaatctgtaaggagtcgctctcgacatgaaaaaacttcacgcccaaaattaagaattttgaatgtttcaaataaaggagaccgagtagtagaatgtcaattagagactcataataggaaaatggttacattcaaatttgacctagatggtgacaaccccgaggagatagcaacaattatggtgaacaatgactttattctagcaatagagagagagtcgtttgtggatcaagtgcgagaaattattgaaaaagctgatgaaatgctcagtgaggatgtcagtgtggaaccagagggtgatcagggattggagagtctacaaggaaaggatgactatggcttttcaggttctcagaaattggaaggagagttcaaacaaccaattcctgcgtcttccatgccacagcaaataggcattcctaccagttctttaactcaagttgttcattctgcgggaaggcggtttatagtgagtcctgtgccagaaagccgattacgagaatcaaaagttttccccagtgaaataacagatacagttgctgcctctacagctcagagccctggaatgaacttgtctcactctgcatcatcccttagtctacaacaggccttttctgaacttagacgtgcccaaatgacagaaggacccaacacagcacctccaaactttagtcatacaggaccaacatttccagtagtacctcctttcttaagtagcattgctggagtcccaaccacagcagcagccacagcaccagtccctgcaacaagcagccctcctaatgacatttccacatcagtaattcagtctgaggttacagtgcccactgaagaggggattgctggagttgccaccagcacaggtgtggtaacttcaggtggtctccccataccacctgtgtctgaatcaccagtactttccagcgtagtttcaagtatcacaatacctgcagttgtctcaatatctactacatccccgtcacttcaagtccccacatccacatctgagatcgttgtttctagtacagcactgtatccttcagtaacagtttcagcaacttcagcctctgcagggggcagtactgctaccccaggtcctaagcctccagctgtagtatctcagcaggcagcaggcagcactactgtgggagccacattaacatcagtttctaccaccacttcattcccaagcacagcttcacagctgtgcattcagcttagcagcagtacttctactcctactttagctgaaaccgtggtagttagcgcacactcactagataagacatctcatagcagtacaactggattggctttctccctctctgcaccatcttcctcttcctctcctggagcaggagtgtctagttatatttctcagcctggtgggctgcatcctttggtcattccatcagtgatagcttctactcctattcttccccaagcagcaggacctacttctacacctttattaccccaagtacctagtatcccacccttggtacagcctgttgccaatgtgcctgctgtacagcagacactaattcatagtcagcctcaaccagctttgcttcccaaccagccccatactcattgtcctgaagtagattctgatacacaacccaaagctcctggaattgatgacataaagactctagaagaaaagctgcggtctctgttcagtgaacacagctcatctggagctcagcatgcctctgtctcactggagacctcactagtcatagagagcactgtcacaccaggcatcccaactactgctgttgcaccaagcaaactcctgacttctaccacaagtacttgcttaccaccaaccaatttaccactaggaacagttgctttgccagttacaccagtggtcacacctgggcaagtttctaccccagtcagcactactacatcaggagtgaaacctggaactgctccctccaagccacctctaactaaggctccggtgctgccagtgggtactgaacttccagcaggtactctacccagcgagcagctgccaccttttccaggaccttctctaacccagtcccagcaacctctagaggatcttgatgctcaattgagaagaacacttagtccagagatgatcacagtgacttctgcggttggtcctgtgtccatggcggctccaacagcaatcacagaagcaggaacacagcctcagaagggtgtttctcaagtcaaagaaggccctgtcctagcaactagttcaggagctggtgtttttaagatgggacgatttcaggtttctgttgcagcagacggtgcccagaaagagggtaaaaataagtcagaagatgcaaagtctgttcattttgaatccagcacctcagagtcctcagtgctatcaagtagtagtccagagagtaccttggtgaaaccagagccgaatggcataaccatccctggtatctcttcagatgtgccagagagtgcccacaaaactactgcctcagaggcaaagtcagacactgggcagcctaccaaggttggacgttttcaggtgacaactacagcaaacaaagtgggtcgtttctctgtatcaaaaactgaggacaagatcactgacacaaagaaagaaggaccagtggcatctcctccttttatggatttggaacaagctgttcttcctgctgtgataccaaagaaagagaagcctgaactgtcagagccttcacatctaaatgggccgtcttctgacccggaggccgcttttttaagtagggatgtggatgatggttccggtagtccacactcgccccatcagctgagctcaaagagccttcctagccagaatctaagtcaaagccttagtaattcatttaactcctcttacatgagtagcgacaatgagtcagatatcgaagatgaagacttaaagttagagctgcgacgactacgagataaacatctcaaagagattcaggacctgcagagtcgccagaagcatgaaattgaatctttgtataccaaactgggcaaggtgccccctgctgttattattcccccagctgctcccctttcagggagaagacgacgacccactaaaagcaaaggcagcaaatctagtcgaagcagttccttggggaataaaagcccccagctttcaggtaacctgtctggtcagagtgcagcttcagtcttgcacccccagcagaccctccaccctcctggcaacatcccagagtccgggcagaatcagctgttacagccccttaagccatctccctccagtgacaacctctattcagccttcaccagtgatggtgccatttcagtaccaagcctttctgctccaggtcaaggaaccagcagcacaaacactgttggggcaacagtgaacagccaagccgcccaagctcagcctcctgccatgacgtccagcaggaagggcacattcacagatgacttgcacaagttggtagacaattgggcccgagatgccatgaatctctcaggcaggagaggaagcaaagggcacatgaattacgagggccctggaatggcaaggaagttctctgcacctgggcaactgtgcatctccatgacctcgaacctgggtggctctgcccccatctctgcagcatcagctacctctctaggtcacttcaccaagtctatgtgccccccacagcagtatggctttccagctaccccatttggcgctcaatggagtgggacgggtggcccagcaccacagccacttggccagttccaacctgtgggaactgcctccttgcagaatttcaacatcagcaatttgcagaaatccatcagcaaccccccaggctccaacctgcggaccacttagacctagagacattaactgaatagatctgggggcaggagatggaatgctgagggggtgggtgggggtgggaagtagcctatatactaactactagtgctgcatttaactggttatttcttgccagaggggaatgtttttaatactgcattgagccctcagaatggagagtctcccccgctccagttattggaatgggagaggaaggaaagaacagcttttttgtcaaggggcagcttcagaccatgctttcctgtttatctatactcagtaatgaggatgagggctaggaaagtcttgttcataaggaagctggagaactcaatgtaaaatcaaacccatctgtaatttcgagtgggtggagctcttgcttttggtacatgccctgaatccctcactccctcaagaatccgaaccacaggacaaaaaccacctactgggctctctcctaccctgccctcctcccttttttttacccctctcttttttattttttctttgctctttagaacccagtgaaaaataccagggtactggggtgcaactctttcttatgataggtcattagtgctttaagcaaaagatattagcagctttgactgcagcattagcaattaggaaaaaaaaaaaattaagttccctgcggacatgtaactttgccatcagttttgatgtggaaacactgtgatatataaaatgttgttggacaacagtagttttaagagtaaaatatgaaacgtttaaaaagttccaaaaaaagctagctctgtcctttacttattgagacactttaactttttcctttgtatttccattgtattagataaataaatgtgaatgtaaaattgtataaattactgtacttgaatacttctgtttcccagtgttgcttgctggacattttagtgccttggacttctattgcttctgccattagcatcaacttaccagaccccagatcaataaagggcatgtggaaggaaatcgtaggtccatgtgaccccagcagtccagcagtggttatgccaaagggaaattgaaaaagtatttttttaagtcattcaacaactttgtctagagcaggtgtaagatgagtagggtgggaagttaggttggcatcagtggttaaaaacagaaagttctgtttcgggaatagtgaggagggggtgttgtaacaaaattggacaacttaaaagaatggtgtgtgctgggtgaaagacaaagactaaagaatgaggaaacaaacgtgatgcctggccagtgactgtcatataaacctttcttatttgagctaggcttgaacagacgtgacctagaagaaactgaacataaagagaagggggtggggggctagttttcaagttggggaacctgatagtgaaaagtcacagatggagaaaattgctctcagaaaaactgtttggattgctttcctcttgttgcacatgtaccatgcatttctcagcttggggtactacattttgtggaaagttaatctatctatctttccacatctgaattaatcattctaggaaagaatacttattcctactcatttcctttatgatgtccaaatggttgcaggatcataatctattgtgccacctttatttctagaagtacaactaatatgttcacattttcaaataaataatactccccgtaagtaataactgcaaccaatcagtgttattcagtgctatgcctccttgtaatgggtagttattaattattttcagagctttccggaaatactgtcctaactggctatgtttaggatctttgttatctctgaagacaaagaaagaagctaggactcttaattttggggtgcttcttgactcttagttgggaaactgaaaatatttccaaccttttacccacgtcaatggcatattctgggaatcaccaccaccaccaccactaccacagaaagaggctggaggctcctgtaccctgttcattccttaagggccctgcttcccttagtaagtaagtaagttggtctacggccctaaatatgcaaatgagagctgaaggtttttaaaaggtagaaaggaaaagggcaagggcttccacccctgctttaaaatgatttatttattctctgcttgtatttcttgtggagagagtaaggatagaaccaacaaggggctgagtagctgagaaaggggccacccaagagtgaaacatactttataccagaggagcagtggagcctcatgcagcacattatcatttgttatttgggtttaataataattttgacatcttttcactcatacacaaaaaaagtcagaactggtgttatttactgttgatttcatcctcctgtgtatgaaataacaagcctagaggaatgaactagtgctactgaactgtttaaattatttttgtgttaatagtacactttgagtatctttttccacattaaaaactttctgaattataaatgttttccttacattatttaacaatgtacactgttaaaaataaaaataaaaattcaaactttgggggtttctcagcagccgttaattgtacattttgcactaactctgggtgttgcgcttcttgtaagattgcgctttgtgcttcagtttgttacctttgtagacttatttaatgaaaccattcaaataaaccaaacttgcttttgttga

SEQ ID NO: 200206 - DNA, 1902 bp, Homo sapiens
  Payload ID: 19503
  Gene Name: WNK lysine deficient protein kinase 1
  ENST ID: ENST00000447667
  CDS Start-End: 511-1692
ccactcctctgccccggggccgccaccgcccgggcgtcggacctggtcccgtgctcgcggtgccgccgccctctgggcctagcccgcccagctcggcgagcggcggcagtgggagccgcgtccgccgcatccgcctcgactcggtgccggcccctggccctcccctcatgactgcggcgcctctgctgccaccgcccgcccggccgccgctcgccgcaggatggatgcggaccgtgcggcgctaacccccgtggctcagctcccgaatcgcccgccttcgagccctcctcgtgagccgcagcagcctcggtgccagcccccgccgcagctgggcccagcggtccgcctgtccctcgttgcggcttgtcggtgctgagtgaggcgtcgtccgggtcggcgcgaacccgcccggccgcggttccctgcagacctctgcgcgggcggctcggcccttcacgcccttttcgttcacgaatccgagcccgctcgcctctctccagcgaaccgaccatgtctggcggcgccgcagagaagcagagcagcactcccggttccctgttcctctcgccgccggctcctgcccccaagaatggctccagctccgattcctccgtgggggagaaactgggagccgcggccgccgacgctgtgaccggcaggaccgaggagtacaggcgccgccgccacactatggacaaggacagccgtggggcggccgcgaccactaccaccactgagcaccgcttcttccgccggagcgtcatctgtgactccaatgccactgcactggagcttcccggccttcctctttccctgccccagcccagcatccccgcggctgtcccgcagagtgctccaccggagccccaccgggaagagaccgtgaccgccaccgccacttcccaggtagcccagcagcctccagccgctgccgcccctggggaacaggccgtcgcgggccctgccccctcgactgtccccagcagtaccagcaaagaccgcccagtgtcccagcctagccttgtggggagcaaagaggagccgccgccggcgagaagtggcagcggcggcggcagcgccaaggagccacaggaggaacggagccagcagcaggatgatatcgaagagctggagaccaaggccgtgggaatgtctaacgatggccgctttctcaagtttgacatcgaaatcggcagaggctcctttaagacggtctacaaaggtctggacactgaaaccaccgtggaagtcgcctggtgtgaactgcaggatcgaaaattaacaaagtctgagaggcagagatttaaagaagaagctgaaatgttaaaaggtcttcagcatcccaatattgttagattttatgattcctgggaatccacagtaaaaggaaagaagtgcattgttttggtgactgaacttatgacgtctggaacacttaaaacgtatctgaaaaggtttaaagtgatgaagatcaaagttctaagaagctggtgccgtcagatccttaaaggtcttcagtttcttcatactcgaactccacctatcattcaccgcgatcttaaatgtgacaacatctttatcaccggccctactggctcagtcaagattggagacctcggtctggcaaccctgaagcgggcttcttttgccaagagtgtgataggtatgtttcaggtgtaccttggagcctgactggctttctcacattccttttatttagaatcctggctctgtcagagttttaagtgatataaaccttaagaaattcatagcttgaactcaggaggtgatccattgtacttatgagatataggattctctatatttgtgcttcttggaatcatcttagagactattggtaacattacgttacaagaaataaagtgaactttgttgataaaa

SEQ ID NO: 200207 - DNA, 11804 bp, Homo sapiens
  Payload ID: 19503
  Gene Name: WNK lysine deficient protein kinase 1
  Uniprot ID: Q9H4A3
  ENST ID: ENST00000530271
  CDS Start-End: 644-9145
ccggcccttcgcctctgggcgatgggcgacctgtgaggccggtccccatcgctgggggcgcgtgtgggaggaggcggccgcccgagtgaccgggagccgggccgcggccttccctcgcccgcctcggcccctcccactcctctgccccggggccgccaccgcccgggcgtcggacctggtcccgtgctcgcggtgccgccgccctctgggcctagcccgcccagctcggcgagcggcggcagtgggagccgcgtccgccgcatccgcctcgactcggtgccggcccctggccctcccctcatgactgcggcgcctctgctgccaccgcccgcccggccgccgctcgccgcaggatggatgcggaccgtgcggcgctaacccccgtggctcagctcccgaatcgcccgccttcgagccctcctcgtgagccgcagcagcctcggtgccagcccccgccgcagctgggcccagcggtccgcctgtccctcgttgcggcttgtcggtgctgagtgaggcgtcgtccgggtcggcgcgaacccgcccggccgcggttccctgcagacctctgcgcgggcggctcggcccttcacgcccttttcgttcacgaatccgagcccgctcgcctctctccagcgaaccgaccatgtctggcggcgccgcagagaagcagagcagcactcccggttccctgttcctctcgccgccggctcctgcccccaagaatggctccagctccgattcctccgtgggggagaaactgggagccgcggccgccgacgctgtgaccggcaggaccgaggagtacaggcgccgccgccacactatggacaaggacagccgtggggcggccgcgaccactaccaccactgagcaccgcttcttccgccggagcgtcatctgtgactccaatgccactgcactggagcttcccggccttcctctttccctgccccagcccagcatccccgcggctgtcccgcagagtgctccaccggagccccaccgggaagagaccgtgaccgccaccgccacttcccaggtagcccagcagcctccagccgctgccgcccctggggaacaggccgtcgcgggccctgccccctcgactgtccccagcagtaccagcaaagaccgcccagtgtcccagcctagccttgtggggagcaaagaggagccgccgccggcgagaagtggcagcggcggcggcagcgccaaggagccacaggaggaacggagccagcagcaggatgatatcgaagagctggagaccaaggccgtgggaatgtctaacgatggccgctttctcaagtttgacatcgaaatcggcagaggctcctttaagacggtctacaaaggtctggacactgaaaccaccgtggaagtcgcctggtgtgaactgcaggatcgaaaattaacaaagtctgagaggcagagatttaaagaagaagctgaaatgttaaaaggtcttcagcatcccaatattgttagattttatgattcctgggaatccacagtaaaaggaaagaagtgcattgttttggtgactgaacttatgacgtctggaacacttaaaacgtatctgaaaaggtttaaagtgatgaagatcaaagttctaagaagctggtgccgtcagatccttaaaggtcttcagtttcttcatactcgaactccacctatcattcaccgcgatcttaaatgtgacaacatctttatcaccggccctactggctcagtcaagattggagacctcggtctggcaaccctgaagcgggcttcttttgccaagagtgtgataggtaccccagagttcatggcccctgagatgtatgaggagaaatatgatgaatccgttgacgtttatgcttttgggatgtgcatgcttgagatggctacatctgaatatccttactcggagtgccaaaatgctgcacagatctaccgtcgcgtgaccagtggggtgaagccagccagttttgacaaagtagcaattcctgaagtgaaggaaattattgaaggatgcatacgacaaaacaaagatgaaagatattccatcaaagaccttttgaaccatgccttcttccaagaggaaacaggagtacgggtagaattagcagaagaagatgatggagaaaaaatagccataaaattatggctacgtattgaagatattaagaaattaaagggaaaatacaaagataatgaagctattgagttttcttttgatttagagagagatgtcccagaagatgttgcacaagaaatggtagagtctgggtatgtctgtgaaggtgatcacaagaccatggctaaagctatcaaagacagagtatcattaattaagaggaaacgagagcagcggcagttggtacgggaggagcaagaaaaaaaaaagcaggaagagagcagtctcaaacagcaggtagaacaatccagtgcttcccagacaggaatcaagcagctcccttctgctagcaccggcatacctactgcttctaccacttcagcttcagtttctacacaagtagaacctgaagaacctgaggcagatcaacatcaacaactacagtaccagcaacccagtatatctgtgttatctgatgggacggttgacagtggtcagggatcctctgtcttcacagaatctcgagtgagcagccaacagacagtttcatatggttcccaacatgaacaggcacattctacaggcacagtcccagggcatataccttctactgtccaagcacagtctcagccccatggggtatatccaccctcaagtgtgcctcagtccatggcgcatccgtgtggggggaccccaacatacccagaatcacagatatttttcccaactattcatgaacgtccagtttctttttcaccacctcccacctgcccaccgaaagtagccatttcccagcggcgtaagagcacctccttcctggaagcccaaactcaccacttccaacccctgctgaggactgttggccaaagtcttcttccacctggtggcagcccaactaactggacaccagaggccgtagttatgttgggtactacagccagtagagtaactggagagtcatgtgagatacaggtccatcctatgtttgaaccatctcaagtttacagtgactatagacctggactagtacttccagaagaagctcactattttattcctcaggaagcagtgtatgtagctggggtacattaccaggcccgggtggcagaacagtatgagggcattccatacaactcatcagtactgtcaagtcctatgaaacagatacctgaacagaagccagtacaagggggccctacttcaagttctgtctttgaatttccatctggacaggctttcctggtaggacaccttcagaatctaagattagattctggattgggtccgggatctcccctctctagtatttctgcacctatcagtacagatgctacacgtttgaaatttcaccctgtctttgttcctcattctgcgcctgctgtgttaactcataacaatgagagcagaagcaactgtgtatttgaatttcatgttcacacaccaagctcctcttcaggagaaggaggtggaattttacctcagcgtgtttaccgaaatcggcaggttgcagtggacttgaatcaagaagaactgcctcctcaatcagttggattacatggctacttgcagcctgtgactgaagaaaagcataattaccatgccccagaattgaccgtttctgtggtagagcctatcggacagaactggccaataggaagcccagaatattccagtgattcctcacaaatcacttcttcagaccccagtgattttcagtcacctccccctacagggggagcagctgcaccttttggctctgacgtctcaatgccctttatccatctgcctcagacagtgttacaagaatccccacttttcttctgtttcccccaaggaaccacatctcagcaggtcttaactgcctcattttcttcaggaggatctgcacttcatccacaggcacaggggcagagccagggtcagccatcctcaagtagcttaacaggggtttcatcttcccaacccatacaacatcctcagcagcagcagggaatacagcagacagcccctcctcaacagacagtgcagtattcactttcacagacatcaacctccagtgaggccactactgcacagccagtgagtcagcctcaagctccacaagtcttgcctcaagtatcagctggaaaacagcttccagtttcccagccagtaccaactatccaaggcgaacctcagatcccagttgcgacacaaccctcggttgttccagtccactctggtgctcatttccttccagtgggacagccgctccctactcccttgctccctcagtaccctgtctctcagattcccatatcaactcctcatgtgtctacggctcagacaggtttctcatcccttcccatcacaatggcagctggcattactcagcctctgctcacgttggcttcatctgctacaacagctgcgatcccgggggtatcaactgtggttcctagtcagcttccaacccttctgcagcctgtgactcagctgccaagtcaggttcacccacagctcctacaaccagcagttcagtccatgggaataccagctaaccttggacaagctgctgaggttccactttcctctggagatgttctgtaccagggcttcccacctcgactgccaccacagtacccaggagattcaaatattgctccctcttccaacgtggcttctgtttgcatccattctacagtcctatcccctcccatgccgacagaagtactggctacacctgggtactttcccacagtggtgcagccttatgtggaatcaaatcttttagttcctatgggtggtgtaggaggacaggttcaagtgtcccagccaggagggagtttagcacaagcccccactacatcctcccagcaagcagttttggagagtactcagggagtctctcaggttgctcctgcagagccagttgcagtagcacagacccaagctacccagccgaccactttggcttcctctgtagacagtgcacattcagatgttgcttcaggtatgagtgatggcaatgagaacgtcccatcttccagtggaaggcatgaaggaagaactacaaaacggcattaccgaaaatctgtaaggagtcgctctcgacatgaaaaaacttcacgcccaaaattaagaattttgaatgtttcaaataaaggagaccgagtagtagaatgtcaattagagactcataataggaaaatggttacattcaaatttgacctagatggtgacaaccccgaggagatagcaacaattatggtgaacaatgactttattctagcaatagagagagagtcgtttgtggatcaagtgcgagaaattattgaaaaagctgatgaaatgctcagtgaggatgtcagtgtggaaccagagggtgatcagggattggagagtctacaaggaaaggatgactatggcttttcaggttctcagaaattggaaggagagttcaaacaaccaattcctgcgtcttccatgccacagcaaataggcattcctaccagttctttaactcaagttgttcattctgcgggaaggcggtttatagtgagtcctgtgccagaaagccgattacgagaatcaaaagttttccccagtgaaataacagatacagttgctgcctctacagctcagagccctggaatgaacttgtctcactctgcatcatcccttagtctacaacaggccttttctgaacttagacgtgcccaaatgacagaaggacccaacacagcacctccaaactttagtcatacaggaccaacatttccagtagtacctcctttcttaagtagcattgctggagtcccaaccacagcagcagccacagcaccagtccctgcaacaagcagccctcctaatgacatttccacatcagtaattcagtctgaggttacagtgcccactgaagaggggattgctggagttgccaccagcacaggtgtggtaacttcaggtggtctccccataccacctgtgtctgaatcaccagtactttccagcgtagtttcaagtatcacaatacctgcagttgtctcaatatctactacatccccgtcacttcaagtccccacatccacatctgagatcgttgtttctagtacagcactgtatccttcagtaacagtttcagcaacttcagcctctgcagggggcagtactgctaccccaggtcctaagcctccagctgtagtatctcagcaggcagcaggcagcactactgtgggagccacattaacatcagtttctaccaccacttcattcccaagcacagcttcacagctgtgcattcagcttagcagcagtacttctactcctactttagctgaaaccgtggtagttagcgcacactcactagataagacatctcatagcagtacaactggattggctttctccctctctgcaccatcttcctcttcctctcctggagcaggagtgtctagttatatttctcagcctggtgggctgcatcctttggtcattccatcagtgatagcttctactcctattcttccccaagcagcaggacctacttctacacctttattaccccaagtacctagtatcccacccttggtacagcctgttgccaatgtgcctgctgtacagcagacactaattcatagtcagcctcaaccagctttgcttcccaaccagccccatactcattgtcctgaagtagattctgatacacaacccaaagctcctggaattgatgacataaagactctagaagaaaagctgcggtctctgttcagtgaacacagctcatctggagctcagcatgcctctgtctcactggagacctcactagtcatagagagcactgtcacaccaggcatcccaactactgctgttgcaccaagcaaactcctgacttctaccacaagtacttgcttaccaccaaccaatttaccactaggaacagttgctttgccagttacaccagtggtcacacctgggcaagtttctaccccagtcagcactactacatcaggagtgaaacctggaactgctccctccaagccacctctaactaaggctccggtgctgccagtgggtactgaacttccagcaggtactctacccagcgagcagctgccaccttttccaggaccttctctaacccagtcccagcaacctctagaggatcttgatgctcaattgagaagaacacttagtccagagatgatcacagtgacttctgcggttggtcctgtgtccatggcggctccaacagcaatcacagaagcaggaacacagcctcagaagggtgtttctcaagtcaaagaaggccctgtcctagcaactagttcaggagctggtgtttttaagatgggacgatttcaggtttctgttgcagcagacggtgcccagaaagagggtaaaaataagtcagaagatgcaaagtctgttcattttgaatccagcacctcagagtcctcagtgctatcaagtagtagtccagagagtaccttggtgaaaccagagccgaatggcataaccatccctggtatctcttcagatgtgccagagagtgcccacaaaactactgcctcagaggcaaagtcagacactgggcagcctaccaaggttggacgttttcaggtgacaactacagcaaacaaagtgggtcgtttctctgtatcaaaaactgaggacaagatcactgacacaaagaaagaaggaccagtggcatctcctccttttatggatttggaacaagctgttcttcctgctgtgataccaaagaaagagaagcctgaactgtcagagccttcacatctaaatgggccgtcttctgacccggaggccgcttttttaagtagggatgtggatgatggttccggtagtccacactcgccccatcagctgagctcaaagagccttcctagccagaatctaagtcaaagccttagtaattcatttaactcctcttacatgagtagcgacaatgagtcagatatcgaagatgaagacttaaagttagagctgcgacgactacgagataaacatctcaaagagattcaggacctgcagagtcgccagaagcatgaaattgaatctttgtataccaaactgggcaaggtgccccctgctgttattattcccccagctgctcccctttcagggagaagacgacgacccactaaaagcaaaggcagcaaatctagtcgaagcagttccttggggaataaaagcccccagctttcaggtaacctgtctggtcagagtgcagcttcagtcttgcacccccagcagaccctccaccctcctggcaacatcccagagtccgggcagaatcagctgttacagccccttaagccatctccctccagtgacaacctctattcagccttcaccagtgatggtgccatttcagtaccaagcctttctgctccaggtcaaggctgtgcgaagtttaactgtgcatctgaacaggtgacattcaaacctggtggcaggaggacccgatttctgaggaagatggtgaaaaaagtctgtccttgcaaccagctctgtagaaccagcagcacaaacactgttggggcaacagtgaacagccaagccgcccaagctcagcctcctgccatgacgtccagcaggaagggcacattcacagatgacttgcacaagttggtagacaattgggcccgagatgccatgaatctctcaggcaggagaggaagcaaagggcacatgaattacgagggccctggaatggcaaggaagttctctgcacctgggcaactgtgcatctccatgacctcgaacctgggtggctctgcccccatctctgcagcatcagctacctctctaggtcacttcaccaagtctatgtgccccccacagcagtatggctttccagctaccccatttggcgctcaatggagtgggacgggtggcccagcaccacagccacttggccagttccaacctgtgggaactgcctccttgcagaatttcaacatcagcaatttgcagaaatccatcagcaaccccccaggctccaacctgcggaccacttagacctagagacattaactgaatagatctgggggcaggagatggaatgctgagggggtgggtgggggtgggaagtagcctatatactaactactagtgctgcatttaactggttatttcttgccagaggggaatgtttttaatactgcattgagccctcagaatggagagtctcccccgctccagttattggaatgggagaggaaggaaagaacagcttttttgtcaaggggcagcttcagaccatgctttcctgtttatctatactcagtaatgaggatgagggctaggaaagtcttgttcataaggaagctggagaactcaatgtaaaatcaaacccatctgtaatttcgagtgggtggagctcttgcttttggtacatgccctgaatccctcactccctcaagaatccgaaccacaggacaaaaaccacctactgggctctctcctaccctgccctcctcccttttttttacccctctcttttttattttttctttgctctttagaacccagtgaaaaataccagggtactggggtgcaactctttcttatgataggtcattagtgctttaagcaaaagatattagcagctttgactgcagcattagcaattaggaaaaaaaaaaaattaagttccctgcggacatgtaactttgccatcagttttgatgtggaaacactgtgatatataaaatgttgttggacaacagtagttttaagagtaaaatatgaaacgtttaaaaagttccaaaaaaagctagctctgtcctttacttattgagacactttaactttttcctttgtatttccattgtattagataaataaatgtgaatgtaaaattgtataaattactgtacttgaatacttctgtttcccagtgttgcttgctggacattttagtgccttggacttctattgcttctgccattagcatcaacttaccagaccccagatcaataaagggcatgtggaaggaaatcgtaggtccatgtgaccccagcagtccagcagtggttatgccaaagggaaattgaaaaagtatttttttaagtcattcaacaactttgtctagagcaggtgtaagatgagtagggtgggaagttaggttggcatcagtggttaaaaacagaaagttctgtttcgggaatagtgaggagggggtgttgtaacaaaattggacaacttaaaagaatggtgtgtgctgggtgaaagacaaagactaaagaatgaggaaacaaacgtgatgcctggccagtgactgtcatataaacctttcttatttgagctaggcttgaacagacgtgacctagaagaaactgaacataaagagaagggggtggggggctagttttcaagttggggaacctgatagtgaaaagtcacagatggagaaaattgctctcagaaaaactgtttggattgctttcctcttgttgcacatgtaccatgcatttctcagcttggggtactacattttgtggaaagttaatctatctatctttccacatctgaattaatcattctaggaaagaatacttattcctactcatttcctttatgatgtccaaatggttgcaggatcataatctattgtgccacctttatttctagaagtacaactaatatgttcacattttcaaataaataatactccccgtaagtaataactgcaaccaatcagtgttattcagtgctatgcctccttgtaatgggtagttattaattattttcagagctttccggaaatactgtcctaactggctatgtttaggatctttgttatctctgaagacaaagaaagaagctaggactcttaattttggggtgcttcttgactcttagttgggaaactgaaaatatttccaaccttttacccacgtcaatggcatattctgggaatcaccaccaccaccaccactaccacagaaagaggctggaggctcctgtaccctgttcattccttaagggccctgcttcccttagtaagtaagtaagttggtctacggccctaaatatgcaaatgagagctgaaggtttttaaaaggtagaaaggaaaagggcaagggcttccacccctgctttaaaatgatttatttattctctgcttgtatttcttgtggagagagtaaggatagaaccaacaaggggctgagtagctgagaaaggggccacccaagagtgaaacatactttataccagaggagcagtggagcctcatgcagcacattatcatttgttatttgggtttaataataattttgacatcttttcactcatacacaaaaaaagtcagaactggtgttatttactgttgatttcatcctcctgtgtatgaaataacaagcctagaggaatgaactagtgctactgaactgtttaaattatttttgtgttaatagtacactttgagtatctttttccacattaaaaactttctgaattataaatgttttccttacattatttaacaatgtacactgttaaaaataaaaataaaaattcaaactttgggggtttctcagcagccgttaattgtacattttgcactaactctgggtgttgcgcttcttgtaagattgcgctttgtgcttcagtttgttacctttgtagacttatttaatgaaaccattcaaataaaccaaacttgcttttgttg

SEQ ID NO: 200208 - DNA, 226 bp, Homo sapiens
  Payload ID: 19503
  Gene Name: WNK lysine deficient protein kinase 1
  ENST ID: ENST00000544559
  CDS Start-End: 1-226
cagtgacaacctctattcagccttcaccagtgatggtgccatttcagtaccaagcctttctgctccaggtcaagggaagatggtgaaaaaagtctgtccttgcaaccagctctgtagaaccagcagcacaaacactgttggggcaacagtgaacagccaagccgcccaagctcagcctcctgccatgacgtccagcaggaagggcacattcacagatgacttgcac

SEQ ID NO: 200209 - DNA, 653 bp, Homo sapiens
  Payload ID: 19503
  Gene Name: WNK lysine deficient protein kinase 1
  ENST ID: ENST00000544965
  CDS Start-End: 1-653
agctgatgggacggttgacagtggtcagggatcctctgtcttcacagaatctcgagtgagcagccaacagacagtttcatatggttcccaacatgaacaggcacattctacaggcacagtcccagggcatataccttctactgtccaagcacagtctcagccccatggggtatatccaccctcaagtgtgcagcagggaatacagcagacagcccctcctcaacagacagtgcagtattcactttcacagacatcaacctccagtgaggccactactgcacagccagtgagtcagcctcaagctccacaagtcttgcctcaagtatcagctggaaaacagagtactcagggagtctctcaggttgctcctgcagagccagttgcagtagcacagacccaagctacccagccgaccactttggcttcctctgtagacagtgcacattcagatgttgcttcaggtatgagtgatggcaatgagaacgtcccatcttccagtggaaggcatgaaggaagaactacaaaacggcattaccgaaaatctgtaaggagtcgctctcgacatgaaaaaacttcacgcccaaaattaagaattttgaatgtttcaaataaaggagaccgagtagtagaatgtcaattagagactcataata

SEQ ID NO: 200210 - DNA, 201 bp, Homo sapiens
  Payload ID: 19503
  Gene Name: WNK lysine deficient protein kinase 1
  ENST ID: ENST00000543065
  CDS Start-End: 1-201
agtgacaacctctattcagccttcaccagtgatggtgccatttcagtaccaagcctttctgctccaggtcaaggctgtgcgaagtttaactgtgcatctgaacaggtgacattcaaacctggtggcaggaggacccgatttctgagtacgccctgcttggctctttggaagatggtgaaaaaagtctgtccttgcaaccag

SEQ ID NO: 200211 - DNA, 736 bp, Homo sapiens
  Payload ID: 19503
  Gene Name: WNK lysine deficient protein kinase 1
  ENST ID: ENST00000535698
  CDS Start-End: 1-736
tctcagccccatggggtatatccaccctcaagtgtgcagggaatacagcagacagcccctcctcaacagacagtgcagtattcactttcacagacatcaacctccagtgaggccactactgcacagccagtgagtcagcctcaagctccacaagtcttgcctcaagtatcagctggaaaacagcttccagtttcccagccagtaccaactatccaaggcgaacctcagatcccagttgcgacacaaccctcggttgttccagtccactctggtgctcatttccttccagtgggacagccgctccctactcccttgctccctcagtaccctgtctctcagattcccatatcaactcctcatgtgtctacggctcagacaggtttctcatcccttcccatcacaatggcagctggcattactcagcctctgctcacgttggcttcatctgctacaacagctgcgatcccgggggtatcaactgtggttcctagtcagcttccaacccttctgcagcctgtgactcagctgccaagtcaggttcacccacagctcctacaaccagcagttcagtccatgggaataccagctaaccttggacaagctgctgaggttccactttcctctggagatgttctgtaccagggcttcccacctcgactgccaccacagtacccaggagattcaaatattgctccctcttccaacgtggcttctgtttgcatccattctacagtcc

SEQ ID NO: 200212 - DNA, 9886 bp, Homo sapiens
  Payload ID: 19503
  Gene Name: WNK lysine deficient protein kinase 1
  ENST ID: ENST00000535572
  CDS Start-End: 974-7378
atttagcgcggagagtttcccgggtggacgcggctcctctctcggccactccgcacccccatcttcggtgacagaaggcgcctggtgggggtggctgctcttttctctccctgttccccctcacccagtcctctaggtctcctctcctcttgcctcagagaagcagcggagctcgggccccgcggtgagcggccctcccctccccgccgttccctcctccgtcagcccccggcaccggcccgggaggagacgggtttgccaggcctggggcgggcggggaggcctcggggaagggggggcccgctcctcaggcgccgaggctccgaggctccggcccttcgcctctgggcgatgggcgacctgtgaggccggtccccatcgctgggggcgcgtgtgggaggaggcggccgcccgagtgaccgggagccgggccgcggccttccctcgcccgcctcggcccctcccactcctctgccccggggccgccaccgcccgggcgtcggacctggtcccgtgctcgcggtgccgccgccctctgggcctagcccgcccagctcggcgagcggcggcagtgggagccgcgtccgccgcatccgcctcgactcggtgccggcccctggccctcccctcatgactgcggcgcctctgctgccaccgcccgcccggccgccgctcgccgcaggatggatgcggaccgtgcggcgctaacccccgtggctcagctcccgaatcgcccgccttcgagccctcctcgtgagccgcagcagcctcggtgccagcccccgccgcagctgggcccagcggtccgcctgtccctcgttgcggcttgtcggtgctgagtgaggcgtcgtccgggtcggcgcgaacccgcccggccgcggttccctgcagacctctgcgcgggcggctcggcccttcacgcccttttcgttcacgaatccgagcccgctcgcctctctccagcgaaccgaccatgtctggcggcgccgcagagaagcagagcagcactcccggttccctgttcctctcgccgccggctcctgcccccaagaatggctccagctccgattcctccgtgggggagaaactgggagccgcggccgccgacgctgtgaccggcaggaccgaggagtacaggcgccgccgccacactatggacaaggacagccgtggggcggccgcgaccactaccaccactgagcaccgcttcttccgccggagcgtcatctgtgactccaatgccactgcactggagcttcccggccttcctctttccctgccccagcccagcatccccgcggctgtcccgcagagtgctccaccggagccccaccgggaagagaccgtgaccgccaccgccacttcccaggtagcccagcagcctccagccgctgccgcccctggggaacaggccgtcgcgggccctgccccctcgactgtccccagcagtaccagcaaagaccgcccagtgtcccagcctagccttgtggggagcaaagaggagccgccgccggcgagaagtggcagcggcggcggcagcgccaaggagccacaggaggaacggagccagcagcaggatgatatcgaagagctggagaccaaggccgtgggaatgtctaacgatggccgctttctcaagtttgacatcgaaatcggcagaggctcctttaagacggtctacaaaggtctggacactgaaaccaccgtggaagtcgcctggtgtgaactgcaggatcgaaaattaacaaagtctgagaggcagagatttaaagaagaagctgaaatgttaaaaggtcttcagcatcccaatattgttagattttatgattcctgggaatccacagtaaaaggaaagaagtgcattgttttggtgactgaacttatgacgtctggaacacttaaaacgtatctgaaaaggtttaaagtgatgaagatcaaagttctaagaagctggtgccgtcagatccttaaaggtcttcagtttcttcatactcgaactccacctatcattcaccgcgatcttaaatgtgacaacatctttatcaccggccctactggctcagtcaagattggagacctcggtctggcaaccctgaagcgggcttcttttgccaagagtgtgataggtaccccagagttcatggcccctgagatgtatgaggagaaatatgatgaatccgttgacgtttatgcttttgggatgtgcatgcttgagatggctacatctgaatatccttactcggagtgccaaaatgctgcacagatctaccgtcgcgtgaccagtggggtgaagccagccagttttgacaaagtagcaattcctgaagtgaaggaaattattgaaggatgcatacgacaaaacaaagatgaaagatattccatcaaagaccttttgaaccatgccttcttccaagaggaaacaggagtacgggtagaattagcagaagaagatgatggagaaaaaatagccataaaattatggctacgtattgaagatattaagaaattaaagggaaaatacaaagataatgaagctattgagttttcttttgatttagagagagatgtcccagaagatgttgcacaagaaatggtagagtctgggtatgtctgtgaaggtgatcacaagaccatggctaaagctatcaaagacagagtatcattaattaagaggaaacgagagcagcggcagttggtacgggaggagcaagaaaaaaaaaagcaggaagagagcagtctcaaacagcaggtagaacaatccagtgcttcccagacaggaatcaagcagctcccttctgctagcaccggcatacctactgcttctaccacttcagcttcagtttctacacaagtagaacctgaagaacctgaggcagatcaacatcaacaactacagtaccagcaacccagtatatctgtgttatctgatgggacggttgacagtggtcagggatcctctgtcttcacagaatctcgagtgagcagccaacagacagtttcatatggttcccaacatgaacaggcacattctacaggcacagtcccagggcatataccttctactgtccaagcacagtctcagccccatggggtatatccaccctcaagtgtggcacaggggcagagccagggtcagccatcctcaagtagcttaacaggggtttcatcttcccaacccatacaacatcctcagcagcagggaatacagcagacagcccctcctcaacagacagtgcagtattcactttcacagacatcaacctccagtgaggccactactgcacagccagtgagtcagcctcaagctccacaagtcttgcctcaagtatcagctggaaaacagagtactcagggagtctctcaggttgctcctgcagagccagttgcagtagcacagacccaagctacccagccgaccactttggcttcctctgtagacagtgcacattcagatgttgcttcaggtatgagtgatggcaatgagaacgtcccatcttccagtggaaggcatgaaggaagaactacaaaacggcattaccgaaaatctgtaaggagtcgctctcgacatgaaaaaacttcacgcccaaaattaagaattttgaatgtttcaaataaaggagaccgagtagtagaatgtcaattagagactcataataggaaaatggttacattcaaatttgacctagatggtgacaaccccgaggagatagcaacaattatggtgaacaatgactttattctagcaatagagagagagtcgtttgtggatcaagtgcgagaaattattgaaaaagctgatgaaatgctcagtgaggatgtcagtgtggaaccagagggtgatcagggattggagagtctacaaggaaaggatgactatggcttttcaggttctcagaaattggaaggagagttcaaacaaccaattcctgcgtcttccatgccacagcaaataggcattcctaccagttctttaactcaagttgttcattctgcgggaaggcggtttatagtgagtcctgtgccagaaagccgattacgagaatcaaaagttttccccagtgaaataacagatacagttgctgcctctacagctcagagccctggaatgaacttgtctcactctgcatcatcccttagtctacaacaggccttttctgaacttagacgtgcccaaatgacagaaggacccaacacagcacctccaaactttagtcatacaggaccaacatttccagtagtacctcctttcttaagtagcattgctggagtcccaaccacagcagcagccacagcaccagtccctgcaacaagcagccctcctaatgacatttccacatcagtaattcagtctgaggttacagtgcccactgaagaggggattgctggagttgccaccagcacaggtgtggtaacttcaggtggtctccccataccacctgtgtctgaatcaccagtactttccagcgtagtttcaagtatcacaatacctgcagttgtctcaatatctactacatccccgtcacttcaagtccccacatccacatctgagatcgttgtttctagtacagcactgtatccttcagtaacagtttcagcaacttcagcctctgcagggggcagtactgctaccccaggtcctaagcctccagctgtagtatctcagcaggcagcaggcagcactactgtgggagccacattaacatcagtttctaccaccacttcattcccaagcacagcttcacagctgtgcattcagcttagcagcagtacttctactcctactttagctgaaaccgtggtagttagcgcacactcactagataagacatctcatagcagtacaactggattggctttctccctctctgcaccatcttcctcttcctctcctggagcaggagtgtctagttatatttctcagcctggtgggctgcatcctttggtcattccatcagtgatagcttctactcctattcttccccaagcagcaggacctacttctacacctttattaccccaagtacctagtatcccacccttggtacagcctgttgccaatgtgcctgctgtacagcagacactaattcatagtcagcctcaaccagctttgcttcccaaccagccccatactcattgtcctgaagtagattctgatacacaacccaaagctcctggaattgatgacataaagactctagaagaaaagctgcggtctctgttcagtgaacacagctcatctggagctcagcatgcctctgtctcactggagacctcactagtcatagagagcactgtcacaccaggcatcccaactactgctgttgcaccaagcaaactcctgacttctaccacaagtacttgcttaccaccaaccaatttaccactaggaacagttgctttgccagttacaccagtggtcacacctgggcaagtttctaccccagtcagcactactacatcaggagtgaaacctggaactgctccctccaagccacctctaactaaggctccggtgctgccagtgggtactgaacttccagcaggtactctacccagcgagcagctgccaccttttccaggaccttctctaacccagtcccagcaacctctagaggatcttgatgctcaattgagaagaacacttagtccagagatgatcacagtgacttctgcggttggtcctgtgtccatggcggctccaacagcaatcacagaagcaggaacacagcctcagaaggtttctcaagtcaaagaaggccctgtcctagcaactagttcaggagctggtgtttttaagatgggacgatttcaggtttctgttgcagcagacggtgcccagaaagagggtaaaaataagtcagaagatgcaaagtctgttcattttgaatccagcacctcagagtcctcagtgctatcaagtagtagtccagagagtaccttggtgaaaccagagccgaatggcataaccatccctggtatctcttcagatgtgccagagagtgcccacaaaactactgcctcagaggcaaagtcagacactgggcagcctaccaaggttggacgttttcaggtgacaactacagcaaacaaagtgggtcgtttctctgtatcaaaaactgaggacaagatcactgacacaaagaaagaaggaccagtggcatctcctccttttatggatttggaacaagctgttcttcctgctgtgataccaaagaaagagaagcctgaactgtcagagccttcacatctaaatgggccgtcttctgacccggaggccgcttttttaagtagggatgtggatgatggttccggtagtccacactcgccccatcagctgagctcaaagagccttcctagccagaatctaagtcaaagccttagtaattcatttaactcctcttacatgagtagcgacaatgagtcagatatcgaagatgaagacttaaagttagagctgcgacgactacgagataaacatctcaaagagattcaggacctgcagagtcgccagaagcatgaaattgaatctttgtataccaaactgggcaaggtgccccctgctgttattattcccccagctgctcccctttcagggagaagacgacgacccactaaaagcaaaggcagcaaatctagtcgaagcagttccttggggaataaaagcccccagctttcaggtaacctgtctggtcagagtgcagcttcagtcttgcacccccagcagaccctccaccctcctggcaacatcccagagtccgggcagaatcagctgttacagccccttaagccatctccctccagtgacaacctctattcagccttcaccagtgatggtgccatttcagtaccaagcctttctgctccaggtcaaggaaccagcagcacaaacactgttggggcaacagtgaacagccaagccgcccaagctcagcctcctgccatgacgtccagcaggaagggcacattcacagatgacttgcacaagttggtagacaattgggcccgagatgccatgaatctctcaggcaggagaggaagcaaagggcacatgaattacgagggccctggaatggcaaggaagttctctgcacctgggcaactgtgcatctccatgacctcgaacctgggtggctctgcccccatctctgcagcatcagctacctctctaggtcacttcaccaagtctatgtgccccccacagcagtatggctttccagctaccccatttggcgctcaatggagtgggacgggtggcccagcaccacagccacttggccagttccaacctgtgggaactgcctccttgcagaatttcaacatcagcaatttgcagaaatccatcagcaaccccccaggctccaacctgcggaccacttagacctagagacattaactgaatagatctgggggcaggagatggaatgctgagggggtgggtgggggtgggaagtagcctatatactaactactagtgctgcatttaactggttatttcttgccagaggggaatgtttttaatactgcattgagccctcagaatggagagtctcccccgctccagttattggaatgggagaggaaggaaagaacagcttttttgtcaaggggcagcttcagaccatgctttcctgtttatctatactcagtaatgaggatgagggctaggaaagtcttgttcataaggaagctggagaactcaatgtaaaatcaaacccatctgtaatttcgagtgggtggagctcttgcttttggtacatgccctgaatccctcactccctcaagaatccgaaccacaggacaaaaaccacctactgggctctctcctaccctgccctcctcccttttttttacccctctcttttttattttttctttgctctttagaacccagtgaaaaataccagggtactggggtgcaactctttcttatgataggtcattagtgctttaagcaaaagatattagcagctttgactgcagcattagcaattaggaaaaaaaaaaaattaagttccctgcggacatgtaactttgccatcagttttgatgtggaaacactgtgatatataaaatgttgttggacaacagtagttttaagagtaaaatatgaaacgtttaaaaagttccaaaaaaagctagctctgtcctttacttattgagacactttaactttttcctttgtatttccattgtattagataaataaatgtgaatgtaaaattgtataaattactgtacttgaatacttctgtttcccagtgttgcttgctggacattttagtgccttggacttctattgcttctgccattagcatcaacttaccagaccccagatcaataaagggcatgtggaaggaaatcgtaggtccatgtgaccccagcagtccagcagtggttatgccaaagggaaattgaaaaagtatttttttaagtcattcaacaactttgtctagagcaggtgtaagatgagtagggtgggaagttaggttggcatcagtggttaaaaacagaaagttctgtttcgggaatagtgaggagggggtgttgtaacaaaattggacaacttaaaagaatggtgtgtgctgggtgaaagacaaagactaaagaatgaggaaacaaacgtgatgcctggccagtgactgtcatataaacctttcttatttgagctaggcttgaacagacgtgacctagaagaaactgaacataaagagaagggggtggggggctagttttcaagttggggaacctgatagtgaaaagtcacagatggagaaaattgctctcagaaaaactgtttggattgctttcctcttgttgcacatgtaccatgcatttctcagcttggggtactacattttgtggaaagttaatctatctatctttccacatctgaattaatcattctaggaaagaatacttattcctactcatttcctttatgatgtccaaatggttgcaggatcataatctattgtgccacctttatttctagaagtacaactaatatgttcacattttcaaataaataatactccccgtaagtaataactgcaaccaatcagtgttattcagtgctatgcctccttgtaatgggtagttattaattattttcagagctttccggaaatactgtcctaactggctatgtttaggatctttgttatctctgaagacaaagaaagaagctaggactcttaattttggggtgcttcttgactcttagttgggaaactgaaaatatttccaaccttttacccacgtcaatggcatattctgggaatcaccaccaccaccaccactaccacagaaagaggctggaggctcctgtaccctgttcattccttaagggccctgcttcccttagtaagtaagtaagttggtctacggccctaaatatgcaaatgagagctgaaggtttttaaaaggtagaaaggaaaagggcaagggcttccacccctgctttaaaatgatttatttattctctgcttgtatttcttgtggagagagtaaggatagaaccaacaaggggctgagtagctgagaaaggggccacccaagagtgaaacatactttataccagaggagcagtggagcctcatgcagcacattatcatttgttatttgggtttaataataattttgacatcttttcactcatacacaaaaaaagtcagaactggtgttatttactgttgatttcatcctcctgtgtatgaaataacaagcctagaggaatgaactagtgctactgaactgtttaaattatttttgtgttaatagtacactttgagtatctttttccacattaaaaactttctgaattataaatgttttccttacattatttaacaatgtacactgttaaaaataaaaataaaaattcaaa

SEQ ID NO: 200213 - DNA, 11232 bp, Homo sapiens
  Payload ID: 19503
  Gene Name: WNK lysine deficient protein kinase 1
  Uniprot ID: Q9H4A3
  ENST ID: ENST00000537687
  CDS Start-End: 644-8572
ccggcccttcgcctctgggcgatgggcgacctgtgaggccggtccccatcgctgggggcgcgtgtgggaggaggcggccgcccgagtgaccgggagccgggccgcggccttccctcgcccgcctcggcccctcccactcctctgccccggggccgccaccgcccgggcgtcggacctggtcccgtgctcgcggtgccgccgccctctgggcctagcccgcccagctcggcgagcggcggcagtgggagccgcgtccgccgcatccgcctcgactcggtgccggcccctggccctcccctcatgactgcggcgcctctgctgccaccgcccgcccggccgccgctcgccgcaggatggatgcggaccgtgcggcgctaacccccgtggctcagctcccgaatcgcccgccttcgagccctcctcgtgagccgcagcagcctcggtgccagcccccgccgcagctgggcccagcggtccgcctgtccctcgttgcggcttgtcggtgctgagtgaggcgtcgtccgggtcggcgcgaacccgcccggccgcggttccctgcagacctctgcgcgggcggctcggcccttcacgcccttttcgttcacgaatccgagcccgctcgcctctctccagcgaaccgaccatgtctggcggcgccgcagagaagcagagcagcactcccggttccctgttcctctcgccgccggctcctgcccccaagaatggctccagctccgattcctccgtgggggagaaactgggagccgcggccgccgacgctgtgaccggcaggaccgaggagtacaggcgccgccgccacactatggacaaggacagccgtggggcggccgcgaccactaccaccactgagcaccgcttcttccgccggagcgtcatctgtgactccaatgccactgcactggagcttcccggccttcctctttccctgccccagcccagcatccccgcggctgtcccgcagagtgctccaccggagccccaccgggaagagaccgtgaccgccaccgccacttcccaggtagcccagcagcctccagccgctgccgcccctggggaacaggccgtcgcgggccctgccccctcgactgtccccagcagtaccagcaaagaccgcccagtgtcccagcctagccttgtggggagcaaagaggagccgccgccggcgagaagtggcagcggcggcggcagcgccaaggagccacaggaggaacggagccagcagcaggatgatatcgaagagctggagaccaaggccgtgggaatgtctaacgatggccgctttctcaagtttgacatcgaaatcggcagaggctcctttaagacggtctacaaaggtctggacactgaaaccaccgtggaagtcgcctggtgtgaactgcaggatcgaaaattaacaaagtctgagaggcagagatttaaagaagaagctgaaatgttaaaaggtcttcagcatcccaatattgttagattttatgattcctgggaatccacagtaaaaggaaagaagtgcattgttttggtgactgaacttatgacgtctggaacacttaaaacgtatctgaaaaggtttaaagtgatgaagatcaaagttctaagaagctggtgccgtcagatccttaaaggtcttcagtttcttcatactcgaactccacctatcattcaccgcgatcttaaatgtgacaacatctttatcaccggccctactggctcagtcaagattggagacctcggtctggcaaccctgaagcgggcttcttttgccaagagtgtgataggtaccccagagttcatggcccctgagatgtatgaggagaaatatgatgaatccgttgacgtttatgcttttgggatgtgcatgcttgagatggctacatctgaatatccttactcggagtgccaaaatgctgcacagatctaccgtcgcgtgaccagtggggtgaagccagccagttttgacaaagtagcaattcctgaagtgaaggaaattattgaaggatgcatacgacaaaacaaagatgaaagatattccatcaaagaccttttgaaccatgccttcttccaagaggaaacaggagtacgggtagaattagcagaagaagatgatggagaaaaaatagccataaaattatggctacgtattgaagatattaagaaattaaagggaaaatacaaagataatgaagctattgagttttcttttgatttagagagagatgtcccagaagatgttgcacaagaaatggtagagtctgggtatgtctgtgaaggtgatcacaagaccatggctaaagctatcaaagacagagtatcattaattaagaggaaacgagagcagcggcagttggtacgggaggagcaagaaaaaaaaaagcaggaagagagcagtctcaaacagcaggtagaacaatccagtgcttcccagacaggaatcaagcagctcccttctgctagcaccggcatacctactgcttctaccacttcagcttcagtttctacacaagtagaacctgaagaacctgaggcagatcaacatcaacaactacagtaccagcaacccagtatatctgtgttatctgatgggacggttgacagtggtcagggatcctctgtcttcacagaatctcgagtgagcagccaacagacagtttcatatggttcccaacatgaacaggcacattctacaggcacagtcccagggcatataccttctactgtccaagcacagtctcagccccatggggtatatccaccctcaagtgtgcctcagtccatggcgcatccgtgtggggggaccccaacatacccagaatcacagatatttttcccaactattcatgaacgtccagtttctttttcaccacctcccacctgcccaccgaaagtagccatttcccagcggcgtaagagcacctccttcctggaagcccaaactcaccacttccaacccctgctgaggactgttggccaaagtcttcttccacctggtggcagcccaactaactggacaccagaggccgtagttatgttgggtactacagccagtagagtaactggagagtcatgtgagatacaggtccatcctatgtttgaaccatctcaagtttacagtgactatagacctggactagtacttccagaagaagctcactattttattcctcaggaagcagtgtatgtagctggggtacattaccaggcccgggtggcagaacagtatgagggcattccatacaactcatcagtactgtcaagtcctatgaaacagatacctgaacagaagccagtacaagggggccctacttcaagttctgtctttgaatttccatctggacaggctttcctggtaggacaccttcagaatctaagattagattctggattgggtccgggatctcccctctctagtatttctgcacctatcagtacagatgctacacgtttgaaatttcaccctgtctttgttcctcattctgcgcctgctgtgttaactcataacaatgagagcagaagcaactgtgtatttgaatttcatgttcacacaccaagctcctcttcaggagaaggaggtggaattttacctcagcgtgtttaccgaaatcggcaggttgcagtggacttgaatcaagaagaactgcctcctcaatcagttggattacatggctacttgcagcctgtgactgaagaaaagcataattaccatgccccagaattgaccgtttctgtggtagagcctatcggacagaactggccaataggaagcccagaatattccagtgattcctcacaaatcacttcttcagaccccagtgattttcagtcacctccccctacagggggagcagctgcaccttttggctctgacgtctcaatgccctttatccatctgcctcagacagtgttacaagaatccccacttttcttctgtttcccccaaggaaccacatctcagcaggtcttaactgcctcattttcttcaggaggatctgcacttcatccacaggcacaggggcagagccagggtcagccatcctcaagtagcttaacaggggtttcatcttcccaacccatacaacatcctcagcagcagcagggaatacagcagacagcccctcctcaacagacagtgcagtattcactttcacagacatcaacctccagtgaggccactactgcacagccagtgagtcagcctcaagctccacaagtcttgcctcaagtatcagctggaaaacagggcttcccacctcgactgccaccacagtacccaggagattcaaatattgctccctcttccaacgtggcttctgtttgcatccattctacagtcctatcccctcccatgccgacagaagtactggctacacctgggtactttcccacagtggtgcagccttatgtggaatcaaatcttttagttcctatgggtggtgtaggaggacaggttcaagtgtcccagccaggagggagtttagcacaagcccccactacatcctcccagcaagcagttttggagagtactcagggagtctctcaggttgctcctgcagagccagttgcagtagcacagacccaagctacccagccgaccactttggcttcctctgtagacagtgcacattcagatgttgcttcaggtatgagtgatggcaatgagaacgtcccatcttccagtggaaggcatgaaggaagaactacaaaacggcattaccgaaaatctgtaaggagtcgctctcgacatgaaaaaacttcacgcccaaaattaagaattttgaatgtttcaaataaaggagaccgagtagtagaatgtcaattagagactcataataggaaaatggttacattcaaatttgacctagatggtgacaaccccgaggagatagcaacaattatggtgaacaatgactttattctagcaatagagagagagtcgtttgtggatcaagtgcgagaaattattgaaaaagctgatgaaatgctcagtgaggatgtcagtgtggaaccagagggtgatcagggattggagagtctacaaggaaaggatgactatggcttttcaggttctcagaaattggaaggagagttcaaacaaccaattcctgcgtcttccatgccacagcaaataggcattcctaccagttctttaactcaagttgttcattctgcgggaaggcggtttatagtgagtcctgtgccagaaagccgattacgagaatcaaaagttttccccagtgaaataacagatacagttgctgcctctacagctcagagccctggaatgaacttgtctcactctgcatcatcccttagtctacaacaggccttttctgaacttagacgtgcccaaatgacagaaggacccaacacagcacctccaaactttagtcatacaggaccaacatttccagtagtacctcctttcttaagtagcattgctggagtcccaaccacagcagcagccacagcaccagtccctgcaacaagcagccctcctaatgacatttccacatcagtaattcagtctgaggttacagtgcccactgaagaggggattgctggagttgccaccagcacaggtgtggtaacttcaggtggtctccccataccacctgtgtctgaatcaccagtactttccagcgtagtttcaagtatcacaatacctgcagttgtctcaatatctactacatccccgtcacttcaagtccccacatccacatctgagatcgttgtttctagtacagcactgtatccttcagtaacagtttcagcaacttcagcctctgcagggggcagtactgctaccccaggtcctaagcctccagctgtagtatctcagcaggcagcaggcagcactactgtgggagccacattaacatcagtttctaccaccacttcattcccaagcacagcttcacagctgtgcattcagcttagcagcagtacttctactcctactttagctgaaaccgtggtagttagcgcacactcactagataagacatctcatagcagtacaactggattggctttctccctctctgcaccatcttcctcttcctctcctggagcaggagtgtctagttatatttctcagcctggtgggctgcatcctttggtcattccatcagtgatagcttctactcctattcttccccaagcagcaggacctacttctacacctttattaccccaagtacctagtatcccacccttggtacagcctgttgccaatgtgcctgctgtacagcagacactaattcatagtcagcctcaaccagctttgcttcccaaccagccccatactcattgtcctgaagtagattctgatacacaacccaaagctcctggaattgatgacataaagactctagaagaaaagctgcggtctctgttcagtgaacacagctcatctggagctcagcatgcctctgtctcactggagacctcactagtcatagagagcactgtcacaccaggcatcccaactactgctgttgcaccaagcaaactcctgacttctaccacaagtacttgcttaccaccaaccaatttaccactaggaacagttgctttgccagttacaccagtggtcacacctgggcaagtttctaccccagtcagcactactacatcaggagtgaaacctggaactgctccctccaagccacctctaactaaggctccggtgctgccagtgggtactgaacttccagcaggtactctacccagcgagcagctgccaccttttccaggaccttctctaacccagtcccagcaacctctagaggatcttgatgctcaattgagaagaacacttagtccagagatgatcacagtgacttctgcggttggtcctgtgtccatggcggctccaacagcaatcacagaagcaggaacacagcctcagaagggtgtttctcaagtcaaagaaggccctgtcctagcaactagttcaggagctggtgtttttaagatgggacgatttcaggtttctgttgcagcagacggtgcccagaaagagggtaaaaataagtcagaagatgcaaagtctgttcattttgaatccagcacctcagagtcctcagtgctatcaagtagtagtccagagagtaccttggtgaaaccagagccgaatggcataaccatccctggtatctcttcagatgtgccagagagtgcccacaaaactactgcctcagaggcaaagtcagacactgggcagcctaccaaggttggacgttttcaggtgacaactacagcaaacaaagtgggtcgtttctctgtatcaaaaactgaggacaagatcactgacacaaagaaagaaggaccagtggcatctcctccttttatggatttggaacaagctgttcttcctgctgtgataccaaagaaagagaagcctgaactgtcagagccttcacatctaaatgggccgtcttctgacccggaggccgcttttttaagtagggatgtggatgatggttccggtagtccacactcgccccatcagctgagctcaaagagccttcctagccagaatctaagtcaaagccttagtaattcatttaactcctcttacatgagtagcgacaatgagtcagatatcgaagatgaagacttaaagttagagctgcgacgactacgagataaacatctcaaagagattcaggacctgcagagtcgccagaagcatgaaattgaatctttgtataccaaactgggcaaggtgccccctgctgttattattcccccagctgctcccctttcagggagaagacgacgacccactaaaagcaaaggcagcaaatctagtcgaagcagttccttggggaataaaagcccccagctttcaggtaacctgtctggtcagagtgcagcttcagtcttgcacccccagcagaccctccaccctcctggcaacatcccagagtccgggcagaatcagctgttacagccccttaagccatctccctccagtgacaacctctattcagccttcaccagtgatggtgccatttcagtaccaagcctttctgctccaggtcaaggaaccagcagcacaaacactgttggggcaacagtgaacagccaagccgcccaagctcagcctcctgccatgacgtccagcaggaagggcacattcacagatgacttgcacaagttggtagacaattgggcccgagatgccatgaatctctcaggcaggagaggaagcaaagggcacatgaattacgagggccctggaatggcaaggaagttctctgcacctgggcaactgtgcatctccatgacctcgaacctgggtggctctgcccccatctctgcagcatcagctacctctctaggtcacttcaccaagtctatgtgccccccacagcagtatggctttccagctaccccatttggcgctcaatggagtgggacgggtggcccagcaccacagccacttggccagttccaacctgtgggaactgcctccttgcagaatttcaacatcagcaatttgcagaaatccatcagcaaccccccaggctccaacctgcggaccacttagacctagagacattaactgaatagatctgggggcaggagatggaatgctgagggggtgggtgggggtgggaagtagcctatatactaactactagtgctgcatttaactggttatttcttgccagaggggaatgtttttaatactgcattgagccctcagaatggagagtctcccccgctccagttattggaatgggagaggaaggaaagaacagcttttttgtcaaggggcagcttcagaccatgctttcctgtttatctatactcagtaatgaggatgagggctaggaaagtcttgttcataaggaagctggagaactcaatgtaaaatcaaacccatctgtaatttcgagtgggtggagctcttgcttttggtacatgccctgaatccctcactccctcaagaatccgaaccacaggacaaaaaccacctactgggctctctcctaccctgccctcctcccttttttttacccctctcttttttattttttctttgctctttagaacccagtgaaaaataccagggtactggggtgcaactctttcttatgataggtcattagtgctttaagcaaaagatattagcagctttgactgcagcattagcaattaggaaaaaaaaaaaattaagttccctgcggacatgtaactttgccatcagttttgatgtggaaacactgtgatatataaaatgttgttggacaacagtagttttaagagtaaaatatgaaacgtttaaaaagttccaaaaaaagctagctctgtcctttacttattgagacactttaactttttcctttgtatttccattgtattagataaataaatgtgaatgtaaaattgtataaattactgtacttgaatacttctgtttcccagtgttgcttgctggacattttagtgccttggacttctattgcttctgccattagcatcaacttaccagaccccagatcaataaagggcatgtggaaggaaatcgtaggtccatgtgaccccagcagtccagcagtggttatgccaaagggaaattgaaaaagtatttttttaagtcattcaacaactttgtctagagcaggtgtaagatgagtagggtgggaagttaggttggcatcagtggttaaaaacagaaagttctgtttcgggaatagtgaggagggggtgttgtaacaaaattggacaacttaaaagaatggtgtgtgctgggtgaaagacaaagactaaagaatgaggaaacaaacgtgatgcctggccagtgactgtcatataaacctttcttatttgagctaggcttgaacagacgtgacctagaagaaactgaacataaagagaagggggtggggggctagttttcaagttggggaacctgatagtgaaaagtcacagatggagaaaattgctctcagaaaaactgtttggattgctttcctcttgttgcacatgtaccatgcatttctcagcttggggtactacattttgtggaaagttaatctatctatctttccacatctgaattaatcattctaggaaagaatacttattcctactcatttcctttatgatgtccaaatggttgcaggatcataatctattgtgccacctttatttctagaagtacaactaatatgttcacattttcaaataaataatactccccgtaagtaataactgcaaccaatcagtgttattcagtgctatgcctccttgtaatgggtagttattaattattttcagagctttccggaaatactgtcctaactggctatgtttaggatctttgttatctctgaagacaaagaaagaagctaggactcttaattttggggtgcttcttgactcttagttgggaaactgaaaatatttccaaccttttacccacgtcaatggcatattctgggaatcaccaccaccaccaccactaccacagaaagaggctggaggctcctgtaccctgttcattccttaagggccctgcttcccttagtaagtaagtaagttggtctacggccctaaatatgcaaatgagagctgaaggtttttaaaaggtagaaaggaaaagggcaagggcttccacccctgctttaaaatgatttatttattctctgcttgtatttcttgtggagagagtaaggatagaaccaacaaggggctgagtagctgagaaaggggccacccaagagtgaaacatactttataccagaggagcagtggagcctcatgcagcacattatcatttgttatttgggtttaataataattttgacatcttttcactcatacacaaaaaaagtcagaactggtgttatttactgttgatttcatcctcctgtgtatgaaataacaagcctagaggaatgaactagtgctactgaactgtttaaattatttttgtgttaatagtacactttgagtatctttttccacattaaaaactttctgaattataaatgttttccttacattatttaacaatgtacactgttaaaaataaaaataaaaattcaaactttgggggtttctcagcagccgttaattgtacattttgcactaactctgggtgttgcgcttcttgtaagattgcgctttgtgcttcagtttgttacctttgtagacttatttaatgaaaccattcaaataaaccaaacttgcttttgttga

SEQ ID NO: 200214 - DNA, 584 bp, Homo sapiens
  Payload ID: 19503
  Gene Name: WNK lysine deficient protein kinase 1
  ENST ID: ENST00000534872
  CDS Start-End: 1-584
accactttggcttcctctgtagacagtgcacattcagatgttgcttcaggtatgagtgatggcaatgagaacgtcccatcttccagtggaaggcatgaaggaagaactacaaaacggcattaccgaaaatctgtaaggagtcgctctcgacatgaaaaaacttcacgcccaaaattaagaattttgaatgtgaacaatgactttattctagcaatagagagagagtcgtttgtggatcaagtgcgagaaattattgaaaaagctgatgaaatgctcagtgaggatgtcagtgtggaaccagagggtgatcagggattggagagtctacaaggaaaggatgactatggcttttcaggttctcagaaattggaaggagagttcaaacaaccaattcctgcgtcttccatgccacagcaaataggcattcctaccagttctttaactcaagttgttcattctgcgggaaggcggtttatagtgagtcctgtgccagaaagccgattacgagaatcaaaagttttccccagtgaaataacagatacagttgctgcctctacagctcagagccctggaatgaacttgtc

SEQ ID NO: 200215 - DNA, 528 bp, Homo sapiens
  Payload ID: 19503
  Gene Name: WNK lysine deficient protein kinase 1
  ENST ID: ENST00000545285
  CDS Start-End: 1-528
tgaacaggcacattctacaggcacagtcccagggcatataccttctactgtccaagcacagtctcagccccatggggtatatccaccctcaagtgtggcacaggggcagagccagggtcagccatcctcaagtagcttaacaggggtttcatcttcccaacccatacaacatcctcagcagcagcagggaatacagcagacagcccctcctcaacagacagtgcagtattcactttcacagacatcaacctccagtgaggccactactgcacagccagtgagtcagcctcaagctccacaagtcttgcctcaagtatcagctggaaaacagggcttcccacctcgactgccaccacagtacccaggagattcaaatattgctccctcttccaacgtggcttctgtttgcatccattctacagtcctatcccctcccatgccgacagaagtactggctacacctgggtactttcccacagtggtgcagccttatgtggaatcaaatcttttagttcctatgggtggtgt

SEQ ID NO: 200216 - DNA, 722 bp, Homo sapiens
  Payload ID: 19503
  Gene Name: WNK lysine deficient protein kinase 1
  ENST ID: ENST00000574679
  CDS Start-End: 1-722
cctcattctgcgcctgctgtgttaactcataacaatgagagcagaagcaactgtgtatttgaatttcatgttcacacaccaagctcctcttcaggagaaggaggtggaattttacctcagcgtgtttaccgaaatcggcaggttgcagtggacttgaatcaagaagaactgcctcctcaatcagttggattacatggctacttgcagcctgtgactgaagaaaagcataattaccatgccccagaattgaccgtttctgtggtagagcctatcggacagaactggccaataggaagcccagaatattccagtgattcctcacaaatcacttcttcagaccccagtgattttcagtcacctccccctacagggggagcagctgcaccttttggctctgacgtctcaatgccctttatccatctgcctcagacagtgttacaagaatccccacttttcttctgtttcccccaaggaaccacatctcagcaggtcttaactgcctcattttcttcaggaggatctgcacttcatccacaggcacaggggcagagccagggtcagccatcctcaagtagcttaacaggggtttcatcttcccaacccatacaacatcctcagcagcagcagggaatacagcagacagcccctcctcaacagacagtgcagtattcactttcacagacatcaacctccagtgaggccactactgcacagccagtgag

SEQ ID NO: 200217 - DNA, 1401 bp, Homo sapiens
  Payload ID: 19503
  Gene Name: WNK lysine deficient protein kinase 1
  ENST ID: ENST00000574564
  CDS Start-End: 37-1341
cccagttgtgcatgtctgatgtaatttcacatatgaatgtatgaattacttgtcttattcatgttgatacagcctcagtccatggcgcatccgtgtggggggaccccaacatacccagaatcacagatatttttcccaactattcatgaacgtccagtttctttttcaccacctcccacctgcccaccgaaagtagccatttcccagcggcgtaagagcacctccttcctggaagcccaaactcaccacttccaacccctgctgaggactgttggccaaagtcttcttccacctggtggcagcccaactaactggacaccagaggccgtagttatgttgggtactacagccagtagagtaactggagagtcatgtgagatacaggtccatcctatgtttgaaccatctcaagtttacagtgactatagacctggactagtacttccagaagaagctcactattttattcctcaggaagcagtgtatgtagctggggtacattaccaggcccgggtggcagaacagtatgagggcattccatacaactcatcagtactgtcaagtcctatgaaacagatacctgaacagaagccagtacaagggggccctacttcaagttctgtctttgaatttccatctggacaggctttcctggtaggacaccttcagaatctaagattagattctggattgggtccgggatctcccctctctagtatttctgcacctatcagtacagatgctacacgtttgaaatttcaccctgtctttgttcctcattctgcgcctgctgtgttaactcataacaatgagagcagaagcaactgtgtatttgaatttcatgttcacacaccaagctcctcttcaggagaaggaggtggaattttacctcagcgtgtttaccgaaatcggcaggttgcagtggacttgaatcaagaagaactgcctcctcaatcagttggattacatggctacttgcagcctgtgactgaagaaaagcataattaccatgccccagaattgaccgtttctgtggtagagcctatcggacagaactggccaataggaagcccagaatattccagtgattcctcacaaatcacttcttcagaccccagtgattttcagtcacctccccctacagggggagcagctgcaccttttggctctgacgtctcaatgccctttatccatctgcctcagacagtgttacaagaatccccacttttcttctgtttcccccaaggaaccacatctcagcaggtcttaactgcctcattttcttcaggaggatctgcacttcatccacaggttataggaaaacttccacaattattttaaactaccctactttgcaccataacatttaaattttctattccttatttccctgaatcatgg

SEQ ID NO: 200218 - DNA, 7138 bp, Homo sapiens
  Payload ID: 19504
  Gene Name: WNK lysine deficient protein kinase 2
  Uniprot ID: Q9Y3S1
  ENST ID: ENST00000297954
  CDS Start-End: 1-6894
atggacggcgatggcggccgccgagacgtccccggcacgctgatggagcccgggcgcggcgcggggcccgcgggcatggcggagcctcgggcgaaggcggcgcggccggggccccagcgctttctgcggcgcagcgtggtagagtcggaccaggaggagccgccgggcttggaggcagccgaggcgccgggcccgcagcccccgcagcccctgcagcgccgggtgcttctgctctgcaagacgcgccgcctcatcgcggagcgcgcccgcggacgccccgccgcccccgcgcccgcagcgctggtagcgcagccgggagcccccggagcccccgcggacgccggccccgagcccgtgggcacgcaggagcccggcccggaccccatcgcagccgctgtcgaaaccgcgcctgcccccgacggcggccccagggaggaggcggcggcgaccgtgaggaaggaggatgagggggcggccgaggcgaagcctgagcccgggcgcactcgccgggacgagcccgaagaggaggaggacgacgaggacgacctcaaggccgtggccacctctctggacggccgcttcctcaagttcgacatcgagctgggccgcggttccttcaagacggtctacaaggggctggacacggagacctgggtggaggtggcctggtgtgagctgcaggaccggaagctcaccaagctggagcggcagcggttcaaggaagaggctgagatgctgaaaggcctgcagcaccccaacatcgtgcgcttctacgacttctgggagtccagcgccaagggcaagcggtgcattgtgctggtgacggagctgatgacctcagggacgctgaagacatacctgaagcggttcaaggtgatgaagcccaaggttctccgcagctggtgccggcagatcctgaagggcctgctgttcctgcacacaaggacgccacccatcatccaccgagacctgaaatgtgacaatattttcatcaccggaccaactgggtctgtgaagattggcgacttgggcctggccactctgaaaagagcgtcatttgccaaaagtgtgataggtactcccgagttcatggcgcccgagatgtacgaggagcactacgatgagtccgtggacgtctatgcctttgggatgtgcatgctggagatggccacctcggagtacccctactcggagtgccagaatgcggcccagatctaccgcaaggtcacctgtggtatcaagccggccagctttgagaaagtgcacgatcctgaaatcaaggagattattggggagtgtatctgcaaaaacaaggaggaaaggtacgagatcaaagacctgctgagccacgccttcttcgcagaggacacaggcgtgagggtggagctcgcggaggaggaccacggcaggaagtccaccatcgccctgaggctctgggtggaagaccccaagaaactgaagggaaagcccaaggacaatggagccatagagttcaccttcgacctggagaaggagacgccggatgaggtggcccaagagatgattgagtctggattcttccacgagagtgacgtcaagatcgtggccaagtccatccgtgaccgcgtggccttgatccagtggcggcgggagaggatctggcccgcgctgcagcccaaggagcagcaggatgtgggcagcccggacaaggccaggggtccgccggtgcccctgcaggtccaggtgacctaccatgcacaggctgggcagcccgggccaccagagcccgaggagccggaggccgaccagcacctcctgccacctacgttgccgaccagcgccacctccctggcctcggacagcaccttcgacagcggccagggctctaccgtgtactcagactcgcagagcagccagcagagcgtgatgcttggctcccttgccgacgcagcgccgtccccggcccagtgtgtgtgcagcccccctgtgagcgaggggcccgtcctgccgcagagcctgccctcgctgggggcctaccagcagcccacggctgcacctggcttgccggtgggctctgtcccggcccccgcctgccctccgtccctccagcagcacttcccggatccggccatgagcttcgcccccgtgctgccgccgcccagcacccccatgcccacgggcccaggccagccagcaccccccggccagcagcctcctccgctggcccagccgacacccctgccgcaggtcctggccccacagcccgtggtccccctccagccggttcccccccacctgccaccgtacctggctccagcctcccaggtgggggcccccgctcagctgaagcccctccagatgccacaggcgcccctgcagccgcttgctcaagtccctccgcagatgcccccgattcctgttgtgccccccatcacgcccctggcgggaatcgacggcctccctccggccctcccagacctgccgaccgcgactgtgcctcccgtgccaccacctcagtatttctctccagccgtgatcttgccgagcctcgctgccccactcccccctgcgtccccagccttgcctctgcaggctgtgaagctgccccacccccctggggcgcccctggccatgccctgccggaccattgtgccaaatgcaccggccactatccccctgctggccgtagccccaccgggcgtggctgccctgtccattcattctgccgtggcccagctcccaggccaacctgtgtacccagcggccttcccacagatggcgcctactgacgtccctccttccccccatcacacggtgcagaatatgagggccacccctccacagccggcactgcctccacaacccacactgcccccacaacccgtgctgcccccgcaacccacgctgccccctcaacctgtgttgcccccgcaacccacacggccccctcaacctgtgctgcccccgcaacccatgctgcccccacaacctgtgctgcccccgcagccggcactgcctgtgcgccctgagcccctccagccccaccttcctgaacaagctgctccagctgctacaccagggagccagattctgcttggccacccagctccctatgctgtggacgtcgccgctcaggtccccaccgtgcctgtgccaccggctgcggtcctctcgccgcctctgccggaagtgctgctgcctgccgcccctgagctcctgcctcagttccccagctccctggccacggtgtctgcctctgtgcagagtgtgcccacccagactgccacacttctgccaccagcaaacccaccgctgcctggcgggcccgggatcgccagcccttgcccaactgtccagctgacggtggaaccagtccaagaggagcaggcctcacaggacaagccgcccggcctcccgcagagctgtgagagctatggaggttctgatgtcacttctggaaaagagctgagtgacagctgtgaaggcgcctttggagggggcaggctggagggcagggcagcccgaaaacaccaccgcaggtccacgcgtgcgcgctcccggcaggagagggccagccggccccggcttaccatcttgaacgtgtgcaacactggggacaagatggtggagtgccagctggagacgcacaaccacaagatggtgaccttcaagttcgacttggacggggacgcacccgatgaaattgccacgtatatggtggagcatgactttatcctgcaggccgagcgggaaacgttcatcgagcagatgaaggatgtcatggacaaggcagaggacatgctcagcgaggacacagacgccgaccgtggctccgacccagggaccagcccgccacacctcagcacctgcggcctgggcaccggggaggagagccgacaatcccaagccaacgcccccgtgtatcagcagaacgtcctgcacaccgggaagaggtggttcatcatctgtccggtggctgagcaccccgcccccgaggcccctgaatcttcgcccccacttcctctaagctccctgccgccagaagccagccaaggtccatgcagggggctcaccctgccctgtctcccatggcgcagagcagcctgtggggctgtgttcctatccttgttttctgctgaatcagctcagtcaaagcagcctccagattcagcgccctataaagaccagctgtcctcgaaggaacaacccagctttctagccagtcagcagctcctgagccaggcgggccccagcaaccctcctggggcacccccagcccctttggccccctcctcccctcctgtgactgctctgccccaagatggagcagctccagccaccagcaccatgccagagccagcgtcaggaactgccagccaggcagggggtccagggacacctcaggggctgaccagtgagctcgagacgtctcagccactagcggagactcacgaggccccgcttgctgtgcagcccctcgtggtgggcctagcaccttgcactccagctccagaggctgcctcaaccagggacgccagtgccccaagggagcccctgccacctcctgcacctgagcccagcccccacagcgggaccccacagcccgccttgggtcaacctgctcccctgcttcctgccgcagtgggggccgtcagcctggccacctcccagctcccaagcccacccctggggcccaccgtccccccacagccaccctcggccctggagtcggatggggaagggccgccccccagggtgggctttgtggacagcaccatcaagagcctggacgagaagctgcggactctgctctaccaggagcacgtgcccacctcctcagcctcagctgggacccctgtggaggtgggcgacagagacttcaccctggagcccctgagaggggaccagccccgctcagaggtctgcgggggggacctggccctgcccccagtgcctaaggaggcggtctcagggcgtgtccagctgccccagcccttggtggagaagtcagaactggcccccactcgaggggccgtgatggagcagggcacgtcctcgtcaatgacagcagagtcgtctcccaggagtatgctaggctatgacagagatggaaggcaggtggcctcagactcccatgtggtccccagcgtcccccaggatgtacctgcttttgtgagacctgcacgtgtggagcccacagacagggatggtggagaagctggagaaagctcggcagagcccccgccgagtgacatgggcacagtggggggccaggctagccacccccagacactcggcgctcgagctttggggtcccctcggaaacgtccagagcagcaggatgtcagctcaccagccaagactgtgggccgtttctcggtggtcagcactcaggacgagtggaccctggcctccccccacagcctgagatactctgccccacccgacgtctacctggacgaggccccctccagccccgacgtgaagctggcagtgcggcgggcgcagacggcctcctccatcgaggtcggcgtgggcgagcccgtgtccagcgactctggggacgagggccctcgggcgagacccccggtgcagaagcaggcgtccctgcccgtgagtggcagcgtggctggcgacttcgtgaagaaggccaccgccttcctgcagaggccttctcgggccggctcgctgggccccgagacacccagcagggtgggcatgaaggtccccacgatcagcgtgacctccttccattcccagtcgtcctacatcagcagcgacaatgattcggagctcgaggatgctgacataaagaaggagctgcagagtctgcgggagaagcacctgaaggagatctcggagctgcagagccagcagaagcaggagatcgaagctctgtaccgccgcctgggcaagccactgccccccaacgtgggcttcttccacacggcaccccccactggccgccggagaaaaaccagcaagagcaagctgaaggcaggcaagctgctaaatcccctggtgcggcagctcaaggtcgtggcctccagcacaggtcacttggctgactccagcagaggccctcccgctaaggaccctgcccaagccagtgtggggctcactgcagacagcacgggcctgagcgggaaggcagtgcagacccagcagccctgctccgtccgggcctccctgtcttcggacatctgctccggcttagccagtgatggaggcggagcgcgtggccaaggctggacggtttaccacccaacgtctgagagagtgacctataagtctagtagcaaacctcgtgctcgattcctcagtggacccgtatctgtgtccatctggtctgccctgaagcgtctctgcctaggcaaagaacacagcagtaggtcctccaccagcagcctggccccaggccctgagccaggcccccagcccgccctgcacgtccaggcgcaggtgaacaacagcaacaacaagaagggtaccttcacggacgacctgcacaagctggtggacgagtggacgagcaagacggtgggggccgcgcagctgaagcccacgctcaaccagctgaagcagacccagaagctgcaagacatggaggcccaggcaggctgggctgcccctggcgaggcgcgggctatgaccgcacctcgagcaggagtggggatgccacgtctgcccccagcgcccggccctctgtccaccacggtcattcccggagccgccccgaccctgtccgtgcccacaccagatggcgccctcggaaccgcccggagaaaccaggtgtggtttggcctccgagtcccccccaccgcctgctgtgggcacagcactcagccgcgagggggacagcgggtgggcagcaagactgcttcctttgcggcttcagaccctgttcgctcctaggttcctgtggtccacgcgccgtctccacacccacttcctatacttgagttgatggttagaaccttgtcgtcaccctgcagaagtacagtgccttgaatgccagcttttccgttccctgatgaaaagatatgttaaaaaaaattatcggaaaaggtttcatttgcaattggcttgtgcattgataatctttatttactgttttaagttgcagagatgtgaatggtttacaaatctgaagctgaag

SEQ ID NO: 200219 - DNA, 6834 bp, Homo sapiens
  Payload ID: 19504
  Gene Name: WNK lysine deficient protein kinase 2
  ENST ID: ENST00000395477
  CDS Start-End: 1-6654
atggacggcgatggcggccgccgagacgtccccggcacgctgatggagcccgggcgcggcgcggggcccgcgggcatggcggagcctcgggcgaaggcggcgcggccggggccccagcgctttctgcggcgcagcgtggtagagtcggaccaggaggagccgccgggcttggaggcagccgaggcgccgggcccgcagcccccgcagcccctgcagcgccgggtgcttctgctctgcaagacgcgccgcctcatcgcggagcgcgcccgcggacgccccgccgcccccgcgcccgcagcgctggtagcgcagccgggagcccccggagcccccgcggacgccggccccgagcccgtgggcacgcaggagcccggcccggaccccatcgcagccgctgtcgaaaccgcgcctgcccccgacggcggccccagggaggaggcggcggcgaccgtgaggaaggaggatgagggggcggccgaggcgaagcctgagcccgggcgcactcgccgggacgagcccgaagaggaggaggacgacgaggacgacctcaaggccgtggccacctctctggacggccgcttcctcaagttcgacatcgagctgggccgcggttccttcaagacggtctacaaggggctggacacggagacctgggtggaggtggcctggtgtgagctgcaggaccggaagctcaccaagctggagcggcagcggttcaaggaagaggctgagatgctgaaaggcctgcagcaccccaacatcgtgcgcttctacgacttctgggagtccagcgccaagggcaagcggtgcattgtgctggtgacggagctgatgacctcagggacgctgaagacatacctgaagcggttcaaggtgatgaagcccaaggttctccgcagctggtgccggcagatcctgaagggcctgctgttcctgcacacaaggacgccacccatcatccaccgagacctgaaatgtgacaatattttcatcaccggaccaactgggtctgtgaagattggcgacttgggcctggccactctgaaaagagcgtcatttgccaaaagtgtgataggtactcccgagttcatggcgcccgagatgtacgaggagcactacgatgagtccgtggacgtctatgcctttgggatgtgcatgctggagatggccacctcggagtacccctactcggagtgccagaatgcggcccagatctaccgcaaggtcacctgtggtatcaagccggccagctttgagaaagtgcacgatcctgaaatcaaggagattattggggagtgtatctgcaaaaacaaggaggaaaggtacgagatcaaagacctgctgagccacgccttcttcgcagaggacacaggcgtgagggtggagctcgcggaggaggaccacggcaggaagtccaccatcgccctgaggctctgggtggaagaccccaagaaactgaagggaaagcccaaggacaatggagccatagagttcaccttcgacctggagaaggagacgccggatgaggtggcccaagagatgattgagtctggattcttccacgagagtgacgtcaagatcgtggccaagtccatccgtgaccgcgtggccttgatccagtggcggcgggagaggatctggcccgcgctgcagcccaaggagcagcaggatgtgggcagcccggacaaggccaggggtccgccggtgcccctgcaggtccaggtgacctaccatgcacaggctgggcagcccgggccaccagagcccgaggagccggaggccgaccagcacctcctgccacctacgttgccgaccagcgccacctccctggcctcggacagcaccttcgacagcggccagggctctaccgtgtactcagactcgcagagcagccagcagagcgtgatgcttggctcccttgccgacgcagcgccgtccccggcccagtgtgtgtgcagcccccctgtgagcgaggggcccgtcctgccgcagagcctgccctcgctgggggcctaccagcagcccacggctgcacctggcttgccggtgggctctgtcccggcccccgcctgccctccgtccctccagcagcacttcccggatccggccatgagcttcgcccccgtgctgccgccgcccagcacccccatgcccacgggcccaggccagccagcaccccccggccagcagcctcctccgctggcccagccgacacccctgccgcaggtcctggccccacagcccgtggtccccctccagccggttcccccccacctgccaccgtacctggctccagcctcccaggtgggggcccccgctcagctgaagcccctccagatgccacaggcgcccctgcagccgcttgctcaagtccctccgcagatgcccccgattcctgttgtgccccccatcacgcccctggcgggaatcgacggcctccctccggccctcccagacctgccgaccgcgactgtgcctcccgtgccaccacctcagtatttctctccagccgtgatcttgccgagcctcgctgccccactcccccctgcgtccccagccttgcctctgcaggctgtgaagctgccccacccccctggggcgcccctggccatgccctgccggaccattgtgccaaatgcaccggccactatccccctgctggccgtagccccaccgggcgtggctgccctgtccattcattctgccgtggcccagctcccaggccaacctgtgtacccagcggccttcccacagatggcgcctactgacgtccctccttccccccatcacacggtgcagaatatgagggccacccctccacagccggcactgcctccacaacccacactgcccccacaacccgtgctgcccccgcaacccacgctgccccctcaacctgtgttgcccccgcaacccacacggccccctcaacctgtgctgcccccgcaacccatgctgcccccacaacctgtgctgcccccgcagccggcactgcctgtgcgccctgagcccctccagccccaccttcctgaacaagctgctccagctgctacaccagggagccagattctgcttggccacccagctccctatgctgtggacgtcgccgctcaggtccccaccgtgcctgtgccaccggctgcggtcctctcgccgcctctgccggaagtgctgctgcctgccgcccctgagctcctgcctcagttccccagctccctggccacggtgtctgcctctgtgcagagtgtgcccacccagactgccacacttctgccaccagcaaacccaccgctgcctggcgggcccgggatcgccagcccttgcccaactgtccagctgacggtggaaccagtccaagaggagcaggcctcacaggacaagccgcccggcctcccgcagagctgtgagagctatggaggttctgatgtcacttctggaaaagagctgagtgacagctgtgaaggcgcctttggagggggcaggctggagggcagggcagcccgaaaacaccaccgcaggtccacgcgtgcgcgctcccggcaggagagggccagccggccccggcttaccatcttgaacgtgtgcaacactggggacaagatggtggagtgccagctggagacgcacaaccacaagatggtgaccttcaagttcgacttggacggggacgcacccgatgaaattgccacgtatatggtggagcatgactttatcctgcaggccgagcgggaaacgttcatcgagcagatgaaggatgtcatggacaaggcagaggacatgctcagcgaggacacagacgccgaccgtggctccgacccagggaccagcccgccacacctcagcacctgcggcctgggcaccggggaggagagccgacaatcccaagccaacgcccccgtgtatcagcagaacgtcctgcacaccgggaagaggtggttcatcatctgtccggtggctgagcaccccgcccccgaggcccctgaatcttcgcccccacttcctctaagctccctgccgccagaagccagccaagattcagcgccctataaagaccagctgtcctcgaaggaacaacccagctttctagccagtcagcagctcctgagccaggcgggccccagcaaccctcctggggcacccccagcccctttggccccctcctcccctcctgtgactgctctgccccaagatggagcagctccagccaccagcaccatgccagagccagcgtcaggaactgccagccaggcagggggtccagggacacctcaggggctgaccagtgagctcgagacgtctcagccactagcggagactcacgaggccccgcttgctgtgcagcccctcgtggtgggcctagcaccttgcactccagctccagaggctgcctcaaccagggacgccagtgccccaagggagcccctgccacctcctgcacctgagcccagcccccacagcgggaccccacagcccgccttgggtcaacctgctcccctgcttcctgccgcagtgggggccgtcagcctggccacctcccagctcccaagcccacccctggggcccaccgtccccccacagccaccctcggccctggagtcggatggggaagggccgccccccagggtgggctttgtggacagcaccatcaagagcctggacgagaagctgcggactctgctctaccaggagcacgtgcccacctcctcagcctcagctgggacccctgtggaggtgggcgacagagacttcaccctggagcccctgagaggggaccagccccgctcagaggtctgcgggggggacctggccctgcccccagtgcctaaggaggcggtctcagggcgtgtccagctgccccagcccttggtggagaagtcagaactggcccccactcgaggggccgtgatggagcagggcacgtcctcgtcaatgacagcagagtcgtctcccaggagtatgctaggctatgacagagatggaaggcaggtggcctcagactcccatgtggtccccagcgtcccccaggatgtacctgcttttgtgagacctgcacgtgtggagcccacagacagggatggtggagaagctggagaaagctcggcagagcccccgccgagtgacatgggcacagtggggggccaggctagccacccccagacactcggcgctcgagctttggggtcccctcggaaacgtccagagcagcaggatgtcagctcaccagccaagactgtgggccgtttctcggtggtcagcactcaggacgagtggaccctggcctccccccacagcctgagatactctgccccacccgacgtctacctggacgaggccccctccagccccgacgtgaagctggcagtgcggcgggcgcagacggcctcctccatcgaggtcggcgtgggcgagcccgtgtccagcgactctggggacgagggccctcgggcgagacccccggtgcagaagcaggcgtccctgcccgtgagtggcagcgtggctggcgacttcgtgaagaaggccaccgccttcctgcagaggccttctcgggccggctcgctgggccccgagacacccagcagggtgggcatgaaggtccccacgatcagcgtgacctccttccattcccagtcgtcctacatcagcagcgacaatgattcggagctcgaggatgctgacataaagaaggagctgcagagtctgcgggagaagcacctgaaggagatctcggagctgcagagccagcagaagcaggagatcgaagctctgtaccgccgcctgggcaagccactgccccccaacgtgggcttcttccacacggcaccccccactggccgccggagaaaaaccagcaagagcaagctgaaggcaggcaagctgctaaatcccctggtgcggcagctcaaggtcgtggcctccagcacaggtcacttggctgactccagcagaggccctcccgctaaggaccctgcccaagccagtgtggggctcactgcagacagcacgggcctgagcgggaaggcagtgcagacccagcagccctgctccgtccgggcctccctgtcttcggacatctgctccggcttagccagtgatggaggcggagcgcgtggccaaggctggacggtttaccacccaacgtctgagagagtgacctataagtctagtagcaaacctcgtgctcgattcctcagtggacccgtatctgtgtccatctggtctgccctgaagcgtctctgcctaggcaaagaacacagcagtaggtcctccaccagcagcctggccccaggccctgagccaggcccccagcccgccctgcacgtccaggcgcaggtgaacaacagcaacaacaagaagggtaccttcacggacgacctgcacaagctggtggacgagtggacgagcaagacggtgggggccgcgcagctgaagcccacgctcaaccagctgaagcagacccagaagctgcaagacatggaggcccaggcaggctgggctgcccctggcgaggcgcgggctatgaccgcacctcgagcaggagtggggatgccacgtctgcccccagcgcccggccctctgtccaccacggtcattcccggagccgccccgaccctgtccgtgcccacaccagatcctgagagtgagaagcctgactgaccccgcctagacgccaggcccacttcacgccgtctaagtggagaagtgacggaccctcagggccagctgctcctcctgtccagttcacgctgttttgtaaccactttctaagcattttttattcacaattggaaacacaaatgtaatgcaagaataaaaaatattttggggcagaaagga

SEQ ID NO: 200220 - DNA, 3224 bp, Homo sapiens
  Payload ID: 19504
  Gene Name: WNK lysine deficient protein kinase 2
  ENST ID: ENST00000448251
  CDS Start-End: 1-3044
gccagctggagacgcacaaccacaagatggtgaccttcaagttcgacttggacggggacgcacccgatgaaattgccacgtatatggtggagcatgactttatcctgcaggccgagcgggaaacgttcatcgagcagatgaaggatgtcatggacaaggcagaggacatgctcagcgaggacacagacgccgaccgtggctccgacccagggaccagcccgccacacctcagcacctgcggcctgggcaccggggaggagagccgacaatcccaagccaacgcccccgtgtatcagcagaacgtcctgcacaccgggaagaggtggttcatcatctgtccggtggctgagcaccccgcccccgaggcccctgaatcttcgcccccacttcctctaagctccctgccgccagaagccagccaagattcagcgccctataaagaccagctgtcctcgaaggaacaacccagctttctagccagtcagcagctcctgagccaggcgggccccagcaaccctcctggggcacccccagcccctttggccccctcctcccctcctgtgactgctctgccccaagatggagcagctccagccaccagcaccatgccagagccagcgtcaggaactgccagccaggcagggggtccagggacacctcaggggctgaccagtgagctcgagacgtctcagccactagcggagactcacgaggccccgcttgctgtgcagcccctcgtggtgggcctagcaccttgcactccagctccagaggctgcctcaaccagggacgccagtgccccaagggagcccctgccacctcctgcacctgagcccagcccccacagcgggaccccacagcccgccttgggtcaacctgctcccctgcttcctgccgcagtgggggccgtcagcctggccacctcccagctcccaagcccacccctggggcccaccgtccccccacagccaccctcggccctggagtcggatggggaagggccgccccccagggtgggctttgtggacagcaccatcaagagcctggacgagaagctgcggactctgctctaccaggagcacgtgcccacctcctcagcctcagctgggacccctgtggaggtgggcgacagagacttcaccctggagcccctgagaggggaccagccccgctcagaggtctgcgggggggacctggccctgcccccagtgcctaaggaggcggtctcagggcgtgtccagctgccccagcccttggtggagaagtcagaactggcccccactcgaggggccgtgatggagcagggcacgtcctcgtcaatgacagcagagtcgtctcccaggagtatgctaggctatgacagagatggaaggcaggtggcctcagactcccatgtggtccccagcgtcccccaggatgtacctgcttttgtgagacctgcacgtgtggagcccacagacagggatggtggagaagctggagaaagctcggcagagcccccgccgagtgacatgggcacagtggggggccaggctagccacccccagacactcggcgctcgagctttggggtcccctcggaaacgtccagagcagcaggatgtcagctcaccagccaagactgtgggccgtttctcggtggtcagcactcaggacgagtggaccctggcctccccccacagcctgagatactctgccccacccgacgtctacctggacgaggccccctccagccccgacgtgaagctggcagtgcggcgggcgcagacggcctcctccatcgaggtcggcgtgggcgagcccgtgtccagcgactctggggacgagggccctcgggcgagacccccggtgcagaagcaggcgtccctgcccgtgagtggcagcgtggctggcgacttcgtgaagaaggccaccgccttcctgcagaggccttctcgggccggctcgctgggccccgagacacccagcagggtgggcatgaaggtccccacgatcagcgtgacctccttccattcccagtcgtcctacatcagcagcgacaatgattcggagctcgaggatgctgacataaagaaggagctgcagagtctgcgggagaagcacctgaaggagatctcggagctgcagagccagcagaagcaggagatcgaagctctgtaccgccgcctgggcaagccactgccccccaacgtgggcttcttccacacggcaccccccactggccgccggagaaaaaccagcaagagcaagctgaaggcaggcaagctgctaaatcccctggtgcggcagctcaaggtcgtggcctccagcacaggtcacttggctgactccagcagaggccctcccgctaaggaccctgcccaagccagtgtggggctcactgcagacagcacgggcctgagcgggaaggcagtgcagacccagcagccctgctccgtccgggcctccctgtcttcggacatctgctccggcttagccagtgatggaggcggagcgcgtggccaaggctggacggtttaccacccaacgtctgagagagtgacctataagtctagtagcaaacctcgtgctcgattcctcagtggacccgtatctgtgtccatctggtctgccctgaagcgtctctgcctaggcaaagaacacagcagtaggtcctccaccagcagcctggccccaggccctgagccaggcccccagcccgccctgcacgtccaggcgcaggtgaacaacagcaacaacaagaagggtaccttcacggacgacctgcacaagctggtggacgagtggacgagcaagacggtgggggccgcgcagctgaagcccacgctcaaccagctgaagcagacccagaagctgcaagacatggaggcccaggcaggctgggctgcccctggcgaggcgcgggctatgaccgcacctcgagcaggagtggggatgccacgtctgcccccagcgcccggccctctgtccaccacggtcattcccggagccgccccgaccctgtccgtgcccacaccagatcctgagagtgagaagcctgactgaccccgcctagacgccaggcccacttcacgccgtctaagtggagaagtgacggaccctcagggccagctgctcctcctgtccagttcacgctgttttgtaaccactttctaagcattttttattcacaattggaaacacaaatgtaatgcaagaataaaaaatattttggggcagaaagga

SEQ ID NO: 200221 - DNA, 6108 bp, Homo sapiens
  Payload ID: 19504
  Gene Name: WNK lysine deficient protein kinase 2
  ENST ID: ENST00000427277
  CDS Start-End: 5017-6108
atggacggcgatggcggccgccgagacgtccccggcacgctgatggagcccgggcgcggcgcggggcccgcgggcatggcggagcctcgggcgaaggcggcgcggccggggccccagcgctttctgcggcgcagcgtggtagagtcggaccaggaggagccgccgggcttggaggcagccgaggcgccgggcccgcagcccccgcagcccctgcagcgccgggtgcttctgctctgcaagacgcgccgcctcatcgcggagcgcgcccgcggacgccccgccgcccccgcgcccgcagcgctggtagcgcagccgggagcccccggagcccccgcggacgccggccccgagcccgtgggcacgcaggagcccggcccggaccccatcgcagccgctgtcgaaaccgcgcctgcccccgacggcggccccagggaggaggcggcggcgaccgtgaggaaggaggatgagggggcggccgaggcgaagcctgagcccgggcgcactcgccgggacgagcccgaagaggaggaggacgacgaggacgacctcaaggccgtggccacctctctggacggccgcttcctcaagttcgacatcgagctgggccgcggttccttcaagacggtctacaaggggctggacacggagacctgggtggaggtggcctggtgtgagctgcaggaccggaagctcaccaagctggagcggcagcggttcaaggaagaggctgagatgctgaaaggcctgcagcaccccaacatcgtgcgcttctacgacttctgggagtccagcgccaagggcaagcggtgcattgtgctggtgacggagctgatgacctcagggacgctgaagacatacctgaagcggttcaaggtgatgaagcccaaggttctccgcagctggtgccggcagatcctgaagggcctgctgttcctgcacacaaggacgccacccatcatccaccgagacctgaaatgtgacaatattttcatcaccggaccaactgggtctgtgaagattggcgacttgggcctggccactctgaaaagagcgtcatttgccaaaagtgtgataggtactcccgagttcatggcgcccgagatgtacgaggagcactacgatgagtccgtggacgtctatgcctttgggatgtgcatgctggagatggccacctcggagtacccctactcggagtgccagaatgcggcccagatctaccgcaaggtcacctgtggtatcaagccggccagctttgagaaagtgcacgatcctgaaatcaaggagattattggggagtgtatctgcaaaaacaaggaggaaaggtacgagatcaaagacctgctgagccacgccttcttcgcagaggacacaggcgtgagggtggagctcgcggaggaggaccacggcaggaagtccaccatcgccctgaggctctgggtggaagaccccaagaaactgaagggaaagcccaaggacaatggagccatagagttcaccttcgacctggagaaggagacgccggatgaggtggcccaagagatgattgagtctggattcttccacgagagtgacgtcaagatcgtggccaagtccatccgtgaccgcgtggccttgatccagtggcggcgggagaggatctggcccgcgctgcagcccaaggagcagcaggatgtgggcagcccggacaaggccaggggtccgccggtgcccctgcaggtccaggtgacctaccatgcacaggctgggcagcccgggccaccagagcccgaggagccggaggccgaccagcacctcctgccacctacgttgccgaccagcgccacctccctggcctcggacagcaccttcgacagcggccagggctctaccgtgtactcagactcgcagagcagccagcagagcgtgatgcttggctcccttgccgacgcagcgccgtccccggcccagtgtgtgtgcagcccccctgtgagcgaggggcccgtcctgccgcagagcctgccctcgctgggggcctaccagcagcccacggctgcacctggcttgccggtgggctctgtcccggcccccgcctgccctccgtccctccagcagcacttcccggatccggccatgagcttcgcccccgtgctgccgccgcccagcacccccatgcccacgggcccaggccagccagcaccccccggccagcagcctcctccgctggcccagccgacacccctgccgcaggtcctggccccacagcccgtggtccccctccagccggttcccccccacctgccaccgtacctggctccagcctcccaggtgggggcccccgctcagctgaagcccctccagatgccacaggcgcccctgcagccgcttgctcaagtccctccgcagatgcccccgattcctgttgtgccccccatcacgcccctggcgggaatcgacggcctccctccggccctcccagacctgccgaccgcgactgtgcctcccgtgccaccacctcagtatttctctccagccgtgatcttgccgagcctcgctgccccactcccccctgcgtccccagccttgcctctgcaggctgtgaagctgccccacccccctggggcgcccctggccatgccctgccggaccattgtgccaaatgcaccggccactatccccctgctggccgtagccccaccgggcgtggctgccctgtccattcattctgccgtggcccagctcccaggccaacctgtgtacccagcggccttcccacagatggcgcctactgacgtccctccttccccccatcacacggtgcagaatatgagggccacccctccacagccggcactgcctccacaacccacactgcccccacaacccgtgctgcccccgcaacccacgctgccccctcaacctgtgttgcccccgcaacccacacggccccctcaacctgtgctgcccccgcaacccatgctgcccccacaacctgtgctgcccccgcagccggcactgcctgtgcgccctgagcccctccagccccaccttcctgaacaagctgctccagctgctacaccagggagccagattctgcttggccacccagctccctatgctgtggacgtcgccgctcaggtccccaccgtgcctgtgccaccggctgcggtcctctcgccgcctctgccggaagtgctgctgcctgccgcccctgagctcctgcctcagttccccagctccctggccacggtgtctgcctctgtgcagagtgtgcccacccagactgccacacttctgccaccagcaaacccaccgctgcctggcgggcccgggatcgccagcccttgcccaactgtccagctgacggtggaaccagtccaagaggagcaggcctcacaggacaagccgcccggcctcccgcagagctgtgagagctatggaggttctgatgtcacttctggaaaagagctgagtgacagctgtgaaggcgcctttggagggggcaggctggagggcagggcagcccgaaaacaccaccgcaggtccacgcgtgcgcgctcccggcaggagagggccagccggccccggcttaccatcttgaacgtgtgcaacactggggacaagatggtggagtgccagctggagacgcacaaccacaagatggtgaccttcaagttcgacttggacggggacgcacccgatgaaattgccacgtatatggtggagcatgactttatcctgcaggccgagcgggaaacgttcatcgagcagatgaaggatgtcatggacaaggcagaggacatgctcagcgaggacacagacgccgaccgtggctccgacccagggaccagcccgccacacctcagcacctgcggcctgggcaccggggaggagagccgacaatcccaagccaacgcccccgtgtatcagcagaacgtcctgcacaccgggaagaggtggttcatcatctgtccggtggctgagcaccccgcccccgaggcccctgaatcttcgcccccacttcctctaagctccctgccgccagaagccagccaaggtccatgcagggggctcaccctgccctgtctcccatggcgcagagcagcctgtggggctgtgttcctatccttgttttctgctgaatcagctcagtcaaagcagcctccagattcagcgccctataaagaccagctgtcctcgaaggaacaacccagctttctagccagtcagcagctcctgagccaggcgggccccagcaaccctcctggggcacccccagcccctttggccccctcctcccctcctgtgactgctctgccccaagatggagcagctccagccaccagcaccatgccagagccagcgtcaggaactgccagccaggcagggggtccagggacacctcaggggctgaccagtgagctcgagacgtctcagccactagcggagactcacgaggccccgcttgctgtgcagcccctcgtggtgggcctagcaccttgcactccagctccagaggctgcctcaaccagggacgccagtgccccaagggagcccctgccacctcctgcacctgagcccagcccccacagcgggaccccacagcccgccttgggtcaacctgctcccctgcttcctgccgcagtgggggccgtcagcctggccacctcccagctcccaagcccacccctggggcccaccgtccccccacagccaccctcggccctggagtcggatggggaagggccgccccccagggtgggctttgtggacagcaccatcaagagcctggacgagaagctgcggactctgctctaccaggagcacgtgcccacctcctcagcctcagctgggacccctgtggaggtgggcgacagagacttcaccctggagcccctgagaggggaccagccccgctcagaggtctgcgggggggacctggccctgcccccagtgcctaaggaggcggtctcagggcgtgtccagctgccccagcccttggtggagaagtcagaactggcccccactcgaggggccgtgatggagcagggcacgtcctcgtcaatgacagagtcgtctcccaggagtatgctaggctatgacagagatggaaggcaggtggcctcagactcccatgtggtccccagcgtcccccaggatgtacctgcttttgtgagacctgcacgtgtggagcccacagacagggatggtggagaagctggagaaagctcggcagagcccccgccgagtgacatgggcacagtggggggccaggctagccacccccagacactcggcgctcgagctttggggtcccctcggaaacgtccagagcagcaggatgtcagctcaccagccaagactgtgggccgtttctcggtggtcagcactcaggacgagtggaccctggcctccccccacagcctgagatactctgccccacccgacgtctacctggacgaggccccctccagccccgacgtgaagctggcagtgcggcgggcgcagacggcctcctccatcgaggtcggcgtgggcgagcccgtgtccagcgactctggggacgagggccctcgggcgagacccccggtgcagaagcaggcgtccctgcccgtgagtggcagcgtggctggcgacttcgtgaagaaggccacctcctgcagaggccttctcgggccgtcgctgggccccgagacacccagcagggtgggcatgaaggtccccacgatcagcgtgacctccttccattcccagtcgtcctacatcagcagcgacaatgattcggagctcgaggatgctgacataaagaaggagctgcagagtctgcgggagaagcacctgaaggagatctcggagctgcagagccagcagaagcaggagatcgaagctctgtaccgccgcctgggcaagccactgccccccaacgtgggcttcttccacacggcaccccccactggccgccggagaaaaaccagcaagagcaagctgaaggcaggcaagctgctaaatcccctggtgcggcagctcaaggtcgtggcctccagcacaggtcacttggctgactccagcagaggccctcccgctaaggaccccaagccagtgtggggctcactgcagacagcacgggcctga

SEQ ID NO: 200222 - DNA, 2385 bp, Homo sapiens
  Payload ID: 19504
  Gene Name: WNK lysine deficient protein kinase 2
  ENST ID: ENST00000448039
  CDS Start-End: 15-2385
cttggcccacagagatggacggcgatggcggccgccgagacgtccccggcacgctgatggagcccgggcgcggcgcggggcccgcgggcatggcggagcctcgggcgaaggcggcgcggccggggccccagcgctttctgcggcgcagcgtggtagagtcggaccaggaggagccgccgggcttggaggcagccgaggcgccgggcccgcagcccccgcagcccctgcagcgccgggtgcttctgctctgcaagacgcgccgcctcatcgcggagcgcgcccgcggacgccccgccgcccccgcgcccgcagcgctggtagcgcagccgggagcccccggagcccccgcggacgccggccccgagcccgtgggcacgcaggagcccggcccggaccccatcgcagccgctgtcgaaaccgcgcctgcccccgacggcggccccagggaggaggcggcggcgaccgtgaggaaggaggatgagggggcggccgaggcgaagcctgagcccgggcgcactcgccgggacgagcccgaagaggaggaggacgacgaggacgacctcaaggccgtggccacctctctggacggccgcttcctcaagttcgacatcgagctgggccgcggttccttcaagacggtctacaaggggctggacacggagacctgggtggaggtggcctggtgtgagctgcaggaccggaagctcaccaagctggagcggcagcggttcaaggaagaggctgagatgctgaaaggcctgcagcaccccaacatcgtgcgcttctacgacttctgggagtccagcgccaagggcaagcggtgcattgtgctggtgacggagctgatgacctcagggacgctgaagacatacctgaagcggttcaaggtgatgaagcccaaggttctccgcagctggtgccggcagatcctgaagggcctgctgttcctgcacacaaggacgccacccatcatccaccgagacctgaaatgtgacaatattttcatcaccggaccaactgggtctgtgaagattggcgacttgggcctggccactctgaaaagagcgtcatttgccaaaagtgtgataggtactcccgagttcatggcgcccgagatgtacgaggagcactacgatgagtccgtggacgtctatgcctttgggatgtgcatgctggagatggccacctcggagtacccctactcggagtgccagaatgcggcccagatctaccgcaaggtcacctgtggtatcaagccggccagctttgagaaagtgcacgatcctgaaatcaaggagattattggggagtgtatctgcaaaaacaaggaggaaaggtacgagatcaaagacctgctgagccacgccttcttcgcagaggacacaggcgtgagggtggagctcgcggaggaggaccacggcaggaagtccaccatcgccctgaggctctgggtggaagaccccaagaaactgaagggaaagcccaaggacaatggagccatagagttcaccttcgacctggagaaggagacgccggatgaggtggcccaagagatgattgagtctggattcttccacgagagtgacgtcaagatcgtggccaagtccatccgtgaccgcgtggccttgatccagtggcggcgggagaggatctggcccgcgctgcagcccaaggagcagcaggatgtgggcagcccggacaaggccaggggtccgccggtgcccctgcaggtccaggtgacctaccatgcacaggctgggcagcccgggccaccagagcccgaggagccggaggccgaccagcacctcctgccacctacgttgccgaccagcgccacctccctggcctcggacagcaccttcgacagcggccagggctctaccgtgtactcagactcgcagagcagccagcagagcgtgatgcttggctcccttgccgacgcagcgccgtccccggcccagtgtgtgtgcagcccccctgtgagcgaggggcccgtcctgccgcagagcctgccctcgctgggggcctaccagcagcccacggctgcacctcctccgctggcccagccgacacccctgccgcaggtcctggccccacagcccgtggtccccctccagccggttcccccccacctgccaccgtacctggctccagcctcccaggtgggggcccccgctcagctgaagcccctccagatgccacaggcgcccctgcagccgcttgctcaagtccctccgcagatgcccccgattcctgttgtgccccccatcacgcccctggcgggaatcgacggcctccctccggccctcccagacctgccgaccgcgactgtgcctcccgtgccaccacctcagtatttctctccagccgtgatcttgccgagcc

SEQ ID NO: 200223 - DNA, 1937 bp, Homo sapiens
  Payload ID: 19504
  Gene Name: WNK lysine deficient protein kinase 2
  ENST ID: ENST00000453718
  CDS Start-End: 1-1937
ctgcacctgagcccagcccccacagcgggaccccacagcccgccttgggtcaacctgctcccctgcttcctgccgcagtgggggccgtcagcctggccacctcccagctcccaagcccacccctggggcccaccgtccccccacagccaccctcggccctggagtcggatggggaagggccgccccccagggtgggctttgtggacagcaccatcaagagcctggacgagaagctgcggactctgctctaccaggagcacgtgcccacctcctcagcctcagctgggacccctgtggaggtgggcgacagagacttcaccctggagcccctgagaggggaccagccccgctcagaggtctgcgggggggacctggccctgcccccagtgcctaaggaggcggtctcagggcgtgtccagctgccccagcccttggtggagaagtcagaactggcccccactcgaggggccgtgatggagcagggcacgtcctcgtcaatgacagagtcgtctcccaggagtatgctaggctatgacagagatggaaggcaggtggcctcagactcccatgtggtccccagcgtcccccaggatgtacctgcttttgtgagacctgcacgtgtggagcccacagacagggatggtggagaagctggagaaagctcggcagagcccccgccgagtgacatgggcacagtggggggccaggctagccacccccagacactcggcgctcgagctttggggtcccctcggaaacgtccagagcagcaggatgtcagctcaccagccaagactgtgggccgtttctcggtggtcagcactcaggacgagtggaccctggcctccccccacagcctgagatactctgccccacccgacgtctacctggacgaggccccctccagccccgacgtgaagctggcagtgcggcgggcgcagacggcctcctccatcgaggtcggcgtgggcgagcccgtgtccagcgactctggggacgagggccctcgggcgagacccccggtgcagaagcaggcgtccctgcccgtgagtggcagcgtggctggcgacttcgtgaagaaggccaccgccttcctgcagaggccttctcgggccggctcgctgggccccgagacacccagcagggtgggcatgaaggtccccacgatcagcgtgacctccttccattcccagtcgtcctacatcagcagcgacaatgattcggagctcgaggatgctgacataaagaaggagctgcagagtctgcgggagaagcacctgaaggagatctcggagctgcagagccagcagaagcaggagatcgaagctctgtaccgccgcctgggcaagccactgccccccaacgtgggcttcttccacacggcaccccccactggccgccggagaaaaaccagcaagagcaagctgaaggcaggcaagctgctaaatcccctggtgcggcagctcaaggtcgtggcctccagcacaggtcacttggctgactccagcagaggccctcccgctaaggaccctgcccaagccagtgtggggctcactgcagacagcacgggcctgagcgggaaggcagtgcagacccagcagccctgctccgtccgggcctccctgtcttcggacatctgctccggcttagccagtgatggaggcggagcgcgtggccaagggtcctccaccagcagcctggccccaggccctgagccaggcccccagcccgccctgcacgtccaggcgcaggtgaacaacagcaacaacaagaagggtaccttcacggacgacctgcacaagctggtggacgagtggacgagcaagacggtgggggccgcgcagctgaagcccacgctcaaccagctgaagcagacccagaagctgcaagacatggaggcccaggcaggctgggctgcccctggcgaggcgcgggct

SEQ ID NO: 200224 - DNA, 6679 bp, Homo sapiens
  Payload ID: 19504
  Gene Name: WNK lysine deficient protein kinase 2
  ENST ID: ENST00000411624
  CDS Start-End: 1-5320
ggagtgccagaatgcggcccagatctaccgcaaggtcacctgtggtatcaagccggccagctttgagaaagtgcacgatcctgaaatcaaggagattattggggagtgtatctgcaaaaacaaggaggaaaggtacgagatcaaagacctgctgagccacgccttcttcgcagaggacacaggcgtgagggtggagctcgcggaggaggaccacggcaggaagtccaccatcgccctgaggctctgggtggaagaccccaagaaactgaagggaaagcccaaggacaatggagccatagagttcaccttcgacctggagaaggagacgccggatgaggtggcccaagagatgattgagtctggattcttccacgagagtgacgtcaagatcgtggccaagtccatccgtgaccgcgtggccttgatccagtggcggcgggagaggatctggcccgcgctgcagcccaaggagcagcaggatgtgggcagcccggacaaggccaggggtccgccggtgcccctgcaggtccaggtgacctaccatgcacaggctgggcagcccgggccaccagagcccgaggagccggaggccgaccagcacctcctgccacctacgttgccgaccagcgccacctccctggcctcggacagcaccttcgacagcggccagggctctaccgtgtactcagactcgcagagcagccagcagagcgtgatgcttggctcccttgccgacgcagcgccgtccccggcccagtgtgtgtgcagcccccctgtgagcgaggggcccgtcctgccgcagagcctgccctcgctgggggcctaccagcagcccacggctgcacctggcttgccggtgggctctgtcccggcccccgcctgccctccgtccctccagcagcacttcccggatccggccatgagcttcgcccccgtgctgccgccgcccagcacccccatgcccacgggcccaggccagccagcaccccccggccagcagcctcctccgctggcccagccgacacccctgccgcaggtcctggccccacagcccgtggtccccctccagccggttcccccccacctgccaccgtacctggctccagcctcccaggtgggggcccccgctcagctgaagcccctccagatgccacaggcgcccctgcagccgcttgctcaagtccctccgcagatgcccccgattcctgttgtgccccccatcacgcccctggcgggaatcgacggcctccctccggccctcccagacctgccgaccgcgactgtgcctcccgtgccaccacctcagtatttctctccagccgtgatcttgccgagcctcgctgccccactcccccctgcgtccccagccttgcctctgcaggctgtgaagctgccccacccccctggggcgcccctggccatgccctgccggaccattgtgccaaatgcaccggccactatccccctgctggccgtagccccaccgggcgtggctgccctgtccattcattctgccgtggcccagctcccaggccaacctgtgtacccagcggccttcccacagatggcgcctactgacgtccctccttccccccatcacacggtgcagaatatgagggccacccctccacagccggcactgcctccacaacccacactgcccccacaacccgtgctgcccccgcaacccacgctgccccctcaacctgtgttgcccccgcaacccacacggccccctcaacctgtgctgcccccgcaacccatgctgcccccacaacctgtgctgcccccgcagccggcactgcctgtgcgccctgagcccctccagccccaccttcctgaacaagctgctccagctgctacaccagggagccagattctgcttggccacccagctccctatgctgtggacgtcgccgctcaggtccccaccgtgcctgtgccaccggctgcggtcctctcgccgcctctgccggaagtgctgctgcctgccgcccctgagctcctgcctcagttccccagctccctggccacggtgtctgcctctgtgcagagtgtgcccacccagactgccacacttctgccaccagcaaacccaccgctgcctggcgggcccgggatcgccagcccttgcccaactgtccagctgacggtggaaccagtccaagaggagcaggcctcacaggacaagccgcccggcctcccgcagagctgtgagagctatggaggttctgatgtcacttctggaaaagagctgagtgacagctgtgaaggcgcctttggagggggcaggctggagggcagggcagcccgaaaacaccaccgcaggtccacgcgtgcgcgctcccggcaggagagggccagccggccccggcttaccatcttgaacgtgtgcaacactggggacaagatggtggagtgccagctggagacgcacaaccacaagatggtgaccttcaagttcgacttggacggggacgcacccgatgaaattgccacgtatatggtggagcatgactttatcctgcaggccgagcgggaaacgttcatcgagcagatgaaggatgtcatggacaaggcagaggacatgctcagcgaggacacagacgccgaccgtggctccgacccagggaccagcccgccacacctcagcacctgcggcctgggcaccggggaggagagccgacaatcccaagccaacgcccccgtgtatcagcagaacgtcctgcacaccgggaagaggtggttcatcatctgtccggtggctgagcaccccgcccccgaggcccctgaatcttcgcccccacttcctctaagctccctgccgccagaagccagccaagattcagcgccctataaagaccagctgtcctcgaaggaacaacccagctttctagccagtcagcagctcctgagccaggcgggccccagcaaccctcctggggcacccccagcccctttggccccctcctcccctcctgtgactgctctgccccaagatggagcagctccagccaccagcaccatgccagagccagcgtcaggaactgccagccaggcagggggtccagggacacctcaggggctgaccagtgagctcgagacgtctcagccactagcggagactcacgaggccccgcttgctgtgcagcccctcgtggtgggcctagcaccttgcactccagctccagaggctgcctcaaccagggacgccagtgccccaagggagcccctgccacctcctgcacctgagcccagcccccacagcgggaccccacagcccgccttgggtcaacctgctcccctgcttcctgccgcagtgggggccgtcagcctggccacctcccagctcccaagcccacccctggggcccaccgtccccccacagccaccctcggccctggagtcggatggggaagggccgccccccagggtgggctttgtggacagcaccatcaagagcctggacgagaagctgcggactctgctctaccaggagcacgtgcccacctcctcagcctcagctgggacccctgtggaggtgggcgacagagacttcaccctggagcccctgagaggggaccagccccgctcagaggtctgcgggggggacctggccctgcccccagtgcctaaggaggcggtctcagggcgtgtccagctgccccagcccttggtggagaagtcagaactggcccccactcgaggggccgtgatggagcagggcacgtcctcgtcaatgacagcagagtcgtctcccaggagtatgctaggctatgacagagatggaaggcaggtggcctcagactcccatgtggtccccagcgtcccccaggatgtacctgcttttgtgagacctgcacgtgtggagcccacagacagggatggtggagaagctggagaaagctcggcagagcccccgccgagtgacatgggcacagtggggggccaggctagccacccccagacactcggcgctcgagctttggggtcccctcggaaacgtccagagcagcaggatgtcagctcaccagccaagactgtgggccgtttctcggtggtcagcactcaggacgagtggaccctggcctccccccacagcctgagatactctgccccacccgacgtctacctggacgaggccccctccagccccgacgtgaagctggcagtgcggcgggcgcagacggcctcctccatcgaggtcggcgtgggcgagcccgtgtccagcgactctggggacgagggccctcgggcgagacccccggtgcagaagcaggcgtccctgcccgtgagtggcagcgtggctggcgacttcgtgaagaaggccaccgccttcctgcagaggccttctcgggccggctcgctgggccccgagacacccagcagggtgggcatgaaggtccccacgatcagcgtgacctccttccattcccagtcgtcctacatcagcagcgacaatgattcggagctcgaggatgctgacataaagaaggagctgcagagtctgcgggagaagcacctgaaggagatctcggagctgcagagccagcagaagcaggagatcgaagctctgtaccgccgcctgggcaagccactgccccccaacgtgggcttcttccacacggcaccccccactggccgccggagaaaaaccagcaagagcaagctgaaggcaggcaagctgctaaatcccctggtgcggcagctcaaggtcgtggcctccagcacagggtcctccaccagcagcctggccccaggccctgagccaggcccccagcccgccctgcacgtccaggcgcaggtgaacaacagcaacaacaagaagggtaccttcacggacgacctgcacaagctggtggacgagtggacgagcaagacggtgggggccgcgcagctgaagcccacgctcaaccagctgaagcagacccagaagctgcaagacatggaggcccaggcaggctgggctgcccctggcgaggcgcgggctatgaccgcacctcgagcaggagtggggatgccacgtctgcccccagcgcccggccctctgtccaccacggtcattcccggagccgccccgaccctgtccgtgcccacaccaggtactgccctctccaacctcccaaccccaccctgtgcgctgcctctgggtcagtacagaggcctgctcccagctccagtgtcctgggggccctgggcaggccaggtgggccagctgggggcacagggcagctggaacaccccccaggtgcccgtgctgccagtcttcttgcagccacctgtggtcagcatgcctggcccccggctgcggatcacgtagccttctgccctgtcccttgccagatggcgccctcggaaccgcccggagaaaccaggtgtggtttggcctccgagtcccccccaccgcctgctgtgggcacagcactcagccgcgagggggacagcgggtgggcagcaagactgcttcctttgcggcttcagaccctgttcgctcctaggttcctgtggtccacgcgccgtctccacacccacttcctatacttgagttgatggttagaaccttgtcgtcaccctgcagaagtacagtgccttgaatgccagcttttccgttccctgatgaaaagatatgttaaaaaaaattatcggaaaaggtttcatttgcaattggcttgtgcattgataatctttatttactgttttaagttgcagagatgtgaatggtttacaaatctgaagctgaagttcaatctttggttttctgttgtaaatgccttttacaaacattgaattagctaccttaagtattgaagagcttccattgctaggtgagccctgctttgtcctcagtagagtgccggttccctgggctcatccaggggctgagagacggcgggacgctggggcagggcacactggcggagctgcttgctcagtagggaatgtcagttgttgcgctgggccatgagaaatccgccagaaaacgttaggtgagcagacatgccccccatgccagtgggctgctgtgagtgaggataaggtgtgtgttgggcatagaaaccctggctgcccgcccaccctgtggagacaagtgcagctcctccagctggagaggctgccctctctcctgcccacttccctcccttctccatgatttccatggagacctgtggctctgctcacccctggcatgcagaccgctctcccgtccagccctaagcctgctctgcggagggcggggtcattcttctcctggagatttcagtgggactcgtccccagtgggcacaacacagcccttggtgggaggggaaggccccagcctcctccacctcccactggaaagcagactgcttgggactgcccagctgtgaattgtatagtttctgtacttattagaactgggtaaattattttggttcaaatctattattccatcaattcagttagaattgaattttctaggtgattatgcagaatcttctgccagggcacgatgctgtcgtaagagatttctgttctctgtactgggcccccttgccctgttccttgagtgaagtgggggctgccctcacctgtcccccttgcctgtgaatcccttccttgtacatggtggtcagtggcacggaatccccaatagattgtatatctgaaggagaaaaataaacacttttgctcgaaaa

SEQ ID NO: 200225 - DNA, 7792 bp, Homo sapiens
  Payload ID: 19504
  Gene Name: WNK lysine deficient protein kinase 2
  ENST ID: ENST00000432730
  CDS Start-End: 1-6662
gcggccgccgagacgtccccggcacgctgatggagcccgggcgcggcgcggggcccgcgggcatggcggagcctcgggcgaaggcggcgcggccggggccccagcgctttctgcggcgcagcgtggtagagtcggaccaggaggagccgccgggcttggaggcagccgaggcgccgggcccgcagcccccgcagcccctgcagcgccgggtgcttctgctctgcaagacgcgccgcctcatcgcggagcgcgcccgcggacgccccgccgcccccgcgcccgcagcgctggtagcgcagccgggagcccccggagcccccgcggacgccggccccgagcccgtgggcacgcaggagcccggcccggaccccatcgcagccgctgtcgaaaccgcgcctgcccccgacggcggccccagggaggaggcggcggcgaccgtgaggaaggaggatgagggggcggccgaggcgaagcctgagcccgggcgcactcgccgggacgagcccgaagaggaggaggacgacgaggacgacctcaaggccgtggccacctctctggacggccgcttcctcaagttcgacatcgagctgggccgcggttccttcaagacggtctacaaggggctggacacggagacctgggtggaggtggcctggtgtgagctgcaggaccggaagctcaccaagctggagcggcagcggttcaaggaagaggctgagatgctgaaaggcctgcagcaccccaacatcgtgcgcttctacgacttctgggagtccagcgccaagggcaagcggtgcattgtgctggtgacggagctgatgacctcagggacgctgaagacatacctgaagcggttcaaggtgatgaagcccaaggttctccgcagctggtgccggcagatcctgaagggcctgctgttcctgcacacaaggacgccacccatcatccaccgagacctgaaatgtgacaatattttcatcaccggaccaactgggtctgtgaagattggcgacttgggcctggccactctgaaaagagcgtcatttgccaaaagtgtgataggtactcccgagttcatggcgcccgagatgtacgaggagcactacgatgagtccgtggacgtctatgcctttgggatgtgcatgctggagatggccacctcggagtacccctactcggagtgccagaatgcggcccagatctaccgcaaggtcacctgtggtatcaagccggccagctttgagaaagtgcacgatcctgaaatcaaggagattattggggagtgtatctgcaaaaacaaggaggaaaggtacgagatcaaagacctgctgagccacgccttcttcgcagaggacacaggcgtgagggtggagctcgcggaggaggaccacggcaggaagtccaccatcgccctgaggctctgggtggaagaccccaagaaactgaagggaaagcccaaggacaatggagccatagagttcaccttcgacctggagaaggagacgccggatgaggtggcccaagagatgattgagtctggattcttccacgagagtgacgtcaagatcgtggccaagtccatccgtgaccgcgtggccttgatccagtggcggcgggagaggatctggcccgcgctgcagcccaaggagcagcaggatgtgggcagcccggacaaggccaggggtccgccggtgcccctgcaggtccaggtgacctaccatgcacaggctgggcagcccgggccaccagagcccgaggagccggaggccgaccagcacctcctgccacctacgttgccgaccagcgccacctccctggcctcggacagcaccttcgacagcggccagggctctaccgtgtactcagactcgcagagcagccagcagagcgtgatgcttggctcccttgccgacgcagcgccgtccccggcccagtgtgtgtgcagcccccctgtgagcgaggggcccgtcctgccgcagagcctgccctcgctgggggcctaccagcagcccacggctgcacctggcttgccggtgggctctgtcccggcccccgcctgccctccgtccctccagcagcacttcccggatccggccatgagcttcgcccccgtgctgccgccgcccagcacccccatgcccacgggcccaggccagccagcaccccccggccagcagcctcctccgctggcccagccgacacccctgccgcaggtcctggccccacagcccgtggtccccctccagccggttcccccccacctgccaccgtacctggctccagcctcccaggtgggggcccccgctcagctgaagcccctccagatgccacaggcgcccctgcagccgcttgctcaagtccctccgcagatgcccccgattcctgttgtgccccccatcacgcccctggcgggaatcgacggcctccctccggccctcccagacctgccgaccgcgactgtgcctcccgtgccaccacctcagtatttctctccagccgtgatcttgccgagcctcgctgccccactcccccctgcgtccccagccttgcctctgcaggctgtgaagctgccccacccccctggggcgcccctggccatgccctgccggaccattgtgccaaatgcaccggccactatccccctgctggccgtagccccaccgggcgtggctgccctgtccattcattctgccgtggcccagctcccaggccaacctgtgtacccagcggccttcccacagatggcgcctactgacgtccctccttccccccatcacacggtgcagaatatgagggccacccctccacagccggcactgcctccacaacccacactgcccccacaacccgtgctgcccccgcaacccacgctgccccctcaacctgtgttgcccccgcaacccacacggccccctcaacctgtgctgcccccgcaacccatgctgcccccacaacctgtgctgcccccgcagccggcactgcctgtgcgccctgagcccctccagccccaccttcctgaacaagctgctccagctgctacaccagggagccagattctgcttggccacccagctccctatgctgtggacgtcgccgctcaggtccccaccgtgcctgtgccaccggctgcggtcctctcgccgcctctgccggaagtgctgctgcctgccgcccctgagctcctgcctcagttccccagctccctggccacggtgtctgcctctgtgcagagtgtgcccacccagactgccacacttctgccaccagcaaacccaccgctgcctggcgggcccgggatcgccagcccttgcccaactgtccagctgacggtggaaccagtccaagaggagcaggcctcacaggacaagccgcccggcctcccgcagagctgtgagagctatggaggttctgatgtcacttctggaaaagagctgagtgacagctgtgaaggcgcctttggagggggcaggctggagggcagggcagcccgaaaacaccaccgcaggtccacgcgtgcgcgctcccggcaggagagggccagccggccccggcttaccatcttgaacgtgtgcaacactggggacaagatggtggagtgccagctggagacgcacaaccacaagatggtgaccttcaagttcgacttggacggggacgcacccgatgaaattgccacgtatatggtggagcatgactttatcctgcaggccgagcgggaaacgttcatcgagcagatgaaggatgtcatggacaaggcagaggacatgctcagcgaggacacagacgccgaccgtggctccgacccagggaccagcccgccacacctcagcacctgcggcctgggcaccggggaggagagccgacaatcccaagccaacgcccccgtgtatcagcagaacgtcctgcacaccgggaagaggtggttcatcatctgtccggtggctgagcaccccgcccccgaggcccctgaatcttcgcccccacttcctctaagctccctgccgccagaagccagccaagattcagcgccctataaagaccagctgtcctcgaaggaacaacccagctttctagccagtcagcagctcctgagccaggcgggccccagcaaccctcctggggcacccccagcccctttggccccctcctcccctcctgtgactgctctgccccaagatggagcagctccagccaccagcaccatgccagagccagcgtcaggaactgccagccaggcagggggtccagggacacctcaggggctgaccagtgagctcgagacgtctcagccactagcggagactcacgaggccccgcttgctgtgcagcccctcgtggtgggcctagcaccttgcactccagctccagaggctgcctcaaccagggacgccagtgccccaagggagcccctgccacctcctgcacctgagcccagcccccacagcgggaccccacagcccgccttgggtcaacctgctcccctgcttcctgccgcagtgggggccgtcagcctggccacctcccagctcccaagcccacccctggggcccaccgtccccccacagccaccctcggccctggagtcggatggggaagggccgccccccagggtgggctttgtggacagcaccatcaagagcctggacgagaagctgcggactctgctctaccaggagcacgtgcccacctcctcagcctcagctgggacccctgtggaggtgggcgacagagacttcaccctggagcccctgagaggggaccagccccgctcagaggtctgcgggggggacctggccctgcccccagtgcctaaggaggcggtctcagggcgtgtccagctgccccagcccttggtggagaagtcagaactggcccccactcgaggggccgtgatggagcagggcacgtcctcgtcaatgacagcagagtcgtctcccaggagtatgctaggctatgacagagatggaaggcaggtggcctcagactcccatgtggtccccagcgtcccccaggatgtacctgcttttgtgagacctgcacgtgtggagcccacagacagggatggtggagaagctggagaaagctcggcagagcccccgccgagtgacatgggcacagtggggggccaggctagccacccccagacactcggcgctcgagctttggggtcccctcggaaacgtccagagcagcaggatgtcagctcaccagccaagactgtgggccgtttctcggtggtcagcactcaggacgagtggaccctggcctccccccacagcctgagatactctgccccacccgacgtctacctggacgaggccccctccagccccgacgtgaagctggcagtgcggcgggcgcagacggcctcctccatcgaggtcggcgtgggcgagcccgtgtccagcgactctggggacgagggccctcgggcgagacccccggtgcagaagcaggcgtccctgcccgtgagtggcagcgtggctggcgacttcgtgaagaaggccaccgccttcctgcagaggccttctcgggccggctcgctgggccccgagacacccagcagggtgggcatgaaggtccccacgatcagcgtgacctccttccattcccagtcgtcctacatcagcagcgacaatgattcggagctcgaggatgctgacataaagaaggagctgcagagtctgcgggagaagcacctgaaggagatctcggagctgcagagccagcagaagcaggagatcgaagctctgtaccgccgcctgggcaagccactgccccccaacgtgggcttcttccacacggcaccccccactggccgccggagaaaaaccagcaagagcaagctgaaggcaggcaagctgctaaatcccctggtgcggcagctcaaggtcgtggcctccagcacaggtcacttggctgactccagcagaggccctcccgctaaggaccctgcccaagccagtgtggggctcactgcagacagcacgggcctgagcgggaaggcagtgcagacccagcagccctgctccgtccgggcctccctgtcttcggacatctgctccggcttagccagtgatggaggcggagcgcgtggccaaggctggacggtttaccacccaacgtctgagagagtgacctataagtctagtagcaaacctcgtgctcgattcctcagtggacccgtatctgtgtccatctggtctgccctgaagcgtctctgcctaggcaaagaacacagcagtaggtcctccaccagcagcctggccccaggccctgagccaggcccccagcccgccctgcacgtccaggcgcaggtgaacaacagcaacaacaagaagggtaccttcacggacgacctgcacaagctggtggacgagtggacgagcaagacggtgggggccgcgcagctgaagcccacgctcaaccagctgaagcagacccagaagctgcaagacatggaggcccaggcaggctgggctgcccctggcgaggcgcgggctatgaccgcacctcgagcaggagtggggatgccacgtctgcccccagcgcccggccctctgtccaccacggtcattcccggagccgccccgaccctgtccgtgcccacaccaggttcctgtggtccacgcgccgtctccacacccacttcctatacttgagttgatggttagaaccttgtcgtcaccctgcagaagtacagtgccttgaatgccagcttttccgttccctgatgaaaagatatgttaaaaaaaattatcggaaaaggtttcatttgcaattggcttgtgcattgataatctttatttactgttttaagttgcagagatgtgaatggtttacaaatctgaagctgaagttcaatctttggttttctgttgtaaatgccttttacaaacattgaattagctaccttaagtattgaagagcttccattgctaggtgagccctgctttgtcctcagtagagtgccggttccctgggctcatccaggggctgagagacggcgggacgctggggcagggcacactggcggagctgcttgctcagtagggaatgtcagttgttgcgctgggccatgagaaatccgccagaaaacgttaggtgagcagacatgccccccatgccagtgggctgctgtgagtgaggataaggtgtgtgttgggcatagaaaccctggctgcccgcccaccctgtggagacaagtgcagctcctccagctggagaggctgccctctctcctgcccacttccctcccttctccatgatttccatggagacctgtggctctgctcacccctggcatgcagaccgctctcccgtccagccctaagcctgctctgcggagggcggggtcattcttctcctggagatttcagtgggactcgtccccagtgggcacaacacagcccttggtgggaggggaaggccccagcctcctccacctcccactggaaagcagactgcttgggactgcccagctgtgaattgtatagtttctgtacttattagaactgggtaaattattttggttcaaatctattattccatcaattcagttagaattgaattttctaggtgattatgcagaatcttctgccagggcacgatgctgtcgtaagagatttctgttctctgtactgggcccccttgccctgttccttgagtgaagtgggggctgccctcacctgtcccccttgcctgtgaatcccttccttgtacatggtggtcagtggcacggaatccccaatagattgtatatctgaaggagaaaaataaacacttttgctcg

SEQ ID NO: 200226 - DNA, 11341 bp, Homo sapiens
  Payload ID: 19505
  Gene Name: WNK lysine deficient protein kinase 3
  Uniprot ID: Q9BYP7
  ENST ID: ENST00000354646
  CDS Start-End: 440-5842
ctcagctccgggccgagcgcgagcttgggctcgtaccccgctcccctctctccgcccgctctttacctaccggccgtagctggcccggtgggctcgcggggagacgctcgcgcgcgcaagcgcacacgacgcggagcggagctcgagacatcgaggagaggagtaagaagcatcggaggaggcgatcgaggaggaggcggtgtgtgtgtatgtgtctattctacggtgtggctcgtcgtggggcgagaggaggctcgagagagggcgagggagaagcgaaaagagtaagagagtcttcctttgcgagagcctctaatctggttgctatggaaatacatgaccacgcaaaaggaagtccattctgataattctgatacctgagatgtaactggactgaagagtagaaacaggaaaaattttagtgccaactttaattacaatggccactgattcaggggatccagccagcacagaagattctgagaaacctgatggaatttcatttgaaaacagagttccccaggtcgctgcaactttgacagtagaagctagactaaaggagaaaaacagtaccttctctgcttctggggaaactgtagaaaggaagagatttttccgaaagagtgttgaaatgacggaagatgacaaagttgccgaatcatcccccaaagatgagagaattaaggctgcaatgaatattccaagagtagataagcttccttcaaatgtgttgagaggtggacaagaagttaaatatgaacagtgttcaaagtcaacctcagaaatctcaaaagattgtttcaaggagaaaaatgaaaaggaaatggaagaagaagcagaaatgaaggctgtagctacttctcctagtggcagattcctgaaatttgacatagaactaggaagaggagcatttaaaacagtatataaaggactggacactgaaacatgggttgaggttgcttggtgtgagctgcaggaccgaaagttaaccaaagctgagcagcaaagattcaaggaagaagcagagatgttgaagggtctccagcaccccaatatagttcgattttatgattcctgggaatctatattaaaaggaaagaaatgtattgtattagtgactgaactaatgacatctgggaccttaaagacgtacttaaaacgatttaaagtcatgaaaccaaaggtcttaaggagctggtgcaggcaaattttaaaggggttgcagttcttgcacactaggactcctcctattattcaccgggatctgaagtgtgacaatattttcatcacgggacccactggatctgtgaagattggtgatctaggattagccaccttaatgcgtacctcatttgctaagagtgtcattggaactcctgagtttatggctccagagatgtatgaagaacactatgatgaatccgtagatgtttatgcttttggaatgtgtatgctggaaatggccacatcggagtatccttattctgagtgtcagaatgcagctcaaatataccggaaagtaactagtggcataaaaccagccagcttcaataaagtcactgatcctgaagtcaaagaaatcattgaaggatgtattcgtcaaaacaaatctgaaaggttgtctatcagggacctattaaaccatgcattttttgctgaggatacaggactgagggtggagttagcagaagaagatgattgctcaaattcatcccttgctttaagactctgggttgaagaccctaaaaaattgaaaggcaaacacaaagacaatgaagctattgaatttagtttcaacttagaaacagatacacctgaggaagtagcatatgaaatggtcaagtctgggttcttccatgaaagtgattccaaagctgttgctaaatccattagagaccgggtgacgccaataaagaagacaagagagaagaagcctgctggctgtttggaagaacgcagggattctcagtgcaagtctatggggaatgtattccctcagccccagaatacaactttaccccttgctcccgctcagcaaactggggctgaatgtgaagaaactgaagttgatcaacatgttagacaacagcttctacaaagaaaaccacagcagcactgctcctctgttacaggtgacaatttgtctgaggcaggagctgcatcagttatacattcagatacttcaagtcagcccagtgtagcctattcctcaaatcaaacgatgggctctcaaatggtttctaatatcccgcaggctgaagtaaatgttccagggcaaatttattcatctcagcaactagtaggacattaccagcaagtttcagggttacagaagcattcaaagctgactcagccgcagattttgcctttggttcaaggtcagtccactgttttacctgtacatgtccttggaccgacagttgtttcacaaccccaggtttccccattaactgttcagaaggtcccacagataaagcctgtatcccaaccagttggagctgaacaacaagcagctcttctaaaaccagatttagttcgaagcttgaatcaagatgtggcaactacgaaggaaaacgtcagtagccctgataacccaagtggaaatggcaaacaggatcggatcaaacagagaagagcttcctgtccccgaccagagaaggggactaaatttcagcttaccgtccttcaggtatcaacctctggagataacatggtagagtgtcagctggagacacacaacaacaagatggtcaccttcaagtttgatgttgatggtgatgcgccagaggatattgcagactatatggttgaagataactttgtgctggaaagtgagaaagaaaaatttgtagaagaattgagagctattgtaggtcaagcccaggagatccttcatgtccactttgccacagaaagagccactggagttgattctattactgtggactccaacagtagccagacagggtcatctgaacaagtacagataaattctacatctactcaaaccagcaatgaatctgctcctcagtcatccccagttggtcggtggcgattctgtatcaatcagacgataagaaaccgtgagactcagtctcctccttctcttcagcattccatgtctgcggttcctggccgacatccacttcctagtccaaaaaacacaagtaataaggaaatatcacgggacacattgctcactatagaaaataatccatgccaccgtgcacttttcacctccaaatcagaacacaaggatgtggttgatggtaagatttctgaatgtgctagtgtagaaaccaagcagccagctatactttatcaagtggaagataacaggcagataatggcaccagttactaatagttccagttactctactacttcagttcgtgcagttccagctgaatgtgagggactcaccaaacaagcaagcatattcatacctgtgtatccatgtcaccaaactgccagtcaggctgatgcacttatgtcccatcctggcgaatcaactcagacttctggtaactctcttacaactctggcatttgatcaaaagcctcaaaccttatcagtacagcagccagctatggatgcagagtttatttctcaagaaggagaaactacagtgaacactgaagcaagttctcctaagacagtcattcccactcagacccctggccttgaaccaactacccttcaacccactactgtcctggaatcagatggagaaagacctccaaaactggagtttgcagacaaccgaattaaaactctggatgaaaaattaagaaacttgctctatcaggagcacagcatctctagcatctatcccgagagtcagaaggatacccaaagcatagactctccattttcttcctctgctgaagataccctctcctgtccagtgacagaagtcatagccatcagtcactgtggaattaaagatagccctgtacaatcccctaatttccaacagacaggctctaagcttctgtccaatgtggctgcaagtcagcctgctaatatatcagtgttcaaaagggacctgaatgtgataacttctgtacccagcgaattgtgtttacatgagatgtcctcagatgcttcacttccaggggatccagaggcctatcctgctgctgtgtcaagcggtggagccattcatctgcagacaggaggtggatattttggcctaagctttacttgtcctagtctcaaaaatcctattagcaagaaatcctggactcgcaaattaaaaagctgggcatacaggctacggcagtcaaccagctttttcaagagatcaaaagtccgtcaagtggaaacagaagagatgagatcagcaattgctcctgatcccattcctctgacacgggagtccacagctgatactagggctttgaatagatgtaaagcgatgagtggatcatttcagcggggtcggttccaggtgattacaattcctcagcagcagtcagcaaaaatgacatcttttggaatagaacacatatcagtgttcagtgagacaaaccattctagtgaagaagcctttattaaaacagcaaagtctcagttggtagaaatagaacctgccacacaaaatccaaaaacttcgttttcttatgagaagttacaagctcttcaggaaacctgtaaagaaaataaaggagttcccaaacaaggtgacaacttcttatctttcagcgcagcttgtgagactgatgtatcttcagtgaccccagaaaaggaatttgaagaaacttcagccacaggaagtagcatgcagtctggatctgaactgttgcttaaagagagagagatattgactgctgggaaacagcctagctctgatagtgaattttcagccagtcttgctggcagtggaaagtcagtggcaaagactggtccagagagtaatcagtgcttaccacaccacgaagaacaagcttatgctcaaacacagagttcactcttctattcgccatcttccccaatgagcagtgatgatgaatcagaaatagaggatgaggacttgaaggtggagcttcaaagattacgagaaaaacacattcaggaggtggtaaatcttcaaacccagcagaataaggagctgcaggagctctatgaacgccttcggtcaattaaagatagcaaaacccaatctactgagattcctttgccacctgcatcaccacgtcgaccaagatctttcaaaagcaaacttcgaagccgcccccagtccttgacacatgtggacaatggcatagttgctacagggaaaagctgccttataaatgagttggaaaatccactgtgtgtggagagtaatgcagcatcatgccaacagtctccagccagtaaaaaagggatgttcacagatgacttacacaagctggtggatgactggacaaaggaagcagtaggaaattctcttattaagccaagtttaaaccaacttaaacaaagtcaacacaaactagagacagaaaactggaataaagtatctgaaaatactccgtctactatgggctacacatcaacatggatttcttctctgtcccaaatccgtggagctgtcccaacttccttgccacaaggactctcactcccttcatttcctgggccattatcatcatatggaatgcctcacgtttgtcagtataatgctgtggcgggggcggggtatccagtacagtgggtaggaatttcaggaacaacacaacaatctgtagtaattcccgcccaatctgggggaccattccagccagggatgaatatgcaggcatttccaacttcatcagtgcagaatcctgccacaatccctcctggtcctaaatgaatcagagtagatggtgataaaaagggaggttttttcagaattattttcaggacacccaagatattaaagtttcttcctcttgggttctgtcatattttccctcatttgagtttactttagactatatattttttgttccagtgtggtatttgatacagctcatcattctgtagaaatgtgcagtttgcagatagaacactgcacacagaaatgttttttcacttcaaattctatcctctttgatacttgattttttaaaaatactgttcagaatgctttaataagctcagcttgagcattaccatttccaggacactttccatgaattgttgagaagctccccatcccccgccttttttttttttttttttaactgctgctatctgcagctggatactcttctttaaaaatgtttaaaaattatttagattgattctccccaaatgtggatgaactgagaccctccatcagccagagtcttatgggatcttcacttcacatgtttgtcttaggtttacctttcacagaaggcagggtaacttgctgcaggaaacgttttggtgtataaaattagaatcacttttttttttttttttgagatggagtctctctctgtcacccaggttggagtgcagtggtgtgatcttggctcactgctgcaacctccccctcctgggttcaagcgattctcctgcctcagcctcctgagtagctgggactacaggcgccagccaccatgcctggctaatttttgtatttttagtagaggatggggtttcactatgttggccagactggtctcaaactcctaaccttgtgatccgccctccttagcccccccaaaaaattacaataattttgtcaaccaatacagaacatgagccctttttaaatgtgatttcccgtcatcacagcagtaggatgaagccttgttttgggtgagacagagggaaagggaaaaaacagaattgtaacagttccttgattctgcagatactgctgctgttttacgatttcagtaataattcaaagcagctgtctccttgtttctcacatgcatactacattggttttgagcatctgagaggcattggtttgtcttgcattcttttgcaaggcatatattgcagctgatatgaatctcgtttggggggaatccttgtattcctaacaagggggattaaagctacacctcaatccattcttctgaagtgaaatttacttgacacagtaggtttcgagacttacatatgaaacactggctttacagggttctcagagatgtggggtatacactgtcctgcagtgagatagtagaccctagaaggatactatttaagttgtccttagctctttttaattacaatttttagttgttagaatttctttttagtatctatagtatcttagatgattttagatcttaaatgagtttggcagcctctttagaatctgagagagatcactgtcaagttgcactttactgggttttatccagttttaggaggaggggaggcaatgtcaaaatgtacacctttggtttttaagaaggttaactataataatgttaaaggctagtcacagggttacctaatgctcagtctgtgaaacctaaatagaattcttaaaatgttatttaccaactaagtattcatgttcaaattacttaccttccactctgaagactttaaggtcatttctaatacacatttacctaattaggagttctgtctactagtaaacattccaaattgctacccaacattactgttaacagattttcctccgtattcttctaaaaattataccccatgggcttgccaggtaatgacgaaaacttaatgggtgtacttttttttttttttgcacagtctactttgtgacattaagtacctcttttccaaaaaaaaaaaaaaatgtgttttatgttgcttacctgaggatcacatccattatcaagaagattctgtcgctataatttgaggcatctagggcagcattttgagaattgctgttgataagatccactgtttcttttcatagaacatgatctgttttgtatgagtctttccaaatgttaagtacagattcttcaaatttcttgtacagtattggtttgcagtttaaagtgattttaggacattagtgtaatgcaaatgcttgcattgcactgttttccatatgtataaaaacaatgctcctaaaatccctaattctttaaaactgcctgtgtttcattataaaaagttggctttgtgtaattacaccgagccatacaacctataaagtgaaaatactgcagattttaggaccccttcttctctagtcacaatcattttaaacagtgtaccccaggatgaaaaaagctccatggctgacatgtacaattacatgtattaatgactgctctacatcctatgttctgcctttggccaccacctctattccacatataattcatcattcttgtttgcctgcagactcttgcagtgccttgtaatatttacaatcttttcaggtttttgctggaaagaaaagtagtcttctaaagtttgaagatggtgaatagtgtactgctgtctccatgctgactgcagtaaccgggttatcatatatgttatgtatacattatgtatatataacatgtgtacatttaaaaatacagaaaaaagtgagcttgtgcagaaatggagaaaacaatgttattctcatcactgtggggttttattaaaattattttttcccatgacttacatgtttggttcagattatagtcactttgactgtaaatactggctagttttctatccagggcttttgcattatttcataattttgctaaatcatataatagtgctattttcatccttgtctgaggtacttttcctccccagaaataattaacttgaggtaaagctcagaaattcccttcttaacaaagagcctactatataaaaagggccttcctttccaaaaaacacacaaacctgtccttttcattttccttcttgtagaggagaaaatggttgtacttaaccatcctgcttgtaaagtttattcagaggatagtctgtatgtccagccaccatgtttacttctcaaagtgcaagtctgatgaatagtactgtatctccatatgtggtaatgtgagcatttcatcatgaagtacctgctgctatgtctgtgaagttgggtgtaacatcataagaatatgaaaccagtattggtgtaaatctaatgaaaataaccctatgtatatttgtagcagtcttgaatctctatttaaggtaatttgctgtaatataacaaatattcattctgtttttcatcccttccttgccagttttatatcaagcatgaattccaatggtttgacagcaaaattatctgtgaaagtttaaaaggcacttttctgctgtgatttttggattgagtgtggagtgttatgtacagtttgatgggatatatcattttagaaccccagatttaattctagtccaattaattttgtttaactacctcgttttcagtgctgttttgggtgcacaagtaaacactacctgtgaaacttgcttttttgccttgattctcagtattctttcagattataaatctggtctgcctcttttttcccagtgctagccaacagtttgagatgagagggatcatcactctcatctgtgtttaagtggagagccatgtgcttctgtgaaatatgctttggggatttgggggtggagagcagaagaataattgaaattggtggcaatataggatttaggtgtaggagttagttataaaataaacaaatggtaagaaagtacctgaattagacaatccagtgcctataactttgcattttttattagagatgcatttctcgtctgtgtgcctaaagggcaatgggttgaaattgctttaactaccacagcgaaatatttgacaaatccttcagcaatggcctatcattcaacatatattagcacagtgctaggtatttgcagtggtattttgttaccttaaaacggccaaatgcatttagttgaaatgtagttgatagtaagggttttatataactttatccaatctctaaagtttatggaagcattgactttcttctttgctgtcttttctgagtgatgaaaatgatgcattccttttttttccttgaaaactcagcaaatgtttgtaaccagatgttccttgtttcacatgtttactgtgtaacactacagcatatttaatattggtaaatactgtatttcagtcattatgcataagtacattcctgaggtatatttgccatcattttgggattcagttattttatcttctgtttgggtcagaaaaacttgaactatctgaggtggtatgcaggccattttctagaagattgttttttgaatctgtagtttatcaaggacttgttccccccctccctttgtttagaagaggaatcagaaaaggggggtggtgtgtagaaaaggcctttgatttgataggtgtaatttctaagattgaaattttaaaaatgcagatcgtaagatagtaacactcaaacttgataaaatcctttgaattgaaattagtatgaaatttttatggaaccaaatgccttcaggtcaccctggaaatagtctttgtatgtgaaagatcaacacaaacattggtcaggaaccctgacagccaatatatgaaggagcctgggatagtaactaggttacactaaagttattttcaactaagatagctagacgagtgtacaaaccaatagctcctattctggaaggttttctttttattaaaaaaaattcaaacaaggttaaaagtcaagcaagaagggaagagagaaactgggttctgagaaaaaaatgtgccagtataaaataaactcctaaatgcgtgcttgtcatcctctagtttttttttaagttgaatttcttttccactgtaacttaagatttgagattgaggtttgcggtccagaacataccctcagcagatacagtgactaactggaaagtgcagttgttcaaggtctgtcatgctcaatcacctaaagctataatttgtttgatatattaagcatgtagacctagtgcagcatgggagccactcaggaagtttatgcaattaataaactttcagcataatttactatgaagtatgcagaatttcaccctcttctccacacttaacatttagttgtatatgtgaactctcctttcttaattggggaatgtagcattatatagaatgttgttaaagttaattttaatcctttttgacattaacctttttttttttttggtaaaccaagtgatctgcctttcagcaactgtcttattttggttctttgaaactgtgatttttatttcatttgtacccaaccattgtaagtattttgttttgtttcctggaaattctgttttgaaacagaaaataaaggctgtgttaaatgagtatgttatcttattaaaatgctgccatagtcactgc

SEQ ID NO: 200227 - DNA, 5403 bp, Homo sapiens
  Payload ID: 19505
  Gene Name: WNK lysine deficient protein kinase 3
  Uniprot ID: Q9BYP7
  ENST ID: ENST00000375159
  CDS Start-End: 1-5403
atggccactgattcaggggatccagccagcacagaagattctgagaaacctgatggaatttcatttgaaaacagagttccccaggtcgctgcaactttgacagtagaagctagactaaaggagaaaaacagtaccttctctgcttctggggaaactgtagaaaggaagagatttttccgaaagagtgttgaaatgacggaagatgacaaagttgccgaatcatcccccaaagatgagagaattaaggctgcaatgaatattccaagagtagataagcttccttcaaatgtgttgagaggtggacaagaagttaaatatgaacagtgttcaaagtcaacctcagaaatctcaaaagattgtttcaaggagaaaaatgaaaaggaaatggaagaagaagcagaaatgaaggctgtagctacttctcctagtggcagattcctgaaatttgacatagaactaggaagaggagcatttaaaacagtatataaaggactggacactgaaacatgggttgaggttgcttggtgtgagctgcaggaccgaaagttaaccaaagctgagcagcaaagattcaaggaagaagcagagatgttgaagggtctccagcaccccaatatagttcgattttatgattcctgggaatctatattaaaaggaaagaaatgtattgtattagtgactgaactaatgacatctgggaccttaaagacgtacttaaaacgatttaaagtcatgaaaccaaaggtcttaaggagctggtgcaggcaaattttaaaggggttgcagttcttgcacactaggactcctcctattattcaccgggatctgaagtgtgacaatattttcatcacgggacccactggatctgtgaagattggtgatctaggattagccaccttaatgcgtacctcatttgctaagagtgtcattggaactcctgagtttatggctccagagatgtatgaagaacactatgatgaatccgtagatgtttatgcttttggaatgtgtatgctggaaatggccacatcggagtatccttattctgagtgtcagaatgcagctcaaatataccggaaagtaactagtggcataaaaccagccagcttcaataaagtcactgatcctgaagtcaaagaaatcattgaaggatgtattcgtcaaaacaaatctgaaaggttgtctatcagggacctattaaaccatgcattttttgctgaggatacaggactgagggtggagttagcagaagaagatgattgctcaaattcatcccttgctttaagactctgggttgaagaccctaaaaaattgaaaggcaaacacaaagacaatgaagctattgaatttagtttcaacttagaaacagatacacctgaggaagtagcatatgaaatggtcaagtctgggttcttccatgaaagtgattccaaagctgttgctaaatccattagagaccgggtgacgccaataaagaagacaagagagaagaagcctgctggctgtttggaagaacgcagggattctcagtgcaagtctatggggaatgtattccctcagccccagaatacaactttaccccttgctcccgctcagcaaactggggctgaatgtgaagaaactgaagttgatcaacatgttagacaacagcttctacaaagaaaaccacagcagcactgctcctctgttacaggtgacaatttgtctgaggcaggagctgcatcagttatacattcagatacttcaagtcagcccagtgtagcctattcctcaaatcaaacgatgggctctcaaatggtttctaatatcccgcaggctgaagtaaatgttccagggcaaatttattcatctcagcaactagtaggacattaccagcaagtttcagggttacagaagcattcaaagctgactcagccgcagattttgcctttggttcaaggtcagtccactgttttacctgtacatgtccttggaccgacagttgtttcacaaccccaggtttccccattaactgttcagaaggtcccacagataaagcctgtatcccaaccagttggagctgaacaacaagcagctcttctaaaaccagatttagttcgaagcttgaatcaagatgtggcaactacgaaggaaaacgtcagtagccctgataacccaagtggaaatggcaaacaggatcggatcaaacagagaagagcttcctgtccccgaccagagaaggggactaaatttcagcttaccgtccttcaggtatcaacctctggagataacatggtagagtgtcagctggagacacacaacaacaagatggtcaccttcaagtttgatgttgatggtgatgcgccagaggatattgcagactatatggttgaagataactttgtgctggaaagtgagaaagaaaaatttgtagaagaattgagagctattgtaggtcaagcccaggagatccttcatgtccactttgccacagaaagagccactggagttgattctattactgtggactccaacagtagccagacagggtcatctgaacaagtacagataaattctacatctactcaaaccagcaatgaatctgctcctcagtcatccccagttggtcggtggcgattctgtatcaatcagacgataagaaaccgtgagactcagtctcctccttctcttcagcattccatgtctgcggttcctggccgacatccacttcctagtccaaaaaacacaagtaataaggaaatatcacgggacacattgctcactatagaaaataatccatgccaccgtgcacttttcacctccaaatcagaacacaaggatgtggttgatggtaagatttctgaatgtgctagtgtagaaaccaagcagccagctatactttatcaagtggaagataacaggcagataatggcaccagttactaatagttccagttactctactacttcagttcgtgcagttccagctgaatgtgagggactcaccaaacaagcaagcatattcatacctgtgtatccatgtcaccaaactgccagtcaggctgatgcacttatgtcccatcctggcgaatcaactcagacttctggtaactctcttacaactctggcatttgatcaaaagcctcaaaccttatcagtacagcagccagctatggatgcagagtttatttctcaagaaggagaaactacagtgaacactgaagcaagttctcctaagacagtcattcccactcagacccctggccttgaaccaactacccttcaacccactactgtcctggaatcagatggagaaagacctccaaaactggagtttgcagacaaccgaattaaaactctggatgaaaaattaagaaacttgctctatcaggagcacagcatctctagcatctatcccgagagtcagaaggatacccaaagcatagactctccattttcttcctctgctgaagataccctctcctgtccagtgacagaagtcatagccatcagtcactgtggaattaaagatagccctgtacaatcccctaatttccaacagacaggctctaagcttctgtccaatgtggctgcaagtcagcctgctaatatatcagtgttcaaaagggacctgaatgtgataacttctgtacccagcgaattgtgtttacatgagatgtcctcagatgcttcacttccaggggatccagaggcctatcctgctgctgtgtcaagcggtggagccattcatctgcagacaggaggtggatattttggcctaagctttacttgtcctagtctcaaaaatcctattagcaagaaatcctggactcgcaaattaaaaagctgggcatacaggctacggcagtcaaccagctttttcaagagatcaaaagtccgtcaagtggaaacagaagagatgagatcagcaattgctcctgatcccattcctctgacacgggagtccacagctgatactagggctttgaatagatgtaaagcgatgagtggatcatttcagcggggtcggttccaggtgattacaattcctcagcagcagtcagcaaaaatgacatcttttggaatagaacacatatcagtgttcagtgagacaaaccattctagtgaagaagcctttattaaaacagcaaagtctcagttggtagaaatagaacctgccacacaaaatccaaaaacttcgttttcttatgagaagttacaagctcttcaggaaacctgtaaagaaaataaaggagttcccaaacaaggtgacaacttcttatctttcagcgcagcttgtgagactgatgtatcttcagtgaccccagaaaaggaatttgaagaaacttcagccacaggaagtagcatgcagtctggatctgaactgttgcttaaagagagagagatattgactgctgggaaacagcctagctctgatagtgaattttcagccagtcttgctggcagtggaaagtcagtggcaaagactggtccagagagtaatcagtgcttaccacaccacgaagaacaagcttatgctcaaacacagagttcactcttctattcgccatcttccccaatgagcagtgatgatgaatcagaaatagaggatgaggacttgaaggtggagcttcaaagattacgagaaaaacacattcaggaggtggtaaatcttcaaacccagcagaataaggagctgcaggagctctatgaacgccttcggtcaattaaagatagcaaaacccaatctactgagattcctttgccacctgcatcaccacgtcgaccaagatctttcaaaagcaaacttcgaagccgcccccagtccttgacacatgtggacaatggcatagttgctacagggaaaagctgccttataaatgagttggaaaatccactgtgtgtggagagtaatgcagcatcatgccaacagtctccagccagtaaaaaagggatgttcacagatgacttacacaagctggtggatgactggacaaaggaagcagtaggaaattctcttattaagccaagtttaaaccaacttaaacaaagtcaacacaaactagagacagaaaactggaataaagtatctgaaaatactccgtctactatgggctacacatcaacatggatttcttctctgtcccaaatccgtggagctgtcccaacttccttgccacaaggactctcactcccttcatttcctgggccattatcatcatatggaatgcctcacgtttgtcagtataatgctgtggcgggggcggggtatccagtacagtgggtaggaatttcaggaacaacacaacaatctgtagtaattcccgcccaatctgggggaccattccagccagggatgaatatgcaggcatttccaacttcatcagtgcagaatcctgccacaatccctcctggtcctaaatga

SEQ ID NO: 200228 - DNA, 11172 bp, Homo sapiens
  Payload ID: 19505
  Gene Name: WNK lysine deficient protein kinase 3
  Uniprot ID: Q9BYP7
  ENST ID: ENST00000375169
  CDS Start-End: 440-5671
ctcagctccgggccgagcgcgagcttgggctcgtaccccgctcccctctctccgcccgctctttacctaccggccgtagctggcccggtgggctcgcggggagacgctcgcgcgcgcaagcgcacacgacgcggagcggagctcgagacatcgaggagaggagtaagaagcatcggaggaggcgatcgaggaggaggcggtgtgtgtgtatgtgtctattctacggtgtggctcgtcgtggggcgagaggaggctcgagagagggcgagggagaagcgaaaagagtaagagagtcttcctttgcgagagcctctaatctggttgctatggaaatacatgaccacgcaaaaggaagtccattctgataattctgatacctgagatgtaactggactgaagagtagaaacaggaaaaattttagtgccaactttaattacaatggccactgattcaggggatccagccagcacagaagattctgagaaacctgatggaatttcatttgaaaacagagttccccaggtcgctgcaactttgacagtagaagctagactaaaggagaaaaacagtaccttctctgcttctggggaaactgtagaaaggaagagatttttccgaaagagtgttgaaatgacggaagatgacaaagttgccgaatcatcccccaaagatgagagaattaaggctgcaatgaatattccaagagtagataagcttccttcaaatgtgttgagaggtggacaagaagttaaatatgaacagtgttcaaagtcaacctcagaaatctcaaaagattgtttcaaggagaaaaatgaaaaggaaatggaagaagaagcagaaatgaaggctgtagctacttctcctagtggcagattcctgaaatttgacatagaactaggaagaggagcatttaaaacagtatataaaggactggacactgaaacatgggttgaggttgcttggtgtgagctgcaggaccgaaagttaaccaaagctgagcagcaaagattcaaggaagaagcagagatgttgaagggtctccagcaccccaatatagttcgattttatgattcctgggaatctatattaaaaggaaagaaatgtattgtattagtgactgaactaatgacatctgggaccttaaagacgtacttaaaacgatttaaagtcatgaaaccaaaggtcttaaggagctggtgcaggcaaattttaaaggggttgcagttcttgcacactaggactcctcctattattcaccgggatctgaagtgtgacaatattttcatcacgggacccactggatctgtgaagattggtgatctaggattagccaccttaatgcgtacctcatttgctaagagtgtcattggaactcctgagtttatggctccagagatgtatgaagaacactatgatgaatccgtagatgtttatgcttttggaatgtgtatgctggaaatggccacatcggagtatccttattctgagtgtcagaatgcagctcaaatataccggaaagtaactagtggcataaaaccagccagcttcaataaagtcactgatcctgaagtcaaagaaatcattgaaggatgtattcgtcaaaacaaatctgaaaggttgtctatcagggacctattaaaccatgcattttttgctgaggatacaggactgagggtggagttagcagaagaagatgattgctcaaattcatcccttgctttaagactctgggttgaagaccctaaaaaattgaaaggcaaacacaaagacaatgaagctattgaatttagtttcaacttagaaacagatacacctgaggaagtagcatatgaaatggtcaagtctgggttcttccatgaaagtgattccaaagctgttgctaaatccattagagaccgggtgacgccaataaagaagacaagagagaagaagcctgctggctgtttggaagaacgcagggattctcagtgcaagtctatggggaatgtattccctcagccccagaatacaactttaccccttgctcccgctcagcaaactggggctgaatgtgaagaaactgaagttgatcaacatgttagacaacagcttctacaaagaaaaccacagcagcactgctcctctgttacaggtgacaatttgtctgaggcaggagctgcatcagttatacattcagatacttcaagtcagcccagtgtagcctattcctcaaatcaaacgatgggctctcaaatggtttctaatatcccgcaggctgaagtaaatgttccagggcaaatttattcatctcagcaactagtaggacattaccagcaagtttcagggttacagaagcattcaaagctgactcagccgcagattttgcctttggttcaaggtcagtccactgttttacctgtacatgtccttggaccgacagttgtttcacaaccccaggtttccccattaactgttcagaaggtcccacagataaagcctgtatcccaaccagttggagctgaacaacaagcagctcttctaaaaccagatttagttcgaagcttgaatcaagatgtggcaactacgaaggaaaacgtcagtagccctgataacccaagtggaaatggcaaacaggatcggatcaaacagagaagagcttcctgtccccgaccagagaaggggactaaatttcagcttaccgtccttcaggtatcaacctctggagataacatggtagagtgtcagctggagacacacaacaacaagatggtcaccttcaagtttgatgttgatggtgatgcgccagaggatattgcagactatatggttgaagataactttgtgctggaaagtgagaaagaaaaatttgtagaagaattgagagctattgtaggtcaagcccaggagatccttcatgtccactttgccacagaaagagccactggagttgattctattactgtggactccaacagtagccagacagggtcatctgaacaagtacagataaattctacatctactcaaaccagcaatgaatctgctcctcagtcatccccagttggtcggtggcgattctgtatcaatcagacgataagaaaccgtgagactcagtctcctccttctcttcagcattccatgtctgcggttcctggccgacatccacttcctagtccaaaaaacacaagtaataaggaaatatcacgggacacattgctcactatagaaaataatccatgccaccgtgcacttttcacctccaaatcagaacacaaggatgtggttgatggtaagatttctgaatgtgctagtgtagaaaccaagcagccagctatactttatcaagtggaagataacaggcagataatggcaccagttactaatagttccagttactctactacttcagttcgtgcagttccagctgaatgtgagggactcaccaaacaagcaagcatattcatacctgtgtatccatgtcaccaaactgccagtcaggctgatgcacttatgtcccatcctggcgaatcaactcagacttctggtaactctcttacaactctggcatttgatcaaaagcctcaaaccttatcagtacagcagccagctatggatgcagagtttatttctcaagaaggagaaactacagtgaacactgaagcaagttctcctaagacagtcattcccactcagacccctggccttgaaccaactacccttcaacccactactgtcctggaatcagatggagaaagacctccaaaactggagtttgcagacaaccgaattaaaactctggatgaaaaattaagaaacttgctctatcaggagcacagcatctctagcatctatcccgagagtcagaaggatacccaaagcatagactctccattttcttcctctgctgaagataccctctcctgtccagtgacagaagtcatagccatcagtcactgtggaattaaagatagccctgtacaatcccctaatttccaacagacaggctctaagcttctgtccaatgtggctgcaagtcagcctgctaatatatcagtgttcaaaagggacctgaatgtgataacttctgtacccagcgaattgtgtttacatgagatgtcctcagatgcttcacttccaggggatccagaggcctatcctgctgctgtgtcaagcggtggagccattcatctgcagacaggagtggaaacagaagagatgagatcagcaattgctcctgatcccattcctctgacacgggagtccacagctgatactagggctttgaatagatgtaaagcgatgagtggatcatttcagcggggtcggttccaggtgattacaattcctcagcagcagtcagcaaaaatgacatcttttggaatagaacacatatcagtgttcagtgagacaaaccattctagtgaagaagcctttattaaaacagcaaagtctcagttggtagaaatagaacctgccacacaaaatccaaaaacttcgttttcttatgagaagttacaagctcttcaggaaacctgtaaagaaaataaaggagttcccaaacaaggtgacaacttcttatctttcagcgcagcttgtgagactgatgtatcttcagtgaccccagaaaaggaatttgaagaaacttcagccacaggaagtagcatgcagtctggatctgaactgttgcttaaagagagagagatattgactgctgggaaacagcctagctctgatagtgaattttcagccagtcttgctggcagtggaaagtcagtggcaaagactggtccagagagtaatcagtgcttaccacaccacgaagaacaagcttatgctcaaacacagagttcactcttctattcgccatcttccccaatgagcagtgatgatgaatcagaaatagaggatgaggacttgaaggtggagcttcaaagattacgagaaaaacacattcaggaggtggtaaatcttcaaacccagcagaataaggagctgcaggagctctatgaacgccttcggtcaattaaagatagcaaaacccaatctactgagattcctttgccacctgcatcaccacgtcgaccaagatctttcaaaagcaaacttcgaagccgcccccagtccttgacacatgtggacaatggcatagttgctacagatccactgtgtgtggagagtaatgcagcatcatgccaacagtctccagccagtaaaaaagggatgttcacagatgacttacacaagctggtggatgactggacaaaggaagcagtaggaaattctcttattaagccaagtttaaaccaacttaaacaaagtcaacacaaactagagacagaaaactggaataaagtatctgaaaatactccgtctactatgggctacacatcaacatggatttcttctctgtcccaaatccgtggagctgtcccaacttccttgccacaaggactctcactcccttcatttcctgggccattatcatcatatggaatgcctcacgtttgtcagtataatgctgtggcgggggcggggtatccagtacagtgggtaggaatttcaggaacaacacaacaatctgtagtaattcccgcccaatctgggggaccattccagccagggatgaatatgcaggcatttccaacttcatcagtgcagaatcctgccacaatccctcctggtcctaaatgaatcagagtagatggtgataaaaagggaggttttttcagaattattttcaggacacccaagatattaaagtttcttcctcttgggttctgtcatattttccctcatttgagtttactttagactatatattttttgttccagtgtggtatttgatacagctcatcattctgtagaaatgtgcagtttgcagatagaacactgcacacagaaatgttttttcacttcaaattctatcctctttgatacttgattttttaaaaatactgttcagaatgctttaataagctcagcttgagcattaccatttccaggacactttccatgaattgttgagaagctccccatcccccgccttttttttttttttttttaactgctgctatctgcagctggatactcttctttaaaaatgtttaaaaattatttagattgattctccccaaatgtggatgaactgagaccctccatcagccagagtcttatgggatcttcacttcacatgtttgtcttaggtttacctttcacagaaggcagggtaacttgctgcaggaaacgttttggtgtataaaattagaatcacttttttttttttttttgagatggagtctctctctgtcacccaggttggagtgcagtggtgtgatcttggctcactgctgcaacctccccctcctgggttcaagcgattctcctgcctcagcctcctgagtagctgggactacaggcgccagccaccatgcctggctaatttttgtatttttagtagaggatggggtttcactatgttggccagactggtctcaaactcctaaccttgtgatccgccctccttagcccccccaaaaaattacaataattttgtcaaccaatacagaacatgagccctttttaaatgtgatttcccgtcatcacagcagtaggatgaagccttgttttgggtgagacagagggaaagggaaaaaacagaattgtaacagttccttgattctgcagatactgctgctgttttacgatttcagtaataattcaaagcagctgtctccttgtttctcacatgcatactacattggttttgagcatctgagaggcattggtttgtcttgcattcttttgcaaggcatatattgcagctgatatgaatctcgtttggggggaatccttgtattcctaacaagggggattaaagctacacctcaatccattcttctgaagtgaaatttacttgacacagtaggtttcgagacttacatatgaaacactggctttacagggttctcagagatgtggggtatacactgtcctgcagtgagatagtagaccctagaaggatactatttaagttgtccttagctctttttaattacaatttttagttgttagaatttctttttagtatctatagtatcttagatgattttagatcttaaatgagtttggcagcctctttagaatctgagagagatcactgtcaagttgcactttactgggttttatccagttttaggaggaggggaggcaatgtcaaaatgtacacctttggtttttaagaaggttaactataataatgttaaaggctagtcacagggttacctaatgctcagtctgtgaaacctaaatagaattcttaaaatgttatttaccaactaagtattcatgttcaaattacttaccttccactctgaagactttaaggtcatttctaatacacatttacctaattaggagttctgtctactagtaaacattccaaattgctacccaacattactgttaacagattttcctccgtattcttctaaaaattataccccatgggcttgccaggtaatgacgaaaacttaatgggtgtacttttttttttttttgcacagtctactttgtgacattaagtacctcttttccaaaaaaaaaaaaaaatgtgttttatgttgcttacctgaggatcacatccattatcaagaagattctgtcgctataatttgaggcatctagggcagcattttgagaattgctgttgataagatccactgtttcttttcatagaacatgatctgttttgtatgagtctttccaaatgttaagtacagattcttcaaatttcttgtacagtattggtttgcagtttaaagtgattttaggacattagtgtaatgcaaatgcttgcattgcactgttttccatatgtataaaaacaatgctcctaaaatccctaattctttaaaactgcctgtgtttcattataaaaagttggctttgtgtaattacaccgagccatacaacctataaagtgaaaatactgcagattttaggaccccttcttctctagtcacaatcattttaaacagtgtaccccaggatgaaaaaagctccatggctgacatgtacaattacatgtattaatgactgctctacatcctatgttctgcctttggccaccacctctattccacatataattcatcattcttgtttgcctgcagactcttgcagtgccttgtaatatttacaatcttttcaggtttttgctggaaagaaaagtagtcttctaaagtttgaagatggtgaatagtgtactgctgtctccatgctgactgcagtaaccgggttatcatatatgttatgtatacattatgtatatataacatgtgtacatttaaaaatacagaaaaaagtgagcttgtgcagaaatggagaaaacaatgttattctcatcactgtggggttttattaaaattattttttcccatgacttacatgtttggttcagattatagtcactttgactgtaaatactggctagttttctatccagggcttttgcattatttcataattttgctaaatcatataatagtgctattttcatccttgtctgaggtacttttcctccccagaaataattaacttgaggtaaagctcagaaattcccttcttaacaaagagcctactatataaaaagggccttcctttccaaaaaacacacaaacctgtccttttcattttccttcttgtagaggagaaaatggttgtacttaaccatcctgcttgtaaagtttattcagaggatagtctgtatgtccagccaccatgtttacttctcaaagtgcaagtctgatgaatagtactgtatctccatatgtggtaatgtgagcatttcatcatgaagtacctgctgctatgtctgtgaagttgggtgtaacatcataagaatatgaaaccagtattggtgtaaatctaatgaaaataaccctatgtatatttgtagcagtcttgaatctctatttaaggtaatttgctgtaatataacaaatattcattctgtttttcatcccttccttgccagttttatatcaagcatgaattccaatggtttgacagcaaaattatctgtgaaagtttaaaaggcacttttctgctgtgatttttggattgagtgtggagtgttatgtacagtttgatgggatatatcattttagaaccccagatttaattctagtccaattaattttgtttaactacctcgttttcagtgctgttttgggtgcacaagtaaacactacctgtgaaacttgcttttttgccttgattctcagtattctttcagattataaatctggtctgcctcttttttcccagtgctagccaacagtttgagatgagagggatcatcactctcatctgtgtttaagtggagagccatgtgcttctgtgaaatatgctttggggatttgggggtggagagcagaagaataattgaaattggtggcaatataggatttaggtgtaggagttagttataaaataaacaaatggtaagaaagtacctgaattagacaatccagtgcctataactttgcattttttattagagatgcatttctcgtctgtgtgcctaaagggcaatgggttgaaattgctttaactaccacagcgaaatatttgacaaatccttcagcaatggcctatcattcaacatatattagcacagtgctaggtatttgcagtggtattttgttaccttaaaacggccaaatgcatttagttgaaatgtagttgatagtaagggttttatataactttatccaatctctaaagtttatggaagcattgactttcttctttgctgtcttttctgagtgatgaaaatgatgcattccttttttttccttgaaaactcagcaaatgtttgtaaccagatgttccttgtttcacatgtttactgtgtaacactacagcatatttaatattggtaaatactgtatttcagtcattatgcataagtacattcctgaggtatatttgccatcattttgggattcagttattttatcttctgtttgggtcagaaaaacttgaactatctgaggtggtatgcaggccattttctagaagattgttttttgaatctgtagtttatcaaggacttgttccccccctccctttgtttagaagaggaatcagaaaaggggggtggtgtgtagaaaaggcctttgatttgataggtgtaatttctaagattgaaattttaaaaatgcagatcgtaagatagtaacactcaaacttgataaaatcctttgaattgaaattagtatgaaatttttatggaaccaaatgccttcaggtcaccctggaaatagtctttgtatgtgaaagatcaacacaaacattggtcaggaaccctgacagccaatatatgaaggagcctgggatagtaactaggttacactaaagttattttcaactaagatagctagacgagtgtacaaaccaatagctcctattctggaaggttttctttttattaaaaaaaattcaaacaaggttaaaagtcaagcaagaagggaagagagaaactgggttctgagaaaaaaatgtgccagtataaaataaactcctaaatgcgtgcttgtcatcctctagtttttttttaagttgaatttcttttccactgtaacttaagatttgagattgaggtttgcggtccagaacataccctcagcagatacagtgactaactggaaagtgcagttgttcaaggtctgtcatgctcaatcacctaaagctataatttgtttgatatattaagcatgtagacctagtgcagcatgggagccactcaggaagtttatgcaattaataaactttcagcataatttactatgaagtatgcagaatttcaccctcttctccacacttaacatttagttgtatatgtgaactctcctttcttaattggggaatgtagcattatatagaatgttgttaaagttaattttaatcctttttgacattaacctttttttttttttggtaaaccaagtgatctgcctttcagcaactgtcttattttggttctttgaaactgtgatttttatttcatttgtacccaaccattgtaagtattttgttttgtttcctggaaattctgttttgaaacagaaaataaaggctgtgttaaatgagtatgttatcttattaaaatgctgccatagtcactgcaa

SEQ ID NO: 200229 - DNA, 715 bp, Homo sapiens
  Payload ID: 19505
  Gene Name: WNK lysine deficient protein kinase 3
  ENST ID: ENST00000458404
  CDS Start-End: 220-715
gggggcgggggagacatgccgtggctgttgcccccgcaacgtaactgggaggccagtatttgtaaatcggtgcttcgacttctaatcccaaagccggcaggttgctatggaaatacatgaccacgcaaaaggaagtccattctgataattctgatacctgagatgtaactggactgaagagtagaaacaggaaaaattttagtgccaactttaattacaatggccactgattcaggggatccagccagcacagaagattctgagaaacctgatggaatttcatttgaaaacagagttccccaggtcgctgcaactttgacagtagaagctagactaaaggagaaaaacagtaccttctctgcttctggggaaactgtagaaaggaagagatttttccgaaagagtgttgaaatgacggaagatgacaaagttgccgaatcatcccccaaagatgagagaattaaggctgcaatgaatattccaagagtagataagcttccttcaaatgtgttgagaggtggacaagaagttaaatatgaacagtgttcaaagtcaacctcagaaatctcaaaagattgtttcaaggagaaaaatgaaaaggaaatggaagaagaagcagaaatgaaggctgtagctacttctcctagtggcagattcctgaaatttgacatagaactaggaagaggagcatttaaaacagtatataaaggactgg

SEQ ID NO: 200230 - DNA, 5400 bp, Homo sapiens
  Payload ID: 19505
  Gene Name: WNK lysine deficient protein kinase 3
  ENST ID: ENST00000620763
  CDS Start-End: 1-5400
atggccactgattcaggggatccagccagcacagaagattctgagaaacctgatggaatttcatttgaaaacagagttccccaggtcgctgcaactttgacagtagaagctagactaaaggagaaaaacagtaccttctctgcttctggggaaactgtagaaaggaagagatttttccgaaagagtgttgaaatgacggaagatgacaaagttgccgaatcatcccccaaagatgagagaattaaggctgcaatgaatattccaagagtagataagcttccttcaaatgtgttgagaggtggacaagaagttaaatatgaacagtgttcaaagtcaacctcagaaatctcaaaagattgtttcaaggagaaaaatgaaaaggaaatggaagaagaagcagaaatgaaggctgtagctacttctcctagtggcagattcctgaaatttgacatagaactaggaagaggagcatttaaaacagtatataaaggactggacactgaaacatgggttgaggttgcttggtgtgagctgcaggaccgaaagttaaccaaagctgagcagcaaagattcaaggaagaagcagagatgttgaagggtctccagcaccccaatatagttcgattttatgattcctgggaatctatattaaaaggaaagaaatgtattgtattagtgactgaactaatgacatctgggaccttaaagacgtacttaaaacgatttaaagtcatgaaaccaaaggtcttaaggagctggtgcaggcaaattttaaaggggttgcagttcttgcacactaggactcctcctattattcaccgggatctgaagtgtgacaatattttcatcacgggacccactggatctgtgaagattggtgatctaggattagccaccttaatgcgtacctcatttgctaagagtgtcattggaactcctgagtttatggctccagagatgtatgaagaacactatgatgaatccgtagatgtttatgcttttggaatgtgtatgctggaaatggccacatcggagtatccttattctgagtgtcagaatgcagctcaaatataccggaaagtaactagtggcataaaaccagccagcttcaataaagtcactgatcctgaagtcaaagaaatcattgaaggatgtattcgtcaaaacaaatctgaaaggttgtctatcagggacctattaaaccatgcattttttgctgaggatacaggactgagggtggagttagcagaagaagatgattgctcaaattcatcccttgctttaagactctgggttgaagaccctaaaaaattgaaaggcaaacacaaagacaatgaagctattgaatttagtttcaacttagaaacagatacacctgaggaagtagcatatgaaatggtcaagtctgggttcttccatgaaagtgattccaaagctgttgctaaatccattagagaccgggtgacgccaataaagaagacaagagagaagaagcctgctggctgtttggaagaacgcagggattctcagtgcaagtctatggggaatgtattccctcagccccagaatacaactttaccccttgctcccgctcagcaaactggggctgaatgtgaagaaactgaagttgatcaacatgttagacaacagcttctacaaagaaaaccacagcagcactgctcctctgttacaggtgacaatttgtctgaggcaggagctgcatcagttatacattcagatacttcaagtcagcccagtgtagcctattcctcaaatcaaacgatgggctctcaaatggtttctaatatcccgcaggctgaagtaaatgttccagggcaaatttattcatctcagcaactagtaggacattaccagcaagtttcagggttacagaagcattcaaagctgactcagccgcagattttgcctttggttcaaggtcagtccactgttttacctgtacatgtccttggaccgacagttgtttcacaaccccaggtttccccattaactgttcagaaggtcccacagataaagcctgtatcccaaccagttggagctgaacaacaagcagctcttctaaaaccagatttagttcgaagcttgaatcaagatgtggcaactacgaaggaaaacgtcagtagccctgataacccaagtggaaatggcaaacaggatcggatcaaacagagaagagcttcctgtccccgaccagagaaggggactaaatttcagcttaccgtccttcaggtatcaacctctggagataacatggtagagtgtcagctggagacacacaacaacaagatggtcaccttcaagtttgatgttgatggtgatgcgccagaggatattgcagactatatggttgaagataactttgtgctggaaagtgagaaagaaaaatttgtagaagaattgagagctattgtaggtcaagcccaggagatccttcatgtccactttgccacagaaagagccactggagttgattctattactgtggactccaacagtagccagacagggtcatctgaacaagtacagataaattctacatctactcaaaccagcaatgaatctgctcctcagtcatccccagttggtcggtggcgattctgtatcaatcagacgataagaaaccgtgagactcagtctcctccttctcttcagcattccatgtctgcggttcctggccgacatccacttcctagtccaaaaaacacaagtaataaggaaatatcacgggacacattgctcactatagaaaataatccatgccaccgtgcacttttcacctccaaatcagaacacaaggatgtggttgatggtaagatttctgaatgtgctagtgtagaaaccaagcagccagctatactttatcaagtggaagataacaggcagataatggcaccagttactaatagttccagttactctactacttcagttcgtgcagttccagctgaatgtgagggactcaccaaacaagcaagcatattcatacctgtgtatccatgtcaccaaactgccagtcaggctgatgcacttatgtcccatcctggcgaatcaactcagacttctggtaactctcttacaactctggcatttgatcaaaagcctcaaaccttatcagtacagcagccagctatggatgcagagtttatttctcaagaaggagaaactacagtgaacactgaagcaagttctcctaagacagtcattcccactcagacccctggccttgaaccaactacccttcaacccactactgtcctggaatcagatggagaaagacctccaaaactggagtttgcagacaaccgaattaaaactctggatgaaaaattaagaaacttgctctatcaggagcacagcatctctagcatctatcccgagagtcagaaggatacccaaagcatagactctccattttcttcctctgctgaagataccctctcctgtccagtgacagaagtcatagccatcagtcactgtggaattaaagatagccctgtacaatcccctaatttccaacagacaggctctaagcttctgtccaatgtggctgcaagtcagcctgctaatatatcagtgttcaaaagggacctgaatgtgataacttctgtacccagcgaattgtgtttacatgagatgtcctcagatgcttcacttccaggggatccagaggcctatcctgctgctgtgtcaagcggtggagccattcatctgcagacaggaggtggatattttggcctaagctttacttgtcctagtctcaaaaatcctattagcaagaaatcctggactcgcaaattaaaaagctgggcatacaggctacggcagtcaaccagctttttcaagagatcaaaagtccgtcaagtggaaacagaagagatgagatcagcaattgctcctgatcccattcctctgacacgggagtccacagctgatactagggctttgaatagatgtaaagcgatgagtggatcatttcagcggggtcggttccaggtgattacaattcctcagcagcagtcagcaaaaatgacatcttttggaatagaacacatatcagtgttcagtgagacaaaccattctagtgaagaagcctttattaaaacagcaaagtctcagttggtagaaatagaacctgccacacaaaatccaaaaacttcgttttcttatgagaagttacaagctcttcaggaaacctgtaaagaaaataaaggagttcccaaacaaggtgacaacttcttatctttcagcgcagcttgtgagactgatgtatcttcagtgaccccagaaaaggaatttgaagaaacttcagccacaggaagtagcatgcagtctggatctgaactgttgcttaaagagagagagatattgactgctgggaaacagcctagctctgatagtgaattttcagccagtcttgctggcagtggaaagtcagtggcaaagactggtccagagagtaatcagtgcttaccacaccacgaagaacaagcttatgctcaaacacagagttcactcttctattcgccatcttccccaatgagcagtgatgatgaatcagaaatagaggatgaggacttgaaggtggagcttcaaagattacgagaaaaacacattcaggaggtggtaaatcttcaaacccagcagaataaggagctgcaggagctctatgaacgccttcggtcaattaaagatagcaaaacccaatctactgagattcctttgccacctgcatcaccacgtcgaccaagatctttcaaaagcaaacttcgaagccgcccccagtccttgacacatgtggacaatggcatagttgctacaggtaaatcagtcataaaagtattaaaaaatccactgtgtgtggagagtaatgcagcatcatgccaacagtctccagccagtaaaaaagggatgttcacagatgacttacacaagctggtggatgactggacaaaggaagcagtaggaaattctcttattaagccaagtttaaaccaacttaaacaaagtcaacacaaactagagacagaaaactggaataaagtatctgaaaatactccgtctactatgggctacacatcaacatggatttcttctctgtcccaaatccgtggagctgtcccaacttccttgccacaaggactctcactcccttcatttcctgggccattatcatcatatggaatgcctcacgtttgtcagtataatgctgtggcgggggcggggtatccagtacagtgggtaggaatttcaggaacaacacaacaatctgtagtaattcccgcccaatctgggggaccattccagccagggatgaatatgcaggcatttccaacttcatcagtgcagaatcctgccacaatccctcctggtcctaaatga

SEQ ID NO: 200231 - DNA, 4001 bp, Homo sapiens
  Payload ID: 19506
  Gene Name: WNK lysine deficient protein kinase 4
  Uniprot ID: Q96J92
  ENST ID: ENST00000246914
  CDS Start-End: 22-3753
ttcggcgccctgctcttcctcatgttggcatccccggccacggagaccaccgtcctcatgtcccagactgaggccgacctggccctgcggcccccgcctcctcttggcaccgcggggcagccccgcctcgggccccctcctcgccgagcgcgccgcttctccgggaaggctgagccccggccgcgctcttctcgtctcagccgccgtagctcagtcgacttggggctgctgagctcttggtccctgccagcctcacccgctccggacccccccgatcctccggactccgctggtcctggccccgcgaggagcccaccgcctagctccaaagaaccccccgagggcacgtggaccgagggagcccctgtgaaggctgcggaagactccgcgcgtcccgagctcccggactctgcagtgggcccggggtccagggagccgctaagggtccctgaagctgtggccctagagcggcggcgggagcaggaagaaaaggaggacatggagacccaggctgtggcaacgtcccccgatggccgatacctcaagtttgacatcgagattggacgtggctccttcaagacggtgtatcgagggctagacaccgacaccacagtggaggtggcctggtgtgagctgcagactcggaaactgtctagagctgagcggcagcgcttctcagaggaggtggagatgctcaaggggctgcagcaccccaacatcgtccgcttctatgattcgtggaagtcggtgctgaggggccaggtttgcatcgtgctggtcaccgaactcatgacctcgggcacgctcaagacgtacctgaggcggttccgggagatgaagccgcgggtccttcagcgctggagccgccaaatcctgcggggacttcatttcctacactcccgggttcctcccatcctgcaccgggatctcaagtgcgacaatgtctttatcacgggacctactggctctgtcaaaatcggggacctgggcctggccacgctcaagcgcgcctcctttgccaagagtgtcatcgggaccccggaattcatggcccccgagatgtacgaggaaaagtacgatgaggccgtggacgtgtacgcgttcggcatgtgcatgctggagatggccacctctgagtacccgtactccgagtgccagaatgccgcgcaaatctaccgcaaggtcacttcgggcagaaagccgaacagcttccacaaggtgaagatacccgaggtgaaggagatcattgaaggctgcatccgcacggataagaacgagaggttcaccatccaggacctcctggcccacgccttcttccgcgaggagcgcggtgtgcacgtggaactagcggaggaggacgacggcgagaagccgggcctcaagctctggctgcgcatggaggacgcgcggcgcggggggcgcccacgggacaaccaggccatcgagttcctgttccagctgggccgggacgcggccgaggaggtggcacaggagatggtggctctgggcttggtctgtgaagccgattaccagccagtggcccgtgcagtacgtgaacgggttgctgccatccagcgaaagcgtgagaagctgcgtaaagcaagggaattggaggcactcccaccagagccaggacctccaccagcaactgtgcccatggcccccggtccccccagtgtcttcccccctgagcctgaggagccagaggcagaccagcaccagcccttccttttccgccacgccagctactcatctaccacttcggattgcgagactgatggctacctcagctcctccggcttcctggatgcctcagaccctgcccttcagccccctgggggggtgccatccagcctggctgagtcccatctctgcctgccctcggcttttgccctatccattccacgttctggccctggaagtgacttttcccccggggacagctatgcctcagatgcagcttcaggccttagcgatgtgggagaagggatgggacaaatgaggagacccccagggaggaatctccggcgcagaccccgatcccggctgcgggtcactagtgtctcagaccagaatgacagagtggttgagtgccagctacagacccataacagcaagatggtgaccttccgatttgatctggatggggacagcccggaagagattgcagctgccatggtatataacgagttcattctgccttcggagcgagatggatttctcagacggattcgggagattatccagcgagtggagaccctgttgaagagagacactggccccatggaggctgctgaagacaccctaagcccccaggaggagccagcaccattacctgccctgcccgtccccctcccagacccatccaatgaagagctccagagcagcacctccctggagcacaggagctggacagccttctccacctcctcatcttctcctggaactcctttgtctcctggaaacccattttcccctggaacccccatttccccaggtcccatcttccccatcacttctcccccatgtcatcccagcccctccccattctcccccatttcttcccaggtctcctcaaatccctctccacaccccaccagctctccacttccattctcctccagcacacccgagtttccggtcccactctctcagtgtccctggagttctctccccacgacttctccacctacgttctctcccacttgttctcaggtcactcttagttcccctttctttcctccgtgcccctccacttcttccttcccctccaccacagcagcccctctcctttctctggctagtgccttctcactggctgtgatgactgtggcccagtccctgctgtccccctcacctgggctcctttcccagtctcctccagcccctcctagtcccctccctagcctgccccttccccctcccgttgctcctggtggccaggaaagcccttcaccccacacagctgaggtggagagtgaggcctcaccacctcctgctcggcccctcccaggggaagccaggctggcgcccatctctgaagagggaaagccgcagcttgttgggcgtttccaagtgacttcatccaaggaaccggctgagcctcttcccttgcagccaacatcccccactctctctggttctccaaaaccttcaacccctcagctcacttcagagagctcagatacagaggacagtgctggaggcgggccagagaccagggaagctctggctgagagcgaccgtgcagctgagggtctgggggctggagttgaggaggaaggagatgatgggaaggaaccccaagttgggggcagcccccaacccctgagccatcccagcccagtgtggatgaactactcctacagcagcctgtgtttgagcagcgaggagtcagaaagcagtggggaagatgaggagttctgggctgagctgcagagtcttcggcagaagcacttgtcagaggtggaaacactacagacactacagaaaaaagaaattgaagatttgtacagccggctggggaagcagcccccaccgggtattgtggccccagctgctatgctgtccagccgccagcgccgcctctccaagggcagcttccccacctcccgccgcaacagcctacagcgctctgagcccccaggccctggcatcatgcgaaggaactctctgagtggcagcagcaccggctcccaggagcagcgggcaagcaagggggtgacattcgccggggatgttggcaggatgtgaattcagaacagaagccatgtatctcccccacaccagggcccaccatggagcttgtgttctcagaatctgatgctttctgatcaacaaaactgagcaaggaagatcccaacactgaaggggtagaaggccaggggggcatggagagtgcagctccattatagtgaagagccaaacatatgtgaactgtttgctgtgtggaggtgttagttctgctgcctaccatcttcatctctagcacctcccctgcc

SEQ ID NO: 200232 - DNA, 3909 bp, Homo sapiens
  Payload ID: 19506
  Gene Name: WNK lysine deficient protein kinase 4
  ENST ID: ENST00000591448
  CDS Start-End: 19-1428
ggcgccctgctcttcctcatgttggcatccccggccacggagaccaccgtcctcatgtcccagactgaggccgacctggccctgcggcccccgcctcctcttggcaccgcggggcagccccgcctcgggccccctcctcgccgagcgcgccgcttctccgggaaggctgagccccggccgcgctcttctcgtctcagccgccgtagctcagtcgacttggggctgctgagctcttggtccctgccagcctcacccgctccggacccccccgatcctccggactccgctggtcctggccccgcgaggagcccaccgcctagctccaaagaaccccccgagggcacgtggaccgagggagcccctgtgaaggctgcggaagactccgcgcgtcccgagctcccggactctgcagtgggcccggggtccagggagccgctaagggtccctgaagctgtggccctagagcggcggcgggagcaggaagaaaaggaggacatggagacccaggctgtggcaacgtcccccgatggccgatacctcaagtttgacatcgagattggacgtggctccttcaagacggtgtatcgagggctagacaccgacaccacagtggaggtggcctggtgtgagctgcagactcggaaactgtctagagctgagcggcagcgcttctcagaggaggtggagatgctcaaggggctgcagcaccccaacatcgtccgcttctatgattcgtggaagtcggtgctgaggggccaggtttgcatcgtgctggtcaccgaactcatgacctcgggcacgctcaagacgtacctgaggcggttccgggagatgaagccgcgggtccttcagcgctggagccgccaaatcctgcggggacttcatttcctacactcccgggttcctcccatcctgcaccgggatctcaagtgcgacaatgtctttatcacgggacctactggctctgtcaaaatcggggacctgggcctggccacgctcaagcgcgcctcctttgccaagagtgtcatcgggaccccggaattcatggcccccgagatgtacgaggaaaagtacgatgaggccgtggacgtgtacgcgttcggcatgtgcatgctggagatggccacctctgagtacccgtactccgagtgccagaatgccgcgcaaatctaccgcaaggtcacttcggttcaccatccaggacctcctggcccacgccttcttccgcgaggagcgcggtgtgcacgtggaactagcggaggaggacgacggcgagaagccgggcctcaagctctggctgcgcatggaggacgcgcggcgcggggggcgcccacgggacaaccaggccatcgagttcctgttccagctgggccgggacgcggccgaggaggtggcacaggagatggtggctctgggcttggtctgtgaagccgattaccagccagtggcccgtgcagtacgtgaacgggttgctgccatccagcgaaagcgtgagaagctgcgtaaagcaagggaattggaggcactcccaccagagccaggacctccaccagcaactgtgcccatggcccccggtccccccagtgtcttcccccctgagcctgaggagccagaggcagaccagcaccagcccttccttttccgccacgccagctactcatctaccacttcggattgcgagactgatggctacctcagctcctccggcttcctggatgcctcagaccctgcccttcagccccctgggggggtgccatccagcctggctgagtcccatctctgcctgccctcggcttttgccctatccattccacgttctggccctggaagtgacttttcccccggggacagctatgcctcagatgcagcttcaggccttagcgatgtgggagaagggatgggacaaatgaggagacccccagggaggaatctccggcgcagaccccgatcccggctgcgggtcactagtgtctcagaccagaatgacagagtggttgagtgccagctacagacccataacagcaagatggtgaccttccgatttgatctggatggggacagcccggaagagattgcagctgccatggtatataacgagttcattctgccttcggagcgagatggatttctcagacggattcgggagattatccagcgagtggagaccctgttgaagagagacactggccccatggaggctgctgaagacaccctaagcccccaggaggagccagcaccattacctgccctgcccgtccccctcccagacccatccaatgaagagctccagagcagcacctccctggagcacaggagctggacagccttctccacctcctcatcttctcctggaactcctttgtctcctggaaacccattttcccctggaacccccatttccccaggtcccatcttccccatcacttctcccccatgtcatcccagcccctccccattctcccccatttcttcccaggtctcctcaaatccctctccacaccccaccagctctccacttccattctcctccagcacacccgagtttccggtcccactctctcagtgtccctggagttctctccccacgacttctccacctacgttctctcccacttgttctcaggtcactcttagttcccctttctttcctccgtgcccctccacttcttccttcccctccaccacagcagcccctctcctttctctggctagtgccttctcactggctgtgatgactgtggcccagtccctgctgtccccctcacctgggctcctttcccagtctcctccagcccctcctagtcccctccctagcctgccccttccccctcccgttgctcctggtggccaggaaagcccttcaccccacacagctgaggtggagagtgaggcctcaccacctcctgctcggcccctcccaggggaagccaggctggcgcccatctctgaagagggaaagccgcagcttgttgggcgtttccaagtgacttcatccaaggaaccggctgagcctcttcccttgcagccaacatcccccactctctctggttctccaaaaccttcaacccctcagctcacttcagagagctcagatacagaggacagtgctggaggcgggccagagaccagggaagctctggctgagagcgaccgtgcagctgagggtctgggggctggagttgaggaggaaggagatgatgggaaggaaccccaagttgggggcagcccccaacccctgagccatcccagcccagtgtggatgaactactcctacagcagcctgtgtttgagcagcgaggagtcagaaagcagtggggaagatgaggagttctgggctgagctgcagagtcttcggcagaagcacttgtcagaggtggaaacactacagacactacagaaaaaagaaattgaagatttgtacagccggctggggaagcagcccccaccgggtattgtggccccagctgctatgctgtccagccgccagcgccgcctctccaagggcagcttccccacctcccgccgcaacagcctacagcgctctgagcccccaggccctggcatcatgcgaaggaactctctgagtggcagcagcaccggctcccaggagcagcgggcaagcaagggggtgacattcgccggggatgttggcaggatgtgaattcagaacagaagccatgtatctcccccacaccagggcccaccatggagcttgtgttctcagaatctgatgctttctgatcaacaaaactgagcaaggaagatcccaacactgaaggggtagaaggccaggggggcatggagagtgcagctccattatagtgaagagccaaacatatgtgaactgtttgctgtgtggaggtgttagttctgctgcctaccatcttcatctctagcacctcccctgcc

SEQ ID NO: 200233 - DNA, 188 bp, Homo sapiens
  Payload ID: 19506
  Gene Name: WNK lysine deficient protein kinase 4
  ENST ID: ENST00000587745
  CDS Start-End: 1-188
accctaagcccccaggaggagccagcaccattacctgccctgcccgtccccctcccagacccatccaatgagggaaagccgcagcttgttgggcgtttccaagtgacttcatccaaggaaccggctgagcctcttcccttgcagccaacatcccccactctctctggttctccaaaaccttcaacccc

SEQ ID NO: 200234 - DNA, 2238 bp, Homo sapiens
  Payload ID: 19507
  Gene Name: WNT inhibitory factor 1
  Uniprot ID: Q9Y5W5
  ENST ID: ENST00000286574
  CDS Start-End: 376-1515
gccccactcctcgctcgcacctcgctcgcgccagcccttcccgctcttctgttctcgctctatttgccccgctgactgctggcctcgccagctttgccagtcttacgtctctgccgcccccactcccgcccgcgccccatcttcttgcgcgactcgcgcccgctggtccccccctcctcctcccgcgtcctgcctgccccctcctcctgctctcgcaggctccttggcacccaggccgggaggcgacgcgcccagccgtctaaacgggaacagccctggctgagggagctgcagcgcagcagagtatctgacggcgccaggttgcgtaggtgcggcacgaggagttttcccggcagcgaggaggtcctgagcagcatggcccggaggagcgccttccctgccgccgcgctctggctctggagcatcctcctgtgcctgctggcactgcgggcggaggccgggccgccgcaggaggagagcctgtacctatggatcgatgctcaccaggcaagagtactcataggatttgaagaagatatcctgattgtttcagaggggaaaatggcaccttttacacatgatttcagaaaagcacaacagagaatgccagctattcctgtcaatatccattccatgaattttacctggcaagctgcagggcaggcagaatacttctatgaattcctgtccttgcgctccctggataaaggcatcatggcagatccaaccgtcaatgtccctctgctgggaacagtgcctcacaaggcatcagttgttcaagttggtttcccatgtcttggaaaacaggatggggtggcagcatttgaagtggatgtgattgttatgaattctgaaggcaacaccattctccaaacacctcaaaatgctatcttctttaaaacatgtcaacaagctgagtgcccaggcgggtgccgaaatggaggcttttgtaatgaaagacgcatctgcgagtgtcctgatgggttccacggacctcactgtgagaaagccctttgtaccccacgatgtatgaatggtggactttgtgtgactcctggtttctgcatctgcccacctggattctatggagtgaactgtgacaaagcaaactgctcaaccacctgctttaatggagggacctgtttctaccctggaaaatgtatttgccctccaggactagagggagagcagtgtgaaatcagcaaatgcccacaaccctgtcgaaatggaggtaaatgcattggtaaaagcaaatgtaagtgttccaaaggttaccagggagacctctgttcaaagcctgtctgcgagcctggctgtggtgcacatggaacctgccatgaacccaacaaatgccaatgtcaagaaggttggcatggaagacactgcaataaaaggtacgaagccagcctcatacatgccctgaggccagcaggcgcccagctcaggcagcacacgccttcacttaaaaaggccgaggagcggcgggatccacctgaatccaattacatctggtgaactccgacatctgaaacgttttaagttacaccaagttcatagcctttgttaacctttcatgtgttgaatgttcaaataatgttcattacacttaagaatactggcctgaattttattagcttcattataaatcactgagctgatatttactcttccttttaagttttctaagtacgtctgtagcatgatggtatagattttcttgtttcagtgctttgggacagattttatattatgtcaattgatcaggttaaaattttcagtgtgtagttggcagatattttcaaaattacaatgcatttatggtgtctgggggcaggggaacatcagaaaggttaaattgggcaaaaatgcgtaagtcacaagaatttggatggtgcagttaatgttgaagttacagcatttcagattttattgtcagatatttagatgtttgttacatttttaaaaattgctcttaatttttaaactctcaatacaatatattttgaccttaccattattccagagattcagtattaaaaaaaaaaaaattacactgtggtagtggcatttaaacaatataatatattctaaacacaatgaaatagggaatataatgtatgaactttttgcattggcttgaagcaatataatatattgtaaacaaaacacagctcttacctaataaacattttatactgtttgtatgtataaaataaaggtgctgctttagttttctga

SEQ ID NO: 200235 - DNA, 429 bp, Homo sapiens
  Payload ID: 19507
  Gene Name: WNT inhibitory factor 1
  ENST ID: ENST00000543094
  CDS Start-End: 1-387
ggagtgaactgtgacaaagcaaactgctcaaccacctgctttaatggagggacctgtttctaccctggaaaatgtatttgccctccaggactagagggagagcagtgtgaaatcagcaaatgcccacaaccctgtcgaaatggaggtaaatgcattggtaaaagcaaatctgtctgcgagcctggctgtggtgcacatggaacctgccatgaacccaacaaatgccaatgtcaagaaggttggcatggaagacactgcaataaaaggtacgaagccagcctcatacatgccctgaggccagcaggcgcccagctcaggcagcacacgccttcacttaaaaaggccgaggagcggcgggatccacctgaatccaattacatctggtgaactccgacatctgaaacgttttaagttacaccaagttcatag

SEQ ID NO: 200236 - DNA, 568 bp, Homo sapiens
  Payload ID: 19507
  Gene Name: WNT inhibitory factor 1
  ENST ID: ENST00000546001
  CDS Start-End: 169-568
gtactgaaggcagatgcttgtgaacagaaatgacccacactaattctttggttttctttttgcttgaaacttctgatttagatgatttcaagtctacctggtttgatcgttttattattttaaaaaccaggatttgaagaagatatcctgattgtttcagaggggaaaatggcaccttttacacatgatttcagaaaagcacaacagagaatgccagctattcctgtcaatatccattccatgaattttacctggcaagctgcagggcaggcagaatacttctatgaattcctgtccttgcgctccctggataaaggcatcatggcagatccaaccgtcaatgtccctctgctgggaacagtgcctcacaaggcatcagttgttcaagttggtttcccatgtcttggaaaacaggatggggtggcagcatttgaagtggatgtgattgttatgaattctgaaggcaacaccattctccaaacacctcaaaatgctatcttctttaaaacatgtcaacaagctgagtgcccaggcgggtgccgaaatggaggcttttgtaatgaaagac

SEQ ID NO: 200237 - DNA, 1205 bp, Homo sapiens
  Payload ID: 19508
  Gene Name: WNT1 inducible signaling pathway protein 1
  Uniprot ID: O95388
  ENST ID: ENST00000220856
  CDS Start-End: 9-851
gtccaggcatgaggtggttcctgccctggacgctggcagcagtgacagcagcagccgccagcaccgtcctggccacggccctctctccagcccctacgaccatggactttaccccagctccactggaggacacctcctcacgcccccaattctgcaagtggccatgtgagtgcccgccatccccaccccgctgcccgctgggggtcagcctcatcacagatggctgtgagtgctgtaagatgtgcgctcagcagcttggggacaactgcacggaggctgccatctgtgacccccaccggggcctctactgtgactacagcggggaccgcccgaggtacgcaataggagtgtgtgcacatgctgtgggtgaggtggaggcatggcacaggaactgcatagcctacacaagcccctggagcccttgctccaccagctgcggcctgggggtctccactcggatctccaatgttaacgcccagtgctggcctgagcaagagagccgcctctgcaacttgcggccatgcgatgtggacatccatacactcattaaggcagggaagaagtgtctggctgtgtaccagccagaggcatccatgaacttcacacttgcgggctgcatcagcacacgctcctatcaacccaagtactgtggagtttgcatggacaataggtgctgcatcccctacaagtctaagactatcgacgtgtccttccagtgtcctgatgggcttggcttctcccgccaggtcctatggattaatgcctgcttctgtaacctgagctgtaggaatcccaatgacatctttgctgacttggaatcctaccctgacttctcagaaattgccaactaggcaggcacaaatcttgggtcttggggactaacccaatgcctgtgaagcagtcagcccttatggccaataacttttcaccaatgagccttagttaccctgatctggacccttggcctccatttctgtctctaaccattcaaatgacgcctgatggtgctgctcaggcccatgctatgagttttctccttgatatcattcagcatctactctaaagaaaaatgcctgtctctagctgttctggactacacccaagcctgatccagcctttccaagtcactagaagtcctgctggatcttgcctaaatcccaagaaatggaatcaggtagacttttaatatcactaatttcttcttt

SEQ ID NO: 200238 - DNA, 3844 bp, Homo sapiens
  Payload ID: 19508
  Gene Name: WNT1 inducible signaling pathway protein 1
  Uniprot ID: O95388
  ENST ID: ENST00000250160
  CDS Start-End: 107-1210
atatctggtgctcctgatgggccggccagtctgggcccagctcccccgagaggtggtcggatcctctgggctgctcggtcgatgcctgtgccactgacgtccaggcatgaggtggttcctgccctggacgctggcagcagtgacagcagcagccgccagcaccgtcctggccacggccctctctccagcccctacgaccatggactttaccccagctccactggaggacacctcctcacgcccccaattctgcaagtggccatgtgagtgcccgccatccccaccccgctgcccgctgggggtcagcctcatcacagatggctgtgagtgctgtaagatgtgcgctcagcagcttggggacaactgcacggaggctgccatctgtgacccccaccggggcctctactgtgactacagcggggaccgcccgaggtacgcaataggagtgtgtgcacaggtggtcggtgtgggctgcgtcctggatggggtgcgctacaacaacggccagtccttccagcctaactgcaagtacaactgcacgtgcatcgacggcgcggtgggctgcacaccactgtgcctccgagtgcgccccccgcgtctctggtgcccccacccgcggcgcgtgagcatacctggccactgctgtgagcagtgggtatgtgaggacgacgccaagaggccacgcaagaccgcaccccgtgacacaggagccttcgatgctgtgggtgaggtggaggcatggcacaggaactgcatagcctacacaagcccctggagcccttgctccaccagctgcggcctgggggtctccactcggatctccaatgttaacgcccagtgctggcctgagcaagagagccgcctctgcaacttgcggccatgcgatgtggacatccatacactcattaaggcagggaagaagtgtctggctgtgtaccagccagaggcatccatgaacttcacacttgcgggctgcatcagcacacgctcctatcaacccaagtactgtggagtttgcatggacaataggtgctgcatcccctacaagtctaagactatcgacgtgtccttccagtgtcctgatgggcttggcttctcccgccaggtcctatggattaatgcctgcttctgtaacctgagctgtaggaatcccaatgacatctttgctgacttggaatcctaccctgacttctcagaaattgccaactaggcaggcacaaatcttgggtcttggggactaacccaatgcctgtgaagcagtcagcccttatggccaataacttttcaccaatgagccttagttaccctgatctggacccttggcctccatttctgtctctaaccattcaaatgacgcctgatggtgctgctcaggcccatgctatgagttttctccttgatatcattcagcatctactctaaagaaaaatgcctgtctctagctgttctggactacacccaagcctgatccagcctttccaagtcactagaagtcctgctggatcttgcctaaatcccaagaaatggaatcaggtagacttttaatatcactaatttcttctttagatgccaaaccacaagactctttgggtccattcagatgaatagatggaatttggaacaatagaataatctattatttggagcctgccaagaggtactgtaatgggtaattctgacgtcagcgcaccaaaactatcctgattccaaatatgtatgcacctcaaggtcatcaaacatttgccaagtgagttgaatagttgcttaattttgatttttaatggaaagttgtatccattaacctgggcattgttgaggttaagtttctcttcacccctacactgtgaagggtacagattaggtttgtcccagtcagaaataaaatttgataaacattcctgttgatgggaaaagcccccagttaatactccagagacagggaaaggtcagcccgtttcagaaggaccaattgactctcacactgaatcagctgctgactggcagggctttgggcagttggccaggctcttccttgaatcttctcccttgtcctgcttggggttcataggaattggtaaggcctctggactggcctgtctggcccctgagagtggtgccctggaacactcctctactcttacagagccttgagagacccagctgcagaccatgccagacccactgaaatgaccaagacaggttcaggtaggggtgtgggtcaaaccaagaagtgggtgcccttggtagcagcctggggtgacctctagagctggaggctgtgggactccaggggcccccgtgttcaggacacatctattgcagagactcatttcacagcctttcgttctgctgaccaaatggccagttttctggtaggaagatggaggtttaccggttgtttagaaacagaaatagacttaataaaggtttaaagctgaagaggttgaagctaaaaggaaaaggttgttgttaatgaatatcaggctattatttattgtattaggaaaatataatatttactgttagaattcttttatttagggccttttctgtgccagacattgctctcagtgctttgcatgtattagctcactgaatcttcacgacaatgttgagaagttcccattattatttctgttcttacaaatgtgaaacggaagctcatagaggtgagaaaactcaaccagagtcacccagttggtgactgggaaagttaggattcagatcgaaattggactgtctttataacccatattttccccctgtttttagagcttccaaatgtgtcagaataggaaaacattgcaataaatggcttgattttttaatgtcatttttccctcttatagtctttctagctccttttcaaaagacgagaatatctgattttctgataatttaggtgcttaagcatccaaaatacatgggacacacaaaaatccaggaatcccctgtagcttattccctctttcccatcggaaccagctctcatcacacatttaaaagatgattctgtttacccaatgctgcatattgaatgttgtgtagttattcacagggaattctgtgcagtgtgcagagagattcctaaacgggaaaaggactgggaatacatcctccttactgtgacctccccaaaacctagtccagtgcaaggtatacagtggtgctcattaaatacttgatgaatacaggaagctgtgcatgtgttcctacttttattcgaagctctcttcttccaaagctacatgaaaatagaattttaacagtcaaaattttatattaagtgccttagcaaaagagacatttaatatttcaaagaaatgcatatgtatgtatacatatatttgtgtatgcgtatgcaagaattcttgtataaagagaattcactccatgaatgatctcttctgtaagtcagtgtgaatcatgttagattttctgagagtgaaaacacctgccatctacaaattacaaggctggataacagctcactccatttgaaattcagtggaaacccaagagctaggttcttactgaatttgcatctcaatttgggaaactgaacttagctttcaaagatcataggaagtctggttggagaaactagggattattctggcaatgggtgcaggaaggtggtcagaataacccagtcgccattggttttgagaaacggaactatcttatgcagagcccggagggcaagtctcagacccatgggttgaagccatggagaaggaaatttggatccaatgtaatgaagcgctttctaagtcagaatttccctgcaatggtgtggcctgattcaataaaaattaagaataataaatataatggaaaaaaa

SEQ ID NO: 200239 - DNA, 1319 bp, Homo sapiens
  Payload ID: 19508
  Gene Name: WNT1 inducible signaling pathway protein 1
  ENST ID: ENST00000377862
  CDS Start-End: 107-217
atatctggtgctcctgatgggccggccagtctgggcccagctcccccgagaggtggtcggatcctctgggctgctcggtcgatgcctgtgccactgacgtccaggcatgaggtggttcctgccctggacgctggcagcagtgacagcagcagccgccagcaccgtcctggccacgatgctgtgggtgaggtggaggcatggcacaggaactgcatagcctacacaagcccctggagcccttgctccaccagctgcggcctgggggtctccactcggatctccaatgttaacgcccagtgctggcctgagcaagagagccgcctctgcaacttgcggccatgcgatgtggacatccatacactcattaaggcagggaagaagtgtctggctgtgtaccagccagaggcatccatgaacttcacacttgcgggctgcatcagcacacgctcctatcaacccaagtactgtggagtttgcatggacaataggtgctgcatcccctacaagtctaagactatcgacgtgtccttccagtgtcctgatgggcttggcttctcccgccaggtcctatggattaatgcctgcttctgtaacctgagctgtaggaatcccaatgacatctttgctgacttggaatcctaccctgacttctcagaaattgccaactaggcaggcacaaatcttgggtcttggggactaacccaatgcctgtgaagcagtcagcccttatggccaataacttttcaccaatgagccttagttaccctgatctggacccttggcctccatttctgtctctaaccattcaaatgacgcctgatggtgctgctcaggcccatgctatgagttttctccttgatatcattcagcatctactctaaagaaaaatgcctgtctctagctgttctggactacacccaagcctgatccagcctttccaagtcactagaagtcctgctggatcttgcctaaatcccaagaaatggaatcaggtagacttttaatatcactaatttcttctttagatgccaaaccacaagactctttgggtccattcagatgaatagatggaatttggaacaatagaataatctattatttggagcctgccaagaggtactgtaatgggtaattctgacgtcagcgcaccaaaactatcctgattccaaatatgtatgcacctcaaggtcatcaaacatttgccaagtgagttgaatagttgcttaattttgatttttaatggaaagttgtatccattaacctgggcattgttgaggttaagtttctcttcacccctacactgtgaagggtacagatta

SEQ ID NO: 200240 - DNA, 716 bp, Homo sapiens
  Payload ID: 19508
  Gene Name: WNT1 inducible signaling pathway protein 1
  Uniprot ID: O95388
  ENST ID: ENST00000517423
  CDS Start-End: 62-529
ccgagaggtggtcggatcctctgggctgctcggtcgatgcctgtgccactgacgtccaggcatgaggtggttcctgccctggacgctggcagcagtgacagcagcagccgccagcaccgtcctggccacggccctctctccagcccctacgaccatggactttaccccagctccactggaggacacctcctcacgcccccaattctgcaagtggccatgtgagtgcccgccatccccaccccgctgcccgctgggggtcagcctcatcacagatggctgtgagtgctgtaagatgtgcgctcagcagcttggggacaactgcacggaggctgccatctgtgacccccaccggggcctctactgtgactacagcggggaccgcccgaggtacgcaataggagtgtgtgcacgcagggaagaagtgtctggctgtgtaccagccagaggcatccatgaacttcacacttgcgggctgcatcagcacacgctcctatcaacccaagtactgtggagtttgcatggacaataggtgctgcatcccctacaagtctaagactatcgacgtgtccttccagtgtcctgatgggcttggcttctcccgccaggtcctatggattaatgcctgcttctgtaacctgagctgtaggaatcccaatgacatctttgctgacttggaatcctaccctgacttctcagaaattgccaactaggcaggc

SEQ ID NO: 200241 - DNA, 545 bp, Homo sapiens
  Payload ID: 19508
  Gene Name: WNT1 inducible signaling pathway protein 1
  Uniprot ID: O95388
  ENST ID: ENST00000519433
  CDS Start-End: 77-445
ctgggcccagctcccccgagaggtggtcggatcctctgggctgctcggtcgatgcctgtgccactgacgtccaggcatgaggtggttcctgccctggacgctggcagcagtgacagcagcagccgccagcaccgtcctggccacggcagggaagaagtgtctggctgtgtaccagccagaggcatccatgaacttcacacttgcgggctgcatcagcacacgctcctatcaacccaagtactgtggagtttgcatggacaataggtgctgcatcccctacaagtctaagactatcgacgtgtccttccagtgtcctgatgggcttggcttctcccgccaggtcctatggattaatgcctgcttctgtaacctgagctgtaggaatcccaatgacatctttgctgacttggaatcctaccctgacttctcagaaattgccaactaggcaggcacaaatcttgggtcttggggactaacccaatgcctgtgaagcagtcagcccttatggccaataacttttcaccaatgagccttagttaccctga

SEQ ID NO: 200242 - DNA, 1403 bp, Homo sapiens
  Payload ID: 19509
  Gene Name: WNT1 inducible signaling pathway protein 2
  Uniprot ID: O76076
  ENST ID: ENST00000190983
  CDS Start-End: 147-899
gtgtgtgtgtgtgtgtgagcgcgcgcgcgcgcgcgcgtgtgtactcgtgcgtgtgcctgtgtgtgcctgggagtgacctcacagctgccggaacataaagactcacaggtccgcctcccaggctcaaagctggctctgcaggggacatgagaggcacaccgaagacccacctcctggccttctccctcctctgcctcctctcaaaggtgcgtacccagctgtgcccgacaccatgtacctgcccctggccacctccccgatgcccgctgggagtacccctggtgctggatggctgtggctgctgccgggtatgtgcacggcggctgggggagccctgcgaccaactccacgtctgcgacgccagccagggcctggtctgccagcccggggcaggacccggtggccggggggccctgtgcctcttggcagaggacgacagcagctgtgaggtgaacggccgcctgtatcgggaaggggagaccttccagccccactgcagcatccgctgccgctgcgaggacggcggcttcacctgcgtgccgctgtgcagcgaggatgtgcggctgcccagctgggactgcccccaccccaggagggtcgaggtcctgggcaagtgctgccctgagtgggtgtgcggccaaggagggggactggggacccagccccttccagcccaaggaccccagttttctggccttgtctcttccctgccccctggtgtcccctgcccagaatggagcacggcctggggaccctgctcgaccacctgtgggctgggcatggccacccgggtgtccaaccagaaccgcttctgccgactggagacccagcgccgcctgtgcctgtccaggccctgcccaccctccaggggtcgcagtccacaaaacagtgccttctagagccgggctgggaatggggacacggtgtccaccatccccagctggtggccctgtgcctgggccctgggctgatggaagatggtccgtgcccaggcccttggctgcaggcaacactttagcttgggtccaccatgcagaacaccaatattaacacgctgcctggtctgtctggatcccgaggtatggcagaggtgcaagacctagtcccctttcctctaactcactgcctaggaggctggccaaggtgtccagggtcctctagcccactccctgcctacacacacagcctatatcaaacatgcacacgggcgagctttctctccgacttcccctgggcaagagatgggacaagcagtcccttaatattgaggctgcagcaggtgctgggctggactggccatttttctgggggtaggatgaagagaaggcacacagagattctggatctcctgctgccttttctggagtttgtaaaattgttcctgaatacaagcctatgcgtga

SEQ ID NO: 200243 - DNA, 1518 bp, Homo sapiens
  Payload ID: 19509
  Gene Name: WNT1 inducible signaling pathway protein 2
  Uniprot ID: O76076
  ENST ID: ENST00000372865
  CDS Start-End: 509-1165
ggagaccttgggtcagctctgcaaaggggttgtttactgaatgcttctggtatctgcagccccgctggggttcggacagggggtctggaatagggcttcacaactacagcagggctaggaccctcttgggctggaaggagctggagaggcctctgcaagctgtcacaggctcttggtgctggcactggctcaggctttcacacacacacacgcgcacacacacacacacacacacacggacaggcacccccttggtggccttcacagtttcaccttcaggtaaatgggctcatcctttgagccatgaggatgggaagcgaagcaaggaatgaaaaagctagtgtgtttgtgtgtgtgtgtgtgtgtgtgtgtgtgtgtgagcgcgcgcgcgcgcgcgcgtgtgtactcgtgcgtgtgcctgtgtgtgcctgggagtgacctcacagctgccggaacataaagactcacaggtccgcctcccaggctcaaagctggctctgcaggggacatgagaggcacaccgaagacccacctcctggccttctccctcctctgcctcctctcaaaggtgcgtacccagctgtgcccgacaccatgtacctgcccctggccacctccccgatgcccgctgggagtacccctggtgctggatggctgtggctgctgccgggtatgtgcacggcggctgggggagccctgcgaccaactccacgtctgcgacgccagccagggcctggtctgccagcccggggcaggacccggtggccggggggccctgtgcctctgtaagcaggaccccagttttctggccttgtctcttccctgccccctggtgtcccctgcccagaatggagcacggcctggggaccctgctcgaccacctgtgggctgggcatggccacccgggtgtccaaccagaaccgcttctgccgactggagacccagcgccgcctgtgcctgtccaggccctgcccaccctccaggggtcgcagtccacaaaacagtgccttctagagccgggctgggaatggggacacggtgtccaccatccccagctggtggccctgtgcctgggccctgggctgatggaagatggtccgtgcccaggcccttggctgcaggcaacactttagcttgggtccaccatgcagaacaccaatattaacacgctgcctggtctgtctggatcccgaggtatggcagaggtgcaagacctagtcccctttcctctaactcactgcctaggaggctggccaaggtgtccagggtcctctagcccactccctgcctacacacacagcctatatcaaacatgcacacgggcgagctttctctccgacttcccctgggcaagagatgggacaagcagtcccttaatattgaggctgcagcaggtgctgggctggactggccatttttctgggggtaggatgaagagaaggcacacagagattctggatctcctgctgccttttctggagtttgtaaaattgttcctgaatacaagcctatgcgtga

SEQ ID NO: 200244 - DNA, 1600 bp, Homo sapiens
  Payload ID: 19509
  Gene Name: WNT1 inducible signaling pathway protein 2
  Uniprot ID: O76076
  ENST ID: ENST00000372868
  CDS Start-End: 344-1096
ctgggccgcggctacccagagtcagggccacggagcttaggagaccttgggtcagctctgcaaaggggttgtttactgaatgcttctggtatctgcagccccgctggggttcggacagggggtctggaatagggcttcacaactacagcagggctaggaccctcttgggctggaaggagctggagaggcctctgcaagctgtcacaggctcttggtgctggcactggctcaggctttcacacacacacacgcgcacacacacacacacacacacacggacaggcacccccttggtggccttcacagtttcaccttcaggctcaaagctggctctgcaggggacatgagaggcacaccgaagacccacctcctggccttctccctcctctgcctcctctcaaaggtgcgtacccagctgtgcccgacaccatgtacctgcccctggccacctccccgatgcccgctgggagtacccctggtgctggatggctgtggctgctgccgggtatgtgcacggcggctgggggagccctgcgaccaactccacgtctgcgacgccagccagggcctggtctgccagcccggggcaggacccggtggccggggggccctgtgcctcttggcagaggacgacagcagctgtgaggtgaacggccgcctgtatcgggaaggggagaccttccagccccactgcagcatccgctgccgctgcgaggacggcggcttcacctgcgtgccgctgtgcagcgaggatgtgcggctgcccagctgggactgcccccaccccaggagggtcgaggtcctgggcaagtgctgccctgagtgggtgtgcggccaaggagggggactggggacccagccccttccagcccaaggaccccagttttctggccttgtctcttccctgccccctggtgtcccctgcccagaatggagcacggcctggggaccctgctcgaccacctgtgggctgggcatggccacccgggtgtccaaccagaaccgcttctgccgactggagacccagcgccgcctgtgcctgtccaggccctgcccaccctccaggggtcgcagtccacaaaacagtgccttctagagccgggctgggaatggggacacggtgtccaccatccccagctggtggccctgtgcctgggccctgggctgatggaagatggtccgtgcccaggcccttggctgcaggcaacactttagcttgggtccaccatgcagaacaccaatattaacacgctgcctggtctgtctggatcccgaggtatggcagaggtgcaagacctagtcccctttcctctaactcactgcctaggaggctggccaaggtgtccagggtcctctagcccactccctgcctacacacacagcctatatcaaacatgcacacgggcgagctttctctccgacttcccctgggcaagagatgggacaagcagtcccttaatattgaggctgcagcaggtgctgggctggactggccatttttctgggggtaggatgaagagaaggcacacagagattctggatctcctgctgccttttctggagtttgtaaaattgttcctgaatacaagcctatgcgtga

SEQ ID NO: 200245 - DNA, 1235 bp, Homo sapiens
  Payload ID: 19510
  Gene Name: WNT1 inducible signaling pathway protein 3
  Uniprot ID: O95389
  ENST ID: ENST00000230529
  CDS Start-End: 111-1175
cctgagtcccgggaggaaagtgctcgcccattcctgacctgtgacacgctcactgcgaaggcaggttattagaagagtcccatgaaaggtggctccacggtcccagcgacatgcaggggctcctcttctccactcttctgcttgctggcctggcacagttctgctgcagggtacagggcactggaccattagatacaacacctgaaggaaggcctggagaagtgtcagatgcacctcagcgtaaacagttttgtcactggccctgcaaatgccctcagcagaagccccgttgccctcctggagtgagcctggtgagagatggctgtggatgctgtaaaatctgtgccaagcaaccaggggaaatctgcaatgaagctgacctctgtgacccacacaaagggctgtattgtgactactcagtagacaggcctaggtacgagactggagtgtgtgcataccttgtagctgttgggtgcgagttcaaccaggtacattatcataatggccaagtgtttcagcccaaccccttgttcagctgcctctgtgtgagtggggccattggatgcacacctctgttcataccaaagctggctggcagtcactgctctggagctaaaggtggaaagaagtctgatcagtcaaactgtagcctggaaccattactacagcagctttcaacaagctacaaaacaatgccagcttatagaaatctcccacttatttggaaaaaaaaatgtcttgtgcaagcaacaaaatggactccctgctccagaacatgtgggatgggaatatctaacagggtgaccaatgaaaacagcaactgtgaaatgagaaaagagaaaagactgtgttacattcagccttgcgacagcaatatattaaagacaataaagattcccaaaggaaaaacatgccaacctactttccaactctccaaagctgaaaaatttgtcttttctggatgctcaagtactcagagttacaaacccactttttgtggaatatgcttggataagagatgctgtatccctaataagtctaaaatgattactattcaatttgattgcccaaatgaggggtcatttaaatggaagatgctgtggattacatcttgtgtgtgtcagagaaactgcagagaacctggagatatattttctgagctcaagattctgtaaaaccaagcaaatgggggaaaagttagtcaatcctgtcatataataaaaaaattagtgagt

SEQ ID NO: 200246 - DNA, 2512 bp, Homo sapiens
  Payload ID: 19510
  Gene Name: WNT1 inducible signaling pathway protein 3
  Uniprot ID: O95389
  ENST ID: ENST00000361714
  CDS Start-End: 100-1164
gtggggtttgcagaggagacaggggagctttgtgtacccggagcaatgaacaagcggcgacttctctacccctcagggtggctccacggtcccagcgacatgcaggggctcctcttctccactcttctgcttgctggcctggcacagttctgctgcagggtacagggcactggaccattagatacaacacctgaaggaaggcctggagaagtgtcagatgcacctcagcgtaaacagttttgtcactggccctgcaaatgccctcagcagaagccccgttgccctcctggagtgagcctggtgagagatggctgtggatgctgtaaaatctgtgccaagcaaccaggggaaatctgcaatgaagctgacctctgtgacccacacaaagggctgtattgtgactactcagtagacaggcctaggtacgagactggagtgtgtgcataccttgtagctgttgggtgcgagttcaaccaggtacattatcataatggccaagtgtttcagcccaaccccttgttcagctgcctctgtgtgagtggggccattggatgcacacctctgttcataccaaagctggctggcagtcactgctctggagctaaaggtggaaagaagtctgatcagtcaaactgtagcctggaaccattactacagcagctttcaacaagctacaaaacaatgccagcttatagaaatctcccacttatttggaaaaaaaaatgtcttgtgcaagcaacaaaatggactccctgctccagaacatgtgggatgggaatatctaacagggtgaccaatgaaaacagcaactgtgaaatgagaaaagagaaaagactgtgttacattcagccttgcgacagcaatatattaaagacaataaagattcccaaaggaaaaacatgccaacctactttccaactctccaaagctgaaaaatttgtcttttctggatgctcaagtactcagagttacaaacccactttttgtggaatatgcttggataagagatgctgtatccctaataagtctaaaatgattactattcaatttgattgcccaaatgaggggtcatttaaatggaagatgctgtggattacatcttgtgtgtgtcagagaaactgcagagaacctggagatatattttctgagctcaagattctgtaaaaccaagcaaatgggggaaaagttagtcaatcctgtcatataataaaaaaattagtgagtataaaatggtggcaaatctactttgtttaaaacagtatgaatgcctattctcagatcactacatttaaggcattagaaacttttaaaaagttatcttaaaaatatacataaaatttgaacaacttaaaaattgaactaatttctaaaatatatcctataattatataatacacagacatttgttaccatctaagcattttgtatatgaaaaaattatgcaatttacaagaaaatattttacaaaataatctggaatacttgctaaagctgtataaaaagtatactaaattttaggctgggcgcagtggttcatgtctgtaatcccagcacttcgggaggccaaggtgggcagatcatttgaggtcaggagtttgagaccagcctggccaacatggtgaaaccctgtctgtaattaaaaaaatacaaaaattagccaagtgtggtggcatgcgcctgtaatcccagctactcgggaggctgagtcagaagaattgcttgaacccaggtggtggaggttgcagtgggtcaagattgcaccactgcactggcacggagaagcgagactcctttgggggagaaaaaaacatactcaatttaaaaaatttaatctatatttgacaatgtagcctaaggtgcccattagttgatacatcattatagggcaagtgaaattctagattaattcttgaacagaaataagattaagctgtaaatatatttagacttttcactgcctgatcttgaatatcagtttcttttggaaaggagaaaatgcaacttttctggccactgttaacaactgcaatctaaaattttttacatcaaatattgtaaaaagttaaatttccaagacaaagaccaagaacagtatcattactttgcaaaggaaagaaatataaagaatacaacttaaaattaacctgtggatctgaaatataaaatgttattaaaaataaattaatgttaaggctagaactgaagattatagtaaccggaacaattatagccatttattgcaaagtttggaagatatcaagcttagtaacattctgttcatttgcataaatgtcatgcagaacaataacaagtagcactgttgaaaaatatagacatttattataaaatcaattggtttgataagaaagcaattatttaaaaagtttaatacaaatacatgttaagtgtacaaattaggattcttttgggcaaacaagttgttatctaaagaagaagcaaaacctccttaacagttgtaataaaacctatgcctgaaaagttggtggctatt

SEQ ID NO: 200247 - DNA, 1089 bp, Homo sapiens
  Payload ID: 19510
  Gene Name: WNT1 inducible signaling pathway protein 3
  ENST ID: ENST00000368663
  CDS Start-End: 3-695
acatgcaggggctcctcttctccactcttctgcttgctggcctggcacagttctgctgcagggtacagggcactggaccattagatacaacacctgaaggaaggcctggagaagtgtcagatgcacctcagcgtaaacagttttgtcactggccctgcaaatgccctcagcagaagccccgttgccctcctggagtgagcctggtgagagatggctgtggatgctgtaaaatctgtgccaagcaaccaggggaaatctgcaatgaagctgacctctgtgacccacacaaagggctgtattgtgactactcagtagacaggcctaggtacgagactggagtgtgtgcataccttgtagctgttgggtgcgagttcaaccaggtacattatcataatggccaagtgtttcagcccaaccccttgttcagctgcctctgtgtgagtggggccattggatgcacacctctgttcataccaaagctggctggcagtcactgctctggagctaaaggtggaaagaagtctgatcagtcaaactgtagcctggaaccattactacagcagctttcaacaagctacaaaacaatgccagcttatagaaatctcccacttatttggaaaaaaaatgtcttgtgcaagcaacaaaatggactccctgctccagaacatgtgggatgggaatatctaacagggtgaccaatgaaaacagcaactgtgaaatgagaaaagagaaaagactgtgttacattcagccttgcgacagcaatatattaaagacaataaagattcccaaaggaaaaacatgccaacctactttccaactctccaaagctgaaaaatttgtcttttctggatgctcaagtactcagagttacaaacccactttttgtggaatatgcttggataagagatgctgtatccctaataagtctaaaatgattactattcaatttgattgcccaaatgaggggtcatttaaatggaagatgctgtggattacatcttgtgtgtgtcagagaaactgcagagaacctggagatatattttctgagctcaagattctgtaaaaccaagcaaatgggggaaaagt

SEQ ID NO: 200248 - DNA, 1305 bp, Homo sapiens
  Payload ID: 19510
  Gene Name: WNT1 inducible signaling pathway protein 3
  ENST ID: ENST00000368664
  CDS Start-End: 85-798
tgtgggaggtagagggtgtgtgttcttgtgcagaggagcgtggggtttgcagaggagacaggggagctttgtgtacccggagcaatgaacaagcggcgacttctctacccctcagggtggctccacggtcccagcgacatgcaggggctcctcttctccactcttctgcttgctggcctggcacagttctgctgcagggtacagggcactggaccattagatacaacacctgaaggaaggcctggagaagtgtcagatgcacctcagcgtaaacagttttgtcactggccctgcaaatgccctcagcagaagccccgttgccctcctggagtgagcctggtgagagatggctgtggatgctgtaaaatctgtgccaagcaaccaggggaaatctgcaatgaagctgacctctgtgacccacacaaagggctgtattgtgactactcagtagacaggcctaggtacgagactggagtgtgtgcataccttgtagctgttgggtgcgagttcaaccaggtacattatcataatggccaagtgtttcagcccaaccccttgttcagctgcctctgtgtgagtggggccattggatgcacacctctgttcataccaaagctggctggcagtcactgctctggagctaaaggtggaaagaagtctgatcagtcaaactgtagcctggaaccattactacagcagctttcaacaagctacaaaacaatgccagatgtgtgccaagcttctaatctgcttcctgcattgaggtctttaaactgttgtctaccttccagcttatagaaatctcccacttatttggaaaaaaaaatgtcttgtgcaagcaacaaaatggactccctgctccagaacatgtgggatgggaatatctaacagggtgaccaatgaaaacagcaactgtgaaatgagaaaagagaaaagactgtgttacattcagccttgcgacagcaatatattaaagacaataaagattcccaaaggaaaaacatgccaacctactttccaactctccaaagctgaaaaatttgtcttttctggatgctcaagtactcagagttacaaacccactttttgtggaatatgcttggataagagatgctgtatccctaataagtctaaaatgattactattcaatttgattgcccaaatgaggggtcatttaaatggaagatgctgtggattacatcttgtgtgtgtcagagaaactgcagagaacctggagatatattttctgagctcaagattctgtaaaaccaagcaaatgggggaaaagttagtcaatcctgtca

SEQ ID NO: 200249 - DNA, 2700 bp, Homo sapiens
  Payload ID: 19510
  Gene Name: WNT1 inducible signaling pathway protein 3
  Uniprot ID: O95389
  ENST ID: ENST00000368666
  CDS Start-End: 233-1351
cctcctgagtcccgggaggaaagtgctcgcccattcctgacctgtgacacgctcactgcgaaggcaggttattagaagagtcccatgaaagtaaacagggtattaaaacggatccttaaaaatgaaagtgcaggctgaaagttggtagtgtgggaggtagagggtgtgtgttcttgtgcagaggagcgtggggtttgcagaggagacaggggagctttgtgtacccggagcaatgaacaagcggcgacttctctacccctcagggtggctccacggtcccagcgacatgcaggggctcctcttctccactcttctgcttgctggcctggcacagttctgctgcagggtacagggcactggaccattagatacaacacctgaaggaaggcctggagaagtgtcagatgcacctcagcgtaaacagttttgtcactggccctgcaaatgccctcagcagaagccccgttgccctcctggagtgagcctggtgagagatggctgtggatgctgtaaaatctgtgccaagcaaccaggggaaatctgcaatgaagctgacctctgtgacccacacaaagggctgtattgtgactactcagtagacaggcctaggtacgagactggagtgtgtgcataccttgtagctgttgggtgcgagttcaaccaggtacattatcataatggccaagtgtttcagcccaaccccttgttcagctgcctctgtgtgagtggggccattggatgcacacctctgttcataccaaagctggctggcagtcactgctctggagctaaaggtggaaagaagtctgatcagtcaaactgtagcctggaaccattactacagcagctttcaacaagctacaaaacaatgccagcttatagaaatctcccacttatttggaaaaaaaaatgtcttgtgcaagcaacaaaatggactccctgctccagaacatgtgggatgggaatatctaacagggtgaccaatgaaaacagcaactgtgaaatgagaaaagagaaaagactgtgttacattcagccttgcgacagcaatatattaaagacaataaagattcccaaaggaaaaacatgccaacctactttccaactctccaaagctgaaaaatttgtcttttctggatgctcaagtactcagagttacaaacccactttttgtggaatatgcttggataagagatgctgtatccctaataagtctaaaatgattactattcaatttgattgcccaaatgaggggtcatttaaatggaagatgctgtggattacatcttgtgtgtgtcagagaaactgcagagaacctggagatatattttctgagctcaagattctgtaaaaccaagcaaatgggggaaaagttagtcaatcctgtcatataataaaaaaattagtgagtataaaatggtggcaaatctactttgtttaaaacagtatgaatgcctattctcagatcactacatttaaggcattagaaacttttaaaaagttatcttaaaaatatacataaaatttgaacaacttaaaaattgaactaatttctaaaatatatcctataattatataatacacagacatttgttaccatctaagcattttgtatatgaaaaaattatgcaatttacaagaaaatattttacaaaataatctggaatacttgctaaagctgtataaaaagtatactaaattttaggctgggcgcagtggttcatgtctgtaatcccagcacttcgggaggccaaggtgggcagatcatttgaggtcaggagtttgagaccagcctggccaacatggtgaaaccctgtctgtaattaaaaaaatacaaaaattagccaagtgtggtggcatgcgcctgtaatcccagctactcgggaggctgagtcagaagaattgcttgaacccaggtggtggaggttgcagtgggtcaagattgcaccactgcactggcacggagaagcgagactcctttgggggagaaaaaaacatactcaatttaaaaaatttaatctatatttgacaatgtagcctaaggtgcccattagttgatacatcattatagggcaagtgaaattctagattaattcttgaacagaaataagattaagctgtaaatatatttagacttttcactgcctgatcttgaatatcagtttcttttggaaaggagaaaatgcaacttttctggccactgttaacaactgcaatctaaaattttttacatcaaatattgtaaaaagttaaatttccaagacaaagaccaagaacagtatcattactttgcaaaggaaagaaatataaagaatacaacttaaaattaacctgtggatctgaaatataaaatgttattaaaaataaattaatgttaaggctagaactgaagattatagtaaccggaacaattatagccatttattgcaaagtttggaagatatcaagcttagtaacattctgttcatttgcataaatgtcatgcagaacaataacaagtagcactgttgaaaaatatagacatttattataaaatcaattggtttgataagaaagcaattatttaaaaagtttaatacaaatacatgttaagtgtacaaattaggattcttttgggcaaacaagttgttatctaaagaagaagcaaaacctccttaacagttgtaataaaacctatgcctgaaaagttggtggctatta

SEQ ID NO: 200250 - DNA, 953 bp, Homo sapiens
  Payload ID: 19510
  Gene Name: WNT1 inducible signaling pathway protein 3
  ENST ID: ENST00000409166
  CDS Start-End: 523-915
tgtgggaggtagagggtgtgtgcatgtaagtgtcttcttctggacctgctggaaaagattgagtctagacagaatttttttttcctgcaattgttagcttggagtgatcagcttagtttggctaaatatgagaccttgtagctgttgggtgcgagttcaaccaggtacattatcataatggccaagtgtttcagcccaaccccttgttcagctgcctctgtgtgagtggggccattggatgcacacctctgttcataccaaagctggctggcagtcactgctctggagctaaaggtggaaagaagtctgatcagtcaaactgtagcctggaaccattactacagcagctttcaacaagctacaaaacaatgccagatgtgtgccaagcttctaatctgcttcctgcattgaggtctttaaactgttgtctaccttccagcttatagaaatctcccacttatttggaaaaaaaaatgtcttgtgcaagcaacaaaatggactccctgctccagaacatgtgggatgggaatatctaacagggtgaccaatgaaaacagcaactgtgaaatgagaaaagagaaaagactgtgttacattcagccttgcgacagcaatatattaaagacaataaagattcccaaaggaaaaacatgccaacctactttccaactctccaaagctgaaaaatttgtcttttctggatgctcaagtactcagagttacaaacccactttttgtggaatatgcttggataagagatgctgtatccctaataagtctaaaatgattactattcaatttgattgcccaaatgaggggtcatttaaatggaagatgctgtggattacatcttgtgtgtgtcagagaaactgcagagaacctggagatatattttctgagctcaagattctgtaaaaccaagcaaatgggggaaaagttagtcaatcctgtca

SEQ ID NO: 200251 - DNA, 1305 bp, Homo sapiens
  Payload ID: 19510
  Gene Name: WNT1 inducible signaling pathway protein 3
  ENST ID: ENST00000454589
  CDS Start-End: 111-770
cctgagtcccgggaggaaagtgctcgcccattcctgacctgtgacacgctcactgcgaaggcaggttattagaagagtcccatgaaaggtggctccacggtcccagcgacatgcaggggctcctcttctccactcttctgcttgctggcctggcacagttctgctgcagggtacagggcactggaccattagatacaacacctgaaggaaggcctggagaagtgtcagatgcacctcagcgtaaacagttttgtcactggccctgcaaatgccctcagcagaagccccgttgccctcctggagtgagcctggtgagagatggctgtggatgctgtaaaatctgtgccaagcaaccaggggaaatctgcaatgaagctgacctctgtgacccacacaaagggctgtattgtgactactcagtagacaggcctaggtacgagactggagtgtgtgcataccttgtagctgttgggtgcgagttcaaccaggtacattatcataatggccaagtgtttcagcccaaccccttgttcagctgcctctgtgtgagtggggccattggatgcacacctctgttcataccaaagctggctggcagtcactgctctggagctaaaggtggaaagaagtctgatcagtcaaactgtagcctggaaccattactacagcagctttcaacaagctacaaaacaatgccagatgtgtgccaagcttctaatctgcttcctgcattgaggtctttaaactgttgtctaccttccagcttatagaaatctcccacttatttggaaaaaaaaatgtcttgtgcaagcaacaaaatggactccctgctccagaacatgtgggatgggaatatctaacagggtgaccaatgaaaacagcaactgtgaaatgagaaaagagaaaagactgtgttacattcagccttgcgacagcaatatattaaagacaataaagattcccaaaggaaaaacatgccaacctactttccaactctccaaagctgaaaaatttgtcttttctggatgctcaagtactcagagttacaaacccactttttgtggaatatgcttggataagagatgctgtatccctaataagtctaaaatgattactattcaatttgattgcccaaatgaggggtcatttaaatggaagatgctgtggattacatcttgtgtgtgtcagagaaactgcagagaacctggagatatattttctgagctcaagattctgtaaaaccaagcaaatgggggaaaagttagtcaatcctgtcatataataaaaaaattagtgagtataaaa

SEQ ID NO: 200252 - DNA, 1250 bp, Homo sapiens
  Payload ID: 19510
  Gene Name: WNT1 inducible signaling pathway protein 3
  Uniprot ID: O95389
  ENST ID: ENST00000604763
  CDS Start-End: 120-1184
cctgagtcccgggaggaaagtgctcgcccattcctgacctgtgacacgctcactgcgaaggcaggttattagaagagtcccatgaaagtaaacaggggtggctccacggtcccagcgacatgcaggggctcctcttctccactcttctgcttgctggcctggcacagttctgctgcagggtacagggcactggaccattagatacaacacctgaaggaaggcctggagaagtgtcagatgcacctcagcgtaaacagttttgtcactggccctgcaaatgccctcagcagaagccccgttgccctcctggagtgagcctggtgagagatggctgtggatgctgtaaaatctgtgccaagcaaccaggggaaatctgcaatgaagctgacctctgtgacccacacaaagggctgtattgtgactactcagtagacaggcctaggtacgagactggagtgtgtgcataccttgtagctgttgggtgcgagttcaaccaggtacattatcataatggccaagtgtttcagcccaaccccttgttcagctgcctctgtgtgagtggggccattggatgcacacctctgttcataccaaagctggctggcagtcactgctctggagctaaaggtggaaagaagtctgatcagtcaaactgtagcctggaaccattactacagcagctttcaacaagctacaaaacaatgccagcttatagaaatctcccacttatttggaaaaaaaaatgtcttgtgcaagcaacaaaatggactccctgctccagaacatgtgggatgggaatatctaacagggtgaccaatgaaaacagcaactgtgaaatgagaaaagagaaaagactgtgttacattcagccttgcgacagcaatatattaaagacaataaagattcccaaaggaaaaacatgccaacctactttccaactctccaaagctgaaaaatttgtcttttctggatgctcaagtactcagagttacaaacccactttttgtggaatatgcttggataagagatgctgtatccctaataagtctaaaatgattactattcaatttgattgcccaaatgaggggtcatttaaatggaagatgctgtggattacatcttgtgtgtgtcagagaaactgcagagaacctggagatatattttctgagctcaagattctgtaaaaccaagcaaatgggggaaaagttagtcaatcctgtcatataataaaaaaattagtgagtataaaa

SEQ ID NO: 200253 - DNA, 2748 bp, Homo sapiens
  Payload ID: 19511
  Gene Name: wntless Wnt ligand secretion mediator
  Uniprot ID: Q5T9L3
  ENST ID: ENST00000262348
  CDS Start-End: 255-1880
ctttaagcgtccacaggcggcggagcggccacaatcacagctccgggcattgggggaacccgagccggctgcgccgggggaatccgtgcgggcgccttccgtcccggtcccatcctcgccgcgctccagcacctctgaagttttgcagcgcccagaaaggaggcgaggaaggagggagtgtgtgagaggagggagcaaaaagctcaccctaaaacatttatttcaaggagaaaagaaaaagggggggcgcaaaaatggctggggcaattatagaaaacatgagcaccaagaagctgtgcattgttggtgggattctgctcgtgttccaaatcatcgcctttctggtgggaggcttgattgctccagggcccacaacggcagtgtcctacatgtcggtgaaatgtgtggatgcccgtaagaaccatcacaagacaaaatggttcgtgccttggggacccaatcattgtgacaagatccgagacattgaagaggcaattccaagggaaattgaagccaatgacatcgtgttttctgttcacattcccctcccccacatggagatgagtccttggttccaattcatgctgtttatcctgcagctggacattgccttcaagctaaacaaccaaatcagagaaaatgcagaagtctccatggacgtttccctggcttaccgtgatgacgcgtttgctgagtggactgaaatggcccatgaaagagtaccacggaaactcaaatgcaccttcacatctcccaagactccagagcatgagggccgttactatgaatgtgatgtccttcctttcatggaaattgggtctgtggcccataagttttaccttttaaacatccggctgcctgtgaatgagaagaagaaaatcaatgtgggaattggggagataaaggatatccggttggtggggatccaccaaaatggaggcttcaccaaggtgtggtttgccatgaagaccttccttacgcccagcatcttcatcattatggtgtggtattggaggaggatcaccatgatgtcccgacccccagtgcttctggaaaaagtcatctttgcccttgggatttccatgacctttatcaatatcccagtggaatggttttccatcgggtttgactggacctggatgctgctgtttggtgacatccgacagggcatcttctatgcgatgcttctgtccttctggatcatcttctgtggcgagcacatgatggatcagcacgagcggaaccacatcgcagggtattggaagcaagtcggacccattgccgttggctccttctgcctcttcatatttgacatgtgtgagagaggggtacaactcacgaatcccttctacagtatctggactacagacattggaacagagctggccatggccttcatcatcgtggctggaatctgcctctgcctctacttcctgtttctatgcttcatggtatttcaggtgtttcggaacatcagtgggaagcagtccagcctgccagctatgagcaaagtccggcggctacactatgaggggctaatttttaggttcaagttcctcatgcttatcaccttggcctgcgctgccatgactgtcatcttcttcatcgttagtcaggtaacggaaggccattggaaatggggcggcgtcacagtccaagtgaacagtgcctttttcacaggcatctatgggatgtggaatctgtatgtctttgctctgatgttcttgtatgcaccatcccataaaaactatggagaagaccagtccaatggcgatctgggtgtccatagtggggaagaactccagctcaccaccactatcacccatgtggacggacccactgagatctacaagttgacccgcaaggaggcccaggagtaggaggctgcagcgcccggctgggacggtctctccataccccagcccctctaactagagtggggagcatgccagagagagctcaatgtacaaatgaatgcctcatggctcttagctgtggtttcttggaccagcggcatggacatttgtcagtttgccttctgacggtagcttttggaggaagattcctgcagccactaatgcattgtgtatgataacaaaaactctggtatgacacattttctgtgatcattgttaattagtgacatagtaacatctgtagcagctggttagtaaacctcatgtgggggtggggtgggggtgtattccttgggggatggtttgggccgaatggggagtggaatatttgacatttttcctgttttaaattctaggatagattttaacatcctttgcggtcccagtccaaggtaggctggtgtcatagtcttctcactcctaatccatgaccactgtttttttcctatttatatcaccaggtagcccactgagttaatatttaagttgtcaatagataagtgtccctgttttgtggcataatataactgaatttcatgagaagatttattccaccaggggtatttcagctttgaaaccaaatctgtgtatctaatactaaccaatctgttggatgtgggttttaaaaaatgtttgctaaactacccaagtaagatttactgtattaaatggccttcgggtctgaaaagcttttttaacttcttgcttaaaatgcgttttattttgataagatacttcaaatagcctccaaaagtgtagatccaatcatttaaataaacctgtatgtatatgcatatgtgtacatgcatatcccctcctgctaaaactcata

SEQ ID NO: 200254 - DNA, 2037 bp, Homo sapiens
  Payload ID: 19511
  Gene Name: wntless Wnt ligand secretion mediator
  Uniprot ID: Q5T9L3
  ENST ID: ENST00000354777
  CDS Start-End: 247-1878
gtccacaggcggcggagcggccacaatcacagctccgggcattgggggaacccgagccggctgcgccgggggaatccgtgcgggcgccttccgtcccggtcccatcctcgccgcgctccagcacctctgaagttttgcagcgcccagaaaggaggcgaggaaggagggagtgtgtgagaggagggagcaaaaagctcaccctaaaacatttatttcaaggagaaaagaaaaagggggggcgcaaaaatggctggggcaattatagaaaacatgagcaccaagaagctgtgcattgttggtgggattctgctcgtgttccaaatcatcgcctttctggtgggaggcttgattgggcccacaacggcagtgtcctacatgtcggtgaaatgtgtggatgcccgtaagaaccatcacaagacaaaatggttcgtgccttggggacccaatcattgtgacaagatccgagacattgaagaggcaattccaagggaaattgaagccaatgacatcgtgttttctgttcacattcccctcccccacatggagatgagtccttggttccaattcatgctgtttatcctgcagctggacattgccttcaagctaaacaaccaaatcagagaaaatgcagaagtctccatggacgtttccctggcttaccgtgatgacgcgtttgctgagtggactgaaatggcccatgaaagagtaccacggaaactcaaatgcaccttcacatctcccaagactccagagcatgagggccgttactatgaatgtgatgtccttcctttcatggaaattgggtctgtggcccataagttttaccttttaaacatccggctgcctgtgaatgagaagaagaaaatcaatgtgggaattggggagataaaggatatccggttggtggggatccaccaaaatggaggcttcaccaaggtgtggtttgccatgaagaccttccttacgcccagcatcttcatcattatggtgtggtattggaggaggatcaccatgatgtcccgacccccagtgcttctggaaaaagtcatctttgcccttgggatttccatgacctttatcaatatcccagtggaatggttttccatcgggtttgactggacctggatgctgctgtttggtgacatccgacagggcatcttctatgcgatgcttctgtccttctggatcatcttctgtggcgagcacatgatggatcagcacgagcggaaccacatcgcagggtattggaagcaagtcggacccattgccgttggctccttctgcctcttcatatttgacatgtgtgagagaggggtacaactcacgaatcccttctacagtatctggactacagacattggaacagagctggccatggccttcatcatcgtggctggaatctgcctctgcctctacttcctgtttctatgcttcatggtatttcaggtgtttcggaacatcagtgggaagcagtccagcctgccagctatgagcaaagtccggcggctacactatgaggggctaatttttaggttcaagttcctcatgcttatcaccttggcctgcgctgccatgactgtcatcttcttcatcgttagtcaggtaacggaaggccattggaaatggggcggcgtcacagtccaagtgaacagtgcctttttcacaggcatctatgggatgtggaatctgtatgtctttgctctgatgttcttgtatgcaccatcccataaaaactatggagaagaccagtccaatggaatgcaactcccatgtaaatcgagggaagattgtgctttgtttgtttcggaactttatcaagaattgttcagcgcttcgaaatattccttcatcaatgacaacgcagcttctggtatttgagtcaacaaggcaacacatgtttatcagctttgcatttgcagttgtcacagtcacattgattgtacttgtatacgcacacaaatacactcatttagcctttatctcaaaatgttaaatataaggaaaaaagcgtcaacaataaatattctttgagtattg

SEQ ID NO: 200255 - DNA, 700 bp, Homo sapiens
  Payload ID: 19511
  Gene Name: wntless Wnt ligand secretion mediator
  ENST ID: ENST00000370971
  CDS Start-End: 225-608
acaatcacagctccgggcattgggggaacccgagccggctgcgccgggggaatccgtgcgggcgccttccgtcccggtcccatcctcgccgcgctccagcacctctgaagttttgcagcgcccagaaaggaggcgaggaaggagggagtgtgtgagaggagggagcaaaaagctcaccctaaaacatttatttcaaggagaaaagaaaaagggggggcgcaaaaatggctggggcaattatagaaaacatgagcaccaagaagctgtgcattgttggtgggattctgctcgtgttccaaatcatcgcctttctggtgggaggcttgattgctccagggcccacaacggcagtgtcctacatgtcggtgaaatgtgtggatgcccgtaagaaccatcacaagacaaaatggttcgtgccttggggacccaatcattgtgacaagatccgagacattgaagaggcaattccaagggaaattgaagccaatgacatcgtgttttctgttcacattcccctcccccacatggagatgagtccttggttccaattcatgctgtttatcctgcagctggacattgccttcaagctaaacaaccaaatcagttaagtgtactctcctctcatccctttcttccctttgagcattgccctctttgggttctttttgagccaattctaataaaagtaaaaatggtaata

SEQ ID NO: 200256 - DNA, 572 bp, Homo sapiens
  Payload ID: 19511
  Gene Name: wntless Wnt ligand secretion mediator
  ENST ID: ENST00000370973
  CDS Start-End: 206-572
acaatcacagctccgggcattgggggaacccgagccggctgcgccgggggaatccgtgcgggcgccttccgtcccggtcccatcctcgccgcgctccagcacctctgaagttttgcagcgcccagaaaggaggcgaggaaggagggagtgtctggacattgccttcaagctaaacaaccaaatcagagaaaatgcagaagtctccatggacgtttccctggcttaccgtgatgacgcgtttgctgagtggactgaaatggcccatgaaagagtaccacggaaactcaaatgcaccttcacatctcccaagactccagagcatgagggccgttactatgaatgtgatgtccttcctttcatggaaattgggtctgtggcccataagttttaccttttaaacatccggctgcctgtgaatgagaagaagaaaatcaatgtgggaattggggagataaaggatatccggttggtggggatccaccaaaatggaggcttcaccaaggtgtggtttgccatgaagaccttccttacgcccagcatcttcatcattatggtgtggtattggaggagga

SEQ ID NO: 200257 - DNA, 2332 bp, Homo sapiens
  Payload ID: 19511
  Gene Name: wntless Wnt ligand secretion mediator
  Uniprot ID: Q5T9L3
  ENST ID: ENST00000370976
  CDS Start-End: 246-1598
tccacaggcggcggagcggccacaatcacagctccgggcattgggggaacccgagccggctgcgccgggggaatccgtgcgggcgccttccgtcccggtcccatcctcgccgcgctccagcacctctgaagttttgcagcgcccagaaaggaggcgaggaaggagggagtgtgtgagaggagggagcaaaaagctcaccctaaaacatttatttcaaggagaaaagaaaaagggggggcgcaaaaatggctggggcaattatagaaaacatgagcaccaagaagctgtgcattgttggtgggattctgctcgtgttccaaatcatcgcctttctggtgggaggcttgattggagaaaatgcagaagtctccatggacgtttccctggcttaccgtgatgacgcgtttgctgagtggactgaaatggcccatgaaagagtaccacggaaactcaaatgcaccttcacatctcccaagactccagagcatgagggccgttactatgaatgtgatgtccttcctttcatggaaattgggtctgtggcccataagttttaccttttaaacatccggctgcctgtgaatgagaagaagaaaatcaatgtgggaattggggagataaaggatatccggttggtggggatccaccaaaatggaggcttcaccaaggtgtggtttgccatgaagaccttccttacgcccagcatcttcatcattatggtgtggtattggaggaggatcaccatgatgtcccgacccccagtgcttctggaaaaagtcatctttgcccttgggatttccatgacctttatcaatatcccagtggaatggttttccatcgggtttgactggacctggatgctgctgtttggtgacatccgacagggcatcttctatgcgatgcttctgtccttctggatcatcttctgtggcgagcacatgatggatcagcacgagcggaaccacatcgcagggtattggaagcaagtcggacccattgccgttggctccttctgcctcttcatatttgacatgtgtgagagaggggtacaactcacgaatcccttctacagtatctggactacagacattggaacagagctggccatggccttcatcatcgtggctggaatctgcctctgcctctacttcctgtttctatgcttcatggtatttcaggtgtttcggaacatcagtgggaagcagtccagcctgccagctatgagcaaagtccggcggctacactatgaggggctaatttttaggttcaagttcctcatgcttatcaccttggcctgcgctgccatgactgtcatcttcttcatcgttagtcaggtaacggaaggccattggaaatggggcggcgtcacagtccaagtgaacagtgcctttttcacaggcatctatgggatgtggaatctgtatgtctttgctctgatgttcttgtatgcaccatcccataaaaactatggagaagaccagtccaatggcgatctgggtgtccatagtggggaagaactccagctcaccaccactatcacccatgtggacggacccactgagatctacaagttgacccgcaaggaggcccaggagtaggaggctgcagcgcccggctgggacggtctctccataccccagcccctctaactagagtggggagcatgccagagagagctcaatgtacaaatgaatgcctcatggctcttagctgtggtttcttggaccagcggcatggacatttgtcagtttgccttctgacggtagcttttggaggaagattcctgcagccactaatgcattgtgtatgataacaaaaactctggtatgacacattttctgtgatcattgttaattagtgacatagtaacatctgtagcagctggttagtaaacctcatgtgggggtggggtgggggtgtattccttgggggatggtttgggccgaatggggagtggaatatttgacatttttcctgttttaaattctaggatagattttaacatcctttgcggtcccagtccaaggtaggctggtgtcatagtcttctcactcctaatccatgaccactgtttttttcctatttatatcaccaggtagcccactgagttaatatttaagttgtcaatagataagtgtccctgttttgtggcataatataactgaatttcatgagaagatttattccaccaggggtatttcagctttgaaaccaaatctgtgtatctaatactaaccaatctgttggatgtgggttttaaaaaatgtttgctaaactacccaagtaagatttactgtattaaatggccttcgggtctgaaaagcttttttaa

SEQ ID NO: 200258 - DNA, 600 bp, Homo sapiens
  Payload ID: 19511
  Gene Name: wntless Wnt ligand secretion mediator
  ENST ID: ENST00000534713
  CDS Start-End: 1-600
aaaacatgagcaccaagaagctgtgcattgttggtgggattctgctcgtgttccaaatcatcgcctttctggtgggaggcttgattggagaaaatgcagaagtctccatggacgtttccctggcttaccgtgatgacgcgtttgctgagtggactgaaatggcccatgaaagagtaccacggaaactcaaatgcaccttcacatctcccaagactccagagcatgagggccgttactatgaatgtgatgtccttcctttcatggaaattgggtctgtggcccataagttttaccttttaaacatccggctgcctgtgaatgagaagaagaaaatcaatgtgggaattggggagataaaggatatccggttggtggggatccaccaaaatggaggcttcaccaaggtgtggtttgccatgaagaccttccttacgcccagcatcttcatcattatggtgtggtattggaggaggatcaccatgatgtcccgacccccagtgcttctggaaaaagtcatctttgcccttgggatttccatgacctttatcaatatcccagtggaatggttttccatcgggtttgactggacctggatgctgc

SEQ ID NO: 200259 - DNA, 1056 bp, Homo sapiens
  Payload ID: 19511
  Gene Name: wntless Wnt ligand secretion mediator
  ENST ID: ENST00000530486
  CDS Start-End: 389-1056
agaaagaagtcgagctgagactttattccgcatctctgtgttttgacttaggcatctattgggtccttttaaaaaaaattctcctcctctttcctaaagagagttctagcagttgggggtggggtggggaccatttcctaaagtcaacgcgtaagttaaaggtctgcaaggcggtccaccggtgatttaaatctcgcacttcggaaaccagaaaaggaaacctgtgagaagctgggcagggggaacccgcttaacatcaacagcaacccctaaatggcatcagaccttggagagacaggttgcaggccagactcgggagccaggcgccagcacccgccagagctctgagccccgaactgctccagggcccacaacggcagtgtcctacatgtcggtgaaatgtgtggatgcccgtaagaaccatcacaagacaaaatggttcgtgccttggggacccaatcattgtgacaagatccgagacattgaagaggcaattccaagggaaattgaagccaatgacatcgtgttttctgttcacattcccctcccccacatggagatgagtccttggttccaattcatgctgtttatcctgcagctggacattgccttcaagctaaacaaccaaatcagagaaaatgcagaagtctccatggacgtttccctggcttaccgtgatgacgcgtttgctgagtggactgaaatggcccatgaaagagtaccacggaaactcaaatgcaccttcacatctcccaagactccagagcatgagggccgttactatgaatgtgatgtccttcctttcatggaaattgggtctgtggcccataagttttaccttttaaacatccggctgcctgtgaatgagaagaagaaaatcaatgtgggaattggggagataaaggatatccggttggtggggatccaccaaaatggaggcttcaccaaggtgtggtttgccatgaagaccttccttacgcccagcatcttcatcattatggtgtggtattggaggaggatcaccatgatgtcccgacccccagtgcttctggaaaa

SEQ ID NO: 200260 - DNA, 779 bp, Homo sapiens
  Payload ID: 19511
  Gene Name: wntless Wnt ligand secretion mediator
  ENST ID: ENST00000491076
  CDS Start-End: 223-339
aatcacagctccgggcattgggggaacccgagccggctgcgccgggggaatccgtgcgggcgccttccgtcccggtcccatcctcgccgcgctccagcacctctgaagttttgcagcgcccagaaaggaggcgaggaaggagggagtgtgtgagaggagggagcaaaaagctcaccctaaaacatttatttcaaggagaaaagaaaaagggggggcgcaaaaatggctggggcaattatagaaaacatgagcaccaagaagctgtgcattgttggtgggattctgctcgtgttccaaatcatcgcctttctggtgggaggcttgattgcatacccataaatgagactattccaaacataaactctccagggcccacaacggcagtgtcctacatgtcggtgaaatgtgtggatgcccgtaagaaccatcacaagacaaaatggttcgtgccttggggacccaatcattgtgacaagatccgagacattgaagaggcaattccaagggaaattgaagccaatgacatcgtgttttctgttcacattcccctcccccacatggagatgagtccttggttccaattcatgctgtttatcctgcagctggacattgccttcaagctaaacaaccaaatcagagaaaatgcagaagtctccatggacgtttccctggcttaccgtgatgacgcgtttgctgagtggactgaaatggcccatgaaagagtaccacggaaactcaaatgcaccttcacatctcccaagactccagagcatgagggc

SEQ ID NO: 200261 - DNA, 524 bp, Homo sapiens
  Payload ID: 19511
  Gene Name: wntless Wnt ligand secretion mediator
  ENST ID: ENST00000533537
  CDS Start-End: 121-524
ggtcgtctttgctaggggctgagggtttgcaatttggggtcccgaccttcgcgccctctgctttcccgccgcactccaccccacgctctgccgtggacaggagaaaatgcagaagtctccatggacgtttccctggcttaccgtgatgacgcgtttgctgagtggactgaaatggcccatgaaagagtaccacggaaactcaaatgcaccttcacatctcccaagactccagagcatgagggccgttactatgaatgtgatgtccttcctttcatggaaattgggtctgtggcccataagttttaccttttaaacatccggctgcctgtgaatgagaagaagaaaatcaatgtgggaattggggagataaaggatatccggttggtggggatccaccaaaatggaggcttcaccaaggtgtggtttgccatgaagaccttccttacgcccagcatcttcatcattatggtgtggtattggaggaggatcaccatgatgtcccgacccccagtgcttctggaaaa

SEQ ID NO: 200262 - DNA, 570 bp, Homo sapiens
  Payload ID: 19511
  Gene Name: wntless Wnt ligand secretion mediator
  ENST ID: ENST00000527864
  CDS Start-End: 1-458
ggttcccttccaatcagctccgggagggcaacgtaatcgactttattaggaacaacagaagagtcggggaactgtgcccggcgcaaacccggagctctgttacaaggctgagatacttgcacgctccagggcccacaacggcagtgtcctacatgtcggtgaaatgtgtggatgcccgtaagaaccatcacaagacaaaatggttcgtgccttggggacccaatcattgtgacaagatccgagacattgaagaggcaattccaagggaaattgaagccaatgacatcgtgttttctgttcacattcccctcccccacatggagatgagtccttggttccaattcatgctgtttatcctgcagctggacattgccttcaagctaaacaaccaaatcacaatgaacaggacttcagagaagagtttgggagtgtggcaaacaagatcctattacacatgatggcttcctgcttatcagagattcacctgtaacaatattacttcatatgagaaaatgcagaagtctccatggacgtttccctggcttaccgtgatgacgcgtttgctgagtg

SEQ ID NO: 200263 - DNA, 555 bp, Homo sapiens
  Payload ID: 19511
  Gene Name: wntless Wnt ligand secretion mediator
  ENST ID: ENST00000471243
  CDS Start-End: 98-555
aacgaacagtggtctgatttggctggagagcaagtttcctcaaggggcgccgtggggaatttagctggctccagggcccacaacggcagtgtcctacatgtcggtgaaatgtgtggatgcccgtaagaaccatcacaagacaaaatggttcgtgccttggggacccaatcattgtgacaagatccgagacattgaagaggcaattccaagggaaattgaagccaatgacatcgtgttttctgttcacattcccctcccccacatggagatgagtccttggttccaattcatgctgtttatcctgcagctggacattgccttcaagctaaacaaccaaatcagagaaaatgcagaagtctccatggacgtttccctggcttaccgtgatgacgcgtttgctgagtggactgaaatggcccatgaaagagtaccacggaaactcaaatgcaccttcacatctcccaagactccagagcatgagggccgttactatgaatgtgatgtccttcctttcatggaaattgggtctgtggcccataagttttaccttttaaa

SEQ ID NO: 200264 - DNA, 8050 bp, Homo sapiens
  Payload ID: 19512
  Gene Name: Wolf-Hirschhorn syndrome candidate 1
  Uniprot ID: O96028
  ENST ID: ENST00000312087
  CDS Start-End: 432-2375
gcatgagccaccgtgcctgtcctagaaccactggtaactcttaactgagacaagatttcgccatgttgcccaggctggtctcgaacttctgagctcaagcgatctacctgcctcgtcctcccaaagtgttggaattgcaggtgtgagccactgcacccggcccttgcctcatgtttgaatgataatttacctgggcataaaattctggacacttgtggtggcacgagctgtctgcttttctgtggagactgcgggttgcagacaccagcagccccctattgctgcacgtcaggtgtcctccacctcagtactgtggacatctcgggccgcatagccctgttgcgcgggcatcctgtgcgttgcaggagatgcagcagcatccatgaccgcaacccatcagagtgttctaagaacggaagcatctgggctggatggaatttagcatcaagcagagtcccctttctgttcagagtgttgtaaagtgcataaagatgaagcaggcaccagaaatcctcggcagtgccaacgggaagactccgagctgcgaggtgaaccgcgagtgttctgtgttcctcagcaaagcccagctctccagtagcctgcaggagggggtcatgcagaagtttaacggccacgacgccctgccctttattccagccgacaagctgaaagatcttacttcccgggtgtttaatggagaacccggcgcacacgatgccaaactgcgttttgagtcccaggaaatgaaagggattgggacaccccctaacactacccctatcaaaaatggctctccagaaattaagctgaaaatcaccaaaacatacatgaatgggaagcctctctttgaatcttccatttgtggtgacagtgctgctgatgtgtctcagtcagaagaaaatggacaaaaaccagaaaacaaggcgagaaggaacaggaagaggagcataaaatatgactccttgctggagcagggccttgtcgaagcagctcttgtgtctaagatctcaagtccttcagataaaaagattccagctaagaaagagtcttgtccaaacactggaagagacaaagaccacctgttgaaatacaacgttggtgatttggtgtggtccaaagtgtcgggttacccttggtggccttgcatggtttctgcagatccactccttcacagctataccaaacttaaaggtcagaaaaagagtgcacgccagtatcacgtacagttctttggtgacgccccagaaagagcttggatatttgagaagagcctcgtagcttttgaaggagaaggacagtttgaaaaattatgccaggaaagtgccaagcaggcacccacgaaagctgagaaaattaagctattgaaaccaatttcagggaaattgagggcccagtgggaaatgggcattgttcaagcagaagaagctgcaagcatgtcagtggaggagcggaaagccaagttcacctttctctatgtgggggaccagcttcatctcaaccctcaagtagccaaggaggctggcattgctgcagagtctttgggagaaatggcagaatcctcaggagtcagtgaagaagctgctgaaaaccccaagtctgtgagagaagagtgcattcccatgaagagaaggcggagggccaaactgtgtagctctgcagagaccctggagagtcaccccgacatagggaagagtactcctcaaaagacggcagaggctgaccccagaagaggagtagggtctcctcctgggaggaagaagaccacagtctccatgccacgaagcaggaagggagatgcagcatcccagtttttggtcttctgtcaaaaacacagggatgaggtggtagctgagcacccagatgcttcaggtgaggagattgaagagctgctcaggtcacagtggagtctgctgagtgagaagcagagagcacgctacaacaccaagtttgccctggtggcccctgtccaggctgaagaagactctggtaatgtaaatgggaaaaaaagaaaccacacaaagaggatacaggaccctacagaagatgctgaagctgaggacacacccaggaaaagactcaggacggacaagcacagtcttcggaagagagacacaatcactgacaaaacggccagaacaagctcttacaaggccatggaggcagcctcctcgctcaagagccaggcagcaacgaaaaatctgtctgatgcatgtaaaccactgaagaagcgaaatcgggcttccacggcagcatcttcagctcttgggtttagcaaaagttcatctccttctgcatccttaactgagaatgagcttttgtgggagcccacaccagtcaagttggatttgaacccagctgctctgtactgcacttagaatgatgtaatattccaggatgctgctgcaggtggcgtatcatcgtacacactcagtgacatttctatcacaatcattttatggaagatgtgtgataatctgtttttactggtattaataaacacatacaatgaagaaaacagataacaaattttaagaccaaggtctcggacagcccgggagacgagccctcggagtccccatacgaaagtgcagacgaaacacaaactgaagtatctgtctcatccaaaaagtctgagcgaggagtgactgccaaaaaggagtatgtgtgccagctgtgtgagaagccgggcagcctcctgctctgtgaaggaccctgctgcggagctttccacctcgcctgccttgggctttcccggaggccagaagggaggttcacctgcagcgagtgtgcctcagggattcactcatgtttcgtgtgtaaagagagcaagacagatgttaagcgctgtgtggtaactcagtgtggaaaattttaccatgaggcttgtgtgaaaaaataccctctgactgtatttgagagccgaggtttccgctgccccctccacagctgtgtgagctgccatgcttccaacccttcaaacccaaggccgtcaaaaggtaaaatgatgcggtgtgtccgctgccccgttgcctatcacagcggggatgcttgtctggcagcaggatgctcagtgatcgcctccaacagcatcatctgcactgcccacttcactgctcggaaggggaagcgacaccacgcccacgtcaacgtgagctggtgcttcgtgtgctccaaaggggggagccttctgtgctgtgagtcctgcccagcggccttccaccctgactgcctgaacatcgagatgcctgacggcagctggttctgcaatgactgcagggctgggaagaagctgcacttccaggatatcatttgggtgaaacttgggaactacagatggtggccggcagaagtttgccatcccaaaaatgttcccccaaatattcagaaaatgaagcacgagattggagaattccctgtgtttttctttgggtctaaagattattactggacgcatcaggcgcgagtgttcccgtacatggagggggaccggggcagccgctaccagggggtcagagggatcggaagagtcttcaaaaacgcactgcaagaagctgaagctcgttttcgtgaaattaagcttcagagggaagcccgagaaacacaggagagcgagcgcaagcccccaccatacaagcacatcaaggtgaataagccttacgggaaagtccagatctacacagcggatatttcagaaatccctaagtgcaactgcaagcccacagatgagaatccttgtggctttgattcggagtgtctgaacaggatgctgatgtttgagtgccacccgcaggtgtgtcccgcgggcgagttctgccagaaccagtgcttcaccaagcgccagtacccagagaccaagatcatcaagacagatggcaaagggtggggcctggtcgccaagagggacatcagaaagggagaatttgttaacgagtacgttggggagctgatcgacgaggaggagtgcatggcgagaatcaagcacgcacacgagaacgacatcacccacttctacatgctcactatagacaaggaccgtataatagacgctggccccaaaggaaactactctcgatttatgaatcacagctgccagcccaactgtgagaccctcaagtggacagtgaatggggacactcgtgtgggcctgtttgccgtctgtgacattcctgcagggacggagctgacttttaactacaacctcgattgtctgggcaatgaaaaaacggtctgccggtgtggagcctccaattgcagtggattcctcggggatagaccaaagacctcgacgaccctttcatcagaggaaaagggcaaaaagaccaagaagaaaacgaggcggcgcagagcaaaaggggaagggaagaggcagtcagaggacgagtgcttccgctgcggtgatggcgggcagctggtgctgtgtgaccgcaagttctgcaccaaggcctaccacctgtcctgcctgggccttggcaagcggcccttcgggaagtgggaatgtccttggcatcattgtgacgtgtgtggcaaaccttcgacttcattttgccacctctgccccaattcgttctgtaaggagcaccaggacgggacagccttcagctgcaccccggacgggcggtcctactgctgtgagcatgacttaggggcggcatcggtcagaagcaccaagactgagaagccccccccagagccagggaagccgaaggggaagaggcggcggcggaggggctggcggagagtcacagagggcaaatagcgccaggcggccgcttggccggatccaggggcggtgcagggcggccggccctgcctgcgggagagggcgagcatgaactggcccggaggacccagctcgagccgccaggacacagacgtacaggcctcctcgggagggagcgcctccccaccactgagccatcctcagcagcgtccgctgcgtctgcactgatgaccgtctgagcccagctcagcgttcctggacaaacagcctcactcctcagcgttaccgccacacttgaatttctccgaatgtcaaggttccctcccactctatttttttaggttaaagttaattggcatatggaatgttttaatctcctctgaaatgtgtagcgtaggcttttcccaagggtcgctagaaactcgtcttcgcgttgccccctttctggctctcagcgccgtcgccactcgggagaggctgggtgaggcccgtgtgaggactgaccctggattcctcgaaactgccattgtgatcattactctgctctttggaaatggctgtatcatttttttgtactaatgtgaattgttcctcagaaacgcttcttttccatcctagtgagaagctggccctgcaggtggtggcagcaatggtgttgtaagatttcctcccgtagttttttctcctcatggatttgaatgaaatgccaataacacgtccactttcaacgtgtagtttacgcggagcactttcgaggcctggccgggttgggcctacttctcacctgggcctatcttctgaactcgctaggttcttatcaacatttgggggataactttgtatatttttttcatttggcttttctttaccagtttctgatttttattctcaatatatttttgctaaacctatttcacaaatcaccaccgactgaagtgtgtgtttactgatgcggccctgagctccatggcgaaaggagtgactttgcagggcgtgagaccgcagtctgcttagagcacaggaagtgacaacttagggagccccgtagggcgctgcaggccccggggaccccagcacgtgggtctaaagagagacggagtctagctctcctgccacccagagtggcttccatctcagcactctgtgggtctggtgatggaagatgcagtctctgctgatcacatgtgccctctgccagggcacctactgagaggtgcggtcctgggggtggaggcctgcctggcaggtgtgcgtgcctcgtacgtgtgttatgggcactggtctaggccaggtatgacacccactctcctgtgagatttcactttagtttttaaaaggtccagttctacagagtgagacctatctatctgagtactacatatgttttaagacttggttctttttttgagggatccttgaccctgggaagtctggagcaccctgagaagggggcaccatgtgtgcctttgcccacgtgtcctgaggggctgcttgtctgggagggagggagagaacattcagcagcaggtgcttttttatggccttttcttaaaataacctaagggggacacatccatcttgcagagaagtttacagaactccccttgaaaactgctgctgaggctcctgttaaattttctgtggcatcttttatgccttggtaaaaactgcagtgtctttggacctgagagtggctactccgtggttttgtgacctgtaagcgtggggttcaggggtgtgtggccctgcagggtcccacgcctccctgagcactgactggaagtttcactggctggtggctgtcccttctcccatcagggtccccagcaaagttaactacacagaggacccaggggaaacgagctgtgtagccactgacttgctcgcgcggccgtggcctctgaggggcactcgccggttaagacagggtgggagtagtgctttccagttcagactctaacttctcccaaagtgtcctaagaaaatactggatcggctcatagatttatgctccttatgatgccctaacttggaaggttgttctagggacaggccgggcagtgtccccacacacaccttagagtcgaaggccccagggccccgctgtcacttgcccaaaagatcccttccggcaggtaagggactaccaatgcttacgtcaaaacagcagaatcggctttgcagtgcactttggggagcagatattaacttatttttgtgttggacagtagtgaaatcttgtgatttttaatcgctttgataatacttccaaattttatgatttttctgaaggaaataatgcaaacattttaaatatgtttctccccctttccaaaaactgttaaactaatgagcaagtaacactaactttgaatgtctctacaatacccgttgataactcagtggagccaggctttggggtagcggccctgagcttgcagggtttctcgccactggggctgaccacgcccccagctgtgaccgtgggtgtggctggctctcggccctgcccagctttgttctgaggacgtggtgacttcctgaacatcagcttcaatcctccatcattaatgtgaagcaaaacacaaaaaccgccccaatccctcaggattccttggcatccgaaaccagcatctgcacctaaacccatacccacccgtgtgcgcccacagggggatgtgtccgaatgggcagcttaaaatgtggtcacctgtgggggaaactcttcaggcacctgaagtgagaacccagctgtccgtcctcaggccggcctttcttccggcgacacccgtccatggctggctgggtccccttcgcagtgtttgtctgtcttgacatctaaaccccggcgtgtgcagtgcccatcttccaggactaccttattttccagaattaaacctgttttataattcaagttaatgcaaatgactgtcagttgccaaatatcttgatcctatgagtgtagttgatgactgtttgttagtcagtagagtaaaatgctgtgtccacggggtgtcacagcctcaccataccctgttgaggtgtgaaatgccccgtcagaaattaaatacaaacttaaatgtgcctattggtgtctaaacttcatacaatgtaaggtcagattccttttaggaatactgggtgctgtcaccaggtttgatagttagacttaaaaacttgaaattcactttttggggggagggatatactgaaatagagagttgagacttgccagttgggggaaaatagcatttaaaatggaaagctgtgtttggaaaattgtgtatgagtatttttgtattaaaaacattttaaaggcttttttcttaa

SEQ ID NO: 200265 - DNA, 7980 bp, Homo sapiens
  Payload ID: 19512
  Gene Name: Wolf-Hirschhorn syndrome candidate 1
  Uniprot ID: O96028
  ENST ID: ENST00000353275
  CDS Start-End: 495-2438
tggtcttgaactcctgaccttgtgatccgctcgcctcagcctcccaaagtgctgggattacaggcatgagccaccgtgcctgtcctagaaccactggtaactcttaactgagacaagatttcgccatgttgcccaggctggtctcgaacttctgagctcaagcgatctacctgcctcgtcctcccaaagtgttggaattgcaggtgtgagccactgcacccggcccttgcctcatgtttgaatgataatttacctgggcataaaattctggacacttgtggtggcacgagctgtctgcttttctgtggagactgcgggttgcagacaccagcagccccctattgctgcacgtcaggtgtcctccacctcagtactgtggacatctcgggccgcatagccctgttgcgcgggcatcctgtgcgttgcaggagatgcagcagcatccatgaccgcaacccatcagagtgttctaagaacggaagcatctgggctggatggaatttagcatcaagcagagtcccctttctgttcagagtgttgtaaagtgcataaagatgaagcaggcaccagaaatcctcggcagtgccaacgggaagactccgagctgcgaggtgaaccgcgagtgttctgtgttcctcagcaaagcccagctctccagtagcctgcaggagggggtcatgcagaagtttaacggccacgacgccctgccctttattccagccgacaagctgaaagatcttacttcccgggtgtttaatggagaacccggcgcacacgatgccaaactgcgttttgagtcccaggaaatgaaagggattgggacaccccctaacactacccctatcaaaaatggctctccagaaattaagctgaaaatcaccaaaacatacatgaatgggaagcctctctttgaatcttccatttgtggtgacagtgctgctgatgtgtctcagtcagaagaaaatggacaaaaaccagaaaacaaggcgagaaggaacaggaagaggagcataaaatatgactccttgctggagcagggccttgtcgaagcagctcttgtgtctaagatctcaagtccttcagataaaaagattccagctaagaaagagtcttgtccaaacactggaagagacaaagaccacctgttgaaatacaacgttggtgatttggtgtggtccaaagtgtcgggttacccttggtggccttgcatggtttctgcagatccactccttcacagctataccaaacttaaaggtcagaaaaagagtgcacgccagtatcacgtacagttctttggtgacgccccagaaagagcttggatatttgagaagagcctcgtagcttttgaaggagaaggacagtttgaaaaattatgccaggaaagtgccaagcaggcacccacgaaagctgagaaaattaagctattgaaaccaatttcagggaaattgagggcccagtgggaaatgggcattgttcaagcagaagaagctgcaagcatgtcagtggaggagcggaaagccaagttcacctttctctatgtgggggaccagcttcatctcaaccctcaagtagccaaggaggctggcattgctgcagagtctttgggagaaatggcagaatcctcaggagtcagtgaagaagctgctgaaaaccccaagtctgtgagagaagagtgcattcccatgaagagaaggcggagggccaaactgtgtagctctgcagagaccctggagagtcaccccgacatagggaagagtactcctcaaaagacggcagaggctgaccccagaagaggagtagggtctcctcctgggaggaagaagaccacagtctccatgccacgaagcaggaagggagatgcagcatcccagtttttggtcttctgtcaaaaacacagggatgaggtggtagctgagcacccagatgcttcaggtgaggagattgaagagctgctcaggtcacagtggagtctgctgagtgagaagcagagagcacgctacaacaccaagtttgccctggtggcccctgtccaggctgaagaagactctggtaatgtaaatgggaaaaaaagaaaccacacaaagaggatacaggaccctacagaagatgctgaagctgaggacacacccaggaaaagactcaggacggacaagcacagtcttcggaagagagacacaatcactgacaaaacggccagaacaagctcttacaaggccatggaggcagcctcctcgctcaagagccaggcagcaacgaaaaatctgtctgatgcatgtaaaccactgaagaagcgaaatcgggcttccacggcagcatcttcagctcttgggtttagcaaaagttcatctccttctgcatccttaactgagaatgagcttttgtgggagcccacaccagtcaagttggatttgaacccagctgctctgtactgcacttagaatgatgtaatattccaggatgctgctgcaggtctcggacagcccgggagacgagccctcggagtccccatacgaaagtgcagacgaaacacaaactgaagtatctgtctcatccaaaaagtctgagcgaggagtgactgccaaaaaggagtatgtgtgccagctgtgtgagaagccgggcagcctcctgctctgtgaaggaccctgctgcggagctttccacctcgcctgccttgggctttcccggaggccagaagggaggttcacctgcagcgagtgtgcctcagggattcactcatgtttcgtgtgtaaagagagcaagacagatgttaagcgctgtgtggtaactcagtgtggaaaattttaccatgaggcttgtgtgaaaaaataccctctgactgtatttgagagccgaggtttccgctgccccctccacagctgtgtgagctgccatgcttccaacccttcaaacccaaggccgtcaaaaggtaaaatgatgcggtgtgtccgctgccccgttgcctatcacagcggggatgcttgtctggcagcaggatgctcagtgatcgcctccaacagcatcatctgcactgcccacttcactgctcggaaggggaagcgacaccacgcccacgtcaacgtgagctggtgcttcgtgtgctccaaaggggggagccttctgtgctgtgagtcctgcccagcggccttccaccctgactgcctgaacatcgagatgcctgacggcagctggttctgcaatgactgcagggctgggaagaagctgcacttccaggatatcatttgggtgaaacttgggaactacagatggtggccggcagaagtttgccatcccaaaaatgttcccccaaatattcagaaaatgaagcacgagattggagaattccctgtgtttttctttgggtctaaagattattactggacgcatcaggcgcgagtgttcccgtacatggagggggaccggggcagccgctaccagggggtcagagggatcggaagagtcttcaaaaacgcactgcaagaagctgaagctcgttttcgtgaaattaagcttcagagggaagcccgagaaacacaggagagcgagcgcaagcccccaccatacaagcacatcaaggtgaataagccttacgggaaagtccagatctacacagcggatatttcagaaatccctaagtgcaactgcaagcccacagatgagaatccttgtggctttgattcggagtgtctgaacaggatgctgatgtttgagtgccacccgcaggtgtgtcccgcgggcgagttctgccagaaccagtgcttcaccaagcgccagtacccagagaccaagatcatcaagacagatggcaaagggtggggcctggtcgccaagagggacatcagaaagggagaatttgttaacgagtacgttggggagctgatcgacgaggaggagtgcatggcgagaatcaagcacgcacacgagaacgacatcacccacttctacatgctcactatagacaaggaccgtataatagacgctggccccaaaggaaactactctcgatttatgaatcacagctgccagcccaactgtgagaccctcaagtggacagtgaatggggacactcgtgtgggcctgtttgccgtctgtgacattcctgcagggacggagctgacttttaactacaacctcgattgtctgggcaatgaaaaaacggtctgccggtgtggagcctccaattgcagtggattcctcggggatagaccaaagacctcgacgaccctttcatcagaggaaaagggcaaaaagaccaagaagaaaacgaggcggcgcagagcaaaaggggaagggaagaggcagtcagaggacgagtgcttccgctgcggtgatggcgggcagctggtgctgtgtgaccgcaagttctgcaccaaggcctaccacctgtcctgcctgggccttggcaagcggcccttcgggaagtgggaatgtccttggcatcattgtgacgtgtgtggcaaaccttcgacttcattttgccacctctgccccaattcgttctgtaaggagcaccaggacgggacagccttcagctgcaccccggacgggcggtcctactgctgtgagcatgacttaggggcggcatcggtcagaagcaccaagactgagaagccccccccagagccagggaagccgaaggggaagaggcggcggcggaggggctggcggagagtcacagagggcaaatagcgccaggcggccgcttggccggatccaggggcggtgcagggcggccggccctgcctgcgggagagggcgagcatgaactggcccggaggacccagctcgagccgccaggacacagacgtacaggcctcctcgggagggagcgcctccccaccactgagccatcctcagcagcgtccgctgcgtctgcactgatgaccgtctgagcccagctcagcgttcctggacaaacagcctcactcctcagcgttaccgccacacttgaatttctccgaatgtcaaggttccctcccactctatttttttaggttaaagttaattggcatatggaatgttttaatctcctctgaaatgtgtagcgtaggcttttcccaagggtcgctagaaactcgtcttcgcgttgccccctttctggctctcagcgccgtcgccactcgggagaggctgggtgaggcccgtgtgaggactgaccctggattcctcgaaactgccattgtgatcattactctgctctttggaaatggctgtatcatttttttgtactaatgtgaattgttcctcagaaacgcttcttttccatcctagtgagaagctggccctgcaggtggtggcagcaatggtgttgtaagatttcctcccgtagttttttctcctcatggatttgaatgaaatgccaataacacgtccactttcaacgtgtagtttacgcggagcactttcgaggcctggccgggttgggcctacttctcacctgggcctatcttctgaactcgctaggttcttatcaacatttgggggataactttgtatatttttttcatttggcttttctttaccagtttctgatttttattctcaatatatttttgctaaacctatttcacaaatcaccaccgactgaagtgtgtgtttactgatgcggccctgagctccatggcgaaaggagtgactttgcagggcgtgagaccgcagtctgcttagagcacaggaagtgacaacttagggagccccgtagggcgctgcaggccccggggaccccagcacgtgggtctaaagagagacggagtctagctctcctgccacccagagtggcttccatctcagcactctgtgggtctggtgatggaagatgcagtctctgctgatcacatgtgccctctgccagggcacctactgagaggtgcggtcctgggggtggaggcctgcctggcaggtgtgcgtgcctcgtacgtgtgttatgggcactggtctaggccaggtatgacacccactctcctgtgagatttcactttagtttttaaaaggtccagttctacagagtgagacctatctatctgagtactacatatgttttaagacttggttctttttttgagggatccttgaccctgggaagtctggagcaccctgagaagggggcaccatgtgtgcctttgcccacgtgtcctgaggggctgcttgtctgggagggagggagagaacattcagcagcaggtgcttttttatggccttttcttaaaataacctaagggggacacatccatcttgcagagaagtttacagaactccccttgaaaactgctgctgaggctcctgttaaattttctgtggcatcttttatgccttggtaaaaactgcagtgtctttggacctgagagtggctactccgtggttttgtgacctgtaagcgtggggttcaggggtgtgtggccctgcagggtcccacgcctccctgagcactgactggaagtttcactggctggtggctgtcccttctcccatcagggtccccagcaaagttaactacacagaggacccaggggaaacgagctgtgtagccactgacttgctcgcgcggccgtggcctctgaggggcactcgccggttaagacagggtgggagtagtgctttccagttcagactctaacttctcccaaagtgtcctaagaaaatactggatcggctcatagatttatgctccttatgatgccctaacttggaaggttgttctagggacaggccgggcagtgtccccacacacaccttagagtcgaaggccccagggccccgctgtcacttgcccaaaagatcccttccggcaggtaagggactaccaatgcttacgtcaaaacagcagaatcggctttgcagtgcactttggggagcagatattaacttatttttgtgttggacagtagtgaaatcttgtgatttttaatcgctttgataatacttccaaattttatgatttttctgaaggaaataatgcaaacattttaaatatgtttctccccctttccaaaaactgttaaactaatgagcaagtaacactaactttgaatgtctctacaatacccgttgataactcagtggagccaggctttggggtagcggccctgagcttgcagggtttctcgccactggggctgaccacgcccccagctgtgaccgtgggtgtggctggctctcggccctgcccagctttgttctgaggacgtggtgacttcctgaacatcagcttcaatcctccatcattaatgtgaagcaaaacacaaaaaccgccccaatccctcaggattccttggcatccgaaaccagcatctgcacctaaacccatacccacccgtgtgcgcccacagggggatgtgtccgaatgggcagcttaaaatgtggtcacctgtgggggaaactcttcaggcacctgaagtgagaacccagctgtccgtcctcaggccggcctttcttccggcgacacccgtccatggctggctgggtccccttcgcagtgtttgtctgtcttgacatctaaaccccggcgtgtgcagtgcccatcttccaggactaccttattttccagaattaaacctgttttataattcaagttaatgcaaatgactgtcagttgccaaatatcttgatcctatgagtgtagttgatgactgtttgttagtcagtagagtaaaatgctgtgtccacggggtgtcacagcctcaccataccctgttgaggtgtgaaatgccccgtcagaaattaaatacaaacttaaatgtgcctattggtgtctaaacttcatacaatgtaaggtcagattccttttaggaatactgggtgctgtcaccaggtttgatagttagacttaaaaacttgaaattcactttttggggggagggatatactgaaatagagagttgagacttgccagttgggggaaaatagcatttaaaatggaaagctgtgtttggaaaattgtgtatgagtatttttgtattaaaaacattttaaaggcttttttcttaa

SEQ ID NO: 200266 - DNA, 2666 bp, Homo sapiens
  Payload ID: 19512
  Gene Name: Wolf-Hirschhorn syndrome candidate 1
  Uniprot ID: O96028
  ENST ID: ENST00000382888
  CDS Start-End: 519-2660
cagctgtgtgagaagccgggcagcctcctgctctgtgaaggaccctgctgcggagctttccacctcgcctgccttgggctttcccggaggccagaagggaggttcacctgcagcgagtgtgcctcaggtgtcgcccggcacagtctggggtctgtgaggatgatgagaggacacctgcacagccgtggcccttcctgcctactcaccgggcccaaggagtctcctatctcacgtcagaacacttcctgggtcaggaagacacctggagagtctcccaggccatggcagccccacagcagcacctcacttatgggagtgtctgtctgcctgcccagaatgataagtgactgctccaccactggccagctgctctcaaggaggaaaggcctcttttcataggagccccttctttcaagcttcttgccagttagactgggcctccccagccaggctgcctagtaagattctcctgtatttcaggtgaagctggagctcagatcgcagcaaggtaatccttgatggctggatctttttgctggagaatgcttggactagtgagcaaggttggaaacagggccaggtgctttagcagcatggctgcctctgaagaggagttgcttgattttagtggctcagaactgcaatttaattcttgttctttgcacctctctctccaccccttctttaactttttgttagggattcactcatgtttcgtgtgtaaagagagcaagacagatgttaagcgctgtgtggtaactcagtgtggaaaattttaccatgaggcttgtgtgaaaaaataccctctgactgtatttgagagccgaggtttccgctgccccctccacagctgtgtgagctgccatgcttccaacccttcaaacccaaggccgtcaaaaggtaaaatgatgcggtgtgtccgctgccccgttgcctatcacagcggggatgcttgtctggcagcaggatgctcagtgatcgcctccaacagcatcatctgcactgcccacttcactgctcggaaggggaagcgacaccacgcccacgtcaacgtgagctggtgcttcgtgtgctccaaaggggggagccttctgtgctgtgagtcctgcccagcggccttccaccctgactgcctgaacatcgagatgcctgacggcagctggttctgcaatgactgcagggctgggaagaagctgcacttccaggatatcatttgggtgaaacttgggaactacagatggtggccggcagaagtttgccatcccaaaaatgttcccccaaatattcagaaaatgaagcacgagattggagaattccctgtgtttttctttgggtctaaagattattactggacgcatcaggcgcgagtgttcccgtacatggagggggaccggggcagccgctaccagggggtcagagggatcggaagagtcttcaaaaacgcactgcaagaagctgaagctcgttttcgtgaaattaagcttcagagggaagcccgagaaacacaggagagcgagcgcaagcccccaccatacaagcacatcaaggtgaataagccttacgggaaagtccagatctacacagcggatatttcagaaatccctaagtgcaactgcaagcccacagatgagaatccttgtggctttgattcggagtgtctgaacaggatgctgatgtttgagtgccacccgcaggtgtgtcccgcgggcgagttctgccagaaccagtgcttcaccaagcgccagtacccagagaccaagatcatcaagacagatggcaaagggtggggcctggtcgccaagagggacatcagaaagggagaatttgttaacgagtacgttggggagctgatcgacgaggaggagtgcatggcgagaatcaagcacgcacacgagaacgacatcacccacttctacatgctcactatagacaaggaccgtataatagacgctggccccaaaggaaactactctcgatttatgaatcacagctgccagcccaactgtgagaccctcaagtggacagtgaatggggacactcgtgtgggcctgtttgccgtctgtgacattcctgcagggacggagctgacttttaactacaacctcgattgtctgggcaatgaaaaaacggtctgccggtgtggagcctccaattgcagtggattcctcggggatagaccaaagacctcgacgaccctttcatcagaggaaaagggcaaaaagaccaagaagaaaacgaggcggcgcagagcaaaaggggaagggaagaggcagtcagaggacgagtgcttccgctgcggtgatggcgggcagctggtgctgtgtgaccgcaagttctgcaccaaggcctaccacctgtcctgcctgggccttggcaagcggcccttcgggaagtgggaatgtccttggcatcattgtgacgtgtgtggcaaaccttcgacttcattttgccacctctgccccaattcgttctgtaaggagcaccaggacgggacagccttcagctgcaccccggacgggcggtcctactgctgtgagcatgacttaggggcggcatcggtcagaagcaccaagactgagaagccccccccagagccagggaagccgaaggggaagaggcggcggcggaggggctggcggagagtcacagagggcaaatagcgccag

SEQ ID NO: 200267 - DNA, 7534 bp, Homo sapiens
  Payload ID: 19512
  Gene Name: Wolf-Hirschhorn syndrome candidate 1
  Uniprot ID: O96028
  ENST ID: ENST00000382891
  CDS Start-End: 140-4237
tggtcttgaactcctgaccttgtgatccgctcgcctcagcctcccaaagtgctgggattacaggcatgagccaccgtgcctgtcctagaaccactggtaactcttaactgtgttctaagaacggaagcatctgggctggatggaatttagcatcaagcagagtcccctttctgttcagagtgttgtaaagtgcataaagatgaagcaggcaccagaaatcctcggcagtgccaacgggaagactccgagctgcgaggtgaaccgcgagtgttctgtgttcctcagcaaagcccagctctccagtagcctgcaggagggggtcatgcagaagtttaacggccacgacgccctgccctttattccagccgacaagctgaaagatcttacttcccgggtgtttaatggagaacccggcgcacacgatgccaaactgcgttttgagtcccaggaaatgaaagggattgggacaccccctaacactacccctatcaaaaatggctctccagaaattaagctgaaaatcaccaaaacatacatgaatgggaagcctctctttgaatcttccatttgtggtgacagtgctgctgatgtgtctcagtcagaagaaaatggacaaaaaccagaaaacaaggcgagaaggaacaggaagaggagcataaaatatgactccttgctggagcagggccttgtcgaagcagctcttgtgtctaagatctcaagtccttcagataaaaagattccagctaagaaagagtcttgtccaaacactggaagagacaaagaccacctgttgaaatacaacgttggtgatttggtgtggtccaaagtgtcgggttacccttggtggccttgcatggtttctgcagatccactccttcacagctataccaaacttaaaggtcagaaaaagagtgcacgccagtatcacgtacagttctttggtgacgccccagaaagagcttggatatttgagaagagcctcgtagcttttgaaggagaaggacagtttgaaaaattatgccaggaaagtgccaagcaggcacccacgaaagctgagaaaattaagctattgaaaccaatttcagggaaattgagggcccagtgggaaatgggcattgttcaagcagaagaagctgcaagcatgtcagtggaggagcggaaagccaagttcacctttctctatgtgggggaccagcttcatctcaaccctcaagtagccaaggaggctggcattgctgcagagtctttgggagaaatggcagaatcctcaggagtcagtgaagaagctgctgaaaaccccaagtctgtgagagaagagtgcattcccatgaagagaaggcggagggccaaactgtgtagctctgcagagaccctggagagtcaccccgacatagggaagagtactcctcaaaagacggcagaggctgaccccagaagaggagtagggtctcctcctgggaggaagaagaccacagtctccatgccacgaagcaggaagggagatgcagcatcccagtttttggtcttctgtcaaaaacacagggatgaggtggtagctgagcacccagatgcttcaggtgaggagattgaagagctgctcaggtcacagtggagtctgctgagtgagaagcagagagcacgctacaacaccaagtttgccctggtggcccctgtccaggctgaagaagactctggtaatgtaaatgggaaaaaaagaaaccacacaaagaggatacaggaccctacagaagatgctgaagctgaggacacacccaggaaaagactcaggacggacaagcacagtcttcggaagagagacacaatcactgacaaaacggccagaacaagctcttacaaggccatggaggcagcctcctcgctcaagagccaggcagcaacgaaaaatctgtctgatgcatgtaaaccactgaagaagcgaaatcgggcttccacggcagcatcttcagctcttgggtttagcaaaagttcatctccttctgcatccttaactgagaatgaggtctcggacagcccgggagacgagccctcggagtccccatacgaaagtgcagacgaaacacaaactgaagtatctgtctcatccaaaaagtctgagcgaggagtgactgccaaaaaggagtatgtgtgccagctgtgtgagaagccgggcagcctcctgctctgtgaaggaccctgctgcggagctttccacctcgcctgccttgggctttcccggaggccagaagggaggttcacctgcagcgagtgtgcctcagggattcactcatgtttcgtgtgtaaagagagcaagacagatgttaagcgctgtgtggtaactcagtgtggaaaattttaccatgaggcttgtgtgaaaaaataccctctgactgtatttgagagccgaggtttccgctgccccctccacagctgtgtgagctgccatgcttccaacccttcaaacccaaggccgtcaaaaggtaaaatgatgcggtgtgtccgctgccccgttgcctatcacagcggggatgcttgtctggcagcaggatgctcagtgatcgcctccaacagcatcatctgcactgcccacttcactgctcggaaggggaagcgacaccacgcccacgtcaacgtgagctggtgcttcgtgtgctccaaaggggggagccttctgtgctgtgagtcctgcccagcggccttccaccctgactgcctgaacatcgagatgcctgacggcagctggttctgcaatgactgcagggctgggaagaagctgcacttccaggatatcatttgggtgaaacttgggaactacagatggtggccggcagaagtttgccatcccaaaaatgttcccccaaatattcagaaaatgaagcacgagattggagaattccctgtgtttttctttgggtctaaagattattactggacgcatcaggcgcgagtgttcccgtacatggagggggaccggggcagccgctaccagggggtcagagggatcggaagagtcttcaaaaacgcactgcaagaagctgaagctcgttttcgtgaaattaagcttcagagggaagcccgagaaacacaggagagcgagcgcaagcccccaccatacaagcacatcaaggtgaataagccttacgggaaagtccagatctacacagcggatatttcagaaatccctaagtgcaactgcaagcccacagatgagaatccttgtggctttgattcggagtgtctgaacaggatgctgatgtttgagtgccacccgcaggtgtgtcccgcgggcgagttctgccagaaccagtgcttcaccaagcgccagtacccagagaccaagatcatcaagacagatggcaaagggtggggcctggtcgccaagagggacatcagaaagggagaatttgttaacgagtacgttggggagctgatcgacgaggaggagtgcatggcgagaatcaagcacgcacacgagaacgacatcacccacttctacatgctcactatagacaaggaccgtataatagacgctggccccaaaggaaactactctcgatttatgaatcacagctgccagcccaactgtgagaccctcaagtggacagtgaatggggacactcgtgtgggcctgtttgccgtctgtgacattcctgcagggacggagctgacttttaactacaacctcgattgtctgggcaatgaaaaaacggtctgccggtgtggagcctccaattgcagtggattcctcggggatagaccaaagacctcgacgaccctttcatcagaggaaaagggcaaaaagaccaagaagaaaacgaggcggcgcagagcaaaaggggaagggaagaggcagtcagaggacgagtgcttccgctgcggtgatggcgggcagctggtgctgtgtgaccgcaagttctgcaccaaggcctaccacctgtcctgcctgggccttggcaagcggcccttcgggaagtgggaatgtccttggcatcattgtgacgtgtgtggcaaaccttcgacttcattttgccacctctgccccaattcgttctgtaaggagcaccaggacgggacagccttcagctgcaccccggacgggcggtcctactgctgtgagcatgacttaggggcggcatcggtcagaagcaccaagactgagaagccccccccagagccagggaagccgaaggggaagaggcggcggcggaggggctggcggagagtcacagagggcaaatagcgccaggcggccgcttggccggatccaggggcggtgcagggcggccggccctgcctgcgggagagggcgagcatgaactggcccggaggacccagctcgagccgccaggacacagacgtacaggcctcctcgggagggagcgcctccccaccactgagccatcctcagcagcgtccgctgcgtctgcactgatgaccgtctgagcccagctcagcgttcctggacaaacagcctcactcctcagcgttaccgccacacttgaatttctccgaatgtcaaggttccctcccactctatttttttaggttaaagttaattggcatatggaatgttttaatctcctctgaaatgtgtagcgtaggcttttcccaagggtcgctagaaactcgtcttcgcgttgccccctttctggctctcagcgccgtcgccactcgggagaggctgggtgaggcccgtgtgaggactgaccctggattcctcgaaactgccattgtgatcattactctgctctttggaaatggctgtatcatttttttgtactaatgtgaattgttcctcagaaacgcttcttttccatcctagtgagaagctggccctgcaggtggtggcagcaatggtgttgtaagatttcctcccgtagttttttctcctcatggatttgaatgaaatgccaataacacgtccactttcaacgtgtagtttacgcggagcactttcgaggcctggccgggttgggcctacttctcacctgggcctatcttctgaactcgctaggttcttatcaacatttgggggataactttgtatatttttttcatttggcttttctttaccagtttctgatttttattctcaatatatttttgctaaacctatttcacaaatcaccaccgactgaagtgtgtgtttactgatgcggccctgagctccatggcgaaaggagtgactttgcagggcgtgagaccgcagtctgcttagagcacaggaagtgacaacttagggagccccgtagggcgctgcaggccccggggaccccagcacgtgggtctaaagagagacggagtctagctctcctgccacccagagtggcttccatctcagcactctgtgggtctggtgatggaagatgcagtctctgctgatcacatgtgccctctgccagggcacctactgagaggtgcggtcctgggggtggaggcctgcctggcaggtgtgcgtgcctcgtacgtgtgttatgggcactggtctaggccaggtatgacacccactctcctgtgagatttcactttagtttttaaaaggtccagttctacagagtgagacctatctatctgagtactacatatgttttaagacttggttctttttttgagggatccttgaccctgggaagtctggagcaccctgagaagggggcaccatgtgtgcctttgcccacgtgtcctgaggggctgcttgtctgggagggagggagagaacattcagcagcaggtgcttttttatggccttttcttaaaataacctaagggggacacatccatcttgcagagaagtttacagaactccccttgaaaactgctgctgaggctcctgttaaattttctgtggcatcttttatgccttggtaaaaactgcagtgtctttggacctgagagtggctactccgtggttttgtgacctgtaagcgtggggttcaggggtgtgtggccctgcagggtcccacgcctccctgagcactgactggaagtttcactggctggtggctgtcccttctcccatcagggtccccagcaaagttaactacacagaggacccaggggaaacgagctgtgtagccactgacttgctcgcgcggccgtggcctctgaggggcactcgccggttaagacagggtgggagtagtgctttccagttcagactctaacttctcccaaagtgtcctaagaaaatactggatcggctcatagatttatgctccttatgatgccctaacttggaaggttgttctagggacaggccgggcagtgtccccacacacaccttagagtcgaaggccccagggccccgctgtcacttgcccaaaagatcccttccggcaggtaagggactaccaatgcttacgtcaaaacagcagaatcggctttgcagtgcactttggggagcagatattaacttatttttgtgttggacagtagtgaaatcttgtgatttttaatcgctttgataatacttccaaattttatgatttttctgaaggaaataatgcaaacattttaaatatgtttctccccctttccaaaaactgttaaactaatgagcaagtaacactaactttgaatgtctctacaatacccgttgataactcagtggagccaggctttggggtagcggccctgagcttgcagggtttctcgccactggggctgaccacgcccccagctgtgaccgtgggtgtggctggctctcggccctgcccagctttgttctgaggacgtggtgacttcctgaacatcagcttcaatcctccatcattaatgtgaagcaaaacacaaaaaccgccccaatccctcaggattccttggcatccgaaaccagcatctgcacctaaacccatacccacccgtgtgcgcccacagggggatgtgtccgaatgggcagcttaaaatgtggtcacctgtgggggaaactcttcaggcacctgaagtgagaacccagctgtccgtcctcaggccggcctttcttccggcgacacccgtccatggctggctgggtccccttcgcagtgtttgtctgtcttgacatctaaaccccggcgtgtgcagtgcccatcttccaggactaccttattttccagaattaaacctgttttataattcaagttaatgcaaatgactgtcagttgccaaatatcttgatcctatgagtgtagttgatgactgtttgttagtcagtagagtaaaatgctgtgtccacggggtgtcacagcctcaccataccctgttgaggtgtgaaatgccccgtcagaaattaaatacaaacttaaatgtgcctattggtgtctaaacttcatacaatgtaaggtcagattccttttaggaatactgggtgctgtcaccaggtttgatagttagacttaaaaacttgaaattcactttttggggggagggatatactgaaatagagagttgagacttgccagttgggggaaaatagcatttaaaatggaaagctgtgtttggaaaattgtgtatgagtatttttgtattaaaaacattttaaaggcttttttcttaactt

SEQ ID NO: 200268 - DNA, 7706 bp, Homo sapiens
  Payload ID: 19512
  Gene Name: Wolf-Hirschhorn syndrome candidate 1
  Uniprot ID: O96028
  ENST ID: ENST00000382892
  CDS Start-End: 315-4412
tggtcttgaactcctgaccttgtgatccgctcgcctcagcctcccaaagtgctgggattacaggcatgagccaccgtgcctgtcctagaaccactggtaactcttaactgctgtctgcttttctgtggagactgcgggttgcagacaccagcagccccctattgctgcacgtcaggtgtcctccacctcagtactgtggacatctcgggccgcatagccctgttgcgcgggcatcctgtgcgttgcaggagatgcagcagcatccatgaccgcaacccatcagagtgttctaagaacggaagcatctgggctggatggaatttagcatcaagcagagtcccctttctgttcagagtgttgtaaagtgcataaagatgaagcaggcaccagaaatcctcggcagtgccaacgggaagactccgagctgcgaggtgaaccgcgagtgttctgtgttcctcagcaaagcccagctctccagtagcctgcaggagggggtcatgcagaagtttaacggccacgacgccctgccctttattccagccgacaagctgaaagatcttacttcccgggtgtttaatggagaacccggcgcacacgatgccaaactgcgttttgagtcccaggaaatgaaagggattgggacaccccctaacactacccctatcaaaaatggctctccagaaattaagctgaaaatcaccaaaacatacatgaatgggaagcctctctttgaatcttccatttgtggtgacagtgctgctgatgtgtctcagtcagaagaaaatggacaaaaaccagaaaacaaggcgagaaggaacaggaagaggagcataaaatatgactccttgctggagcagggccttgtcgaagcagctcttgtgtctaagatctcaagtccttcagataaaaagattccagctaagaaagagtcttgtccaaacactggaagagacaaagaccacctgttgaaatacaacgttggtgatttggtgtggtccaaagtgtcgggttacccttggtggccttgcatggtttctgcagatccactccttcacagctataccaaacttaaaggtcagaaaaagagtgcacgccagtatcacgtacagttctttggtgacgccccagaaagagcttggatatttgagaagagcctcgtagcttttgaaggagaaggacagtttgaaaaattatgccaggaaagtgccaagcaggcacccacgaaagctgagaaaattaagctattgaaaccaatttcagggaaattgagggcccagtgggaaatgggcattgttcaagcagaagaagctgcaagcatgtcagtggaggagcggaaagccaagttcacctttctctatgtgggggaccagcttcatctcaaccctcaagtagccaaggaggctggcattgctgcagagtctttgggagaaatggcagaatcctcaggagtcagtgaagaagctgctgaaaaccccaagtctgtgagagaagagtgcattcccatgaagagaaggcggagggccaaactgtgtagctctgcagagaccctggagagtcaccccgacatagggaagagtactcctcaaaagacggcagaggctgaccccagaagaggagtagggtctcctcctgggaggaagaagaccacagtctccatgccacgaagcaggaagggagatgcagcatcccagtttttggtcttctgtcaaaaacacagggatgaggtggtagctgagcacccagatgcttcaggtgaggagattgaagagctgctcaggtcacagtggagtctgctgagtgagaagcagagagcacgctacaacaccaagtttgccctggtggcccctgtccaggctgaagaagactctggtaatgtaaatgggaaaaaaagaaaccacacaaagaggatacaggaccctacagaagatgctgaagctgaggacacacccaggaaaagactcaggacggacaagcacagtcttcggaagagagacacaatcactgacaaaacggccagaacaagctcttacaaggccatggaggcagcctcctcgctcaagagccaggcagcaacgaaaaatctgtctgatgcatgtaaaccactgaagaagcgaaatcgggcttccacggcagcatcttcagctcttgggtttagcaaaagttcatctccttctgcatccttaactgagaatgaggtctcggacagcccgggagacgagccctcggagtccccatacgaaagtgcagacgaaacacaaactgaagtatctgtctcatccaaaaagtctgagcgaggagtgactgccaaaaaggagtatgtgtgccagctgtgtgagaagccgggcagcctcctgctctgtgaaggaccctgctgcggagctttccacctcgcctgccttgggctttcccggaggccagaagggaggttcacctgcagcgagtgtgcctcagggattcactcatgtttcgtgtgtaaagagagcaagacagatgttaagcgctgtgtggtaactcagtgtggaaaattttaccatgaggcttgtgtgaaaaaataccctctgactgtatttgagagccgaggtttccgctgccccctccacagctgtgtgagctgccatgcttccaacccttcaaacccaaggccgtcaaaaggtaaaatgatgcggtgtgtccgctgccccgttgcctatcacagcggggatgcttgtctggcagcaggatgctcagtgatcgcctccaacagcatcatctgcactgcccacttcactgctcggaaggggaagcgacaccacgcccacgtcaacgtgagctggtgcttcgtgtgctccaaaggggggagccttctgtgctgtgagtcctgcccagcggccttccaccctgactgcctgaacatcgagatgcctgacggcagctggttctgcaatgactgcagggctgggaagaagctgcacttccaggatatcatttgggtgaaacttgggaactacagatggtggccggcagaagtttgccatcccaaaaatgttcccccaaatattcagaaaatgaagcacgagattggagaattccctgtgtttttctttgggtctaaagattattactggacgcatcaggcgcgagtgttcccgtacatggagggggaccggggcagccgctaccagggggtcagagggatcggaagagtcttcaaaaacgcactgcaagaagctgaagctcgttttcgtgaaattaagcttcagagggaagcccgagaaacacaggagagcgagcgcaagcccccaccatacaagcacatcaaggtgaataagccttacgggaaagtccagatctacacagcggatatttcagaaatccctaagtgcaactgcaagcccacagatgagaatccttgtggctttgattcggagtgtctgaacaggatgctgatgtttgagtgccacccgcaggtgtgtcccgcgggcgagttctgccagaaccagtgcttcaccaagcgccagtacccagagaccaagatcatcaagacagatggcaaagggtggggcctggtcgccaagagggacatcagaaagggagaatttgttaacgagtacgttggggagctgatcgacgaggaggagtgcatggcgagaatcaagcacgcacacgagaacgacatcacccacttctacatgctcactatagacaaggaccgtataatagacgctggccccaaaggaaactactctcgatttatgaatcacagctgccagcccaactgtgagaccctcaagtggacagtgaatggggacactcgtgtgggcctgtttgccgtctgtgacattcctgcagggacggagctgacttttaactacaacctcgattgtctgggcaatgaaaaaacggtctgccggtgtggagcctccaattgcagtggattcctcggggatagaccaaagacctcgacgaccctttcatcagaggaaaagggcaaaaagaccaagaagaaaacgaggcggcgcagagcaaaaggggaagggaagaggcagtcagaggacgagtgcttccgctgcggtgatggcgggcagctggtgctgtgtgaccgcaagttctgcaccaaggcctaccacctgtcctgcctgggccttggcaagcggcccttcgggaagtgggaatgtccttggcatcattgtgacgtgtgtggcaaaccttcgacttcattttgccacctctgccccaattcgttctgtaaggagcaccaggacgggacagccttcagctgcaccccggacgggcggtcctactgctgtgagcatgacttaggggcggcatcggtcagaagcaccaagactgagaagccccccccagagccagggaagccgaaggggaagaggcggcggcggaggggctggcggagagtcacagagggcaaatagcgccaggcggccgcttggccggatccaggggcggtgcagggcggccggccctgcctgcgggagagggcgagcatgaactggcccggaggacccagctcgagccgccaggacacagacgtacaggcctcctcgggagggagcgcctccccaccactgagccatcctcagcagcgtccgctgcgtctgcactgatgaccgtctgagcccagctcagcgttcctggacaaacagcctcactcctcagcgttaccgccacacttgaatttctccgaatgtcaaggttccctcccactctatttttttaggttaaagttaattggcatatggaatgttttaatctcctctgaaatgtgtagcgtaggcttttcccaagggtcgctagaaactcgtcttcgcgttgccccctttctggctctcagcgccgtcgccactcgggagaggctgggtgaggcccgtgtgaggactgaccctggattcctcgaaactgccattgtgatcattactctgctctttggaaatggctgtatcatttttttgtactaatgtgaattgttcctcagaaacgcttcttttccatcctagtgagaagctggccctgcaggtggtggcagcaatggtgttgtaagatttcctcccgtagttttttctcctcatggatttgaatgaaatgccaataacacgtccactttcaacgtgtagtttacgcggagcactttcgaggcctggccgggttgggcctacttctcacctgggcctatcttctgaactcgctaggttcttatcaacatttgggggataactttgtatatttttttcatttggcttttctttaccagtttctgatttttattctcaatatatttttgctaaacctatttcacaaatcaccaccgactgaagtgtgtgtttactgatgcggccctgagctccatggcgaaaggagtgactttgcagggcgtgagaccgcagtctgcttagagcacaggaagtgacaacttagggagccccgtagggcgctgcaggccccggggaccccagcacgtgggtctaaagagagacggagtctagctctcctgccacccagagtggcttccatctcagcactctgtgggtctggtgatggaagatgcagtctctgctgatcacatgtgccctctgccagggcacctactgagaggtgcggtcctgggggtggaggcctgcctggcaggtgtgcgtgcctcgtacgtgtgttatgggcactggtctaggccaggtatgacacccactctcctgtgagatttcactttagtttttaaaaggtccagttctacagagtgagacctatctatctgagtactacatatgttttaagacttggttctttttttgagggatccttgaccctgggaagtctggagcaccctgagaagggggcaccatgtgtgcctttgcccacgtgtcctgaggggctgcttgtctgggagggagggagagaacattcagcagcaggtgcttttttatggccttttcttaaaataacctaagggggacacatccatcttgcagagaagtttacagaactccccttgaaaactgctgctgaggctcctgttaaattttctgtggcatcttttatgccttggtaaaaactgcagtgtctttggacctgagagtggctactccgtggttttgtgacctgtaagcgtggggttcaggggtgtgtggccctgcagggtcccacgcctccctgagcactgactggaagtttcactggctggtggctgtcccttctcccatcagggtccccagcaaagttaactacacagaggacccaggggaaacgagctgtgtagccactgacttgctcgcgcggccgtggcctctgaggggcactcgccggttaagacagggtgggagtagtgctttccagttcagactctaacttctcccaaagtgtcctaagaaaatactggatcggctcatagatttatgctccttatgatgccctaacttggaaggttgttctagggacaggccgggcagtgtccccacacacaccttagagtcgaaggccccagggccccgctgtcacttgcccaaaagatcccttccggcaggtaagggactaccaatgcttacgtcaaaacagcagaatcggctttgcagtgcactttggggagcagatattaacttatttttgtgttggacagtagtgaaatcttgtgatttttaatcgctttgataatacttccaaattttatgatttttctgaaggaaataatgcaaacattttaaatatgtttctccccctttccaaaaactgttaaactaatgagcaagtaacactaactttgaatgtctctacaatacccgttgataactcagtggagccaggctttggggtagcggccctgagcttgcagggtttctcgccactggggctgaccacgcccccagctgtgaccgtgggtgtggctggctctcggccctgcccagctttgttctgaggacgtggtgacttcctgaacatcagcttcaatcctccatcattaatgtgaagcaaaacacaaaaaccgccccaatccctcaggattccttggcatccgaaaccagcatctgcacctaaacccatacccacccgtgtgcgcccacagggggatgtgtccgaatgggcagcttaaaatgtggtcacctgtgggggaaactcttcaggcacctgaagtgagaacccagctgtccgtcctcaggccggcctttcttccggcgacacccgtccatggctggctgggtccccttcgcagtgtttgtctgtcttgacatctaaaccccggcgtgtgcagtgcccatcttccaggactaccttattttccagaattaaacctgttttataattcaagttaatgcaaatgactgtcagttgccaaatatcttgatcctatgagtgtagttgatgactgtttgttagtcagtagagtaaaatgctgtgtccacggggtgtcacagcctcaccataccctgttgaggtgtgaaatgccccgtcagaaattaaatacaaacttaaatgtgcctattggtgtctaaacttcatacaatgtaaggtcagattccttttaggaatactgggtgctgtcaccaggtttgatagttagacttaaaaacttgaaattcactttttggggggagggatatactgaaatagagagttgagacttgccagttgggggaaaatagcatttaaaatggaaagctgtgtttggaaaattgtgtatgagtatttttgtattaaaaacattttaaaggcttttttcttaa

SEQ ID NO: 200269 - DNA, 7827 bp, Homo sapiens
  Payload ID: 19512
  Gene Name: Wolf-Hirschhorn syndrome candidate 1
  Uniprot ID: O96028
  ENST ID: ENST00000382895
  CDS Start-End: 432-4529
gcatgagccaccgtgcctgtcctagaaccactggtaactcttaactgagacaagatttcgccatgttgcccaggctggtctcgaacttctgagctcaagcgatctacctgcctcgtcctcccaaagtgttggaattgcaggtgtgagccactgcacccggcccttgcctcatgtttgaatgataatttacctgggcataaaattctggacacttgtggtggcacgagctgtctgcttttctgtggagactgcgggttgcagacaccagcagccccctattgctgcacgtcaggtgtcctccacctcagtactgtggacatctcgggccgcatagccctgttgcgcgggcatcctgtgcgttgcaggagatgcagcagcatccatgaccgcaacccatcagagtgttctaagaacggaagcatctgggctggatggaatttagcatcaagcagagtcccctttctgttcagagtgttgtaaagtgcataaagatgaagcaggcaccagaaatcctcggcagtgccaacgggaagactccgagctgcgaggtgaaccgcgagtgttctgtgttcctcagcaaagcccagctctccagtagcctgcaggagggggtcatgcagaagtttaacggccacgacgccctgccctttattccagccgacaagctgaaagatcttacttcccgggtgtttaatggagaacccggcgcacacgatgccaaactgcgttttgagtcccaggaaatgaaagggattgggacaccccctaacactacccctatcaaaaatggctctccagaaattaagctgaaaatcaccaaaacatacatgaatgggaagcctctctttgaatcttccatttgtggtgacagtgctgctgatgtgtctcagtcagaagaaaatggacaaaaaccagaaaacaaggcgagaaggaacaggaagaggagcataaaatatgactccttgctggagcagggccttgtcgaagcagctcttgtgtctaagatctcaagtccttcagataaaaagattccagctaagaaagagtcttgtccaaacactggaagagacaaagaccacctgttgaaatacaacgttggtgatttggtgtggtccaaagtgtcgggttacccttggtggccttgcatggtttctgcagatccactccttcacagctataccaaacttaaaggtcagaaaaagagtgcacgccagtatcacgtacagttctttggtgacgccccagaaagagcttggatatttgagaagagcctcgtagcttttgaaggagaaggacagtttgaaaaattatgccaggaaagtgccaagcaggcacccacgaaagctgagaaaattaagctattgaaaccaatttcagggaaattgagggcccagtgggaaatgggcattgttcaagcagaagaagctgcaagcatgtcagtggaggagcggaaagccaagttcacctttctctatgtgggggaccagcttcatctcaaccctcaagtagccaaggaggctggcattgctgcagagtctttgggagaaatggcagaatcctcaggagtcagtgaagaagctgctgaaaaccccaagtctgtgagagaagagtgcattcccatgaagagaaggcggagggccaaactgtgtagctctgcagagaccctggagagtcaccccgacatagggaagagtactcctcaaaagacggcagaggctgaccccagaagaggagtagggtctcctcctgggaggaagaagaccacagtctccatgccacgaagcaggaagggagatgcagcatcccagtttttggtcttctgtcaaaaacacagggatgaggtggtagctgagcacccagatgcttcaggtgaggagattgaagagctgctcaggtcacagtggagtctgctgagtgagaagcagagagcacgctacaacaccaagtttgccctggtggcccctgtccaggctgaagaagactctggtaatgtaaatgggaaaaaaagaaaccacacaaagaggatacaggaccctacagaagatgctgaagctgaggacacacccaggaaaagactcaggacggacaagcacagtcttcggaagagagacacaatcactgacaaaacggccagaacaagctcttacaaggccatggaggcagcctcctcgctcaagagccaggcagcaacgaaaaatctgtctgatgcatgtaaaccactgaagaagcgaaatcgggcttccacggcagcatcttcagctcttgggtttagcaaaagttcatctccttctgcatccttaactgagaatgaggtctcggacagcccgggagacgagccctcggagtccccatacgaaagtgcagacgaaacacaaactgaagtatctgtctcatccaaaaagtctgagcgaggagtgactgccaaaaaggagtatgtgtgccagctgtgtgagaagccgggcagcctcctgctctgtgaaggaccctgctgcggagctttccacctcgcctgccttgggctttcccggaggccagaagggaggttcacctgcagcgagtgtgcctcagggattcactcatgtttcgtgtgtaaagagagcaagacagatgttaagcgctgtgtggtaactcagtgtggaaaattttaccatgaggcttgtgtgaaaaaataccctctgactgtatttgagagccgaggtttccgctgccccctccacagctgtgtgagctgccatgcttccaacccttcaaacccaaggccgtcaaaaggtaaaatgatgcggtgtgtccgctgccccgttgcctatcacagcggggatgcttgtctggcagcaggatgctcagtgatcgcctccaacagcatcatctgcactgcccacttcactgctcggaaggggaagcgacaccacgcccacgtcaacgtgagctggtgcttcgtgtgctccaaaggggggagccttctgtgctgtgagtcctgcccagcggccttccaccctgactgcctgaacatcgagatgcctgacggcagctggttctgcaatgactgcagggctgggaagaagctgcacttccaggatatcatttgggtgaaacttgggaactacagatggtggccggcagaagtttgccatcccaaaaatgttcccccaaatattcagaaaatgaagcacgagattggagaattccctgtgtttttctttgggtctaaagattattactggacgcatcaggcgcgagtgttcccgtacatggagggggaccggggcagccgctaccagggggtcagagggatcggaagagtcttcaaaaacgcactgcaagaagctgaagctcgttttcgtgaaattaagcttcagagggaagcccgagaaacacaggagagcgagcgcaagcccccaccatacaagcacatcaaggtgaataagccttacgggaaagtccagatctacacagcggatatttcagaaatccctaagtgcaactgcaagcccacagatgagaatccttgtggctttgattcggagtgtctgaacaggatgctgatgtttgagtgccacccgcaggtgtgtcccgcgggcgagttctgccagaaccagtgcttcaccaagcgccagtacccagagaccaagatcatcaagacagatggcaaagggtggggcctggtcgccaagagggacatcagaaagggagaatttgttaacgagtacgttggggagctgatcgacgaggaggagtgcatggcgagaatcaagcacgcacacgagaacgacatcacccacttctacatgctcactatagacaaggaccgtataatagacgctggccccaaaggaaactactctcgatttatgaatcacagctgccagcccaactgtgagaccctcaagtggacagtgaatggggacactcgtgtgggcctgtttgccgtctgtgacattcctgcagggacggagctgacttttaactacaacctcgattgtctgggcaatgaaaaaacggtctgccggtgtggagcctccaattgcagtggattcctcggggatagaccaaagacctcgacgaccctttcatcagaggaaaagggcaaaaagaccaagaagaaaacgaggcggcgcagagcaaaaggggaagggaagaggcagtcagaggacgagtgcttccgctgcggtgatggcgggcagctggtgctgtgtgaccgcaagttctgcaccaaggcctaccacctgtcctgcctgggccttggcaagcggcccttcgggaagtgggaatgtccttggcatcattgtgacgtgtgtggcaaaccttcgacttcattttgccacctctgccccaattcgttctgtaaggagcaccaggacgggacagccttcagctgcaccccggacgggcggtcctactgctgtgagcatgacttaggggcggcatcggtcagaagcaccaagactgagaagccccccccagagccagggaagccgaaggggaagaggcggcggcggaggggctggcggagagtcacagagggcaaatagcgccaggcggccgcttggccggatccaggggcggtgcagggcggccggccctgcctgcgggagagggcgagcatgaactggcccggaggacccagctcgagccgccaggacacagacgtacaggcctcctcgggagggagcgcctccccaccactgagccatcctcagcagcgtccgctgcgtctgcactgatgaccgtctgagcccagctcagcgttcctggacaaacagcctcactcctcagcgttaccgccacacttgaatttctccgaatgtcaaggttccctcccactctatttttttaggttaaagttaattggcatatggaatgttttaatctcctctgaaatgtgtagcgtaggcttttcccaagggtcgctagaaactcgtcttcgcgttgccccctttctggctctcagcgccgtcgccactcgggagaggctgggtgaggcccgtgtgaggactgaccctggattcctcgaaactgccattgtgatcattactctgctctttggaaatggctgtatcatttttttgtactaatgtgaattgttcctcagaaacgcttcttttccatcctagtgagaagctggccctgcaggtggtggcagcaatggtgttgtaagatttcctcccgtagttttttctcctcatggatttgaatgaaatgccaataacacgtccactttcaacgtgtagtttacgcggagcactttcgaggcctggccgggttgggcctacttctcacctgggcctatcttctgaactcgctaggttcttatcaacatttgggggataactttgtatatttttttcatttggcttttctttaccagtttctgatttttattctcaatatatttttgctaaacctatttcacaaatcaccaccgactgaagtgtgtgtttactgatgcggccctgagctccatggcgaaaggagtgactttgcagggcgtgagaccgcagtctgcttagagcacaggaagtgacaacttagggagccccgtagggcgctgcaggccccggggaccccagcacgtgggtctaaagagagacggagtctagctctcctgccacccagagtggcttccatctcagcactctgtgggtctggtgatggaagatgcagtctctgctgatcacatgtgccctctgccagggcacctactgagaggtgcggtcctgggggtggaggcctgcctggcaggtgtgcgtgcctcgtacgtgtgttatgggcactggtctaggccaggtatgacacccactctcctgtgagatttcactttagtttttaaaaggtccagttctacagagtgagacctatctatctgagtactacatatgttttaagacttggttctttttttgagggatccttgaccctgggaagtctggagcaccctgagaagggggcaccatgtgtgcctttgcccacgtgtcctgaggggctgcttgtctgggagggagggagagaacattcagcagcaggtgcttttttatggccttttcttaaaataacctaagggggacacatccatcttgcagagaagtttacagaactccccttgaaaactgctgctgaggctcctgttaaattttctgtggcatcttttatgccttggtaaaaactgcagtgtctttggacctgagagtggctactccgtggttttgtgacctgtaagcgtggggttcaggggtgtgtggccctgcagggtcccacgcctccctgagcactgactggaagtttcactggctggtggctgtcccttctcccatcagggtccccagcaaagttaactacacagaggacccaggggaaacgagctgtgtagccactgacttgctcgcgcggccgtggcctctgaggggcactcgccggttaagacagggtgggagtagtgctttccagttcagactctaacttctcccaaagtgtcctaagaaaatactggatcggctcatagatttatgctccttatgatgccctaacttggaaggttgttctagggacaggccgggcagtgtccccacacacaccttagagtcgaaggccccagggccccgctgtcacttgcccaaaagatcccttccggcaggtaagggactaccaatgcttacgtcaaaacagcagaatcggctttgcagtgcactttggggagcagatattaacttatttttgtgttggacagtagtgaaatcttgtgatttttaatcgctttgataatacttccaaattttatgatttttctgaaggaaataatgcaaacattttaaatatgtttctccccctttccaaaaactgttaaactaatgagcaagtaacactaactttgaatgtctctacaatacccgttgataactcagtggagccaggctttggggtagcggccctgagcttgcagggtttctcgccactggggctgaccacgcccccagctgtgaccgtgggtgtggctggctctcggccctgcccagctttgttctgaggacgtggtgacttcctgaacatcagcttcaatcctccatcattaatgtgaagcaaaacacaaaaaccgccccaatccctcaggattccttggcatccgaaaccagcatctgcacctaaacccatacccacccgtgtgcgcccacagggggatgtgtccgaatgggcagcttaaaatgtggtcacctgtgggggaaactcttcaggcacctgaagtgagaacccagctgtccgtcctcaggccggcctttcttccggcgacacccgtccatggctggctgggtccccttcgcagtgtttgtctgtcttgacatctaaaccccggcgtgtgcagtgcccatcttccaggactaccttattttccagaattaaacctgttttataattcaagttaatgcaaatgactgtcagttgccaaatatcttgatcctatgagtgtagttgatgactgtttgttagtcagtagagtaaaatgctgtgtccacggggtgtcacagcctcaccataccctgttgaggtgtgaaatgccccgtcagaaattaaatacaaacttaaatgtgcctattggtgtctaaacttcatacaatgtaaggtcagattccttttaggaatactgggtgctgtcaccaggtttgatagttagacttaaaaacttgaaattcactttttggggggagggatatactgaaatagagagttgagacttgccagttgggggaaaatagcatttaaaatggaaagctgtgtttggaaaattgtgtatgagtatttttgtattaaaaacattttaaaggcttttttcttaactta

SEQ ID NO: 200270 - DNA, 8390 bp, Homo sapiens
  Payload ID: 19512
  Gene Name: Wolf-Hirschhorn syndrome candidate 1
  Uniprot ID: O96028
  ENST ID: ENST00000398261
  CDS Start-End: 30-1973
tgttctaagaacggaagcatctgggctggatggaatttagcatcaagcagagtcccctttctgttcagagtgttgtaaagtgcataaagatgaagcaggcaccagaaatcctcggcagtgccaacgggaagactccgagctgcgaggtgaaccgcgagtgttctgtgttcctcagcaaagcccagctctccagtagcctgcaggagggggtcatgcagaagtttaacggccacgacgccctgccctttattccagccgacaagctgaaagatcttacttcccgggtgtttaatggagaacccggcgcacacgatgccaaactgcgttttgagtcccaggaaatgaaagggattgggacaccccctaacactacccctatcaaaaatggctctccagaaattaagctgaaaatcaccaaaacatacatgaatgggaagcctctctttgaatcttccatttgtggtgacagtgctgctgatgtgtctcagtcagaagaaaatggacaaaaaccagaaaacaaggcgagaaggaacaggaagaggagcataaaatatgactccttgctggagcagggccttgtcgaagcagctcttgtgtctaagatctcaagtccttcagataaaaagattccagctaagaaagagtcttgtccaaacactggaagagacaaagaccacctgttgaaatacaacgttggtgatttggtgtggtccaaagtgtcgggttacccttggtggccttgcatggtttctgcagatccactccttcacagctataccaaacttaaaggtcagaaaaagagtgcacgccagtatcacgtacagttctttggtgacgccccagaaagagcttggatatttgagaagagcctcgtagcttttgaaggagaaggacagtttgaaaaattatgccaggaaagtgccaagcaggcacccacgaaagctgagaaaattaagctattgaaaccaatttcagggaaattgagggcccagtgggaaatgggcattgttcaagcagaagaagctgcaagcatgtcagtggaggagcggaaagccaagttcacctttctctatgtgggggaccagcttcatctcaaccctcaagtagccaaggaggctggcattgctgcagagtctttgggagaaatggcagaatcctcaggagtcagtgaagaagctgctgaaaaccccaagtctgtgagagaagagtgcattcccatgaagagaaggcggagggccaaactgtgtagctctgcagagaccctggagagtcaccccgacatagggaagagtactcctcaaaagacggcagaggctgaccccagaagaggagtagggtctcctcctgggaggaagaagaccacagtctccatgccacgaagcaggaagggagatgcagcatcccagtttttggtcttctgtcaaaaacacagggatgaggtggtagctgagcacccagatgcttcaggtgaggagattgaagagctgctcaggtcacagtggagtctgctgagtgagaagcagagagcacgctacaacaccaagtttgccctggtggcccctgtccaggctgaagaagactctggtaatgtaaatgggaaaaaaagaaaccacacaaagaggatacaggaccctacagaagatgctgaagctgaggacacacccaggaaaagactcaggacggacaagcacagtcttcggaagagagacacaatcactgacaaaacggccagaacaagctcttacaaggccatggaggcagcctcctcgctcaagagccaggcagcaacgaaaaatctgtctgatgcatgtaaaccactgaagaagcgaaatcgggcttccacggcagcatcttcagctcttgggtttagcaaaagttcatctccttctgcatccttaactgagaatgagcttttgtgggagcccacaccagtcaagttggatttgaacccagctgctctgtactgcacttagaatgatgtaatattccaggatgctgctgcaggtggcgtatcatcgtacacactcagtgacatttctatcacaatcattttatggaagatgtgtgataatctgtttttactggtattaataaacacatacaatgaagaaaacagataacaaattttaagaccaaggtaagataactaatcaaggccatttaatccgtcacattcatctcataatagaaacacgttcatattccagtggtcaatgtagatttcaagttgaaaggcagtccctttagttgggggctgtccagagctgcagcagggctttgcacggaaggggtggccctgttagagttgcttctcctctagtttgtaacttactggacttttgtggaaaatatcagcgtcgctaccctcagaaacaaactaacagcacacgttaggaggagtcctcatcagctgttctcattgccagtgagatatattcagtattgtagatactacactaatttccaacataagaggcaggaagagttttgattctatccttttttactaaacagttttattatgacactagatacagtaaatttttagaaaaaaataccatttacagtattattgtgaaccatttaacccttttgatccaaggccccggaccaaggggatactgtaatcaggttatgtacaccaacctctgcatcagttgcttctatagagcatcagccctcatgtttcattgtcttaatgtcggggagcagcctggtgtcctgccccaggtgtccgcatttttgcatggtaaggaaaaggcttacttgcccttcagctcataaaagcagaaggtgtgctattcacagtaccatgcgagtagcccacagttaattcccggcagattctttggctgtgttttatctttaatgaacgtttctgactaatattttgttgtaaaccattaagtaatgtaacgcatgtaagatgcttagggtgcctggccaggactccgtggtttcctgttgtgacagtaataatggttataataataaaaatgataaaattgccatcattctatttttatccaaaagtataaattttgctttggcatgaaaagtggtcctcttgactgcattatgcatgcgaggatgaaataaacctagaagtggcagaacactggatttgtgtgtgtggcgctttagggtgctggactgtatggctgagggctggttgggttcctctattggctctgctcaaatgttgcaggatacatagccccaaagatggtctaggagcaatctaagctgtgttactccaaaggacatgaaaaagctcaagagtaaaattaaaattctcaaaaaaaaaccccacgaaatttaaagatggggaaaaaaagatggtataaaaatggctctggttcaataagcagtcacccaaagtaaagactctatcttgaaaggcttttggtgaaaatgaagggatttcatttgaaattacagcatgatgaattttgcatgggtggccagccagctagcccataactgatagatgcattagaagtcagccagcgcataggtgctccctctatattatggagaaagcaaaaccctgcaaatgaccaaatggtgtccaaagagcagcatgacattggcatcagctgaataaccaggggcacatgggggaacgtggatgggaatgatagtgtatctcagcggggggtggggtgacatcgttccctggggacattgggaaggtgggcaggggcaagtgaactcagcactctgcagtgagagggacagtcccatgtgtggcagcattgtcccacttcagatgccaggagtgggctcatcctagaggagcggagttttccgagaggaccatctcctggtttcctgaaggaggtgggtggaaacggctcttgtttgaaagaacttagggaggaccattggcttgccaagagtacagaaattcattatgctgctaatttaacgtggaattccttcatttcataagaacctcaaaataatggtgatacattctagccttaagacatttgaattgccggttgttgaggtgaattttgtttgtcatacatggaaccattttagtcccatttgactcacttcagaccatcttccacacactatgtctgtgcttggagaggggaggtggctctccagtgtaaaacttgaggcattcactagaggtgaaaacttgtcagaatatataaaagcttagattgtagctgttctaaaaacgtaagtactccattgtaatagggtggcatcttcaggtagtgcacatattggcaatagaggtcctgaattgtttttctaagactgatctgagagccattgggccatcaagcctttatatatctgcttctaaaattgccccacctgctctagatggatctttgggcctttcctcagtgttcatgcaaaaattaaatgtcttttttcagcatactgactccaggtgtagttacatctcagtgctgtcttgagtatatattttatctcttatacctgtatctcccaactagaaacagctccagtgtttttaagagaatgtttcttaaaaccaataggaaacttaagcgaggtttcatgacacaacctttcatgtcgtgaaaggcagagggtgactgtgtgtgatgtgcagagtccttggacaggagtcgggggctcctctgtcccactgctgcttcttgagtgggtggagtggtgcttagaggatctccgagaggtccccgcagctctagggagatctgattttgtgttttttgtttaagtacttcacacagaagcctaggtagatttaaaatggggtgctcagggactggggaacaagacggggtggggtggggagatgggcatttggagagtctcatgtagctggagacgttaagagctgagcacaccacaggaaaggagggaggatgctgtgtgagagccatgctgtcaggagcaagcttgctgctcctgtgctgccctggccctggccttgcttgcccatggtgtgtgtgtccagaggtgtgtgtgaggctgccagaacaagtgctgggtctgtcacagagaagtttaaaaaagaaaactaagattataaattagcatctagttccaaaaccaaaaaaagtgcctgtggatgtatataaaattaagatgataagaaagtgctcctgagaaggctcttgccagaagcctgatgtgagtgtgtggcacctgtgatggcagggctgtgagctgggcttctgtcctcctctgtgtcccggcatggaagccagtataagcatttccaaatgagggaaaagtccttggctcgtttgatccagttgagttgaaagggttgccttggcagcagaggctcctctgatggctgacatcagtcactgcgtctgggcctgagacgtgcatggagggctgtaaagccacggattcccctcgctggagaggctcctgtctgatagcggtagatgaaaaataaggtcgttatgactttggcaacttgcttcatttctttttcatttgacttacaacacacttctctaacatctagcccttttaaatttttaattaatttcaaagcttcctctggccaggtagacttttgtatacagaccaggtgagagcccttttgccttagtgtgaaaatgtaacattttatgcttttaaaatcaatagattcatcaccttagttttttaaaaaaaatctataaatagggtaattgctgaggtgtgcggtttatctttgagatgataaagctaaattatagtcttttgccagagaaactgaggtaactgtcattagaaaaggtttcttaaaatactcacaaagctgttattggcttcttaacttctaaaatttggggggtcttgcatttatttattatttatttatttatttatttagagacagagtctcaccctgttggccaggctggagtgcagtaagtggcacaatctcggctcactgcaacctccgcctccttggttccagcaattcttctgcctcagcctcccgagtagctgggactacaagcggctgccaccacacctggctatttttttttgtatttttagtagagacagggtttcgccatattggccaggctggtcttgaactcctgacctcgtgatccacccgcctcaccctcccaaaatgctgggattacaggcgtaagccactgcacctggcggggtcttgcttattttaaaagaaatattctgattcatattttaggactttttgtcaacgaaattggttttgatccctttgggtaccatttttattgttttatgtagaatgttagaaattaccactaatttacctggcagtgatgtcaaattgactgtaattagcaggtagaaaattatttgtattatattcatctgattcctatactggatgagcaaggagcatgcttcctttgggacattcttacagcagggtgtctctccaacagcccgacaggcctcatctttttggttggatacctttgaactccatggttacgtgttaggtccacatttgtgtttttttctagcctacctatagttgttggcctttttgcatataactctcgggtaatattttgaagcatgctgaccatccaggcatatagtattttcaagaaatgactgaggtaggggtgggggtcctggtccggctgatgggggtttgctcagcactgtgccagtggaagcaggtgtattgtgggcagttttgtcattgtcctcaagtccttcgcagacagtgcacagcctgctgtctgcagtcggccagaccaggctcctccccagcacactccctgtgggatggccgctgctcaggacacagtgggacaaagttgggttgataggatattttagattcattttacctttgacaagggcaggccttgaattgggagcagcagccacctggcctcactctggccacaggtgacacttggtccttgctgccacctgcttggggctatgtggctacggctacacaaaagcctgtgcaggttagaagacgactgtggtgtgcagtggtgctctgggagtggagacttcctctgttctcagagactcacccccagccctgaccctagaatttagggatagccaggaagtttctagtttgtgtaacctagaagggtcactttaataaaaattgttatgaactatagtattttagatgatgagtgacttattttaattccactttaacattttactgtgctgttaacttggaagacctgtttgaaattagtcttgatttcacactcatttaatctgctgagcacagggctgttgtcatttgtaaacgcaaacactgtggaggtacttctcgccatcagcttccttctttacaaaaccatcatttcaacatgaaaattatgtcagtttatagaaatatttattgttcaaggtctgtaattgtatttcaaaaacgatgtcgtattcaagttgtgaagggatttgttttgtcaaaaaattaaaaactcaatgtgtatgacgccactctgaagagtaggtgagcgctttgcagtcacagaaggtggcatctgactgcggctcatacaggtcaccctgaagggccacgtgcttttagcagttggctggaatgtgttcactaggttccgttatgtttggtaatatcatcttgaaaagtccctgtaatagatcaaggagactgcattccctgccctgaaggaatgtatttctaaggcaaataggcaacttggtactatcttattctgagtagagagtggagaaagtattttcagactgaagaaaactttgaaaagtcaggagctaagctgctcggagctcagtgccgcagcatggctgtggtggacgcgggaaacaacgggaaagttcttgacagagtctgtgtccgctcagtccctgcacttttcctttccaaatgcatctcgttggatatggaatagatcgtagatgttgtagactgagatttgggactatgttgggaccgtacaggtgaatgtgccacctccacaaatggcttctccgagtgagtcacgtcacctggtgcgtggaggtggagcctgcggctggagtaaggcttgctgtgggacgccctcgtactttgctctccttgcgggtggttgccgagccgagagcattggatcctccccgactgtggctagttgtctgtccggtggctgggagggggtgtggtgggaaaaagtcggaatctctgcaatctgtgtcatggactgtactattgtaaggtctatattctgtatgtgggtcccagaccctgatcaggaaatgagcctcatgtgtgtcgttaacatttatatatttccattcaaaatatgtattcagtgtttatttcctcaaaacagactttgttaatgtaggaaatctctccaagtggaaacgtgctaactttttctgtaaatctgaaataaaaggtgctgttccttcctctg

SEQ ID NO: 200271 - DNA, 5109 bp, Homo sapiens
  Payload ID: 19512
  Gene Name: Wolf-Hirschhorn syndrome candidate 1
  Uniprot ID: O96028
  ENST ID: ENST00000420906
  CDS Start-End: 432-2321
gcatgagccaccgtgcctgtcctagaaccactggtaactcttaactgagacaagatttcgccatgttgcccaggctggtctcgaacttctgagctcaagcgatctacctgcctcgtcctcccaaagtgttggaattgcaggtgtgagccactgcacccggcccttgcctcatgtttgaatgataatttacctgggcataaaattctggacacttgtggtggcacgagctgtctgcttttctgtggagactgcgggttgcagacaccagcagccccctattgctgcacgtcaggtgtcctccacctcagtactgtggacatctcgggccgcatagccctgttgcgcgggcatcctgtgcgttgcaggagatgcagcagcatccatgaccgcaacccatcagagtgttctaagaacggaagcatctgggctggatggaatttagcatcaagcagagtcccctttctgttcagagtgttgtaaagtgcataaagatgaagcaggcaccagaaatcctcggcagtgccaacgggaagactccgagctgcgaggtgaaccgcgagtgttctgtgttcctcagcaaagcccagctctccagtagcctgcaggagggggtcatgcagaagtttaacggccacgacgccctgccctttattccagccgacaagctgaaagatcttacttcccgggtgtttaatggagaacccggcgcacacgatgccaaactgcgttttgagtcccaggaaatgaaagggattgggacaccccctaacactacccctatcaaaaatggctctccagaaattaagctgaaaatcaccaaaacatacatgaatgggaagcctctctttgaatcttccatttgtggtgacagtgctgctgatgtgtctcagtcagaagaaaatggacaaaaaccagaaaacaaggcgagaaggaacaggaagaggagcataaaatatgactccttgctggagcagggccttgtcgaagcagctcttgtgtctaagatctcaagtccttcagataaaaagattccagctaagaaagagtcttgtccaaacactggaagagacaaagaccacctgttgaaatacaacgttggtgatttggtgtggtccaaagtgtcgggttacccttggtggccttgcatggtttctgcagatccactccttcacagctataccaaacttaaaggtcagaaaaagagtgcacgccagtatcacgtacagttctttggtgacgccccagaaagagcttggatatttgagaagagcctcgtagcttttgaaggagaaggacagtttgaaaaattatgccaggaaagtgccaagcaggcacccacgaaagctgagaaaattaagctattgaaaccaatttcagggaaattgagggcccagtgggaaatgggcattgttcaagcagaagaagctgcaagcatgtcagtggaggagcggaaagccaagttcacctttctctatgtgggggaccagcttcatctcaaccctcaagtagccaaggaggctggcattgctgcagagtctttgggagaaatggcagaatcctcaggagtcagtgaagaagctgctgaaaaccccaagtctgtgagagaagagtgcattcccatgaagagaaggcggagggccaaactgtgtagctctgcagagaccctggagagtcaccccgacatagggaagagtactcctcaaaagacggcagaggctgaccccagaagaggagtagggtctcctcctgggaggaagaagaccacagtctccatgccacgaagcaggaagggagatgcagcatcccagtttttggtcttctgtcaaaaacacagggatgaggtggtagctgagcacccagatgcttcaggtgaggagattgaagagctgctcaggtcacagtggagtctgctgagtgagaagcagagagcacgctacaacaccaagtttgccctggtggcccctgtccaggctgaagaagactctggtaatgtaaatgggaaaaaaagaaaccacacaaagaggatacaggaccctacagaagatgctgaagctgaggacacacccaggaaaagactcaggacggacaagcacagtcttcggaagagagacacaatcactgacaaaacggccagaacaagctcttacaaggccatggaggcagcctcctcgctcaagagccaggcagcaacgaaaaatctgtctgatgcatgtaaaccactgaagaagcgaaatcgggcttccacggcagcatcttcagctcttgggtttagcaaaagttcatctccttctgcatccttaactgagaatgaggtaaaataataataataacgataaccatggcattggtatgaaggccatttagctgcccacgctgcagtgtgagtaatgctcagacttcataagcgcagcattggtgctcactgccagtgcagatgttttagggcctcttggctaactcagattcatgaaatggacaaacagtgcactatgttagtttatttgagcactttttatacacacgcacacagtgtctgtgtacatgtacagatatacttcagtcttgatgcagtttcatagttcttaaaatctgtctgaagaatgttgtgttctgtgtagccctcacactgtaagagttcacatggaagtaagtctgcgttggttctgaaagggcacagtgtcagttgagctgacatatactgggtggggtggaaggcgactcacacaccacacctgattcctgttgcttccagacctaggctcatggaggaagccaaagatttctttgttctcatgcatttcatggctttggtcctttaaattctggcacatttttagttacttgagtgttgaggtgagtcagaactaccattgtaatatgactcctgtgttctggacttgcagagtacatgatagcaaaataaagccatttggggctgctgcctgccatcattgtaacatgacacttagactttattatcaaacctaaattttttgccgttgccaaaaacaacaaatagccacagaacgtaggtgtgacacttttttgttcggaggtagttttggtttcctgatttttagggattaccttcatagagctttggagttttaatttcttgttatttggttctccgtgatgctgtttttctcattgtagacatgggtcctgtttttgtcatgtttatgaggagatgataactgggggcccttttggaacagggtagtgaggcaagggttggacaggccccttactcttgctgagtcagaaggcggcacttctggccaggtctctgccatggtccccaggaaggatggggtgtgcctcagttgtttccactcattagaggagtgtaggccttccagtgcaggaaggtcagggacctaggcaacctgggcggggctcatagagctctgcggcttgccactctgaatcctcagcgaccactcctccgagtgggattttctgcagggactcaaaccaactcagtggtggtcgagacctgttcacggatggtgggactggggctgctttacagtttgatacgtgtagataattaagcattttgtgatgtttggacacactggagaaaaggcagtaagaattatttactgaaacatctaggagcttactgaaatatgaaaaggcaaattttatacaaattatttttcctttttcctttctttcttgtccaagttcaggttaaaatcttagaaaattaaatgaaaggtcatttacagttccaaagaagaatattaaacatttttcacttaagttgagatttttgctttaaagagcttttaatgagtttttctgttatcataattttggtccggttattcacttgagttgttgcttatactgttgtcaggtacagtagagagaacatggagcctgctgagatcttctctgttattcctgatcctaagtcatgtatatcgaaggctttgatttagagtaatgcatgaggccagtgtagcggggtcgaggcctgcccatgagtcaggggagctcagtctccctggcctaggcagttgtcctgaccttgagaagacatagatgaagcattttatcatcattagacttaaattttaattcttcagaatgtcagaagttgataggttgttaaatacatttatataatacattaaatatgtgaaattaatacaccttcctacattttgaaggtgatgcatagatcccatagtgtgcatcatgttccttatatgaaaacgtttaaattactgggtcttttccattaaactacttttgtatggcttagataaatcttccattagtgttcatttttatagaattatgctgttaaaactactttaggtgaacaaataaacttgtctattatatattaacgcgactgaactacagtaaatgtttgtgatgtttccaatgctgaatgcctgttagcatatgaggcaaagtgtagtgttataaaaaacagcctgttgactgctgggcccgattctgatatgagttaggtgaccatgagaattgctgtttgaggtccacactgacacacacccattgggtcacaccccctttgcatgtttgtatttcctccctttcatcacatttgtttgaaataaggtacttttatagggttggtatttcagaacactttaggtcatgttgtagtttaaattcttcttgaaaaaggtatatgtgataaataaaaatttttattggaataattattacatggtactacatcaccctgaggaagagaataaattaaaattacacacttgcatgacaaaggcctgtgaaggaattaatgtgatttaagtgttttgtaacttcattttttattcctttagtagagcaaattcttatttttttcgccttcactggtaacagcttttgtgggagcccacaccagtcaagttggatttgaacccagctgctctgtactgcacttagaatgatgtaatattccaggatgctgctgcaggtggcgtatcatcgtacacactcagtgacatttctatcacaatcattttatggaagatgtgtgataatctgtttttactggtattaataaacacatacaatgaagaaaacagataacaaattttaagaccaaggtaagataac

SEQ ID NO: 200272 - DNA, 835 bp, Homo sapiens
  Payload ID: 19512
  Gene Name: Wolf-Hirschhorn syndrome candidate 1
  Uniprot ID: O96028
  ENST ID: ENST00000436793
  CDS Start-End: 14-835
gcatctgggctggatggaatttagcatcaagcagagtcccctttctgttcagagtgttgtaaagtgcataaagatgaagcaggcaccagaaatcctcggcagtgccaacgggaagactccgagctgcgaggtgaaccgcgagtgttctgtgttcctcagcaaagcccagctctccagtagcctgcaggagggggtcatgcagaagtttaacggccacgacgccctgccctttattccagccgacaagctgaaagatcttacttcccgggtgtttaatggagaacccggcgcacacgatgccaaactgcgttttgagtcccaggaaatgaaagggattgggacaccccctaacactacccctatcaaaaatggctctccagaaattaagctgaaaatcaccaaaacatacatgaatgggaagcctctctttgaatcttccatttgtggtgacagtgctgctgatgtgtctcagtcagaagaaaatggacaaaaaccagaaaacaaggcgagaaggaacaggaagaggagcataaaatatgactccttgctggagcagggccttgtcgaagcagctcttgtgtctaagatctcaagtccttcagataaaaagattccagctaagaaagagtcttgtccaaacactggaagagacaaagaccacctgttgaaatacaacgttggtgatttggtgtggtccaaagtgtcgggttacccttggtggccttgcatggtttctgcagatccactccttcacagctataccaaacttaaaggtattttcaaatcaaagaagtttgaacacttaaaaacaagtcaaattgtactgaaagattaa

SEQ ID NO: 200273 - DNA, 528 bp, Homo sapiens
  Payload ID: 19512
  Gene Name: Wolf-Hirschhorn syndrome candidate 1
  ENST ID: ENST00000507820
  CDS Start-End: 417-528
gccgccgccgccgccccctccccgcctgggccctaccgccgcacggccccggccccctcccagcctgccgctccggagagccgcccgccgaggatgcgacgcaccgcagagatgggtctcgccatcaccatgttgcccagtctggtctccaactcctgggctcaagcgatcctcctgccttggtctcccaaagtgctgggattacagagacaagatttcgccatgttgcccaggctggtctcgaacttctgagctcaagcgatctacctgcctcgtcctcccaaagtgttggaattgcaggtgtgagccactgcacccggcccttgcctcatgtttgaatgataatttacctgggcataaaattctggacacttgtggtggcacgagtgttctaagaacggaagcatctgggctggatggaatttagcatcaagcagagtcccctttctgttcagagtgttgtaaagtgcataaagatgaagcaggcaccagaaatcctcggcagtgccaacgggaagactccgagct

SEQ ID NO: 200274 - DNA, 3964 bp, Homo sapiens
  Payload ID: 19512
  Gene Name: Wolf-Hirschhorn syndrome candidate 1
  Uniprot ID: O96028
  ENST ID: ENST00000514045
  CDS Start-End: 112-2001
gggccctaccgccgcacggccccggccccctcccagcctgccgctccggagagccgcccgccgaggatgcgacgcaccgcagtgttctaagaacggaagcatctgggctggatggaatttagcatcaagcagagtcccctttctgttcagagtgttgtaaagtgcataaagatgaagcaggcaccagaaatcctcggcagtgccaacgggaagactccgagctgcgaggtgaaccgcgagtgttctgtgttcctcagcaaagcccagctctccagtagcctgcaggagggggtcatgcagaagtttaacggccacgacgccctgccctttattccagccgacaagctgaaagatcttacttcccgggtgtttaatggagaacccggcgcacacgatgccaaactgcgttttgagtcccaggaaatgaaagggattgggacaccccctaacactacccctatcaaaaatggctctccagaaattaagctgaaaatcaccaaaacatacatgaatgggaagcctctctttgaatcttccatttgtggtgacagtgctgctgatgtgtctcagtcagaagaaaatggacaaaaaccagaaaacaaggcgagaaggaacaggaagaggagcataaaatatgactccttgctggagcagggccttgtcgaagcagctcttgtgtctaagatctcaagtccttcagataaaaagattccagctaagaaagagtcttgtccaaacactggaagagacaaagaccacctgttgaaatacaacgttggtgatttggtgtggtccaaagtgtcgggttacccttggtggccttgcatggtttctgcagatccactccttcacagctataccaaacttaaaggtcagaaaaagagtgcacgccagtatcacgtacagttctttggtgacgccccagaaagagcttggatatttgagaagagcctcgtagcttttgaaggagaaggacagtttgaaaaattatgccaggaaagtgccaagcaggcacccacgaaagctgagaaaattaagctattgaaaccaatttcagggaaattgagggcccagtgggaaatgggcattgttcaagcagaagaagctgcaagcatgtcagtggaggagcggaaagccaagttcacctttctctatgtgggggaccagcttcatctcaaccctcaagtagccaaggaggctggcattgctgcagagtctttgggagaaatggcagaatcctcaggagtcagtgaagaagctgctgaaaaccccaagtctgtgagagaagagtgcattcccatgaagagaaggcggagggccaaactgtgtagctctgcagagaccctggagagtcaccccgacatagggaagagtactcctcaaaagacggcagaggctgaccccagaagaggagtagggtctcctcctgggaggaagaagaccacagtctccatgccacgaagcaggaagggagatgcagcatcccagtttttggtcttctgtcaaaaacacagggatgaggtggtagctgagcacccagatgcttcaggtgaggagattgaagagctgctcaggtcacagtggagtctgctgagtgagaagcagagagcacgctacaacaccaagtttgccctggtggcccctgtccaggctgaagaagactctggtaatgtaaatgggaaaaaaagaaaccacacaaagaggatacaggaccctacagaagatgctgaagctgaggacacacccaggaaaagactcaggacggacaagcacagtcttcggaagagagacacaatcactgacaaaacggccagaacaagctcttacaaggccatggaggcagcctcctcgctcaagagccaggcagcaacgaaaaatctgtctgatgcatgtaaaccactgaagaagcgaaatcgggcttccacggcagcatcttcagctcttgggtttagcaaaagttcatctccttctgcatccttaactgagaatgaggtaaaataataataataacgataaccatggcattggtatgaaggccatttagctgcccacgctgcagtgtgagtaatgctcagacttcataagcgcagcattggtgctcactgccagtgcagatgttttagggcctcttggctaactcagattcatgaaatggacaaacagtgcactatgttagtttatttgagcactttttatacacacgcacacagtgtctgtgtacatgtacagatatacttcagtcttgatgcagtttcatagttcttaaaatctgtctgaagaatgttgtgttctgtgtagccctcacactgtaagagttcacatggaagtaagtctgcgttggttctgaaagggcacagtgtcagttgagctgacatatactgggtggggtggaaggcgactcacacaccacacctgattcctgttgcttccagacctaggctcatggaggaagccaaagatttctttgttctcatgcatttcatggctttggtcctttaaattctggcacatttttagttacttgagtgttgaggtgagtcagaactaccattgtaatatgactcctgtgttctggacttgcagagtacatgatagcaaaataaagccatttggggctgctgcctgccatcattgtaacatgacacttagactttattatcaaacctaaattttttgccgttgccaaaaacaacaaatagccacagaacgtaggtgtgacacttttttgttcggaggtagttttggtttcctgatttttagggattaccttcatagagctttggagttttaatttcttgttatttggttctccgtgatgctgtttttctcattgtagacatgggtcctgtttttgtcatgtttatgaggagatgataactgggggcccttttggaacagggtagtgaggcaagggttggacaggccccttactcttgctgagtcagaaggcggcacttctggccaggtctctgccatggtccccaggaaggatggggtgtgcctcagttgtttccactcattagaggagtgtaggccttccagtgcaggaaggtcagggacctaggcaacctgggcggggctcatagagctctgcggcttgccactctgaatcctcagcgaccactcctccgagtgggattttctgcagggactcaaaccaactcagtggtggtcgagacctgttcacggatggtgggactggggctgctttacagtttgatacgtgtagataattaagcattttgtgatgtttggacacactggagaaaaggcagtaagaattatttactgaaacatctaggagcttactgaaatatgaaaaggcaaattttatacaaattatttttcctttttcctttctttcttgtccaagttcaggttaaaatcttagaaaattaaatgaaaggtcatttacagttccaaagaagaatattaaacatttttcacttaagttgagatttttgctttaaagagcttttaatgagtttttctgttatcataattttggtccggttattcacttgagttgttgcttatactgttgtcaggtacagtagagagaacatggagcctgctgagatcttctctgttattcctgatcctaagtcatgtatatcgaaggctttgatttagagtaatgcatgaggccagtgtagcggggtcgaggcctgcccatgagtcaggggagctcagtctccctggcctaggcagttgtcctgaccttgagaagacatagatgaagcattttatcatcattagacttaaattttaattcttcagaatgtcagaagttgataggttgttaaatacatttatataatacattaaatatgtgaaattaatacaccttcctacattttgaaggtgatgcatagatcccatagtgtgcatcatgttccttatatgaaaacgtttaaattactgggtcttttccattaaactacttttgtatggcttagataaa

SEQ ID NO: 200275 - DNA, 1212 bp, Homo sapiens
  Payload ID: 19512
  Gene Name: Wolf-Hirschhorn syndrome candidate 1
  ENST ID: ENST00000509115
  CDS Start-End: 37-1212
accatagtgttctaagaacggaagcatctgggctggatggaatttagcatcaagcagagtcccctttctgttcagagtgttgtaaagtgcataaagatgaagcaggcaccagaaatcctcggcagtgccaacgggaagactccgagctgcgaggtgaaccgcgagtgttctgtgttcctcagcaaagcccagctctccagtagcctgcaggagggggtcatgcagaagtttaacggccacgacgccctgccctttattccagccgacaagctgaaagatcttacttcccgggtgtttaatggagaacccggcgcacacgatgccaaactgcgttttgagtcccaggaaatgaaagggattgggacaccccctaacactacccctatcaaaaatggctctccagaaattaagctgaaaatcaccaaaacatacatgaatgggaagcctctctttgaatcttccatttgtggtgacagtgctgctgatgtgtctcagtcagaagaaaatggacaaaaaccagaaaacaaggcgagaaggaacaggaagaggagcataaaatatgactccttgctggagcagggccttgtcgaagcagctcttgtgtctaagatctcaagtccttcagataaaaagattccagctaagaaagagtcttgtccaaacactggaagagacaaagaccacctgttgaaatacaacgttggtgatttggtgtggtccaaagtgtcgggttacccttggtggccttgcatggtttctgcagatccactccttcacagctataccaaacttaaaggtcagaaaaagagtgcacgccagtatcacgtacagttctttggtgacgccccagaaagagcttggatatttgagaagagcctcgtagcttttgaaggagaaggacagtttgaaaaattatgccaggaaagtgccaagcaggcacccacgaaagctgagaaaattaagctattgaaaccaatttcagggaaattgagggcccagtgggaaatgggcattgttcaagcagaagaagctgcaagcatgtcagtggaggagcggaaagccaagttcacctttctctatgtgggggaccagcttcatctcaaccctcaagtagccaaggaggctggcattgctgcagagtctttgggagaaatggcagaatcctcaggagtcagtgaagaagctgctgaaaaccccaagtctgtgagagaa

SEQ ID NO: 200276 - DNA, 4251 bp, Homo sapiens
  Payload ID: 19512
  Gene Name: Wolf-Hirschhorn syndrome candidate 1
  Uniprot ID: O96028
  ENST ID: ENST00000508803
  CDS Start-End: 149-4246
cgctgcgcccgccgccgccgccgccccctccccgcctgggccctaccgccgcacggccccggccccctcccagcctgccgctccggagagccgcccgccgaggatgcgacgcaccgcagtgttctaagaacggaagcatctgggctggatggaatttagcatcaagcagagtcccctttctgttcagagtgttgtaaagtgcataaagatgaagcaggcaccagaaatcctcggcagtgccaacgggaagactccgagctgcgaggtgaaccgcgagtgttctgtgttcctcagcaaagcccagctctccagtagcctgcaggagggggtcatgcagaagtttaacggccacgacgccctgccctttattccagccgacaagctgaaagatcttacttcccgggtgtttaatggagaacccggcgcacacgatgccaaactgcgttttgagtcccaggaaatgaaagggattgggacaccccctaacactacccctatcaaaaatggctctccagaaattaagctgaaaatcaccaaaacatacatgaatgggaagcctctctttgaatcttccatttgtggtgacagtgctgctgatgtgtctcagtcagaagaaaatggacaaaaaccagaaaacaaggcgagaaggaacaggaagaggagcataaaatatgactccttgctggagcagggccttgtcgaagcagctcttgtgtctaagatctcaagtccttcagataaaaagattccagctaagaaagagtcttgtccaaacactggaagagacaaagaccacctgttgaaatacaacgttggtgatttggtgtggtccaaagtgtcgggttacccttggtggccttgcatggtttctgcagatccactccttcacagctataccaaacttaaaggtcagaaaaagagtgcacgccagtatcacgtacagttctttggtgacgccccagaaagagcttggatatttgagaagagcctcgtagcttttgaaggagaaggacagtttgaaaaattatgccaggaaagtgccaagcaggcacccacgaaagctgagaaaattaagctattgaaaccaatttcagggaaattgagggcccagtgggaaatgggcattgttcaagcagaagaagctgcaagcatgtcagtggaggagcggaaagccaagttcacctttctctatgtgggggaccagcttcatctcaaccctcaagtagccaaggaggctggcattgctgcagagtctttgggagaaatggcagaatcctcaggagtcagtgaagaagctgctgaaaaccccaagtctgtgagagaagagtgcattcccatgaagagaaggcggagggccaaactgtgtagctctgcagagaccctggagagtcaccccgacatagggaagagtactcctcaaaagacggcagaggctgaccccagaagaggagtagggtctcctcctgggaggaagaagaccacagtctccatgccacgaagcaggaagggagatgcagcatcccagtttttggtcttctgtcaaaaacacagggatgaggtggtagctgagcacccagatgcttcaggtgaggagattgaagagctgctcaggtcacagtggagtctgctgagtgagaagcagagagcacgctacaacaccaagtttgccctggtggcccctgtccaggctgaagaagactctggtaatgtaaatgggaaaaaaagaaaccacacaaagaggatacaggaccctacagaagatgctgaagctgaggacacacccaggaaaagactcaggacggacaagcacagtcttcggaagagagacacaatcactgacaaaacggccagaacaagctcttacaaggccatggaggcagcctcctcgctcaagagccaggcagcaacgaaaaatctgtctgatgcatgtaaaccactgaagaagcgaaatcgggcttccacggcagcatcttcagctcttgggtttagcaaaagttcatctccttctgcatccttaactgagaatgaggtctcggacagcccgggagacgagccctcggagtccccatacgaaagtgcagacgaaacacaaactgaagtatctgtctcatccaaaaagtctgagcgaggagtgactgccaaaaaggagtatgtgtgccagctgtgtgagaagccgggcagcctcctgctctgtgaaggaccctgctgcggagctttccacctcgcctgccttgggctttcccggaggccagaagggaggttcacctgcagcgagtgtgcctcagggattcactcatgtttcgtgtgtaaagagagcaagacagatgttaagcgctgtgtggtaactcagtgtggaaaattttaccatgaggcttgtgtgaaaaaataccctctgactgtatttgagagccgaggtttccgctgccccctccacagctgtgtgagctgccatgcttccaacccttcaaacccaaggccgtcaaaaggtaaaatgatgcggtgtgtccgctgccccgttgcctatcacagcggggatgcttgtctggcagcaggatgctcagtgatcgcctccaacagcatcatctgcactgcccacttcactgctcggaaggggaagcgacaccacgcccacgtcaacgtgagctggtgcttcgtgtgctccaaaggggggagccttctgtgctgtgagtcctgcccagcggccttccaccctgactgcctgaacatcgagatgcctgacggcagctggttctgcaatgactgcagggctgggaagaagctgcacttccaggatatcatttgggtgaaacttgggaactacagatggtggccggcagaagtttgccatcccaaaaatgttcccccaaatattcagaaaatgaagcacgagattggagaattccctgtgtttttctttgggtctaaagattattactggacgcatcaggcgcgagtgttcccgtacatggagggggaccggggcagccgctaccagggggtcagagggatcggaagagtcttcaaaaacgcactgcaagaagctgaagctcgttttcgtgaaattaagcttcagagggaagcccgagaaacacaggagagcgagcgcaagcccccaccatacaagcacatcaaggtgaataagccttacgggaaagtccagatctacacagcggatatttcagaaatccctaagtgcaactgcaagcccacagatgagaatccttgtggctttgattcggagtgtctgaacaggatgctgatgtttgagtgccacccgcaggtgtgtcccgcgggcgagttctgccagaaccagtgcttcaccaagcgccagtacccagagaccaagatcatcaagacagatggcaaagggtggggcctggtcgccaagagggacatcagaaagggagaatttgttaacgagtacgttggggagctgatcgacgaggaggagtgcatggcgagaatcaagcacgcacacgagaacgacatcacccacttctacatgctcactatagacaaggaccgtataatagacgctggccccaaaggaaactactctcgatttatgaatcacagctgccagcccaactgtgagaccctcaagtggacagtgaatggggacactcgtgtgggcctgtttgccgtctgtgacattcctgcagggacggagctgacttttaactacaacctcgattgtctgggcaatgaaaaaacggtctgccggtgtggagcctccaattgcagtggattcctcggggatagaccaaagacctcgacgaccctttcatcagaggaaaagggcaaaaagaccaagaagaaaacgaggcggcgcagagcaaaaggggaagggaagaggcagtcagaggacgagtgcttccgctgcggtgatggcgggcagctggtgctgtgtgaccgcaagttctgcaccaaggcctaccacctgtcctgcctgggccttggcaagcggcccttcgggaagtgggaatgtccttggcatcattgtgacgtgtgtggcaaaccttcgacttcattttgccacctctgccccaattcgttctgtaaggagcaccaggacgggacagccttcagctgcaccccggacgggcggtcctactgctgtgagcatgacttaggggcggcatcggtcagaagcaccaagactgagaagccccccccagagccagggaagccgaaggggaagaggcggcggcggaggggctggcggagagtcacagagggcaaatagcgcca

SEQ ID NO: 200277 - DNA, 690 bp, Homo sapiens
  Payload ID: 19512
  Gene Name: Wolf-Hirschhorn syndrome candidate 1
  ENST ID: ENST00000511904
  CDS Start-End: 1-492
agctctgcagagaccctggagagtcaccccgacatagggaagagtactcctcaaaagacggcagaggctgaccccagaagaggagtagggtctcctcctgggaggaagaagaccacagtctccatgccacgaagcaggaagggagatgcagcatcccagtttttggtcttctgtcaaaaacacagggatgaggtggtagctgagcacccagatgcttcaggtgaggagattgaagagctgctcaggtcacagtggagtctgctgagtgagaagcagagagcacgctacaacaccaagtttgccctggtggcccctgtccaggctgaagaagactctggtaatgtaaatgggaaaaaaagaaaccacacaaagaggatacaggaccctacagaagatgctgaagctgaggacacacccaggaaaagactcaggacggacaagcacagtcttcggaagcaacgaaaaatctgtctgatgcatgtaaaccactgaagaagcgaaatcgggcttccacggcagcatcttcagctcttgggtttagcaaaagttcatctccttctgcatccttaactgagaatgaggtctcggacagcccgggagacgagccctcggagtccccatacgaaagtgcagacgaaacacaaactgaagtatctgtctcatccaaaaagtctgagcgaggagtgactg

SEQ ID NO: 200278 - DNA, 851 bp, Homo sapiens
  Payload ID: 19512
  Gene Name: Wolf-Hirschhorn syndrome candidate 1
  ENST ID: ENST00000514329
  CDS Start-End: 1-851
aaatctgtctgatgcatgtaaaccactgaagaagcgaaatcgggcttccacggcagcatcttcagctcttgggtttagcaaaagttcatctccttctgcatccttaactgagaatgaggtctcggacagcccgggagacgagccctcggagtccccatacgaaagtgcagacgaaacacaaactgaagtatctgtctcatccaaaaagtctgagcgaggagtgactgccaaaaaggagtatgtgtgccagctgtgtgagaagccgggcagcctcctgctctgtgaaggaccctgctgcggagctttccacctcgcctgccttgggctttcccggaggccagaagggaggttcacctgcagcgagtgtgcctcaggatgctcagtgatcgcctccaacagcatcatctgcactgcccacttcactgctcggaaggggaagcgacaccacgcccacgtcaacgtgagctggtgcttcgtgtgctccaaaggggggagccttctgtgctgtgagtcctgcccagcggccttccaccctgactgcctgaacatcgagatgcctgacggcagctggttctgcaatgactgcagggctgggaagaagctgcacttccaggatatcatttgggtgaaacttgggaactacagatggtggccggcagaagtttgccatcccaaaaatgttcccccaaatattcagaaaatgaagcacgagattggagaattccctgtgtttttctttgggtctaaagattattactggacgcatcaggcgcgagtgttcccgtacatggagggggaccggggcagccgctaccagggggtcagagggatcggaagagtcttcaaaaacg

SEQ ID NO: 200279 - DNA, 8568 bp, Homo sapiens
  Payload ID: 19512
  Gene Name: Wolf-Hirschhorn syndrome candidate 1
  Uniprot ID: O96028
  ENST ID: ENST00000503128
  CDS Start-End: 208-2151
cagctgtctgcttttctgtggagactgcgggttgcagacaccagcagccccctattgctgcacgtcaggtgtcctccacctcagtactgtggacatctcgggccgcatagccctgttgcgcgggcatcctgtgcgttgcaggagatgcagcagcatccatgaccgcaacccatcagagtgttctaagaacggaagcatctgggctggatggaatttagcatcaagcagagtcccctttctgttcagagtgttgtaaagtgcataaagatgaagcaggcaccagaaatcctcggcagtgccaacgggaagactccgagctgcgaggtgaaccgcgagtgttctgtgttcctcagcaaagcccagctctccagtagcctgcaggagggggtcatgcagaagtttaacggccacgacgccctgccctttattccagccgacaagctgaaagatcttacttcccgggtgtttaatggagaacccggcgcacacgatgccaaactgcgttttgagtcccaggaaatgaaagggattgggacaccccctaacactacccctatcaaaaatggctctccagaaattaagctgaaaatcaccaaaacatacatgaatgggaagcctctctttgaatcttccatttgtggtgacagtgctgctgatgtgtctcagtcagaagaaaatggacaaaaaccagaaaacaaggcgagaaggaacaggaagaggagcataaaatatgactccttgctggagcagggccttgtcgaagcagctcttgtgtctaagatctcaagtccttcagataaaaagattccagctaagaaagagtcttgtccaaacactggaagagacaaagaccacctgttgaaatacaacgttggtgatttggtgtggtccaaagtgtcgggttacccttggtggccttgcatggtttctgcagatccactccttcacagctataccaaacttaaaggtcagaaaaagagtgcacgccagtatcacgtacagttctttggtgacgccccagaaagagcttggatatttgagaagagcctcgtagcttttgaaggagaaggacagtttgaaaaattatgccaggaaagtgccaagcaggcacccacgaaagctgagaaaattaagctattgaaaccaatttcagggaaattgagggcccagtgggaaatgggcattgttcaagcagaagaagctgcaagcatgtcagtggaggagcggaaagccaagttcacctttctctatgtgggggaccagcttcatctcaaccctcaagtagccaaggaggctggcattgctgcagagtctttgggagaaatggcagaatcctcaggagtcagtgaagaagctgctgaaaaccccaagtctgtgagagaagagtgcattcccatgaagagaaggcggagggccaaactgtgtagctctgcagagaccctggagagtcaccccgacatagggaagagtactcctcaaaagacggcagaggctgaccccagaagaggagtagggtctcctcctgggaggaagaagaccacagtctccatgccacgaagcaggaagggagatgcagcatcccagtttttggtcttctgtcaaaaacacagggatgaggtggtagctgagcacccagatgcttcaggtgaggagattgaagagctgctcaggtcacagtggagtctgctgagtgagaagcagagagcacgctacaacaccaagtttgccctggtggcccctgtccaggctgaagaagactctggtaatgtaaatgggaaaaaaagaaaccacacaaagaggatacaggaccctacagaagatgctgaagctgaggacacacccaggaaaagactcaggacggacaagcacagtcttcggaagagagacacaatcactgacaaaacggccagaacaagctcttacaaggccatggaggcagcctcctcgctcaagagccaggcagcaacgaaaaatctgtctgatgcatgtaaaccactgaagaagcgaaatcgggcttccacggcagcatcttcagctcttgggtttagcaaaagttcatctccttctgcatccttaactgagaatgagcttttgtgggagcccacaccagtcaagttggatttgaacccagctgctctgtactgcacttagaatgatgtaatattccaggatgctgctgcaggtggcgtatcatcgtacacactcagtgacatttctatcacaatcattttatggaagatgtgtgataatctgtttttactggtattaataaacacatacaatgaagaaaacagataacaaattttaagaccaaggtaagataactaatcaaggccatttaatccgtcacattcatctcataatagaaacacgttcatattccagtggtcaatgtagatttcaagttgaaaggcagtccctttagttgggggctgtccagagctgcagcagggctttgcacggaaggggtggccctgttagagttgcttctcctctagtttgtaacttactggacttttgtggaaaatatcagcgtcgctaccctcagaaacaaactaacagcacacgttaggaggagtcctcatcagctgttctcattgccagtgagatatattcagtattgtagatactacactaatttccaacataagaggcaggaagagttttgattctatccttttttactaaacagttttattatgacactagatacagtaaatttttagaaaaaaataccatttacagtattattgtgaaccatttaacccttttgatccaaggccccggaccaaggggatactgtaatcaggttatgtacaccaacctctgcatcagttgcttctatagagcatcagccctcatgtttcattgtcttaatgtcggggagcagcctggtgtcctgccccaggtgtccgcatttttgcatggtaaggaaaaggcttacttgcccttcagctcataaaagcagaaggtgtgctattcacagtaccatgcgagtagcccacagttaattcccggcagattctttggctgtgttttatctttaatgaacgtttctgactaatattttgttgtaaaccattaagtaatgtaacgcatgtaagatgcttagggtgcctggccaggactccgtggtttcctgttgtgacagtaataatggttataataataaaaatgataaaattgccatcattctatttttatccaaaagtataaattttgctttggcatgaaaagtggtcctcttgactgcattatgcatgcgaggatgaaataaacctagaagtggcagaacactggatttgtgtgtgtggcgctttagggtgctggactgtatggctgagggctggttgggttcctctattggctctgctcaaatgttgcaggatacatagccccaaagatggtctaggagcaatctaagctgtgttactccaaaggacatgaaaaagctcaagagtaaaattaaaattctcaaaaaaaaaccccacgaaatttaaagatggggaaaaaaagatggtataaaaatggctctggttcaataagcagtcacccaaagtaaagactctatcttgaaaggcttttggtgaaaatgaagggatttcatttgaaattacagcatgatgaattttgcatgggtggccagccagctagcccataactgatagatgcattagaagtcagccagcgcataggtgctccctctatattatggagaaagcaaaaccctgcaaatgaccaaatggtgtccaaagagcagcatgacattggcatcagctgaataaccaggggcacatgggggaacgtggatgggaatgatagtgtatctcagcggggggtggggtgacatcgttccctggggacattgggaaggtgggcaggggcaagtgaactcagcactctgcagtgagagggacagtcccatgtgtggcagcattgtcccacttcagatgccaggagtgggctcatcctagaggagcggagttttccgagaggaccatctcctggtttcctgaaggaggtgggtggaaacggctcttgtttgaaagaacttagggaggaccattggcttgccaagagtacagaaattcattatgctgctaatttaacgtggaattccttcatttcataagaacctcaaaataatggtgatacattctagccttaagacatttgaattgccggttgttgaggtgaattttgtttgtcatacatggaaccattttagtcccatttgactcacttcagaccatcttccacacactatgtctgtgcttggagaggggaggtggctctccagtgtaaaacttgaggcattcactagaggtgaaaacttgtcagaatatataaaagcttagattgtagctgttctaaaaacgtaagtactccattgtaatagggtggcatcttcaggtagtgcacatattggcaatagaggtcctgaattgtttttctaagactgatctgagagccattgggccatcaagcctttatatatctgcttctaaaattgccccacctgctctagatggatctttgggcctttcctcagtgttcatgcaaaaattaaatgtcttttttcagcatactgactccaggtgtagttacatctcagtgctgtcttgagtatatattttatctcttatacctgtatctcccaactagaaacagctccagtgtttttaagagaatgtttcttaaaaccaataggaaacttaagcgaggtttcatgacacaacctttcatgtcgtgaaaggcagagggtgactgtgtgtgatgtgcagagtccttggacaggagtcgggggctcctctgtcccactgctgcttcttgagtgggtggagtggtgcttagaggatctccgagaggtccccgcagctctagggagatctgattttgtgttttttgtttaagtacttcacacagaagcctaggtagatttaaaatggggtgctcagggactggggaacaagacggggtggggtggggagatgggcatttggagagtctcatgtagctggagacgttaagagctgagcacaccacaggaaaggagggaggatgctgtgtgagagccatgctgtcaggagcaagcttgctgctcctgtgctgccctggccctggccttgcttgcccatggtgtgtgtgtccagaggtgtgtgtgaggctgccagaacaagtgctgggtctgtcacagagaagtttaaaaaagaaaactaagattataaattagcatctagttccaaaaccaaaaaaagtgcctgtggatgtatataaaattaagatgataagaaagtgctcctgagaaggctcttgccagaagcctgatgtgagtgtgtggcacctgtgatggcagggctgtgagctgggcttctgtcctcctctgtgtcccggcatggaagccagtataagcatttccaaatgagggaaaagtccttggctcgtttgatccagttgagttgaaagggttgccttggcagcagaggctcctctgatggctgacatcagtcactgcgtctgggcctgagacgtgcatggagggctgtaaagccacggattcccctcgctggagaggctcctgtctgatagcggtagatgaaaaataaggtcgttatgactttggcaacttgcttcatttctttttcatttgacttacaacacacttctctaacatctagcccttttaaatttttaattaatttcaaagcttcctctggccaggtagacttttgtatacagaccaggtgagagcccttttgccttagtgtgaaaatgtaacattttatgcttttaaaatcaatagattcatcaccttagttttttaaaaaaaatctataaatagggtaattgctgaggtgtgcggtttatctttgagatgataaagctaaattatagtcttttgccagagaaactgaggtaactgtcattagaaaaggtttcttaaaatactcacaaagctgttattggcttcttaacttctaaaatttggggggtcttgcatttatttattatttatttatttatttatttagagacagagtctcaccctgttggccaggctggagtgcagtaagtggcacaatctcggctcactgcaacctccgcctccttggttccagcaattcttctgcctcagcctcccgagtagctgggactacaagcggctgccaccacacctggctatttttttttgtatttttagtagagacagggtttcgccatattggccaggctggtcttgaactcctgacctcgtgatccacccgcctcaccctcccaaaatgctgggattacaggcgtaagccactgcacctggcggggtcttgcttattttaaaagaaatattctgattcatattttaggactttttgtcaacgaaattggttttgatccctttgggtaccatttttattgttttatgtagaatgttagaaattaccactaatttacctggcagtgatgtcaaattgactgtaattagcaggtagaaaattatttgtattatattcatctgattcctatactggatgagcaaggagcatgcttcctttgggacattcttacagcagggtgtctctccaacagcccgacaggcctcatctttttggttggatacctttgaactccatggttacgtgttaggtccacatttgtgtttttttctagcctacctatagttgttggcctttttgcatataactctcgggtaatattttgaagcatgctgaccatccaggcatatagtattttcaagaaatgactgaggtaggggtgggggtcctggtccggctgatgggggtttgctcagcactgtgccagtggaagcaggtgtattgtgggcagttttgtcattgtcctcaagtccttcgcagacagtgcacagcctgctgtctgcagtcggccagaccaggctcctccccagcacactccctgtgggatggccgctgctcaggacacagtgggacaaagttgggttgataggatattttagattcattttacctttgacaagggcaggccttgaattgggagcagcagccacctggcctcactctggccacaggtgacacttggtccttgctgccacctgcttggggctatgtggctacggctacacaaaagcctgtgcaggttagaagacgactgtggtgtgcagtggtgctctgggagtggagacttcctctgttctcagagactcacccccagccctgaccctagaatttagggatagccaggaagtttctagtttgtgtaacctagaagggtcactttaataaaaattgttatgaactatagtattttagatgatgagtgacttattttaattccactttaacattttactgtgctgttaacttggaagacctgtttgaaattagtcttgatttcacactcatttaatctgctgagcacagggctgttgtcatttgtaaacgcaaacactgtggaggtacttctcgccatcagcttccttctttacaaaaccatcatttcaacatgaaaattatgtcagtttatagaaatatttattgttcaaggtctgtaattgtatttcaaaaacgatgtcgtattcaagttgtgaagggatttgttttgtcaaaaaattaaaaactcaatgtgtatgacgccactctgaagagtaggtgagcgctttgcagtcacagaaggtggcatctgactgcggctcatacaggtcaccctgaagggccacgtgcttttagcagttggctggaatgtgttcactaggttccgttatgtttggtaatatcatcttgaaaagtccctgtaatagatcaaggagactgcattccctgccctgaaggaatgtatttctaaggcaaataggcaacttggtactatcttattctgagtagagagtggagaaagtattttcagactgaagaaaactttgaaaagtcaggagctaagctgctcggagctcagtgccgcagcatggctgtggtggacgcgggaaacaacgggaaagttcttgacagagtctgtgtccgctcagtccctgcacttttcctttccaaatgcatctcgttggatatggaatagatcgtagatgttgtagactgagatttgggactatgttgggaccgtacaggtgaatgtgccacctccacaaatggcttctccgagtgagtcacgtcacctggtgcgtggaggtggagcctgcggctggagtaaggcttgctgtgggacgccctcgtactttgctctccttgcgggtggttgccgagccgagagcattggatcctccccgactgtggctagttgtctgtccggtggctgggagggggtgtggtgggaaaaagtcggaatctctgcaatctgtgtcatggactgtactattgtaaggtctatattctgtatgtgggtcccagaccctgatcaggaaatgagcctcatgtgtgtcgttaacatttatatatttccattcaaaatatgtattcagtgtttatttcctcaaaacagactttgttaatgtaggaaatctctccaagtggaaacgtgctaactttttctgtaaatctgaaataaaaggtgctgttccttcctctg

SEQ ID NO: 200280 - DNA, 816 bp, Homo sapiens
  Payload ID: 19512
  Gene Name: Wolf-Hirschhorn syndrome candidate 1
  ENST ID: ENST00000515806
  CDS Start-End: 220-816
ggtcttgctcccttgcgcaggcgagagtacagtggcacgatcatagctcactgtagcctccaactcctgggctcaagcagtcctcctacttcaggctaccaaagtgctgggattacaggtgtgagcgtgagccactacacctggctaatttttgttggctgtttttaatctaccacacttttatagcaagtgttctaagaacggaagcatctgggctggatggaatttagcatcaagcagagtcccctttctgttcagagtgttgtaaagtgcataaagatgaagcaggcaccagaaatcctcggcagtgccaacgggaagactccgagctgcgaggtgaaccgcgagtgttctgtgttcctcagcaaagcccagctctccagtagcctgcaggagggggtcatgcagaagtttaacggccacgacgccctgccctttattccagccgacaagctgaaagatcttacttcccgggtgtttaatggagaacccggcgcacacgatgccaaactgcgttttgagtcccaggaaatgaaagggattgggacaccccctaacactacccctatcaaaaatggctctccagaaattaagctgaaaatcaccaaaacatacatgaatgggaagcctctctttgaatcttccatttgtggtgacagtgctgctgatgtgtctcagtcagaagaaaatggacaaaaaccagaaaacaaggcgagaaggaacaggaagaggagcataaaatatgactccttgctggagcagggccttgtcgaagcagctcttgtgtctaagatctcaagtccttcagataaaaag

SEQ ID NO: 200281 - DNA, 1095 bp, Homo sapiens
  Payload ID: 19512
  Gene Name: Wolf-Hirschhorn syndrome candidate 1
  Uniprot ID: O96028
  ENST ID: ENST00000512700
  CDS Start-End: 6-827
gctggatggaatttagcatcaagcagagtcccctttctgttcagagtgttgtaaagtgcataaagatgaagcaggcaccagaaatcctcggcagtgccaacgggaagactccgagctgcgaggtgaaccgcgagtgttctgtgttcctcagcaaagcccagctctccagtagcctgcaggagggggtcatgcagaagtttaacggccacgacgccctgccctttattccagccgacaagctgaaagatcttacttcccgggtgtttaatggagaacccggcgcacacgatgccaaactgcgttttgagtcccaggaaatgaaagggattgggacaccccctaacactacccctatcaaaaatggctctccagaaattaagctgaaaatcaccaaaacatacatgaatgggaagcctctctttgaatcttccatttgtggtgacagtgctgctgatgtgtctcagtcagaagaaaatggacaaaaaccagaaaacaaggcgagaaggaacaggaagaggagcataaaatatgactccttgctggagcagggccttgtcgaagcagctcttgtgtctaagatctcaagtccttcagataaaaagattccagctaagaaagagtcttgtccaaacactggaagagacaaagaccacctgttgaaatacaacgttggtgatttggtgtggtccaaagtgtcgggttacccttggtggccttgcatggtttctgcagatccactccttcacagctataccaaacttaaaggtattttcaaatcaaagaagtttgaacacttaaaaacaagtcaaattgtactgaaagattaatagtgaaaaatcatcccctgccttcctctctcctccccagaggtcagaaaaagagtgcacgccagtatcacgtacagttctttggtgacgccccagaaagagcttggatatttgagaagagcctcgtagcttttgaaggagaaggacagtttgaaaaattatgccaggaaagtgccaagcaggcacccacgaaagctgagaaaattaagctattgaaaccaatttcagggaaattgagggcccagtgggaaatgggcattgttcaagc

SEQ ID NO: 200282 - DNA, 3995 bp, Homo sapiens
  Payload ID: 19513
  Gene Name: Wolf-Hirschhorn syndrome candidate 1-like 1
  Uniprot ID: Q9BZ95
  ENST ID: ENST00000316985
  CDS Start-End: 519-2456
gggggctttgtgcgcggcggcggcgggagaggcggcggcggcggccagcacggaggcggaggccgagggggctgtgcacaggtcgccgcggagaggcgtgcgaattccgagccgagcgccgaggaccgtgctacccaggccgggctgccagccgcaggctcctctctggcagcagcggcggcgcggcgacccccgtccctcggcctccccttcccatcccacctcccgagccttcctcttcccgcagcacgcccggcccggcccggccgtggccctcctcagtgccggccgccatggcagaggcgtccggcgcggggaaaatctagcccggggatttcatgcggcctagctcggttccgcctcctcctcgcgcggccccagcggctgcccgcaccccagccccactccgggcctccgtgtctctcctgtgatcgcactgacacggccggggggttagaatggaacaaactgaaggcccgatgagagaaagggaaagttaaggatgctggagcagaacaatggatttctctttctctttcatgcaagggatcatgggaaacacaattcagcaaccacctcaactcattgactccgccaacatccgtcaggaggatgcctttgataacaacagtgacattgctgaagatggtggccagacaccatatgaagctactttgcagcaaggctttcagtacccagctacaacagaagatcttcctccactcacaaatgggtatccatcatcaatcagtgtgtatgaaactcaaaccaaataccagtcatataatcagtatcctaatgggtcagccaatggctttggtgcagttagaaactttagccccactgactattatcattcagaaattccaaacacaagaccacatgaaattctggaaaaaccttcccctccacagccaccacctcctccttcggtaccacaaactgtgattccaaagaagactggctcacctgaaattaaactaaaaataaccaaaactatccagaatggcagggaattgtttgagtcttccctttgtggagaccttttaaatgaagtacaggcaagtgagcacacgaaatcaaagcatgaaagcagaaaagaaaagaggaaaaaaagcaacaagcatgactcatcaagatctgaagagcgcaagtcacacaaaatccccaaattagaaccagaggaacaaaatagaccaaatgagagggttgacactgtatcagaaaaaccaagggaagaaccagtactaaaagaggaagccccagttcagccaatactatcttctgttccaacaacggaagtgtccactggtgttaagtttcaggttggcgatcttgtgtggtccaaggtgggaacctatccttggtggccttgtatggtttcaagtgatccccagcttgaggttcatactaaaattaacacaagaggtgcccgagaatatcatgtccagttttttagcaaccagccagagagggcgtgggttcatgaaaaacgggtacgagagtataaaggtcataaacagtatgaagaattactggctgaggcaaccaaacaagccagcaatcactctgagaaacaaaagattcggaaaccccgacctcagagagaacgtgctcagtgggatattggcattgcccatgcagagaaagcattgaaaatgactcgagaagaaagaatagaacagtatacttttatttacattgataaacagcctgaagaggctttatcccaagcaaaaaagagtgttgcctccaaaaccgaagttaaaaaaacccgacgaccaagatctgtgctgaatactcagccagaacagaccaatgcaggggaggtggcctcctcactctcaagtactgaaattcggagacatagccagaggcggcacacaagtgcggaagaggaagagccaccgcctgttaaaatagcctggaaaactgcggcagcaaggaaatccttaccagcttccattacgatgcacaaagggagcctggatttgcagaagtgtaacatgtctccagttgtgaaaattgaacaagtgtttgctcttcagaatgctacaggggatgggaaatttatcgatcaatttgtttattcaacaaagggaattggtaacaaaacagaaataagtgtcagggggcaagacaggcttataatttctacaccaaaccagagaaatgaaaagccaacgcagagtgtatcatctcctgaagcaacatctggttctacaggctcagtagaaaagaagcaacagagaagatcaattagaactcgttctgaatcagagaaatccactgaggttgtgccaaagaagaagatcaaaaaggagcaggttgaaacagttcctcaggctacagtgaagactggattacagaaagggtcggcggaccggggagtgcagggctctgtcagattcagtgacagctccgtctccgcagcgattgaggaaactgtggactgagattcctgtacaatttcatcccagaaactccagacttgtagtctccatgcaagatttctttgtcggcggcttgataaacagtttctttgttttcgattttgatttcgccaatcatcattattggcattttcctgcctggtttcttcttcaagactctgaacaattgctttaacagtcaaatgatttttttttttcggtttgagctggatgggtacagcttaaatcatgggtccagcctaaaaaccaccatttaacttacactgatcaatttcaacatggactgtttttggttttttgtttttaaataaagcatcattaatgcacatctgcaggggtttgccaaacagcccaaactgtatacattacaatcattaaaagttcttattttttttaatattagtgccgttatcatggagaacagcatgacagctgtctttggcagtctgtcatttttctagcattttcagaaactcatcggaaatggcggtacctgtgtttcccttcgaaagcctctcagtacagcactcctgttcctctgttaaaactccttgttaatccagtgatcttttaggccaaggaaatattttgtgatggtgttctgggtccatacaccagcaatgaaggagatagatttgtgtacttgtgttttttaatcagcattaacatgggcaggcaccctcatttatagatgtcaggaaacattcagtgaaaaacttgtagaatgggatgtgataacgaggttccagtaatctgagcagtctaacgaggcccacctcctccaccacagaacgtggctatgttccaagtgctactctcactcagcctgttgcggatcttcatggcctcaggagacttgtttctccatgggctcttctggactgcacacttccaccatagcttgctgggttgatctagatgtctgtttgttgtatggaaattttgggggaaaaaatccaaaacacaaactgtgggttgaaatattaaccgtctccttggttccttggtattcaccgtgcctgatctgcacatttcatcgtggctgtttctgtatagcctatactgcattagcccaagagattgttgctttgtaactttttgcactattgttttggctggatttgtattacacacagttttaaaaaaaacaattccacactattctctgccttttttttcctatttatttcttcccgcacaaattccacatagaggccttcccatccagctctacgtgatttggctgcacttgaacactgattgtccatttacagccctcagcaatgtgccttctaaatggcatgacatatgtagatgtgctgcagcgcttgttaatggtcacaataaatgccacttcaccaaggaagtctcagatgaacaattatgaacatccaaattttattggggggcaataatcaactgaattgcaaaatttgggggaaaatggcactatccgtgtacgaatcgaatacaaatcaaagatttgtcacatccctaataaaaacaagatggagatgtctctgcaaccatatttgtaagcta

SEQ ID NO: 200283 - DNA, 10776 bp, Homo sapiens
  Payload ID: 19513
  Gene Name: Wolf-Hirschhorn syndrome candidate 1-like 1
  Uniprot ID: Q9BZ95
  ENST ID: ENST00000317025
  CDS Start-End: 519-4832
gggggctttgtgcgcggcggcggcgggagaggcggcggcggcggccagcacggaggcggaggccgagggggctgtgcacaggtcgccgcggagaggcgtgcgaattccgagccgagcgccgaggaccgtgctacccaggccgggctgccagccgcaggctcctctctggcagcagcggcggcgcggcgacccccgtccctcggcctccccttcccatcccacctcccgagccttcctcttcccgcagcacgcccggcccggcccggccgtggccctcctcagtgccggccgccatggcagaggcgtccggcgcggggaaaatctagcccggggatttcatgcggcctagctcggttccgcctcctcctcgcgcggccccagcggctgcccgcaccccagccccactccgggcctccgtgtctctcctgtgatcgcactgacacggccggggggttagaatggaacaaactgaaggcccgatgagagaaagggaaagttaaggatgctggagcagaacaatggatttctctttctctttcatgcaagggatcatgggaaacacaattcagcaaccacctcaactcattgactccgccaacatccgtcaggaggatgcctttgataacaacagtgacattgctgaagatggtggccagacaccatatgaagctactttgcagcaaggctttcagtacccagctacaacagaagatcttcctccactcacaaatgggtatccatcatcaatcagtgtgtatgaaactcaaaccaaataccagtcatataatcagtatcctaatgggtcagccaatggctttggtgcagttagaaactttagccccactgactattatcattcagaaattccaaacacaagaccacatgaaattctggaaaaaccttcccctccacagccaccacctcctccttcggtaccacaaactgtgattccaaagaagactggctcacctgaaattaaactaaaaataaccaaaactatccagaatggcagggaattgtttgagtcttccctttgtggagaccttttaaatgaagtacaggcaagtgagcacacgaaatcaaagcatgaaagcagaaaagaaaagaggaaaaaaagcaacaagcatgactcatcaagatctgaagagcgcaagtcacacaaaatccccaaattagaaccagaggaacaaaatagaccaaatgagagggttgacactgtatcagaaaaaccaagggaagaaccagtactaaaagaggaagccccagttcagccaatactatcttctgttccaacaacggaagtgtccactggtgttaagtttcaggttggcgatcttgtgtggtccaaggtgggaacctatccttggtggccttgtatggtttcaagtgatccccagcttgaggttcatactaaaattaacacaagaggtgcccgagaatatcatgtccagttttttagcaaccagccagagagggcgtgggttcatgaaaaacgggtacgagagtataaaggtcataaacagtatgaagaattactggctgaggcaaccaaacaagccagcaatcactctgagaaacaaaagattcggaaaccccgacctcagagagaacgtgctcagtgggatattggcattgcccatgcagagaaagcattgaaaatgactcgagaagaaagaatagaacagtatacttttatttacattgataaacagcctgaagaggctttatcccaagcaaaaaagagtgttgcctccaaaaccgaagttaaaaaaacccgacgaccaagatctgtgctgaatactcagccagaacagaccaatgcaggggaggtggcctcctcactctcaagtactgaaattcggagacatagccagaggcggcacacaagtgcggaagaggaagagccaccgcctgttaaaatagcctggaaaactgcggcagcaaggaaatccttaccagcttccattacgatgcacaaagggagcctggatttgcagaagtgtaacatgtctccagttgtgaaaattgaacaagtgtttgctcttcagaatgctacaggggatgggaaatttatcgatcaatttgtttattcaacaaagggaattggtaacaaaacagaaataagtgtcagggggcaagacaggcttataatttctacaccaaaccagagaaatgaaaagccaacgcagagtgtatcatctcctgaagcaacatctggttctacaggctcagtagaaaagaagcaacagagaagatcaattagaactcgttctgaatcagagaaatccactgaggttgtgccaaagaagaagatcaaaaaggagcaggttgaaacagttcctcaggctacagtgaagactggattacagaaaggtgccagcgagatttcagattcctgtaaacctctaaagaaaaggagtcgcgcctcaactgatgtagaaatgactagttcagcatacagagacacatctgactccgattctagaggactgagtgacctgcaggtaggctttggaaagcaagtagatagcccttcagctactgcagatgcagacgtttctgatgtgcagtccatggattcaagtttgtcgagaagaggcactggaatgagtaagaaggacactgtatgtcagatttgtgaaagctctggtgactctctgattccttgtgagggagagtgctgcaaacactttcacctggagtgcctgggattggcatcacttcctgatagcaagttcatctgcatggaatgtaaaactgggcagcacccatgtttttcgtgtaaagtgtctggtaaagatgtgaagcgttgttctgttggtgcttgtgggaaattttatcatgaagcctgtgtccgcaaattccccactgccatctttgaatcaaaaggattccgctgtcctcagcactgctgctctgcctgctctatggagaaagatatccacaaagcaagtaaaggccgcatgatgagatgtttaagatgtccagttgcctatcactctggagatgcttgcattgcggccggaagcatgttagtatcctcctacattctcatctgtagtaatcattccaaacggagcagtaattcttctgctgtaaatgtaggcttttgtttcgtttgtgccagagggctgatagttcaggaccattcagaccccatgttcagttcatatgcctataagtcccactacctactgaatgaatcaaatcgtgctgagttgatgaaattacctatgattccttcttcgtcagcttccaaaaagaaatgtgagaaaggtggaagattgctctgctgtgaatcgtgcccagcttccttccacccggaatgcctaagcatagaaatgccagaaggctgctggaattgtaatgactgtaaagctggcaagaaactacattacaagcagattgtttgggtcaaattgggaaattacagatggtggccagcagagatctgcaaccccaggtctgtgccactgaacatccagggccttaaacatgacttgggggacttccctgtattcttctttggttctcatgactactactgggtacaccagggcagagtgttcccttatgttgaaggagacaaaagctttgctgaagggcagactagtattaacaagaccttcaaaaaggcactggaagaagctgcaaaacgtttccaggaattgaaagcacaaagagaaagtaaagaagccctagagattgaaaaaaactcaagaaaaccccctccctacaaacacatcaaagctaacaaagtaataggaaaggtgcagatccaggttgctgacctgtcagagattccccgctgtaactgcaagccagctgatgaaaacccttgtggcttggaatcggagtgcctgaacagaatgttgcagtatgaatgccacccgcaggtgtgcccagctggagatcgttgtcagaaccagtgctttacaaagagactataccctgatgcagagatcatcaaaacggagcggagaggctggggcctcaggaccaaaaggagcattaagaagggtgaatttgtaaatgaatacgtcggtgaattaattgatgaagaagaatgcagattgcgaatcaagcgagcccacgagaacagtgtaactaatttttatatgttaactgttaccaaggaccgtataattgatgccggcccaaaaggaaattattctcgcttcatgaaccacagttgtaatcccaactgtgaaacacaaaagtggacagtgaatggagatgttcgagtgggactatttgctctctgtgatattcctgcagggatggagttaacatttaattataacctagattgtctgggcaacggcagaacggagtgccactgtggagcagataactgcagtggttttctaggagtgcggccaaagtcggcatgtgcgtcaacaaatgaagagaaggcaaaaaatgctaagttaaaacagaagagacgaaagatcaaaacagaaccaaagcagatgcatgaagattactgttttcaatgtggagatggtggagagctggtcatgtgtgacaaaaaagactgtcccaaagcataccacctcctatgccttaacctgactcagccaccatatggaaagtgggagtgtccgtggcatcagtgcgatgagtgcagcagtgcagctgtttccttctgtgaattctgtccacattcattttgtaaagatcatgaaaagggggccctggttccctctgcactggaaggccgcctctgctgctcggaacatgaccccatggctcctgtgtcaccagaatactggagcaagataaaatgtaaatgggaatcacaagatcatggagaagaagtaaaagaataaatgtgtggtgtcccctcctttctatttaagtgaaaaaagcaaatagatcatgcatttaaaaagaagagactgctacagtgcatacagcctttgccatcggaactgccttattaaagcaaaaatgggaaaccagttcatgcaggcagaagcagttggtggtgtctggtttttgtttgatttggttggtttgggattcttttgtggagggttaaattcccttggtcttttcttgccttttattgtgcttcagtgccattgcagcttgaaaaagaaatgtttttgctgttaaaataagaacaaagagaaaagtaagttttgttaatgagataaatttaaagtctaagatgtgttccttggttgtataaagcaaaagtagccatcattcctttatttattttcatttttaggaatttcaagaagtgtagttcaatagtctaatcaagtgtgtgtgtgttttaagtaggaatctgagaaagccctctaggaaagggtatgataagctttatatacctctttactgagcagtaggtaggctcacttctctttcccttcaaaatgcttttcataggcttagagaagggctctatggaagtattaaatctggcctcttgaaaacaatgcctcggtggattttacctctgtggtcttaaacaaggtgggctttgtactatggtaactttacctagaagggtatatggtgtgtttccttggtggaaggaaaaaaaggaatggatgtgctcactgatttttaaaacgttttccattgacatggatggtttgggttttggatgaagtgcgtttctgtggatatgaagcatagttggaatggtcactcctattttcctgacactgattaaggcagctaaagggggatgaaggcataaaccaaaatttggatcatataagcaccattttctgtccaattttattgtagaccctggtcttaattggagagaattacaggcattttattttttgtctctgttttcctctcctactcaaacatttcttttgtcatctgaccattcagtcatgtttcctggtaaaaccacacaagtgagtttgaattgtatttgaatagatctttttggttgagttcctaatttggggggtgaaagtagtaggggcatccccaggttacatgtaaagaatttctattattatccagtacttaagattgctcccattgagtaaggggaagaacttctacttttacagggtgcataagagccacacaaacacacttcatcttaggaagcacttggagaaaactcccaagaaagtcagtgttagcaaaaatggttgatggtgatgcttgactcttatagatgcgagtataccaagatgtctgctcaccaaactcacttgcttttaatgcttaggaatatgtatattccagtattccttgtatgaaaataattagtaatgtcagacattgttgtaacactgtactaagtagaagtctagggttagcttgaatgaatgttaactttctctgtgaattttgactgcttacaattgctggtacctggtagcatttattttccctcaagtacctagtaaccttatgaaggtagggagggtagatgctctaccacattccttcagctgtattgagtgttccatttgcttatcaatttagagctcttctatggaaagagggtgaaaatctgttttgtgcctcttttttttgtatgtaaatgtgcaattatactggattttctcttgtaaaaaacactacaattcttttactgaagctcctaaactgccatttgcctgactccagcaattaattctgcggtgactcattgggcttccagtacttctgttgattagatatggtcccaaaagaaagagcaaaatggaaaatgcgatccatgtcaccaaatataattgctacaagtaacatgaaatacagctcaccaaaacactaaactttgctcttgagcaattatatagtttgatgtccttttaaaaaataagaaaagctaggttttatcatactaaaattttattttgtatatgatgtttggttttttaaacttactaacataaggatttcctttaatattccaaatacagttcttgaaacagtatccaacatgaaatcttatctccttgcttttagacttagtgctatttactatctaaagacttttctatggtaagccagggtacatcctatatactacagataccttaggtttcagtatttttatgcagcttcttcattgtgtcacattttgttttcatatctgtaacagagctctgctgaaattaaaaaaaaattatgattaataggattgtttcaccatttcagaaatcagagtagaaaacaaaatagctgccaggtgcagtggctcacacctgtaatcccagcactttgggaggccgaggtgggcagatcatgaggtcaggagtttgagaccagcctgaccaacatggtgaaaccctgtctctgctaaaaatacaaaaaggagccgggcatggtggcacatacctgtagtcccagtttctcaggaggcagaggttgcagtgagccaagatcacatcactgcactccagcctgggtgacagagcgagactccatctcaaaaaaaaaaggtaaccatagttctgaagtctttggccatgaatgttctttaatggtctaaaaagcggttttagtcatgctggtgccaaggagttctcctcacacctccatagcgtcaatgttgacctatttgatatatttttaagttgcagattatagatgcagaaagagaaaattgtcctttatgtgtgcatgagtatacatgcactgtgcctgtgatacaccaatgaaatattccaaaagacattgctcactcatagtctgaagttggtatttgttaacttttaaatctatatgtggtcagagtgtaagtggctggtttttattcttgtccaacaatgaaataacttaaagcagcatgggctaatggtggtattttttttaaccacatgttaatttgttgaaggaagaagtgaacataagatttttgataatcagcctaaagcttcagaaactggatcagtaagagctaaagatgaaatcctgggaaactttctcaggcactgtgcaggggagggaggggctggaccgccactgctgcgagggaagaatcagaagagctgcctgtggctggctgagaagggcaaggtggatggctcttcattcctggaaggctgaagcagccagaggcagtgattcacctctttaatgtctaatcagggagagatacaggagtgaggtgggttttattttcatttttgttttaacaagttcccactcttatcttaattctcaaaaatgatctggcctcatctatagaactggctgagttggggaatcatttaaaatttgggattttctgtacaagtcaagaacatatgtgaaagctaaaaaagtaatggaggcagggggactgctcccagctcccttctgccatttacacaaaatatttgaaaacatgtctgtaaataacgttgtggaactgagatattgagtatctaatcatgtaaaggaccctcagatgggacaggctattggacaactttcctggttcatgaagtggaatttcctttttgagtagtttcttgcatggtgtattccaataggtcaaacccagacctactgtttgcaaacaggccatctgtagagaatacaatctctggactgcccaggacttgttgcttgtctttcatttcattttaaatacaaagctcttcctttagcattcaccttgaagtcaaggtgttggctgccacatgccatgtcctcttaacaagataagaaaacagtggctatggagccctcacagctgggaagctgacattctatacttccatatgagaaaaaggacattggaaagttgctttatttctgggcagcgtagactaaagttacttttcacaaggctgatgcatccagcctcccccagttgtccaagttggtgcagacatgaattgatgaatggaaacactttcctttggcctagggccacctagaattggtctctggttatttgtaaaacaaaaagtagaacttgcttccattttcagatggactagggaatactataattagacagctttgcaatgaattaacaaatactgaaaagttggaaatgtgtatatactgaaatctcaccaacttttacctggggtggggtaccaggagaaagggaaccccctttctcctggtaaagggtaaggggggggataatgtttaccacaggtacgaaatagtcactttaacattgagacctctgcctcattgaattcaggttttttaagtacttgaaactcttcagattctccttattttagtttctttttacatttatgaagtagaaagcattgttttgtaaactgttttgaaaataaatagcctagtctcttatcctctttagcgtggattaaaggtgaagttctgcaaatgggagagtgttcacagtagatagctcagattgattgaacacatttgaggaagagactcctgcatgagataccagcatttttacaaatactttttatgtacattctttattttgtcattttgtcaaccctctccccaagcacatcttctttccttttactatgtctatgtagggaaaaaaacaaaacaaaaaattgcacttacgttacactcccaaaatgtgggtaatccgtgtctttcaaaaaacatttctgttttttgttttgttttggtcagtccattgcataagtgacaagtttgggtgcttgtggcacgtatgtatgaagcgggagggggatgagaattgcctgtccttcagtaggctgtaaaagtaatttacatgtaagtaaaaagggaaaatagaatagatgccaaagtcatttattcagtccttagttttcttatgtggcattactgcatctgctagttagtgagaaagcaccctcagcttttactgctcccctccctgcctgccaacacacttgatgtgtgcaaacagccctcaagtatctgtcagatgacctatataaggtattgaataaggtattcttgtcagtttagaaatggactggataaaacttacttggttgtcattattttatctcatttgtcctgttacatgccctatgttaagataattatattgccactaataatcaagatgctaaatgagtattacaactggctaatatcattttttatatacaagggtatgtgtatatttggaattgatatgagaaactcatttgtacccatttgagtgatattgcacaacaaacacagatacctacagactccgttttcattttctcgtgttctttatgataatgatctttgtagattggttatttctgtactttatctgtaataaactttgtagatcctgtgaaccattactttgcctaaatcacttgagacttgagtctttaataacaaagcatcaatattcactaaagtcaatctcttttgagtttctgtgacttggctagaagctcttgacactaagggattagtgttaattttccctgggggtgttccactagggcattactgtataatgacttgatgttgccacatagacttcaagatatataatattttgaggattttgttgattggcctatgttttattgcatagtgtgaaacgtgtaaagcttggttaacctgtatatagatagcttattgttgactagttatagtgtatttagggttgcctgtaatatttaagcttctttactgatgtgtgtgctggtaggaacatataatttttgtacattatatttactgagatgttgccttttttattttacaaatactttggaattccaatgtgttttttgcttccgtgaggattaatttggaaaggtttttaatgacattccactgatttcagattttgcttgagattgacttcaataaattgtcctgtatgttccaaattaaata

SEQ ID NO: 200284 - DNA, 5276 bp, Homo sapiens
  Payload ID: 19513
  Gene Name: Wolf-Hirschhorn syndrome candidate 1-like 1
  Uniprot ID: Q9BZ95
  ENST ID: ENST00000433384
  CDS Start-End: 492-4658
agaggcggcggcggcggccagcacggaggcggaggccgagggggctgtgcacaggtcgccgcggagaggcgtgcgaattccgagccgagcgccgaggaccgtgctacccaggccgggctgccagccgcaggctcctctctggcagcagcggcggcgcggcgacccccgtccctcggcctccccttcccatcccacctcccgagccttcctcttcccgcagcacgcccggcccggcccggccgtggccctcctcagtgccggccgccatggcagaggcgtccggcgcggggaaaatctagcccggggatttcatgcggcctagctcggttccgcctcctcctcgcgcggccccagcggctgcccgcaccccagccccactccgggcctccgtgtctctcctgtgatcgcactgacacggccggggggttagaatggaacaaactgaaggcccgatgagagaaagggaaagttaaggatgctggagcagaacaatggatttctctttctctttcatgcaagggatcatgggaaacacaattcagcaaccacctcaactcattgactccgccaacatccgtcaggaggatgcctttgataacaacagtgacattgctgaagatggtggccagacaccatatgaagctactttgcagcaaggctttcagtacccagctacaacagaagatcttcctccactcacaaatgggtatccatcatcaatcagtgtgtatgaaactcaaaccaaataccagtcatataatcagtatcctaatgggtcagccaatggctttggtgcagttagaaactttagccccactgactattatcattcagaaattccaaacacaagaccacatgaaattctggaaaaaccttcccctccacagccaccacctcctccttcggtaccacaaactgtgattccaaagaagactggctcacctgaaattaaactaaaaataaccaaaactatccagaatggcagggaattgtttgagtcttccctttgtggagaccttttaaatgaagtacaggcaagtgagcacacgaaatcaaagcatgaaagcagaaaagaaaagaggaaaaaaagcaacaagcatgactcatcaagatctgaagagcgcaagtcacacaaaatccccaaattagaaccagaggaacaaaatagaccaaatgagagggttgacactgtatcagaaaaaccaagggaagaaccagtactaaaagaggaagccccagttcagccaatactatcttctgttccaacaacggaagtgtccactggtgttaagtttcaggttggcgatcttgtgtggtccaaggtgggaacctatccttggtggccttgtatggtttcaagtgatccccagcttgaggttcatactaaaattaacacaagaggtgcccgagaatatcatgtccagttttttagcaaccagccagagagggcgtgggttcatgaaaaacgggtacgagagtataaaggtcataaacagtatgaagaattactggctgaggcaaccaaacaagccagcaatcactctgagaaacaaaagattcggaaaccccgacctcagagagaacgtgctcagtgggatattggcattgcccatgcagagaaagcattgaaaatgactcgagaagaaagaatagaacagtatacttttatttacattgataaacagcctgaagaggctttatcccaagcaaaaaagagtgttgcctccaaaaccgaagttaaaaaaacccgacgaccaagatctgtgctgaatactcagccagaacagaccaatgcaggggaggtggcctcctcactctcaagtactgaaattcggagacatagccagaggcggcacacaagtgcggaagaggaagagccaccgcctgttaaaatagcctggaaaactgcggcagcaaggaaatccttaccagcttccattacgatgcacaaagggagcctggatttgcagaagtgtaacatgtctccagttgtgaaaattgaacaagtgtttgctcttcagaatgctacaggggatgggaaatttatcgatcaatttgtttattcaacaaagggaattggtaacaaaacagaaataagtgtcagggggcaagacaggcttataatttctacaccaaaccagagaaatgaaaagccaacgcagagtgtatcatctcctgaagcaacatctggttctacaggctcagtagaaaagaagcaacagagaagatcaattagaactcgttctgaatcagagaaatccactgaggttgtgccaaagaagaagatcaaaaaggagcaggttgaaacagttcctcaggctacagtgaagactggattacagaaaggtgccagcgagatttcagattcctgtaaacctctaaagaaaaggagtcgcgcctcaactgatgtagaaatgactagttcagcatacagagacacatctgactccgattctagaggactgagtgacctgcaggtaggctttggaaagcaagtagatagcccttcagctactgcagatgcagacgtttctgatgtgcagtccatggattcaagtttgtcgagaagaggcactggaatgagtaagaaggacactgtatgtcagatttgtgaaagctctggtgactctctgattccttgtgagggagagtgctgcaaacactttcacctggagtgcctgggattggcatcacttcctgatagcaagttcatctgcatggaatgtaaaactgggcagcacccatgtttttcgtgtaaagtgtctggtaaagatgtgaagcgttgttctgttggtgcttgtgggaaattttatcatgaagcctgtgtccgcaaattccccactgccatctttgaatcaaaaggattccgctgtcctcagcactgctgctctgcctgctctatggagaaagatatccacaaagcaagtaaaggccgcatgatgagatgtttaagatgtccagttgcctatcactctggagatgcttgcattgcggccggaagcatgttagtatcctcctacattctcatctgtagtaatcattccaaacggagcagtaattcttctgctgtaaatgtaggcttttgtttcgtttgtgccagaggtggaagattgctctgctgtgaatcgtgcccagcttccttccacccggaatgcctaagcatagaaatgccagaaggctgctggaattgtaatgactgtaaagctggcaagaaactacattacaagcagattgtttgggtcaaattgggaaattacagatggtggccagcagagatctgcaaccccaggtctgtgccactgaacatccagggccttaaacatgacttgggggacttccctgtattcttctttggttctcatgactactactgggtacaccagggcagagtgttcccttatgttgaaggagacaaaagctttgctgaagggcagactagtattaacaagaccttcaaaaaggcactggaagaagctgcaaaacgtttccaggaattgaaagcacaaagagaaagtaaagaagccctagagattgaaaaaaactcaagaaaaccccctccctacaaacacatcaaagctaacaaagtaataggaaaggtgcagatccaggttgctgacctgtcagagattccccgctgtaactgcaagccagctgatgaaaacccttgtggcttggaatcggagtgcctgaacagaatgttgcagtatgaatgccacccgcaggtgtgcccagctggagatcgttgtcagaaccagtgctttacaaagagactataccctgatgcagagatcatcaaaacggagcggagaggctggggcctcaggaccaaaaggagcattaagaagggtgaatttgtaaatgaatacgtcggtgaattaattgatgaagaagaatgcagattgcgaatcaagcgagcccacgagaacagtgtaactaatttttatatgttaactgttaccaaggaccgtataattgatgccggcccaaaaggaaattattctcgcttcatgaaccacagttgtaatcccaactgtgaaacacaaaagtggacagtgaatggagatgttcgagtgggactatttgctctctgtgatattcctgcagggatggagttaacatttaattataacctagattgtctgggcaacggcagaacggagtgccactgtggagcagataactgcagtggttttctaggagtgcggccaaagtcggcatgtgcgtcaacaaatgaagagaaggcaaaaaatgctaagttaaaacagaagagacgaaagatcaaaacagaaccaaagcagatgcatgaagattactgttttcaatgtggagatggtggagagctggtcatgtgtgacaaaaaagactgtcccaaagcataccacctcctatgccttaacctgactcagccaccatatggaaagtgggagtgtccgtggcatcagtgcgatgagtgcagcagtgcagctgtttccttctgtgaattctgtccacattcattttgtaaagatcatgaaaagggggccctggttccctctgcactggaaggccgcctctgctgctcggaacatgaccccatggctcctgtgtcaccagaatactggagcaagataaaatgtaaatgggaatcacaagatcatggagaagaagtaaaagaataaatgtgtggtgtcccctcctttctatttaagtgaaaaaagcaaatagatcatgcatttaaaaagaagagactgctacagtgcatacagcctttgccatcggaactgccttattaaagcaaaaatgggaaaccagttcatgcaggcagaagcagttggtggtgtctggtttttgtttgatttggttggtttgggattcttttgtggagggttaaattcccttggtcttttcttgccttttattgtgcttcagtgccattgcagcttgaaaaagaaatgtttttgctgttaaaataagaacaaagagaaaagtaagttttgttaatgagataaatttaaagtctaagatgtgttccttggttgtataaagcaaaagtagccatcattcctttatttattttcatttttaggaatttcaagaagtgtagttcaatagtctaatcaagtgtgtgtgtgttttaagtaggaatctgagaaagccctctaggaaagggtatgataagctttatatacctctttactgagcagtaggtaggctcacttctctttcccttcaaaatgcttttcataggcttagagaagggctctatggaagtattaaatctggcctcttgaaaacaa

SEQ ID NO: 200285 - DNA, 301 bp, Homo sapiens
  Payload ID: 19513
  Gene Name: Wolf-Hirschhorn syndrome candidate 1-like 1
  ENST ID: ENST00000534539
  CDS Start-End: 257-301
ttccttttcctctccgacatcagtatgaatctggaaggggccaattcagactgttagccccctttctttctattcatgaactcttttccccttacgtcttgggtcattttaaattattcataaccgccaaaggaggtagtgatgttttccatcactacctttttgatgcttttctccctctctttaccctcttccttctggttgcaaacaaggcccgatgagagaaagggaaagttaaggatgctggagcagaacaatggatttctctttctctttcatgcaagggatcatgggaaacaca

SEQ ID NO: 200286 - DNA, 577 bp, Homo sapiens
  Payload ID: 19513
  Gene Name: Wolf-Hirschhorn syndrome candidate 1-like 1
  ENST ID: ENST00000534155
  CDS Start-End: 502-577
cagcacggaggcggaggccgagggggctgtgcacaggtcgccgcggagaggcgtgcgaattccgagccgagcgccgaggaccgtgctacccaggccgggctgccagccgcaggctcctctctggcagcagcggcggcgcggcgacccccgtccctcggcctccccttcccatcccacctcccgagccttcctcttcccgcagcacgcccggcccggcccggccgtggccctcctcagtgccggccgccatggcagaggcgtccggcgcggggaaaatctagcccggggatttcatgcggcctagctcggttccgcctcctcctcgcgcggccccagcggctgcccgcaccccagccccactccgggcctccgtgtctctcctgtgatcgcactgacacggccggggggttagaatggaacaaactgaagggatgctcctgaaactgaagacaaccaagcccgatgagagaaagggaaagttaaggatgctggagcagaacaatggatttctctttctctttcatgcaagggatcatgggaaacacaattcagcaaccacctcaactcattgactccg

SEQ ID NO: 200287 - DNA, 4471 bp, Homo sapiens
  Payload ID: 19513
  Gene Name: Wolf-Hirschhorn syndrome candidate 1-like 1
  Uniprot ID: Q9BZ95
  ENST ID: ENST00000527502
  CDS Start-End: 93-4373
tgtgatcgcactgacacggccggggggttagaatggaacaaactgaaggcccgatgagagaaagggaaagttaaggatgctggagcagaacaatggatttctctttctctttcatgcaagggatcatgggaaacacaattcagcaaccacctcaactcattgactccgccaacatccgtcaggaggatgcctttgataacaacagtgacattgctgaagatggtggccagacaccatatgaagctactttgcagcaaggctttcagtacccagctacaacagaagatcttcctccactcacaaatgggtatccatcatcaatcagtgtgtatgaaactcaaaccaaataccagtcatataatcagtatcctaatgggtcagccaatggctttggtgcagttagaaactttagccccactgactattatcattcagaaattccaaacacaagaccacatgaaattctggaaaaaccttcccctccacagccaccacctcctccttcggtaccacaaactgtgattccaaagaagactggctcacctgaaattaaactaaaaataaccaaaactatccagaatggcagggaattgtttgagtcttccctttgtggagaccttttaaatgaagtacaggcaagtgagcacacgaaatcaaagcatgaaagcagaaaagaaaagaggaaaaaaagcaacaagcatgactcatcaagatctgaagagcgcaagtcacacaaaatccccaaattagaaccagaggaacaaaatagaccaaatgagagggttgacactgtatcagaaaaaccaagggaagaaccagtactaaaagaggaagccccagttcagccaatactatcttctgttccaacaacggaagtgtccactggtgttaagtttcaggttggcgatcttgtgtggtccaaggtgggaacctatccttggtggccttgtatggtttcaagtgatccccagcttgaggttcatactaaaattaacacaagaggtgcccgagaatatcatgtccagttttttagcaaccagccagagagggcgtgggttcatgaaaaacgggtacgagagtataaaggtcataaacagtatgaagaattactggctgaggcaaccaaacaagccagcaatcactctgagaaacaaaagattcggaaaccccgacctcagagagaacgtgctcagtgggatattggcattgcccatgcagagaaagcattgaaaatgactcgagaagaaagaatagaacagtatacttttatttacattgataaacagcctgaagaggctttatcccaagcaaaaaagagtgttgcctccaaaaccgaagttaaaaaaacccgacgaccaagatctgtgctgaatactcagccagaacagaccaatgcaggggaggtggcctcctcactctcaagtactgaaattcggagacatagccagaggcggcacacaagtgcggaagaggaagagccaccgcctgttaaaatagcctggaaaactgcggcagcaaggaaatccttaccagcttccattacgatgcacaaagggagcctggatttgcagaagtgtaacatgtctccagttgtgaaaattgaacaagtgtttgctcttcagaatgctacaggggatgggaaatttatcgatcaatttgtttattcaacaaagggaattggtaacaaaacagaaataagtgtcagggggcaagacaggcttataatttctacaccaaaccagagaaatgaaaagccaacgcagagtgtatcatctcctgaagcaacatctggttctacaggctcagtagaaaagaagcaacagagaagatcaattagaactcgttctgaatcagagaaatccactgaggttgtgccaaagaagaagatcaaaaaggagcaggttgaaacagttcctcaggctacagtgaagactggattacagaaaggtgccagcgagatttcagattcctgtaaacctctaaagaaaaggagtcgcgcctcaactgatgtagaaatgactagttcagcatacagagacacatctgactccgattctagaggactgagtgacctgcaggtaggctttggaaagcaagtagatagcccttcagctactgcagatgcagacgtttctgatgtgcagtccatggattcaagtttgtcgagaagaggcactggaatgagtaagaaggacactgtatgtcagatttgtgaaagctctggtgactctctgattccttgtgagggagagtgctgcaaacactttcacctggagtgcctgggattggcatcacttcctgatagcaagttcatctgcatggaatgtaaaactgggcagcacccatgtttttcgtgtaaagtgtctggtaaagatgtgaagcgttgttctgttggtgcttgtgggaaattttatcatgaagcctgtgtccgcaaattccccactgccatctttgaatcaaaaggattccgctgtcctcagcactgctgctctgcctgctctatggagaaagatatccacaaagcaagtaaaggccgcatgatgagatgtttaagatgtccagttgcctatcactctggagatgcttgcattgcggccggaagcatgttagtatcctcctacattctcatctgtagtaatcattccaaacggagcagtaattcttctgctgtaaatgtaggcttttgtttcgtttgtgccagagggctgatagttcaggaccattcagaccccatgttcagttcatatgcctataagtcccactacctactgaatgaatcaaatcgtgctgagttgatgaaattacctatgattccttcttcgtcagcttccaaaaagaaatgtgagaaaggtggaagattgctctgctgtgaatcgtgcccagcttccttccacccggaatgcctaagcatagaaatgccagaaggctgctggaattgtaatgactgtaaagctggcaagaaactacattacaagcagattgtttgggtcaaattgggaaattacagatggtggccagcagagatctgcaaccccaggtctgtgccactgaacatccagggccttaaacatgacttgggggacttccctgtattcttctttggttctcatgactactactgggtacaccagggcagagtgttcccttatgttgaaggagacaaaagctttgctgaagggcagactagtattaacaagaccttcaaaaaggcactggaagaagctgcaaaacgtttccaggaattgaaagcacaaagagaaagtaaagaagccctagagattgaaaaaaactcaagaaaaccccctccctacaaacacatcaaagctaacaaagtaataggaaaggtgcagatccaggttgctgacctgtcagagattccccgctgtaactgcaagccagctgatgaaaacccttgtggcttggaatcggagtgcctgaacagaatgttgcagtatgaatgccacccgcaggtgtgcccagctggagatcgttgtcagaaccagtgctttacaaagagactataccctgatgcagagatcatcaaaacggagcggagaggctggggcctcaggaccaaaaggagcattaagaagggtgaatttgtaaatgaatacgtcggtgaattaattgatgaagaagaatgcagattgcgaatcaagcgagcccacgagaacagtgaccgtataattgatgccggcccaaaaggaaattattctcgcttcatgaaccacagttgtaatcccaactgtgaaacacaaaagtggacagtgaatggagatgttcgagtgggactatttgctctctgtgatattcctgcagggatggagttaacatttaattataacctagattgtctgggcaacggcagaacggagtgccactgtggagcagataactgcagtggttttctaggagtgcggccaaagtcggcatgtgcgtcaacaaatgaagagaaggcaaaaaatgctaagttaaaacagaagagacgaaagatcaaaacagaaccaaagcagatgcatgaagattactgttttcaatgtggagatggtggagagctggtcatgtgtgacaaaaaagactgtcccaaagcataccacctcctatgccttaacctgactcagccaccatatggaaagtgggagtgtccgtggcatcagtgcgatgagtgcagcagtgcagctgtttccttctgtgaattctgtccacattcattttgtaaagatcatgaaaagggggccctggttccctctgcactggaaggccgcctctgctgctcggaacatgaccccatggctcctgtgtcaccagaatactggagcaagataaaatgtaaatgggaatcacaagatcatggagaagaagtaaaagaataaatgtgtggtgtcccctcctttctatttaagtgaaaaaagcaaatagatcatgcatttaaaaagaagagactgctacagtgcatacagcctttgccatc

SEQ ID NO: 200288 - DNA, 1524 bp, Homo sapiens
  Payload ID: 19513
  Gene Name: Wolf-Hirschhorn syndrome candidate 1-like 1
  ENST ID: ENST00000528627
  CDS Start-End: 1-234
ataagtgtcagggggcaagacaggcttataatttctacaccaaaccagagaaatgaaaagccaacgcagagtgtatcatctcctgaagcaacatctggttctacaggctcagtagaaaagaagcaacagagaagatcaattagaactcgttctgaatcagagaaatccactgaggttgtgccaaagaagaagatcaaaaaggagcaggttggcttcctacatgtagagagttaaaacattgtatttgtaaatgttgtggcttacattcctgtcttaaaagaaagagaaactttcccccacactgagtttcctttctggactatcttaacgcttctgtcctggtgggttccagtgctcagttttaatacagccatccctgtgattctgcttcaagcattttcacagaaaacaggtttcaggagatgggaagccagtggtgcaagacttaaaaaatccttcacatttatttagaagtttctgttatcagcagaatgatttcatgtttttatgatttttatttggaaccatcattgagttcctttttttttttttaagtttgatttttggtttaagctgctggtatatattgttttttattttttaaacaaatcaatttaatttatattcttatatttaagaagcagatattcatagatgatctgttttttctgttaatatcgcagattttttggaatgttattttcccagtggaatattcacctgatatcaggttgtcagataaataatatttaggtaaaaaaaggtgtgtgggggggttgcattttgactgaagtgtattaaaccagtgtaatcaatgtagtaagatacatttaaatcaacttttcaaataaaattttagaagccattcttctttaaattaaactcacaatcagattttttcttaatttttttgttaaagaatatccattcttacagcctaaacacctgctagcaaacaaaacaaattctgaatagaattagttccaataagttttatattttttaaaccatttatatggaagaatgtgagcttttctatttaaaatatttccttcatgattttaaacttccaaatttaaaagctaactttgtgggtgctctgtggtatcaccaagcaagtgaaacagtttttccagaatatttaactaaaatttaaatagtatactaatttgtcattcatttatcatattaactttcatatttcatacttaggaaattatattccaaaaaatctttctaagctcttgaaaatctatagttattcattaccaaaatgaagttgtgattttgccagctggttcccaaaatcagtctgtgaccagtcagttttaaactaataagcagaatgagtataaaaagtgggacaaattgttaatgccactgtgttatagttagtagtagaacaataccagtgattgtttagaagattttatatttgtattactaattgtatcttataaaagcgtttctgttgtatgtttttttacctgttgtaaaaaaaataaaattttttttaaaaagctt

SEQ ID NO: 200289 - DNA, 1032 bp, Homo sapiens
  Payload ID: 19513
  Gene Name: Wolf-Hirschhorn syndrome candidate 1-like 1
  ENST ID: ENST00000529223
  CDS Start-End: 187-1032
gtagtgctaggaagggctgaggagggaacgacggggagggggcgacctagggatggagcgccagaccccaggaggaatggaaggggaagcgggtggcctgaaagggctcgaggggagtcctgacggaggagcagatggcaaggcccgatgagagaaagggaaagttaaggatgctggagcagaacaatggatttctctttctctttcatgcaagggatcatgggaaacacaattcagcaaccacctcaactcattgactccgccaacatccgtcaggaggatgcctttgataacaacagtgacattgctgaagatggtggccagacaccatatgaagctactttgcagcaaggctttcagtacccagctacaacagaagatcttcctccactcacaaatgggtatccatcatcaatcagtgtgtatgaaactcaaaccaaataccagtcatataatcagtatcctaatgggtcagccaatggctttggtgcagttagaaactttagccccactgactattatcattcagaaattccaaacacaagaccacatgaaattctggaaaaaccttcccctccacagccaccacctcctccttcggtaccacaaactgtgattccaaagaagactggctcacctgaaattaaactaaaaataaccaaaactatccagaatggcagggaattgtttgagtcttccctttgtggagaccttttaaatgaagtacaggcaagtgagcacacgaaatcaaagcatgaaagcagaaaagaaaagaggaaaaaaagcaacaagcatgactcatcaagatctgaagagcgcaagtcacacaaaatccccaaattagaaccagaggaacaaaatagaccaaatgagagggttgacactgtatcagaaaaaccaagggaagaaccagtactaaaagaggaagccccagttcagccaatactatcttctgttccaacaacggaagtgtccactggtgttaagtttcaggttggcgatcttgtgtggtccaaggtgggaacctatcct

SEQ ID NO: 200290 - DNA, 3640 bp, Homo sapiens
  Payload ID: 19514
  Gene Name: Wolfram syndrome 1 (wolframin)
  Uniprot ID: O76024
  ENST ID: ENST00000226760
  CDS Start-End: 171-2843
gtgcagaaggccgcgctagccggctcttcagcagcgagtgcagattgctcccccgcggccgcagatctcccgtttgcgccgcgttcagctgctcccgaacaacttttctgccggcccagaggccccagggcgtcgcagcgccgcgtgcggcccactcacgggccggcaggatggactccaacactgctccgctgggcccctcctgcccacagcccccgccagcaccgcagccccaggcgcgttcccgactcaatgccacagcctcgttggagcaggagaggagcgaaaggccccgagcacccggaccccaggctggccctggccctggtgttagagacgcagcggcccccgctgaaccccaggcccagcataccaggagccgggaaagagcagacggcaccgggcctacaaagggagacatggaaatcccctttgaagaagtcctggagagggccaaggccggggaccccaaggcacagactgaggtggggaagcactacctgcagttggccggcgacacggatgaagaactcaacagctgcaccgctgtggactggctggtcctcgccgcgaagcagggccgtcgcgaggctgtgaagctgcttcgccggtgcttggcggacagaagaggcatcacgtccgagaacgaacgggaggtgaggcagctctcctccgagaccgacctggagagggccgtgcgcaaggcagccctggtcatgtactggaagctcaaccccaagaagaagaagcaggtggccgtggcggagctgctggagaatgtcggccaggtcaacgagcacgatggaggggcgcagccaggccccgtgcccaagtccctgcagaagcagaggcgcatgctggagcgcctggtcagcagcgagtccaagaactacatcgcgctggatgactttgtggagatcactaagaagtacgccaagggcgtcatccccagcagcctgttcctgcaggacgacgaagatgatgacgagctggcggggaagagccctgaggacctgccactgcgtctgaaggtggtcaagtaccccctgcacgccatcatggagatcaaggagtacctgattgacatggcctccagggcaggcatgcactggctgtccaccatcatccccacgcaccacatcaacgcgctcatcttcttcttcatcgtcagcaacctcaccatcgacttcttcgccttcttcatcccgctggtcatcttctacctgtccttcatctccatggtgatctgcaccctcaaggtgttccaggacagcaaggcctgggagaacttccgcaccctcaccgacctgctgctgcgcttcgagcccaacctggatgtggagcaggccgaggtcaacttcggctggaaccacctggagccctatgcccatttcctgctctctgtcttcttcgtcatcttctccttccccatcgccagcaaggactgcatcccctgctcggagctggctgtcatcaccggcttctttaccgtgaccagctacctgagcctgagcacccatgcagagccctacacgcgcagggccctggccaccgaggtcaccgccggcctgctatcgctgctgccctccatgcccttgaattggccctacctgaaggtccttggccagaccttcatcaccgtgcctgtcggccacctggtcgtcctcaacgtcagcgtcccgtgcctgctctatgtctacctgctctatctcttcttccgcatggcacagctgaggaatttcaagggcacctactgctaccttgtgccctacctggtgtgcttcatgtggtgtgagctctccgtggtcatcctgctggagtccaccggcctggggctgctccgcgcctccatcggctacttcctcttcctctttgccctccccatcctggtggccggcctggccctggtgggcgtgctgcagttcgcccggtggttcacgtctctggagctcaccaagatcgcagtcaccgtggcggtctgtagtgtgcccctgctgttgcgctggtggaccaaggccagcttctctgtggtggggatggtgaagtccctgacgcggagctccatggtcaagctcatcctggtgtggctcacggccatcgtgctgttctgctggttctatgtgtaccgctcagagggcatgaaggtctacaactccacactgacctggcagcagtatggtgcgctgtgcgggccacgcgcctggaaggagaccaacatggcgcgcacccagatcctctgcagccacctggagggccacagggtcacgtggaccggccgcttcaagtacgtccgcgtgactgacatcgacaacagcgccgagtctgccatcaacatgctcccgttcttcatcggcgactggatgcgctgcctctacggcgaggcctaccctgcctgcagccctggcaacacctccacggccgaggaggagctctgtcgccttaagctgctggccaagcacccctgccacatcaagaagttcgaccgctacaagtttgagattaccgtgggcatgccattcagcagcggcgctgacggctcgcgcagccgcgaggaggacgacgtcaccaaggacatcgtgctgcgggccagcagcgagttcaagagcgtgctgctcagcctgcgccagggcagcctcatcgagttcagcaccatcctggagggccgcctgggcagcaagtggcctgtcttcgagctcaaggccatcagctgcctcaactgcatggcccagctctcacccaccaggcggcacgtgaagatcgagcacgactggcgcagcaccgtgcatggcgccgtgaagttcgccttcgacttctttttcttcccattcctgtcggcggcctgaggatggtccgccacgaggagcttccagtgcatgttgccatgaggcctttccccagtgtggccccagcccgacaggcatgcaccagtgccgcctgtgcccacgtgtgcagactgtggctgcagagaccttgcgaccatgtgtagattgcgtggaccccgacaaagggaaggctgctgtgtagctctgtccactctgaataccaagtgtgttgggaattgcatgccatctccaccctgagcctgacctttctgagtgacatgggtgtgccaggctagactaggaggttccggtgtctggaaaagcactttacagatgagattccctctcctcccccaccttcaagcaccctgttccctctttctttcttttgtgttggatttgtttaaaaaccaaataagcatctgtgtaacctccacagtagcatttcttatttgtttggtcactgctacaccttagcagctcttcccctttcctgggggatgtgcacggcagcttgagcctgtcacgtggtcaaggcccggccccatcagaggctgggggaggcggcacattggcagtgtgtcacactgagctgggcaccacaggctgcctcatgaccctcctgtccagcaggtagtgggtgaatgtgtgaaggtcttgcctgaatccatcaggacttgggaaacagagaaccctgtgggggcggctgtgggggaggtccctgccagtgtttagaagagcctgactgtgttcagtgccttggagcagaaagccagggtcctgagtggctgaaataaaagcctctggtggaacctgca

SEQ ID NO: 200291 - DNA, 3255 bp, Homo sapiens
  Payload ID: 19514
  Gene Name: Wolfram syndrome 1 (wolframin)
  Uniprot ID: O76024
  ENST ID: ENST00000503569
  CDS Start-End: 168-2840
cgtgcagaaggccgcgctagccggctcttcagcagcgagtgcagattgctcccccgcggccgcagatctcccgtttgcgccgcgttcagctgctcccgaacaacttttctgccggcccagaggccccagggcgtcgcagcgccgcgtgcggcccactcacgggccggatggactccaacactgctccgctgggcccctcctgcccacagcccccgccagcaccgcagccccaggcgcgttcccgactcaatgccacagcctcgttggagcaggagaggagcgaaaggccccgagcacccggaccccaggctggccctggccctggtgttagagacgcagcggcccccgctgaaccccaggcccagcataccaggagccgggaaagagcagacggcaccgggcctacaaagggagacatggaaatcccctttgaagaagtcctggagagggccaaggccggggaccccaaggcacagactgaggtggggaagcactacctgcagttggccggcgacacggatgaagaactcaacagctgcaccgctgtggactggctggtcctcgccgcgaagcagggccgtcgcgaggctgtgaagctgcttcgccggtgcttggcggacagaagaggcatcacgtccgagaacgaacgggaggtgaggcagctctcctccgagaccgacctggagagggccgtgcgcaaggcagccctggtcatgtactggaagctcaaccccaagaagaagaagcaggtggccgtggcggagctgctggagaatgtcggccaggtcaacgagcacgatggaggggcgcagccaggccccgtgcccaagtccctgcagaagcagaggcgcatgctggagcgcctggtcagcagcgagtccaagaactacatcgcgctggatgactttgtggagatcactaagaagtacgccaagggcgtcatccccagcagcctgttcctgcaggacgacgaagatgatgacgagctggcggggaagagccctgaggacctgccactgcgtctgaaggtggtcaagtaccccctgcacgccatcatggagatcaaggagtacctgattgacatggcctccagggcaggcatgcactggctgtccaccatcatccccacgcaccacatcaacgcgctcatcttcttcttcatcgtcagcaacctcaccatcgacttcttcgccttcttcatcccgctggtcatcttctacctgtccttcatctccatggtgatctgcaccctcaaggtgttccaggacagcaaggcctgggagaacttccgcaccctcaccgacctgctgctgcgcttcgagcccaacctggatgtggagcaggccgaggtcaacttcggctggaaccacctggagccctatgcccatttcctgctctctgtcttcttcgtcatcttctccttccccatcgccagcaaggactgcatcccctgctcggagctggctgtcatcaccggcttctttaccgtgaccagctacctgagcctgagcacccatgcagagccctacacgcgcagggccctggccaccgaggtcaccgccggcctgctatcgctgctgccctccatgcccttgaattggccctacctgaaggtccttggccagaccttcatcaccgtgcctgtcggccacctggtcgtcctcaacgtcagcgtcccgtgcctgctctatgtctacctgctctatctcttcttccgcatggcacagctgaggaatttcaagggcacctactgctaccttgtgccctacctggtgtgcttcatgtggtgtgagctctccgtggtcatcctgctggagtccaccggcctggggctgctccgcgcctccatcggctacttcctcttcctctttgccctccccatcctggtggccggcctggccctggtgggcgtgctgcagttcgcccggtggttcacgtctctggagctcaccaagatcgcagtcaccgtggcggtctgtagtgtgcccctgctgttgcgctggtggaccaaggccagcttctctgtggtggggatggtgaagtccctgacgcggagctccatggtcaagctcatcctggtgtggctcacggccatcgtgctgttctgctggttctatgtgtaccgctcagagggcatgaaggtctacaactccacactgacctggcagcagtatggtgcgctgtgcgggccacgcgcctggaaggagaccaacatggcgcgcacccagatcctctgcagccacctggagggccacagggtcacgtggaccggccgcttcaagtacgtccgcgtgactgacatcgacaacagcgccgagtctgccatcaacatgctcccgttcttcatcggcgactggatgcgctgcctctacggcgaggcctaccctgcctgcagccctggcaacacctccacggccgaggaggagctctgtcgccttaagctgctggccaagcacccctgccacatcaagaagttcgaccgctacaagtttgagattaccgtgggcatgccattcagcagcggcgctgacggctcgcgcagccgcgaggaggacgacgtcaccaaggacatcgtgctgcgggccagcagcgagttcaagagcgtgctgctcagcctgcgccagggcagcctcatcgagttcagcaccatcctggagggccgcctgggcagcaagtggcctgtcttcgagctcaaggccatcagctgcctcaactgcatggcccagctctcacccaccaggcggcacgtgaagatcgagcacgactggcgcagcaccgtgcatggcgccgtgaagttcgccttcgacttctttttcttcccattcctgtcggcggcctgaggatggtccgccacgaggagcttccagtgcatgttgccatgaggcctttccccagtgtggccccagcccgacaggcatgcaccagtgccgcctgtgcccacgtgtgcagactgtggctgcagagaccttgcgaccatgtgtagattgcgtggaccccgacaaagggaaggctgctgtgtagctctgtccactctgaataccaagtgtgttgggaattgcatgccatctccaccctgagcctgacctttctgagtgacatgggtgtgccaggctagactaggaggttccggtgtctggaaaagcactttacagatgagattccctctcctcccccaccttcaagcaccctgttccctctttctttcttttgtgttggatttgtttaaaaaccaaataagcatctgtgtaacctcca

SEQ ID NO: 200292 - DNA, 755 bp, Homo sapiens
  Payload ID: 19514
  Gene Name: Wolfram syndrome 1 (wolframin)
  ENST ID: ENST00000506362
  CDS Start-End: 1-755
agcagggccgtcgcgaggctgtgaagctgcttcgccggtgcttggcggacagaagaggcatcacgtccgagaacgaacgggaggtgaggcagctctcctccgagaccgacctggagagggccgtgcgcaaggcagccctggtcatgtactggaagctcaaccccaagaagaagaagcaggtggccgtggcggagctgctggagaatgtcggccaggtcaacgagcacgatggaggggcgcagccaggccccgtgcccaagtccctgcagaagcagaggcgcatgctggagcgcctggtcagcagcgagttgtggggcgcccatgctgttttctctcatgcttcagccaagaactacatcgcgctggatgactttgtggagatcactaagaagtacgccaagggcgtcatccccagcagcctgttcctgcaggacgacgaagatgatgacgagctggcggggaagagccctgaggacctgccactgcgtctgaaggtggtcaagtaccccctgcacgccatcatggagatcaaggagtacctgattgacatggcctccagggcaggcatgcactggctgtccaccatcatccccacgcaccacatcaacgcgctcatcttcttcttcatcgtcagcaacctcaccatcgacttcttcgccttcttcatcccgctggtcatcttctacctgtccttcatctccatggtgatctgcaccctcaaggtgttccaggacagcaaggcctgggagaacttc

SEQ ID NO: 200293 - DNA, 5819 bp, Homo sapiens
  Payload ID: 19515
  Gene Name: WSC domain containing 1
  Uniprot ID: Q658N2
  ENST ID: ENST00000317744
  CDS Start-End: 328-2055
ggcgcgggtgcgggcgccccagccggccgcgatcgcgggatttctgcgccaggagatgaggggcggtagagccctggaatggagatgtccttgacgcctgggcagaggctgcagctgcaggaccctgtggccactggagataagtaatggtgccatttgaacacctactggaaacggggcaggaacagtgagtgaccccaggcgagcacaggcaggtgccaggagccaggatgcaaggatgacgcctccggaggccctggcctcactcccacctgggcgctaggagccatcccggggctccagccaggagccctgctgcccaggggcatggccaaacctttcttccgactccagaagtttctccgccgaacacagttcctgctgttcttcctcacggctgcctacctgatgaccggcagcctgctgctgctgcagcgggtccgcgtggctctcccacagggcccccgggcacccggccccctgcagaccttgccagtggccgccgtggcgctgggcgtgggcttgctggacagcagagccctgcacgaccctcgagtcagcccagagctgctgctgggtgtggacatgctgcagagccccctgacccggccccggcccggcccccgctggctccggagccgcaactcggagctgcgtcagttgcgtcgccgctggttccaccacttcatgagtgactcccagggaccgcccgccctgggccccgaggctgccaggcccgccatccacagccgaggcacctacattggatgcttcagtgacgatggccacgagaggactctgaaaggagctgtgttttatgacttgagaaagatgactgtctcccactgccaggatgcgtgtgctgagcggtcctatgtctacgccggcttggaggccggggcggagtgttactgcgggaaccggctgccagcggtgagcgtggggctggaagagtgtaaccatgagtgcaaaggcgagaagggctctgtgtgcggggctgtggaccggctctccgtgtaccgtgtggacgagctgcagccgggctccaggaagcggcggaccgccacctaccgcggatgcttccgactgccagagaacatcacacatgccttccccagctccctgatacaggccaatgtgaccgtggggacttgctcgggcttttgttcccagaaagagttccccttggccattctcaggggctgggaatgctactgtgcttaccctaccccccggttcaacctgcgggatgccatggacagctcagtatgtggccaggaccctgaggcacagaggctggcagaatactgtgaggtctaccagacacctgtgcaagacactcgttgtacagacaggaggttcctgcctaacaaatccaaagtgtttgtggctttgtcaagcttcccaggagccgggaacacatgggcacggcacctcattgagcatgccactggcttctatacagggagctactactttgatggaaccctctacaacaaagggttcaagggcgaaaaggaccactggcggagccgacgcaccatctgtgtcaaaacccacgagagtggcaggagggagattgagatgtttgattcagccatcctgctaatccggaacccatacaggtccctggtggcagaattcaacagaaaatgtgccgggcacctgggatatgcagctgaccgcaactggaagagcaaagagtggccggactttgtcaacagctacgcctcgtggtggtcctcgcacgtcctggactggctcaagtacgggaagcggctgctggtggtgcactacgaggagctgcggcgcagcctggtgcccacgttacgggagatggtggccttcctcaacgtgtctgtgagcgaggagcggctgctctgcgtggagaacaacaaggagggcagcttccggcggcgcggccggcgctcccacgaccctgagcccttcaccccggagatgaaagacttgatcaatggctacatccggacggtggaccaagccctgcgtgaccacaactggacggggctgcccagggagtatgtgcccagatgataggcctggcccacgccgccgcccccgctgagtgacgcaatcgcaccacggggctgcgctccccactctgatgctcaggcccgtggcctcactgggacgaacggtgggtggggggctcaccctggtgctgcctcccgcacaaggagacctggacacaacagacacacatcacaaggcgaacacaaatggacacacatacctggccacgaacccacacctcctcagacactcagacaccactccaggctcatagccccgtcttgatgcagagaagccacccacgtggggtgtgccaggcacccccagatacaaatgcagccacgcacagacgtaacacacaggtgccaggccgtgtgctcctggaggctggctggctgtctctctcacacagatacacgtgcgctccctgggatccgggaggccctgggcttcctgtgtgtagccctggcatagacttgctcgtcagggtgttcgactctgggatgctgggccgggcagacatttatgctctgagcagcaaggaccattgggatggaggtgggcacaaagactgctgcttccagggtgtgcggccctggccgtgtgtctgacatcccataaatgtgtgtgtggtgtgactacgggcaccacaaactccgcagccttgcctctcttttctctgtggctgggctggctgcaccatgggcagggttgaggactgccccccaccccgcccaagccaatgcagacactgacctcaagaccagccacaccaagtctgtgcactgcccaccacccccttcaacccctcctacaccatgctccggggcctggggcctccttgcctggcttcttcctccagctatcctcagggaagctggagattcaagtcatgccccagaagcaaggtgtaagcatgggggcgtggggaagagggcaggagctgaagttccaggggagcccaggacccctggggacctgtacactagcaggatgggtcttgggagttggcatggggagattgtaagggctgtatctccgcgattactggtactggtgctccacccataggggccctgttctctctggggtcccacactggggtcatgagagctagttagtactcagcctgacccctaggtctggtcctgccagcctgggatgggggtcaatgtatgctacacatcttgggctcacaagtgaggctgtggaggccaggaggttcaagtatggagggtaggagtgcaacccaggagcaacgctcaaggtggccgagatgcagggaggattgtggcgatccggttgcacactggcctctgtggaggtcagggaggtgggaaggtgggtgggcctgaactcaggcagcccttcagtggcttcttcaggcctaggataaccctggccaggccccatggtcctgctctgggtcagctgtcagggagacctcccttcagcctgagccaagctgcattgggaggagaaggcagggtgagggatctgggagagcaggacgttgagatatcctgaccctctgcttcctagcctgatgatggggaacccagagccacccgctatgagcacaggccgggggtggaaggcccagtagagctgcccttccccagatggaagcttcctccaaccttcagtttggccagtgggtgggtttgggcatctgtgcccctggtggcctccaaatccttcctgggattcccccaaacccacactgatgcgaagctgttcttgaccctcccatagcatcaactcagttcagctcaaagctagaaacaccaaggtctttgaaaatgtttattggctcaggatagcttcggcatccaatctgcgaaggcccctgatggagctatttcttcctagtatcaggagcaattgagacccctcaggagtttccacactgctgtggacgggatagccagggcagacctgcatcccagagcaagcctagatccttgaaagcaatgtcaggcgtggcagtggggaagccatggaggctgggaagggcaaagtgtggagagaggagtgaccgggactggagccagggtctggggagagcaacagcaccaggcttttcctggtagttggattggtacattcactgctgccaggtacccagagatgtcatctctctccaggtagagcatcaccagctcctgtggccttgtagatgactctgtacctcagtgaagagtgcaggcaagtagagtgatggggtcagtgtccatccagtttacgctgagtcagtccatacagcaagacacctggcacttggcaggtactcctggatgttgatgagcaaggaagagcaacggccctgtcagctggcagtggtcctcacagccttcatcccaggtctgcctacgtgggagatctcatcagaaacaggaacggggatctgtctgtgcttgcaggaaagtccatttgtttttctccaagttaggtctcatctacagctcttagcttctcagtaaagaggatactctcccaaccagccaaggaataaaagctgatctgtatgtagggcagaagtgtggcaaatgcatcaggaaccggttagaacagaacagagaaaccctgactgtctacagattccaactttaatagcaagcctgtggagttacacaaacctgtgttaaaacatgtaatttttatggatttcatctcccgttgtggatcaatttggaaaaaccaaaatatgtaattttaaaaaactaaaacacatcctggtagtcccagtgatgtgtaaatgagagagaagaatagacaggcttccaaaccctgggaagaaagctgcttaattatgtgaacatcttataatgaagtctcttgcagctaaaattagattttgagtgcatgaatctgtgataatgtttgcatatcagaatgcattctccccttaaaagtagcagtagccacttggttcttagggggccccaagaggagaggagaagtgctgaggttgatgttacgactgcaagaattcttgggacacaggtttgttttctgctgacttgctcggaaacccattggaggtatctgaaatgtgatgactccaaaggggttcatttcactatagggagaaattgattcgtctgacttcctatttatcaccactcaatattgggtgagttggtctgaacaaggtggggataaagtagagtggaaataatgtagagtcgtcagactgaaaggccaggttgtagtcccagctcttatctgccatcttggacaaagcttttcccatctccagtctcagtttcccatccataaaatgggggaagtggtaggtcttgctgattgcatccacattcattcctccatttcctttcccagcaaccccccatttctgtttgggaattcatatgatctgccagagcctctccaggggtggaatacatgtcctggactaagccaatgacaccttccatctttccagctatggtgactgggttaggtatgatcttgtgagttaagacaatgaagccagagggaatttcaagacttatgggaatgctgggtagaagctgttttaattcccctgttgaatgtgaaaaaggtagtagtattcctgggtctttatgatgaccaccttgggccttgggatcatgaccaggaatcacgtgaagctgacaccactgaagggagagttgagaggcagaaagagatcaagtccttggtgaaattgtttaagtacaggatcaagccttgcttgagattggccttacctctggactttttttgttatatgagctaataaattctgtttattgttt

SEQ ID NO: 200294 - DNA, 2665 bp, Homo sapiens
  Payload ID: 19515
  Gene Name: WSC domain containing 1
  Uniprot ID: Q658N2
  ENST ID: ENST00000539421
  CDS Start-End: 353-2080
ggtcagcggagggtttgctccgtctcttggtgaacttgaacagaggcagaggcaaaagcaaaacatttctgcgccaggagatgaggggcggtagagccctggaatggagatgtccttgacgcctgggcagaggctgcagctgcaggaccctgtggccactggagataagtaatggtgccatttgaacacctactggaaacggggcaggaacagtgagtgaccccaggcgagcacaggcaggtgccaggagccaggatgcaaggatgacgcctccggaggccctggcctcactcccacctgggcgctaggagccatcccggggctccagccaggagccctgctgcccaggggcatggccaaacctttcttccgactccagaagtttctccgccgaacacagttcctgctgttcttcctcacggctgcctacctgatgaccggcagcctgctgctgctgcagcgggtccgcgtggctctcccacagggcccccgggcacccggccccctgcagaccttgccagtggccgccgtggcgctgggcgtgggcttgctggacagcagagccctgcacgaccctcgagtcagcccagagctgctgctgggtgtggacatgctgcagagccccctgacccggccccggcccggcccccgctggctccggagccgcaactcggagctgcgtcagttgcgtcgccgctggttccaccacttcatgagtgactcccagggaccgcccgccctgggccccgaggctgccaggcccgccatccacagccgaggcacctacattggatgcttcagtgacgatggccacgagaggactctgaaaggagctgtgttttatgacttgagaaagatgactgtctcccactgccaggatgcgtgtgctgagcggtcctatgtctacgccggcttggaggccggggcggagtgttactgcgggaaccggctgccagcggtgagcgtggggctggaagagtgtaaccatgagtgcaaaggcgagaagggctctgtgtgcggggctgtggaccggctctccgtgtaccgtgtggacgagctgcagccgggctccaggaagcggcggaccgccacctaccgcggatgcttccgactgccagagaacatcacacatgccttccccagctccctgatacaggccaatgtgaccgtggggacttgctcgggcttttgttcccagaaagagttccccttggccattctcaggggctgggaatgctactgtgcttaccctaccccccggttcaacctgcgggatgccatggacagctcagtatgtggccaggaccctgaggcacagaggctggcagaatactgtgaggtctaccagacacctgtgcaagacactcgttgtacagacaggaggttcctgcctaacaaatccaaagtgtttgtggctttgtcaagcttcccaggagccgggaacacatgggcacggcacctcattgagcatgccactggcttctatacagggagctactactttgatggaaccctctacaacaaagggttcaagggcgaaaaggaccactggcggagccgacgcaccatctgtgtcaaaacccacgagagtggcaggagggagattgagatgtttgattcagccatcctgctaatccggaacccatacaggtccctggtggcagaattcaacagaaaatgtgccgggcacctgggatatgcagctgaccgcaactggaagagcaaagagtggccggactttgtcaacagctacgcctcgtggtggtcctcgcacgtcctggactggctcaagtacgggaagcggctgctggtggtgcactacgaggagctgcggcgcagcctggtgcccacgttacgggagatggtggccttcctcaacgtgtctgtgagcgaggagcggctgctctgcgtggagaacaacaaggagggcagcttccggcggcgcggccggcgctcccacgaccctgagcccttcaccccggagatgaaagacttgatcaatggctacatccggacggtggaccaagccctgcgtgaccacaactggacggggctgcccagggagtatgtgcccagatgataggcctggcccacgccgccgcccccgctgagtgacgcaatcgcaccacggggctgcgctccccactctgatgctcaggcccgcacaaggagacctggacacaacagacacacatcacaaggcgaacacaaatggacacacatacctggccacgaacccacacctcctcagacactcagacaccactccaggctcatagccccgtcttgatgcagagaagccacccacgtggggtgtgccaggcacccccagatacaaatgcagccacgcacagacgtaacacacaggtgccaggccgtgtgctcctggaggctggctggctgtctctctcacacagatacacgtgcgctccctgggatccgggaggccctgggcttcctgtgtgtagccctggcatagacttgctcgtcagggtgttcgactctgggatgctgggccgggcagacatttatgctctgagcagcaaggaccattgggatggaggtgggcacaaagactgctgcttccagggtgtgcggccctggccgtgtgtctgacatcccataaatgtgtgtgtggtgtgactacgggcaccacaaactccgc

SEQ ID NO: 200295 - DNA, 2168 bp, Homo sapiens
  Payload ID: 19515
  Gene Name: WSC domain containing 1
  ENST ID: ENST00000571494
  CDS Start-End: 1-410
ccggcagcctgctgctgctgcagcgggtccgcgtggctctcccacagggcccccgggcacccggccccctgcagaccttgccagtggccgccgtggcgctgggcgtgggcttgctggacagcagagccctgcacgaccctcgagtcagcccagagctgctgctgggtgtggacatgctgcagagccccctgacccggccccggcccggcccccgctggctccggagccgcaactcggagctgcgtcagttgcgtcgccgctggttccaccacttcatgagtgactcccagggaccgcccgccctgggccccgaggctgccaggcccgccatccacagccgaggtcctatgtctacgccggcttggaggccggggcggagtgttactgcgggaaccggctgccagcggtgagcgtggggctggaagagtgtaaccatgagtgcaaaggcgagaagggctctgtgtgcggggctgtggaccggctctccgtgtaccgtgtggacgagctgcagccgggctccaggaagcggcggaccgccacctaccgcggatgcttccgactgccagagaacatcacacatgccttccccagctccctgatacaggccaatgtgaccgtggggacttgctcgggcttttgttcccagaaagagttccccttggccattctcaggggctgggaatgctactgtgcttaccctaccccccggttcaacctgcgggatgccatggacagctcagtatgtggccaggaccctgaggcacagaggctggcagaatactgtgaggtctaccagacacctgtgcaagacactcgttgtacagacaggaggttcctgcctaacaaatccaaagtgtttgtggctttgtcaagcttcccaggagccgggaacacatgggcacggcacctcattgagcatgccactggcttctatacagggagctactactttgatggaaccctctacaacaaagggttcaagggcgaaaaggaccactggcggagccgacgcaccatctgtgtcaaaacccacgagagtggcaggagggagattgagatgtttgattcagccatcctgctaatccggaacccatacaggtccctggtggcagaattcaacagaaaatgtgccgggcacctgggatatgcagctgaccgcaactggaagagcaaagagtggccggactttgtcaacagctacgcctcgtggtggtcctcgcacgtcctggactggctcaagtacgggaagcggctgctggtggtgcactacgaggagctgcggcgcagcctggtgcccacgttacgggagatggtggccttcctcaacgtgtctgtgagcgaggagcggctgctctgcgtggagaacaacaaggagggcagcttccggcggcgcggccggcgctcccacgaccctgagcccttcaccccggagatgaaagacttgatcaatggctacatccggacggtggaccaagccctgcgtgaccacaactggacggggctgcccagggagtatgtgcccagatgataggcctggcccacgccgccgcccccgctgagtgacgcaatcgcaccacggggctgcgctccccactctgatgctcaggcccgtggcctcactgggacgaacggtgggtggggggctcaccctggtgctgcctcccgcacaaggagacctggacacaacagacacacatcacaaggcgaacacaaatggacacacatacctggccacgaacccacacctcctcagacactcagacaccactccaggctcatagccccgtcttgatgcagagaagccacccacgtggggtgtgccaggcacccccagatacaaatgcagccacgcacagacgtaacacacaggtgccaggccgtgtgctcctggaggctggctggctgtctctctcacacagatacacgtgcgctccctgggatccgggaggccctgggcttcctgtgtgtagccctggcatagacttgctcgtcagggtgttcgactctgggatgctgggccgggcagacatttatgctctgagcagcaaggaccattgggatggaggtgggcacaaagactgctgcttccagggtgtgcggccctggccgtgtgtctgacatcccataaatgtgtgtgtggtgtgactacgggcaccacaaactccgca

SEQ ID NO: 200296 - DNA, 2129 bp, Homo sapiens
  Payload ID: 19515
  Gene Name: WSC domain containing 1
  Uniprot ID: Q658N2
  ENST ID: ENST00000574232
  CDS Start-End: 353-2080
ggtcagcggagggtttgctccgtctcttggtgaacttgaacagaggcagaggcaaaagcaaaacatttctgcgccaggagatgaggggcggtagagccctggaatggagatgtccttgacgcctgggcagaggctgcagctgcaggaccctgtggccactggagataagtaatggtgccatttgaacacctactggaaacggggcaggaacagtgagtgaccccaggcgagcacaggcaggtgccaggagccaggatgcaaggatgacgcctccggaggccctggcctcactcccacctgggcgctaggagccatcccggggctccagccaggagccctgctgcccaggggcatggccaaacctttcttccgactccagaagtttctccgccgaacacagttcctgctgttcttcctcacggctgcctacctgatgaccggcagcctgctgctgctgcagcgggtccgcgtggctctcccacagggcccccgggcacccggccccctgcagaccttgccagtggccgccgtggcgctgggcgtgggcttgctggacagcagagccctgcacgaccctcgagtcagcccagagctgctgctgggtgtggacatgctgcagagccccctgacccggccccggcccggcccccgctggctccggagccgcaactcggagctgcgtcagttgcgtcgccgctggttccaccacttcatgagtgactcccagggaccgcccgccctgggccccgaggctgccaggcccgccatccacagccgaggcacctacattggatgcttcagtgacgatggccacgagaggactctgaaaggagctgtgttttatgacttgagaaagatgactgtctcccactgccaggatgcgtgtgctgagcggtcctatgtctacgccggcttggaggccggggcggagtgttactgcgggaaccggctgccagcggtgagcgtggggctggaagagtgtaaccatgagtgcaaaggcgagaagggctctgtgtgcggggctgtggaccggctctccgtgtaccgtgtggacgagctgcagccgggctccaggaagcggcggaccgccacctaccgcggatgcttccgactgccagagaacatcacacatgccttccccagctccctgatacaggccaatgtgaccgtggggacttgctcgggcttttgttcccagaaagagttccccttggccattctcaggggctgggaatgctactgtgcttaccctaccccccggttcaacctgcgggatgccatggacagctcagtatgtggccaggaccctgaggcacagaggctggcagaatactgtgaggtctaccagacacctgtgcaagacactcgttgtacagacaggaggttcctgcctaacaaatccaaagtgtttgtggctttgtcaagcttcccaggagccgggaacacatgggcacggcacctcattgagcatgccactggcttctatacagggagctactactttgatggaaccctctacaacaaagggttcaagggcgaaaaggaccactggcggagccgacgcaccatctgtgtcaaaacccacgagagtggcaggagggagattgagatgtttgattcagccatcctgctaatccggaacccatacaggtccctggtggcagaattcaacagaaaatgtgccgggcacctgggatatgcagctgaccgcaactggaagagcaaagagtggccggactttgtcaacagctacgcctcgtggtggtcctcgcacgtcctggactggctcaagtacgggaagcggctgctggtggtgcactacgaggagctgcggcgcagcctggtgcccacgttacgggagatggtggccttcctcaacgtgtctgtgagcgaggagcggctgctctgcgtggagaacaacaaggagggcagcttccggcggcgcggccggcgctcccacgaccctgagcccttcaccccggagatgaaagacttgatcaatggctacatccggacggtggaccaagccctgcgtgaccacaactggacggggctgcccagggagtatgtgcccagatgataggcctggcccacgccgccgcccccgctgagtgacgcaatcgcaccac

SEQ ID NO: 200297 - DNA, 677 bp, Homo sapiens
  Payload ID: 19515
  Gene Name: WSC domain containing 1
  ENST ID: ENST00000571973
  CDS Start-End: 416-677
actcttgttaactccatgcgtctgaaagccctcagctccgttaagctgtgttcctggaccgcctgggggcctgtgcctatgcactgctccatctctcccatgtttcaggcttcatccatggctctggatttctgcgccaggagatgaggggcggtagagccctggaatggagatgtccttgacgcctgggcagaggctgcagctgcaggaccctgtggccactggagataagtaatggtgccatttgaacacctactggaaacggggcaggaacagtgagtgaccccaggcgagcacaggcaggtgccaggagccaggatgcaaggatgacgcctccggaggccctggcctcactcccacctgggcgctaggagccatcccggggctccagccaggagccctgctgcccaggggcatggccaaacctttcttccgactccagaagtttctccgccgaacacagttcctgctgttcttcctcacggctgcctacctgatgaccggcagcctgctgctgctgcagcgggtccgcgtggctctcccacagggcccccgggcacccggccccctgcagaccttgccagtggccgccgtggcgctgggcgtgggcttgctggacagcagagccctgcacgaccctcgagtcagcccagagctgctgctgggtgtggacatgc

SEQ ID NO: 200298 - DNA, 1059 bp, Homo sapiens
  Payload ID: 19515
  Gene Name: WSC domain containing 1
  ENST ID: ENST00000576083
  CDS Start-End: 518-1059
cgcgcccgcccgcccgccccgccgttcagcccggacgccagcagccccggggagccaggcggcggcgccctgtgcccgggcgcgtgggtccgcttgccgcgggcggccggagacgtgcgggcgccggggcttctgggctccgggcactgcggggggctgcgggctcggcgcccggggaaggcgggccatgggcgcgggtgcgggcgccccagccggccgcgatcgcgggatttctgcgccaggagatgaggggcggtagagccctggaatggagatgtccttgacgcctgggcagaggctgcagctgcaggaccctgtggccactggagataagtaatggtgccatttgaacacctactggaaacggggcaggaacagtgagtgaccccaggcgagcacaggcaggtgccaggagccaggatgcaaggatgacgcctccggaggccctggcctcactcccacctgggcgctaggagccatcccggggctccagccaggagccctgctgcccaggggcatggccaaacctttcttccgactccagaagtttctccgccgaacacagttcctgctgttcttcctcacggctgcctacctgatgaccggcagcctgctgctgctgcagcgggtccgcgtggctctcccacagggcccccgggcacccggccccctgcagaccttgccagtggccgccgtggcgctgggcgtgggcttgctggacagcagagccctgcacgaccctcgagtcagcccagagctgctgctgggtgtggacatgctgcagagccccctgacccggccccggcccggcccccgctggctccggagccgcaactcggagctgcgtcagttgcgtcgccgctggttccaccacttcatgagtgactcccagggaccgcccgccctgggccccgaggctgccaggcccgccatccacagccgaggcacctacattggatgcttcagtgacgatggccacgagaggactctgaaaggagctgtgttttatgacttgagaaagatgactgtctcccactgccaggatgcgtgtgctgagcg

SEQ ID NO: 200299 - DNA, 1573 bp, Homo sapiens
  Payload ID: 19515
  Gene Name: WSC domain containing 1
  ENST ID: ENST00000573634
  CDS Start-End: 117-1496
ttttaggaagacggagtaagaggcaccaccacctgctcctgctgcctctgctgtcctcagcttctgggagcatcttagcagccagctccgggtgaggacagggtccaccggtgcacatggcagagcagggcagatgctgtgacttggcggctttgggggaacagggtggggctcctccctgggaaaaatctttaggcacctacattggatgcttcagtgacgatggccacgagaggactctgaaaggagctgtgttttatgacttgagaaagatgactgtctcccactgccaggatgcgtgtgctgagcggtcctatgtctacgccggcttggaggccggggcggagtgttactgcgggaaccggctgccagcggtgagcgtggggctggaagagtgtaaccatgagtgcaaaggcgagaagggctctgtgtgcggggctgtggaccggctctccgtgtaccgtgtggacgagctgcagccgggctccaggaagcggcggaccgccacctaccgcggatgcttccgactgccagagaacatcacacatgccttccccagctccctgatacaggccaatgtgaccgtggggacttgctcgggcttttgttcccagaaagagttccccttggccattctcaggggctgggaatgctactgtgcttaccctaccccccggttcaacctgcgggatgccatggacagctcagtatgtggccaggaccctgaggcacagaggctggcagaatactgtgaggtctaccagacacctgtgcaagacactcgttgtacagacaggaggttcctgcctaacaaatccaaagtgtttgtggctttgtcaagcttcccaggagccgggaacacatgggcacggcacctcattgagcatgccactggcttctatacagggagctactactttgatggaaccctctacaacaaagggttcaagggcgaaaaggaccactggcggagccgacgcaccatctgtgtcaaaacccacgagagtggcaggagggagattgagatgtttgattcagccatcctgctaatccggaacccatacaggtccctggtggcagaattcaacagaaaatgtgccgggcacctgggatatgcagctgaccgcaactggaagagcaaagagtggccggactttgtcaacagctacgcctcgtggtggtcctcgcacgtcctggactggctcaagtacgggaagcggctgctggtggtgcactacgaggagctgcggcgcagcctggtgcccacgttacgggagatggtggccttcctcaacgtgtctgtgagcgaggagcggctgctctgcgtggagaacaacaaggagggcagcttccggcggcgcggccggcgctcccacgaccctgagcccttcaccccggagatgaaagacttgatcaatggctacatccggacggtggaccaagccctgcgtgaccacaactggacggggctgcccagggagtatgtgcccagatgataggcctggcccacgccgccgcccccgctgagtgacgcaatcgcaccacggggctgcgctccccactctgatgctca

SEQ ID NO: 200300 - DNA, 494 bp, Homo sapiens
  Payload ID: 19515
  Gene Name: WSC domain containing 1
  ENST ID: ENST00000576947
  CDS Start-End: 416-494
aagtgcaaattctcagattctcccggagttgcctagtcaggaactctggggtaggggccagcaggctttgtatttaacgctgtctccagctgaaaggaataaatccgcctcagagtgggtcccagtgtatccctcggaagttctttctttcctgaacattctcgcctctgtcggggagttagaaaagctgttcattctgcgtccagataaaagagctcgcctcctcttttatccccgtcgcacactgagacggggccagccaggcccgggctcgccctccacgccggtgagctccatcaaatggccagctggtcacagccatgcttccctttctgcaggcacctacattggatgcttcagtgacgatggccacgagaggactctgaaaggagctgtgttttatgacttgagaaagatgactgtctcccactgccaggatgcgtgtgctgagcggtcctatgtctacgccggcttggaggccggggcggagtgtt

SEQ ID NO: 200301 - DNA, 5884 bp, Homo sapiens
  Payload ID: 19515
  Gene Name: WSC domain containing 1
  Uniprot ID: Q658N2
  ENST ID: ENST00000574946
  CDS Start-End: 391-2118
atgaaactcccttttaggaagacggagtaagaggcaccaccacctgctcctgctgcctctgctgtcctcagcttctgggagcatcttagcagccagctccggatttctgcgccaggagatgaggggcggtagagccctggaatggagatgtccttgacgcctgggcagaggctgcagctgcaggaccctgtggccactggagataagtaatggtgccatttgaacacctactggaaacggggcaggaacagtgagtgaccccaggcgagcacaggcaggtgccaggagccaggatgcaaggatgacgcctccggaggccctggcctcactcccacctgggcgctaggagccatcccggggctccagccaggagccctgctgcccaggggcatggccaaacctttcttccgactccagaagtttctccgccgaacacagttcctgctgttcttcctcacggctgcctacctgatgaccggcagcctgctgctgctgcagcgggtccgcgtggctctcccacagggcccccgggcacccggccccctgcagaccttgccagtggccgccgtggcgctgggcgtgggcttgctggacagcagagccctgcacgaccctcgagtcagcccagagctgctgctgggtgtggacatgctgcagagccccctgacccggccccggcccggcccccgctggctccggagccgcaactcggagctgcgtcagttgcgtcgccgctggttccaccacttcatgagtgactcccagggaccgcccgccctgggccccgaggctgccaggcccgccatccacagccgaggcacctacattggatgcttcagtgacgatggccacgagaggactctgaaaggagctgtgttttatgacttgagaaagatgactgtctcccactgccaggatgcgtgtgctgagcggtcctatgtctacgccggcttggaggccggggcggagtgttactgcgggaaccggctgccagcggtgagcgtggggctggaagagtgtaaccatgagtgcaaaggcgagaagggctctgtgtgcggggctgtggaccggctctccgtgtaccgtgtggacgagctgcagccgggctccaggaagcggcggaccgccacctaccgcggatgcttccgactgccagagaacatcacacatgccttccccagctccctgatacaggccaatgtgaccgtggggacttgctcgggcttttgttcccagaaagagttccccttggccattctcaggggctgggaatgctactgtgcttaccctaccccccggttcaacctgcgggatgccatggacagctcagtatgtggccaggaccctgaggcacagaggctggcagaatactgtgaggtctaccagacacctgtgcaagacactcgttgtacagacaggaggttcctgcctaacaaatccaaagtgtttgtggctttgtcaagcttcccaggagccgggaacacatgggcacggcacctcattgagcatgccactggcttctatacagggagctactactttgatggaaccctctacaacaaagggttcaagggcgaaaaggaccactggcggagccgacgcaccatctgtgtcaaaacccacgagagtggcaggagggagattgagatgtttgattcagccatcctgctaatccggaacccatacaggtccctggtggcagaattcaacagaaaatgtgccgggcacctgggatatgcagctgaccgcaactggaagagcaaagagtggccggactttgtcaacagctacgcctcgtggtggtcctcgcacgtcctggactggctcaagtacgggaagcggctgctggtggtgcactacgaggagctgcggcgcagcctggtgcccacgttacgggagatggtggccttcctcaacgtgtctgtgagcgaggagcggctgctctgcgtggagaacaacaaggagggcagcttccggcggcgcggccggcgctcccacgaccctgagcccttcaccccggagatgaaagacttgatcaatggctacatccggacggtggaccaagccctgcgtgaccacaactggacggggctgcccagggagtatgtgcccagatgataggcctggcccacgccgccgcccccgctgagtgacgcaatcgcaccacggggctgcgctccccactctgatgctcaggcccgtggcctcactgggacgaacggtgggtggggggctcaccctggtgctgcctcccgcacaaggagacctggacacaacagacacacatcacaaggcgaacacaaatggacacacatacctggccacgaacccacacctcctcagacactcagacaccactccaggctcatagccccgtcttgatgcagagaagccacccacgtggggtgtgccaggcacccccagatacaaatgcagccacgcacagacgtaacacacaggtgccaggccgtgtgctcctggaggctggctggctgtctctctcacacagatacacgtgcgctccctgggatccgggaggccctgggcttcctgtgtgtagccctggcatagacttgctcgtcagggtgttcgactctgggatgctgggccgggcagacatttatgctctgagcagcaaggaccattgggatggaggtgggcacaaagactgctgcttccagggtgtgcggccctggccgtgtgtctgacatcccataaatgtgtgtgtggtgtgactacgggcaccacaaactccgcagccttgcctctcttttctctgtggctgggctggctgcaccatgggcagggttgaggactgccccccaccccgcccaagccaatgcagacactgacctcaagaccagccacaccaagtctgtgcactgcccaccacccccttcaacccctcctacaccatgctccggggcctggggcctccttgcctggcttcttcctccagctatcctcagggaagctggagattcaagtcatgccccagaagcaaggtgtaagcatgggggcgtggggaagagggcaggagctgaagttccaggggagcccaggacccctggggacctgtacactagcaggatgggtcttgggagttggcatggggagattgtaagggctgtatctccgcgattactggtactggtgctccacccataggggccctgttctctctggggtcccacactggggtcatgagagctagttagtactcagcctgacccctaggtctggtcctgccagcctgggatgggggtcaatgtatgctacacatcttgggctcacaagtgaggctgtggaggccaggaggttcaagtatggagggtaggagtgcaacccaggagcaacgctcaaggtggccgagatgcagggaggattgtggcgatccggttgcacactggcctctgtggaggtcagggaggtgggaaggtgggtgggcctgaactcaggcagcccttcagtggcttcttcaggcctaggataaccctggccaggccccatggtcctgctctgggtcagctgtcagggagacctcccttcagcctgagccaagctgcattgggaggagaaggcagggtgagggatctgggagagcaggacgttgagatatcctgaccctctgcttcctagcctgatgatggggaacccagagccacccgctatgagcacaggccgggggtggaaggcccagtagagctgcccttccccagatggaagcttcctccaaccttcagtttggccagtgggtgggtttgggcatctgtgcccctggtggcctccaaatccttcctgggattcccccaaacccacactgatgcgaagctgttcttgaccctcccatagcatcaactcagttcagctcaaagctagaaacaccaaggtctttgaaaatgtttattggctcaggatagcttcggcatccaatctgcgaaggcccctgatggagctatttcttcctagtatcaggagcaattgagacccctcaggagtttccacactgctgtggacgggatagccagggcagacctgcatcccagagcaagcctagatccttgaaagcaatgtcaggcgtggcagtggggaagccatggaggctgggaagggcaaagtgtggagagaggagtgaccgggactggagccagggtctggggagagcaacagcaccaggcttttcctggtagttggattggtacattcactgctgccaggtacccagagatgtcatctctctccaggtagagcatcaccagctcctgtggccttgtagatgactctgtacctcagtgaagagtgcaggcaagtagagtgatggggtcagtgtccatccagtttacgctgagtcagtccatacagcaagacacctggcacttggcaggtactcctggatgttgatgagcaaggaagagcaacggccctgtcagctggcagtggtcctcacagccttcatcccaggtctgcctacgtgggagatctcatcagaaacaggaacggggatctgtctgtgcttgcaggaaagtccatttgtttttctccaagttaggtctcatctacagctcttagcttctcagtaaagaggatactctcccaaccagccaaggaataaaagctgatctgtatgtagggcagaagtgtggcaaatgcatcaggaaccggttagaacagaacagagaaaccctgactgtctacagattccaactttaatagcaagcctgtggagttacacaaacctgtgttaaaacatgtaatttttatggatttcatctcccgttgtggatcaatttggaaaaaccaaaatatgtaattttaaaaaactaaaacacatcctggtagtcccagtgatgtgtaaatgagagagaagaatagacaggcttccaaaccctgggaagaaagctgcttaattatgtgaacatcttataatgaagtctcttgcagctaaaattagattttgagtgcatgaatctgtgataatgtttgcatatcagaatgcattctccccttaaaagtagcagtagccacttggttcttagggggccccaagaggagaggagaagtgctgaggttgatgttacgactgcaagaattcttgggacacaggtttgttttctgctgacttgctcggaaacccattggaggtatctgaaatgtgatgactccaaaggggttcatttcactatagggagaaattgattcgtctgacttcctatttatcaccactcaatattgggtgagttggtctgaacaaggtggggataaagtagagtggaaataatgtagagtcgtcagactgaaaggccaggttgtagtcccagctcttatctgccatcttggacaaagcttttcccatctccagtctcagtttcccatccataaaatgggggaagtggtaggtcttgctgattgcatccacattcattcctccatttcctttcccagcaaccccccatttctgtttgggaattcatatgatctgccagagcctctccaggggtggaatacatgtcctggactaagccaatgacaccttccatctttccagctatggtgactgggttaggtatgatcttgtgagttaagacaatgaagccagagggaatttcaagacttatgggaatgctgggtagaagctgttttaattcccctgttgaatgtgaaaaaggtagtagtattcctgggtctttatgatgaccaccttgggccttgggatcatgaccaggaatcacgtgaagctgacaccactgaagggagagttgagaggcagaaagagatcaagtccttggtgaaattgtttaagtacaggatcaagccttgcttgagattggccttacctctggactttttttgttatatgagctaataaattctgtttattgtttaa

SEQ ID NO: 200302 - DNA, 570 bp, Homo sapiens
  Payload ID: 19515
  Gene Name: WSC domain containing 1
  ENST ID: ENST00000576233
  CDS Start-End: 435-570
ttttacagatggggaagctgaggcccagcaaggttaagcaacctacccagtgtcacacagctggccagtaacaaagctgggatttaaacctggctttgtccagtgctcctgcaacacagctggtccttggataaagcaagcacaggatttctgcgccaggagatgaggggcggtagagccctggaatggagatgtccttgacgcctgggcagaggctgcagctgcaggaccctgtggccactggagataagtaatggtgccatttgaacacctactggaaacggggcaggaacagtgagtgaccccaggcgagcacaggcaggtgccaggagccaggatgcaaggatgacgcctccggaggccctggcctcactcccacctgggcgctaggagccatcccggggctccagccaggagccctgctgcccaggggcatggccaaacctttcttccgactccagaagtttctccgccgaacacagttcctgctgttcttcctcacggctgcctacctgatgaccggcagcctgctgctgctgcagcgggtccgcgtggctctcccacagggcc

SEQ ID NO: 200303 - DNA, 759 bp, Homo sapiens
  Payload ID: 19515
  Gene Name: WSC domain containing 1
  ENST ID: ENST00000573619
  CDS Start-End: 626-759
ccatattaggaaacccactggcacgctccgccgttatcttcgcaagacttccgttgttgcctcaagttgcagattgccttttaacagagaagaaagtgacaggaatgtgctggcactgatgacacagtaatgaccaaggtaaacaaggacctgctctagcctgacaggctggtcttcagtgttttggccatctccctacctgatcaccctgaagcaacacccacaagcagacaagctctgcccagtgagacagcacagaaaagcctccccgggatgtctggcagctcctacttggttccactggaaagaaaataagaggtcattattcacaaacaagatttctgcgccaggagatgaggggcggtagagccctggaatggagatgtccttgacgcctgggcagaggctgcagctgcaggaccctgtggccactggagataagtaatggtgccatttgaacacctactggaaacggggcaggaacagtgagtgaccccaggcgagcacaggcaggtgccaggagccaggatgcaaggatgacgcctccggaggccctggcctcactcccacctgggcgctaggagccatcccggggctccagccaggagccctgctgcccaggggcatggccaaacctttcttccgactccagaagtttctccgccgaacacagttcctgctgttcttcctcacggctgcctacctgatgaccggcagcctgctgctgctgcagcgggtccgcgtggctctcccacaggg

SEQ ID NO: 200304 - DNA, 4710 bp, Homo sapiens
  Payload ID: 19516
  Gene Name: WSC domain containing 2
  Uniprot ID: Q2TBF2
  ENST ID: ENST00000332082
  CDS Start-End: 819-2516
tttctcataaaatctctgctggaccagccactcctagtggggagcccagggtggtctgggagtgctgcatgcacccagctgctgtatcaccaggacatcaggaggtggagatgttcgcttgtgtgttctccactgcccaaacccaggtggttattctgcaacagctacaacttgagtaagaccaaaacacaactcaagtggactttctaaaaagagaataatttattttggctcccagacatcaaaattcgcaagggattgcttcaggtggcatccctgagtcctgatgcctgactggatggaggcccaccagcttctgttcccatgaggtagaaaggccaagcttggtcttcagctggggaagaggccagaaacaaggcccccagtgaaataacccagatccattggcctgaggagcagagaaagggcaagaagtgaactgcagctgctggtaaccctcagaaaccttctccaagtgctattctcacagttctttaggaacactctgaagtgaagaacaatatgtaggaaaatgggaccaacttatgtgtgttctgagcctcaaaacccccttgttggcccaaagaagctcaccttcagtttgggagggctggtaagctccatcctttctcatggcctcagccaagcattgaacttgccctccccttctggccttggtgatcactttttcaggaagagtgagactgaggacccccaagtgttccatccctaaggaaagcttgggaaaccaagccccttccatcctctcccaagcaccccagccaagccccagagagccagtccggaatgatcccactatggccaagctctggttcaaattccagcggtacttccgccggaaacctgtgcgcttctttaccttcctggcactctacctgactgctgggagccttgtcttccttcactctggctttgtgggccagcccgctgtctcggggaaccaggcgaaccccgctgctgcaggaggcccagctgagggtgctgagctgtccttcttgggtgacatgcatctgggcagaggtttccgggacacaggtgaagcctcaagcattgctcgcaggtacggaccctggttcaagggcaaggatgggaatgagagagccaagcttggcgactacggtggagcctggagccgagccctcaaggggagggttgtccgggagaaggaggaagagcgagccaagtacatcggctgctacctggatgacacccagagtcgggcccttcgaggagtgtccttttttgactacaaaaagatgaccatcttccgttgccaggacaactgtgctgaacggggttacctgtatggcgggctggagttcggcgccgagtgctactgcggccacaagatccaggcgacgaacgtgagcgaggcagagtgcgacatggagtgcaagggcgagcgaggcagcgtgtgcggcggcgccaaccgcctctctgtctaccggctgcagctggcccaggagtcggcccgcaggtatggaagtgcagtgttccggggctgcttccgcaggcccgacaacctttccctggccttacccgtgacagctgccatgctgaacatgtctgtggacaaatgcgtggacttctgcactgagaaggagtacccgctggcagctcttgcaggcaccgcctgccactgtgggtttcccaccacccgattcccgctccatgacagagaggatgagcagctctgtgcccagaagtgcagcgcggaggagtttgagagctgcgggactcctagttacttcattgtgtaccagacacaagtccaagacaaccgttgcatggacagaaggttcctgccaggcaagtccaagcagctcattgctttggccagcttcccaggtgctggcaacacgtgggctcgccacctcattgaattggccacaggcttctacactggcagctactacttcgatggctccctctacaacaaagggtttaaaggtgagcgggaccactggcgcagcggacggaccatctgcatcaagacgcacgaaagcggccagaaagagatcgaggccttcgacgccgccatcctgctcatccgcaacccctacaaagccctcatggctgagttcaaccgcaagtacggcggccacataggctttgctgcgcatgcccactggaagggcaaagagtggccagagttcgtgaggaactatgccccgtggtgggccactcacacactggactggctcaagtttggcaagaaggtgctggtggtgcactttgaggacctgaagcaggacctctttgtccagctgggccggatggtcagcctgctgggcgtggctgtcagggaggaccggctgctctgtgtggagagccagaaggatggcaacttcaagcgctcagggctccggaagctcgagtatgacccctatactgcggacatgcagaagaccatctctgcctacatcaagatggtggatgcagccctcaaagggcggaacctaacgggtgtccccgatgactactacccaagatgatgcgtccacacagggggagggtagactgggagtcctgaccacgcaggccctggggactcaagacccctggttacccccactcatctgtcctctctttggtctggggacaatccccttggctgctctttgccttcaatgagtttcctgcatgacagaggaggctcaagggaagagattgcccaggcactaccactctgctcacatgttccccccttggcaatgtggggcatcttgtttagggggttctagttacatggactcttttctgtctcctgggtccctgcccccaccactctgggttccatttgtgggagggagggctcatccacatcatggagacttgctggatgccccatggcaattgtcaaggctcttgatgcaagagcccagggggctattgtaaaaacttggccccagatgcttgtcccttctgggctgagatttcgcagcccccttctcatctccacccaagaagtgctggcaccgatgtttaactcaggccaccttctgttctaaagaaagattgctgggaagtttctccgtggccttaggtttctgacatcctggatagtgtggggaggtaatggtgctcacagtaggttaattggagacaccatgtggggccattggtgttatgagccccccaggccacactgcttctcagaaatgagctgcttgcctttccacctccagggcatgaaccctgcccctttctatccatgctgtgtccaggaggtgaccttgagatcctgataccaccttcaaggaacctcaggcaccaacagtgagcccacgaggatggtcacatgccatgtgcagaatttgacttaagagagagccccagtgacacatctctccatggtgggctccagtcagtcttacactgcccttctgacccctacaaatgggtcctttgctatccaggtgagacagcaagagtgttcttaatcagatggaaccacacccaaaatggacccccactaccttcccagaccatatatctccccttgatcatagtccaacagggccagcttcccttgggggccctttaaggaatggggtgaatgaaattgtgtcatttctatacaaacactgctctcttgatgctgaaatgccaaaccgaaggatttctgaggacctaaatcacggagcatcaatcttacaaagtgttggtccagagtcccatctcttccccaaccctggataccagtagcttcccacccagtccaaacctgcaccatccatcattatgtagatgaaaaagccataggtcatagcctctttgctattctattggagtagcctccctaggcagtccctctgaagccttggagtgcaggtaaatgctcattcccaagtagcaaagagaccatggagaaggtgcgtgtaaagagatatatttttgtaagaggaatatgattaatacattccgccccttggaacctggccatgcaaagcaagggcacagggattagacctgtggcacacttccccaattccctcatctgtaggatttgggctgccccaggcccacccagggggctctgaatgtattttgtaccgtgtttctttcccccaggagaatttttagtcttctttcatgaagcagtggaggggttggcctcccttctactgggaggttgactctctctgggagactcttggtccaagacctgggtcagttctttgctggtggtcccctctgaccacaagcttctgcctgaagattcctcaggtcaacaccatcattaaatgcgagttttgttgatgattctaccatgtggtagagtgttgtgtaagacaggttcacaaatgggatgttttcctagtgtgtgtgtgtgtgtgtgtgtgtgtgtatgagagagagagagagagacaacagagacagagagaggcagagaggcatagagagacagagagagagacaagaaacagagatagacagaaaatgttcggggtggcaggcgggttggtgtataactgctttgtgcctgtgtgactctggcatagctgctcagggagaattacgtgcctctgtgtgtaaaattgcctttgtgttctcctgcctttctatgttttgaaactgtatcccacaagttgccggtatgaccatcttatttgtaatgagtctgtgcaggtccttgtgtatggaattgcacccgtgtaaaggaggaaatggtcagtgtgcatgaaa

SEQ ID NO: 200305 - DNA, 569 bp, Homo sapiens
  Payload ID: 19516
  Gene Name: WSC domain containing 2
  ENST ID: ENST00000551638
  CDS Start-End: 199-569
agcagctgggaaggcgcccacagagcgggcgcgccaagcgggacgcgggagtcgcagagagggaccccgggcgcctgctgagctcagctggcagagtttgcaagtggcggagacccttcagccaagtacatcggctgctacctggatgacacccagagtcgggcccttcgaggagtgtccttttttgactacaaaaagatgaccatcttccgttgccaggacaactgtgctgaacggggttacctgtatggcgggctggagttcggcgccgagtgctactgcggccacaagatccaggcgacgaacgtgagcgaggcagagtgcgacatggagtgcaagggcgagcgaggcagcgtgtgcggcggcgccaaccgcctctctgtctaccggctgcagctggcccaggagtcggcccgcaggtatggaagtgcagtgttccggggctgcttccgcaggcccgacaacctttccctggccttacccgtgacagctgccatgctgaacatgtctgtggacaaatgcgtggacttctgcactgagaaggagtacccgctggcagctcttgcagg

SEQ ID NO: 200306 - DNA, 3534 bp, Homo sapiens
  Payload ID: 19516
  Gene Name: WSC domain containing 2
  Uniprot ID: Q2TBF2
  ENST ID: ENST00000549903
  CDS Start-End: 1-1758
atggccaagctctggttcaaattccagcggtacttccgccggaaacctgtgcgcttctttaccttcctggcactctacctgactgctgggagccttgtcttccttcactctggctttgtgggccagcccgctgtctcggggaaccaggcgaaccccgctgctgcaggaggcccagctgagggtgctgagctgtccttcttgggtgacatgcatctgggcagaggtttccgggacacaggtgaagcctcaagcattgctcgcaggtacggaccctggttcaagggcaaggatgggaatgagagagccaagcttggcgactacggtggagcctggagccgagccctcaaggggagggttgtccgggagaaggaggaagagcgagccaagtacatcggctgctacctggatgacacccagagtcgggcccttcgaggagtgtccttttttgactacaaaaagatgaccatcttccgttgccaggacaactgtgctgaacggggttacctgtatggcgggctggagttcggcgccgagtgctactgcggccacaagatccaggcgacgaacgtgagcgaggcagagtgcgacatggagtgcaagggcgagcgaggcagcgtgtgcggcggcgccaaccgcctctctgtctaccggctgcagctggcccaggagtcggcccgcaggtatggaagtgcagtgttccggggctgcttccgcaggcccgacaacctttccctggccttacccgtgacagctgccatgctgaacatgtctgtggacaaatgcgtggacttctgcactgagaaggagtacccgctggcagctcttgcaggcaccgcctgccactgtgggtttcccaccacccgattcccgctccatgacagagaggatgagcagctctgtgcccagaagtgcagcgcggaggagtttgagagctgcgggactcctagttacttcattgtgtaccagacacaagtccaagacaaccgttgcatggacagaaggttcctgccaggcaagtccaagcagctcattgctttggccagcttcccaggtgctggcaacacgtgggctcgccacctcattgaattggccacaggcttctacactggcagctactacttcgatggctccctctacaacaaagggtttaaaggtgagcgggaccactggcgcagcggacggaccatctgcatcaagacgcacgaaagcggccagaaagagatcgaggccttcgacgccgccatcctgctcatccgcaacccctacaaagccctcatggctgagttcaaccgcaagtacggcggccacataggctttgctgcgcatgcccactggaagggcaaaggagccgtaccaggatctttgcaaatcttatttcgctcgatttgcacagcatctgtaggagagtggccagagttcgtgaggaactatgccccgtggtgggccactcacacactggactggctcaagtttggcaagaaggtgctggtggtgcactttgaggacctgaagcaggacctctttgtccagctgggccggatggtcagcctgctgggcgtggctgtcagggaggaccggctgctctgtgtggagagccagaaggatggcaacttcaagcgctcagggctccggaagctcgagtatgacccctatactgcggacatgcagaagaccatctctgcctacatcaagatggtggatgcagccctcaaagggcggaacctaacgggtgtccccgatgactactacccaagatgatgcgtccacacagggggagggtagactgggagtcctgaccacgcaggccctggggactcaagacccctggttacccccactcatctgtcctctctttggtctggggacaatccccttggctgctctttgccttcaatgagtttcctgcatgacagaggaggctcaagggaagagattgcccaggcactaccactctgctcacatgttccccccttggcaatgtggggcatcttgtttagggggttctagttacatggactcttttctgtctcctgggtccctgcccccaccactctgggttccatttgtgggagggagggctcatccacatcatggagacttgctggatgccccatggcaattgtcaaggctcttgatgcaagagcccagggggctattgtaaaaacttggccccagatgcttgtcccttctgggctgagatttcgcagcccccttctcatctccacccaagaagtgctggcaccgatgtttaactcaggccaccttctgttctaaagaaagattgctgggaagtttctccgtggccttaggtttctgacatcctggatagtgtggggaggtaatggtgctcacagtaggttaattggagacaccatgtggggccattggtgttatgagccccccaggccacactgcttctcagaaatgagctgcttgcctttccacctccagggcatgaaccctgcccctttctatccatgctgtgtccaggaggtgaccttgagatcctgataccaccttcaaggaacctcaggcaccaacagtgagcccacgaggatggtcacatgccatgtgcagaatttgacttaagagagagccccagtgacacatctctccatggtgggctccagtcagtcttacactgcccttctgacccctacaaatgggtcctttgctatccaggtgagacagcaagagtgttcttaatcagatggaaccacacccaaaatggacccccactaccttcccagaccatatatctccccttgatcatagtccaacagggccagcttcccttgggggccctttaaggaatggggtgaatgaaattgtgtcatttctatacaaacactgctctcttgatgctgaaatgccaaaccgaaggatttctgaggacctaaatcacggagcatcaatcttacaaagtgttggtccagagtcccatctcttccccaaccctggataccagtagcttcccacccagtccaaacctgcaccatccatcattatgtagatgaaaaagccataggtcatagcctctttgctattctattggagtagcctccctaggcagtccctctgaagccttggagtgcaggtaaatgctcattcccaagtagcaaagagaccatggagaaggtgcgtgtaaagagatatatttttgtaagaggaatatgattaatacattccgccccttggaacctggccatgcaaagcaagggcacagggattagacctgtggcacacttccccaattccctcatctgtaggatttgggctgccccaggcccacccagggggctctgaatgtattttgtaccgtgtttctttcccccaggagaatttttagtcttctttcatgaagcagtggaggggttggcctcccttctactgggaggttgactctctctgggagactcttggtccaagacctgggtcagttctttgctggtggtcccctctgaccacaagcttctgcctgaagattcctcaggtcaacaccatcattaaatgcgagttttgttgatgattcta

SEQ ID NO: 200307 - DNA, 4481 bp, Homo sapiens
  Payload ID: 19516
  Gene Name: WSC domain containing 2
  Uniprot ID: Q2TBF2
  ENST ID: ENST00000547525
  CDS Start-End: 1008-2705
atccccggggcgggtgcccgcgcggggcctcgccgcggctcggggcacccgcagtgccgcccgcccgagcgccaggctcacaggagcccggctttcacttcctctcgcttccgcccgcctccctggctcgccggctggcgtcgccaccgcctcctcgtccccggccaccgctgtcgccgctgctgcaattcaaggcgcacactatcccactttcccgctggaggcgcagaggatgccccttgagccagacctggagaaatagccccagggcccggcaggaggagccttggtggcgagaaaggaaatccaggctcccctttccttaaagccactgcagcagctgggaaggcgcccacagagcgggcgcgccaagcgggacgcgggagtcgcagagagggaccccgggcgcctgctgagctcagctggcagagtttgcaagtggcggagacccttcaggtggcatccctgagtcctgatgcctgactggatggaggcccaccagcttctgttcccatgaggtagaaaggccaagcttggtcttcagctggggaagaggccagaaacaaggcccccagtgaaataacccagatccattggcctgaggagcagagaaagggcaagaagtgaactgcagctgctggtaaccctcagaaaccttctccaagtgctattctcacagttctttaggaacactctgaagtgaagaacaatatgtaggaaaatgggaccaacttatgtgtgttctgagcctcaaaacccccttgttggcccaaagaagctcaccttcagtttgggagggctggtaagctccatcctttctcatggcctcagccaagcattgaacttgccctccccttctggccttggtgatcactttttcaggaagagtgagactgaggacccccaagtgttccatccctaaggaaagcttgggaaaccaagccccttccatcctctcccaagcaccccagccaagccccagagagccagtccggaatgatcccactatggccaagctctggttcaaattccagcggtacttccgccggaaacctgtgcgcttctttaccttcctggcactctacctgactgctgggagccttgtcttccttcactctggctttgtgggccagcccgctgtctcggggaaccaggcgaaccccgctgctgcaggaggcccagctgagggtgctgagctgtccttcttgggtgacatgcatctgggcagaggtttccgggacacaggtgaagcctcaagcattgctcgcaggtacggaccctggttcaagggcaaggatgggaatgagagagccaagcttggcgactacggtggagcctggagccgagccctcaaggggagggttgtccgggagaaggaggaagagcgagccaagtacatcggctgctacctggatgacacccagagtcgggcccttcgaggagtgtccttttttgactacaaaaagatgaccatcttccgttgccaggacaactgtgctgaacggggttacctgtatggcgggctggagttcggcgccgagtgctactgcggccacaagatccaggcgacgaacgtgagcgaggcagagtgcgacatggagtgcaagggcgagcgaggcagcgtgtgcggcggcgccaaccgcctctctgtctaccggctgcagctggcccaggagtcggcccgcaggtatggaagtgcagtgttccggggctgcttccgcaggcccgacaacctttccctggccttacccgtgacagctgccatgctgaacatgtctgtggacaaatgcgtggacttctgcactgagaaggagtacccgctggcagctcttgcaggcaccgcctgccactgtgggtttcccaccacccgattcccgctccatgacagagaggatgagcagctctgtgcccagaagtgcagcgcggaggagtttgagagctgcgggactcctagttacttcattgtgtaccagacacaagtccaagacaaccgttgcatggacagaaggttcctgccaggcaagtccaagcagctcattgctttggccagcttcccaggtgctggcaacacgtgggctcgccacctcattgaattggccacaggcttctacactggcagctactacttcgatggctccctctacaacaaagggtttaaaggtgagcgggaccactggcgcagcggacggaccatctgcatcaagacgcacgaaagcggccagaaagagatcgaggccttcgacgccgccatcctgctcatccgcaacccctacaaagccctcatggctgagttcaaccgcaagtacggcggccacataggctttgctgcgcatgcccactggaagggcaaagagtggccagagttcgtgaggaactatgccccgtggtgggccactcacacactggactggctcaagtttggcaagaaggtgctggtggtgcactttgaggacctgaagcaggacctctttgtccagctgggccggatggtcagcctgctgggcgtggctgtcagggaggaccggctgctctgtgtggagagccagaaggatggcaacttcaagcgctcagggctccggaagctcgagtatgacccctatactgcggacatgcagaagaccatctctgcctacatcaagatggtggatgcagccctcaaagggcggaacctaacgggtgtccccgatgactactacccaagatgatgcgtccacacagggggagggtagactgggagtcctgaccacgcaggccctggggactcaagacccctggttacccccactcatctgtcctctctttggtctggggacaatccccttggctgctctttgccttcaatgagtttcctgcatgacagaggaggctcaagggaagagattgcccaggcactaccactctgctcacatgttccccccttggcaatgtggggcatcttgtttagggggttctagttacatggactcttttctgtctcctgggtccctgcccccaccactctgggttccatttgtgggagggagggctcatccacatcatggagacttgctggatgccccatggcaattgtcaaggctcttgatgcaagagcccagggggctattgtaaaaacttggccccagatgcttgtcccttctgggctgagatttcgcagcccccttctcatctccacccaagaagtgctggcaccgatgtttaactcaggccaccttctgttctaaagaaagattgctgggaagtttctccgtggccttaggtttctgacatcctggatagtgtggggaggtaatggtgctcacagtaggttaattggagacaccatgtggggccattggtgttatgagccccccaggccacactgcttctcagaaatgagctgcttgcctttccacctccagggcatgaaccctgcccctttctatccatgctgtgtccaggaggtgaccttgagatcctgataccaccttcaaggaacctcaggcaccaacagtgagcccacgaggatggtcacatgccatgtgcagaatttgacttaagagagagccccagtgacacatctctccatggtgggctccagtcagtcttacactgcccttctgacccctacaaatgggtcctttgctatccaggtgagacagcaagagtgttcttaatcagatggaaccacacccaaaatggacccccactaccttcccagaccatatatctccccttgatcatagtccaacagggccagcttcccttgggggccctttaaggaatggggtgaatgaaattgtgtcatttctatacaaacactgctctcttgatgctgaaatgccaaaccgaaggatttctgaggacctaaatcacggagcatcaatcttacaaagtgttggtccagagtcccatctcttccccaaccctggataccagtagcttcccacccagtccaaacctgcaccatccatcattatgtagatgaaaaagccataggtcatagcctctttgctattctattggagtagcctccctaggcagtccctctgaagccttggagtgcaggtaaatgctcattcccaagtagcaaagagaccatggagaaggtgcgtgtaaagagatatatttttgtaagaggaatatgattaatacattccgccccttggaacctggccatgcaaagcaagggcacagggattagacctgtggcacacttccccaattccctcatctgtaggatttgggctgccccaggcccacccagggggctctgaatgtattttgtaccgtgtttctttcccccaggagaatttttagtcttctttcatgaagcagtggaggggttggcctcccttctactgggaggttgactctctctgggagactcttggtccaagacctgggtcagttctttgctggtggtcccctctgaccacaagcttctgcctgaagattcctcaggtcaacaccatcattaaatgcgagttttgttgatgattcta

SEQ ID NO: 200308 - DNA, 7130 bp, Homo sapiens
  Payload ID: 19517
  Gene Name: WW and C2 domain containing 1
  Uniprot ID: Q8IX03
  ENST ID: ENST00000265293
  CDS Start-End: 503-3844
ggggcagcgcggttacctgcaccgcccgagccgcacctggcggaggcagaagtcacaaacccggcgagctcagagcggtggagcggagaggagggacggcacccggctgcagggaggagggaggcggcagcggcagcggcggcgtggagggcgcagcgcgccgcgcggcggaggagggcagacggcggcggcggcggcgctcggctcgctctgcccggccggctgggcgcgcacccgggctcgcaccgcgccgctgcggacgcacatggcagcgtgagaggccggcggcgggaggagcgggcggcgccgggtcggggctgcagggccgcatggacagcggcgccaccccggccggcccctactagggccccccatctgcgggcgccaccccccggatcatggtgcctcggcggccgcccgggctaagagcggccggctggagccgctgagcccccgctgcggccgggagctgcatgggggagcgccggcagcgcttgggaagatgccccggccggagctgcccctgccggagggctgggaggaggcgcgcgacttcgacggcaaggtctactacatagaccacacgaaccgcaccaccagctggatcgacccgcgggacaggtacaccaaaccgctcacctttgctgactgcattagtgatgagttgccgctaggatgggaagaggcatatgacccacaggttggagattacttcatagaccacaacaccaaaaccactcagattgaggatcctcgagtacaatggcggcgggagcaggaacatatgctgaaggattacctggtggtggcccaggaggctctgagtgcacaaaaggagatctaccaggtgaagcagcagcgcctggagcttgcacagcaggagtaccagcaactgcatgccgtctgggagcataagctgggctcccaggtcagcttggtctctggttcatcatccagctccaagtatgaccctgagatcctgaaagctgaaattgccactgcaaaatcccgggtcaacaagctgaagagagagatggttcacctccagcacgagctgcagttcaaagagcgtggctttcagaccctgaagaaaatcgataagaaaatgtctgatgctcagggcagctacaaactggatgaagctcaggctgtcttgagagaaacaaaagccatcaaaaaggctattacctgtggggaaaaggaaaagcaagatctcattaagagccttgccatgttgaaggacggcttccgcactgacagggggtctcactcagacctgtggtccagcagcagctctctggagagttcgagtttcccgctaccgaaacagtacctggatgtgagctcccagacagacatctcgggaagcttcggcatcaacagcaacaatcagttggcagagaaggtcagattgcgccttcgatatgaagaggctaagagaaggatcgccaacctgaagatccagctggccaagcttgacagtgaggcctggcctggggtgctggactcagagagggaccggctgatccttatcaacgagaaggaggagctgctgaaggagatgcgcttcatcagcccccgcaagtggacccagggggaggtggagcagctggagatggcccggaagcggctggaaaaggacctgcaggcagcccgggacacccagagcaaggcgctgacggagaggttaaagttaaacagtaagaggaaccagcttgtgagagaactggaggaagccacccggcaggtggcaactctgcactcccagctgaaaagtctctcaagcagcatgcagtccctgtcctcaggcagcagccccggatccctcacgtccagccggggctccctggttgcatccagcctggactcctccacttcagccagcttcactgacctctactatgacccctttgagcagctggactcagagctgcagagcaaggtggagttcctgctcctggagggggccaccggcttccggccctcaggctgcatcaccaccatccacgaggatgaggtggccaagacccagaaggcagagggaggtggccgcctgcaggctctgcgttccctgtctggcaccccaaagtccatgacctccctatccccacgttcctctctctcctccccctccccaccctgttcccctctcatggctgaccccctcctggctggtgatgccttcctcaactccttggagtttgaagacccggagctgagtgccactctttgtgaactgagccttggtaacagcgcccaggaaagataccggctggaggaaccaggaacggagggcaagcagctgggccaagctgtgaatacggcccaggggtgtggcctgaaagtggcctgtgtctcagccgccgtatcggacgagtcagtggctggagacagtggtgtgtacgaggcttccgtgcagagactgggtgcttcagaagctgctgcatttgacagtgacgaatcggaagcagtgggtgcgacccgaattcagattgccctgaagtatgatgagaagaataagcaatttgcaatattaatcatccagctgagtaacctttctgctctgttgcagcaacaagaccagaaagtgaatatccgcgtggctgtccttccttgctctgaaagcacaacctgcctgttccggacccggcctctggacgcctcagacactctagtgttcaatgaggtgttctgggtatccatgtcctatccagcccttcaccagaagaccttaagagtcgatgtctgtaccaccgacaggagccatctggaagagtgcctgggaggcgcccagatcagcctggcggaggtctgccggtctggggagaggtcgactcgctggtacaaccttctcagctacaaatacttgaagaaacagagcagggagctcaagccagtgggagtcatggcccctgcctcagggcctgccagcacggacgctgtgtctgctctgttggaacagacagcagtggagctggagaagaggcaggagggcaggagcagcacacagacactggaagacagctggaggtatgaggagaccagtgagaatgaggcagtagccgaggaagaggaggaggaggtggaggaggaggagggagaagaggatgttttcaccgagaaagcctcacctgatatggatgggtacccagcattaaaggtggacaaagagaccaacacggagaccccggccccatcccccacagtggtgcgacctaaggaccggagagtgggcaccccgtcccaggggccatttcttcgagggagcaccatcatccgctctaagaccttctccccaggaccccagagccagtacgtgtgccggctgaatcggagtgatagtgacagctccactctgtccaaaaagccaccttttgttcgaaactccctggagcgacgcagcgtccggatgaagcggccttcctcggtcaagtcgctgcgctccgagcgtctgatccgtacctcgctggacctggagttagacctgcaggcgacaagaacctggcacagccaattgacccaggagatctcggtgctgaaggagctcaaggagcagctggaacaagccaagagccacggggagaaggagctgccacagtggttgcgtgaggacgagcgtttccgcctgctgctgaggatgctggagaagcggcagatggaccgagcggagcacaagggtgagcttcagacagacaagatgatgagggcagctgccaaggatgtgcacaggctccgaggccagagctgtaaggaacccccagaagttcagtctttcagggagaagatggcatttttcacccggcctcggatgaatatcccagctctctctgcagatgacgtctaatcgccagaaaagtatttcctttgttccactgaccaggctgtgaacattgactgtggctaaagttatttatgtggtgttatatgaaggtactgagtcacaagtcctctagtgctcttgttggtttgaagatgaaccgactttttagtttgggtcctactgttgttattaaaaacagaacaaaaacaaaacacacacacacacaaaaacagaaacaaaaaaaaccagcattaaaataataagattgtatagtttgtatatttaggagtgtatttttgggaaagaaaatttaaatgaactaaagcagtattgagttgctgctcttcttaaaatcgtttagattttttttggtttgtacagctccaccttttagaggtcttactgcaataagaagtaatgcctgggggacggtaatcctaataggacgtcccgcacttgtcacagtacagctaatttttcctagttaacatattttgtacaatattaaaaaaatgcacagaaaccattgggggggattcagaggtgcatccacggatcttcttgagctgtgacgtgtttttatgtggctgcccaacgtggagcgggcagtgtgataggctgggtgggctaagcagcctagtctatgtgggtgacaggccacgctggtctcagatgcccagtgaagccactaacatgagtgaggggagggctgtggggaactccattcagttttatctccatcaataaagtggcctttcaaaaagaatcttcctcttgctctctttttctttcctacccctcacttcatctgtttccctgatttttgactctcccctttccagtcatttctttcccacccatccgcagtcctggaaacatttattttttcttttgcccactgttttcatttgctcattaaattaaaatgactgctcggctcattgggaatccacatccccaagttagactggggatatgctctctgtactgtctccttctatggaattccaccccacccagagagagatgacttcacagtttgttcatatgagcatcatcccatgtcgtccccaacccaggggctggtaggtgctacagcttgtgcttcatgctgctcctgtggcccctattcctacccagctcagagctttgcagggtctactgcagacaatcagaagtcagtttctaacaaatagcaacagccacaaatctcttcctccttcctctctgacattaccctgtgcaacttttctcaaagtctgttgcaccactcagcaaagcaagttgcaccagctatatcagaatcacctggggcagcctattaaaaatgcagactgttgagaccatcctggctaacacggtgaaaccctgtctctactaaaaatacaaaaaattagccggccgtggtggcgggcagctactcgggaggctgaggcaggagaatgacctgaacctgggaggcagagcttgcagtgagctgagattgtgccactgcactccagcctgggtgacagagcaagactccgtctcaaaaaaaaaaaaaaaagaaaaatgcagactggctggcgcggtggctcatgcttgtaatcccagcactttgggaggctgaggcgggcagatcaactgagatcgggggttcgagaccagcctgatcaacatggagaaacctggtctctactaaaaatacataattagctgggcgtagtggcgcatacctgtaatcccagctacttgggtggccaaggcttgaacccaggaggcggaggttgcggtgagccgagatggcgccattgactccagcctgggcaacaagagcgtaactccatctcaaaaaaataataataataaaaataaaatgcagactgtcaggtcctctctagacccactgaactatcccgcccaccctgggacggtccccagtgccagtgttttacccatgttccctctgtaagtcttatgcacaccgcaatttgagagccccactggtataaagtgagtgaaacccaggcagagacaggcaaaatggtgaggcccgcatcctattggtgagtcacacagggaacgctgaaattcatggccttctccaggctactgggaacccatgggcggtgatggagggagtggtgccaccttcacttgctgctgaggctcttccccctctccccagcatactccttacctggctgtctctcctcatgtataaggaacctatagtggtgtagaatctactcttcttccccctgtggcttccaggcccccctgtatagctgctatccagcccgatttctcaccactggcccagggcttcctcctgccccgtggcttcacgtctctgaacacatcaatctctgatgttctctctccttccattgaattccaccagacacattcagggtttacttcgtaatgtcttcatatgagtatcaatcaacaccttccccaactcaattgtactaggttgtagagcacaaggatggtctcgtgctgctctgtggcacctgtgcctacactcctctgagctttgaggaggctgctctctttgctgaccccatgatcttttctgcccttctgttaagggcattggccacagcaacggggcaaatgccccaagctggctgtaagtgacccatccctttggctcccatgattagaccaaggagaggcatggggtccagctgagccattcagaaccattccttagcattttccactcaaaggttagagatgagattttctcttcccaaggctacctctggccatggttccagcttcatgggggcaatgggattaggaaaatgaggtcaacctgcaaaggaaagcagatgcaagagatggagacagaatgggggtgtcctggggatcttggagcctgaattcattggcacaaaaggcagcagcatcctcactgtatctgcagtccatttggactcaataaaaactttgaaagtcacatgtgttatggaattccttctcagtgacacattcatctgtgctcagttgtcccagcaagggtcagcccctcatacccctgcagcatccgctgctatgaagcagagctgtaaacgccctccctgtgtataggaaaagctacatggagcaaatcctcctgcctgaagaagtgcatctcagcatcacttcagctgtcggggcatttgtggggagaaccagaccacctctgcggaaggcagcagaccctcttccagccatggatggagttgaattctctataaacggttcaccagcaaaccaccaatacattccattgtttgcctagagagaaatttaaaaataaataaatgttcacttataa

SEQ ID NO: 200309 - DNA, 3980 bp, Homo sapiens
  Payload ID: 19517
  Gene Name: WW and C2 domain containing 1
  ENST ID: ENST00000393895
  CDS Start-End: 1-3241
caggtacaccaaaccgctcacctttgctgactgcattagtgatgagttgccgctaggatgggaagaggcatatgacccacaggttggagattacttcatagaccacaacaccaaaaccactcagattgaggatcctcgagtacaatggcggcgggagcaggaacatatgctgaaggattacctggtggtggcccaggaggctctgagtgcacaaaaggagatctaccaggtgaagcagcagcgcctggagcttgcacagcaggagtaccagcaactgcatgccgtctgggagcataagctgggctcccaggtcagcttggtctctggttcatcatccagctccaagtatgaccctgagatcctgaaagctgaaattgccactgcaaaatcccgggtcaacaagctgaagagagagatggttcacctccagcacgagctgcagttcaaagagcgtggctttcagaccctgaagaaaatcgataagaaaatgtctgatgctcagggcagctacaaactggatgaagctcaggctgtcttgagagaaacaaaagccatcaaaaaggctattacctgtggggaaaaggaaaagcaagatctcattaagagccttgccatgttgaaggacggcttccgcactgacagggggtctcactcagacctgtggtccagcagcagctctctggagagttcgagtttcccgctaccgaaacagtacctggatgtgagctcccagacagacatctcgggaagcttcggcatcaacagcaacaatcagttggcagagaaggtcagattgcgccttcgatatgaagaggctaagagaaggatcgccaacctgaagatccagctggccaagcttgacagtgaggcctggcctggggtgctggactcagagagggaccggctgatccttatcaacgagaaggaggagctgctgaaggagatgcgcttcatcagcccccgcaagtggacccagggggaggtggagcagctggagatggcccggaagcggctggaaaaggacctgcaggcagcccgggacacccagagcaaggcgctgacggagaggttaaagttaaacagtaagaggaaccagcttgtgagagaactggaggaagccacccggcaggtggcaactctgcactcccagctgaaaagtctctcaagcagcatgcagtccctgtcctcaggcagcagccccggatccctcacgtccagccggggctccctggttgcatccagcctggactcctccacttcagccagcttcactgacctctactatgacccctttgagcagctggactcagagctgcagagcaaggtggagttcctgctcctggagggggccaccggcttccggccctcaggctgcatcaccaccatccacgaggatgaggtggccaagacccagaaggcagagggaggtggccgcctgcaggctctgcgttccctgtctggcaccccaaagtccatgacctccctatccccacgttcctctctctcctccccctccccaccctgttcccctctcatggctgaccccctcctggctggtgatgccttcctcaactccttggagtttgaagacccggagctgagtgccactctttgtgaactgagccttggtaacagcgcccaggaaagataccggctggaggaaccaggaacggagggcaagcagctgggccaagctgtgaatacggcccaggggtgtggcctgaaagtggcctgtgtctcagccgccgtatcggacgagtcagtggctggagacagtggtgtgtacgaggcttccgtgcagagactgggtgcttcagaagctgctgcatttgacagtgacgaatcggaagcagtgggtgcgacccgaattcagattgccctgaagtatgatgagaagaataagcaatttgcaatattaatcatccagctgagtaacctttctgctctgttgcagcaacaagaccagaaagtgaatatccgcgtggctgtccttccttgctctgaaagcacaacctgcctgttccggacccggcctctggacgcctcagacactctagtgttcaatgaggtgttctgggtatccatgtcctatccagcccttcaccagaagaccttaagagtcgatgtctgtaccaccgacaggagccatctggaagagtgcctgggaggcgcccagatcagcctggcggaggtctgccggtctggggagaggtcgactcgctggtacaaccttctcagctacaaatacttgaagaaacagagcagggagctcaagccagtgggagtcatggcccctgcctcagggcctgccagcacggacgctgtgtctgctctgttggaacagacagcagtggagctggagaagaggcaggagggcaggagcagcacacagacactggaagacagctggaggtatgaggagaccagtgagaatgaggcagtagccgaggaagaggaggaggaggtggaggaggaggagggagaagaggatgttttcaccgagaaagcctcacctgatatggatgggtacccagcattaaaggtggacaaagagaccaacacggagaccccggccccatcccccacagtggtgcgacctaaggaccggagagtgggcaccccgtcccaggggccatttcttcgagggagcaccatcatccgctctaagaccttctccccaggaccccagagccagtacgtgtgccggctgaatcggagtgatagtgacagctccactctgtccaaaaagccaccttttgttcgaaactccctggagcgacgcagcgtccggatgaagcggccgtccccacccccacagccttcctcggtcaagtcgctgcgctccgagcgtctgatccgtacctcgctggacctggagttagacctgcaggcgacaagaacctggcacagccaattgacccaggagatctcggtgctgaaggagctcaaggagcagctggaacaagccaagagccacggggagaaggagctgccacagtggttgcgtgaggacgagcgtttccgcctgctgctgaggatgctggagaagcggatggaccgagcggagcacaagggtgagcttcagacagacaagatgatgagggcagctgccaaggatgtgcacaggctccgaggccagagctgtaaggaacccccagaagttcagtctttcagggagaagatggcatttttcacccggcctcggatgaatatcccagctctctctgcagatgacgtctaatcgccagaaaagtatttcctttgttccactgaccaggctgtgaacattgactgtggctaaagttatttatgtggtgttatatgaaggtactgagtcacaagtcctctagtgctcttgttggtttgaagatgaaccgactttttagtttgggtcctactgttgttattaaaaacagaacaaaaacaaaacacacacacacacaaaaacagaaacaaaaaaaaccagcattaaaataataagattgtatagtttgtatatttaggagtgtatttttgggaaagaaaatttaaatgaactaaagcagtattgagttgctgctcttcttaaaatcgtttagattttttttggtttgtacagctccaccttttagaggtcttactgcaataagaagtaatgcctgggggacggtaatcctaataggacgtcccgcacttgtcacagtacagctaatttttcctagttaacatattttgtacaatattaaaaaaatgcacagaaaccattgggggggattcagaggtgcatccacggatcttcttgagctgtgacgtgtttttatgtggctgcccaacgtggagcgggcagtgtgataggctgggtgggctaagcagcctagtctatgtgggtgacaggccacgctggtctcagatgcccagtgaagccactaacatgagtgaggggagggctgtggggaactccattcagttttatctccatcaataaagtggcctttcaaaaa

SEQ ID NO: 200310 - DNA, 3562 bp, Homo sapiens
  Payload ID: 19517
  Gene Name: WW and C2 domain containing 1
  Uniprot ID: Q8IX03
  ENST ID: ENST00000521089
  CDS Start-End: 4-3363
aagatgccccggccggagctgcccctgccggagggctgggaggaggcgcgcgacttcgacggcaaggtctactacatagaccacacgaaccgcaccaccagctggatcgacccgcgggacaggtacaccaaaccgctcacctttgctgactgcattagtgatgagttgccgctaggatgggaagaggcatatgacccacaggttggagattacttcatagaccacaacaccaaaaccactcagattgaggatcctcgagtacaatggcggcgggagcaggaacatatgctgaaggattacctggtggtggcccaggaggctctgagtgcacaaaaggagatctaccaggtgaagcagcagcgcctggagcttgcacagcaggagtaccagcaactgcatgccgtctgggagcataagctgggctcccaggtcagcttggtctctggttcatcatccagctccaagtatgaccctgagatcctgaaagctgaaattgccactgcaaaatcccgggtcaacaagctgaagagagagatggttcacctccagcacgagctgcagttcaaagagcgtggctttcagaccctgaagaaaatcgataagaaaatgtctgatgctcagggcagctacaaactggatgaagctcaggctgtcttgagagaaacaaaagccatcaaaaaggctattacctgtggggaaaaggaaaagcaagatctcattaagagccttgccatgttgaaggacggcttccgcactgacagggggtctcactcagacctgtggtccagcagcagctctctggagagttcgagtttcccgctaccgaaacagtacctggatgtgagctcccagacagacatctcgggaagcttcggcatcaacagcaacaatcagttggcagagaaggtcagattgcgccttcgatatgaagaggctaagagaaggatcgccaacctgaagatccagctggccaagcttgacagtgaggcctggcctggggtgctggactcagagagggaccggctgatccttatcaacgagaaggaggagctgctgaaggagatgcgcttcatcagcccccgcaagtggacccagggggaggtggagcagctggagatggcccggaagcggctggaaaaggacctgcaggcagcccgggacacccagagcaaggcgctgacggagaggttaaagttaaacagtaagaggaaccagcttgtgagagaactggaggaagccacccggcaggtggcaactctgcactcccagctgaaaagtctctcaagcagcatgcagtccctgtcctcaggcagcagccccggatccctcacgtccagccggggctccctggttgcatccagcctggactcctccacttcagccagcttcactgacctctactatgacccctttgagcagctggactcagagctgcagagcaaggtggagttcctgctcctggagggggccaccggcttccggccctcaggctgcatcaccaccatccacgaggatgaggtggccaagacccagaaggcagagggaggtggccgcctgcaggctctgcgttccctgtctggcaccccaaagtccatgacctccctatccccacgttcctctctctcctccccctccccaccctgttcccctctcatggctgaccccctcctggctggtgatgccttcctcaactccttggagtttgaagacccggagctgagtgccactctttgtgaactgagccttggtaacagcgcccaggaaagataccggctggaggaaccaggaacggagggcaagcagctgggccaagctgtgaatacggcccaggggtgtggcctgaaagtggcctgtgtctcagccgccgtatcggacgagtcagtggctggagacagtggtgtgtacgaggcttccgtgcagagactgggtgcttcagaagctgctgcatttgacagtgacgaatcggaagcagtgggtgcgacccgaattcagattgccctgaagtatgatgagaagaataagcaatttgcaatattaatcatccagctgagtaacctttctgctctgttgcagcaacaagaccagaaagtgaatatccgcgtggctgtccttccttgctctgaaagcacaacctgcctgttccggacccggcctctggacgcctcagacactctagtgttcaatgaggtgttctgggtatccatgtcctatccagcccttcaccagaagaccttaagagtcgatgtctgtaccaccgacaggagccatctggaagagtgcctgggaggcgcccagatcagcctggcggaggtctgccggtctggggagaggtcgactcgctggtacaaccttctcagctacaaatacttgaagaaacagagcagggagctcaagccagtgggagtcatggcccctgcctcagggcctgccagcacggacgctgtgtctgctctgttggaacagacagcagtggagctggagaagaggcaggagggcaggagcagcacacagacactggaagacagctggaggtatgaggagaccagtgagaatgaggcagtagccgaggaagaggaggaggaggtggaggaggaggagggagaagaggatgttttcaccgagaaagcctcacctgatatggatgggtacccagcattaaaggtggacaaagagaccaacacggagaccccggccccatcccccacagtggtgcgacctaaggaccggagagtgggcaccccgtcccaggggccatttcttcgagggagcaccatcatccgctctaagaccttctccccaggaccccagagccagtacgtgtgccggctgaatcggagtgatagtgacagctccactctgtccaaaaagccaccttttgttcgaaactccctggagcgacgcagcgtccggatgaagcggccgtccccacccccacagccttcctcggtcaagtcgctgcgctccgagcgtctgatccgtacctcgctggacctggagttagacctgcaggcgacaagaacctggcacagccaattgacccaggagatctcggtgctgaaggagctcaaggagcagctggaacaagccaagagccacggggagaaggagctgccacagtggttgcgtgaggacgagcgtttccgcctgctgctgaggatgctggagaagcggcagatggaccgagcggagcacaagggtgagcttcagacagacaagatgatgagggcagctgccaaggatgtgcacaggctccgaggccagagctgtaaggaacccccagaagttcagtctttcagggagaagatggcatttttcacccggcctcggatgaatatcccagctctctctgcagatgacgtctaatcgccagaaaagtatttcctttgttccactgaccaggctgtgaacattgactgtggctaaagttatttatgtggtgttatatgaaggtactgagtcacaagtcctctagtgctcttgttggtttgaagatgaaccgactttttagtttgggtcctactgttgttattaaaaacagaacaaaaacaaaacacacacacac

SEQ ID NO: 200311 - DNA, 2077 bp, Homo sapiens
  Payload ID: 19517
  Gene Name: WW and C2 domain containing 1
  ENST ID: ENST00000524038
  CDS Start-End: 1-1335
tttgcaatattaatcatccagctgagtaacctttctgctctgttgcagcaacaagaccagaaagtgaatatccgcgtggctgtccttccttgctctgaaagcacaacctgcctgttccggacccggcctctggacgcctcagacactctagtgttcaatgaggtgttctgggtatccatgtcctatccagcccttcaccagaagaccttaagagtcgatgtctgtaccaccgacaggagccatctggaagagtgcctgggaggcgcccagatcagcctggcggaggtctgccggtctggggagaggtcgactcgctggtacaaccttctcagctacaaatacttgaagaaacagagcagggagctcaagccagtgggagtcatggcccctgcctcagggcctgccagcacggacgctgtgtctgctctgttggaacagacagcagtggagctggagaagaggcaggagggcaggagcagcacacagacactggaagacagctggaggtatgaggagaccagtgagaatgaggcagtagccgaggaagaggaggaggaggtggaggaggaggagggagaagaggatgttttcaccgagaaagcctcacctgatatggatgggtacccagcattaaaggtggacaaagagaccaacacggagaccccggccccatcccccacagtggtgcgacctaaggaccggagagtgggcaccccgtcccaggggccatttcttcgagggagcaccatcatccgctctaagaccttctccccaggaccccagagccagtacgtgtgccggctgaatcggagtgatagtgacagctccactctgtccaaaaagccaccttttgttcgaaactccctggagcgacgcagcgtccggatgaagcggccgtccccacccccacagccttcctcggtcaagtcgctgcgctccgagcgtctgatccgtacctcgctggacctggagttagacctgcaggcgacaagaacctggcacagccaattgacccaggagatctcggtgctgaaggagctcaaggagcagctggaacaagccaagagccacggggagaaggagctgccacagtggttgcgtgaggacgagcgtttccgcctgctgctgaggatgctggagaagcggatggaccgagcggagcacaagggtgagcttcagacagacaagatgatgagggcagctgccaaggatgtgcacaggctccgaggccagagctgtaaggaacccccagaagttcagtctttcagggagaagatggcatttttcacccggcctcggatgaatatcccagctctctctgcagatgacgtctaatcgccagaaaagtatttcctttgttccactgaccaggctgtgaacattgactgtggctaaagttatttatgtggtgttatatgaaggtactgagtcacaagtcctctagtgctcttgttggtttgaagatgaaccgactttttagtttgggtcctactgttgttattaaaaacagaacaaaaacaaaacacacacacacacaaaaacagaaacaaaaaaaaccagcattaaaataataagattgtatagtttgtatatttaggagtgtatttttgggaaagaaaatttaaatgaactaaagcagtattgagttgctgctcttcttaaaatcgtttagattttttttggtttgtacagctccaccttttagaggtcttactgcaataagaagtaatgcctgggggacggtaatcctaataggacgtcccgcacttgtcacagtacagctaatttttcctagttaacatattttgtacaatattaaaaaaatgcacagaaaccattgggggggattcagaggtgcatccacggatcttcttgagctgtgacgtgtttttatgtggctgcccaacgtggagcgggcagtgtgataggctgggtgggctaagcagcctagtctatgtgggtgacaggccacgctggtctcagatgcccagtgaagccactaacatgagtgaggggagggctgtggggaactccattcagttttatctccatcaataaagtggcctttcaaaaagaa

SEQ ID NO: 200312 - DNA, 3408 bp, Homo sapiens
  Payload ID: 19517
  Gene Name: WW and C2 domain containing 1
  ENST ID: ENST00000524228
  CDS Start-End: 1-2668
caaaaaggctattacctgtggggaaaaggaaaagcaagatctcattaagagccttgccatgttgaaggacggcttccgcactgacagggggtctcactcagacctgtggtccagcagcagctctctggagagttcgagtttcccgctaccgaaacagtacctggatgtgagctcccagacagacatctcgggaagcttcggcatcaacagcaacaatcagttggcagagaaggtcagattgcgccttcgatatgaagaggctaagagaaggatcgccaacctgaagatccagctggccaagcttgacagtgaggcctggcctggggtgctggactcagagagggaccggctgatccttatcaacgagaaggaggagctgctgaaggagatgcgcttcatcagcccccgcaagtggacccagggggaggtggagcagctggagatggcccggaagcggctggaaaaggacctgcaggcagcccgggacacccagagcaaggcgctgacggagaggttaaagttaaacagtaagaggaaccagcttgtgagagaactggaggaagccacccggcaggtggcaactctgcactcccagctgaaaagtctctcaagcagcatgcagtccctgtcctcaggcagcagccccggatccctcacgtccagccggggctccctggttgcatccagcctggactcctccacttcagccagcttcactgacctctactatgacccctttgagcagctggactcagagctgcagagcaaggtggagttcctgctcctggagggggccaccggcttccggccctcaggctgcatcaccaccatccacgaggatgaggtggccaagacccagaaggcagagggaggtggccgcctgcaggctctgcgttccctgtctggcaccccaaagtccatgacctccctatccccacgttcctctctctcctccccctccccaccctgttcccctctcatggctgaccccctcctggctggtgatgccttcctcaactccttggagtttgaagacccggagctgagtgccactctttgtgaactgagccttggtaacagcgcccaggaaagataccggctggaggaaccaggaacggagggcaagcagctgggccaagctgtgaatacggcccaggggtgtggcctgaaagtggcctgtgtctcagccgccgtatcggacgagtcagtggctggagacagtggtgtgtacgaggcttccgtgcagagactgggtgcttcagaagctgctgcatttgacagtgacgaatcggaagcagtgggtgcgacccgaattcagattgccctgaagtatgatgagaagaataagcaatttgcaatattaatcatccagctgagtaacctttctgctctgttgcagcaacaagaccagaaagtgaatatccgcgtggctgtccttccttgctctgaaagcacaacctgcctgttccggacccggcctctggacgcctcagacactctagtgttcaatgaggtgttctgggtatccatgtcctatccagcccttcaccagaagaccttaagagtcgatgtctgtaccaccgacaggagccatctggaagagtgcctgggaggcgcccagatcagcctggcggaggtctgccggtctggggagaggtcgactcgctggtacaaccttctcagctacaaatacttgaagaaacagagcagggagctcaagccagtgggagtcatggcccctgcctcagggcctgccagcacggacgctgtgtctgctctgttggaacagacagcagtggagctggagaagaggcaggagggcaggagcagcacacagacactggaagacagctggaggtatgaggagaccagtgagaatgaggcagtagccgaggaagaggaggaggaggtggaggaggaggagggagaagaggatgttttcaccgagaaagcctcacctgatatggatgggtacccagcattaaaggtggacaaagagaccaacacggagaccccggccccatcccccacagtggtgcgacctaaggaccggagagtgggcaccccgtcccaggggccatttcttcgagggagcaccatcatccgctctaagaccttctccccaggaccccagagccagtacgtgtgccggctgaatcggagtgatagtgacagctccactctgtccaaaaagccaccttttgttcgaaactccctggagcgacgcagcgtccggatgaagcggccttcctcggtcaagtcgctgcgctccgagcgtctgatccgtacctcgctggacctggagttagacctgcaggcgacaagaacctggcacagccaattgacccaggagatctcggtgctgaaggagctcaaggagcagctggaacaagccaagagccacggggagaaggagctgccacagtggttgcgtgaggacgagcgtttccgcctgctgctgaggatgctggagaagcggatggaccgagcggagcacaagggtgagcttcagacagacaagatgatgagggcagctgccaaggatgtgcacaggctccgaggccagagctgtaaggaacccccagaagttcagtctttcagggagaagatggcatttttcacccggcctcggatgaatatcccagctctctctgcagatgacgtctaatcgccagaaaagtatttcctttgttccactgaccaggctgtgaacattgactgtggctaaagttatttatgtggtgttatatgaaggtactgagtcacaagtcctctagtgctcttgttggtttgaagatgaaccgactttttagtttgggtcctactgttgttattaaaaacagaacaaaaacaaaacacacacacacacaaaaacagaaacaaaaaaaaccagcattaaaataataagattgtatagtttgtatatttaggagtgtatttttgggaaagaaaatttaaatgaactaaagcagtattgagttgctgctcttcttaaaatcgtttagattttttttggtttgtacagctccaccttttagaggtcttactgcaataagaagtaatgcctgggggacggtaatcctaataggacgtcccgcacttgtcacagtacagctaatttttcctagttaacatattttgtacaatattaaaaaaatgcacagaaaccattgggggggattcagaggtgcatccacggatcttcttgagctgtgacgtgtttttatgtggctgcccaacgtggagcgggcagtgtgataggctgggtgggctaagcagcctagtctatgtgggtgacaggccacgctggtctcagatgcccagtgaagccactaacatgagtgaggggagggctgtggggaactccattcagttttatctccatcaataaagtggcctttcaaaaag

SEQ ID NO: 200313 - DNA, 1014 bp, Homo sapiens
  Payload ID: 19517
  Gene Name: WW and C2 domain containing 1
  ENST ID: ENST00000619752
  CDS Start-End: 1-1014
atgtcctatccagcccttcaccagaagaccttaagagtcgatgtctgtaccaccgacaggagccatctggaagagtgcctgggaggcgcccagatcagcctggcggaggtctgccggtctggggagaggtcgactcgctggtacaaccttctcagctacaaatacttgaagaaacagagcagggagctcaagccagtgggagtcatggcccctgcctcagggcctgccagcacggtgagctgggaccaggacgctgtgtctgctctgttggaacagacagcagtggagctggagaagaggcaggagggcaggagcagcacacagacactggaagacagctggaggtatgaggagaccagtgagaatgaggcagtagccgaggaagaggaggaggaggtggaggaggaggagggagaagaggatgttttcaccgagaaagcctcacctgatatggatgggtacccagcattaaaggtggacaaagagaccaacacggagaccccggccccatcccccacagtggtgcgacctaaggaccggagagtgggcaccccgtcccaggggccatttcttcgagggagcaccatcatccgctctaagaccttctccccaggaccccagagccagtacgtgtgccggctgaatcggagtgatagtgacagctccactctgtccaaaaagccaccttttgttcgaaactccctggagcgacgcagcgtccggatgaagcggccttcctcggtcaagtcgctgcgctccgagcgtctgatccgtacctcgctggacctggagttagacctgcaggcgacaagaacctggcacagccaattgacccaggagatctcggtgctgaaggagctcaaggagcagctggaacaagccaagagccacggggagaaggagctgccacagtggttgcgtgaggacgagcgtttccgcctgctgctgaggatgctggagaagcggcagatggaccgagcggagcacaagggtgagcttcagacaacaagatga

SEQ ID NO: 200314 - DNA, 8826 bp, Homo sapiens
  Payload ID: 19518
  Gene Name: WW and C2 domain containing 2
  Uniprot ID: Q6AWC2
  ENST ID: ENST00000403733
  CDS Start-End: 200-3778
ctgatccgcagcggggccgcgaacagcgtttcctgaggcacctcccgcgcgtggttccgccgcgccccgcgccctgcgcccctcagcccctcgccggcgcccgcgtcgcgggttggcagcctagcccggcagccgcgttcccgccgcgtcccgcgcccggtacctatggaggcgccgctcgccggcgaggccgccgaccatgcctaggagggccgggagcggtcagctgccgctgccccggggctgggaggaggccagggactacgacggcaaggtcttctacattgaccacaacaccaggaggaccagctggatcgacccccgggacaggttaacgaagcccttgtcatttgctgattgtgttggggatgagctgccgtggggatgggaagcagggtttgaccctcagattggtgtctactacatcgatcacatcaacaaaaccacgcagatagaagatccaagaaaacaatggaggggggaacaggagaagatgctcaaggactacctctctgtggcacaggatgccctccggacacagaaggaactgtaccatgtgaaggagcagaggctggcgctggccctggatgaatacgtgcgattaaatgatgcctataaggaaaagtcaagttctcacacaagcttattctcaggatcttcatccagtactaaatatgatcccgatattttaaaagctgagatctccactacaagattaagggttaaaaagctaaagagagagctctcacagatgaagcaggaactgctctataaagaacaaggctttgaaacattgcagcaaattgataaaaaaatgtctggaggccagagcgggtatgaactcagtgaagccaaagccattctaacagaactaaaatctatcagaaaggcaattagctcaggagaaaaagaaaaacaagatctgatgcagagtcttgctaagctgcaggagcggtttcatttggatcagaacattggcagatctgagccagatttgagatgtagtcctgtgaactctcatttatgtctctccagacagacccttgatgctgggtcacaaacaagcatttccggagatattggagtaagaagtagatcaaatttagctgaaaaggtcaggctaagcctacagtatgaagaagccaaaagaagtatggccaacttaaaaattgaactgtcaaaattggacagtgaggcctggcctggggcactggatattgagaaggaaaaactgatgctgattaatgaaaaagaagaacttttgaaagagcttcagttcgtcaccccacagaaacgtacccaagatgaattagaacgcctagaagctgaaaggcagcggctggaagaagagttgctgtctgtgaggggaacaccaagcagagctctggccgagagattgagattggaagagagaagaaaagagctgctacagaaacttgaagaaactactaaattaactacttatttgcattcacaacttaaaagcctctctgccagcaccctgtccatgtcatctgggagcagcctgggttccctggcatcgagtcggggctctctgaacacctccagcagagggtcactcaactccctcagttccaccgaactctattacagcagtcaaagtgatcagatagatgtggattatcagtataaactggacttccttctgcaagagaaaagcggttacattccttctggacccatcaccaccatccatgaaaacgaggtggtcaagtcccctagccagcctggccagagtggactctgtggagtggcagctgcagcaacaggccacactcctccactggctgaggccccgaagtctgtggcctccctgtcctcgaggtcctccctttcctccttgtctcctccaggctctcccttggttttggaaggcacgtttcccatgtcttcttctcatgatgcctctctccatcagttcactgctgactttgaagactgtgagttgagtagccattttgcagatatcagcctcatcgaaaatcagattttgctggattctgattcaggaggagcctcccagtctctttcagaggataaagaccttaatgaatgtgctagggagccattatatgaaggaactgcagatgtggaaaaatcattaccaaaaagaagagtgatccacttgcttggggagaaaaccacttgtgtgtcggctgctgtgtctgatgagtctgtggctggagacagtggggtctatgaagctttcgtgaaacaacctagtgaaatggaagatgtcacatacagtgaagaggatgtagccattgtagagaccgcccaggttcagataggactcagatacaatgcaaaaagttcaagtttcatggtgattatagcacagctccgaaaccttcatgccttcttgatacctcatacttcaaaagtatattttagggttgccgttcttccttcctcaactgatgtcagctgtctgtttcgcacaaaagttcatccgcccacagaatccattttattcaatgatgtgttcagagtcgccatttcccaaacagccttacaacagaagacactgagggtagacctttgctctgtcagtaaacaccgaagggaagaatgcctggctggaactcagatcagcctggcagatttaccattttccagtgaggttttcactctatggtataacttgcttccttccaagcaaatgccttgcaaaaagaatgaagaaaatgaggactctgtatttcaaccaaaccagccgttagtagattctatagacttggatgcagtgtcagccttacttgcaagaacatcagctgagttgttagctgtggaacaagaattagcacaagaagaagaagaagaatcaggacaagaagagccaaggggcccagatggagactggctaacaatgctaagagaggcctctgatgaaattgtggctgaaaaagaggctgaagttaaattgccagaggacagtagctgtacagaagatttaagttcatgcactagtgtgcctgagatgaatgaagacgggaacaggaaagaaagcaactgtgccaaagacctcagaagtcagccacctactagaataccaacactggttgacaaagagacaaacactgatgaagccgctaatgacaatatggcagttcgccccaaagagcgcagcagcctgagctctagacagcatccgtttgtgaggagcagtgtgatagtgcgctcacagaccttttctccaggagagcggaaccagtacatctgcaggttaaatcggagtgacagtgacagttcaaccctggctaaaaaatcactgtttgtgagaaactccaccgaacgccgcagtttgagggtcaaaaggacggtttgccagtcagtccttagaagaacaacacaggaatgcccagtgcggacatctctagacttagaactggaccttcaggcatctctgacccggcagagccgcctcaatgatgagctgcaggcgctgagggacttgcggcagaagctggaggaactgaaagctcagggagagactgaccttccaccaggcgtgctggaggatgagaggttccagaggcttctgaagcaagctgagaagcaggctgaacagtccaaagaagagcagaagcaaggtctgaatgcagagaagttgatgaggcaagtctccaaggacgtgtgtcggctccgggagcagagccagaaggtgcctcggcaggtgcagtccttcagggagaagattgcctacttcaccagagcaaagataagcatcccatccctgccagctgatgatgtgtgattacatgacttaagaaattattttttcatctgttcactttcttagggagggtaaaagactgaagatttgtgtttttgttttggtgtttggttttttttggtaacgtaactgtcaactcttgaagaacttttatttcacatcagattttcaacacattaatttgtaaagtaccttgagtgtaatttttatatgcttaaaaaagaaaaaatcatataagaaagatgggataacctggtacacaaatgttgcccagtatgtgcgcattgccagtggacttcattttgtaaaaatggaatagaggcagtaccccacatgtgtactgttgagccggctgttgagaaacaacttggttcagccggtggttttgcttctcctttgtgttcctgtgagtaggctgtgccgatggcagcagcgccacgtggtatctgtgcgctggcgaggagaggagcgctttccatttggaggcagtgtgagcacacgctggagtgcagcgttccaaagtccgcccgaaatggatgctgcgtccacggccatcacctgtgcgggaacacctggtttccttaagacaatttcctttttgtccttttatatttttctaaagaaaactaagatataaactaccaagtgctcttaagaataaaaataagaataagaatacaaaggagcactactcttggctacacgaaagatcttgggattcatgacactgagggcagggagaagaaagaacaccagccacgcagagatacaaataagctcatcaaatgagcagctggtttgtctcactcagcctgaatttgcattaagtgttcaaaagtgagtttctggcttgcactagtgttttgccctaaatctaaggatggtgcctagtggtggccctgtgttctgaggacagagagagctggaggggtggagggaaatgcatcggcactcatttggtgtaaccaagaagagggggaaagatgtcttgatagaatcaaagttgccaaaaacaaagaagagtttatcaagcagatttctaacatttagtagaaactacttcatagctctcatttttagggggttctatctataatttatggtaaatagttgggaggcaaagggaagaatgtgtgtggggggattattaatttgaagtataagctaaattgtttattaaaaagcctattttggatgaacaagtttagagagataaactgactaatgtgtcctccagtttagaatttcaccttacccgacccaggcacttcttaaaaacacagatcctcagtgcagctctgccagcatcaaggcttttaaaatatgtagtatttaggccatttaaaccatacttattactcaataacccaagaaacaattttgggttagccatctaatatagcaaataaaatagattttttaaagaaatccaaaattgtcttaaaggaatggaccccttgaagaaaaaaaaaaaaagttttgttcctcagttagaatgctcactagctcactagcaagaatttttattttcttgaaagcaattatatatattttggaaagttcatgttattggaattgaagttcaaattaagcaacttctgagcctagaactttaattactttttcctaaatgtcccaacacttacatacaaatttctttgaagacataactggacatggcagacactgctttgaacaaaaaccagcctagtgaattgactgagtacagtcctttaaggctgcccagttcattctattagatgactaaggaaaactagaaaaagaatacagttcacccttgtcaaggtcaaatgtgaaagacagaagtttatttaatgtagaggtaaatgaaggtgagctgttttcagcatcttagtttgaccatgaaaatgtctatagaattatgtgtagttgttccgtacgattttattttcttcatttatttatttacagtcttatttatgttctgtttaatatatagtttgattctggccattttaaatatttgacacagaagagactatattggaatatttacagctttataagtctttcatcagattagctgttgactttttgtaatacaaaaagtttcagacaagtattaaagaataaaatctgtctcaggctggtagttagcagttgtgaccaagatgcttttggttgttgtatttcacaaaatttcctcatttctaacatgagagatgaacttattttaatataatcctttttctacactttaaaagtcagcaatagtgttatgtatttataggcagcttttaataatcttgtcatatttgtactaacccaaatgattcacagtgacaaaacattttaataacttgatcacaaaaccatatggacaaatatgaattttaatattataaatactatttttaaaaggtagaatttattcgcacagggtaaaaagaatgtaatatttagttctcaagtttgaattatcagtatattattacaattttgtatatcagaatcttaagtgttacaggtacaaaaagaatattgctagccaaatgaacaaagtttagctaaatctctgtagcatgcaaatcaaataaattaaaattttttgctattgctttatctatattgtcttaaatatcaaaagctcaggactgaacttaatatttaatcaggttaaattctgaacatgtttctgttttaatttgtcttgtttgtaaacgtatgcaaatacatcacatagattaactggtttctgcactttccatgtgtttgtgggtggaaaaaaattcagtggttttttttaaaaaaaaaagcaaaaacaaagctacatattgcctaatactctatttcagtgtcgtttattgttcagtttatttccctgattggcacaaacacaagagtttccttgaaccatgtaccaagcaaatacaaaatatttcatgaagaaatccccaggctggcagtttgtgatgaatagttcttgttggaactatatgtattgctgataaaaaaggacgaagtattttcattgagcaaataaaatgaagggctccagaatatgtgctctgtggtcgctgcgcctgggctggcagtgtgctccacagagaggcagccgtcccaggaggttatctacccacacaccccagtcctgccctgccgtgccccccacaggctgctcagtgcctgggaagccagaaacgctgcccgtgaaatacagaacacaggatgcagaagcacgtttgtgtggcagagtctacttgaatcatccaaaacccaagatcgccctcctgcctctgacagtatagaaggcgtgactgaatgtggctgccttttgaaaaaggttccatagagacactgaggtctctgattcagaaggagatgatgtgtctacacctttcacctctgaagcttctaaagagctagtaattattttatataataagacgtcatgcattttaaataaatatgcaacaagacctcaggcttattatactaggttatcttaaacacctgaaataagtaaatgatttgccaaatgattccgctccatatgaataataccttcaaagatacatagagattaatgttttatttaccacttctgtgcaatcgctattttaaaattgagaaaactcatccacagtaatgggtgtcattactattcagtcttgattgattttggtctcagactagaagataaaaatggtttaccagtcttggaaagaaactatagtttaatagccacaggaaaagatgcattttcaaaaatcaaaagcacagtgagatgactagagcgggacatcctaccaaatccagtgttgagcaagcgtctcctgaacagcagacgcttgtcctttctggcttagtgtttcaggttggtgtttctcgtctccagttcttgatgatgatcttgtgtttgtgccactgcgtagtggcccgaagctaggggagcgtggctggagcaggctgcacagtggagcagacaccctcctagcagaagagaaagtccagcaaaccagcccagaaacagggcctccccaaactcccacctggggacaaagtctgggacgttctcatcccagaactcctgaaccgtcttgtgggcaacccaagagacgggaaccagggctgtgactcccgaggcccaggacagaattcctcccaggatcagcagtcgcctcttgagatctctctgactctctccaattctcaaacagtccaggccaaacccagagaccagcaggcccagaaatcccagcccatttgacagaaacattaagatcctggagaccctgagttcagcaggcaaagccaggaaggagtcaaagtccttgcattgcatccccacttcctcttggatgacacaggtttgccagagtcccatggtccagttttccatttcatttaagtccaggttgaggttcttccagtgtggcaggtagtttgtaagacaggataaaacccatcccagcaaagataatgaaactccagctagttgagctacagttctaaatactaaagccattataatgtcctgagagctttagccaaactaactcctgcccttcggttgctgtgaaaagaagtgtgacacttgtgttataacttatgaaactcagaaatatttcttcattgtgtatataggaggattcttgccagagttgctattgtttgattccatgttgaatgggtttcacaaaaggatagggaaataatgccgccaaccagtaatgccaaggtgtggccaagattgtgtttgtgtcctgtgggctggatttgacagaaagcagtttgtcactgaaatataattaagtgataatctcctttcattgtcaaggttaaaatggctttcatgttattcccaacctttctaacaaagaattaagtctaaatgcaaaatgtttaactgatggttttggttcaactcctcctgctttgtgtttcactaactgcacctgtcagattttcatctcttatagttctcacatttcaaatgtgcatgttatggtaatactgagtgttattttttaaaaataggtttaagaaaagtatttcttaaccaaataaatcaatcttatcagaaa

SEQ ID NO: 200315 - DNA, 6373 bp, Homo sapiens
  Payload ID: 19518
  Gene Name: WW and C2 domain containing 2
  ENST ID: ENST00000427431
  CDS Start-End: 148-381
tcatttgctgattgtgttggggatgagctgccgtggggatgggaagcagggtttgaccctcagattggtgtctactacatcgatcacatcaacaaaaccacgcagatagaagatccaagaaaacaatggaggggggaacaggagaagatgctcaaggactacctctctgtggcacaggatgccctccggacacagaaggaactgtaccatgtgaaggagcagaggctggcgctggccctggatgaatacgtgcgattaaatgatgcctataaggaaaagtcaagttctcacacaagcttattctcaggatcttcatccagtactaaatatgatcccgatattttaaaagctgagatctccactacaagattaaggaattgataaaaaaatgtctggaggccagagcgggtatgaactcagtgaagccaaagccattctaacagaactaaaatctatcagaaaggcaattagctcaggagaaaaagaaaaacaagatctgatgcagagtcttgctaagctgcaggagcggtttcatttggatcagaacattggcagatctgagccagatttgagatgtagtcctgtgaactctcatttatgtctctccagacagacccttgatgctgggtcacaaacaagcatttccggagatattggagtaagaagtagatcaaatttagctgaaaaggtcaggctaagcctacagtatgaagaagccaaaagaagtatggccaacttaaaaattgaactgtcaaaattggacagtgaggcctggcctggggcactggatattgagaaggaaaaactgatgctgattaatgaaaaagaagaacttttgaaagagcttcagttcgtcaccccacagaaacgtacccaagatgaattagaacgcctagaagctgaaaggcagcggctggaagaagagttgctgtctgtgaggggaacaccaagcagagctctggccgagagattgagattggaagagagaagaaaagagctgctacagaaacttgaagaaactactaaattaactacttatttgcattcacaacttaaaagcctctctgccagcaccctgtccatgtcatctgggagcagcctgggttccctggcatcgagtcggggctctctgaacacctccagcagagggtcactcaactccctcagttccaccgaactctattacagcagtcaaagtgatcagatagatgtggattatcagtataaactggacttccttctgcaagagaaaagcggttacattccttctggacccatcaccaccatccatgaaaacgaggtggtcaagtcccctagccagcctggccagagtggactctgtggagtggcagctgcagcaacaggccacactcctccactggctgaggccccgaagtctgtggcctccctgtcctcgaggtcctccctttcctccttgtctcctccaggctctcccttggttttggaaggcacgtttcccatgtcttcttctcatgatgcctctctccatcagttcactgctgactttgaagactgtgagttgagtagccattttgcagatatcagcctcatcgaaaatcagattttgctggattctgattcaggaggagcctcccagtctctttcagaggataaagaccttaatgaatgtgctagggagccattatatgaaggaactgcagatgtggaaaaatcattaccaaaaagaagagtgatccacttgcttggggagaaaaccacttgtgtgtcggctgctgtgtctgatgagtctgtggctggagacagtggggtctatgaagctttcgtgaaacaacctagtgaaatggaagatgtcacatacagtgaagaggatgtagccattgtagagaccgcccaggttcagataggactcagatacaatgcaaaaagttcaagtttcatggtgattatagcacagctccgaaaccttcatgccttcttgatacctcatacttcaaaagtatattttagggttgccgttcttccttcctcaactgatgtcagctgtctgtttcgcacaaaagttcatccgcccacagaatccattttattcaatgatgtgttcagagtcgccatttcccaaacagccttacaacagaagacactgagggtagacctttgctctgtcagtaaacaccgaagggaagaatgcctggctggaactcagatcagcctggcagatttaccattttccagtgaggttttcactctatggtataacttgcttccttccaagcaaatgccttgcaaaaagaatgaagaaaatgaggactctgtatttcaaccaaaccagccgttagtagattctatagacttggatgcagtgtcagccttacttgcaagaacatcagctgagttgttagctgtggaacaagaattagcacaagaagaagaagaagaatcaggacaagaagagccaaggggcccagatggagactggctaacaatgctaagagaggcctctgatgaaattgtggctgaaaaagaggctgaagttaaattgccagaggacagtagctgtacagaagatttaagttcatgcactagtgtgcctgagatgaatgaagacgggaacaggaaagaaagcaactgtgccaaagacctcagaagtcagccacctactagaataccaacactggttgacaaagagacaaacactgatgaagccgctaatgacaatatggcagttcgccccaaagagcgcagcagcctgagctctagacagcatccgtttgtgaggagcagtgtgatagtgcgctcacagaccttttctccaggagagcggaaccagtacatctgcaggttaaatcggagtgacagtgacagttcaaccctggctaaaaaatcactgtttgtgagaaactccaccgaacgccgcagtttgagggtcaaaaggacggtttgccagtcagtccttagaagaacaacacaggaatgcccagtgcggacatctctagacttagaactggaccttcaggcatctctgacccggcagagccgcctcaatgatgagctgcaggcgctgagggacttgcggcagaagctggaggaactgaaagctcagggagagactgaccttccaccaggcgtgctggaggatgagaggttccagaggcttctgaagcaagctgagaagcaggctgaacagtccaaagaagagcagaagcaaggtctgaatgcagagaagttgatgaggcaagtctccaaggacgtgtgtcggctccgggagcagagccagaaggtgcctcggcaggtgcagtccttcagggagaagattgcctacttcaccagagcaaagataagcatcccatccctgccagctgatgatgtgtgattacatgacttaagaaattattttttcatctgttcactttcttagggagggtaaaagactgaagatttgtgtttttgttttggtgtttggttttttttggtaacgtaactgtcaactcttgaagaacttttatttcacatcagattttcaacacattaatttgtaaagtaccttgagtgtaatttttatatgcttaaaaaagaaaaaatcatataagaaagatgggataacctggtacacaaatgttgcccagtatgtgcgcattgccagtggacttcattttgtaaaaatggaatagaggcagtaccccacatgtgtactgttgagccggctgttgagaaacaacttggttcagccggtggttttgcttctcctttgtgttcctgtgagtaggctgtgccgatggcagcagcgccacgtggtatctgtgcgctggcgaggagaggagcgctttccatttggaggcagtgtgagcacacgctggagtgcagcgttccaaagtccgcccgaaatggatgctgcgtccacggccatcacctgtgcgggaacacctggtttccttaagacaatttcctttttgtccttttatatttttctaaagaaaactaagatataaactaccaagtgctcttaagaataaaaataagaataagaatacaaaggagcactactcttggctacacgaaagatcttgggattcatgacactgagggcagggagaagaaagaacaccagccacgcagagatacaaataagctcatcaaatgagcagctggtttgtctcactcagcctgaatttgcattaagtgttcaaaagtgagtttctggcttgcactagtgttttgccctaaatctaaggatggtgcctagtggtggccctgtgttctgaggacagagagagctggaggggtggagggaaatgcatcggcactcatttggtgtaaccaagaagagggggaaagatgtcttgatagaatcaaagttgccaaaaacaaagaagagtttatcaagcagatttctaacatttagtagaaactacttcatagctctcatttttagggggttctatctataatttatggtaaatagttgggaggcaaagggaagaatgtgtgtggggggattattaatttgaagtataagctaaattgtttattaaaaagcctattttggatgaacaagtttagagagataaactgactaatgtgtcctccagtttagaatttcaccttacccgacccaggcacttcttaaaaacacagatcctcagtgcagctctgccagcatcaaggcttttaaaatatgtagtatttaggccatttaaaccatacttattactcaataacccaagaaacaattttgggttagccatctaatatagcaaataaaatagattttttaaagaaatccaaaattgtcttaaaggaatggaccccttgaagaaaaaaaaaaaaagttttgttcctcagttagaatgctcactagctcactagcaagaatttttattttcttgaaagcaattatatatattttggaaagttcatgttattggaattgaagttcaaattaagcaacttctgagcctagaactttaattactttttcctaaatgtcccaacacttacatacaaatttctttgaagacataactggacatggcagacactgctttgaacaaaaaccagcctagtgaattgactgagtacagtcctttaaggctgcccagttcattctattagatgactaaggaaaactagaaaaagaatacagttcacccttgtcaaggtcaaatgtgaaagacagaagtttatttaatgtagaggtaaatgaaggtgagctgttttcagcatcttagtttgaccatgaaaatgtctatagaattatgtgtagttgttccgtacgattttattttcttcatttatttatttacagtcttatttatgttctgtttaatatatagtttgattctggccattttaaatatttgacacagaagagactatattggaatatttacagctttataagtctttcatcagattagctgttgactttttgtaatacaaaaagtttcagacaagtattaaagaataaaatctgtctcaggctggtagttagcagttgtgaccaagatgcttttggttgttgtatttcacaaaatttcctcatttctaacatgagagatgaacttattttaatataatcctttttctacactttaaaagtcagcaatagtgttatgtatttataggcagcttttaataatcttgtcatatttgtactaacccaaatgattcacagtgacaaaacattttaataacttgatcacaaaaccatatggacaaatatgaattttaatattataaatactatttttaaaaggtagaatttattcgcacagggtaaaaagaatgtaatatttagttctcaagtttgaattatcagtatattattacaattttgtatatcagaatcttaagtgttacaggtacaaaaagaatattgctagccaaatgaacaaagtttagctaaatctctgtagcatgcaaatcaaataaattaaaattttttgctattgctttatctatattgtcttaaatatcaaaagctcaggactgaacttaatatttaatcaggttaaattctgaacatgtttctgttttaatttgtcttgtttgtaaacgtatgcaaatacatcacatagattaactggtttctgcactttccatgtgtttgtgggtggaaaaaaattcagtggttttttttaaaaaaaaaagcaaaaacaaagctacatattgcctaatactctatttcagtgtcgtttattgttcagtttatttccctgattggcacaaacacaagagtttccttgaaccatgtaccaagcaaatacaaaatatttcatgaagaaatccccaggctggcagtttgtgatgaatagttcttgttggaactatatgtattgctgataaaaaaggacgaagtattttcattgagcaaataaaatgaagggctccagaa

SEQ ID NO: 200316 - DNA, 6356 bp, Homo sapiens
  Payload ID: 19518
  Gene Name: WW and C2 domain containing 2
  Uniprot ID: Q6AWC2
  ENST ID: ENST00000448232
  CDS Start-End: 1-3651
atgcctaggagggccgggagcggtcagctgccgctgccccggggctgggaggaggccagggactacgacggcaaggtcttctacattgaccacaacaccaggaggaccagctggatcgacccccgggacaggttaacgaagcccttgtcatttgctgattgtgttggggatgagctgccgtggggatgggaagcagggtttgaccctcagattggtgtctactacatcgatcacatcaacaaaaccacgcagatagaagatccaagaaaacaatggaggggggaacaggagaagatgctcaaggactacctctctgtggcacaggatgccctccggacacagaaggaactgtaccatgtgaaggagcagaggctggcgctggccctggatgaatacgtgcgattaaatgatgcctataaggaaaagtcaagttctcacacaagcttattctcaggatcttcatccagtactaaatatgatcccgatattttaaaagctgagatctccactacaagattaagggttaaaaagctaaagagagagctctcacagatgaagcaggaactgctctataaagaacaaggctttgaaacattgcagcaaattgataaaaaaatgtctggaggccagagcgggtatgaactcagtgaagccaaagccattctaacagaactaaaatctatcagaaaggcaattagctcaggagaaaaagaaaaacaagatctgatgcagagtcttgctaagctgcaggagcggtttcatttggatcagaacattggcagatctgagccagatttgagatgtagtcctgtgaactctcatttatgtctctccagacagacccttgatgctgggtcacaaacaagcatttccggagatattggagtaagaagtagatcaaatttagctgaaaaggtcaggctaagcctacagtatgaagaagccaaaagaagtatggccaacttaaaaattgaactgtcaaaattggacagtgaggcctggcctggggcactggatattgagaaggaaaaactgatgctgattaatgaaaaagaagaacttttgaaagagcttcagttcgtcaccccacagaaacgtacccaagatgaattagaacgcctagaagctgaaaggcagcggctggaagaagagttgctgtctgtgaggggaacaccaagcagagctctggccgagagattgagattggaagagagaagaaaagagctgctacagaaacttgaagaaactactaaattaactacttatttgcattcacaacttaaaagcctctctgccagcaccctgtccatgtcatctgggagcagcctgggttccctggcatcgagtcggggctctctgaacacctccagcagagggtcactcaactccctcagttccaccgaactctattacagcagtcaaagtgatcagatagatgtggattatcagtataaactggacttccttctgcaagagaaaagcggttacattccttctggacccatcaccaccatccatgaaaacgaggtggtcaagtcccctagccagcctggccagagtggactctgtggagtggcagctgcagcaacaggccacactcctccactggctgaggccccgaagtctgtggcctccctgtcctcgaggtcctccctttcctccttgtctcctccaggctctcccttggttttggaaggcacgtttcccatgtcttcttctcatgatgcctctctccatcagttcactgctgactttgaagactgtgagttgagtagccattttgcagatatcagcctcatcgaaaatcagattttgctggattctgattcaggaggagcctcccagtctctttcagaggataaagaccttaatgaatgtgctagggagccattatatgaaggaactgcagatgtggaaaaatcattaccaaaaagaagagtgatccacttgcttggggagaaaaccacttgtgtgtcggctgctgtgtctgatgagtctgtggctggagacagtggggtctatgaagctttcgtgaaacaacctagtgaaatggaagatgtcacatacagtgaagaggatgtagccattgtagagaccgcccaggttcagataggactcagatacaatgcaaaaagttcaagtttcatggtgattatagcacagctccgaaaccttcatgccttcttgatacctcatacttcaaaagtatattttagggttgccgttcttccttcctcaactgatgtcagctgtctgtttcgcacaaaagttcatccgcccacagaatccattttattcaatgatgtgttcagagtcgccatttcccaaacagccttacaacagaagacactgagggtagacctttgctctgtcagtaaacaccgaagggaagaatgcctggctggaactcagatcagcctggcagatttaccattttccagtgaggttttcactctatggtataacttgcttccttccaagcaaatgccttgcaaaaagaatgaagaaaatgaggactctgtatttcaaccaaaccagccgttagtagattctatagacttggatgcagtgtcagccttacttgcaagaacatcagctgagttgttagctgtggaacaagaattagcacaagaagaagaagaagaatcaggacaagaagagccaaggggcccagatggagactggttaaacacttatttcctttgctgttgggagctcaaagatgatgtgtttacacggcttacagtgaaacctttgctaacaatgctaagagaggcctctgatgaaattgtggctgaaaaagaggctgaagttaaattgccagaggacagtagctgtacagaagatttaagttcatgcactagtgtgcctgagatgaatgaagacgggaacaggaaagaaagcaactgtgccaaagacctcagaagtcagccacctactagaataccaacactggttgacaaagagacaaacactgatgaagccgctaatgacaatatggcagttcgccccaaagagcgcagcagcctgagctctagacagcatccgtttgtgaggagcagtgtgatagtgcgctcacagaccttttctccaggagagcggaaccagtacatctgcaggttaaatcggagtgacagtgacagttcaaccctggctaaaaaatcactgtttgtgagaaactccaccgaacgccgcagtttgagggtcaaaaggacggtttgccagtcagtccttagaagaacaacacaggaatgcccagtgcggacatctctagacttagaactggaccttcaggcatctctgacccggcagagccgcctcaatgatgagctgcaggcgctgagggacttgcggcagaagctggaggaactgaaagctcagggagagactgaccttccaccaggcgtgctggaggatgagaggttccagaggcttctgaagcaagctgagaagcaggctgaacagtccaaagaagagcagaagcaaggtctgaatgcagagaagttgatgaggcaagtctccaaggacgtgtgtcggctccgggagcagagccagaaggtgcctcggcaggtgcagtccttcagggagaagattgcctacttcaccagagcaaagataagcatcccatccctgccagctgatgatgtgtgattacatgacttaagaaattattttttcatctgttcactttcttagggagggtaaaagactgaagatttgtgtttttgttttggtgtttggttttttttggtaacgtaactgtcaactcttgaagaacttttatttcacatcagattttcaacacattaatttgtaaagtaccttgagtgtaatttttatatgcttaaaaaagaaaaaatcatataagaaagatgggataacctggtacacaaatgttgcccagtatgtgcgcattgccagtggacttcattttgtaaaaatggaatagaggcagtaccccacatgtgtactgttgagccggctgttgagaaacaacttggttcagccggtggttttgcttctcctttgtgttcctgtgagtaggctgtgccgatggcagcagcgccacgtggtatctgtgcgctggcgaggagaggagcgctttccatttggaggcagtgtgagcacacgctggagtgcagcgttccaaagtccgcccgaaatggatgctgcgtccacggccatcacctgtgcgggaacacctggtttccttaagacaatttcctttttgtccttttatatttttctaaagaaaactaagatataaactaccaagtgctcttaagaataaaaataagaataagaatacaaaggagcactactcttggctacacgaaagatcttgggattcatgacactgagggcagggagaagaaagaacaccagccacgcagagatacaaataagctcatcaaatgagcagctggtttgtctcactcagcctgaatttgcattaagtgttcaaaagtgagtttctggcttgcactagtgttttgccctaaatctaaggatggtgcctagtggtggccctgtgttctgaggacagagagagctggaggggtggagggaaatgcatcggcactcatttggtgtaaccaagaagagggggaaagatgtcttgatagaatcaaagttgccaaaaacaaagaagagtttatcaagcagatttctaacatttagtagaaactacttcatagctctcatttttagggggttctatctataatttatggtaaatagttgggaggcaaagggaagaatgtgtgtggggggattattaatttgaagtataagctaaattgtttattaaaaagcctattttggatgaacaagtttagagagataaactgactaatgtgtcctccagtttagaatttcaccttacccgacccaggcacttcttaaaaacacagatcctcagtgcagctctgccagcatcaaggcttttaaaatatgtagtatttaggccatttaaaccatacttattactcaataacccaagaaacaattttgggttagccatctaatatagcaaataaaatagattttttaaagaaatccaaaattgtcttaaaggaatggaccccttgaagaaaaaaaaaaaaagttttgttcctcagttagaatgctcactagctcactagcaagaatttttattttcttgaaagcaattatatatattttggaaagttcatgttattggaattgaagttcaaattaagcaacttctgagcctagaactttaattactttttcctaaatgtcccaacacttacatacaaatttctttgaagacataactggacatggcagacactgctttgaacaaaaaccagcctagtgaattgactgagtacagtcctttaaggctgcccagttcattctattagatgactaaggaaaactagaaaaagaatacagttcacccttgtcaaggtcaaatgtgaaagacagaagtttatttaatgtagaggtaaatgaaggtgagctgttttcagcatcttagtttgaccatgaaaatgtctatagaattatgtgtagttgttccgtacgattttattttcttcatttatttatttacagtcttatttatgttctgtttaatatatagtttgattctggccattttaaatatttgacacagaagagactatattggaatatttacagctttataagtctttcatcagattagctgttgactttttgtaatacaaaaagtttcagacaagtattaaagaataaaatctgtctcaggctggtagttagcagttgtgaccaagatgcttttggttgttgtatttcacaaaatttcctcatttctaacatgagagatgaacttattttaatataatcctttttctacactttaaaagtcagcaatagtgttatgtatttataggcagcttttaataatcttgtcatatttgtactaacccaaatgattcacagtgacaaaacattttaataacttgatcacaaaaccatatggacaaatatgaattttaatattataaatactatttttaaaaggtagaatttattcgcacagggtaaaaagaatgtaatatttagttctcaagtttgaattatcagtatattattacaattttgtatatcagaatcttaagtgttacaggtacaaaaagaatattgctagccaaatgaacaaagtttagctaaatctctgtagcatgcaaatcaaataaattaaaattttttgctattgctttatctatattgtcttaaatatcaaaagctcaggactgaacttaatatttaatcaggttaaattctgaacatgtttctgttttaatttgtcttgtttgtaaacgtatgcaaatacatcacataga

SEQ ID NO: 200317 - DNA, 3824 bp, Homo sapiens
  Payload ID: 19518
  Gene Name: WW and C2 domain containing 2
  Uniprot ID: Q6AWC2
  ENST ID: ENST00000438543
  CDS Start-End: 142-2280
agtgtggcctgggctgactaatgtacactctctacacccctaagaaaggggttgtggaactctgagtgggctgtggaagtattttcagaaaccacgcagatagaagatccaagaaaacaatggaggggggaacaggagaagatgctcaaggactacctctctgtggcacaggatgccctccggacacagaaggaactgtaccatgtgaaggagcagaggctggcgctggccctggatgaatacgtgcgattaaatgatgcctataaggaaaagtcaagttctcacacaagcttattctcaggatcttcatccagtactaaatatgatcccgatattttaaaagctgagatctccactacaagattaagggttaaaaagctaaagagagagctctcacagatgaagcaggaactgctctataaagaacaaggctttgaaacattgcagcaaattgataaaaaaatgtctggaggccagagcgggtatgaactcagtgaagccaaagccattctaacagaactaaaatctatcagaaaggcaattagctcaggagaaaaagaaaaacaagatctgatgcagagtcttgctaagctgcaggagcggtttcatttggatcagaacattggcagatctgagccagatttgagatgtagtcctgtgaactctcatttatgtctctccagacagacccttgatgctgggtcacaaacaagcatttccggagatattggagtaagaagtagatcaaatttagctgaaaaggtcaggctaagcctacagtatgaagaagccaaaagaagtatggccaacttaaaaattgaactgtcaaaattggacagtgaggcctggcctggggcactggatattgagaaggaaaaactgatgctgattaatgaaaaagaagaacttttgaaagagcttcagttcgtcaccccacagaaacgtacccaagatgaattagaacgcctagaagctgaaaggcagcggctggaagaagagttgctgtctgtgaggggaacaccaagcagagctctggccgagagattgagattggaagagagaagaaaagagctgctacagaaacttgaagaaactactaaattaactacttatttgcattcacaacttaaaagcctctctgccagcaccctgtccatgtcatctgggagcagcctgggttccctggcatcgagtcggggctctctgaacacctccagcagagggtcactcaactccctcagttccaccgaactctattacagcagtcaaagtgatcagatagatgtggattatcagtataaactggacttccttctgcaagagaaaagcggttacattccttctggacccatcaccaccatccatgaaaacgaggtggtcaagtcccctagccagcctggccagagtggactctgtggagtggcagctgcagcaacaggccacactcctccactggctgaggccccgaagtctgtggcctccctgtcctcgaggtcctccctttcctccttgtctcctccaggctctcccttggttttggaaggcacgtttcccatgtcttcttctcatgatgcctctctccatcagttcactgctgactttgaagactgtgagttgagtagccattttgcagatatcagcctcatcgaaaatcagattttgctggattctgattcaggaggagcctcccagtctctttcagaggataaagaccttaatgaatgtgctagggagccattatatgaaggaactgcagatgtggaaaaatcattaccaaaaagaagagtgatccacttgcttggggagaaaaccacttgtgtgtcggctgctgtgtctgatgagtctgtggctggagacagtggggtctatgaagctttcgtgaaacaacctagtgaaatggaagatgtcacatacagtgaagaggatgtagccattgtagagaccgcccaggttcagataggactcagatacaatgcaaaaagttcaagtttcatggtgattatagcacagctccgaaaccttcatgccttcttgatacctcatacttcaaaagtatattttagggttgccgttcttccttcctcaactgatgtcagctgtctgtttcgcacaaaagttcatccgcccacagaatccattttattcaatgatgtgttcagagtcgccatttcccaaacagccttacaacagaagacactgaggaagaactttacctttgtgacagctatcactcatggagtgtgcttaccactcccagtaccaatgccaagctttgcgtgactgctgtgtatatattatctcatttaatcctcatgacaacctgatgaaagattggttatgaaatggatgattatccactattttcagataaggagctgcttagagagtattggagctttcgggaagatgtgatgttactgtttaaagcaatatgacatttaaatgctacagcagaagacttcacagttaactaattgctggaactcagatcagcctggcagatttaccattttccagtgaggttttcactctatggtataacttgcttccttccaagcaaatgccttgcaaaaagaatgaagaaaatgaggactctgtatttcaaccaaaccagccgttagtagattctatagacttggatgcagtgtcagccttacttgcaagaacatcagctgagttgttagctgtggaacaagaattagcacaagaagaagaagaagaatcaggacaagaagagccaaggggcccagatggagactggctaacaatgctaagagaggcctctgatgaaattgtggctgaaaaagaggctgaagttaaattgccagaggacagtagctgtacagaagatttaagttcatgcactagtgtgcctgagatgaatgaagacgggaacaggaaagaaagcaactgtgccaaagacctcagaagtcagccacctactagaataccaacactggttgacaaagagacaaacactgatgaagccgctaatgacaatatggcagttcgccccaaagagcgcagcagcctgagctctagacagcatccgtttgtgaggagcagtgtgatagtgcgctcacagaccttttctccaggagagcggaaccagtacatctgcaggttaaatcggagtgacagtgacagttcaaccctggctaaaaaatcactgtttgtgagaaactccaccgaacgccgcagtttgagggtcaaaaggacggtttgccagtcagtccttagaagaacaacacaggaatgcccagtgcggacatctctagacttagaactggaccttcaggcatctctgacccggcagagccgcctcaatgatgagctgcaggcgctgagggacttgcggcagaagctggaggaactgaaagctcagggagagactgaccttccaccaggcgtgctggaggatgagaggttccagaggcttctgaagcaagctgagaagcaggctgaacagtccaaagaagagcagaagcaaggtctgaatgcagagaagttgatgaggcaagtctccaaggacgtgtgtcggctccgggagcagagccagaaggtgcctcggcaggtgcagtccttcagggagaagattgcctacttcaccagagcaaagataagcatcccatccctgccagctgatgatgtgtgattacatgacttaagaaattattttttcatctgttcactttcttagggagggtaaaagactgaagatttgtgtttttgttttggtgtttggttttttttggtaacgtaactgtcaactcttgaagaacttttatttcacatcagattttcaacacattaatttgtaaagt

SEQ ID NO: 200318 - DNA, 1216 bp, Homo sapiens
  Payload ID: 19518
  Gene Name: WW and C2 domain containing 2
  Uniprot ID: Q6AWC2
  ENST ID: ENST00000508747
  CDS Start-End: 34-996
tgagtctgtttatttcccagataacaacttagcatgcccaggttgcgtgttcatggagcatgcctgcctaccaaaagtgttttgtttttgttttaccataggctaacaatgctaagagaggcctctgatgaaattgtggctgaaaaagaggctgaagttaaattgccagaggacagtagctgtacagaagatttaagttcatgcactagtgtgcctgagatgaatgaagacgggaacaggaaagaaagcaactgtgccaaagacctcagaagtcagccacctactagaataccaacactggttgacaaagagacaaacactgatgaagccgctaatgacaatatggcagttcgccccaaagagcgcagcagcctgagctctagacagcatccgtttgtgaggagcagtgtgatagtgcgctcacagaccttttctccaggagagcggaaccagtacatctgcaggttaaatcggagtgacagtgacagttcaaccctggctaaaaaatcactgtttgtgagaaactccaccgaacgccgcagtttgagggtcaaaaggacggtttgccagtcagtccttagaagaacaacacaggaatgcccagtgcggacatctctagacttagaactggaccttcaggcatctctgacccggcagagccgcctcaatgatgagctgcaggcgctgagggacttgcggcagaagctggaggaactgaaagctcagggagagactgaccttccaccaggcgtgctggaggatgagaggttccagaggcttctgaagcaagctgagaagcaggctgaacagtccaaagaagagcagaagcaaggtctgaatgcagagaagttgatgaggcaagtctccaaggacgtgtgtcggctccgggagcagagccagaaggtgcctcggcaggtgcagtccttcagggagaagattgcctacttcaccagagcaaagataagcatcccatccctgccagctgatgatgtgtgattacatgacttaagaaattattttttcatctgttcactttcttagggagggtaaaagactgaagatttgtgtttttgttttggtgtttggttttttttggtaacgtaactgtcaactcttgaagaacttttatttcacatcagattttcaacacattaatttgtaaagtaccttgagtgtaatttttatatgcttaaaaaagaaaaaatcatataagaaa

SEQ ID NO: 200319 - DNA, 604 bp, Homo sapiens
  Payload ID: 19518
  Gene Name: WW and C2 domain containing 2
  ENST ID: ENST00000508614
  CDS Start-End: 154-399
gcgcgtggttccgccgcgccccgcgccctgcgcccctcagcccctcgccggcgcccgcgtcgcgggttggcagcctagcccggcagccgcgttcccgccgcgtcccgcgcccggtacctatggaggcgccgctcgccggcgaggccgccgaccatgcctaggagggccgggagcggtcagctgccgctgccccggggctgggaggaggccagggactacgacggcaaggtcttctacattgaccacaacaccaggaggaccagctggatcgacccccgggacaggttaacgaagcccttgtcatttgctgattgtgttggggatgagctgccgtggggatgggaagcagggtttgaccctcagattggtgtctactacatcgatcacatcaacagttaaaaagctaaagagagagctctcacagatgaagcaggaactgctctataaagaacaaggctttgaaacattgcagcaaattgataaaaaaatgtctggaggccagagcgggtatgaactcagtgaagccaaagccattctaacagaactaaaatctatcagaaaggcaattagctcaggagaaaaagaaaaacaagatctgatgcag

SEQ ID NO: 200320 - DNA, 4887 bp, Homo sapiens
  Payload ID: 19518
  Gene Name: WW and C2 domain containing 2
  Uniprot ID: Q6AWC2
  ENST ID: ENST00000513834
  CDS Start-End: 1-3432
atgcctaggagggccgggagcggtcagctgccgctgccccggggctgggaggaggccagggactacgacggcaaggtcttctacattgaccacaacaccaggaggaccagctggatcgacccccgggacaggttaacgaagcccttgtcatttgctgattgtgttggggatgagctgccgtggggatgggaagcagggtttgaccctcagattggtgtctactacatcgatcacatcaacaaaaccacgcagatagaagatccaagaaaacaatggaggggggaacaggagaagatgctcaaggactacctctctgtggcacaggatgccctccggacacagaaggaactgtaccatgtgaaggagcagaggctggcgctggccctggatgaatacgtgcgattaaatgatgcctataaggaaaagtcaagttctcacacaagcttattctcaggatcttcatccagtactaaatatgatcccgatattttaaaagctgagatctccactacaagattaagggttaaaaagctaaagagagagctctcacagatgaagcaggaactgctctataaagaacaaggctttgaaacattgcagcaaattgataaaaaaatgtctggaggccagagcgggtatgaactcagtgaagccaaagccattctaacagaactaaaatctatcagaaaggcaattagctcaggagaaaaagaaaaacaagatctgatgcagagtcttgctaagctgcaggagcggtttcatttggatcagaacattggcagatctgagccagatttgagatgtagtcctgtgaactctcatttatgtctctccagacagacccttgatgctgggtcacaaacaagcatttccggagatattggagtaagaagtagatcaaatttagctgaaaaggtcaggctaagcctacagtatgaagaagccaaaagaagtatggccaacttaaaaattgaactgtcaaaattggacagtgaggcctggcctggggcactggatattgagaaggaaaaactgatgctgattaatgaaaaagaagaacttttgaaagagcttcagttcgtcaccccacagaaacgtacccaagatgaattagaacgcctagaagctgaaaggcagcggctggaagaagagttgctgtctgtgaggggaacaccaagcagagctctggccgagagattgagattggaagagagaagaaaagagctgctacagaaacttgaagaaactactaaattaactacttatttgcattcacaacttaaaagcctctctgccagcaccctgtccatgtcatctgggagcagcctgggttccctggcatcgagtcggggctctctgaacacctccagcagagggtcactcaactccctcagttccaccgaactctattacagcagtcaaagtgatcagatagatgtggattatcagtataaactggacttccttctgcaagagaaaagcggttacattccttctggacccatcaccaccatccatgaaaacgaggtggtcaagtcccctagccagcctggccagagtggactctgtggagtggcagctgcagcaacaggccacactcctccactggctgaggccccgaagtctgtggcctccctgtcctcgaggtcctccctttcctccttgtctcctccaggctctcccttggttttggaaggcacgtttcccatgtcttcttctcatgatgcctctctccatcagttcactgctgactttgaagactatgtggaaaaatcattaccaaaaagaagagtgatccacttgcttggggagaaaaccacttgtgtgtcggctgctgtgtctgatgagtctgtggctggagacagtggggtctatgaagctttcgtgaaacaacctagtgaaatggaagatgtcacatacagtgaagaggatgtagccattgtagagaccgcccaggttcagataggactcagatacaatgcaaaaagttcaagtttcatggtgattatagcacagctccgaaaccttcatgccttcttgatacctcatacttcaaaagtatattttagggttgccgttcttccttcctcaactgatgtcagctgtctgtttcgcacaaaagttcatccgcccacagaatccattttattcaatgatgtgttcagagtcgccatttcccaaacagccttacaacagaagacactgagggtagacctttgctctgtcagtaaacaccgaagggaagaatgcctggctggaactcagatcagcctggcagatttaccattttccagtgaggttttcactctatggtataacttgcttccttccaagcaaatgccttgcaaaaagaatgaagaaaatgaggactctgtatttcaaccaaaccagccgttagtagattctatagacttggatgcagtgtcagccttacttgcaagaacatcagctgagttgttagctgtggaacaagaattagcacaagaagaagaagaagaatcaggacaagaagagccaaggggcccagatggagactggctaacaatgctaagagaggcctctgatgaaattgtggctgaaaaagaggctgaagttaaattgccagaggacagtagctgtacagaagatttaagttcatgcactagtgtgcctgagatgaatgaagacgggaacaggaaagaaagcaactgtgccaaagacctcagaagtcagccacctactagaataccaacactggttgacaaagagacaaacactgatgaagccgctaatgacaatatggcagttcgccccaaagagcgcagcagcctgagctctagacagcatccgtttgtgaggagcagtgtgatagtgcgctcacagaccttttctccaggagagcggaaccagtacatctgcaggttaaatcggagtgacagtgacagttcaaccctggctaaaaaatcactgtttgtgagaaactccaccgaacgccgcagtttgagggtcaaaaggacggtttgccagtcagtccttagaagaacaacacaggaatgcccagtgcggacatctctagacttagaactggaccttcaggcatctctgacccggcagagccgcctcaatgatgagctgcaggcgctgagggacttgcggcagaagctggaggaactgaaagctcagggagagactgaccttccaccaggcgtgctggaggatgagaggttccagaggcttctgaagcaagctgagaagcaggctgaacagtccaaagaagagcagaagcaaggtctgaatgcagagaagttgatgaggcaagtctccaaggacgtgtgtcggctccgggagcagagccagaaggtgcctcggcaggtgcagtccttcagggagaagattgcctacttcaccagagcaaagataagcatcccatccctgccagctgatgatgtgtgattacatgacttaagaaattattttttcatctgttcactttcttagggagggtaaaagactgaagatttgtgtttttgttttggtgtttggttttttttggtaacgtaactgtcaactcttgaagaacttttatttcacatcagattttcaacacattaatttgtaaagtaccttgagtgtaatttttatatgcttaaaaaagaaaaaatcatataagaaagatgggataacctggtacacaaatgttgcccagtatgtgcgcattgccagtggacttcattttgtaaaaatggaatagaggcagtaccccacatgtgtactgttgagccggctgttgagaaacaacttggttcagccggtggttttgcttctcctttgtgttcctgtgagtaggctgtgccgatggcagcagcgccacgtggtatctgtgcgctggcgaggagaggagcgctttccatttggaggcagtgtgagcacacgctggagtgcagcgttccaaagtccgcccgaaatggatgctgcgtccacggccatcacctgtgcgggaacacctggtttccttaagacaatttcctttttgtccttttatatttttctaaagaaaactaagatataaactaccaagtgctcttaagaataaaaataagaataagaatacaaaggagcactactcttggctacacgaaagatcttgggattcatgacactgagggcagggagaagaaagaacaccagccacgcagagatacaaataagctcatcaaatgagcagctggtttgtctcactcagcctgaatttgcattaagtgttcaaaagtgagtttctggcttgcactagtgttttgccctaaatctaaggatggtgcctagtggtggccctgtgttctgaggacagagagagctggaggggtggagggaaatgcatcggcactcatttggtgtaaccaagaagagggggaaagatgtcttgatagaatcaaagttgccaaaaacaaagaagagtttatcaagcagatttctaacatttagtagaaactacttcatagctctcatttttagggggttctatctataatttatggtaaatagttgggaggcaaagggaagaatgtgtgtggggggattattaatttgaagtataagctaaattgtttattaaaaagcctattttggatgaacaagtttagagagataaactgactaatgtgtcctccagtttagaatttcaccttacccgacccaggcacttcttaaaaacacagatcctcagtgcagctctgccagcatcaaggcttttaaaatatgtagtatttaggccatttaaaccatacttattactcaataacccaagaaacaattttgggttagccatctaatatagcaaataaaatagattttttaaagaaatccaaaattgtcttaaaggaatggaccccttgaagaaaaaaaaaaaaa

SEQ ID NO: 200321 - DNA, 5247 bp, Homo sapiens
  Payload ID: 19518
  Gene Name: WW and C2 domain containing 2
  Uniprot ID: Q6AWC2
  ENST ID: ENST00000504005
  CDS Start-End: 49-2673
atgatcccgatattttaaaagctgagatctccactacaagattaaggtatggccaacttaaaaattgaactgtcaaaattggacagtgaggcctggcctggggcactggatattgagaaggaaaaactgatgctgattaatgaaaaagaagaacttttgaaagagcttcagttcgtcaccccacagaaacgtacccaagatgaattagaacgcctagaagctgaaaggcagcggctggaagaagagttgctgtctgtgaggggaacaccaagcagagctctggccgagagattgagattggaagagagaagaaaagagctgctacagaaacttgaagaaactactaaattaactacttatttgcattcacaacttaaaagcctctctgccagcaccctgtccatgtcatctgggagcagcctgggttccctggcatcgagtcggggctctctgaacacctccagcagagggtcactcaactccctcagttccaccgaactctattacagcagtcaaagtgatcagatagatgtggattatcagtataaactggacttccttctgcaagagaaaagcggttacattccttctggacccatcaccaccatccatgaaaacgaggtggtcaagtcccctagccagcctggccagagtggactctgtggagtggcagctgcagcaacaggccacactcctccactggctgaggccccgaagtctgtggcctccctgtcctcgaggtcctccctttcctccttgtctcctccaggctctcccttggttttggaaggcacgtttcccatgtcttcttctcatgatgcctctctccatcagttcactgctgactttgaagactgtgagttgagtagccattttgcagatatcagcctcatcgaaaatcagattttgctggattctgattcaggaggagcctcccagtctctttcagaggataaagaccttaatgaatgtgctagggagccattatatgaaggaactgcagatgtggaaaaatcattaccaaaaagaagagtgatccacttgcttggggagaaaaccacttgtgtgtcggctgctgtgtctgatgagtctgtggctggagacagtggggtctatgaagctttcgtgaaacaacctagtgaaatggaagatgtcacatacagtgaagaggatgtagccattgtagagaccgcccaggttcagataggactcagatacaatgcaaaaagttcaagtttcatggtgattatagcacagctccgaaaccttcatgccttcttgatacctcatacttcaaaagtatattttagggttgccgttcttccttcctcaactgatgtcagctgtctgtttcgcacaaaagttcatccgcccacagaatccattttattcaatgatgtgttcagagtcgccatttcccaaacagccttacaacagaagacactgagggtagacctttgctctgtcagtaaacaccgaagggaagaatgcctggctggaactcagatcagcctggcagatttaccattttccagtgaggttttcactctatggtataacttgcttccttccaagcaaatgccttgcaaaaagaatgaagaaaatgaggactctgtatttcaaccaaaccagccgttagtagattctatagacttggatgcagtgtcagccttacttgcaagaacatcagctgagttgttagctgtggaacaagaattagcacaagaagaagaagaagaatcaggacaagaagagccaaggggcccagatggagactggctaacaatgctaagagaggcctctgatgaaattgtggctgaaaaagaggctgaagttaaattgccagaggacagtagctgtacagaagatttaagttcatgcactagtgtgcctgagatgaatgaagacgggaacaggaaagaaagcaactgtgccaaagacctcagaagtcagccacctactagaataccaacactggttgacaaagagacaaacactgatgaagccgctaatgacaatatggcagttcgccccaaagagcgcagcagcctgagctctagacagcatccgtttgtgaggagcagtgtgatagtgcgctcacagaccttttctccaggagagcggaaccagtacatctgcaggttaaatcggagtgacagtgacagttcaaccctggctaaaaaatcactgtttgtgagaaactccaccgaacgccgcagtttgagggtcaaaaggacggtttgccagtcagtccttagaagaacaacacaggaatgcccagtgcggacatctctagacttagaactggaccttcaggcatctctgacccggcagagccgcctcaatgatgagctgcaggcgctgagggacttgcggcagaagctggaggaactgaaagctcagggagagactgaccttccaccaggcgtgctggaggatgagaggttccagaggcttctgaagcaagctgagaagcaggctgaacagtccaaagaagagcagaagcaaggtctgaatgcagagaagttgatgaggcaagtctccaaggacgtgtgtcggctccgggagcagagccagaaggtgcctcggcaggtgcagtccttcagggagaagattgcctacttcaccagagcaaagataagcatcccatccctgccagctgatgatgtgtgattacatgacttaagaaattattttttcatctgttcactttcttagggagggtaaaagactgaagatttgtgtttttgttttggtgtttggttttttttggtaacgtaactgtcaactcttgaagaacttttatttcacatcagattttcaacacattaatttgtaaagtaccttgagtgtaatttttatatgcttaaaaaagaaaaaatcatataagaaagatgggataacctggtacacaaatgttgcccagtatgtgcgcattgccagtggacttcattttgtaaaaatggaatagaggcagtaccccacatgtgtactgttgagccggctgttgagaaacaacttggttcagccggtggttttgcttctcctttgtgttcctgtgagtaggctgtgccgatggcagcagcgccacgtggtatctgtgcgctggcgaggagaggagcgctttccatttggaggcagtgtgagcacacgctggagtgcagcgttccaaagtccgcccgaaatggatgctgcgtccacggccatcacctgtgcgggaacacctggtttccttaagacaatttcctttttgtccttttatatttttctaaagaaaactaagatataaactaccaagtgctcttaagaataaaaataagaataagaatacaaaggagcactactcttggctacacgaaagatcttgggattcatgacactgagggcagggagaagaaagaacaccagccacgcagagatacaaataagctcatcaaatgagcagctggtttgtctcactcagcctgaatttgcattaagtgttcaaaagtgagtttctggcttgcactagtgttttgccctaaatctaaggatggtgcctagtggtggccctgtgttctgaggacagagagagctggaggggtggagggaaatgcatcggcactcatttggtgtaaccaagaagagggggaaagatgtcttgatagaatcaaagttgccaaaaacaaagaagagtttatcaagcagatttctaacatttagtagaaactacttcatagctctcatttttagggggttctatctataatttatggtaaatagttgggaggcaaagggaagaatgtgtgtggggggattattaatttgaagtataagctaaattgtttattaaaaagcctattttggatgaacaagtttagagagataaactgactaatgtgtcctccagtttagaatttcaccttacccgacccaggcacttcttaaaaacacagatcctcagtgcagctctgccagcatcaaggcttttaaaatatgtagtatttaggccatttaaaccatacttattactcaataacccaagaaacaattttgggttagccatctaatatagcaaataaaatagattttttaaagaaatccaaaattgtcttaaaggaatggaccccttgaagaaaaaaaaaaaaagttttgttcctcagttagaatgctcactagctcactagcaagaatttttattttcttgaaagcaattatatatattttggaaagttcatgttattggaattgaagttcaaattaagcaacttctgagcctagaactttaattactttttcctaaatgtcccaacacttacatacaaatttctttgaagacataactggacatggcagacactgctttgaacaaaaaccagcctagtgaattgactgagtacagtcctttaaggctgcccagttcattctattagatgactaaggaaaactagaaaaagaatacagttcacccttgtcaaggtcaaatgtgaaagacagaagtttatttaatgtagaggtaaatgaaggtgagctgttttcagcatcttagtttgaccatgaaaatgtctatagaattatgtgtagttgttccgtacgattttattttcttcatttatttatttacagtcttatttatgttctgtttaatatatagtttgattctggccattttaaatatttgacacagaagagactatattggaatatttacagctttataagtctttcatcagattagctgttgactttttgtaatacaaaaagtttcagacaagtattaaagaataaaatctgtctcaggctggtagttagcagttgtgaccaagatgcttttggttgttgtatttcacaaaatttcctcatttctaacatgagagatgaacttattttaatataatcctttttctacactttaaaagtcagcaatagtgttatgtatttataggcagcttttaataatcttgtcatatttgtactaacccaaatgattcacagtgacaaaacattttaataacttgatcacaaaaccatatggacaaatatgaattttaatattataaatactatttttaaaaggtagaatttattcgcacagggtaaaaagaatgtaatatttagttctcaagtttgaattatcagtatattattacaattttgtatatcagaatcttaagtgttacaggtacaaaaagaatattgctagccaaatgaacaaagtttagctaaatctctgtagcatgcaaatcaaataaattaaaattttttgct

SEQ ID NO: 200322 - DNA, 1294 bp, Homo sapiens
  Payload ID: 19519
  Gene Name: WW domain binding protein 1
  Uniprot ID: Q96G27
  ENST ID: ENST00000233615
  CDS Start-End: 275-1084
cggcggaggcgctgctgtggattggtcacagggagaaacctctgatctgttcctattggcccgtccgtcaagggacgatgatgattggtagggcagagcaatctgagtcctagttggtggagttctgcccggatggaagctccggccgcggagtgatggtggcctcagcgaagatgggccgggcagggaccatggcggtggcagcagaggtggcaggggcggggcggctggcggtagaggaggctgtggtcctcagggggctgtaggtggaggtatggctcgggccagcagcgggaacggcagcgaggaggcctggggggcacttcgggcgccgcaacagcagcttcgagagctgtgcccaggagtgaacaaccagccctacctctgtgagagtggtcactgctgcggggagactggctgctgcacctactactatgagctctggtggttctggctgctctggactgtcctcatcctctttagctgctgttgcgccttccgccaccgacgagctaaactcaggctgcaacaacagcagcggcagcgtgaaatcaacttgttggcctatcatggggcatgccatggggctggtcctttccctaccggttcactgcttgaccttcgcttcctcagcaccttcaagcccccagcctacgaggatgtggttcaccgcccaggcacaccaccccccccttatactgtggccccaggccgccccttgactgcttccagtgaacaaacctgctgttcctcctcatccagctgccctgcccactttgaaggaacaaatgtggaaggtgtttcctcccaccagagtgccccccctcatcaggagggtgagcccggggcaggggtgacccctgcctccacacccccctcctgccgctatcgccgtttaactggcgactccggtattgagctctgcccttgtcctgcctccggtgagggtgagccagtcaaggaggtgagggttagtgccaccctgccagatctggaggactactccccgtgtgcactacccccagagtctgtaccgcagatctttcccatggggctgtcttccagtgaaggggacatcccataagtagttttgagagggtggatgggttacttgcccaccagaaacagccctagtcccaactccttgcgttcctttggcccctccctgcctacctagaatctgcctgaaagggctggagaggggcagtattgggggactgtgctagctttacccccgcaggacatacacaggagcctttgatctcattaaagagatgtgaaccagctacttgtg

SEQ ID NO: 200323 - DNA, 1325 bp, Homo sapiens
  Payload ID: 19519
  Gene Name: WW domain binding protein 1
  ENST ID: ENST00000393972
  CDS Start-End: 204-1115
gggacgatgatgattggtagggcagagcaatctgagtcctagttggtggagttctgcccggatggaagctccggccgcggagtgatggtggcctcagcgaagatgggccgggcagggaccatggcggtggcagcagaggtggcaggggcggggcggctggcggtagaggaggctgtggtcctcagggggctgtaggtggaggtatggctcgggccagcagcgggaacggcagcgaggaggcctggggggcacttcgggcgccgcaacagcagagtccggcagcgtcttctcttgagggagcaatttggagaagagctggaacccagactcgcgccctggatgccatcctttatcatccacagcaatcccatctgcttcgagagctgtgcccaggagtgaacaaccagccctacctctgtgagagtggtcactgctgcggggagactggctgctgcacctactactatgagctctggtggttctggctgctctggactgtcctcatcctctttagctgctgttgcgccttccgccaccgacgagctaaactcaggctgcaacaacagcagcggcagcgtgaaatcaacttgttggcctatcatggggcatgccatggggctggtcctttccctaccggttcactgcttgaccttcgcttcctcagcaccttcaagcccccagcctacgaggatgtggttcaccgcccaggcacaccaccccccccttatactgtggccccaggccgccccttgactgcttccagtgaacaaacctgctgttcctcctcatccagctgccctgcccactttgaaggaacaaatgtggaaggtgtttcctcccaccagagtgccccccctcatcaggagggtgagcccggggcaggggtgacccctgcctccacacccccctcctgccgctatcgccgtttaactggcgactccggtattgagctctgcccttgtcctgcctccggtgagggtgagccagtcaaggaggtgagggttagtgccaccctgccagatctggaggactactccccgtgtgcactacccccagagtctgtaccgcagatctttcccatggggctgtcttccagtgaaggggacatcccataagtagttttgagagggtggatgggttacttgcccaccagaaacagccctagtcccaactccttgcgttcctttggcccctccctgcctacctagaatctgcctgaaagggctggagaggggcagtattgggggactgtgctagctttacccccgcaggacatacacaggagcctttgatctcattaaagagatgtgaaccagctacttgtg

SEQ ID NO: 200324 - DNA, 1110 bp, Homo sapiens
  Payload ID: 19519
  Gene Name: WW domain binding protein 1
  ENST ID: ENST00000409737
  CDS Start-End: 135-935
tccggccgcggagtgatggtggcctcagcgaagatgggccgggcagggaccatggcggtggcagcagaggtggcaggggcggggcggctggcggtagaggaggctgtggtcctcagggggctgtaggtggaggtatggctcgggccagcagcgggaacggcagcgaggaggcctggggggcacttcgggcgccgcaacagcagctgtgcccaggagtgaacaaccagccctacctctgtgagagtggtcactgctgcggggagactggctgctgcacctactactatgagctctggtggttctggctgctctggactgtcctcatcctctttagctgctgttgcgccttccgccaccgacgagctaaactcaggctgcaacaacagcagcggcagcgtgaaatcaacttgttggcctatcatggggcatgccatggggctggtcctttccctaccggttcactgcttgaccttcgcttcctcagcaccttcaagcccccagcctacgaggatgtggttcaccgcccaggcacaccaccccccccttatactgtggccccaggccgccccttgactgcttccagtgaacaaacctgctgttcctcctcatccagctgccctgcccactttgaaggaacaaatgtggaaggtgtttcctcccaccagagtgccccccctcatcaggagggtgagcccggggcaggggtgacccctgcctccacacccccctcctgccgctatcgccgtttaactggcgactccggtattgagctctgcccttgtcctgcctccggtgagggtgagccagtcaaggaggtgagggttagtgccaccctgccagatctggaggactactccccgtgtgcactacccccagagtctgtaccgcagatctttcccatggggctgtcttccagtgaaggggacatcccataagtagttttgagagggtggatgggttacttgcccaccagaaacagccctagtcccaactccttgcgttcctttggcccctccctgcctacctagaatctgcctgaaagggctggagaggggcagtattgggggactgtgctagctttacccccgcaggacatacacaggagccttt

SEQ ID NO: 200325 - DNA, 989 bp, Homo sapiens
  Payload ID: 19519
  Gene Name: WW domain binding protein 1
  ENST ID: ENST00000428943
  CDS Start-End: 241-989
ggccgcggagtgatggtggcctcagcgaagatgggccgggcagggaccatggcggtggcagcagaggtggcaggggcggggcggctggcggtagaggaggctgtggtcctcagggggctgtaggtggaggtatggctcgggccagcagcgggaacggcagcgaggaggcctggggggcacttcgggcgccgcaacagcagatgcagctgactttgcctgtagcctcatagaacccatcccatggctgcagtggaagcttgcggtggctctccagtgaccagaggcatagtgaggtcccagggaggctccctctgtcttgcaacagttatttgtgatctttttctatgtgcctattgtcacaacagagtccggcagcgtcttctcttgagggagcaatttggagaagagctggaacccagactcgcgccctggatgccatcctttatcatccacagcaatcccatctggttgggagcactgctctggcttcgagagctgtgcccaggagtgaacaaccagccctacctctgtgagagtggtcactgctgcggggagactggctgctgcacctactactatgagctctggtggttctggctgctctggactgtcctcatcctctttagctgctgttgcgccttccgccaccgacgagctaaactcaggctgcaacaacagcagcggcagcgtgaaatcaacttgttggcctatcatggggcatgccatggggctggtcctttccctaccggttcactgcttgaccttcgcttcctcagcaccttcaagcccccagcctacgaggatgtggttcaccgcccaggcacaccaccccccccttatactgtggccccaggccgccccttgactgcttccagtgaacaaacctgctgttcctcctcatccagctgccctgcccactttgaaggaacaaatgtggaaggtgtttcctcccaccagagtgccccccctcatcaggagggtgagcccgg

SEQ ID NO: 200326 - DNA, 4646 bp, Homo sapiens
  Payload ID: 19520
  Gene Name: WW domain binding protein 11
  Uniprot ID: Q9Y2W2
  ENST ID: ENST00000261167
  CDS Start-End: 235-2160
aagcggcgctaagagaaggcgggacagaggaatgggaaatgacgtgaggagtgcggaggggcgcgaggtttcaagatggcggtagctgaggggttgaccgagagacccagttgaaggcctttacgaagtgaaagaggccgggagtcgccccctacccgcttctcgtagtcctgggagcacagcagaagtgtttttctttttttaatgaacaagtaaaccatacaaattgtcaacatgggacggagatctacatcatccaccaagagtggaaaatttatgaaccccacagaccaagcccgaaaggaagcccggaagagagaattaaagaagaacaaaaaacagcgcatgatggttcgagctgcagttttaaagatgaaggatccaaaacagataatccgagacatggagaaattggatgaaatggagtttaacccagtgcaacagccacaattaaatgagaaagtactgaaagacaagcgtaaaaagctgcgtgaaacctttgaacgtattctacgactctatgaaaaagagaatccagatatttacaaagaattgagaaagctagaagtagaatatgaacagaagagggctcaacttagccaatattttgatgctgtcaagaatgctcagcatgtggaagtggagagtattcctttgccagatatgccacatgctccttccaacattttgatccaggacattccacttcctggtgcccagccaccctctatcctaaagaaaacctcagcctatggacctccaactcgggcagtttctatccttcctcttcttggacatggtgttccacgtttgccccctggcagaaaacctcctggccctccccctggtccacctcctcctcaagtcgtgcagatgtatggccgtaaagtgggttttgccctagatcttccccctcgtaggcgagatgaagacatgttatatagtcctgaacttgcccagcgaggtcatgatgatgatgtttctagcaccagtgaagatgatggctatcctgaggacatggatcaagataagcatgatgacagtactgatgacagtgacaccgacaaatcagatggagaaagtgacggggatgaatttgtgcaccgtgataatggtgagagagacaacaatgaagaaaagaagtcaggtctgagtgtacggtttgcagatatgcctggaaaatcaaggaagaaaaagaagaacatgaaggaactgactcctcttcaagccatgatgcttcgtatggcaggtcaagaaatccctgaggagggacgggaagtagaggaattttcagaggacgatgatgaagatgattctgatgactctgaagcagaaaagcaatcacaaaagcagcataaagaggaatcccattctgatggcacatccactgcttcttcacagcagcaggctccgccgcagtctgttcctccttctcagatacaagcacctcccatgccaggaccaccacctcttggaccaccacctgctccaccattacggcctcctgggccacctacaggccttcctcctggtccacctccaggagctcctccattcctgagaccacctggaatgccaggactccgagggcccttaccccgacttttacctccaggaccaccaccaggccgaccccctggccctcccccaggtccacctccaggtctgcctcctggtccccctcctcgtggacccccaccaaggctacctccccctgcacctccaggtattcctccacctcgtcctggcatgatgcgcccacctttggtgcctccccttggacctgccccccctgggctgttcccaccagctcccttgccaaaccctggggttttaagtgccccacccaacttgattcagcgacccaaggcggatgatacaagtgcagccaccattgagaagaaagccacagcaaccatcagtgccaagccacagatcactaatcccaaggcagagattactcgatttgtgcccactgcactgagagtacgtcgggagaataaaggggctactgctgctccccaaagaaagtcagaggatgattctgctgtgcctcttgccaaagcagcacccaaatctggtccttctgttcctgtctcagtacaaactaaggatgatgtctatgaggctttcatgaaagagatggaagggctactgtgacagcttttgatgccagaaaaggcttctgttcacaacagtggcccatggagaaagaggctcttattaaacttagatgaaagagctgcttccattgtcagggtattttctaatttcagttcaaggaatatcctaaaatttagccttgttcagaatttactgcacataaaaaagggtatttcatccagaatagatcagttattgaagcagtgctgctaacatccattccctttcataccaccattttcaccctgtttcttcccctcctccagttctttggaaatttgtgatcgggggatcttagttgcttatttgttttgactcttgtgtgctgtgggcactggagtagagatttctggagaaaaaaaaacagtttatttcatcttgccttttgtgtttgagttatttttaatattttcctgtaaatattttgtaatattttacttgtaatgaaatggatcacaatgtcatttcctaatacaaggcaggatatgtgggaagaatatgtacaattatttgattaaaattatttcccactgacctaaactttcagtgatttgtgggaaaaataaataaatgttctacaccaagatactctgtgttactgataatatgtaaacataatacctattttatggacagaaaaagttaaatatttaaaacttgggtctttaaggaactgcctttctggtacagaatgagaatcttactgaaaacatggtaaaaactacattttaaattttaagggataaaaaggagtaattatttcccttttttaagattgtcatactggctttagagaaactgagaggtgttaagaatagtatggtttggcttttattatttaaaagatgtcttaccttcagtggttacttattccagagcttcttgaactgatacgagttgaatggcaaaagtcattttaaaccatttttaagctataaaagaatcagaagaggttagctttttttcctttctgaattggtgggtttggtgtgcttttatattaaaatatgaatgaataagagtgcttaacattaatttgcatttataccattttctttacaaagtgctttaatgtaaactcatctaccaatttagactaactcttagtaagtttaatgttaatttaatgactaactcatctaccaattaaccctatagataacttttctgggtattttccccattttacattagagagtattgaaacttaaaaaggactcgtgatttatccagtgatccaaagtgtgtatttcataaacacatacacacagtgcgtgcattgtttaggcatacgttactttccacagtatctcaaatgccttttacatgaatcccatactatcaaaaattggtgataacctaaaatgtagtgcaataatacaataaggcatttattttcttagagttgagttgatggatttttagatttttattcaagatcttttgtttgtttggctttgcttggaagatactgatttattctttcatattaaagcaaatcctgccaaagcactaaatagaccgttttgggttggttttttagtgtaatattaatacgggtccacaggtgaattgagtctgttcagatgtaaggattgaaccttatgttatcaatccttgacaccatccttgataacttacggatatcaaggatcaaaccatatggtatcaatattgttagttattcagcataaacagaattatttcccaatacttgatctgaaatatttttaatggtcttacttgaaacttatattctttctgggagtgatgtttttatcatttttccatggagacaggttctaactctgttgcccaggctgcagtgcagtgatgtgatcatagctcactgcagcctgaaactcctgggttcaagtgatctctggcctcagcctcccaagtagttggaacttcagatacgtgccaccacaaccagctaatttattttttagagatgaggtctcgctatgttgcccagtctggtctcctagcctcaagtgatcttcccatctcagccttcagttggagatttctgatttatgttaatataagaaagctgttgatagtttatcataaaggcatttccttatattgctagtataattttctgaaaattagtggtgtgacaatacatcagctgcatccacaggaaaggggaattaattagcagttctgattctgggtacacttgttatgatcataatttacataatattttcatgaaaatggtcagctcacagctatgaaatgtaaatgatagaaatctttaatcatgtatatggatagacttgttactatttccttatcaaagtgtcactttagggacagcagttgcccctttaaattaaggatcaccacaataatactctgccatgtcatggaatcagcatgaagccctggatgctatccaagattctgtttcagttctcattttgtatattcttgtttgtgctcttgattaaaatatctccttatatatagct

SEQ ID NO: 200327 - DNA, 494 bp, Homo sapiens
  Payload ID: 19520
  Gene Name: WW domain binding protein 11
  ENST ID: ENST00000535328
  CDS Start-End: 336-494
ggaggggcgcgaggtttcaagatggcggtagctgaggggttgaccgagagacccagttgaaggcctttacgaagtgaaagaggccgggagtcgccccctacccgcttctcgtagtcctgggagcacagcagaagtttgtgttttgaactcttgagagtcaagcattatatctgaactagaactgaatctgaattaaatatgcttaaattaatgagtttttagtgtcttagaagtattgagaatgtacagcatacatgccaagaaaaaccatggagagaggcaaaggtgaggtttttctttttttaatgaacaagtaaaccatacaaattgtcaacatgggacggagatctacatcatccaccaagagtggaaaatttatgaaccccacagaccaagcccgaaaggaagcccggaagagagaattaaagaagaacaaaaaacagcgcatgatggttcgagctgcagttttaaagatgaaggatccaaaacagata

SEQ ID NO: 200328 - DNA, 787 bp, Homo sapiens
  Payload ID: 19520
  Gene Name: WW domain binding protein 11
  ENST ID: ENST00000535638
  CDS Start-End: 46-630
gtttttctttttttaatgaacaagtaaaccatacaaattgtcaacatgggacggagatctacatcatccaccaagagtggaaaatttatgaaccccacagaccaagcccgaaaggaagcccggaagagagaattaaagaagaacaaaaaacagcgcatgatggttcgagctgcagttttaaagatgaaggatccaaaacagataatccgagacatggagaaattggatgaaatggagtttaacccagtgcaacagccacaattaaatgagaaagtactgaaagacaagcgtaaaaagctgcgtgaaacctttgaacgtattctacgactctatgaaaaagagaatccagatatttacaaagaattgagaaagctagaagtagaatatgaacagaagagggctcaacttagccaatattttgatgctgtcaagcccagcgaggtcatgatgatgatgtttctagcaccagtgaagatgatggctatcctgaggacatggatcaagataagcatgatgacagtactgatgacagtgacaccgacaaatcagatggagaaagtgacggggatgaatttgtgcaccgtgataatggtgagagagacaacaatgaagaaaagaagtcaggtctgagtgtacggtttgcagatatgcctggaaaatcaaggaagaaaaagaagaacatgaaggaactgactcctcttcaagccatgatgcttcgtatggcaggtcaagaaatccctgaggagggacgggaagtagaggaattttcagaggacgatgatgaaga

SEQ ID NO: 200329 - DNA, 4107 bp, Homo sapiens
  Payload ID: 19521
  Gene Name: WW domain binding protein 1-like
  Uniprot ID: Q9NX94
  ENST ID: ENST00000369889
  CDS Start-End: 143-1171
tttactttgtctgctttgctaaagaaggccggtgaaccaggaccaccgcacacacaggcccaccaggggcaatgctcattccaagaccttaacttttaagagccctttgttccaacgttagtgtggacgatgctcttgcaggatgcctttccttttgggtcttagacaggataaggaagcctgtgtgggtaccaacaatcaaagctacatctgtgacacaggacactgctgtggacagtctcagtgctgcaactactactatgaactctggtggttctggctggtgtggaccatcatcatcatcctgagctgctgctgtgtttgccaccaccgccgagccaagcaccgccttcaggcccagcagcggcaacatgaaatcaacctgatcgcttaccgagaagcccacaattactcagcgctgccattttatttcaggtttttgccaaactatttactacctccttatgaggaagtggtgaaccgacctccaactcctcccccaccatacagtgccttccagctacagcagcagcagctgctgcctccacagtgtggccctgcaggtggcagtcccccgggcatcgatcccaccaggggatcccagggggcacagagcagccccttgtctgagcccagcagaagcagcacaagacccccaagcatcgctgaccctgatccctctgacctaccagttgaccgagcagccaccaaagccccagggatggagcccagtggctctgtggctggcctgggggagctggacccgggggccttcctggacaaagatgcagaatgtagggaggagctgctgaaagatgacagctctgaacacggcgcacccgacagcaaagagaagacgcctgggagacatcgccgcttcacaggtgactcgggcattgaagtgtgtgtgtgcaaccggggccaccatgacgatgacctcaaagagttcaacacactcatcgatgatgctctggatgggcccctggacttctgcgacagctgccatgtgcggccccctggtgatgaggaggaaggcctctgtcagtcctctgaggagcaggctcgagagcctgggcacccgcacctgccacggccgcccgcatgcctgctgctgaacaccatcaacgagcaggactctcccaactcccagagcagcagctcccccagctagagcaggtcctgccagcacccagcaacttggcaaagcaaccagggtaggggagaaccacgagagaagcattaagtgactttcaaagactttcagagtacagccacttggttcctttttgtttgttttccttctcctctcctgcattttcctccatctccaggtacagttcggggtgtggatgcctcttcctccacaagggcacagtgttgtggagggctaagttggttctgtgactcattcctcataccctaactccatctcctttctttaaagtcaaatctcacctacctgtttgggtcagagagatgtgttttaaaagcccccaaggaaggaggctgggactgtgccctgacatgattcttggtgatggaataggtttgtgctctgattctagtttaagagaacgttgctgtatctcagtccaggagaggcagcccatcttggccctggatgaagaaggaaacccacagaggcccagggcttgtcattgggctgccagtgtctgccaagccagcattgagctaatcctgtgggaggatgagagctactgggccgttgtatgataggttggtaggggcttgttgatctgtcaaattccaggtgacaagatctatgcaccccatgcgtccttgaggggcctcttccccgcaggctctggctggccgcaggctggttctggtgtgaaaggttatactgccttttctttgtttgtttgtttttttctctaaaaacaaacagcaaaagacagctgaaaacaagaacttcaccggtgggcaggcaagaattctcttctggaaaatgacgtttgtggctctttcccaagttggccttcaaagagcctgcctgctgttgagccagaagatgtctcgtgtgaaggctggggtggcggctgtcttggaacctctgtgagcaggaggccctaagccgcagcagtggatagaggtgcagctctctgcctctctgccctttggtctgtgttcacaggtgacccgtgtcagcctgcatcgcaagcacacaccctgcgggccttcaagtctcactgttccgtatgaggaaacagacagcggactgaggaagcgatggccccagagaaagggcccctgtagcctggctctcacacagtattttatctttgattctgaataaatattttttgtggggttttttttttttttttggtggcagttgtttgttttaaactgaccacttggaagaaacaccttggttatctgtggttttcatgccttgtccctgcctctacccccaccccttttgagtcgggtgactcatttttctgtgtagagactcggtggcccaggcaggaggtgaaagcagccatccggaaggccctggggacccttgtgcctgttgctcgccttcaggtcaccagctgagctgcgataggaaaatctgaatggaggcagcaaacagccaaaacaaacattccccacccggccctgtgcatatgaagtctttcttcccccaactcttgaacgatgatgatattcagacgaagcattgatgttatggaagaaagaaagaaacaaacaaaatatatatatatatgtccaaaaacagacaaatccaagggtgtgaggtaaacgagtgtctgcatttagattccacaaaaccaaaatccatgttgaacaaagttaagtccgtacacagtgactttttgggtgagccgtgtgtgtctgtctgttgtgtgtgtgcctcaagccctgttttcctgtgaagatactttgagtggcagccattctctccacgtgaaccacacgtctggagcacagacaggcctctcaaggtcattgatcttacgcatttactgtttaccgaacaaatgtctgactgtgtactcgggtgtactccgcagcattgtcgactgcagtcccctgtgtttgccagagatactgtgctcgaagtagaggttttactctactcatcactgcgatttgcacattgctccgtggacactcggaggcctgcgttctgttccctataaatggaagcgtgctctgagcctgtctgcctccctcggctgctgctggtcctcagtaccagcgcccgggggtgtccacaaccacttgggacagaagaaggtggaatttcagacagaagcttgactgggtcttcaatgacaggcttggactagctgtggcccagacatcggccctgcccagaattgccaggaggaggctttgcaggctctagaggagccgcagggcctgcctgcctctggtgagtccaacaggcacaagcaagctggcgtgtggccagaggtagccggagtgtgtcacagcccctcagatgcctttccttccacctttttttattttttaagaatcccaaataactcactgaagtgtctcaaaggcgaacaagttttaccaaaatgaatcctttttcagttaacagatcaaatggatgagttctgagcctctcaagttcctttccccagttagagtggggaactgggcaagtgttaactgtgggactcactgcagcgtcctatcctaaaggcacgagaagacggaaatgcaacctgcggagctgggcttggttcccaggtcacagtttggcccccgctacaggatgctgccctgctcagagagagatttaatagggagctgaaggaatcgttagggggccagggagatgtgactgaggctggctttccacgtgaatgagacggggtcggtggagggtttggtgctacagccagtcagaagatttgcaaatgcgaacacattcctgtgtgaggcacgttaccctttgtcagttattgtgaatatgtgtattttaagcaataagattcagctggtcagacttttctgggcagtctcagtgacgcatttcctgtgctgtgattgttctgaagacagagtggctctaaccactgtgagaagcccaaataaaaattgatcccaaaaatgcta

SEQ ID NO: 200330 - DNA, 4085 bp, Homo sapiens
  Payload ID: 19521
  Gene Name: WW domain binding protein 1-like
  Uniprot ID: Q9NX94
  ENST ID: ENST00000448841
  CDS Start-End: 85-1176
gaaggaagaagagggtagaggaggagagggaggaggaggagggaggtggcggcgccgtggcggaggagcaggagcaggagggggatggagaggagaaggctcctgggtggcatggcgctcctgctcctccaggcgctgcccagccccttgtcagccagggctgaacccccgcaggataaggaagcctgtgtgggtaccaacaatcaaagctacatctgtgacacaggacactgctgtggacagtctcagtgctgcaactactactatgaactctggtggttctggctggtgtggaccatcatcatcatcctgagctgctgctgtgtttgccaccaccgccgagccaagcaccgccttcaggcccagcagcggcaacatgaaatcaacctgatcgcttaccgagaagcccacaattactcagcgctgccattttatttcaggtttttgccaaactatttactacctccttatgaggaagtggtgaaccgacctccaactcctcccccaccatacagtgccttccagctacagcagcagcagctgctgcctccacagtgtggccctgcaggtggcagtcccccgggcatcgatcccaccaggggatcccagggggcacagagcagccccttgtctgagcccagcagaagcagcacaagacccccaagcatcgctgaccctgatccctctgacctaccagttgaccgagcagccaccaaagccccagggatggagcccagtggctctgtggctggcctgggggagctggacccgggggccttcctggacaaagatgcagaatgtagggaggagctgctgaaagatgacagctctgaacacggcgcacccgacagcaaagagaagacgcctgggagacatcgccgcttcacaggtgactcgggcattgaagtgtgtgtgtgcaaccggggccaccatgacgatgacctcaaagagttcaacacactcatcgatgatgctctggatgggcccctggacttctgcgacagctgccatgtgcggccccctggtgatgaggaggaaggcctctgtcagtcctctgaggagcaggctcgagagcctgggcacccgcacctgccacggccgcccgcatgcctgctgctgaacaccatcaacgagcaggactctcccaactcccagagcagcagctcccccagctagagcaggtcctgccagcacccagcaacttggcaaagcaaccagggtaggggagaaccacgagagaagcattaagtgactttcaaagactttcagagtacagccacttggttcctttttgtttgttttccttctcctctcctgcattttcctccatctccaggtacagttcggggtgtggatgcctcttcctccacaagggcacagtgttgtggagggctaagttggttctgtgactcattcctcataccctaactccatctcctttctttaaagtcaaatctcacctacctgtttgggtcagagagatgtgttttaaaagcccccaaggaaggaggctgggactgtgccctgacatgattcttggtgatggaataggtttgtgctctgattctagtttaagagaacgttgctgtatctcagtccaggagaggcagcccatcttggccctggatgaagaaggaaacccacagaggcccagggcttgtcattgggctgccagtgtctgccaagccagcattgagctaatcctgtgggaggatgagagctactgggccgttgtatgataggttggtaggggcttgttgatctgtcaaattccaggtgacaagatctatgcaccccatgcgtccttgaggggcctcttccccgcaggctctggctggccgcaggctggttctggtgtgaaaggttatactgccttttctttgtttgtttgtttttttctctaaaaacaaacagcaaaagacagctgaaaacaagaacttcaccggtgggcaggcaagaattctcttctggaaaatgacgtttgtggctctttcccaagttggccttcaaagagcctgcctgctgttgagccagaagatgtctcgtgtgaaggctggggtggcggctgtcttggaacctctgtgagcaggaggccctaagccgcagcagtggatagaggtgcagctctctgcctctctgccctttggtctgtgttcacaggtgacccgtgtcagcctgcatcgcaagcacacaccctgcgggccttcaagtctcactgttccgtatgaggaaacagacagcggactgaggaagcgatggccccagagaaagggcccctgtagcctggctctcacacagtattttatctttgattctgaataaatattttttgtggggttttttttttttttttggtggcagttgtttgttttaaactgaccacttggaagaaacaccttggttatctgtggttttcatgccttgtccctgcctctacccccaccccttttgagtcgggtgactcatttttctgtgtagagactcggtggcccaggcaggaggtgaaagcagccatccggaaggccctggggacccttgtgcctgttgctcgccttcaggtcaccagctgagctgcgataggaaaatctgaatggaggcagcaaacagccaaaacaaacattccccacccggccctgtgcatatgaagtctttcttcccccaactcttgaacgatgatgatattcagacgaagcattgatgttatggaagaaagaaagaaacaaacaaaatatatatatatatgtccaaaaacagacaaatccaagggtgtgaggtaaacgagtgtctgcatttagattccacaaaaccaaaatccatgttgaacaaagttaagtccgtacacagtgactttttgggtgagccgtgtgtgtctgtctgttgtgtgtgtgcctcaagccctgttttcctgtgaagatactttgagtggcagccattctctccacgtgaaccacacgtctggagcacagacaggcctctcaaggtcattgatcttacgcatttactgtttaccgaacaaatgtctgactgtgtactcgggtgtactccgcagcattgtcgactgcagtcccctgtgtttgccagagatactgtgctcgaagtagaggttttactctactcatcactgcgatttgcacattgctccgtggacactcggaggcctgcgttctgttccctataaatggaagcgtgctctgagcctgtctgcctccctcggctgctgctggtcctcagtaccagcgcccgggggtgtccacaaccacttgggacagaagaaggtggaatttcagacagaagcttgactgggtcttcaatgacaggcttggactagctgtggcccagacatcggccctgcccagaattgccaggaggaggctttgcaggctctagaggagccgcagggcctgcctgcctctggtgagtccaacaggcacaagcaagctggcgtgtggccagaggtagccggagtgtgtcacagcccctcagatgcctttccttccacctttttttattttttaagaatcccaaataactcactgaagtgtctcaaaggcgaacaagttttaccaaaatgaatcctttttcagttaacagatcaaatggatgagttctgagcctctcaagttcctttccccagttagagtggggaactgggcaagtgttaactgtgggactcactgcagcgtcctatcctaaaggcacgagaagacggaaatgcaacctgcggagctgggcttggttcccaggtcacagtttggcccccgctacaggatgctgccctgctcagagagagatttaatagggagctgaaggaatcgttagggggccagggagatgtgactgaggctggctttccacgtgaatgagacggggtcggtggagggtttggtgctacagccagtcagaagatttgcaaatgcgaacacattcctgtgtgaggcacgttaccctttgtcagttattgtgaatatgtgtattttaagcaataagattcagctggtcagacttttctgggcagtctcagtgacgcatttcctgtgctgtgattgttctgaagacagagtggctctaaccactgtgagaagccc

SEQ ID NO: 200331 - DNA, 1944 bp, Homo sapiens
  Payload ID: 19522
  Gene Name: WW domain binding protein 2
  Uniprot ID: Q969T9
  ENST ID: ENST00000254806
  CDS Start-End: 124-909
gggccagcctccgcactcgagctttgattggctgactctaataagaagacgccactaggggcggggcgaagaggggcgcaagctcattgcgttttgagtctcgggacccctgttggagagactatggcgctcaacaagaatcactcggagggcggcggagtgatcgtcaataacaccgagagcatcctaatgtcctatgatcacgtggaactcacattcaatgacatgaagaacgtgccagaagccttcaaagggaccaagaaaggcactgtctaccttaccccttaccgggtcatctttctgtccaagggcaaggatgccatgcagtccttcatgatgccattttatctcatgaaagactgtgagatcaagcagcccgtatttggtgcaaactacatcaagggaacagtgaaggcggaagcgggaggtggctgggaaggctctgcttcctacaagttgactttcacggcagggggcgccattgagttcggacagcggatgctccaggtggcatctcaagcctccagaggtgaagtccccagtggagcctatggctactcttacatgcccagcggggcctatgtctatcccccgccagtcgccaatggaatgtacccctgccctcctggctacccctatccaccgcccccacctgagttctatccaggaccccccatgatggacggggccatgggatacgtgcagcccccaccaccgccctaccctgggcccatggaacctccggtcagcggccccgatgtcccctccactcctgcagccgaagccaaggccgcagaagcagccgccagcgcctattacaacccaggcaatcctcacaacgtctacatgcccacgagccagccgccgccacctccctactacccaccggaagataagaagacccagtaggccctcctgcctccctgcctcccaccctcatctctctaccctacccctcccatcggggctgtgctggggcttggggaggggagggggcgccttgttctccctccaggtctgatcataaacaattaccaggaactagcattgtgggacattagggcccccggcctcgggagaggtgccgcccagcttcccatgccagcccggagcccacagtgctgcccagcgtacctccctcaccgtctggggctcttctgggagcacggagcatcccctgttcctgtttcactctcagcttctcccctcgaagggactctctggccacctcctccaccgcagtccagctccctcagtctggcacccactgctacactcagcctcatgagccacttcagaccagccaggtgtcttcccgggccctgccagaccctgctcacattccctctgctggtctgtgctggtctcagaaggccaccgcgcccgcattccactcagccagggtccagctgcagcccccgccacccttccttcccttccctgtcctgggtcatgttgttgccaccctgtgtgacttttgaagctgtaaaatgagcttccagggcttgggtggcgtcggggcagggccgccgaggctgggaggaagcccttctgccttttgctggtgtttctggaatttgctttccctcacctctcacttccttctagaaggagcttcctgactggaaccagagaatgcatgtctgtccacttggtggctgctgggtggggccgggaacaagggcccctgaccctgtgtgctggccgggacctgccaccagccccccagcctgcttcttccccttaagctttgtgcccctggatgcgctaacattcactcttgtttgtccctggactggccatgaagtgaggagatggttatttaaagagaattccctatttatttgacaaaaaatccagttaatatattaatgtgaaataaaccctgtttgcacctcgatttgtttgctgaaaatgtgaaatagtaaaaatgaaataactgga

SEQ ID NO: 200332 - DNA, 928 bp, Homo sapiens
  Payload ID: 19522
  Gene Name: WW domain binding protein 2
  ENST ID: ENST00000433525
  CDS Start-End: 39-689
attgcgttttgagtctcgggacccctgttggagagactatggcgctcaacaagaatcactcggagggcggcggagtgatcgtcaataacaccgagagcatcctaatgtcctatgatcacgtggaactcacattcaatgacatgaagaacgtgccagaagccttcaaagggaccaagaaaggcactgtctaccttaccccttaccgggtcatctttctgtccaagggcaaggatgccatgcagtccttcatgatgccattttatctcatgaaagactgtgagatcaagcagcccgtatttggtgcaaactacatcaagggaacagtgaaggcggaagcgggaggtggctgggaaggctctgcttcctacaagttgactttcacggcagggggcgccattgagttcggacagcggatgctccaggtggcatctcaagagttctatccaggaccccccatgatggacggggccatgggatacgtgcagcccccaccaccgccctaccctgggcccatggaacctccggtcagcggccccgatgtcccctccactcctgcagccgaagccaaggccgcagaagcagccgccagcgcctattacaacccaggcaatcctcacaacgtctacatgcccacgagccagccgccgccacctccctactacccaccggaagataagaagacccagtaggccctcctgcctccctgcctcccaccctcatctctctaccctacccctcccatcggggctgtgctggggcttggggaggggagggggcgccttgttctccctccaggtctgatcataaacaattaccaggaactagcattgtgggacattagggcccccggcctcgggagaggtgccgcccagcttcccatgccagcccggagcccacagtgctgcccagcgtacctccctcaccgtct

SEQ ID NO: 200333 - DNA, 610 bp, Homo sapiens
  Payload ID: 19522
  Gene Name: WW domain binding protein 2
  ENST ID: ENST00000593002
  CDS Start-End: 110-610
ggaaggatcctggaggaccaaagttcgggtgtcgaggaagtgggcggtgggtggtgggtggtggggaataagcccctgaagagggagcactgatggagtgagcatcctaatgtcctatgatcacgtggaactcacattcaatgacatgaagaacgtgccagaagccttcaaagggaccaagaaaggcactgtctaccttaccccttaccgggtcatctttctgtccaagggcaaggatgccatgcagtccttcatgatgccattttatctcatgaaagactgtgagatcaagcagcccgtatttggtgcaaactacatcaagggaacagtgaaggcggaagcgggaggtggctgggaaggctctgcttcctacaagttgactttcacggcagggggcgccattgagttcggacagcggatgctccaggtggcatctcaagcctccagaggtgaagtccccagtggagcctatggctactcttacatgcccagcggggcctatgtctatcccccgccagtcgccaatggaatgtacccctgccctcctggctacccctatccaccgcccccacctgagttctatccaggaccccccatgatggacggggcc

SEQ ID NO: 200334 - DNA, 676 bp, Homo sapiens
  Payload ID: 19522
  Gene Name: WW domain binding protein 2
  ENST ID: ENST00000586257
  CDS Start-End: 1-617
gtggctgggaaggctctgcttcctacaagttgactttcacggcagggggcgccattgagttcggacagcggatgctccaggtggcatctcaagcctccagaggtgaagtccccagtggagcctatggctactcttacatgcccagcggggcctatgtctatcccccgccagtcgccaatggaatgtacccctgccctcctggctacccctatccaccgcccccacctgagttctatccaggaccccccatgatggacggggccatgggatacgtgcagcccccaccaccgccctaccctgggcccatggaacctccggtcagcggccccgatgtcccctccactcctgcagccgaagccaaggccgcagaagcagccgccagcgcctattacaacccaggcaatcctcacaacgtctacatgcccacgagccagccgccgccacctccctactacccaccggaagataagaagacccaaaggagcttcctgactggaaccagagaatgcatgtctgtccacttggtggctgctgggtggggccgggaacaagggcccctgaccctgtgtgctggccgggacctgccaccagccccccagcctgcttcttccccttaagctttgtgcccctggatgcgctaacattcactcttgtttgtccctggactggccatgaa

SEQ ID NO: 200335 - DNA, 480 bp, Homo sapiens
  Payload ID: 19522
  Gene Name: WW domain binding protein 2
  ENST ID: ENST00000587374
  CDS Start-End: 139-480
gacccctgttggagagactatggcgctcaacaagaatcactcggagggcggcggagtgatcgtcaataacaccgagaggtcatctttctgtccaagggcaaggatgccatgcagtccttcatgatgccattttatctcatgaaagactgtgagatcaagcagcccgtatttggtgcaaactacatcaagggaacagtgaaggcggaagcgggaggtggctgggaaggctctgcttcctacaagttgactttcacggcagggggcgccattgagttcggacagcggatgctccaggtggcatctcaagcctccagaggtgaagtccccagtggagcctatggctactcttacatgcccagcggggcctatgtctatcccccgccagtcgccaatggaatgtacccctgccctcctggctacccctatccaccgcccccacctggaccccccatgatggacggggccatgggatacgtgcag

SEQ ID NO: 200336 - DNA, 1374 bp, Homo sapiens
  Payload ID: 19522
  Gene Name: WW domain binding protein 2
  ENST ID: ENST00000588373
  CDS Start-End: 13-120
gttggagagactatggcgctcaacaagaatcactcggagggcggcggagtgatcgtcaataacaccgagaggcttgaaaaacaaaccagcaaaaacagaacatctatcacaaggacttaaaagaaaatagaagagttggccgggcgcagtggctcacgcctgtaatccctgcactttgggaggccgaggcaggtggatcacgaagtcaggagatcgagaccatcctggctaacacgcatcctaatgtcctatgatcacgtggaactcacattcaatgacatgaagaacgtgccagaagccttcaaagggaccaagaaaggcactgtctaccttaccccttaccgggtcatctttctgtccaagggcaaggatgccatgcagtccttcatgatgccattttatctcatgaaagactgtgagatcaagcagcccgtatttggtgcaaactacatcaagggaacagtgaaggcggaagcgggaggtggctgggaaggctctgcttcctacaagttgactttcacggcagggggcgccattgagttcggacagcggatgctccaggtggcatctcaagcctccagaggtgaagtccccagtggagcctatggctactcttacatgcccagcggggcctatgtctatcccccgccagtcgccaatggaatgtacccctgccctcctggctacccctatccaccgcccccacctgagttctatccaggaccccccatgatggacggggccatgggatacgtgcagcccccaccaccgccctaccctgggcccatggaacctccggtcagcggccccgatgtcccctccactcctgcagccgaagccaaggccgcagaagcagccgccagcgcctattacaacccaggcaatcctcacaacgtctacatgcccacgagccagccgccgccacctccctactacccaccggaagataagaagacccagtaggccctcctgcctccctgcctcccaccctcatctctctaccctacccctcccatcggggctgtgctggggcttggggaggggagggggcgccttgttctccctccaggtctgatcataaacaattaccaggaactagcattgtgggacattagggcccccggcctcgggagaggtgccgcccagcttcccatgccagcccggagcccacagtgctgcccagcgtacctccctcaccgtctggggctcttctgggagcacggagcatcccctgttcctgtttcactctcagcttctcccctcgaagggactctctggccacctcctccaccgcagtccagctccctcagtctggcacccactgctacactcagcctcatgagccacttcagaccagccaggtgtcttcccggg

SEQ ID NO: 200337 - DNA, 1745 bp, Homo sapiens
  Payload ID: 19522
  Gene Name: WW domain binding protein 2
  ENST ID: ENST00000590221
  CDS Start-End: 10-783
ggagagactatggcgctcaacaagaatcactcggagggcggcggagtgatcgtcaataacaccgagagcatcctaatgtcctatgatcacgtggaactcacattcaatgacatgaagaacgtgccagaagccttcaaagggaccaagaaaggcactgtctaccttaccccttaccgggtcatctttctgtccaagggcaaggatgccatgcagtccttcatgatgccattttatctcatgaaagactgtgagatcaagcagcccgtatttggtgcaaactacatcaagggaacagtgaaggcggaagcgggaggtggctgggaaggctctgcttcctacaagttgactttcacggcagggggcgccattgagttcggacagcggatgctccaggtggcatctcaagcctccagaggtgaagtccccagtggagcctatggctactcttacatgcccagcggggcctatgtctatcccccgccagtcgccaatggaatgtacccctgccctcctggctacccctatccaccgcccccacctggaccccccatgatggacggggccatgggatacgtgcagcccccaccaccgccctaccctgggcccatggaacctccggtcagcggccccgatgtcccctccactcctgcagccgaagccaaggccgcagaagcagccgccagcgcctattacaacccaggcaatcctcacaacgtctacatgcccacgagccagccgccgccacctccctactacccaccggaagataagaagacccagtaggccctcctgcctccctgcctcccaccctcatctctctaccctacccctcccatcggggctgtgctggggcttggggaggggagggggcgccttgttctccctccaggtctgatcataaacaattaccaggaactagcattgtgggacattagggcccccggcctcgggagaggtgccgcccagcttcccatgccagcccggagcccacagtgctgcccagcgtacctccctcaccgtctggggctcttctgggagcacggagcatcccctgttcctgtttcactctcagcttctcccctcgaagggactctctggccacctcctccaccgcagtccagctccctcagtctggcacccactgctacactcagcctcatgagccacttcagaccagccaggtgtcttcccgggccctgccagaccctgctcacattccctctgctggtctgtgctggtctcagaaggccaccgcgcccgcattccactcagccagggtccagctgcagcccccgccacccttccttcccttccctgtcctgggtcatgttgttgccaccctgtgtgacttttgaagctgtaaaatgagcttccagggcttgggtggcgtcggggcagggccgccgaggctgggaggaagcccttctgccttttgctggtgtttctggaatttgctttccctcacctctcacttccttctagaaggagcttcctgactggaaccagagaatgcatgtctgtccacttggtggctgctgggtggggccgggaacaagggcccctgaccctgtgtgctggccgggacctgccaccagccccccagcctgcttcttccccttaagctttgtgcccctggatgcgctaacattcactcttgtttgtccctggactggccatgaagtgaggagatggttatttaaagagaattccctatttatttgacaaaaaatccagttaatatatta

SEQ ID NO: 200338 - DNA, 1406 bp, Homo sapiens
  Payload ID: 19522
  Gene Name: WW domain binding protein 2
  ENST ID: ENST00000591831
  CDS Start-End: 12-707
ttggagagactatggcgctcaacaagaatcactcggagggcggcggagtgatcgtcaataacaccgagagcatcctaatgtcctatgatcacgtggaactcacattcaatgacatgaagaacgtgccagaagccttcaaagggaccaagaaaggcactgtctaccttaccccttaccgggtcatctttctgtccaagggcaaggatgccatgcagtccttcatgatgccattttatctcatgaaagactgtgagatcaagcagcccgtatttggtgcaaactacatcaagggaacagtgaaggcggaagcgggaggtggctgggaaggctctgcttcctacaagttgactttcacggcagggggcgccattgagttcggacagcggatgctccaggtggcatctcaagcctccagaggtgaagtccccagtggagcctatggctactcttacatgcccagcggggcctatgtctatcccccgccagtcgccaatggaatgtacccctgccctcctggctacccctatccaccgcccccacctgagttctatccaggaccccccatgatggacggggccatgggatacgtgcagcccccaccaccgccctaccctgggcccatggaacctccggtcagcggccccgatgtcccctccactcctgcagagccagccgccgccacctccctactacccaccggaagataagaagacccagtaggccctcctgcctccctgcctcccaccctcatctctctaccctacccctcccatcggggctgtgctggggcttggggaggggagggggcgccttgttctccctccaggtctgatcataaacaattaccaggaactagcattgtgggacattagggcccccggcctcgggagaggtgccgcccagcttcccatgccagcccggagcccacagtgctgcccagcgtacctccctcaccgtctggggctcttctgggagcacggagcatcccctgttcctgtttcactctcagcttctcccctcgaagggactctctggccacctcctccaccgcagtccagctccctcagtctggcacccactgctacactcagcctcatgagccacttcagaccagccagaaggagcttcctgactggaaccagagaatgcatgtctgtccacttggtggctgctgggtggggccgggaacaagggcccctgaccctgtgtgctggccgggacctgccaccagccccccagcctgcttcttccccttaagctttgtgcccctggatgcgctaacattcactcttgtttgtccctggactggccatgaagtgaggagatggttatttaaagagaattccctatttatttgacaaaaaatccagttaatatattaatgtgaaataaaccctgtttgcacc

SEQ ID NO: 200339 - DNA, 2225 bp, Homo sapiens
  Payload ID: 19522
  Gene Name: WW domain binding protein 2
  Uniprot ID: Q969T9
  ENST ID: ENST00000591399
  CDS Start-End: 426-1211
attgcacaggacctcacagaacgctgctgtttcctgatcttttctagtgaggcagctttgtttcttcacataggagacctccctggaaagcgaagtcaagcaggtggatctagaggttggccaccacagtcaggaaagcagctgtctactgaaaagcaaactctaattccttaacattaacgagtaccggaactaccacgtgggaagtgcagccccctctctccgcctcacggattcagctcggaggaggaactggaaggagggagtaaactattaccacgtgacgttcgggtcaggtgtttgggccagcctccgcactcgagctttgattggctgactctaataagaagacgccactaggggcggggcgaagaggggcgcaagctcattgcgttttgagtctcgggacccctgttggagagactatggcgctcaacaagaatcactcggagggcggcggagtgatcgtcaataacaccgagagcatcctaatgtcctatgatcacgtggaactcacattcaatgacatgaagaacgtgccagaagccttcaaagggaccaagaaaggcactgtctaccttaccccttaccgggtcatctttctgtccaagggcaaggatgccatgcagtccttcatgatgccattttatctcatgaaagactgtgagatcaagcagcccgtatttggtgcaaactacatcaagggaacagtgaaggcggaagcgggaggtggctgggaaggctctgcttcctacaagttgactttcacggcagggggcgccattgagttcggacagcggatgctccaggtggcatctcaagcctccagaggtgaagtccccagtggagcctatggctactcttacatgcccagcggggcctatgtctatcccccgccagtcgccaatggaatgtacccctgccctcctggctacccctatccaccgcccccacctgagttctatccaggaccccccatgatggacggggccatgggatacgtgcagcccccaccaccgccctaccctgggcccatggaacctccggtcagcggccccgatgtcccctccactcctgcagccgaagccaaggccgcagaagcagccgccagcgcctattacaacccaggcaatcctcacaacgtctacatgcccacgagccagccgccgccacctccctactacccaccggaagataagaagacccagtaggccctcctgcctccctgcctcccaccctcatctctctaccctacccctcccatcggggctgtgctggggcttggggaggggagggggcgccttgttctccctccaggtctgatcataaacaattaccaggaactagcattgtgggacattagggcccccggcctcgggagaggtgccgcccagcttcccatgccagcccggagcccacagtgctgcccagcgtacctccctcaccgtctggggctcttctgggagcacggagcatcccctgttcctgtttcactctcagcttctcccctcgaagggactctctggccacctcctccaccgcagtccagctccctcagtctggcacccactgctacactcagcctcatgagccacttcagaccagccaggtgtcttcccgggccctgccagaccctgctcacattccctctgctggtctgtgctggtctcagaaggccaccgcgcccgcattccactcagccagggtccagctgcagcccccgccacccttccttcccttccctgtcctgggtcatgttgttgccaccctgtgtgacttttgaagctgtaaaatgagcttccagggcttgggtggcgtcggggcagggccgccgaggctgggaggaagcccttctgccttttgctggtgtttctggaatttgctttccctcacctctcacttccttctagaaggagcttcctgactggaaccagagaatgcatgtctgtccacttggtggctgctgggtggggccgggaacaagggcccctgaccctgtgtgctggccgggacctgccaccagccccccagcctgcttcttccccttaagctttgtgcccctggatgcgctaacattcactcttgtttgtccctggactggccatgaagtgaggagatggttatttaaagagaattccctatttatttgacaaaaaatccagttaatatattaatgtgaaataaaccctgtttgcacctcgatttgtttgctgaaaatgtgaaat

SEQ ID NO: 200340 - DNA, 1895 bp, Homo sapiens
  Payload ID: 19522
  Gene Name: WW domain binding protein 2
  ENST ID: ENST00000585462
  CDS Start-End: 151-870
tctcgggacccctgttggagagactatggcgctcaacaagaatcactcggagggcggcggagtgatcgtcaataacaccgagaggtgaaaacactgcggaaggatcctggaggaccaaagttcgggtgtcgaggaagtgggcgcatcctaatgtcctatgatcacgtggaactcacattcaatgacatgaagaacgtgccagaagccttcaaagggaccaagaaaggcactgtctaccttaccccttaccgggtcatctttctgtccaagggcaaggatgccatgcagtccttcatgatgccattttatctcatgaaagactgtgagatcaagcagcccgtatttggtgcaaactacatcaagggaacagtgaaggcggaagcgggaggtggctgggaaggctctgcttcctacaagttgactttcacggcagggggcgccattgagttcggacagcggatgctccaggtggcatctcaagcctccagaggtgaagtccccagtggagcctatggctactcttacatgcccagcggggcctatgtctatcccccgccagtcgccaatggaatgtacccctgccctcctggctacccctatccaccgcccccacctgagttctatccaggaccccccatgatggacggggccatgggatacgtgcagcccccaccaccgccctaccctgggcccatggaacctccggtcagcggccccgatgtcccctccactcctgcagccgaagccaaggccgcagaagcagccgccagcgcctattacaacccaggcaatcctcacaacgtctacatgcccacgagccagccgccgccacctccctactacccaccggaagataagaagacccagtaggccctcctgcctccctgcctcccaccctcatctctctaccctacccctcccatcggggctgtgctggggcttggggaggggagggggcgccttgttctccctccaggtctgatcataaacaattaccaggaactagcattgtgggacattagggcccccggcctcgggagaggtgccgcccagcttcccatgccagcccggagcccacagtgctgcccagcgtacctccctcaccgtctggggctcttctgggagcacggagcatcccctgttcctgtttcactctcagcttctcccctcgaagggactctctggccacctcctccaccgcagtccagctccctcagtctggcacccactgctacactcagcctcatgagccacttcagaccagccaggtgtcttcccgggccctgccagaccctgctcacattccctctgctggtctgtgctggtctcagaaggccaccgcgcccgcattccactcagccagggtccagctgcagcccccgccacccttccttcccttccctgtcctgggtcatgttgttgccaccctgtgtgacttttgaagctgtaaaatgagcttccagggcttgggtggcgtcggggcagggccgccgaggctgggaggaagcccttctgccttttgctggtgtttctggaatttgctttccctcacctctcacttccttctagaaggagcttcctgactggaaccagagaatgcatgtctgtccacttggtggctgctgggtggggccgggaacaagggcccctgaccctgtgtgctggccgggacctgccaccagccccccagcctgcttcttccccttaagctttgtgcccctggatgcgctaacattcactcttgtttgtccctggactggccatgaagtgaggagatggttatttaaagagaattccctatttatttgacaaaaaatccagttaatatattaatgtgaaataaaccctgtttgcacctcgatttgtttgctgaaaatgtgaaatagtaaaaatga

SEQ ID NO: 200341 - DNA, 568 bp, Homo sapiens
  Payload ID: 19522
  Gene Name: WW domain binding protein 2
  ENST ID: ENST00000589642
  CDS Start-End: 112-568
agttcgggtgtcgaggaagtgggcggtgggtggtgggtggtggggaataagcccctgaagagggagcactgatggagtgaggtcatctttctgtccaagggcaaggatgccatgcagtccttcatgatgccattttatctcatgaaagactgtgagatcaagcagcccgtatttggtgcaaactacatcaagggaacagtgaaggcggaagcgggaggtggctgggaaggctctgcttcctacaagttgactttcacggcagggggcgccattgagttcggacagcggatgctccaggtggcatctcaagcctccagaggtgaagtccccagtggagcctatggctactcttacatgcccagcggggcctatgtctatcccccgccagtcgccaatggaatgtacccctgccctcctggctacccctatccaccgcccccacctgagttctatccaggaccccccatgatggacggggccatgggatacgtgcagcccccaccaccgccctaccctgggcccatggaacctccggtcagcggccccgatgtcccctccactcctgcag

SEQ ID NO: 200342 - DNA, 1867 bp, Homo sapiens
  Payload ID: 19522
  Gene Name: WW domain binding protein 2
  ENST ID: ENST00000626827
  CDS Start-End: 124-819
gggccagcctccgcactcgagctttgattggctgactctaataagaagacgccactaggggcggggcgaagaggggcgcaagctcattgcgttttgagtctcgggacccctgttggagagactatggcgctcaacaagaatcactcggagggcggcggagtgatcgtcaataacaccgagagcatcctaatgtcctatgatcacgtggaactcacattcaatgacatgaagaacgtgccagaagccttcaaagggaccaagaaaggcactgtctaccttaccccttaccgggtcatctttctgtccaagggcaaggatgccatgcagtccttcatgatgccattttatctcatgaaagactgtgagatcaagcagcccgtatttggtgcaaactacatcaagggaacagtgaaggcggaagcgggaggtggctgggaaggctctgcttcctacaagttgactttcacggcagggggcgccattgagttcggacagcggatgctccaggtggcatctcaagcctccagaggtgaagtccccagtggagcctatggctactcttacatgcccagcggggcctatgtctatcccccgccagtcgccaatggaatgtacccctgccctcctggctacccctatccaccgcccccacctgagttctatccaggaccccccatgatggacggggccatgggatacgtgcagcccccaccaccgccctaccctgggcccatggaacctccggtcagcggccccgatgtcccctccactcctgcagagccagccgccgccacctccctactacccaccggaagataagaagacccagtaggccctcctgcctccctgcctcccaccctcatctctctaccctacccctcccatcggggctgtgctggggcttggggaggggagggggcgccttgttctccctccaggtctgatcataaacaattaccaggaactagcattgtgggacattagggcccccggcctcgggagaggtgccgcccagcttcccatgccagcccggagcccacagtgctgcccagcgtacctccctcaccgtctggggctcttctgggagcacggagcatcccctgttcctgtttcactctcagcttctcccctcgaagggactctctggccacctcctccaccgcagtccagctccctcagtctggcacccactgctacactcagcctcatgagccacttcagaccagccaggtgtcttcccgggccctgccagaccctgctcacattccctctgctggtctgtgctggtctcagaaggccaccgcgcccgcattccactcagccagggtccagctgcagcccccgccacccttccttcccttccctgtcctgggtcatgttgttgccaccctgtgtgacttttgaagctgtaaaatgagcttccagggcttgggtggcgtcggggcagggccgccgaggctgggaggaagcccttctgccttttgctggtgtttctggaatttgctttccctcacctctcacttccttctagaaggagcttcctgactggaaccagagaatgcatgtctgtccacttggtggctgctgggtggggccgggaacaagggcccctgaccctgtgtgctggccgggacctgccaccagccccccagcctgcttcttccccttaagctttgtgcccctggatgcgctaacattcactcttgtttgtccctggactggccatgaagtgaggagatggttatttaaagagaattccctatttatttgacaaaaaatccagttaatatattaatgtgaaataaaccctgtttgcacctcgatttgtttgctgaaaatgtgaaatagtaaaaatgaaataactgga

SEQ ID NO: 200343 - DNA, 2623 bp, Homo sapiens
  Payload ID: 19523
  Gene Name: WW domain binding protein 4
  Uniprot ID: O75554
  ENST ID: ENST00000379487
  CDS Start-End: 401-1531
agaaggaggatggaggttttgggccccaggggaggacacagagacggcgggatggcgcagggacttgaggcttgagatcccgtccttcagctcaggtcccgtcgcgcttttaccccttcccggtgacctcaacccctttataccgaccccacctctttggagccgggagtaccgcccctgtagggggaggggagaggaggcgatttcgaacgcggattggatcgtctgggcacccgtagttgggaacagcggaacgctggtcccggggactgagtaaggtgtctggatcggagggaggttcgggtgggcatcgggcggctggaagagctcgactcgtcccgctgggaaagcgcgagtctgagtggaaccctggacgacttgcagagcggctggcgcagtcatggcggactactggaagtcacagccaaagaaattctgtgattactgcaagtgctggatagcagacaataggcctagtgttgaatttcatgaaagaggaaagaatcataaggaaaatgtggcaaaaaggatcagtgagattaaacagaaaagcctggataaggcaaaggaagaagaaaaggcatcaaaggagtttgctgcaatggaggcagctgccctgaaagcataccaagaggatttgaaaagacttggcttagagtcagaaattttggagccaagcataacaccagtaaccagcactatcccacctacctcgacatcaaatcaacagaaagaaaagaaagaaaagaagaaaagaaaaaaagatccttcaaagggcagatgggtagaaggcataacctctgagggttaccattactattatgatcttatctcaggagcatctcagtgggagaaacctgaaggatttcaaggagacttaaaaaagacagcagtgaagaccgtttgggtagaaggtttaagtgaagatggttttacctattactataatacagaaacaggagaatccagatgggagaaacctgatgatttcattccacacactagtgatctgccttctagtaaggtcaatgaaaattcacttggcaccctagatgaatccaaatcatcagattcgcatagtgattctgatggggaacaggaagcagaagaaggaggggtctctacagagacagaaaagccaaaaataaagtttaaggaaaaaaataaaaatagtgatggaggaagtgacccagaaacacagaaagaaaaaagtattcagaaacagaattcattaggttcaaatgaagaaaaatcgaaaactcttaagaaatcaaacccatatggagaatggcaagaaattaaacaagaggttgagtctcatgaggaggtagatttggaacttccaagcactgaaaatgagtatgtatcaacttcagaagctgatggtggcggagaacccaaagtggtatttaaagaaaaaacagtcacttctcttggagttatggcagatggagtggccccagtcttcaaaaagagaagaactgaaaatggaaaatctagaaatttaaggcaacgaggtgatgatcaatagttgcaggagagctttttgtacatgcttttaggacagaatggagacttatacacccaaagtttatctgtgtttgtttgtaagtattatgatgctaaaaatttagatttattctaaatgtatttgatgtgaattaaaataaatattttttcatgtgaaatttattttggttcctaaaatggaagcctaccacattgcattgtaatacagtgtattatgttcagtgtctaaaaactgctaattaagtcataatttaagatgctatgtatctgttatttaaaacatggagaaacagggcctttattccattcatattcataagagcatatttatcctgcattgaaaatgcattacttttgcacattgatattaactgttgtccaacaaataagtatcggagtacgtgagaatattcccagcccagtgatgatttggttctgaggctgatgtgagaaagctgatgtaaaaaatgtatgcatattggcttaccttactcaatttaaagtcaaaagccaacagccaggagcagctcaggtacttcagatgtgcttaatatggagtgaaaactggaccagaggtggaaagatgtatttgccccagttcacttcaaagcagcaaacgttgtttaagcattttagtttgaaccaggcattgtgttaggaatccagggataaagatgaatgaaatgtatttctgttcttcaggagttcacattctagcatatgccttttttcccccagtcatgcactctttttagcagtcttatatgtactagaaaagattttttaaagtttatttaaagctgtgtagatgaaggcttgatctaaaatagtataaggtctccagcttcagtaaaagtttttagtgtttacttaaattagtaatttctcactttctgtctggttaaaatgtcttaaaaagtagaattttcttctttaatccgtttagtagttacctcccttttacttttcaaattcacaaaattacatttctcataaattgtatagtatttaacttataatagttaatatttgtctttttaagatgactgtacatgtaagaaaaaagcttattaaaaacttgatcaaagaataa

SEQ ID NO: 200344 - DNA, 921 bp, Homo sapiens
  Payload ID: 19524
  Gene Name: WW domain binding protein 5
  Uniprot ID: Q9UHQ7
  ENST ID: ENST00000372656
  CDS Start-End: 226-540
actggtgacgtagatctcatgtgaccaggagtcgacgtgtgcagaagtcctggtaatctggtccttgttcccgtctggataccagcttccttcagcagcgcaggcggtggtccctgaggcccgtggaaggagtcaaacttgcgggaattttgcagaagtcattgtattcaaagaagaataagcaagaaagaaaagaaggaaggaagagaggtagacagatacaagatgaaatcctgtcaaaaaatggaaggaaaaccagaaaatgagagtgaaccaaagcatgaggaagagccaaagcctgaggaaaagccagaagaggaggagaagctagaggaggaggccaaagcaaaaggaacttttagagaaaggctgattcaatctctccaggagtttaaagaagatatacacaacaggcatttaagcaatgaagatatgtttagagaagtggatgaaatagatgagataaggagagtcagaaacaaacttatagtgatgcgttggaaggttaatcgaaaccatccttacccctatttaatgtagtttaccttgatttttatctgatattaacaataccatatagcttgctttttattagcatttcctgatattcctttgtccatatttctacttataacctgttgctattaatggttttagatgtatctcttgttatctgcatctcattgtttattgtattttgaaccaatctacaagtctctgtcttttaataaaagaactttacacatttgtaaaaaagaggttcttggtaagatataaaatggaaaaaggctaagtaatatgtgaatatcatatttttgaaaggtaaaaagtacatttgtatattacatatatggacataacttgtgaaggatgaaagaaagtacagcctctcggtggtgggattatgaatgatttttctcc

SEQ ID NO: 200345 - DNA, 1096 bp, Homo sapiens
  Payload ID: 19524
  Gene Name: WW domain binding protein 5
  Uniprot ID: Q9UHQ7
  ENST ID: ENST00000372661
  CDS Start-End: 312-626
cgagctcactggtgacgtagatctcatgtgaccaggagtcgacgtgtgcagaagtcctggtaatctggtccttgttcccgtctggataccagcttccttcagcagcgcaggcggtggtccctgaggcccgtggaaggagtcaaacttgcgggaattttgcagtttatctgcagggctgttgtttccagcaagacccaaagctagaaaaggaggaggaagaaactgacccgatcagtgccagaagtcattgtattcaaagaagaataagcaagaaagaaaagaaggaaggaagagaggtagacagatacaagatgaaatcctgtcaaaaaatggaaggaaaaccagaaaatgagagtgaaccaaagcatgaggaagagccaaagcctgaggaaaagccagaagaggaggagaagctagaggaggaggccaaagcaaaaggaacttttagagaaaggctgattcaatctctccaggagtttaaagaagatatacacaacaggcatttaagcaatgaagatatgtttagagaagtggatgaaatagatgagataaggagagtcagaaacaaacttatagtgatgcgttggaaggttaatcgaaaccatccttacccctatttaatgtagtttaccttgatttttatctgatattaacaataccatatagcttgctttttattagcatttcctgatattcctttgtccatatttctacttataacctgttgctattaatggttttagatgtatctcttgttatctgcatctcattgtttattgtattttgaaccaatctacaagtctctgtcttttaataaaagaactttacacatttgtaaaaaagaggttcttggtaagatataaaatggaaaaaggctaagtaatatgtgaatatcatatttttgaaaggtaaaaagtacatttgtatattacatatatggacataacttgtgaaggatgaaagaaagtacagcctctcggtggtgggattatgaatgatttttctccttttgcttgtttgtattttctatattcctaaaattaacacacattattattgctagaataataaaagttttataaaaaagaagcaacaa

SEQ ID NO: 200346 - DNA, 2839 bp, Homo sapiens
  Payload ID: 19525
  Gene Name: WW domain containing adaptor with coiled-coil
  Uniprot ID: Q9BTA9
  ENST ID: ENST00000347934
  CDS Start-End: 268-1902
cgtcgtcttgcccccctccccccggttcgcggtgccgccgtgtagttggcgccgctgccccggctgagagtgagcgtggtgtcgacggagggagatggcccgggagcgccggcgccagtaactgggagctgatgagagtcgccgagggcgcgccgggcccaggtgccggggctgcccgccgcccgccgccgccgccgcctgcgcgcccgcccgcctttcgcggccgctctcccccctccccgacacacactcacaggccgggcattgatggtaatgtatgcgaggaaacagcagagactcagtgatggctgtcacgaccggaggggggactcgcagccttaccaggcacttaagtattcatcgaagagtcaccccagtagcggtgatcacagacatgaaaagatgcgagacgccggagatccttcaccaccaaataaaatgttgcggagatctgatagtcctgaaaacaaatacagtgacagcacaggtcacagtaaggccaaaaatgtgcatactcacagagttagagagagggatggtgggaccagttactctccacaagaaaattcacacaaccacagtgctcttcatagttcaaattcacattcttctaatccaagcaataacccaagcaaaacttcagatgcaccttatgattctgcagatgactggtctgagcatattagctcttctgggaaaaagtactactacaattgtcgaacagaagtttcacaatgggaaaaaccaaaagagtggcttgaaagagaacagagacaaaaagaagcaaacaagatggcagtcaacagcttcccaaaagatagggattacagaagagaggtgatgcaagcaacagccactagtgggtttgccagtggaaaatctacatcaggagacaaacccgtatcacattcttgcacaactccttccacgtcttctgcctctggactgaaccccacatctgcacctccaacatctgcttcagcggtccctgtttctcctgttccacagtcgccaatacctcccttacttcaggacccaaatcttcttagacaattgcttcctgctttgcaagccacgctgcagcttaataattctaatgtggacatatctaaaataaatgaagttcttacagcagctgtgacacaagcctcactgcagtctataattcataagtttcttactgctggaccatctgctttcaacataacgtctctgatttctcaagctgctcagctctctacacaagcccagccatctaatcagtctccgatgtctttaacatctgatgcgtcatccccaagatcatatgtttctccaagaataagcacacctcaaactaacacagtccctatcaaacctttgatcagtactcctcctgtttcatcacagccaaaggttagtactccagtagttaagcaaggaccagtgtcacagtcagccacacagcagcctgtaactgctgacaagcagcaaggtcatgaacctgtctctcctcgaagtcttcagcgctcaagtagccagagaagtccatcacctggtcccaatcatacttctaatagtagtaatgcatcaaatgcaacagttgtaccacagaattcttctgcccgatccacgtgttcattaacgcctgcactagcagcacacttcagtgaaaatctcataaaacacgttcaaggatggcctgcagatcatgcagagaagcaggcatcaagattacgcgaagaagcgcataacatgggaactattcacatgtccgaaatttgtactgaattaaaaaatttaagatctttagtccgagtatgtgaaattcaagcaactttgcgagagcaaaggatactatttttgagacaacaaattaaggaacttgaaaagctaaaaaatcagaattccttcatggtgtgaagatgtgaataattgcacatggttttgagaacaggaactgtaaatctgttgcccaatcttaacatttttgagctgcatttaagtagactttggaccgttaagctgggcaaaggaaatgacaaggggacggggtctgtgagagtcaattcaggggaaagatacaagattgatttgtaaaacccttgaaatgtagatttcttgtagatgtatccttcacgttgtaaatatgttttgtagagtgaagccatgggaagccatgtgtaacagagcttagacatccaaaactaatcaatgctgaggtggctaaatacctagccttttacatgtaaacctgtctgcaaaattagcttttttaaaaaaaaaaaaaaaaaaattgggggggttaatttatcattcagaaatcttgcattttcaaaaattcagtgcaagcgccaggcgatttgtgtctaaggatacgattttgaaccatatgggcagtgtacaaaatatgaaacaactgtttccacacttgcacctgatcaagagcagtgcttctccatttgttttgcagagaaatgtttttcatttcccgtgtgtttccatttccttctgaaattctgattttatccatttttttaaggctcctctttatctcctttcttaaggcactgttgctatggcacttttctataaccttttcattcctgtgtacagtagcttaaaattgcagtgattgagcataacctacttgtttgtataaattattgaaatccatttgcaccctgttaagaatggacttaaaagtactgctggacaggcatgtgtgctcaaagtacattgattgctcaaatataaggaaatggcccaatgaacgtggttgtgggaggggaaagaggaaacagagctagtcagatgtgaattgtatctgttgtaataaacatgttaaaacaaacaaaaa

SEQ ID NO: 200347 - DNA, 3042 bp, Homo sapiens
  Payload ID: 19525
  Gene Name: WW domain containing adaptor with coiled-coil
  Uniprot ID: Q9BTA9
  ENST ID: ENST00000354911
  CDS Start-End: 162-2105
cgccggcgccagtaactgggagctgatgagagtcgccgagggcgcgccgggcccaggtgccggggctgcccgccgcccgccgccgccgccgcctgcgcgcccgcccgcctttcgcggccgctctcccccctccccgacacacactcacaggccgggcattgatggtaatgtatgcgaggaaacagcagagactcagtgatggctgtcacgaccggaggggggactcgcagccttaccaggcacttaagtattcatcgaagagtcaccccagtagcggtgatcacagacatgaaaagatgcgagacgccggagatccttcaccaccaaataaaatgttgcggagatctgatagtcctgaaaacaaatacagtgacagcacaggtcacagtaaggccaaaaatgtgcatactcacagagttagagagagggatggtgggaccagttactctccacaagaaaattcacacaaccacagtgctcttcatagttcaaattcacattcttctaatccaagcaataacccaagcaaaacttcagatgcaccttatgattctgcagatgactggtctgagcatattagctcttctgggaaaaagtactactacaattgtcgaacagaagtttcacaatgggaaaaaccaaaagagtggcttgaaagagaacagagacaaaaagaagcaaacaagatggcagtcaacagcttcccaaaagatagggattacagaagagaggtgatgcaagcaacagccactagtgggtttgccagtggaatggaagacaagcattccagtgatgccagtagtttgctcccacagaatattttgtctcaaacaagcagacacaatgacagagactacagactgccaagagcagagactcacagtagttctacgccagtacagcaccccatcaaaccagtggttcatccaactgctaccccaagcactgttccttctagtccatttacgctacagtctgatcaccagccaaagaaatcatttgatgctaatggagcatctactttatcaaaactgcctacacccacatcttctgtccctgcacagaaaacagaaagaaaagaatctacatcaggagacaaacccgtatcacattcttgcacaactccttccacgtcttctgcctctggactgaaccccacatctgcacctccaacatctgcttcagcggtccctgtttctcctgttccacagtcgccaatacctcccttacttcaggacccaaatcttcttagacaattgcttcctgctttgcaagccacgctgcagcttaataattctaatgtggacatatctaaaataaatgaagttcttacagcagctgtgacacaagcctcactgcagtctataattcataagtttcttactgctggaccatctgctttcaacataacgtctctgatttctcaagctgctcagctctctacacaagcccagccatctaatcagtctccgatgtctttaacatctgatgcgtcatccccaagatcatatgtttctccaagaataagcacacctcaaactaacacagtccctatcaaacctttgatcagtactcctcctgtttcatcacagccaaaggttagtactccagtagttaagcaaggaccagtgtcacagtcagccacacagcagcctgtaactgctgacaagcagcaaggtcatgaacctgtctctcctcgaagtcttcagcgctcaagtagccagagaagtccatcacctggtcccaatcatacttctaatagtagtaatgcatcaaatgcaacagttgtaccacagaattcttctgcccgatccacgtgttcattaacgcctgcactagcagcacacttcagtgaaaatctcataaaacacgttcaaggatggcctgcagatcatgcagagaagcaggcatcaagattacgcgaagaagcgcataacatgggaactattcacatgtccgaaatttgtactgaattaaaaaatttaagatctttagtccgagtatgtgaaattcaagcaactttgcgagagcaaaggatactatttttgagacaacaaattaaggaacttgaaaagctaaaaaatcagaattccttcatggtgtgaagatgtgaataattgcacatggttttgagaacaggaactgtaaatctgttgcccaatcttaacatttttgagctgcatttaagtagactttggaccgttaagctgggcaaaggaaatgacaaggggacggggtctgtgagagtcaattcaggggaaagatacaagattgatttgtaaaacccttgaaatgtagatttcttgtagatgtatccttcacgttgtaaatatgttttgtagagtgaagccatgggaagccatgtgtaacagagcttagacatccaaaactaatcaatgctgaggtggctaaatacctagccttttacatgtaaacctgtctgcaaaattagcttttttaaaaaaaaaaaaaaaaaaattgggggggttaatttatcattcagaaatcttgcattttcaaaaattcagtgcaagcgccaggcgatttgtgtctaaggatacgattttgaaccatatgggcagtgtacaaaatatgaaacaactgtttccacacttgcacctgatcaagagcagtgcttctccatttgttttgcagagaaatgtttttcatttcccgtgtgtttccatttccttctgaaattctgattttatccatttttttaaggctcctctttatctcctttcttaaggcactgttgctatggcacttttctataaccttttcattcctgtgtacagtagcttaaaattgcagtgattgagcataacctacttgtttgtataaattattgaaatccatttgcaccctgttaagaatggacttaaaagtactgctggacaggcatgtgtgctcaaagtacattgattgctcaaatataaggaaatggcccaatgaacgtggttgtgggaggggaaagaggaaacagagctagtcagatgtgaattgtatctgttgtaataaacatgttaaaacaaacaaaaa

SEQ ID NO: 200348 - DNA, 2176 bp, Homo sapiens
  Payload ID: 19525
  Gene Name: WW domain containing adaptor with coiled-coil
  ENST ID: ENST00000375646
  CDS Start-End: 319-1806
gcgatggcttccctcgcgccccaccgtcctcttccggaaggcggctccctccctgcgcagcccggagcccctgagatcagcctcgagcaggcgcccgagcgagactatccctaaacgggaacggcggtggccgactcgcgagtgaggaaaagaaggaaagggcagactggtcgcgaagagaagatccaggcctcagaggaggagaaaggccggagccagccgagctgtcacgaccggaggggggactcgcagccttaccaggcacttaagtattcatcgaagagtcaccccagtagcggtgatcacagacatgaaaagatgcgagacgccggagatccttcaccaccaaataaaatgttgcggagatctgatagtcctgaaaacaaatacagtgacagcacaggtcacagtaaggccaaaaatgtgcatactcacagagttagagagagggatggtgggaccagttactctccacaagaaaattcacacaaccacagtgctcttcatagttcaaattcacattcttctaatccaagcaataacccaagcaaaacttcagatgcaccttatgattctgcagatgactggtctgagcatattagctcttctgggaaaaagtactactacaattgtcgaacagaagtttcacaatgggaaaaaccaaaagagtggcttgaaagagaacagagacaaaaagaagcaaacaagatggcagtcaacagcttcccaaaagatagggattacagaagagaggtgatgcaagcaacagccactagtgggtttgccagtggaaaatctacatcaggagacaaacccgtatcacattcttgcacaactccttccacgtcttctgcctctggactgaaccccacatctgcacctccaacatctgcttcagcggtccctgtttctcctgttccacagtcgccaatacctcccttacttcaggacccaaatcttcttagacaattgcttcctgctttgcaagccacgctgcagcttaataattctaatgtggacatatctaaaataaatgaagctgtgacacaagcctcactgcagtctataattcataagtttcttactgctggaccatctgctttcaacataacgtctctgatttctcaagctgctcagctctctacacaagcccagccatctaatcagtctccgatgtctttaacatctgatgcgtcatccccaagatcatatgtttctccaagaataagcacacctcaaactaacacagtccctatcaaacctttgatcagtactcctcctgtttcatcacagccaaaggttagtactccagtagttaagcaaggaccagtgtcacagtcagccacacagcagcctgtaactgctgacaagcagcaaggtcatgaacctgtctctcctcgaagtcttcagcgctcaagtagccagagaagtccatcacctggtcccaatcatacttctaatagtagtaatgcatcaaatgcaacagttgtaccacagaattcttctgcccgatccacgtgttcattaacgcctgcactagcagcacacttcagtgaaaatctcataaaacacgttcaaggatggcctgcagatcatgcagagaagcaggcatcaagattacgcgaagaagcgcataacatgggaactattcacatgtccgaaatttgtactgaattaaaaaatttaagatctttagtccgagtatgtgaaattcaagcaactttgcgagagcaaaggatactatttttgagacaacaaattaaggaacttgaaaagctaaaaaatcagaattccttcatggtgtgaagatgtgaataattgcacatggttttgagaacaggaactgtaaatctgttgcccaatcttaacatttttgagctgcatttaagtagactttggaccgttaagctgggcaaaggaaatgacaaggggacggggtctgtgagagtcaattcaggggaaagatacaagattgatttgtaaaacccttgaaatgtagatttcttgtagatgtatccttcacgttgtaaatatgttttgtagagtgaagccatgggaagccatgtgtaacagagcttagacatccaaaactaatcaatgctgaggtggctaaatacctagccttttacatgtaaacctgtctgcaaaattagcttttttaaaaaaaaaaaaaaaa

SEQ ID NO: 200349 - DNA, 5924 bp, Homo sapiens
  Payload ID: 19525
  Gene Name: WW domain containing adaptor with coiled-coil
  Uniprot ID: Q9BTA9
  ENST ID: ENST00000375664
  CDS Start-End: 610-2418
ggtggcgcgcggcgtccggtgaggggcagcggcccgggctcggttccggcttccagcagcggcccgaaggcgccggagcacgctccccgctccccagaacgcagcttccgcggctgcagcccaggcagctcttcgggaagcgtccgcccgtggtctcgccagggggtttccgacctccccgcccgacagcgcaggggcgggggccgcggccggagagctcgcccgagagcaccccctcccgctgcgcctctgggcgcacgcgcagccgctgcagcctcccttatttagtccgcgatggcttccctcgcgccccaccgtcctcttccggaaggcggctccctccctgcgcagcccggagcccctgagatcagcctcgagcaggcgcccgagcgagactatccctaaacgggaacggcggtggccgactcgcgagtgaggaaaagaaggaaagggcagactggtcgcgaagagaagatccaggcctcagaggaggagaaaggccggagccagccgagctgtcacgaccggaggggggactcgcagccttaccaggcacttaagtattcatcgaagagtcaccccagtagcggtgatcacagacatgaaaagatgcgagacgccggagatccttcaccaccaaataaaatgttgcggagatctgatagtcctgaaaacaaatacagtgacagcacaggtcacagtaaggccaaaaatgtgcatactcacagagttagagagagggatggtgggaccagttactctccacaagaaaattcacacaaccacagtgctcttcatagttcaaattcacattcttctaatccaagcaataacccaagcaaaacttcagatgcaccttatgattctgcagatgactggtctgagcatattagctcttctgggaaaaagtactactacaattgtcgaacagaagtttcacaatgggaaaaaccaaaagagtggcttgaaagagaacagagacaaaaagaagcaaacaagatggcagtcaacagcttcccaaaagatagggattacagaagagaggtgatgcaagcaacagccactagtgggtttgccagtggaatggaagacaagcattccagtgatgccagtagtttgctcccacagaatattttgtctcaaacaagcagacacaatgacagagactacagactgccaagagcagagactcacagtagttctacgccagtacagcaccccatcaaaccagtggttcatccaactgctaccccaagcactgttccttctagtccatttacgctacagtctgatcaccagccaaagaaatcatttgatgctaatggagcatctactttatcaaaactgcctacacccacatcttctgtccctgcacagaaaacagaaagaaaagaatctacatcaggagacaaacccgtatcacattcttgcacaactccttccacgtcttctgcctctggactgaaccccacatctgcacctccaacatctgcttcagcggtccctgtttctcctgttccacagtcgccaatacctcccttacttcaggacccaaatcttcttagacaattgcttcctgctttgcaagccacgctgcagcttaataattctaatgtggacatatctaaaataaatgaagttcttacagcagctgtgacacaagcctcactgcagtctataattcataagtttcttactgctggaccatctgctttcaacataacgtctctgatttctcaagctgctcagctctctacacaagcccagccatctaatcagtctccgatgtctttaacatctgatgcgtcatccccaagatcatatgtttctccaagaataagcacacctcaaactaacacagtccctatcaaacctttgatcagtactcctcctgtttcatcacagccaaaggttagtactccagtagttaagcaaggaccagtgtcacagtcagccacacagcagcctgtaactgctgacaagcagcaaggtcatgaacctgtctctcctcgaagtcttcagcgctcaagtagccagagaagtccatcacctggtcccaatcatacttctaatagtagtaatgcatcaaatgcaacagttgtaccacagaattcttctgcccgatccacgtgttcattaacgcctgcactagcagcacacttcagtgaaaatctcataaaacacgttcaaggatggcctgcagatcatgcagagaagcaggcatcaagattacgcgaagaagcgcataacatgggaactattcacatgtccgaaatttgtactgaattaaaaaatttaagatctttagtccgagtatgtgaaattcaagcaactttgcgagagcaaaggatactatttttgagacaacaaattaaggaacttgaaaagctaaaaaatcagaattccttcatggtgtgaagatgtgaataattgcacatggttttgagaacaggaactgtaaatctgttgcccaatcttaacatttttgagctgcatttaagtagactttggaccgttaagctgggcaaaggaaatgacaaggggacggggtctgtgagagtcaattcaggggaaagatacaagattgatttgtaaaacccttgaaatgtagatttcttgtagatgtatccttcacgttgtaaatatgttttgtagagtgaagccatgggaagccatgtgtaacagagcttagacatccaaaactaatcaatgctgaggtggctaaatacctagccttttacatgtaaacctgtctgcaaaattagcttttttaaaaaaaaaaaaaaaaaaattgggggggttaatttatcattcagaaatcttgcattttcaaaaattcagtgcaagcgccaggcgatttgtgtctaaggatacgattttgaaccatatgggcagtgtacaaaatatgaaacaactgtttccacacttgcacctgatcaagagcagtgcttctccatttgttttgcagagaaatgtttttcatttcccgtgtgtttccatttccttctgaaattctgattttatccatttttttaaggctcctctttatctcctttcttaaggcactgttgctatggcacttttctataaccttttcattcctgtgtacagtagcttaaaattgcagtgattgagcataacctacttgtttgtataaattattgaaatccatttgcaccctgttaagaatggacttaaaagtactgctggacaggcatgtgtgctcaaagtacattgattgctcaaatataaggaaatggcccaatgaacgtggttgtgggaggggaaagaggaaacagagctagtcagatgtgaattgtatctgttgtaataaacatgttaaaacaaacaaaaattgttatttttcttttccttcggtcagtgcacattagcatttgaactacctggggattctttatcagaactgttcttgttgaatatttatacttaattgaaataattccttaagggaggttttgtttaaaacgtattaacaggaaattgtgtatgagatatttaatgaaataagaaattcaacaagaatgattaagtcacttcccaagtggttgtcatttgttaaaccctggtttacctgtcttgctattatgacatttcatttggaaggatgtttgtgttgtagctaactgttcaagtctggtgctgactgctgttcttagccatcacaaaacgctaaatttgtgtaattggagcttcctgctgttatctggaaatagcaggaaagcgcagctttgtatattgtttcctaaagtatattaaaataaaaaaagaaactattgctactataaaattaccttgactttttttttcctttgctgaaatattagtcacatagccttagcttcacactgccagtaatgtatcaaatcacaagggtttccgcatgaaaaaaatcttttcttcccccacaaaaaaacctttaccatcaaaatcttgccatctgatttagaaaggtgtttcttcttcttcttcttttttttctttaaattggtttagggttttttggtgattttttttttttttttttttctgttggggcagataagtgcttccaaaactggcagcaccaagggcttattttttatgttagacatcaatgtcaatgttactacattctcggatgctaacataaattttgaaattgctcttgtgctttaagcatatattgaaagtatggaagttaaatgttcaggcttttcagtaagctcaaaaagttaactgtaagcgatagtgttggtgttttctaaaatacaaaaatgttccagtgtaattaaaaggaattaaaatcttgaagatattttcctgtaatttaaggatactttttaaatgtaagaaaagacatgtcattaatttattgtcatgtttatacctctgtgagattgttaacatctgctgaatttaactagtgcatgtaaatgaaaccccaaagagctgtgtgttcagctagaaaccttactgtatctttcctggaaagaagtgagcaatttgttgtaataggcaaatgtttcctgatcagatggcaatttgtgatttaggtaaatttgaatttgatttgcttatagtctactggtctgtgtacctatgttttgtttttcaaaaaagtttacatccctaaatgaattagtcacatatatttaggagaagatgcctaatttggtatttcttaatagtgaatttttttttttcttgagacagagtttcactcttgttgcccaggctggagtgcaatggcacgatctcggctcaccgcaacctctgcctcctgggttcaagcgattctcctgcctcggcgttccgagtagctgggattacaggcatgcaccaccacgcctggctaattttgtatttttagtagagatggggtttctccatgttggtcaggctggtcttgaactgccaacttcaggtgatctgcctgccttggcctcccaaagtgctgggattacaggcgtgagccaccgctcctggccagtagtgaatttttaaacacagaaaatctaaaattttgtggaaatattttaaatattgcaccttaatacaaggtatccagctcctaaccttaactagggaatatctattaaaataagcataatgttctggactagagtattccttatctagttggttatggatttgaacatgtaccttggtttagatactttgaaaatagaagtactgaatagcctctagggaacttgagtggcctttccctccccctgcccccccccccccccccccgttttaaaagatcagtagtctctattcaaacttttaaaatgtcgtggtattgtaacaatatatttgatgaaagaaggttacagactcccctgaagaaccagctttcctacgctttttatttttctaacttgtctaacctgattttaaaatgactgcaattccagactaaaaacatgcttcagccctgtttcaagacattatgcttcttttaacagtccaaattagtagttttatttttcttctaaatctttgtttcacacttgtaaaatcttgggaaggaggttcttaaaactttgccaggaattgttacccatttccaaaaacagtttattatgttcaaaaaccaccatatctttgagggactgtttgaaaggggagagggcaacgcgggaaataattcactctgcgcaccggaactattgtagttcaggacttccagctactgtatttagatgttgggtttgaatatacagatttcttttcaatacctgtaaatatggctatattcttgtatttgtacgggagtgtacaaaatgacactgaaaagtaataaatatgttttgactatattgtgcagttatttcagaactgtgttttgaaagtcttagaatgcataatttgcatttgagtaaggaaatttaaaatacagattactgctgagattttaa

SEQ ID NO: 200350 - DNA, 506 bp, Homo sapiens
  Payload ID: 19525
  Gene Name: WW domain containing adaptor with coiled-coil
  ENST ID: ENST00000448193
  CDS Start-End: 330-506
cgggcgggcgggcgggaacgcagtgtggcggggagcgggggcccggcttcgcggcatttcgccctctccggcccttccggaggctccgggtttgtgccgtgtgcgtgcggggctcggcgctggggcgctcggtaggtctcccgcggggaggggcggcgggggccccgttttcttcctccccggccccccacccgcgccgtgtcttatgtcgctgccttctcttcctgtttttcagctgtcacgaccggaggggggactcgcagccttaccaggcacttaagtattcatcgaagagtcaccccagtagcggtgatcacagacatgaaaagatgcgagacgccggagatccttcaccaccaaataaaatgttgcggagatctgatagtcctgaaaacaaatacagtgacagcacaggtcacagtaaggccaaaaatgtgcatactcacagagttagagagagggatggtgggaccagttactctccacaagaaaattcacacaaccac

SEQ ID NO: 200351 - DNA, 1320 bp, Homo sapiens
  Payload ID: 19525
  Gene Name: WW domain containing adaptor with coiled-coil
  ENST ID: ENST00000428935
  CDS Start-End: 281-727
tctcccccctccccgacacacactcacaggccgggcattgatggtaatgtatgcgaggaaacagcagagactcagtgatggctgtcacgaccggaggggggactcgcagccttaccaggtgactggagggagttcgctgatttaggaaaaaagaatcatttgcagccagaaagacctgactcgattatttgattatttgcgagtgaaggaatcgatgggatgagatgataggcacttaagtattcatcgaagagtcaccccagtagcggtgatcacagacatgaaaagatgcgagacgccggagatccttcaccaccaaataaaatgttgcggagatctgatagtcctgaaaacaaatacagtgacagcacaggtcacagtaaggccaaaaatgtgcatactcacagagttagagagagggatggtgggaccagttactctccacaagaaaattcacacaaccacagtgctcttcatagttcaaattcacattcttctaatccaagcaataacccaagcaaaacttcagatgcaccttatgattctgcagatgactggtctgagcatattagctcttctgggaaaaagtactactacaattgtcgaacagaagtttcacaatgggaaaaaccaaaagagtggcttgaaagagaacagagacaaaaagaagcaaacaagatggcagtcaacagcttcccaaaagatagggattacagaagagaggtgatgcaagcaacagccactagtgggtttgccagtggaatggaagacaagcattccagtgatgccagtagtttgctcccacagaatattttgtctcaaacaagcagacacaatgacagagactacagactgccaagagcagagactcacagtagttctacgccagtacagcaccccatcaaaccagtggttcatccaactgctaccccaagcactgttccttctagtccatttacgctacagtctgatcaccagccaaagaaatcatttgatgctaatggagcatctactttatcaaaactgcctacacccacatcttctgtccctgcacagaaaacagaaagaaaagaatctacatcaggagacaaacccgtatcacattcttgcacaactccttccacgtcttctgcctctggactgaaccccacatctgcacctccaacatctgcttcagcggtccctgtttctcctgttccacagtcgccaatacctcccttacttcaggacccaaatcttcttagacaattgcttcctgctttgcaagccacgctgcagcttaataattctaatgtggacatatctaaaataaatgaaggt

SEQ ID NO: 200352 - DNA, 759 bp, Homo sapiens
  Payload ID: 19525
  Gene Name: WW domain containing adaptor with coiled-coil
  ENST ID: ENST00000442148
  CDS Start-End: 240-759
gaggagcggccgcgcgggcgggcgggcgggaacgcagtgtggcggggagcgggggcccggcttcgcggcatttcgccctctccggcccttccggaggctccgggtttgtgccgtgtgcgtgcggggctcggcgctggggcgctcgctgtcacgaccggaggggggactcgcagccttaccaggcacttaagtattcatcgaagagtcaccccagtagcggtgatcacagacatgaaaagatgcgagacgccggagatccttcaccaccaaataaaatgttgcggagatctgatagtcctgaaaacaaatacagtgacagcacaggtcacagtaaggccaaaaatgtgcatactcacagagttagagagagggatggtgggaccagttactctccacaagaaaattcacacaaccacagtgctcttcatagttcaaattcacattcttctaatccaagcaataacccaagcaaaacttcagatgcaccttatgattctgcagatgactggtctgagcatattagctcttctgggaaaaagtactactacaattgtcgaacagaagtttcacaatgggaaaaaccaaaagagtggcttgaaagagaacagagacaaaaagaagcaaacaagatggcagtcaacagcttcccaaaagatagggattacagaagagaggtgatgcaagcaacagccactagtgggtttgccagtggaatggaagacaagcattccagtgatgccagtagtttgctcccacaga

SEQ ID NO: 200353 - DNA, 1330 bp, Homo sapiens
  Payload ID: 19525
  Gene Name: WW domain containing adaptor with coiled-coil
  ENST ID: ENST00000424454
  CDS Start-End: 41-145
tctcccccctccccgacacacactcacaggccgggcattgatggtaatgtatgcgaggaaacagcagagactcagtgatggctgtcacgaccggaggggggactcgcagccttaccaggtgactggagggagttcgctgatttaggaaaaaagaatcatttgcagccagaaagacctgactcgattatttgattatttgcgagtgaaggaatcgatgggatgagatgataggcacttaagtattcatcgaagagtcaccccagtagcggtgatcacagacatgaaaagatgcgagacgccggagatccttcaccaccaaataaaatgttgcggagatctgatagtcctgaaaacaaatacagtgacagcacaggtcacagtaaggccaaaaatgtgcatactcacagagttagagagagggatggtgggaccagttactctccacaagaaaattcacacaaccacagtgctcttcatagttcaaattcacattcttctaatccaagcaataacccaagcaaaacttcagatgcaccttatgattctgcagatgactggtctgagcatattagctcttctgggaaaaagtactactacaattgtcgaacagaagtttcacaatgggaaaaaccaaaagagtggcttgaaagagaacagagacaaaaagaagcaaacaagatggcagtcaacagcttcccaaaagatagggattacagaagagaggtgatgcaagcaacagccactagtgggtttgccagtggaatggaagacaagcattccagtgatgccagtagtttgctcccacagaatattttgtctcaaacaagcagacacaatgacagagactacagactgccaagagcagagactcacagtagttctacgccagtacagcaccccatcaaaccagtggttcatccaactgctaccccaagcactgttccttctagtccatttacgctacagtctgatcaccagccaaagaaatcatttgatgctaatggagcatctactttatcaaaactgcctacacccacatcttctgtccctgcacagaaaacagaaagaaaagaatctacatcaggagacaaacccgtatcacattcttgcacaactccttccacgtcttctgcctctggactgaaccccacatctgcacctccaacatctgcttcagcggtccctgtttctcctgttccacagtcgccaatacctcccttacttcaggacccaaatcttcttagacaattgcttcctgctttgcaagccacgctgcagcttaataattctaatgtggacatatctaaaataaatgaagttcttacagcag

SEQ ID NO: 200354 - DNA, 784 bp, Homo sapiens
  Payload ID: 19525
  Gene Name: WW domain containing adaptor with coiled-coil
  ENST ID: ENST00000420266
  CDS Start-End: 172-784
gccgcctgcgcgcccgcccgcctttcgcggccgctctcccccctccccgacacacactcacaggccgggcattgatgctgtcacgaccggaggggggactcgcagccttaccaggcacttaagtattcatcgaagagtcaccccagtagcggtgatcacagacatgaaaagatgcgagacgccggagatccttcaccaccaaataaaatgttgcggagatctgatagtcctgaaaacaaatacagtgacagcacaggtcacagtaaggccaaaaatgtgcatactcacagagttagagagagggatggtgggaccagttactctccacaagaaaattcacacaaccacagtgctcttcatagttcaaattcacattcttctaatccaagcaataacccaagcaaaacttcagatgcaccttatgattctgcagatgactggtctgagcatattagctcttctgggaaaaagtactactacaattgtcgaacagaagtttcacaatgggaaaaaccaaaagagtggcttgaaagagaacagagacaaaaagaagcaaacaagatggcagtcaacagcttcccaaaagatagggattacagaagagaggtgatgcaagcaacagccactagtgggtttgccagtggaatggaagacaagcattccagtgatgccagtagtttgctcccacagaatattttgtctcaaacaagcagacacaatgacagagactacagactgccaagagcagagactcacagtagttctacgccagtacagcacccca

SEQ ID NO: 200355 - DNA, 816 bp, Homo sapiens
  Payload ID: 19525
  Gene Name: WW domain containing adaptor with coiled-coil
  ENST ID: ENST00000414108
  CDS Start-End: 118-816
tacaggcccttcggtgcaacacatctgaaactagcaccgcggatccccttaaaattccaggcacttaagtattcatcgaagagtcaccccagtagcggtgatcacagacatgaaaagatgcgagacgccggagatccttcaccaccaaataaaatgttgcggagatctgatagtcctgaaaacaaatacagtgacagcacaggtcacagtaaggccaaaaatgtgcatactcacagagttagagagagggatggtgggaccagttactctccacaagaaaattcacacaaccacagtgctcttcatagttcaaattcacattcttctaatccaagcaataacccaagcaaaacttcagatgcaccttatgattctgcagatgactggtctgagcatattagctcttctgggaaaaagtactactacaattgtcgaacagaagtttcacaatgggaaaaaccaaaagagtggcttgaaagagaacagagacaaaaagaagcaaacaagatggcagtcaacagcttcccaaaagatagggattacagaagagaggtgatgcaagcaacagccactagtgggtttgccagtggaatggaagacaagcattccagtgatgccagtagtttgctcccacagaatattttgtctcaaacaagcagacacaatgacagagactacagactgccaagagcagagactcacagtagttctacgccagtacagcaccccatcaaaccagtggttcatccaactgctaccccaagcactgttccttctagtccatttacgctacagtctgatcaccagccaaagaaa

SEQ ID NO: 200356 - DNA, 2762 bp, Homo sapiens
  Payload ID: 19525
  Gene Name: WW domain containing adaptor with coiled-coil
  Uniprot ID: Q9BTA9
  ENST ID: ENST00000439676
  CDS Start-End: 354-1664
attctcagccaaatttttttattttttgcagaatcagtgtgcaaggtggtttataagataatggagtgggttttttttgtgtttagtgtgatttgttatcaggagtcttattgtaacgcttaagcattaggttttttgtctgagaaactttaaagagtaaagcagaattgaaagtggaaattttaattttgtaagttcataaaatttaatgataatacaccaaagtttatgtttaaattagggagtttaaggtttcaattctttctctctttttttgggggggtgatgttttacaggcacttaagtattcatcgaagagtcaccccagtagcggtgatcacagacatgaaaagatgcgagacgccggagatccttcaccaccaaataaaatgttgcggagatctgatagtcctgaaaacaaatacagtgacagcacaggtcacagtaaggccaaaaatgtgcatactcacagagttagagagagggatggtgggaccagttactctccacaagaaaattcacacaaccacagtgctcttcatagttcaaattcacattcttctaatccaagcaataacccaagcaaaacttcagatgcaccttatgattctgcagatgactggtctgagcatattagctcttctgggaaaaagtactactacaattgtcgaacagaagtttcacaatgggaaaaaccaaaagagtggcttgaaagagaacagagacaaaaagaagcaaacaagatggcagtcaacagcttcccaaaagatagggattacagaagagaggtgatgcaagcaacagccactagtgggtttgccagtggaatggaagacaagcattccagtgatgccagtagtttgctcccacagaatattttgtctcaaacaagcagacacaatgacagagactacagactgccaagagcagagactcacagtagttctacgccagtacagcaccccatcaaaccagtggttcatccaactgctaccccaagcactgttccttctagtccatttacgctacagtctgatcaccagccaaagaaatcatttgatgctaatggagcatctactttatcaaaactgcctacacccacatcttctgtccctgcacagaaaacagaaagaaaagaatctacatcaggagacaaacccgtatcacattcttgcacaactccttccacgtcttctgcctctggactgaaccccacatctgcacctccaacatctgcttcagcggtccctgtttctcctgttccacagtcgccaatacctcccttacttcaggacccaaatcttcttagacaattgcttcctgctttgcaagccacgctgcagcttaataattctaatgtggacatatctaaaataaatgaagttcttacagcagctgtgacacaagcctcactgcagtctataattcataagtttcttactgctggaccatctgctttcaacataacgtctctgatttctcaagctgctcagctctctacacaagatatccctcttcatgaaggtatccaaatggagagagatacacataggagcaaatgggaagtgaaagggtcactttgtcagaaagctgataaacagcaggaatgccttgtctggaatggaagtataatggtgcaaagactcttgcaaccctctggctagcctcatgagcaggagactgcgtgggatacctgggcctaaatgtagaataagaaagaagaaataaggatgcccagccatctaatcagtctccgatgtctttaacatctgatgcgtcatccccaagatcatatgtttctccaagaataagcacacctcaaactaacacagtccctatcaaacctttgatcagtactcctcctgtttcatcacagccaaaggttagtactccagtagttaagcaaggaccagtgtcacagtcagccacacagcagcctgtaactgctgacaagcagcaaggtcatgaacctgtctctcctcgaagtcttcagcgctcaagtagccagagaagtccatcacctggtcccaatcatacttctaatagtagtaatgcatcaaatgcaacagttgtaccacagaattcttctgcccgatccacgtgttcattaacgcctgcactagcagcacacttcagtgaaaatctcataaaacacgttcaaggatggcctgcagatcatgcagagaagcaggcatcaagattacgcgaagaagcgcataacatgggaactattcacatgtccgaaatttgtactgaattaaaaaatttaagatctttagtccgagtatgtgaaattcaagcaactttgcgagagcaaaggatactatttttgagacaacaaattaaggaacttgaaaagctaaaaaatcagaattccttcatggtgtgaagatgtgaataattgcacatggttttgagaacaggaactgtaaatctgttgcccaatcttaacatttttgagctgcatttaagtagactttggaccgttaagctgggcaaaggaaatgacaaggggacggggtctgtgagagtcaattcaggggaaagatacaagattgatttgtaaaacccttgaaatgtagatttcttgtagatgtatccttcacgttgtaaatatgttttgtagagtgaagccatgggaagccatgtgtaacagagcttagacatccaaaactaatcaatgctgaggtggctaaatacctagccttttacatgtaaacctgtctgcaaaattagcttttttaaaaaaaaaaaaaaaaaaa

SEQ ID NO: 200357 - DNA, 585 bp, Homo sapiens
  Payload ID: 19525
  Gene Name: WW domain containing adaptor with coiled-coil
  ENST ID: ENST00000526722
  CDS Start-End: 478-585
ttatttagtccgcgatggcttccctcgcgccccaccgtcctcttccggaaggcggctccctccctgcgcagcccggagcccctgagatcagcctcgagcaggcgcccgagcgagactatccctaaacgggaacggcggtggccgactcgcgagtgaggaaaagaaggaaagggcagactggtcgcgaagagaagatccaggcctcagaggaggagaaaggccggagccagccgagctgtcacgaccggaggggggactcgcagccttaccaggtaccagccgaggccggggtggagggattggaaggggccggagggggaagggagggactgctactcgagcgcaggcctcagaagtcgatacaggcccttcggtgcaacacatctgaaactagcaccgcggatccccttaaaattccaggcacttaagtattcatcgaagagtcaccccagtagcggtgatcacagacatgaaaagatgcgagacgccggagatccttcaccaccaaataaaatgttgcggagatctgatagtcctgaaaacaaatacagtgacagcacaggtcacagtaaggccaaaaatgtg

SEQ ID NO: 200358 - DNA, 2740 bp, Homo sapiens
  Payload ID: 19525
  Gene Name: WW domain containing adaptor with coiled-coil
  ENST ID: ENST00000628285
  CDS Start-End: 346-792
attctcagccaaatttttttattttttgcagaatcagtgtgcaaggtggtttataagataatggagtgggttttttttgtgtttagtgtgatttgttatcaggagtcttattgtaacgcttaagcattaggttttttgtctgagaaactttaaagagtaaagcagaattgaaagtggaaattttaattttgtaagttcataaaatttaatgataatacaccaaagtttatgtttaaattagggagtttaaggtttcaattctttctctctttttttgggggggtgatgttttacaggcacttaagtattcatcgaagagtcaccccagtagcggtgatcacagacatgaaaagatgcgagacgccggagatccttcaccaccaaataaaatgttgcggagatctgatagtcctgaaaacaaatacagtgacagcacaggtcacagtaaggccaaaaatgtgcatactcacagagttagagagagggatggtgggaccagttactctccacaagaaaattcacacaaccacagtgctcttcatagttcaaattcacattcttctaatccaagcaataacccaagcaaaacttcagatgcaccttatgattctgcagatgactggtctgagcatattagctcttctgggaaaaagtactactacaattgtcgaacagaagtttcacaatgggaaaaaccaaaagagtggcttgaaagagaacagagacaaaaagaagcaaacaagatggcagtcaacagcttcccaaaagatagggattacagaagagaggtgatgcaagcaacagccactagtgggtttgccagtggaatggaagacaagcattccagtgatgccagtagtttgctcccacagaatattttgtctcaaacaagcagacacaatgacagagactacagactgccaagagcagagactcacagtagttctacgccagtacagcaccccatcaaaccagtggttcatccaactgctaccccaagcactgttccttctagtccatttacgctacagtctgatcaccagccaaagaaatcatttgatgctaatggagcatctactttatcaaaactgcctacacccacatcttctgtccctgcacagaaaacagaaagaaaagaatctacatcaggagacaaacccgtatcacattcttgcacaactccttccacgtcttctgcctctggactgaaccccacatctgcacctccaacatctgcttcagcggtccctgtttctcctgttccacagtcgccaatacctcccttacttcaggacccaaatcttcttagacaattgcttcctgctttgcaagccacgctgcagcttaataattctaatgtggacatatctaaaataaatgaagttcttacagcagctgtgacacaagcctcactgcagtctataattcataagtttcttactgctggaccatctgctttcaacataacgtctctgatttctcaagctgctcagctctctacacaagatatccctcttcatgaaggtatccaaatggagagagatacacataggagcaaatgggaagtgaaagggtcactttgtcagaaagctgataaacagcaggaatgccttgtctggaatggaagtataatggtgcaaagactcttgcaaccctctggctagcctcatgagcaggagactgcgtgggatacctgggcctaaatgtagaataagaaagaagaaataaggatgcccagccatctaatcagtctccgatgtctttaacatctgatgcgtcatccccaagatcatatgtttctccaagaataagcacacctcaaactaacacagtccctatcaaacctttgatcagtactcctcctgtttcatcacagccaaaggttagtactccagtagttaagcaaggaccagtgtcacagtcagccacacagcagcctgtaactgctgacaagcagcaaggtcatgaacctgtctctcctcgaagtcttcagcgctcaagccagagaagtccatcacctggtcccaatcatacttctaatagtagtaatgcatcaaatgcaacagttgtaccacagaattcttctgcccgatccacgtgttcattaacgcctgcactagcagcacacttcagtgaaaatctcataaaacacgttcaaggatggcctgcagatcatgcagagaagcaggcatcaagattacgcgaagaagcgcataacatgggaactattcacatgtccgaaatttgtactgaattaaaaaatttaagatctttagtccgagtatgtgaaattcaagcaactttgcgagagcaaaggatactatttttgagacaacaaattaaggaacttgaaaagctaaaaaatcagaattccttcatggtgtgaagatgtgaataattgcacatggttttgagaacaggaactgtaaatctgttgcccaatcttaacatttttgagctgcatttaagtagactttggaccgttaagctgggcaaaggaaatgacaaggggacggggtctgtgagagtcaattcaggggaaagatacaagattgatttgtaaaacccttgaaatgtagatttcttgtagatgtatccttcacgttgtaaatatgttttgtagagtgaagccatgggaagccatgtgtaacagagcttagacatccaaaactaatcaatgctgaggtggctaaatacctagccttttacatgtaaacctgtctgcaaaattagctttttt

SEQ ID NO: 200359 - DNA, 3362 bp, Homo sapiens
  Payload ID: 19526
  Gene Name: WW domain containing E3 ubiquitin protein ligase 1
  Uniprot ID: Q9H0M0
  ENST ID: ENST00000265428
  CDS Start-End: 11-2779
attttgggacatggccactgcttcaccaaggtctgatactagtaataaccacagtggaaggttgcagttacaggtaactgtttctagtgccaaacttaaaagaaaaaagaactggttcggaacagcaatatatacagaagtagttgtagatggagaaattacgaaaacagcaaaatccagtagttcttctaatccaaaatgggatgaacagctaactgtaaatgttacgccacagactacattggaatttcaagtttggagccatcgcactttaaaagcagatgctttattaggaaaagcaacgatagatttgaaacaagctctgttgatacacaatagaaaattggaaagagtgaaagaacaattaaaactttccttggaaaacaagaatggcatagcacaaactggtgaattgacagttgtgcttgatggattggtgattgagcaagaaaatataacaaactgcagctcatctccaaccatagaaatacaggaaaatggtgatgccttacatgaaaatggagagccttcagcaaggacaactgccaggttggctgttgaaggcacgaatggaatagataatcatgtacctacaagcactctagtccaaaactcatgctgctcgtatgtagttaatggagacaacacaccttcatctccgtctcaggttgctgccagacccaaaaatacaccagctccaaaaccactcgcatctgagcctgccgatgacactgttaatggagaatcatcctcatttgcaccaactgataatgcgtctgtcacgggtactccagtagtgtctgaagaaaatgccttgtctccaaattgcactagtactactgttgaagatcctccagttcaagaaatactgacttcctcagaaaacaatgaatgtattccttctaccagtgcagaattggaatctgaagctagaagtatattagagcctgacacctctaattctagaagtagttctgcttttgaagcagccaaatcaagacagccagatgggtgtatggatcctgtacggcagcagtctgggaatgccaacacagaaaccttgccatcagggtgggaacaaagaaaagatcctcatggtagaacctattatgtggatcataatactcgaactaccacatgggagagaccacaacctttacctccaggttgggaaagaagagttgatgatcgtagaagagtttattatgtggatcataacaccagaacaacaacgtggcagcggcctaccatggaatctgtccgaaattttgaacagtggcaatctcagcggaaccaattgcagggagctatgcaacagtttaaccaacgatacctctattcggcttcaatgttagctgcagaaaatgacccttatggacctttgccaccaggctgggaaaaaagagtggattcaacagacagggtttactttgtgaatcataacacaaaaacaacccagtgggaagatccaagaactcaaggcttacagaatgaagaacccctgccagaaggctgggaaattagatatactcgtgaaggtgtaaggtactttgttgatcataacacaagaacaacaacattcaaagatcctcgcaatgggaagtcatctgtaactaaaggtggtccacaaattgcttatgaacgcggctttaggtggaagcttgctcacttccgttatttgtgccagtctaatgcactacctagtcatgtaaagatcaatgtgtcccggcagacattgtttgaagattccttccaacagattatggcattaaaaccctatgacttgaggaggcgcttatatgtaatatttagaggagaagaaggacttgattatggtggcctagcgagagaatggtttttcttgctttcacatgaagttttgaacccaatgtattgcttatttgagtatgcgggcaagaacaactattgtctgcagataaatccagcatcaaccattaatccagaccatctttcatacttctgtttcattggtcgttttattgccatggcactatttcatggaaagtttatcgatactggtttctctttaccattctacaagcgtatgttaagtaaaaaacttactattaaggatttggaatctattgatactgaattttataactcccttatctggataagagataacaacattgaagaatgtggcttagaaatgtacttttctgttgacatggagattttgggaaaagttacttcacatgacctgaagttgggaggttccaatattctggtgactgaggagaacaaagatgaatatattggtttaatgacagaatggcgtttttctcgaggagtacaagaacagaccaaagctttccttgatggttttaatgaagttgttcctcttcagtggctacagtacttcgatgaaaaagaattagaggttatgttgtgtggcatgcaggaggttgacttggcagattggcagagaaatactgtttatcgacattatacaagaaacagcaagcaaatcatttggttttggcagtttgtgaaagagacagacaatgaagtaagaatgcgactattgcagttcgtcactggaacctgccgtttacctctaggaggatttgctgagctcatgggaagtaatgggcctcaaaagttttgcattgaaaaagttggcaaagacacttggttaccaagaagccatacatgttttaatcgcttggatctaccaccatataagagttatgaacaactaaaggaaaaacttctttttgcaatagaagagacagagggatttggacaagaatgaatgtggcttcttattttggaggagctcttgcatttaaataccccagccaagaaaaattgcacagatagtgtatataagctgttcattctgtacagtgaattttccgaacctctcaaagtatgttttccgttcttccacagaaatatgcaaaacagttcatccttttctactttatttattgttcccttgaaatgactgaccaggaaaaagatcatccttaaattttgaagcaagtgagagactttattaaaaatacatatatatctatataaacatatatgatagtggctctagttttatagagctccaagtgtattaaacatgacagccattcattcataaagatctggatttgctttaccttgttaatattatctaggggaaaaagtgcaaattgctccatgttcttctctcccttatgtaacatctcctgagggtgtttagttgcatggctgttcagaaaggtattaagggcttaggccaaatcttactttgagtatgttaaaaaaaaaaaaatgctgctggcttttctgaagacaggtgcttgaacttgtcagtttgttttaaataaatacaatagttg

SEQ ID NO: 200360 - DNA, 4686 bp, Homo sapiens
  Payload ID: 19526
  Gene Name: WW domain containing E3 ubiquitin protein ligase 1
  Uniprot ID: Q9H0M0
  ENST ID: ENST00000517970
  CDS Start-End: 308-3076
ggcgagctccgcgtgcgggttccgagtggctgctggcggcctgggctgccggggccgacgcctgggtggctgctgccgccgcgcctgctgcgagatggcgatcttgggcgcggaagggtgagggcgcccgccgcaggaggaggtgccgctgccgtggccgcccggctgccgggagccgacagcttcgcgccggggttgtctcctcacagactatgagctccttgaaagagggaatcgtgtcttactcatctttgtatccccagtgtctagcagttcctgatacatagttttagctgaattttgggacatggccactgcttcaccaaggtctgatactagtaataaccacagtggaaggttgcagttacaggtaactgtttctagtgccaaacttaaaagaaaaaagaactggttcggaacagcaatatatacagaagtagttgtagatggagaaattacgaaaacagcaaaatccagtagttcttctaatccaaaatgggatgaacagctaactgtaaatgttacgccacagactacattggaatttcaagtttggagccatcgcactttaaaagcagatgctttattaggaaaagcaacgatagatttgaaacaagctctgttgatacacaatagaaaattggaaagagtgaaagaacaattaaaactttccttggaaaacaagaatggcatagcacaaactggtgaattgacagttgtgcttgatggattggtgattgagcaagaaaatataacaaactgcagctcatctccaaccatagaaatacaggaaaatggtgatgccttacatgaaaatggagagccttcagcaaggacaactgccaggttggctgttgaaggcacgaatggaatagataatcatgtacctacaagcactctagtccaaaactcatgctgctcgtatgtagttaatggagacaacacaccttcatctccgtctcaggttgctgccagacccaaaaatacaccagctccaaaaccactcgcatctgagcctgccgatgacactgttaatggagaatcatcctcatttgcaccaactgataatgcgtctgtcacgggtactccagtagtgtctgaagaaaatgccttgtctccaaattgcactagtactactgttgaagatcctccagttcaagaaatactgacttcctcagaaaacaatgaatgtattccttctaccagtgcagaattggaatctgaagctagaagtatattagagcctgacacctctaattctagaagtagttctgcttttgaagcagccaaatcaagacagccagatgggtgtatggatcctgtacggcagcagtctgggaatgccaacacagaaaccttgccatcagggtgggaacaaagaaaagatcctcatggtagaacctattatgtggatcataatactcgaactaccacatgggagagaccacaacctttacctccaggttgggaaagaagagttgatgatcgtagaagagtttattatgtggatcataacaccagaacaacaacgtggcagcggcctaccatggaatctgtccgaaattttgaacagtggcaatctcagcggaaccaattgcagggagctatgcaacagtttaaccaacgatacctctattcggcttcaatgttagctgcagaaaatgacccttatggacctttgccaccaggctgggaaaaaagagtggattcaacagacagggtttactttgtgaatcataacacaaaaacaacccagtgggaagatccaagaactcaaggcttacagaatgaagaacccctgccagaaggctgggaaattagatatactcgtgaaggtgtaaggtactttgttgatcataacacaagaacaacaacattcaaagatcctcgcaatgggaagtcatctgtaactaaaggtggtccacaaattgcttatgaacgcggctttaggtggaagcttgctcacttccgttatttgtgccagtctaatgcactacctagtcatgtaaagatcaatgtgtcccggcagacattgtttgaagattccttccaacagattatggcattaaaaccctatgacttgaggaggcgcttatatgtaatatttagaggagaagaaggacttgattatggtggcctagcgagagaatggtttttcttgctttcacatgaagttttgaacccaatgtattgcttatttgagtatgcgggcaagaacaactattgtctgcagataaatccagcatcaaccattaatccagaccatctttcatacttctgtttcattggtcgttttattgccatggcactatttcatggaaagtttatcgatactggtttctctttaccattctacaagcgtatgttaagtaaaaaacttactattaaggatttggaatctattgatactgaattttataactcccttatctggataagagataacaacattgaagaatgtggcttagaaatgtacttttctgttgacatggagattttgggaaaagttacttcacatgacctgaagttgggaggttccaatattctggtgactgaggagaacaaagatgaatatattggtttaatgacagaatggcgtttttctcgaggagtacaagaacagaccaaagctttccttgatggttttaatgaagttgttcctcttcagtggctacagtacttcgatgaaaaagaattagaggttatgttgtgtggcatgcaggaggttgacttggcagattggcagagaaatactgtttatcgacattatacaagaaacagcaagcaaatcatttggttttggcagtttgtgaaagagacagacaatgaagtaagaatgcgactattgcagttcgtcactggaacctgccgtttacctctaggaggatttgctgagctcatgggaagtaatgggcctcaaaagttttgcattgaaaaagttggcaaagacacttggttaccaagaagccatacatgttttaatcgcttggatctaccaccatataagagttatgaacaactaaaggaaaaacttctttttgcaatagaagagacagagggatttggacaagaatgaatgtggcttcttattttggaggagctcttgcatttaaataccccagccaagaaaaattgcacagatagtgtatataagctgttcattctgtacagtgaattttccgaacctctcaaagtatgttttccgttcttccacagaaatatgcaaaacagttcatccttttctactttatttattgttcccttgaaatgactgaccaggaaaaagatcatccttaaattttgaagcaagtgagagactttattaaaaatacatatatatctatataaacatatatgatagtggctctagttttatagagctccaagtgtattaaacatgacagccattcattcataaagatctggatttgctttaccttgttaatattatctaggggaaaaagtgcaaattgctccatgttcttctctcccttatgtaacatctcctgagggtgtttagttgcatggctgttcagaaaggtattaagggcttaggccaaatcttactttgagtatgttaaaaaaaaaaaaatgctgctggcttttctgaagacaggtgcttgaacttgtcagtttgttttaaataaatacaatagttgaaaatttttctctgttacatcagtaatattgttaaagtaatggatagaaccataacttacacatgaaagtcatatactagatccaatactatttagtttattatcgaaattggaaggattcattgagcagcatagaagtttgtttacatgttactttgagatgctaggtatttgtggaattaaaaagaatcaggctcttttgtactttgtttttaaatctgtgatgcttttcaaatttaattcataataaattgatgcaatttcatacttaggaacatacaaaaggtaatgtaaactctgccacttttttgtgttcaaaattttggtttttatgaagccagatggattgaagagttacataagcatttgaatgctctaatataaggctaatgattttctgttagtgtttgaatatcttcattcctctcaaattcataacagttctatttaactgaattaaataaccatatgaaaaatcttttgggtctccccctttttacacagataattatttttgtcataacactttttaattgtttttcatcataggggcctttgctgaactacaaaaatgtgtaacaaattaaaatctgatgtgaatgatattaatgctacttttagcaaactgggcttcctaatacaaaattttaaatttccatttgtatcatgcttttaatatgcactgtaaatttcattaacttaaacattttttaatagccatggaactgacttcttaaaatctgttgcctataaatatttcactgctaagtacatacagaaaaacagtaattattgttttgccaaaattttatttttctacatattgagagtgtgttctccattttattcagaattcatagtaaagacgaaagaaaggcagagatctgcttggttgaatagactccttttccaaatccttattatgaacactctggtaattttcaagcctaaagaattaaaaaaaaaattctaatgtatgtgacaggttatgtgatagagggaaactggccttcaaaaaggactgcgt

SEQ ID NO: 200361 - DNA, 696 bp, Homo sapiens
  Payload ID: 19526
  Gene Name: WW domain containing E3 ubiquitin protein ligase 1
  ENST ID: ENST00000520453
  CDS Start-End: 1-696
aggtggtccacaaattgcttatgaacgcggctttaggtggaagcttgctcacttccgttatttgtgccagtctaatgcactacctagtcatgtaaagatcaatgtgtcccggcagacattgtttgaagattccttccaacagattatggcattaaaaccctatgacttgaggaggcgcttatatgtaatatttagaggagaagaaggacttgattatggtggcctagcgaggaatatattaagatcttccttaatgtcagggaagttttcttctattatgtctttgaatattttttctgttccatttgttccatttttcttcaggaacatcagtcatggagaatggtttttcttgctttcacatgaagttttgaacccaatgtattgcttatttgagtatgcgggcaagaacaactattgtctgcagataaatccagcatcaaccattaatccagaccatctttcatacttctgtttcattggtcgttttattgccatggcactatttcatggaaagtttatcgatactggtttctctttaccattctacaagcgtatgttaagtaaaaaacttactattaaggatttggaatctattgatactgaattttataactcccttatctggataagagataacaacattgaagaatgtggcttagaaatgtacttttctgttgacatggagattttggg

SEQ ID NO: 200362 - DNA, 513 bp, Homo sapiens
  Payload ID: 19526
  Gene Name: WW domain containing E3 ubiquitin protein ligase 1
  ENST ID: ENST00000520798
  CDS Start-End: 1-168
gtgaaagagacagacaatgaagtaagaatgcgactattgcagttcgtcactggaacctgccgtttacctctaggaggatttgctgagctcatgggaagtaatgggcctcaaaagttttgcattgaaaaagttggcaaagacacttggttaccaagaagccatacatgaggttttgccacgttgcccaggctggtctcaaactcccaggctcaactgatccaccaaccttggccttccaaaatgctggcattacaggcatgagccaccgtgtccagcaaatgggcattattttaataataccattataaaatattggtgcattattttaataatatttctcaactgtgtgtaaagaatacaactaagtattttttacatcaatttctacactatagcttcccagaaagaaaaaaaagctccttgttataatgtaaataatacaagtacagctttttcgattgcctgttttcttactctgaaaagcttgtgatgagtaaacccaaagtttaacca

SEQ ID NO: 200363 - DNA, 4227 bp, Homo sapiens
  Payload ID: 19527
  Gene Name: WW domain containing E3 ubiquitin protein ligase 2
  Uniprot ID: O00308
  ENST ID: ENST00000356003
  CDS Start-End: 162-2426
attttatagaaacgtttagtactcaccaaggccctcagtggaactggctgaaaatagcagcagactcactcagaaaagaattggagagatccatggcagggaagagagattaagggaaggtagagcgcttaggagagcttgaaaacccaaaggtggagaacatgcagctgaccctgaacctgcagacggagaacaaaggcagcgttgtctcaggcggagagctgacaattttcctggacgggccaactgttgatctgggaaatgtgcctaatggcagtgccctgacagatggatcacagctgccttcgagagactccagtggaacagcagtagctccagagaaccggcaccagccccccagcacaaactgctttggtggaagatcccggacgcacagacattcgggtgcttcagccagaacaaccccagcaaccggcgagcaaagccccggtgctcggagccggcaccgccagcccgtcaagaactcaggccacagtggcttggccaatggcacagtgaatgatgaacccacaacagccactgatcccgaagaaccttccgttgttggtgtgacgtccccacctgctgcacccttgagtgtgaccccgaatcccaacacgacttctctccctgccccagccacaccggctgaaggagaggaacccagcacttcgggtacacagcagctcccagcggctgcccaggcccccgacgctctgcctgctggatgggaacagcgagagctgcccaacggacgtgtctattatgttgaccacaataccaagaccaccacctgggagcggccccttcctccaggctgggaaaaacgcacagatccccgaggcaggttttactatgtggatcacaatactcggaccaccacctggcagcgtccgaccgcggagtacgtgcgcaactatgagcagtggcagtcgcagcggaatcagctccagggggccatgcagcacttcagccaaagattcctctaccagtcttcgagtgcttcgactgaccatgatcccctgggccccctccctcctggctgggagaagagacaggacaatggacgggtgtattacgtgaaccataacactcgcacgacccagtgggaggatccccggacccaggggatgatccaggaaccagctctgcccccaggatgggagatgaaatacaccagcgagggggtgcgatactttgtggaccacaatacccgcaccaccacctttaaggatcctcgcccggggtttgagtcggggacgaagcaaggttcccctggtgcttatgaccgcagttttcggtggaagtatcaccagttccgtttcctctgccattcaaatgccctacctagccacgtgaagatcagcgtttccaggcagacgcttttcgaagattccttccaacagatcatgaacatgaaaccctatgacctgcgccgccggctctacatcatcatgcgtggcgaggagggcctggactatgggggcatcgccagagagtggtttttcctcctgtctcatgaggtgctcaaccctatgtattgtttatttgaatatgccggaaagaacaattactgcctgcagatcaaccccgcctcctccatcaacccggaccacctcacctactttcgctttataggcagattcatcgccatggcgctgtaccatggaaagttcatcgacacgggcttcaccctccctttctacaagcggatgctcaataagagaccaaccctgaaagacctggagtccattgaccctgagttctacaactccattgtctggatcaaagagaacaacctggaagaatgtggcctggagctgtacttcatccaggacatggagatactgggcaaggtgacgacccacgagctgaaggagggcggcgagagcatccgggtcacagaggagaacaaggaagagtacatcatgctgctgactgactggcgtttcacccgaggcgtggaagagcagaccaaagccttcctggatggcttcaacgaggtggccccgctggagtggctgcgctactttgacgagaaagagctggagctgatgctgtgcggcatgcaggagatagacatgagcgactggcagaagagcaccatctaccggcactacaccaagaacagcaagcagatccagtggttctggcaggtggtgaaggagatggacaacgagaagaggatccggctgctgcagtttgtcaccggtacctgccgcctgcccgtcgggggatttgccgaactcatcggtagcaacggaccacagaagttttgcattgacaaagttggcaaggaaacctggctgcccagaagccacacctgcttcaaccgtctggatcttccaccctacaagagctacgaacagctgagagagaagctgctgtatgccattgaggagaccgagggctttggacaggagtaaccgaggccgcccctcccacgccccccagcgcacatgtagtcctgagtcctccctgcctgagaggccactggccccgcagcccttgggaggcccccgtggatgtggccctgtgtgggaccacactgtcatctcgctgctggcagaaaagcctgatcccaggaggccctgcagttcccccgacccgcggatggcagtctggaataaagccccctagttgcctttggccccacctttgcaaagttccagagggctgaccctctctgcaaaactctcccctgtcctctagaccccaccctgggtgtatgtgagtgtgcaagggaaggtgttgcatccccaggggctgccgcagaggccggagacctcctggactagttcggcgaggagactggccactgggggtggctgttcgggactgagagcgccaagggtctttgccagcaaaggaggttctgcctgtaattgagcctctctgatgatggagatgaagtgaaggtctgagggagcgggccctggggcgaggccatctctgcctgcctccctagcaggcgccagcggtggaggctgagtcgcaggacacatgccggccagttaattcattctcagccaatgaaggtttgtctaagctgcctgggtatccacgggacaaaaacagcaaactccctcagactttgtccatgtataaacttgaagtggttgtgttgtagggttgcaggttttttgttacgctgctgtcactttctgtccaggagctggcaccccaggtgttctgagaccttgagggacccagacctttgggtccaagagtttcccaaacagccacgcctctcaggaacccacctggcggttccgtgagctcaggcaggcctgacccggcggcacagcctggcagggacctcgtccccaagcctggcagaatgagaggggttgaggtcccgagcgccactcctagccttgccgccttcaatagagaagaaatccctttgctagatagggtcccccaggcagtccccagtggcgggacacaggggtccggctgtggagctcccctgccagcccctggagctccaggagggcctgttggtcccctgttcagaatggagtgcagcccgccagcggaaagtgttcattctgcataggtgtgaggctttatctgcacacaggacatgaaaaccagcagaaaggccctgagctgctgcatagccccatctgatttctgcagttcccgccagcctccaacacggggactctgccgtaactggaatcttcataggtcatattgaaatcttcaaggtgaccatgccccaccggggtgctggggcagtagtcatggcagactcccggcctgggcccccaggattctaggacccccaggcagccccttggactggtcccgggtgccttccaagcacagtctccatgctcccagattctcgaccttcccccggcccgggaggtgcagcctgcgtctgcctctgtcgtgtgtgctgatttgagtggcttagcttgccacagcgcagcctcttctgtccctttcagtcatttgctgtacttccctgtggcacgttaccatggaagccgctccagggtgggtcagggtgcaagctgctggtgaggtttggaagcatcaggctcacgggtgttcatgtgtgttcgtgcgtgtgtgtgcgtacgtgtatataactgaagtgtctgtacggaatgccctttgctagccatgggctggtcaccagattgttttgtaatgcccgccccttgcctcgatattgccagtttcttgtgcaataaacaatcagcagctgtg

SEQ ID NO: 200364 - DNA, 4515 bp, Homo sapiens
  Payload ID: 19527
  Gene Name: WW domain containing E3 ubiquitin protein ligase 2
  Uniprot ID: O00308
  ENST ID: ENST00000359154
  CDS Start-End: 102-2714
gcgcggtcacgtgacccggcccgagtgcgggcggtggaaggcggaagtaggagaggagttcggcgccgcttctgtggccacggcagcttcacggtgatgatatggcatctgccagctctagccgggcaggagtggccctgccttttgagaagtctcagctcactttgaaagtggtgtccgcaaagcccaaggtgcataatcgtcaacctcgaattaactcctacgtggaggtggcggtggatggactccccagtgagaccaagaagactgggaagcgcattgggagctctgagcttctctggaatgagatcatcattttgaatgtcacggcacagagtcatttagatttaaaggtctggagctgccataccttgagaaatgaactgctaggcaccgcatctgtcaacctctccaacgtcttgaagaacaatgggggcaaaatggagaacatgcagctgaccctgaacctgcagacggagaacaaaggcagcgttgtctcaggcggagagctgacaattttcctggacgggccaactgttgatctgggaaatgtgcctaatggcagtgccctgacagatggatcacagctgccttcgagagactccagtggaacagcagtagctccagagaaccggcaccagccccccagcacaaactgctttggtggaagatcccggacgcacagacattcgggtgcttcagccagaacaaccccagcaaccggcgagcaaagccccggtgctcggagccggcaccgccagcccgtcaagaactcaggccacagtggcttggccaatggcacagtgaatgatgaacccacaacagccactgatcccgaagaaccttccgttgttggtgtgacgtccccacctgctgcacccttgagtgtgaccccgaatcccaacacgacttctctccctgccccagccacaccggctgaaggagaggaacccagcacttcgggtacacagcagctcccagcggctgcccaggcccccgacgctctgcctgctggatgggaacagcgagagctgcccaacggacgtgtctattatgttgaccacaataccaagaccaccacctgggagcggccccttcctccaggctgggaaaaacgcacagatccccgaggcaggttttactatgtggatcacaatactcggaccaccacctggcagcgtccgaccgcggagtacgtgcgcaactatgagcagtggcagtcgcagcggaatcagctccagggggccatgcagcacttcagccaaagattcctctaccagtcttcgagtgcttcgactgaccatgatcccctgggccccctccctcctggctgggagaagagacaggacaatggacgggtgtattacgtgaaccataacactcgcacgacccagtgggaggatccccggacccaggggatgatccaggaaccagctctgcccccaggatgggagatgaaatacaccagcgagggggtgcgatactttgtggaccacaatacccgcaccaccacctttaaggatcctcgcccggggtttgagtcggggacgaagcaaggttcccctggtgcttatgaccgcagttttcggtggaagtatcaccagttccgtttcctctgccattcaaatgccctacctagccacgtgaagatcagcgtttccaggcagacgcttttcgaagattccttccaacagatcatgaacatgaaaccctatgacctgcgccgccggctctacatcatcatgcgtggcgaggagggcctggactatgggggcatcgccagagagtggtttttcctcctgtctcatgaggtgctcaaccctatgtattgtttatttgaatatgccggaaagaacaattactgcctgcagatcaaccccgcctcctccatcaacccggaccacctcacctactttcgctttataggcagattcatcgccatggcgctgtaccatggaaagttcatcgacacgggcttcaccctccctttctacaagcggatgctcaataagagaccaaccctgaaagacctggagtccattgaccctgagttctacaactccattgtctggatcaaagagaacaacctggaagaatgtggcctggagctgtacttcatccaggacatggagatactgggcaaggtgacgacccacgagctgaaggagggcggcgagagcatccgggtcacagaggagaacaaggaagagtacatcatgctgctgactgactggcgtttcacccgaggcgtggaagagcagaccaaagccttcctggatggcttcaacgaggtggccccgctggagtggctgcgctactttgacgagaaagagctggagctgatgctgtgcggcatgcaggagatagacatgagcgactggcagaagagcaccatctaccggcactacaccaagaacagcaagcagatccagtggttctggcaggtggtgaaggagatggacaacgagaagaggatccggctgctgcagtttgtcaccggtacctgccgcctgcccgtcgggggatttgccgaactcatcggtagcaacggaccacagaagttttgcattgacaaagttggcaaggaaacctggctgcccagaagccacacctgcttcaaccgtctggatcttccaccctacaagagctacgaacagctgagagagaagctgctgtatgccattgaggagaccgagggctttggacaggagtaaccgaggccgcccctcccacgccccccagcgcacatgtagtcctgagtcctccctgcctgagaggccactggccccgcagcccttgggaggcccccgtggatgtggccctgtgtgggaccacactgtcatctcgctgctggcagaaaagcctgatcccaggaggccctgcagttcccccgacccgcggatggcagtctggaataaagccccctagttgcctttggccccacctttgcaaagttccagagggctgaccctctctgcaaaactctcccctgtcctctagaccccaccctgggtgtatgtgagtgtgcaagggaaggtgttgcatccccaggggctgccgcagaggccggagacctcctggactagttcggcgaggagactggccactgggggtggctgttcgggactgagagcgccaagggtctttgccagcaaaggaggttctgcctgtaattgagcctctctgatgatggagatgaagtgaaggtctgagggagcgggccctggggcgaggccatctctgcctgcctccctagcaggcgccagcggtggaggctgagtcgcaggacacatgccggccagttaattcattctcagccaatgaaggtttgtctaagctgcctgggtatccacgggacaaaaacagcaaactccctcagactttgtccatgtataaacttgaagtggttgtgttgtagggttgcaggttttttgttacgctgctgtcactttctgtccaggagctggcaccccaggtgttctgagaccttgagggacccagacctttgggtccaagagtttcccaaacagccacgcctctcaggaacccacctggcggttccgtgagctcaggcaggcctgacccggcggcacagcctggcagggacctcgtccccaagcctggcagaatgagaggggttgaggtcccgagcgccactcctagccttgccgccttcaatagagaagaaatccctttgctagatagggtcccccaggcagtccccagtggcgggacacaggggtccggctgtggagctcccctgccagcccctggagctccaggagggcctgttggtcccctgttcagaatggagtgcagcccgccagcggaaagtgttcattctgcataggtgtgaggctttatctgcacacaggacatgaaaaccagcagaaaggccctgagctgctgcatagccccatctgatttctgcagttcccgccagcctccaacacggggactctgccgtaactggaatcttcataggtcatattgaaatcttcaaggtgaccatgccccaccggggtgctggggcagtagtcatggcagactcccggcctgggcccccaggattctaggacccccaggcagccccttggactggtcccgggtgccttccaagcacagtctccatgctcccagattctcgaccttcccccggcccgggaggtgcagcctgcgtctgcctctgtcgtgtgtgctgatttgagtggcttagcttgccacagcgcagcctcttctgtccctttcagtcatttgctgtacttccctgtggcacgttaccatggaagccgctccagggtgggtcagggtgcaagctgctggtgaggtttggaagcatcaggctcacgggtgttcatgtgtgttcgtgcgtgtgtgtgcgtacgtgtatataactgaagtgtctgtacggaatgccctttgctagccatgggctggtcaccagattgttttgtaatgcccgccccttgcctcgatattgccagtttcttgtgcaataaacaatcagcagctgtg

SEQ ID NO: 200365 - DNA, 2474 bp, Homo sapiens
  Payload ID: 19527
  Gene Name: WW domain containing E3 ubiquitin protein ligase 2
  Uniprot ID: O00308
  ENST ID: ENST00000569174
  CDS Start-End: 71-1078
agatgaaacagaaaggctaaagagggctggagtcaggggacttctcttccaccagcttcacggtgatgatatggcatctgccagctctagccgggcaggagtggccctgccttttgagaagtctcagctcactttgaaagtggtgtccgcaaagcccaaggtgcataatcgtcaacctcgaattaactcctacgtggaggtggcggtggatggactccccagtgagaccaagaagactgggaagcgcattgggagctctgagcttctctggaatgagatcatcattttgaatgtcacggcacagagtcatttagatttaaaggtctggagctgccataccttgagaaatgaactgctaggcaccgcatctgtcaacctctccaacgtcttgaagaacaatgggggcaaaatggagaacatgcagctgaccctgaacctgcagacggagaacaaaggcagcgttgtctcaggcggagagctgacaattttcctggacgggccaactgttgatctgggaaatgtgcctaatggcagtgccctgacagatggatcacagctgccttcgagagactccagtggaacagcagtagctccagagaaccggcaccagccccccagcacaaactgctttggtggaagatcccggacgcacagacattcgggtgcttcagccagaacaaccccagcaaccggcgagcaaagccccggtgctcggagccggcaccgccagcccgtcaagaactcaggccacagtggcttggccaatggcacagtgaatgatgaacccacaacagccactgatcccgaagaaccttccgttgttggtgtgacgtccccacctgctgcacccttgagtgtgaccccgaatcccaacacgacttctctccctgccccagccacaccggctgaaggagaggaacccagcacttcgggtacacagcagctcccagcggctgcccaggcccccgacgctctgcctgctggatgggaacagcgagagctgcccaacggacgtgtctattatgttgaccacaataccaagaccaccacctgggagcggccccttcctccagggtaggtcatcaactgagaagacctgagactctggaactgacaccatgagtcacccaatggcttcttgaaacggtccctttctgcggaggtagcatagcacagtgacgtttattccgggtcacttgattgcttttcctatccacttaccttaatattgctcccatgtcttaggacatattagaattattagaagatctctgggaaacaaaaggcgcatgggaggccaagatttagagtgttgatgcattccgccgtaccctatgcccagcctgtccctaaaggcagagtgcttcttattcggcagggcttcgtgagaatgccgccaagttatccaaaaccaaaggatgagagaggcttccaagagagggaagactgtccaagttcaaggagaaggggtttggttccctgtctgccagggacagaaagttctttccacatgtgtctcctggtcccgagagctttcaaaaggggatgtattctgctccaagaaagaatcacctcccagtaaagtagccatgaagggctcctgtataaaatatgcacacttcccctgccctgagtttgtggagggaaaggctgtcggaagtagggactcttaggagagcccgtgtgccctgtttggttcagctgtcaggcgtgtgccacacacatcccacctcatcttctggtcccataattctccatggatgggctgcttttagctccagttttccagtagaatgcttgagttttccttttttccgtacctcctggaggatgaaactcataacctgtcatcatcagtactcactgtgttttccactttgacttgaagtcaaatgaagttaccaaagttaaacatggacttctcaaattagaaaaaaacaaacaacaaaaaaacaggttaagtgttttgttatgaaaattatgaaaatgttcttattattatggaaaatttcaaatagatatagagagaataatgttacaaacccccacatactcaacatttagcttcaaaaattatcaactcatggcgggttttgtttcatctgtacaaactagtcggcacactatgatggcctgtggacaaaatccggccctctgactgtttttgtaaataaggttttattggaacacagccacacatatttgttgacttattgtttttggctgtttttgtacttcattggcagagttgagtaattgcagcagactctatggcttgcaaaacctaaaataattactttgtgtagcgctttatagaaaaaatttgctaactcccgatctgtaacccccaacctatccgccgcaccctgatctaggtaattttgaagcaaatcccaaatgtcacatcatctatccatatttcactatgtatttctaaaacatattcttttattcaaaataaaactctaatatca

SEQ ID NO: 200366 - DNA, 561 bp, Homo sapiens
  Payload ID: 19527
  Gene Name: WW domain containing E3 ubiquitin protein ligase 2
  ENST ID: ENST00000563659
  CDS Start-End: 377-561
agttcggcgccgcttctgtggccacggcaggtgctgtggcttacgtttataatcccatcactttgggaggccaaggcaggaggatggcttgagcctaggagttcaagaccagtctggacaacttggtttgatgaagagtggacaatcgtggagaaatacgattggacaaaaggggtatgattgactgatgaaacagaaaggctaaagagggctggagtcaggggacttctcttccaccagatggagtctcactctctcccccaggctggggtgcagcggcgtgatctcagctcactccaacctctgcttcccaggttcaagcgattcttctgcctcagcctccggatacctgggattacagcttcacggtgatgatatggcatctgccagctctagccgggcaggagtggccctgccttttgagaagtctcagctcactttgaaagtggtgtccgcaaagcccaaggtgcataatcgtcaacctcgaattaactcctacgtggaggtggcggtggatggactccccagtgagaccaagaagactgggaagcgcattgggag

SEQ ID NO: 200367 - DNA, 3672 bp, Homo sapiens
  Payload ID: 19527
  Gene Name: WW domain containing E3 ubiquitin protein ligase 2
  Uniprot ID: O00308
  ENST ID: ENST00000568684
  CDS Start-End: 579-1874
cccctcctgcgtgtggttcttggagaaagttggaggtggtggtgatttcagtcgccttggccgccttgagccggagctgagcggaggcactgggccgagcctgcttcccgggccttcctaccatgccagggctgctccctgcctccgccaccctggcacaccttcacccgcgtaccgcctcctccccgtcgctctgccttttccaaaactcacttgggccctccgtgcgcagggttcttttttggtttttctgtaaaaatcaaaacaaaaaacagagacttttgagaggagcagatgccacctaaagtcccactgcattccctgcaaagcgctcaaatgtggaagccagtcattggcatttttattttttattgattgattgattttttcaccagtggctttttgtaacctctgtgttctgctgtgtttcttgtgtttagtcttcgagtgcttcgactgaccatgatcccctgggccccctccctcctggctgggagaagagacaggacaatggacgggtgtattacgtgaaccataacactcgcacgacccagtgggaggatccccggacccaggggatgatccaggaaccagctctgcccccaggatgggagatgaaatacaccagcgagggggtgcgatactttgtggaccacaatacccgcaccaccacctttaaggatcctcgcccggggtttgagtcggggacgaagcaaggttcccctggtgcttatgaccgcagttttcggtggaagtatcaccagttccgtttcctctgccattcaaatgccctacctagccacgtgaagatcagcgtttccaggcagacgcttttcgaagattccttccaacagatcatgaacatgaaaccctatgacctgcgccgccggctctacatcatcatgcgtggcgaggagggcctggactatgggggcatcgccagagagtggtttttcctcctgtctcatgaggtgctcaaccctatgtattgtttatttgaatatgccggaaagaacaattactgcctgcagatcaaccccgcctcctccatcaacccggaccacctcacctactttcgctttataggcagattcatcgccatggcgctgtaccatggaaagttcatcgacacgggcttcaccctccctttctacaagcggatgctcaataagagaccaaccctgaaagacctggagtccattgaccctgagttctacaactccattgtctggatcaaagagaacaacctggaagaatgtggcctggagctgtacttcatccaggacatggagatactgggcaaggtgacgacccacgagctgaaggagggcggcgagagcatccgggtcacagaggagaacaaggaagagtacatcatgctgctgactgactggcgtttcacccgaggcgtggaagagcagaccaaagccttcctggatggcttcaacgaggtggccccgctggagtggctgcgctactttgacgagaaagagctggagctgatgctgtgcggcatgcaggagatagacatgagcgactggcagaagagcaccatctaccggcactacaccaagaacagcaagcagatccagtggttctggcaggtggtgaaggagatggacaacgagaagaggatccggctgctgcagtttgtcaccggtacctgccgcctgcccgtcgggggatttgccgaactcatcggtagcaacggaccacagaagttttgcattgacaaagttggcaaggaaacctggctgcccagaagccacacctgcttcaaccgtctggatcttccaccctacaagagctacgaacagctgagagagaagctgctgtatgccattgaggagaccgagggctttggacaggagtaaccgaggccgcccctcccacgccccccagcgcacatgtagtcctgagtcctccctgcctgagaggccactggccccgcagcccttgggaggcccccgtggatgtggccctgtgtgggaccacactgtcatctcgctgctggcagaaaagcctgatcccaggaggccctgcagttcccccgacccgcggatggcagtctggaataaagccccctagttgcctttggccccacctttgcaaagttccagagggctgaccctctctgcaaaactctcccctgtcctctagaccccaccctgggtgtatgtgagtgtgcaagggaaggtgttgcatccccaggggctgccgcagaggccggagacctcctggactagttcggcgaggagactggccactgggggtggctgttcgggactgagagcgccaagggtctttgccagcaaaggaggttctgcctgtaattgagcctctctgatgatggagatgaagtgaaggtctgagggagcgggccctggggcgaggccatctctgcctgcctccctagcaggcgccagcggtggaggctgagtcgcaggacacatgccggccagttaattcattctcagccaatgaaggtttgtctaagctgcctgggtatccacgggacaaaaacagcaaactccctcagactttgtccatgtataaacttgaagtggttgtgttgtagggttgcaggttttttgttacgctgctgtcactttctgtccaggagctggcaccccaggtgttctgagaccttgagggacccagacctttgggtccaagagtttcccaaacagccacgcctctcaggaacccacctggcggttccgtgagctcaggcaggcctgacccggcggcacagcctggcagggacctcgtccccaagcctggcagaatgagaggggttgaggtcccgagcgccactcctagccttgccgccttcaatagagaagaaatccctttgctagatagggtcccccaggcagtccccagtggcgggacacaggggtccggctgtggagctcccctgccagcccctggagctccaggagggcctgttggtcccctgttcagaatggagtgcagcccgccagcggaaagtgttcattctgcataggtgtgaggctttatctgcacacaggacatgaaaaccagcagaaaggccctgagctgctgcatagccccatctgatttctgcagttcccgccagcctccaacacggggactctgccgtaactggaatcttcataggtcatattgaaatcttcaaggtgaccatgccccaccggggtgctggggcagtagtcatggcagactcccggcctgggcccccaggattctaggacccccaggcagccccttggactggtcccgggtgccttccaagcacagtctccatgctcccagattctcgaccttcccccggcccgggaggtgcagcctgcgtctgcctctgtcgtgtgtgctgatttgagtggcttagcttgccacagcgcagcctcttctgtccctttcagtcatttgctgtacttccctgtggcacgttaccatggaagccgctccagggtgggtcagggtgcaagctgctggtgaggtttggaagcatcaggctcacgggtgttcatgtgtgttcgtgcgtgtgtgtgcgtacgtgtatataactgaagtgtctgtacggaatgccctttgctagccatgggctggtcaccagattgttttgtaatgcccgccccttgcctcgatattgccagtttcttgtgcaataaacaatcagcagct

SEQ ID NO: 200368 - DNA, 574 bp, Homo sapiens
  Payload ID: 19527
  Gene Name: WW domain containing E3 ubiquitin protein ligase 2
  ENST ID: ENST00000561780
  CDS Start-End: 254-574
gagtgcgggcggtggaaggcggaagtaggagaggagttcggcgccgcttctgtggccacggcagatgaaacagaaaggctaaagagggctggagtcaggggacttctcttccaccagatggagtctcactctctcccccaggctggggtgcagcggcgtgatctcagctcactccaacctctgcttcccaggttcaagcgattcttctgcctcagcctccggatacctgggattacagcttcacggtgatgatatggcatctgccagctctagccgggcaggagtggccctgccttttgagaagtctcagctcactttgaaagtggtgtccgcaaagcccaaggtgcataatcgtcaacctcgaattaactcctacgtggaggtggcggtggatggactccccagtgagaccaagaagactgggaagcgcattgggagctctgagcttctctggaatgagatcatcattttgaatgtcacggcacagagtcatttagatttaaaggtctggagctgccataccttgagaaatgaactgctaggcaccgcatctgtcaacctctccaacgtcttg

SEQ ID NO: 200369 - DNA, 738 bp, Homo sapiens
  Payload ID: 19527
  Gene Name: WW domain containing E3 ubiquitin protein ligase 2
  ENST ID: ENST00000569620
  CDS Start-End: 254-604
gagtgcgggcggtggaaggcggaagtaggagaggagttcggcgccgcttctgtggccacggcagatgaaacagaaaggctaaagagggctggagtcaggggacttctcttccaccagatggagtctcactctctcccccaggctggggtgcagcggcgtgatctcagctcactccaacctctgcttcccaggttcaagcgattcttctgcctcagcctccggatacctgggattacagcttcacggtgatgatatggcatctgccagctctagccgggcaggagtggccctgccttttgagaagtctcagctcactttgaaagtggtgtccgcaaagcccaaggtgcataatcgtcaacctcgaattaactcctacgtggaggtggcggtggatggactccccagtgagaccaagaagactgggaagcgcattgggagctctgagcttctctggaatgagatcatcattttgaatgtcacggcacagagtcatttagatttaaaggtctggagctgccataccttgagaaatgaactgctaggcaccgcatctgtcaacctctccaacgtcttgaagaacaatgggggcaaaagtaccttttaaaaaattaaaatatgctacggcttgagagatttaccaagacggatgaaatctttgtatcttgttttaagaggatccacagctggttcccgagactccttctggggtaccttgttactggagaacatgcagctgac

SEQ ID NO: 200370 - DNA, 710 bp, Homo sapiens
  Payload ID: 19528
  Gene Name: WW domain containing oxidoreductase
  Uniprot ID: Q9NZC7
  ENST ID: ENST00000355860
  CDS Start-End: 101-670
gccccgacgcgcgcgggtctcgtttggagcgggagtgagttcctgagcgagtggacccggcagcgggcgataggggggccaggtgcctccacagtcagccatggcagcgctgcgctacgcggggctggacgacacggacagtgaggacgagctgcctccgggctgggaggagagaaccaccaaggacggctgggtttactacgccaatcacaccgaggagaagactcagtgggaacatccaaaaactggaaaaagaaaacgagtggcaggagatttgccatacggatgggaacaagaaactgatgagaacggacaagtgttttttgttgaccatataaataaaagaaccacctacttggacccaagactggcgtttactgtggatgataatccgaccaagccaaccacccggcaaagatacgacggcagcaccactgccatggaaattctccagggccgggatttcactggcaaagtggttgtggtcactggagctaattcaggaatagggttcgaaaccgccaagtcttttgccctccatggtgcacatgtgatcttggcctgcaggaacatggcaagggcgagtgaagcagtgtcacgcattttagaagaatggaaaacaaaataccaccctccgccagaaaagtgcagaataaaaattttccactagcaaaagaaggaaaaaataaaagatcttgaatagtctcatc

SEQ ID NO: 200371 - DNA, 1594 bp, Homo sapiens
  Payload ID: 19528
  Gene Name: WW domain containing oxidoreductase
  Uniprot ID: Q9NZC7
  ENST ID: ENST00000402655
  CDS Start-End: 126-1061
gcagtgcgcaggcgtgagcggtcgggccccgacgcgcgcgggtctcgtttggagcgggagtgagttcctgagcgagtggacccggcagcgggcgataggggggccaggtgcctccacagtcagccatggcagcgctgcgctacgcggggctggacgacacggacagtgaggacgagctgcctccgggctgggaggagagaaccaccaaggacggctgggtttactacgccaatcacaccgaggagaagactcagtgggaacatccaaaaactggaaaaagaaaacgagtggcaggagatttgccatacggatgggaacaagaaactgatgagaacggacaagtgttttttgttgaccatataaataaaagaaccacctacttggacccaagactggcgtttactgtggatgataatccgaccaagccaaccacccggcaaagatacgacggcagcaccactgccatggaaattctccagggccgggatttcactggcaaagtggttgtggtcactggagctaattcaggaatagcaacagggagctgccaccaccgtgtactgtgctgctgtcccagaactggagggtctgggagggatgtacttcaacaactgctgccgctgcatgccctcaccagaagctcagagcgaagagacggcccggaccctgtgggcgctcagcgagaggctgatccaagaacggcttggcagccagtccggctaagtggagctcagagcggatgggcacacacacccgccctgtgtgtgtcccctcacgcaagtgccagggctgggccccttccaaatgtccctccaacacagatccgcaagagtaaaggaaataagagcagtcacaacagagtgaaaaatcttaagtaccaatgggaagcagggaattcctggggtaaagtatcacttttctggggctgggctaggcataggtctctttgctttctggtggtggcctgtttgaaagtaaaaacctgcttggtgtgtaggttccgtatctccctggagaagcaccagcaattctctttcttttactgttatagaatagcctgaggtcccctcgtcccatccagctaccaccacggccaccactgcagccgggggctggccttctcctacttagggaagaaaaagcaagtgttcactgctccttgctgcattgatccaggagataattgtttcattcatcctgaccaagactgagccagcttagcaactgctggggagacaaatctcagaaccttgtcccagccagtgaggatgacagtgacacccagagggagtagaatacgcagaactaccaggtggcaaagtacttgtcatagactcctttgctaatgctatgcaaaaaattctttagagattataacaaatttttcaaatcattccttagataccttgaaaggcaggaagggaagcgtatatacttaagaatacacaggatattttggggggcagagaataaaacgttagttaatccctttgtctgtcaatcacagtctcagttctcttgctttcacattgtacttaaacctcctgctgtgcctcgcatcctatgcttaataaaagaacatgcttgaatatca

SEQ ID NO: 200372 - DNA, 1701 bp, Homo sapiens
  Payload ID: 19528
  Gene Name: WW domain containing oxidoreductase
  Uniprot ID: Q9NZC7
  ENST ID: ENST00000406884
  CDS Start-End: 126-830
gcagtgcgcaggcgtgagcggtcgggccccgacgcgcgcgggtctcgtttggagcgggagtgagttcctgagcgagtggacccggcagcgggcgataggggggccaggtgcctccacagtcagccatggcagcgctgcgctacgcggggctggacgacacggacagtgaggacgagctgcctccgggctgggaggagagaaccaccaaggacggctgggtttactacgccaatcacaccgaggagaagactcagtgggaacatccaaaaactggaaaaagaaaacgagtggcaggagatttgccatacggatgggaacaagaaactgatgagaacggacaagtgttttttgttgaccatataaataaaagaaccacctacttggacccaagactggcgtttactgtggatgataatccgaccaagccaaccacccggcaaagatacgacggcagcaccactgccatggaaattctccagggccgggatttcactggcaaagtggttgtggtcactggagctaattcaggaatagggttcgaaaccgccaagtcttttgccctccatggtgcacatgtgatcttggcctgcaggaacatggcaagggcgagtgaagcagtgtcacgcattttagaagaatggcaacagggagctgccaccaccgtgtactgtgctgctgtcccagaactggagggtctgggagggatgtacttcaacaactgctgccgctgcatgccctcaccagaagctcagagcgaagagacggcccggaccctgtgggcgctcagcgagaggctgatccaagaacggcttggcagccagtccggctaagtggagctcagagcggatgggcacacacacccgccctgtgtgtgtcccctcacgcaagtgccagggctgggccccttccaaatgtccctccaacacagatccgcaagagtaaaggaaataagagcagtcacaacagagtgaaaaatcttaagtaccaatgggaagcagggaattcctggggtaaagtatcacttttctggggctgggctaggcataggtctctttgctttctggtggtggcctgtttgaaagtaaaaacctgcttggtgtgtaggttccgtatctccctggagaagcaccagcaattctctttcttttactgttatagaatagcctgaggtcccctcgtcccatccagctaccaccacggccaccactgcagccgggggctggccttctcctacttagggaagaaaaagcaagtgttcactgctccttgctgcattgatccaggagataattgtttcattcatcctgaccaagactgagccagcttagcaactgctggggagacaaatctcagaaccttgtcccagccagtgaggatgacagtgacacccagagggagtagaatacgcagaactaccaggtggcaaagtacttgtcatagactcctttgctaatgctatgcaaaaaattctttagagattataacaaatttttcaaatcattccttagataccttgaaaggcaggaagggaagcgtatatacttaagaatacacaggatattttggggggcagagaataaaacgttagttaatccctttgtctgtcaatcacagtctcagttctcttgctttcacattgtacttaaacctcctgctgtgcctcgcatcctatgcttaataaaagaacatgcttgaatatca

SEQ ID NO: 200373 - DNA, 1227 bp, Homo sapiens
  Payload ID: 19528
  Gene Name: WW domain containing oxidoreductase
  Uniprot ID: Q9NZC7
  ENST ID: ENST00000408984
  CDS Start-End: 86-1177
ggtctcgtttggagcgggagtgagttcctgagcgagtggacccggcagcgggcgataggggggccaggtgcctccacagtcagccatggcagcgctgcgctacgcggggctggacgacacggacagtgaggacgagctgcctccgggctgggaggagagaaccaccaaggacggctgggtttactacgccaatcacaccgaggagaagactcagtgggaacatccaaaaactggaaaaagaaaacgagtggcaggagatttgccatacggatgggaacaagaaactgatgagaacggacaagtgttttttgttgaccatataaataaaagaaccacctacttggacccaagactggcgtttactgtggatgataatccgaccaagccaaccacccggcaaagatacgacggcagcaccactgccatggaaattctccagggccgggatttcactggcaaagtggttgtggtcactggagctaattcaggaatagggttcgaaaccgccaagtcttttgccctccatggtgcacatgtgatcttggcctgcaggaacatggcaagggcgagtgaagcagtgtcacgcattttagaagaatggcataaagccaaggtagaagcaatgaccctggacctcgctctgctccgtagcgtgcagcattttgctgaagcattcaaggccaagaatgtgcctcttcatgtgcttgtgtgcaacgcagcaacttttgctctaccctggagtctcaccaaagatggcctggagaccacctttcaagtgaatcatctggggcacttctaccttgtccagctcctccaggatgttttgtgccgctcagctcctgcccgtgtcattgtggtctcctcagagtcccatcgatttacagatattaacgactccttgggaaaactggacttcagtcgcctctctccaacaaaaaacgactattgggcgatgctggcttataacaggtccaagctctgcaacatcctcttctccaacgagctgcaccgtcgcctctccccacgcggggtcacgtcgaacgcagtgcatcctggaaatatgatgtactccaacattcatcgcagctggtgggtgtacacactgctgtttaccttggcgaggcctttcaccaagtccatggtttcagactgcctggtagaaggaggtcacttctgattgtcagtgactttgagctgagtgctgaaataaaatgataaacaagtcaa

SEQ ID NO: 200374 - DNA, 1670 bp, Homo sapiens
  Payload ID: 19528
  Gene Name: WW domain containing oxidoreductase
  ENST ID: ENST00000539474
  CDS Start-End: 126-767
gcagtgcgcaggcgtgagcggtcgggccccgacgcgcgcgggtctcgtttggagcgggagtgagttcctgagcgagtggacccggcagcgggcgataggggggccaggtgcctccacagtcagccatggcagcgctgcgctacgcggggctggacgacacggacagtgaggacgagctgcctccgggctgggaggagagaaccaccaaggacggctgggtttactacgccaatcacaccgaggagaagactcagtgggaacatccaaaaactggaaaaagaaaacgagtggcaggagatttgccatacggatgggaacaagaaactgatgagaacggacaagtgttttttgttgaccatataaataaaagaaccacctacttggacccaagactggcgtttactgtggatgataatccgaccaagccaaccacccggcaaagatacgacggcagcaccactgccatggaaattctccagggccgggatttcactggcaaagtggttgtggtcactggagctaattcaggaataggaaaagccagctgccatgttgggaggatactcaagcatacccgtgtagaagaactgagcctcctgccaacagccatcaacagggagctgccaccaccgtgtactgtgctgctgtcccagaactggagggtctgggagggatgtacttcaacaactgctgccgctgcatgccctcaccagaagctcagagcgaagagacggcccggaccctgtgggcgctcagcgagaggctgatccaagaacggcttggcagccagtccggctaagtggagctcagagcggatgggcacacacacccgccctgtgtgtgtcccctcacgcaagtgccagggctgggccccttccaaatgtccctccaacacagatccgcaagagtaaaggaaataagagcagtcacaacagagtgaaaaatcttaagtaccaatgggaagcagggaattcctggggtaaagtatcacttttctggggctgggctaggcataggtctctttgctttctggtggtggcctgtttgaaagtaaaaacctgcttggtgtgtaggttccgtatctccctggagaagcaccagcaattctctttcttttactgttatagaatagcctgaggtcccctcgtcccatccagctaccaccacggccaccactgcagccgggggctggccttctcctacttagggaagaaaaagcaagtgttcactgctccttgctgcattgatccaggagataattgtttcattcatcctgaccaagactgagccagcttagcaactgctggggagacaaatctcagaaccttgtcccagccagtgaggatgacagtgacacccagagggagtagaatacgcagaactaccaggtggcaaagtacttgtcatagactcctttgctaatgctatgcaaaaaattctttagagattataacaaatttttcaaatcattccttagataccttgaaaggcaggaagggaagcgtatatacttaagaatacacaggatattttggggggcagagaataaaacgttagttaatccctttgtctgtcaatcacagtctcagttctcttgctttcacattgtacttaaacctcctgctgtgcctcgcatcctatgcttaataaaagaacatgcttgaatatca

SEQ ID NO: 200375 - DNA, 571 bp, Homo sapiens
  Payload ID: 19528
  Gene Name: WW domain containing oxidoreductase
  ENST ID: ENST00000566662
  CDS Start-End: 124-261
agtgcgcaggcgtgagcggtcgggccccgacgcgcgcgggtctcgtttggagcgggagtgagttcctgagcgagtggacccggcagcgggcgataggggggccaggtgcctccacagtcagccatggcagcgctgcgctacgcggggctggacgacacggacagtgaggacgagctgcctccgggctgggaggagagaaccaccaaggacggctgggtttactacgccaaatttgccatacggatgggaacaagaaactgatgagaacggacaagtgttttttgttgaggttcgaaaccgccaagtcttttgccctccatggtgcacatgtgatcttggcctgcaggaacatggcaagggcgagtgaagcagtgtcacgcattttagaagaatggcataaagccaaggtagaagcaatgaccctggacctcgctctgctccgtagcgtgcagcattttgctgaagcattcaaggccaagaatgtgcctcttcatgtgcttgtgtgcaacgcagcaacttttgctctaccctggagtctcaccaaagatggcctggagaccacctttcaagt

SEQ ID NO: 200376 - DNA, 525 bp, Homo sapiens
  Payload ID: 19528
  Gene Name: WW domain containing oxidoreductase
  Uniprot ID: Q9NZC7
  ENST ID: ENST00000569818
  CDS Start-End: 105-215
tcgggccccgacgcgcgcgggtctcgtttggagcgggagtgagttcctgagcgagtggacccggcagcgggcgataggggggccaggtgcctccacagtcagccatggcagcgctgcgctacgcggggctggacgacacggacagtgaggacgagctgcctccgggctgggaggagagaaccaccaaggacggctgggtttactacgccaagtaagggggccgcagtggggccgcggacgcacctgggaccctgcacagcccacggacgccacctgcgcggggaggacgcgcactccagcgcagcgcgtgcggtgcaaagtgaaagtaactgttaaggagcttcagggaaaagggtccagggttcccagtaggggccggcccccttggtgggcctcgggtccagcgggggtcacctggtggcttcccggcgcgccctctgctgttcaggatgcagcactgcgcggcgcggcgagggcaaagcggcctcatccccgccaaaaaataaagatgttttaaaaagcgca

SEQ ID NO: 200377 - DNA, 1856 bp, Homo sapiens
  Payload ID: 19528
  Gene Name: WW domain containing oxidoreductase
  ENST ID: ENST00000569332
  CDS Start-End: 154-291
gtggtcggcggagcggcccctggagggcgcagtgcgcaggcgtgagcggtcgggccccgacgcgcgcgggtctcgtttggagcgggagtgagttcctgagcgagtggacccggcagcgggcgataggggggccaggtgcctccacagtcagccatggcagcgctgcgctacgcggggctggacgacacggacagtgaggacgagctgcctccgggctgggaggagagaaccaccaaggacggctgggtttactacgccaaatttgccatacggatgggaacaagaaactgatgagaacggacaagtgttttttgttgaccatataaataaaagaaccacctacttggacccaagactggcgtttactgtggatgataatccgaccaagccaaccacccggcaaagatacgacggcagcaccactgccatggaaattctccagggccgggatttcactggcaaagtggttgtggtcactggagctaattcaggaatagggttcgaaaccgccaagtcttttgccctccatggtgcacatgtgatcttggcctgcaggaacatggcaagggcgagtgaagcagtgtcacgcattttagaagaatggcataaagccaaggtagaagcaatgaccctggacctcgctctgctccgtagcgtgcagcattttgctgaagcattcaaggccaagaatgtgcctcttcatgtgcttgtgtgcaacgcagcaacttttgctctaccctggagtctcaccaaagatggcctggagaccacctttcaagtgaatcatctggggcacttctaccttgtccagctcctccaggatgttttgtgccgctcagctcctgcccgtgtcattgtggtctcctcagagtcccatcgatttacagatattaacgactccttgggaaaactggacttcagtcgcctctctccaacaaaaaacgactattgggcgatgctggcttataacaggtccaagctctgcaacatcctcttctccaacgagctgcaccgtcgcctctccccacgcggggtcacgtcgaacgcagtgcatcctggaaatatgatgtactccaacattcatcgcagctggtgggtgtacacactgctgtttaccttggcgaggcctttcaccaagtccatgcaacagggagctgccaccaccgtgtactgtgctgctgtcccagaactggagggtctgggagggatgtacttcaacaactgctgccgctgcatgccctcaccagaagctcagagcgaagagacggcccggaccctgtgggcgctcagcgagaggctgatccaagaacggcttggcagccagtccggctaagtggagctcagagcggatgggcacacacacccgccctgtgtgtgtcccctcacgcaagtgccagggctgggccccttccaaatgtccctccaacacagatccgcaagagtaaaggaaataagagcagtcacaacagagtgaaaaatcttaagtaccaatgggaagcagggaattcctggggtaaagtatcacttttctggggctgggctaggcataggtctctttgctttctggtggtggcctgtttgaaagtaaaaacctgcttggtgtgtaggttccgtatctccctggagaagcaccagcaattctctttcttttactgttatagaatagcctgaggtcccctcgtcccatccagctaccaccacggccaccactgcagccgggggctggccttctcctacttagggaagaaaaagcaagtgttcactgctccttgctgcattgatccaggagataattgtttcattcatcctgaccaagactgagccagcttagcaactgctggggagacaaatctcag

SEQ ID NO: 200378 - DNA, 2482 bp, Homo sapiens
  Payload ID: 19528
  Gene Name: WW domain containing oxidoreductase
  Uniprot ID: Q9NZC7
  ENST ID: ENST00000566780
  CDS Start-End: 367-1611
gtcctggcccgaaactggatgcgcacgccccttccctgcggcggggaggctgacaaggctccgctctatctctagcgcctcggagcgctctccggctttgctgtctagcccggcggcagcgcgatctcttaggcactttcaccgccttcctctccaggccctgcccctttgacgccggccgtcgcgatattgcggagactggatttcagcttcgtggtcggcggagcggcccctggagggcgcagtgcgcaggcgtgagcggtcgggccccgacgcgcgcgggtctcgtttggagcgggagtgagttcctgagcgagtggacccggcagcgggcgataggggggccaggtgcctccacagtcagccatggcagcgctgcgctacgcggggctggacgacacggacagtgaggacgagctgcctccgggctgggaggagagaaccaccaaggacggctgggtttactacgccaatcacaccgaggagaagactcagtgggaacatccaaaaactggaaaaagaaaacgagtggcaggagatttgccatacggatgggaacaagaaactgatgagaacggacaagtgttttttgttgaccatataaataaaagaaccacctacttggacccaagactggcgtttactgtggatgataatccgaccaagccaaccacccggcaaagatacgacggcagcaccactgccatggaaattctccagggccgggatttcactggcaaagtggttgtggtcactggagctaattcaggaatagggttcgaaaccgccaagtcttttgccctccatggtgcacatgtgatcttggcctgcaggaacatggcaagggcgagtgaagcagtgtcacgcattttagaagaatggcataaagccaaggtagaagcaatgaccctggacctcgctctgctccgtagcgtgcagcattttgctgaagcattcaaggccaagaatgtgcctcttcatgtgcttgtgtgcaacgcagcaacttttgctctaccctggagtctcaccaaagatggcctggagaccacctttcaagtgaatcatctggggcacttctaccttgtccagctcctccaggatgttttgtgccgctcagctcctgcccgtgtcattgtggtctcctcagagtcccatcgatttacagatattaacgactccttgggaaaactggacttcagtcgcctctctccaacaaaaaacgactattgggcgatgctggcttataacaggtccaagctctgcaacatcctcttctccaacgagctgcaccgtcgcctctccccacgcggggtcacgtcgaacgcagtgcatcctggaaatatgatgtactccaacattcatcgcagctggtgggtgtacacactgctgtttaccttggcgaggcctttcaccaagtccatgcaacagggagctgccaccaccgtgtactgtgctgctgtcccagaactggagggtctgggagggatgtacttcaacaactgctgccgctgcatgccctcaccagaagctcagagcgaagagacggcccggaccctgtgggcgctcagcgagaggctgatccaagaacggcttggcagccagtccggctaagtggagctcagagcggatgggcacacacacccgccctgtgtgtgtcccctcacgcaagtgccagggctgggccccttccaaatgtccctccaacacagatccgcaagagtaaaggaaataagagcagtcacaacagagtgaaaaatcttaagtaccaatgggaagcagggaattcctggggtaaagtatcacttttctggggctgggctaggcataggtctctttgctttctggtggtggcctgtttgaaagtaaaaacctgcttggtgtgtaggttccgtatctccctggagaagcaccagcaattctctttcttttactgttatagaatagcctgaggtcccctcgtcccatccagctaccaccacggccaccactgcagccgggggctggccttctcctacttagggaagaaaaagcaagtgttcactgctccttgctgcattgatccaggagataattgtttcattcatcctgaccaagactgagccagcttagcaactgctggggagacaaatctcagaaccttgtcccagccagtgaggatgacagtgacacccagagggagtagaatacgcagaactaccaggtggcaaagtacttgtcatagactcctttgctaatgctatgcaaaaaattctttagagattataacaaatttttcaaatcattccttagataccttgaaaggcaggaagggaagcgtatatacttaagaatacacaggatattttggggggcagagaataaaacgttagttaatccctttgtctgtcaatcacagtctcagttctcttgctttcacattgtacttaaacctcctgctgtgcctcgcatcctatgcttaataaaagaacatgcttgaatatca

SEQ ID NO: 200379 - DNA, 450 bp, Homo sapiens
  Payload ID: 19528
  Gene Name: WW domain containing oxidoreductase
  ENST ID: ENST00000620008
  CDS Start-End: 1-450
cctcttcatgtgcttgtgtgcaacgcagcaacttttgctctaccctggagtctcaccaaagatggcctggagaccacctttcaagtgaatcatctggggcacttctaccttgtccagctcctccaggatgttttgtgccgctcagctcctgcccgtgtcattgtggtctcctcagagtcccatcgatttacagatattaacgactccttgggaaaactggacttcagtcgcctctctccaacaaaaaacgactattgggcgatgctggcttataacaggtccaagctctgcaacatcctcttctccaacgagctgcaccgtcgcctctccccacgcggggtcacgtcgaacgcagtgcatcctggaaatatgatgtactccaacattcatcgcagctggtgggtgtacacactgctgtttaccttggcgaggcctttcaccaagtccatg

SEQ ID NO: 200380 - DNA, 894 bp, Homo sapiens
  Payload ID: 19528
  Gene Name: WW domain containing oxidoreductase
  ENST ID: ENST00000627394
  CDS Start-End: 350-487
gatgcgcacgccccttccctgcggcggggaggctgacaaggctccgctctatctctagcgcctcggagcgctctccggctttgctgtctagcccggcggcagcgcgatctcttaggcactttcaccgccttcctctccaggccctgcccctttgacgccggccgtcgcgatattgcggagactggatttcagcttcgtggtcggcggagcggcccctggagggcgcagtgcgcaggcgtgagcggtcgggccccgacgcgcgcgggtctcgtttggagcgggagtgagttcctgagcgagtggacccggcagcgggcgataggggggccaggtgcctccacagtcagccatggcagcgctgcgctacgcggggctggacgacacggacagtgaggacgagctgcctccgggctgggaggagagaaccaccaaggacggctgggtttactacgccaaatttgccatacggatgggaacaagaaactgatgagaacggacaagtgttttttgttgaccatataaataaaagaaccacctacttggacccaagactggcgtttactgtggatgataatccgaccaagccaaccacccggcaaagatacgacggcagcaccactgccatggaaattctccagggccgggatttcactggcaaagtggttgtggtcactggagctaattcaggaatagggttcgaaaccgccaagtcttttgccctccatggtgcacatgtgatcttggcctgcaggaacatggcaagggcgagtgaagcagtgtcacgcattttagaagaatggaaaacaaaataccaccctccgccagaaaagtgcagaataaaaattttccactagcaaaagaaggaaaaaataaaagatcttgaatagtctcatc

SEQ ID NO: 200381 - DNA, 2103 bp, Homo sapiens
  Payload ID: 19529
  Gene Name: WW domain containing transcription regulator 1
  Uniprot ID: Q9GZV5
  ENST ID: ENST00000360632
  CDS Start-End: 341-1543
ataattcaacagctcaactttcgggcccgcctctttcctgggggtgggagtttgctccaaactttgtttatgggacagtccgggagctgctgcggccgcgctgtctgcttctcctgcgcctccttttcgcccagcactagcgccttaggccagctcgggggatgtgagagccgaagcccttagactgccaggcacagagtcgggtcgggatttgtcagccaagcctcggctccagctccgcaatctcgggactcacccgagcgacccaggcccgacggcaagttcgggcgggacggcggccgccgcgcgctcaggctcagcttcgctgcccgcccagaagatgaatccggcctcggcgccccctccgctcccgccgcctgggcagcaagtgatccacgtcacgcaggacctagacacagacctcgaagccctcttcaactctgtcatgaatccgaagcctagctcgtggcggaagaagatcctgccggagtctttctttaaggagcctgattcgggctcgcactcgcgccagtccagcaccgactcgtcgggcggccacccggggcctcgactggctgggggtgcccagcatgtccgctcgcactcgtcgcccgcgtccctgcagctgggcaccggcgcgggtgctgcgggtagccccgcgcagcagcacgcgcacctccgccagcagtcctacgacgtgaccgacgagctgccactgcccccgggctgggagatgaccttcacggccactggccagaggtacttcctcaatcacatagaaaaaatcaccacatggcaagaccctaggaaggcgatgaatcagcctctgaatcatatgaacctccaccctgccgtcagttccacaccagtgcctcagaggtccatggcagtatcccagccaaatctcgtgatgaatcaccaacaccagcagcagatggcccccagtaccctgagccagcagaaccaccccactcagaacccacccgcagggctcatgagtatgcccaatgcgctgaccactcagcagcagcagcagcagaaactgcggcttcagagaatccagatggagagagaaaggattcgaatgcgccaagaggagctcatgaggcaggaagctgccctctgtcgacagctccccatggaagctgagactcttgccccagttcaggctgctgtcaacccacccacgatgaccccagacatgagatccatcactaataatagctcagatcctttcctcaatggagggccatatcattcgagggagcagagcactgacagtggcctggggttagggtgctacagtgtccccacaactccggaggacttcctcagcaatgtggatgagatggatacaggagaaaacgcaggacaaacacccatgaacatcaatccccaacagacccgtttccctgatttccttgactgtcttccaggaacaaacgttgacttaggaactttggaatctgaagacctgatccccctcttcaatgatgtagagtctgctctgaacaaaagtgagccctttctaacctggctgtaatcactaccattgtaacttggatgtagccatgaccttacatttcctgggcctcttggaaaaagtgatggagcagagcaagtctgcaggtgcaccacttcccgcctccatgactcgtgctccctcctttttatgttgccagtttaatcattgcctggttttgattgagagtaacttaagttaaacataaataaatattctattttcattttctgcaagcctgcgttcttgtgacagattatacagaattgtgtctgcaggattgattatgcagaatacttttctctttcttctctgctgccccatggctaagctttatgggtgttaattgaaatttatacaccaattgattttaaaccataaaaagctgaccacaggcagttacttctgagggcatcttggtccaggaaatgtgcacaaaattcgacctgatttacagtttcaaaaactgtattgatgacagtagtaccaaatgctttaaaaactatttaacttgagctttaaaaatcattgtatggatagtaaaattctactgtatggaatacaatgtaattttgaatcca

SEQ ID NO: 200382 - DNA, 955 bp, Homo sapiens
  Payload ID: 19529
  Gene Name: WW domain containing transcription regulator 1
  ENST ID: ENST00000472417
  CDS Start-End: 215-955
gtattaagtgcctcttgtgagcaatagctcactcttacttgttgcattcagcctgggagccactcttgacaccatgttagcgcagccttacagctgatgtcaggtcgactggtctgcagagccaggaatttgggctttcttctcagagttgttttggagcaatgagaactgctcacttaagaaaggctccctcttgtactccagcctttggggaatgcttcacatagaaaaaatcaccacatggcaagaccctaggaaggcgatgaatcagcctctgaatcatatgaacctccaccctgccgtcagttccacaccagtgcctcagaggtccatggcagtatcccagccaaatctcgtgatgaatcaccaacaccagcagcagatggcccccagtaccctgagccagcagaaccaccccactcagaacccacccgcagggctcatgagtatgcccaatgcgctgaccactcagcagcagcagcagcagaaactgcggcttcagagaatccagatggagagagaaaggattcgaatgcgccaagaggagctcatgaggcaggaagctgccctctgtcgacagctccccatggaagctgagactcttgccccagttcaggctgctgtcaacccacccacgatgaccccagacatgagatccatcactaataatagctcagatcctttcctcaatggagggccatatcattcgagggagcagagcactgacagtggcctggggttagggtgctacagtgtccccacaactccggaggacttcctcagcaatgtggatgagatggatacaggagaaaacgcaggacaaacacccatgaacatcaatccccaacagacccgtttccctgatttccttgactgtcttccaggaacaaacgttgacttaggaactttggaatctgaagacctgatccccctcttcaatgatgtagagtctgct

SEQ ID NO: 200383 - DNA, 566 bp, Homo sapiens
  Payload ID: 19529
  Gene Name: WW domain containing transcription regulator 1
  ENST ID: ENST00000494754
  CDS Start-End: 1-89
aaatgctgatccttggaggctgtggaacgtggggcgttgtgctgcatcatagaagctgccctctgtcgacagctccccatggaagctgagactcttgccccagttcaggctgctgtcaacccacccacgatgaccccagacatgagatccatcactaataatagctcagatcctttcctcaatggagggccatatcattcgagggagcagagcactgacagtggcctggggttagggtgctacagtgtccccacaactccggaggacttcctcagcaatgtggatgagatggatacaggagaaaacgcaggacaaacacccatgaacatcaatccccaacagacccgtttccctgatttccttgactgtcttccaggaacaaacgttgacttaggaactttggaatctgaagacctgatccccctcttcaatgatgtagagtctgctctgaacaaaagtgagccctttctaacctggctgtaatcactaccattgtaacttggatgtagccatgaccttacatttcctgggcctcttggaaaaagtgatggagcagagcaagtctg

SEQ ID NO: 200384 - DNA, 604 bp, Homo sapiens
  Payload ID: 19529
  Gene Name: WW domain containing transcription regulator 1
  ENST ID: ENST00000460517
  CDS Start-End: 542-604
actttgtttatgggacagtccgggagctgctgcggccgcgctgtctgcttctcctgcgcctccttttcgcccagcactagcgccttaggccagctcgggggatgtgagagccgaagcccttagactgccaggcacagagtcgggtcgggatttgtcagccaagcctcggctccagctccgcaatctcgggactcacccgagcgacccaggcccgacggcaagttcgggcgggacggcggccgccgcgcgctcaggctcagcttcgctgcccgcccaggtagtgcccgctggagctcgcgcgctcatccggcaccactccagggctccaggctcctcgggcttccggagtcgagacgtggtggagttggctcgggctgaacttctttcggggggctgcctgtcctggaatcgtgcgacctttcctttgccatcctgcggttcagcaagccccgagtgcagttattccctccacccctcgccctatcttctcctcctccaggcaacttctttgcttcaagaaagttgcataattctcgagaagatgaatccggcctcggcgccccctccgctcccgccgcctgggcagcaagtgatccacgtcacg

SEQ ID NO: 200385 - DNA, 697 bp, Homo sapiens
  Payload ID: 19529
  Gene Name: WW domain containing transcription regulator 1
  ENST ID: ENST00000479238
  CDS Start-End: 130-697
ttatctgtctcctcgtttccttttccctctattctttctcccaccatctcgccctctcaccctgtaaccctcttacccacttcctccgactttaaataaaaggctgatctgaccttctttttgcagaagatgaatccggcctcggcgccccctccgctcccgccgcctgggcagcaagtgatccacgtcacgcaggacctagacacagacctcgaagccctcttcaactctgtcatgaatccgaagcctagctcgtggcggaagaagatcctgccggagtctttctttaaggagcctgattcgggctcgcactcgcgccagtccagcaccgactcgtcgggcggccacccggggcctcgactggctgggggtgcccagcatgtccgctcgcactcgtcgcccgcgtccctgcagctgggcaccggcgcgggtgctgcgggtagccccgcgcagcagcacgcgcacctccgccagcagtcctacgacgtgaccgacgagctgccactgcccccgggctgggagatgaccttcacggccactggccagaggtacttcctcaatcacatagaaaaaatcaccacatggcaagaccctaggaaggcgatgaatcagcctctgaatcatatgaacctccaccctgccgtcagttccacaccagtgcctcagaggtccatggcagtatcccagccaaatctcg

SEQ ID NO: 200386 - DNA, 584 bp, Homo sapiens
  Payload ID: 19529
  Gene Name: WW domain containing transcription regulator 1
  ENST ID: ENST00000471586
  CDS Start-End: 1-128
aacattccagagaactttcttggaggaaaggaccgagcatgttagggaagctgccctctgtcgacagctccccatggaagctgagactcttgccccagttcaggctgctgtcaacccacccacgatgaccccagacatgagatccatcactaataatagctcagatcctttcctcaatggagggccatatcattcgagggagcagagcactgacagtggcctggggttagggtgctacagtgtccccacaactccggaggacttcctcagcaatgtggatgagatggatacaggagaaaacgcaggacaaacacccatgaacatcaatccccaacagacccgtttccctgatttccttgactgtcttccaggaacaaacgttgacttaggaactttggaatctgaagacctgatccccctcttcaatgatgtagagtctgctctgaacaaaagtgagccctttctaacctggctgtaatcactaccattgtaacttggatgtagccatgaccttacatttcctgggcctcttggaaaaagtgatggagcagagcaagtctgcaggtgcaccacttcccgcctcc

SEQ ID NO: 200387 - DNA, 1603 bp, Homo sapiens
  Payload ID: 19529
  Gene Name: WW domain containing transcription regulator 1
  Uniprot ID: Q9GZV5
  ENST ID: ENST00000467467
  CDS Start-End: 206-1408
agtccgggagctgctgcggccgcgctgtctgcttctcctgcgcctccttttcgcccagcactagcgccttaggccagctcgggggatgtgagagccgaagcccttagactgccaggcacagagtcgggtcgggatttgtcagccaagcctcggctccagctccgcaatctcgggactcacccgagcgacccaggcccgacggcaaatgaatccggcctcggcgccccctccgctcccgccgcctgggcagcaagtgatccacgtcacgcaggacctagacacagacctcgaagccctcttcaactctgtcatgaatccgaagcctagctcgtggcggaagaagatcctgccggagtctttctttaaggagcctgattcgggctcgcactcgcgccagtccagcaccgactcgtcgggcggccacccggggcctcgactggctgggggtgcccagcatgtccgctcgcactcgtcgcccgcgtccctgcagctgggcaccggcgcgggtgctgcgggtagccccgcgcagcagcacgcgcacctccgccagcagtcctacgacgtgaccgacgagctgccactgcccccgggctgggagatgaccttcacggccactggccagaggtacttcctcaatcacatagaaaaaatcaccacatggcaagaccctaggaaggcgatgaatcagcctctgaatcatatgaacctccaccctgccgtcagttccacaccagtgcctcagaggtccatggcagtatcccagccaaatctcgtgatgaatcaccaacaccagcagcagatggcccccagtaccctgagccagcagaaccaccccactcagaacccacccgcagggctcatgagtatgcccaatgcgctgaccactcagcagcagcagcagcagaaactgcggcttcagagaatccagatggagagagaaaggattcgaatgcgccaagaggagctcatgaggcaggaagctgccctctgtcgacagctccccatggaagctgagactcttgccccagttcaggctgctgtcaacccacccacgatgaccccagacatgagatccatcactaataatagctcagatcctttcctcaatggagggccatatcattcgagggagcagagcactgacagtggcctggggttagggtgctacagtgtccccacaactccggaggacttcctcagcaatgtggatgagatggatacaggagaaaacgcaggacaaacacccatgaacatcaatccccaacagacccgtttccctgatttccttgactgtcttccaggaacaaacgttgacttaggaactttggaatctgaagacctgatccccctcttcaatgatgtagagtctgctctgaacaaaagtgagccctttctaacctggctgtaatcactaccattgtaacttggatgtagccatgaccttacatttcctgggcctcttggaaaaagtgatggagcagagcaagtctgcaggtgcaccacttcccgcctccatgactcgtgctccctcctttttatgttgccagtttaatcattgcctggttttgattgagagtaacttaagttaaacataaataaatat

SEQ ID NO: 200388 - DNA, 5030 bp, Homo sapiens
  Payload ID: 19529
  Gene Name: WW domain containing transcription regulator 1
  Uniprot ID: Q9GZV5
  ENST ID: ENST00000465804
  CDS Start-End: 258-1460
gacacactcctctacaacaccagagactcccaaacacaaggccttatattgactcatttcagctcacatcctggcgactctcaagagagaaacctcagagtgactaaaatctccataatgagaagacatgtacattcagtatctattttggcattttccccaatacatctctgctcatctgactcttatcttggcatctgcttcctggtggatctgaactgacccataagccacgcttactagtgattttccagaagatgaatccggcctcggcgccccctccgctcccgccgcctgggcagcaagtgatccacgtcacgcaggacctagacacagacctcgaagccctcttcaactctgtcatgaatccgaagcctagctcgtggcggaagaagatcctgccggagtctttctttaaggagcctgattcgggctcgcactcgcgccagtccagcaccgactcgtcgggcggccacccggggcctcgactggctgggggtgcccagcatgtccgctcgcactcgtcgcccgcgtccctgcagctgggcaccggcgcgggtgctgcgggtagccccgcgcagcagcacgcgcacctccgccagcagtcctacgacgtgaccgacgagctgccactgcccccgggctgggagatgaccttcacggccactggccagaggtacttcctcaatcacatagaaaaaatcaccacatggcaagaccctaggaaggcgatgaatcagcctctgaatcatatgaacctccaccctgccgtcagttccacaccagtgcctcagaggtccatggcagtatcccagccaaatctcgtgatgaatcaccaacaccagcagcagatggcccccagtaccctgagccagcagaaccaccccactcagaacccacccgcagggctcatgagtatgcccaatgcgctgaccactcagcagcagcagcagcagaaactgcggcttcagagaatccagatggagagagaaaggattcgaatgcgccaagaggagctcatgaggcaggaagctgccctctgtcgacagctccccatggaagctgagactcttgccccagttcaggctgctgtcaacccacccacgatgaccccagacatgagatccatcactaataatagctcagatcctttcctcaatggagggccatatcattcgagggagcagagcactgacagtggcctggggttagggtgctacagtgtccccacaactccggaggacttcctcagcaatgtggatgagatggatacaggagaaaacgcaggacaaacacccatgaacatcaatccccaacagacccgtttccctgatttccttgactgtcttccaggaacaaacgttgacttaggaactttggaatctgaagacctgatccccctcttcaatgatgtagagtctgctctgaacaaaagtgagccctttctaacctggctgtaatcactaccattgtaacttggatgtagccatgaccttacatttcctgggcctcttggaaaaagtgatggagcagagcaagtctgcaggtgcaccacttcccgcctccatgactcgtgctccctcctttttatgttgccagtttaatcattgcctggttttgattgagagtaacttaagttaaacataaataaatattctattttcattttctgcaagcctgcgttcttgtgacagattatacagaattgtgtctgcaggattgattatgcagaatacttttctctttcttctctgctgccccatggctaagctttatgggtgttaattgaaatttatacaccaattgattttaaaccataaaaagctgaccacaggcagttacttctgagggcatcttggtccaggaaatgtgcacaaaattcgacctgatttacagtttcaaaaactgtattgatgacagtagtaccaaatgctttaaaaactatttaacttgagctttaaaaatcattgtatggatagtaaaattctactgtatggaatacaatgtaattttgaatccatgctggctctgatggctcttattagtctgtatttataaaggcacacagtcctattgtagcttatctttcgttattttactgcagagcatctagacaacttagtccctccagcgggaaagtagcagcagcagcattagtcacaggtcttacactacagatcttgtgaaagagaccagtttggtactaattatgagcattttattcaaacaaaagtttttgaaatattacaactggggatttaaaaaattgcagcttagaatctgatggtttttttttttcttgatgttgtttgtttgtttttgagatcgagttttgctcttgttgtccaggctggaatgcaatggcacaatctcggctcactgcaacctctgccttctgggttcaagcgattctcctgccttagcctcccgagtagctgggattacaggcacctgccaccacgtccggctaattttttgtattttgagtagagacggggtttcaccataatggtcaggctgttctcaaactcctgatctcaggtgatccacccatctcggcctcccaaagtgctgggattactggcgtgagccaccgcacccggccttgatgtttattttataaagcactgtaattttgtagctgatgacaaaaggcagccaaatgtttttgataaatcagtggcaactgtatttttgtcttttgaaataactctgaaaacatcaggacaacatagatttcaacctgatagcacaccacacacagtgagctgttgctttttaaattctgaagccttgtcaggtttgcttcctagatttcaagtgtttaaaataattctatctatgaaactgaaggatgaagcagatctctgactgacatgtaaaaaaaaatgccctttgagggtgtatggtggagataaatgtttctgaattcagtaaaattgattcctaagtatattatcctaatcctgtttgctacagttggtataaaaaggcatgaaatatgtattcaatacctcttatgtaaccaaaaccatttttaattagcttttaaggactgagagagcatcatgttcaactggcatgcagtctgcctgcattgccaatgaagtcctcaactgtttaatattttgaactaatattatttataatctatgaatttaatcttttttgaaagactttaataatttgagtctctgagaggatactttcaatttccatgggggacttatttgttggggatcttaaataagattccttttgatctaccggaatatacatgtacagagtacattggatcatgttggaaagaaggcaagtgaaaaggtcagagatgaagtagcaaagttatggaatatcgtggaaaggatactagttgtgaaatggaaagagacaagttatagtaccccaaaagcaaaacaagcaggagatgcaagagatgccccaaaaggacaaagcaacaattttctgttgccacctttataccggaagactctgttgtagaagaaaagaaggctttggtgcaccttatgtgggaggaggaggggcagggcatgctgatgctgagcgtacaggcagacaagagcgtagcctgctgttgcctccatcactatgaaatgacttattttacctgaaggacccatggtttatgttcctctaattcctttcactctccctaagccctctgagagagatgaagatagatgattttattgctactaaattgaagggagcactatttctttttgtcttttgttagcaaaaaattgcaaaaagaattgtacattcttgctaaaaataaataaataaataaaaaattaaaaaaacaagggacctaacaaaactcagcagtgttactgtatttttaaaaaatatttttatagactcattttcaggttattaaatgtaagagaaacagatacccctcttttttaaagtaggtaaatcattgatgatttatattaccaatttttagaagtaattttctagtaagcttgtggcatcagaaaatactagaagatttttttagttaaattagttagaacatttatgaatgaatataataaatattttttcagaataaaatatggaccctttgtgtttactaatagataaagccagatataattttttgtttttaaggccacaaaatatggcctttgttaaagaacactaaagttagaaatctaaagttagagcaactttttaatggctatttcctattattgtaagtgttaaaacccctgcagaattcttgataaggtgctatttatactatatttcttattataagataactgtctttagtcttcttagtactagtctttttagtactaaatcaatcagtaaacatcatcatttcaccccaaaattttgtcacagaaaaggcgtatcaaatgaaaaataatttcagagatctttctttcaagatattttttcctgataaaatacattgtcttgaagtaaatacattgtcaaaacctaattgcaattctgttaaatctaagtaatttttagacagtgtttcaccgtattatttaggatgtgaaatgccatttctttcactgattacaccatatacaggaaacaggtaaaacagtgaaaactttattgtgctggttgatgccaacttggttgaaaagctctctgcagaagaagtgatctagactgacagaagtgttgctaattacaagttgtgttctcatgacgtaattagaaagtaacttctcaaagtacaacttttatgaaaaaaataagctgttaaaaaaaggaaatcgtaggttaatttaattgggaaaatgggcaattgacagagaccattttcctaacacatatatgtgctagtactttaactttttaaaattttacttctacgttttgtaatataaaaatttctattttaagtttagaatgttatacgtaccgaaagtatgcagccaaatcgatcagatcaaaccattttacctggagtttggtactggtttttacttctctgaatctgtataagaaaaataaagacaattgaacttcca

SEQ ID NO: 200389 - DNA, 503 bp, Homo sapiens
  Payload ID: 19529
  Gene Name: WW domain containing transcription regulator 1
  ENST ID: ENST00000485352
  CDS Start-End: 88-503
caggtagtgcccgctggagctcgcgcgctcatccggcaccactccagggctccaggctcctcgggcttccggagtcgagacgtgaagatgaatccggcctcggcgccccctccgctcccgccgcctgggcagcaagtgatccacgtcacgcaggacctagacacagacctcgaagccctcttcaactctgtcatgaatccgaagcctagctcgtggcggaagaagatcctgccggagtctttctttaaggagcctgattcgggctcgcactcgcgccagtccagcaccgactcgtcgggcggccacccggggcctcgactggctgggggtgcccagcatgtccgctcgcactcgtcgcccgcgtccctgcagctgggcaccggcgcgggtgctgcgggtagccccgcgcagcagcacgcgcacctccgccagcagtcctacgacgtgaccgacgagctgccactgcccccgggctgggagatgaccttcacggccactggcca

SEQ ID NO: 200390 - DNA, 578 bp, Homo sapiens
  Payload ID: 19529
  Gene Name: WW domain containing transcription regulator 1
  ENST ID: ENST00000475579
  CDS Start-End: 250-578
aggatttgcactttctccttttcttcagaatgtgtatctgcctaagcagtgtgataacttttttcccagactggatcgatattccttagctggtcctgttgcagcaggagtccggtgactggagagaggaagctcttgggcagcattttccccaatacatctctgctcatctgactcttatcttggcatctgcttcctggtggatctgaactgacccataagccacgcttactagtgattttccagaagatgaatccggcctcggcgccccctccgctcccgccgcctgggcagcaagtgatccacgtcacgcaggacctagacacagacctcgaagccctcttcaactctgtcatgaatccgaagcctagctcgtggcggaagaagatcctgccggagtctttctttaaggagcctgattcgggctcgcactcgcgccagtccagcaccgactcgtcgggcggccacccggggcctcgactggctgggggtgcccagcatgtccgctcgcactcgtcgcccgcgtccctgcagctgggcaccggcgcgggtgctgcgggtagccccgcgcagcagca

SEQ ID NO: 200391 - DNA, 6647 bp, Homo sapiens
  Payload ID: 19530
  Gene Name: WWC family member 3
  Uniprot ID: Q9ULE0
  ENST ID: ENST00000380861
  CDS Start-End: 392-3670
gcggggcccgcgccgtcatgccttggctgagcggcggccggcggcgacggcggggacagccgcgcgaggccccgcgggagccgccgccttctgcgcagccccagcgggaaccgcgccgccggcgccccccgccgcggtccccacgcccccagctccttccgcgccgccgccgcgggcccgggagagcgccgagctgccgctgcccgccggctgggaggaggcgcgagactacgacggtcgcgtcttttacattgaccacaacacgcgccagacgtcgtggatcgacccccgcgaccggataacaaagccattgacctttgccgattgtgttggggacgaacttcctttaggatgggaaaccgtatatgataaacaaattggagtttattacatggaccacataaataaacttacccagattgaggatccaagagaacagtggaggcgagagcaagagcgcatgttgaaggaatatttaattgtagctcaggaggctctcaatgccaagaaagaaatctaccagattaagcagcagcggttcgagctggcccaggaggaataccagcagctgcacaaaatgtgtgaggatgacagccgctcgtacgccagctcattctctggatattcaacaaatacaaagtatgacccacaccaaattaaagcagaaatagcaagtcgtcgggataggctttccagattaaaacgagagctgacccagatgaagcaggaactgcagtacaaagaaaagggggtggagaccctgcaagagattgatcggaagatgtcaagtactcacaccagctacaaactggatgaggcgcaggctatcatgagtgagctccggaccatcaagaaggccatttgcacaggcgagaaggagaggcgggacctgatgcatagcctggccaagctgaccgatagcttcaagaacagctgctccgttaccgactctctagtggacttccctcaccatgtaggcgtgcctggcgatgctggtgtaccccagcagttctgcgatgccggctcccagactgatatcatcggggagtttgtctttgatgataaaacaagacttgtagaccgagtcagacttaattggcaatatgaagaagccagaaagagagtcgccaacatccagcagcagctggcccggcttgacaatgagtcctggccaagcacggccgaggctgacagggaccggctgcagctcatcaaggagaaggaggccctgctgcaggagcttcagctcatcattgcacagcgccgctctgcgggagatgtggcccggctggaggaggagcgggagcgcctagaggaggagctgcggcgtgcacgggccacctccgcacagggcgccacggagaggattctgcttcaggaaaaaaggaattgtctacttatgcagctggaagaagccacccgcttaacatcctacctccagtcccagttaaaaagcctgtgtgccagcaccctgacggtgtcctcggggagcagccgcgggtccctagcctccagccgtgggtctctggcctccagccggggctccctgagctcggtcagcttcacggacatctacggcctcccgcagtacgagaagcccgacgctgagggcagccagcttctacgcttcgacctcattcccttcgactctctggggcgagatgctcccttttcagagcccccaggcccctcgggcttccacaagcagaggcggtccctggacacgccccagtccctggcatcgctgtcctcccgctcctcgctgtcctcgctgtcgcccccaagctcgcccctggacacgcccttcctccctgcctcacgggactcgccgctggcgcagctggcggacagctgtgaggggccaggcctgggcgccctagacagactgcgggcacacgcctcggctatgggggacgaagacttaccaggcatggcggcccttcagccacacggggtccccggggatggggaagggccgcacgagcgaggacccccaccagccagcgctcccgtgggtggaacagtgactcttcgagaagacagtgccaagaggttggagaggagggcacgccgcatctccgcatgtctgtcggattattcgctagccagcgacagtggggtgtttgaacctctaaccaaaaggaacgaagatgccgaggagcctgcctacggagacacggccagtaacggagatccccagatccacgtgggactcctgcgcgacagtggcagcgagtgtctcctcgtgcacgtgctgcagctgaagaacccggcggggctggcggtgaaggaagactgcaaagtccacatccgagtctatttgcccccactggactcgggcacgcccaacacttactgctccaaggctctggagttccaagtgccgctggtgtttaacgaagtgttcagaatccccgtgcattccagcgcgttgacactgaagtcacttcagttatacgtgtgttcagtgactccgcagctgcaggaagaactgctgggcattgctcagattaacctggctgactatgacagtttgagtgagatgcagctgcgctggcattccgtgcaggtgttcaccagctctgaaccatcaaggacgcgggaggctgggtgtgcaggagagagctccgcccgggaccctgcacacaccatctccatctccggcaagacggatgcggtgacggtgctcctggccagaaccacggcacagctgcaggcggtggagagggaactggccgaggagcgggccaagctggagtacacggaggaggaggtcctggagatggagcgcaaggaggagcaggccgaggccatatccgagcggagttggcaagcggactcggtggatagcggctgtagcaactgcacccagaccagccctccgtacccagagccctgttgcatgggtatcgactccatcctgggccacccatttgctgctcaggcagggccttacagccccgagaaatttcagccctcgcctcttaaggttgataaggaaaccaacacggaagatctctttctggaagaagcagccagcctcgtgaaggagcggcccagccgccgggcccgagggtcgccttttgttcggagtggcacgattgtccgttcccagacattctcgcctggagcacgaagccagtatgtttgcagactttatcgtagtgacagcgacagttcaacgctgccccggaagtccccctttgtccgaaatactttggaaagacgaacccttcgctataagcagtcatgcaggtcttccctggctgagctcatggcccgcacctccctggacttggagctggatctccaggcgtcgagaacacggcagaggcagctgaatgaggagctctgcgccctccgtgagctgcggcagcggttggaggacgcccagctccgtggccagactgacctcccaccctgggtgcttcgggacgagcggctccgtggcctgctgcgggaggccgagcggcagacaagacagaccaaacttgactaccgtcatgagcaggcggctgagaagatgctgaagaaggcctccaaggagatctaccagctgcgtgggcagagccacaaagagcccatccaagtgcagacctttagggagaagatagcattcttcacaaggccaaggatcaacatacctcctctcccagccgacgacgtctgatggagtgcattgtgcacatgaagtatttatccacctgttttattttcatgaagttcttagactagctgaatttgtctttaaaatatttgtgcaaagctattaatatacacattttgtaaaaaaaaaaaaaaaacacgtatatctatacatatatattttataatagtgacggcaacagggcttggtttttccttgttgtgaaatcgacatctctgaagacaggttattttataaaagatcaactatcatgttaagaatgtacagtttttatgctgttttatttgacttaaaggctggaagacagaaacgaagtgagttcaggcaaattcactgtattgtaatttatttatagtacttttttttccttgaaggaaaatactgactttaagatgtattttaagactgaaattttgttctttagtacttttcatgcagtagaacggaacttggggctggtttggtttttgacacctgaaatgcgaacgctatgtgctaaatttgtcaccgtatcatatgtgcatttaccatgtatattgtacacattcactcccttgatgtcatgttaaaatgtcccctgcagtggttcaatcgtgactcggaagcatgtgtgtgttgcagaggtcagtctctggcgtgggccgcacgccaaccgctcatttctgtgttgcctttggaagcatctttctgtgctcagcgtgagtctgaagcaggcgccagggcctctggtgtacggggcttcagcctgcttgcttgtggtggctgtctgtggggcttcagcctgactgtccgtggtggctgtccatgctgcccgcctccccccaccccgccctgtccgactgtaacagaccaggagggtggcggaggaactcctgccacgccactgtgtcatgaaggaaagtgaaagggaacgaggaagtaggaatgcccacgctcgttgactccgtgggtgaatacagcagttaggacatacacaccatcacctttgaaagtgcttgtttgggggagggaaggacatacgggtaactagaactacccagcgagtcgtccagaggagaggatcaggtttgagtcaggaggctccctgtactggagtcgtcccactattcctcaagaaatcttagaaccagcttgtgaggaaaaacattttttaatgtaataaaaatatgccattattctttgaaatgccaaatgatataaatattttgcctaatacatatttattgtagatgaaatgcactcttctcgatgaggcctcgatttgaatcaatggggtgggccacaggaaatgtcagaggaaccagaactcagaactcttcctcctggacctttcttcccttcccttggaggtatccctttgaatcaggcctctctcttctcatcagtctgtagcttccccccttgtataacctgctttcctttttacatttattaaaagtggattttgtaaaagcatttcattgacacgcgacctatcacagacaatggaattcgtcagtggtggtaagactgaaatcctgatgcttttcacacttcttgtctcttgctatgtatttctgcctctagccttgccatgttttgccttttttttttctttttggccaattcctttttatatgtgcccacaacagaggtggggagacacggagcaccctgggtccttcccagcgctgctgggcaggccccgtctccaggccccagctgttgaaactttgaagggcaacaaacaaccatccacactgccggaccctaggctgttcagggaggcagctcatttccaccccggccccaggacacccagcctgtgccccacaaggatctctctaaatgggagggattgaggctacttttctgccaagccctattaagtagtaatgtggggaaacccactgtgtcagtgcaggaagccctagacaaatgttttcaaataaatttcactgcccagcctgcacagatttccatttgaagtacttcccatccaccctgacacccaaaggggtttttttgttttgttttgtttttgagacagggtcttgctttgttgcccaggctggagtgcagtgacgtggtcatagctcactgcagcctcaacctcctgggctcaagtgaccctcctgcctcagcctcccaaagttctgagatgataggcatgagccattgtgcctagcctattttgatttttttcttagagtcaaggtcttgctctgttgcccaggctgatcttggacttgcgagccaccatgcctggctgggttttttaaaaatagaatctcactgatagcctgcaagaaacagatgcagtgcctgcttccgtatcagtccaaggagccctcgtgtttgccacctttacctttgaacctccccctgcctccctgcctgtgtccgcttttgcagctcaatgcagccatgacaaggaaagaaaagacaaaggaaggccagagagccgcgcagttctctgcaggtgcagatgcaggcagtggaggtggcctgagcaggcagaaggacaccaagcgccctatgttgcttgtcattcatgacgtggtcttggagcttctgactagttcagactgccacgccaaccccagaaaataccccacatgccagaaaagtgaagtcctaggtgtttccatctatgtttcaatctgtccatctaccaggcctcgcgataaaaacaaaacaaaaaaacgctgccaggttttagaagcagttctggtctcaaaaccatcaggatcctgccaccagggttcttttgaaatagtaccacatgtaaaagggaatttggctttcacttcatctaatcactgaattgtcaggctttgattgataattgtagaaataagtagccttctgttgtgggaataagttataatcagtattcatctctttgttttttgtcactcttttctctctaattgtgtcatttgtactgtttgaaaaatatttcttctataaaattaaactaacctgccttaagaacaga

SEQ ID NO: 200392 - DNA, 3768 bp, Homo sapiens
  Payload ID: 19530
  Gene Name: WWC family member 3
  ENST ID: ENST00000454666
  CDS Start-End: 1-3651
atgccttggctgagcggcggccggcggcgacggcggggacagccgcgcgaggccccgcgggagccgccgccttctgcgcagccccagcgggaaccgccgccggcgccccccgccgcggtccccacgcccccagctccttccgcgccgccgccgcgggcccgggagagcgccgagctgccgctgcccgccggctgggaggaggcgcgagactacgacggtcgcgtcttttacattgaccacaacacgcgccagacgtcgtggatcgacccccgcgaccggataacaaagccattgacctttgccgattgtgttggggacgaacttcctttaggatgggaaaccgtatatgataaacaaattggagtttattacatggaccacataaataaacttacccagattgaggatccaagagaacagtggaggcgagagcaagagcgcatgttgaaggaatatttaattgtagctcaggaggctctcaatgccaagaaagaaatctaccagattaagcagcagcggttcgagctggcccaggaggaataccagcagctgcacaaaatgtgtgaggatgacagccgctcgtacgccagctcattctctggatattcaacaaatacaaagtatgacccacaccaaattaaagcagaaatagcaagtcgtcgggataggctttccagattaaaacgagagctgacccagatgaagcaggaactgcagtacaaagaaaagggggtggagaccctgcaagagattgatcggaagatgtcaagtactcacaccagctacaaactggatgaggcgcaggctatcatgagtgagctccggaccatcaagaaggccatttgcacaggcgagaaggagaggcgggacctgatgcatagcctggccaagctgaccgatagcttcaagaacagctgctccgttaccgactctctagtggacttccctcaccatgtaggcgtgcctggcgatgctggtgtaccccagcagttctgcgatgccggctcccagactgatatcatcggggagtttgtctttgatgataaaacaagacttgtagaccgagtcagacttaattggcaatatgaagaagccagaaagagagtcgccaacatccagcagcagctggcccggcttgacaatgagtcctggccaagcacggccgaggctgacagggaccggctgcagctcatcaaggagaaggaggccctgctgcaggagcttcagctcatcattgcacagcgccgctctgcgggagatgtggcccggctggaggaggagcgggagcgcctagaggaggagctgcggcgtgcacgggccacctccgcacagggcgccacggagaggattctgcttcaggaaaaaaggaattgtctacttatgcagctggaagaagccacccgcttaacatcctacctccagtcccagttaaaaagcctgtgtgccagcaccctgacggtgtcctcggggagcagccgcgggtccctagcctccagccgtgggtctctggcctccagccggggctccctgagctcggtcagcttcacggacatctacggcctcccgcagtacgagaagcccgacgctgagggcagccagcttctacgcttcgacctcattcccttcgactctctggggcgagatgctcccttttcagagcccccaggcccctcgggcttccacaagcagaggcggtccctggacacgccccagtccctggcatcgctgtcctcccgctcctcgctgtcctcgctgtcgcccccaagctcgcccctggacacgcccttcctccctgcctcacgggactcgccgctggcgcagctggcggacagctgtgaggggccaggcctgggcgccctagacagactgcgggcacacgcctcggctatgggggacgaagacttaccaggcatggcggcccttcagccacacggggtccccggggatggggaagggccgcacgagcgaggacccccaccagccagcgctcccgtgggtggaacagtgactcttcgagaagacagtgccaagaggttggagaggagggcacgccgcatctccgcatgtctgtcggattattcgctagccagcgacagtggggtgtttgaacctctaaccaaaaggaacgaagatgccgaggagcctgcctacggagacacggccagtaacggagatccccagatccacgtgggactcctgcgcgacagtggcagcgagtgtctcctcgtgcacgtgctgcagctgaagaacccggcggggctggcggtgaaggaagactgcaaagtccacatccgagtctatttgcccccactggactcgggcacgcccaacacttactgctccaaggctctggagttccaagtgccgctggtgtttaacgaagtgttcagaatccccgtgcattccagcgcgttgacactgaagtcacttcagttatacgtgtgttcagtgactccgcagctgcaggaagaactgctgggcattgctcagattaacctggctgactatgacagtttgagtgagatgcagctgcgctggcattccgtgcaggtgttcaccagctctgaaccatcaaggacgcgggaggctgggtgtgcaggagagagctccgcccgggaccctgcacacaccatctccatctccggcaagacggatgcggtgacggtgctcctggccagaaccacggcacagctgcaggcggtggagagggaactggccgaggagcgggccaagctggagtacacggaggaggaggtcctggagatggagcgcaaggaggagcaggccgaggccatatccgagcggagttggcaagcggactcggtggatagcggctgtagcaactgcacccagaccagccctccgtacccagagccctgttgcatgggtatcgactccatcctgggccacccatttgctgctcaggcagggccttacagccccgagaaatttcagccctcgcctcttaaggttgataaggaaaccaacacggaagatctctttctggaagaagcagccagcctcgtgaaggagcggcccagccgccgggcccgagggtcgccttttgttcggagtggcacgattgtccgttcccagacattctcgcctggagcacgaagccagtatgtttgcagactttatcgtagtgacagcgacagttcaacgctgccccggaagtccccctttgtccgaaatactttggaaagacgaacccttcgctataagcagtcatgcaggtcttccctggctgagctcatggcccgcacctccctggacttggagctggatctccaggcgtcgagaacacggcagaggcagctgaatgaggagctctgcgccctccgtgagctgcggcagcggttggaggacgcccagctccgtggccagactgacctcccaccctgggtgcttcgggacgagcggctccgtggcctgctgcgggaggccgagcggcagacaagacagaccaaacttgactaccgtcatgagcaggcggctgagaagatgctgaagaaggcctccaaggagatctaccagctgcgtgggcagagccacaaagagcccatccaagtgcagacctttagggagaagatagcattcttcacaaggccaaggatcaacatacctcctctcccagccgacgacgtctgatggagtgcattgtgcacatgaagtatttatccacctgttttattttcatgaagttcttagactagctgaatttgtctttaaaatatttgtgcaaagctattaatatacacattttgt

SEQ ID NO: 200393 - DNA, 474 bp, Homo sapiens
  Payload ID: 19531
  Gene Name: X antigen family, member 1A
  Uniprot ID: Q9HD64
  ENST ID: ENST00000375600
  CDS Start-End: 125-334
gggaacgcggcggagctgtgagccggcgactcgggtccctgaggtctggattctttctccgctactgagacacggcggacacacacaaacacagaaccacacagccagtcccaggagcccagtaatggagagccccaaaaagaagaaccagcagctgaaagtcgggatcctacacctgggcagcagacagaagaagatcaggatacagctgagatcccaggtgctgggaagggaaatgcgcgacatggaaggtgatctgcaagagctgcatcagtcaaacaccggggataaatctggatttgggttccggcgtcaaggtgaagataatacctaaagaggaacactgtaaaatgccagaagcaggtgaagagcaaccacaagtttaaatgaagacaagctgaaacaacgcaagctggttttatattagatatttgacttaaactatctcaataaagttttgcagctttcaccaaa

SEQ ID NO: 200394 - DNA, 614 bp, Homo sapiens
  Payload ID: 19531
  Gene Name: X antigen family, member 1A
  Uniprot ID: Q9HD64
  ENST ID: ENST00000375602
  CDS Start-End: 281-526
ggacctgggaaggagcataggacagggcaaggcgggataaggaggggcaccacagcccttaaggcacgagggaacctcactgcgcatgctcctttggtgcccacctcagtgcgcatgttcactgggcgtcttcccatcggccccttcgccagtgtggggaacgcggcggagctgtgagccggcgactcgggtccctgaggtctggattctttctccgctactgagacacggcggacacacacaaacacagaaccacacagccagtcccaggagcccagtaatggagagccccaaaaagaagaaccagcagctgaaagtcgggatcctacacctgggcagcagacagaagaagatcaggatacagctgagatcccagtgcgcgacatggaaggtgatctgcaagagctgcatcagtcaaacaccggggataaatctggatttgggttccggcgtcaaggtgaagataatacctaaagaggaacactgtaaaatgccagaagcaggtgaagagcaaccacaagtttaaatgaagacaagctgaaacaacgcaagctggttttatattagatatttgacttaaactatctcaataaagttttgcagctttcaccaaa

SEQ ID NO: 200395 - DNA, 474 bp, Homo sapiens; identical to SEQ ID NO: 200393
  Payload ID: 19532
  Gene Name: X antigen family, member 1B
  Uniprot ID: Q9HD64
  ENST ID: ENST00000375613
  CDS Start-End: 125-334

SEQ ID NO: 200396 - DNA, 614 bp, Homo sapiens; identical to SEQ ID NO: 200394
  Payload ID: 19532
  Gene Name: X antigen family, member 1B
  Uniprot ID: Q9HD64
  ENST ID: ENST00000375616
  CDS Start-End: 281-526

SEQ ID NO: 200397 - DNA, 472 bp, Homo sapiens
  Payload ID: 19532
  Gene Name: X antigen family, member 1B
  Uniprot ID: Q9HD64
  ENST ID: ENST00000518075
  CDS Start-End: 142-387
cctagactaaccagtttgtgttggtcctccgctgagctgttaatccagggaagagttgcccttctgaagaatatgtggatttaatggagaccaagacacacacaaacacagaaccacacagccagtcccaggagcccagtaatggagagccccaaaaagaagaaccagcagctgaaagtcgggatcctacacctgggcagcagacagaagaagatcaggatacagctgagatcccagtgcgcgacatggaaggtgatctgcaagagctgcatcagtcaaacaccggggataaatctggatttgggttccggcgtcaaggtgaagataatacctaaagaggaacactgtaaaatgccagaagcaggtgaagagcaaccacaagtttaaatgaagacaagctgaaacaacgcaagctggttttatattagatatttgacttaaactatctcaataaagttttgcagctttcacc

SEQ ID NO: 200398 - DNA, 618 bp, Homo sapiens
  Payload ID: 19533
  Gene Name: X antigen family, member 2
  Uniprot ID: Q96GT9
  ENST ID: ENST00000286049
  CDS Start-End: 194-529
gttccttggacacctgcctcagtgtgcatgttcactgggcatcttcccttcgacccctttgcccacgtggtgaccgctggggagctgtgagagtgtgaggggcacgttccagccgtctggactctttctctcctactgagacgcagcctataggtccgcaggccagtcctcccaggaactgaaatagtgaaatatgagttggcgaggaagatcaacatataggcctaggccaagaagaagtttacagcctcctgagctgattggggctatgcttgaacccactgatgaagagcctaaagaagagaaaccacccactaaaagtcggaatcctacacctgatcagaagagagaagatgatcagggtgcagctgagattcaagtgcctgacctggaagccgatctccaggagctatgtcagacaaagactggggatggatgtgaaggtggtactgatgtcaaggggaagattctaccaaaagcagagcactttaaaatgccagaagcaggtgaagggaaatcacaggtttaaaggaagataagctgaaacaacacaaactgtttttatattagatattttactttaaaatatcttaataaagttttaagcttttctccaaa

SEQ ID NO: 200399 - DNA, 497 bp, Homo sapiens
  Payload ID: 19534
  Gene Name: X antigen family, member 3
  Uniprot ID: Q8WTP9
  ENST ID: ENST00000346279
  CDS Start-End: 72-407
gtgagggtgtgagggtcgcgttcctgctgtctggactttttctgtcccactgagacgcagctgtgtgaaatatgatttggcgaggaagatcaacatataggcctaggccgaggagaagtgtaccacctcctgagctgattgggcctatgctggagcccggtgatgaggagcctcagcaagaggaaccaccaactgaaagtcgggatcctgcacctggtcaggagagagaagaagatcagggtgcagctgagactcaagtgcctgacctggaagctgatctccaggagctgtctcagtcaaagactgggggtgaatgtggaaatggtcctgatgaccaggggaagattctgccaaaatcagaacaatttaaaatgccagaaggaggtgacaggcaaccacaggtttaaatgaagacaagctgaaacaacacaaaactgtttttatctaagatatttgacttaaaaatatcgaaataaacttttgcagctttctccaaa

SEQ ID NO: 200400 - DNA, 489 bp, Homo sapiens
  Payload ID: 19534
  Gene Name: X antigen family, member 3
  Uniprot ID: Q8WTP9
  ENST ID: ENST00000375491
  CDS Start-End: 61-396
aagcattcagaaggcacacatacttacacttgccctgagacttagttcgaaatgtgaaatatgatttggcgaggaagatcaacatataggcctaggccgaggagaagtgtaccacctcctgagctgattgggcctatgctggagcccggtgatgaggagcctcagcaagaggaaccaccaactgaaagtcgggatcctgcacctggtcaggagagagaagaagatcagggtgcagctgagactcaagtgcctgacctggaagctgatctccaggagctgtctcagtcaaagactgggggtgaatgtggaaatggtcctgatgaccaggggaagattctgccaaaatcagaacaatttaaaatgccagaaggaggtgacaggcaaccacaggtttaaatgaagacaagctgaaacaacacaaaactgtttttatctaagatatttgacttaaaaatatcgaaataaacttttgcagctttctccaaagaa

SEQ ID NO: 200401 - DNA, 478 bp, Homo sapiens
  Payload ID: 19535
  Gene Name: X antigen family, member 5
  Uniprot ID: Q8WWM1
  ENST ID: ENST00000351072
  CDS Start-End: 67-393
tggaagtgctcaagtgtggtatacactcaggtgcatttttccaatcacaatattctggactgaaatatgagttggcgaggaagaagatatagaccaagacgatgtttacgacttgctcagctggttgggcctatgcttgagcccagtgtgccagagcctcaacaagaagaaccaccaactgaaagtcaggatcatacacctggtcagaagagagaagatgatcagggtgcagctgagattcaagtgcctaacctggaagctgatctccaggagctgtctcagtcaaagactggggatgaatgcggagatagtcctgatgtccaggggaagattctgccaaaatcagagcaatttaaaatgccagaaggaggggaagggaaaccacagctttaaacgaagacaaccaaaagaatgcaaactggatttatccgagatatttgacttttaaaaatctcaataaagttttccagttttctcc

SEQ ID NO: 200402 - DNA, 415 bp, Homo sapiens
  Payload ID: 19535
  Gene Name: X antigen family, member 5
  Uniprot ID: Q8WWM1
  ENST ID: ENST00000375501
  CDS Start-End: 1-327
atgagttggcgaggaagaagatatagaccaagacgatgtttacgacttgctcagctggttgggcctatgcttgagcccagtgtgccagagcctcaacaagaagaaccaccaactgaaagtcaggatcatacacctggtcagaagagagaagatgatcagggtgcagctgagattcaagtgcctaacctggaagctgatctccaggagctgtctcagtcaaagactggggatgaatgcggagatagtcctgatgtccaggggaagattctgccaaaatcagagcaatttaaaatgccagaaggaggggaagggaaaccacagctttaaacgaagacaaccaaaagaatgcaaactggatttatccgagatatttgacttttaaaaatctcaataaagttttccagttttctccaaa

SEQ ID NO: 200403 - DNA, 870 bp, Homo sapiens
  Payload ID: 19535
  Gene Name: X antigen family, member 5
  ENST ID: ENST00000375503
  CDS Start-End: 364-591
tggaagtgctcaagtgtggtatacactcaggtgcatttttccaatcacaatattctggtttttgctttggtttggtttggcttttttgagacagagttttgctcttgttgcccaggctggagtgcaatggtgcaatctcggctggctgcaacattcgccccccggttcaagtggttctcctgcctcaacttcccgagtagctgggattacaggtgctcgctaccacacccagctacgtttttgtatttttagtagagacggggtttcaccattttggccaagctggcctcgagcttctgacctcaggtgatccatccccctcagcctcccaaagtgcacactattctgtttgcagactgaaatatgagttggcgaggaagaagatatagaccaagacgatgtttacgacttgctcagctggttgggcctatgcttgagcccagtgtgccagagcctcaacaagaagaaccaccaactgaaagtcaggatcatacacctggtcagaagagagaagatgatcagggtgcagctgagattcaaggtacttcgatattggctcaggacaaaacgcagttcagtgaaacaggatagcaactccagaaaagaggtcaatgaatgacagccactgtttcctttgatgtacatttttgacagcatgtttcgtaaaaggtggataattcaggatgttggcgtgcagtgcctaacctggaagctgatctccaggagctgtctcagtcaaagactggggatgaatgcggagatagtcctgatgtccaggggaagattctgccaaaatcagagcaatttaaaatgccagaaggaggggaagggaaaccacagctttaaacgaagacaaccaaaagaatgcaa

SEQ ID NO: 200404 - DNA, 5688 bp, Homo sapiens
  Payload ID: 19536
  Gene Name: xanthine dehydrogenase
  Uniprot ID: P47989
  ENST ID: ENST00000379416
  CDS Start-End: 50-4051
gtctcttaggagtgaggtacctggagttcggggaccccaacctgtgacaatgacagcagacaaattggttttctttgtgaatggcagaaaggtggtggagaaaaatgcagatccagagacaacccttttggcctacctgagaagaaagttggggctgagtggaaccaagctcggctgtggagaggggggctgcggggcttgcacagtgatgctctccaagtatgatcgtctgcagaacaagatcgtccacttttctgccaatgcctgcctggcccccatctgctccttgcaccatgttgcagtgacaactgtggaaggaataggaagcaccaagacgaggctgcatcctgtgcaggagagaattgccaaaagccacggctcccagtgcgggttctgcacccctggcatcgtcatgagtatgtacacactgctccggaatcagcccgagcccaccatggaggagattgagaatgccttccaaggaaatctgtgccgctgcacaggctacagacccatcctccagggcttccggacctttgccagggatggtggatgctgtggaggagatgggaataatccaaattgctgcatgaaccagaagaaagaccactcagtcagcctctcgccatctttattcaaaccagaggagttcacgcccctggatccaacccaggagcccatttttcccccagagttgctgaggctgaaagacactcctcggaagcagctgcgatttgaaggggagcgtgtgacgtggatacaggcctcaaccctcaaggagctgctggacctcaaggctcagcaccctgacgccaagctggtcgtggggaacacggagattggcattgagatgaagttcaagaatatgctgtttcctatgattgtctgcccagcctggatccctgagctgaattcggtagaacatggacccgacggtatctcctttggagctgcttgccccctgagcattgtggaaaaaaccctggtggatgctgttgctaagcttcctgcccaaaagacagaggtgttcagaggggtcctggagcagctgcgctggtttgctgggaagcaagtcaagtctgtggcgtccgttggagggaacatcatcactgccagccccatctccgacctcaaccccgtgttcatggccagtggggccaagctgacacttgtgtccagaggcaccaggagaactgtccagatggaccacaccttcttccctggctacagaaagaccctgctgagcccggaggagatactgctctccatagagatcccctacagcagggagggggagtatttctcagcattcaagcaggcctcccggagagaagatgacattgccaaggtaaccagtggcatgagagttttattcaagccaggaaccacagaggtacaggagctggccctttgctatggtggaatggccaacagaaccatctcagccctcaagaccactcagaggcagctttccaagctctggaaggaggagctgctgcaggacgtgtgtgcaggactggcagaggagctgcatctgcctcccgatgcccctggtggcatggtggacttccggtgcaccctcaccctcagcttcttcttcaagttctacctgacagtccttcagaagctgggccaagagaacctggaagacaagtgtggtaaactggaccccactttcgccagtgcaactttactgtttcagaaagaccccccagccgatgtccagctcttccaagaggtgcccaagggtcagtctgaggaggacatggtgggccggcccctgccccacctggcagcggacatgcaggcctctggtgaggccgtgtactgtgacgacattcctcgctacgagaatgagctgtctctccggctggtcaccagcacccgggcccacgccaagatcaagtccatagatacatcagaagctaagaaggttccagggtttgtttgtttcatttccgctgatgatgttcctgggagtaacataactggaatttgtaatgatgagacagtctttgcgaaggataaggttacttgtgttgggcatatcattggtgctgtggttgctgacaccccggaacacacacagagagctgcccaaggggtgaaaatcacctatgaagaactaccagccattatcacaattgaggatgctataaagaacaactccttttatggacctgagctgaagatcgagaaaggggacctaaagaaggggttttccgaagcagataatgttgtgtcaggggagatatacatcggtggccaagagcacttctacctggagactcactgcaccattgctgttccaaaaggcgaggcaggggagatggagctctttgtgtctacacagaacaccatgaagacccagagctttgttgcaaaaatgttgggggttccagcaaaccggattgtggttcgagtgaagagaatgggaggaggctttggaggcaaggagacccggagcactgtggtgtccacggcagtggccctggctgcatataagaccggccgccctgtgcgatgcatgctggaccgtgatgaggacatgctgataactggtggcagacatcccttcctggccagatacaaggttggcttcatgaagactgggacagttgtggctcttgaggtggaccacttcagcaatgtggggaacacccaggatctctctcagagtattatggaacgagctttattccacatggacaactgctataaaatccccaacatccggggcactgggcggctgtgcaaaaccaaccttccctccaacacggccttccggggctttggggggccccaggggatgctcattgccgagtgctggatgagtgaagttgcagtgacctgtgggatgcctgcagaggaggtgcggagaaaaaacctgtacaaagaaggggacctgacacacttcaaccagaagcttgagggtttcaccttgcccagatgctgggaagaatgcctagcaagctctcagtatcatgctcggaagagtgaggttgacaagttcaacaaggagaattgttggaaaaagagaggattgtgcataattcccaccaagtttggaataagctttacagttccttttctgaatcaggcaggagccctacttcatgtgtacacagatggctctgtgctgctgacccacggggggactgagatgggccaaggccttcataccaaaatggtccaggtggccagtagagctctgaaaatccccacctctaagatttatatcagcgagacaagcactaacactgtgcccaacacctctcccacggctgcctctgtcagcgctgacctcaatggacaggccgtctatgcggcttgtcagaccatcttgaaaaggctggaaccctacaagaagaagaatcccagtggctcctgggaagactgggtcacagctgcctacatggacacagtgagcttgtctgccactgggttttatagaacacccaatctgggctacagctttgagactaactcagggaaccccttccactacttcagctatggggtggcttgctctgaagtagaaatcgactgcctaacaggagatcataagaacctccgcacagatattgtcatggatgttggctccagtctaaaccctgccattgatattggacaggtggaaggggcatttgtccagggccttggcctcttcaccctagaggagctacactattcccccgaggggagcctgcacacccgtggccctagcacctacaagatcccggcatttggcagcatccccattgagttcagggtgtccctgctccgcgactgccccaacaagaaggccatctatgcatcgaaggctgttggagagccgcccctcttcctggctgcttctatcttctttgccatcaaagatgccatccgtgcagctcgagctcagcacacaggtaataacgtgaaggaactcttccggctagacagccctgccaccccggagaagatccgcaatgcctgcgtggacaagttcaccaccctgtgtgtcactggtgtcccagaaaactgcaaaccctggtctgtgagggtctaaagagagagtcctcagcagagtcttcttgtgctgcctttgggcttccatggagcaggaggaacataccacagaacatggatctattaaagtcacagaatgacagacctgtgatttgtcaagatgggatttggaagacaagtgaatgcaatggaagattttgatcaaaaatgtaatttgtaaacacaatgataagcaaattcaaaactgttatgcctaaatggtgaatatgcaattaggatcattttctgtctgttttaatcatgtatctggaatagggtcgggaagggtttgtgctattccccacttactggacagcctgtataacctcaagttctgatggtgtctgtcctttgaagaggattcccacaaacctctagaagcttaaaccgaagttactttaaatcgtgtgccttcctgtgaaagcctggccttcaaaccaatgaacagcaaagcataaccttgaatctatactcaaattttgcaatgaggcagtggggtaaggttaaatcctctaaccatctttgaatcattggaaagaataaagaatgaaacaaattcaaggttaattggatctgattttgtgaagctgcataaagcaagattactctataatacaaaaatccaaccaactcaattattgagcacgtacaatgttctagatttctttcccttcctctttgaagagaatatttgtattccaaatactctttgagtatttacaaaaaagattatgtttaatctttacatttgaagccaaagtaatttccacctagaaatgatgctatcagtcctggcatggtggctcacccctataatcccagcactttgggaggctaaggcaggagaattgcttgagcccagcagtttgagaccagcctgggcaacatagagagctcctgtctttaaaaaaaatttttttaattagttggtcttgatagtgcatgcctgtagtcccaactacttgaaaggctgaggtggagagatcatttgagctcaggaggttgaggctgcagtgagctatgattgcgccactgcactcctgcctgagcgactgagcaagatcttgtctctgaagaaaaaaaaagaaataaaaatgctgctatcaaaatcaagcccaaccagaggtagaagagccaagaagcctgggttctcatcctagctctgtctcttctgtctctatctttgtgatcttggactgtcaattccccttcctgtgatccattttactgcaaacataagggttgcagtaaagggttgtctcacgtcttctgctttaaaagcctataaatatatgacctgaaaactccagttacataaaggatctgcagctatctaaggcttggttttcttactgtcatatgatacctgggtctaatgaactctgctgagatcacctcaagtttctgcggttggtaaagagaacaagggaagaacaaacatcccttttattgctccaaatggtgatttaatccctacatggtgctgggtggacaatgtgtcactgtcacatgccttcactgtataaatccaaccttctgccagagagaatctgtggttctggccatggagggaggatagtggaaatgatatagttggactggtgcttgatgtcactaataaatgaaactgtcagctgg

SEQ ID NO: 200405 - DNA, 1850 bp, Homo sapiens
  Payload ID: 19537
  Gene Name: X-box binding protein 1
  Uniprot ID: P17861
  ENST ID: ENST00000216037
  CDS Start-End: 74-859
agaaaggccgggcgcggcgaggctgggcgctgggcggctgcggcgcgcggtgcgcggtgcgtagtctggagctatggtggtggtggcagccgcgccgaacccggccgacgggacccctaaagttctgcttctgtcggggcagcccgcctccgccgccggagccccggccggccaggccctgccgctcatggtgccagcccagagaggggccagcccggaggcagcgagcggggggctgccccaggcgcgcaagcgacagcgcctcacgcacctgagccccgaggagaaggcgctgaggaggaaactgaaaaacagagtagcagctcagactgccagagatcgaaagaaggctcgaatgagtgagctggaacagcaagtggtagatttagaagaagagaaccaaaaacttttgctagaaaatcagcttttacgagagaaaactcatggccttgtagttgagaaccaggagttaagacagcgcttggggatggatgccctggttgctgaagaggaggcggaagccaaggggaatgaagtgaggccagtggccgggtctgctgagtccgcagcactcagactacgtgcacctctgcagcaggtgcaggcccagttgtcacccctccagaacatctccccatggattctggcggtattgactcttcagattcagagtctgatatcctgttgggcattctggacaacttggacccagtcatgttcttcaaatgcccttccccagagcctgccagcctggaggagctcccagaggtctacccagaaggacccagttccttaccagcctccctttctctgtcagtggggacgtcatcagccaagctggaagccattaatgaactaattcgttttgaccacatatataccaagcccctagtcttagagataccctctgagacagagagccaagctaatgtggtagtgaaaatcgaggaagcacctctcagcccctcagagaatgatcaccctgaattcattgtctcagtgaaggaagaacctgtagaagatgacctcgttccggagctgggtatctcaaatctgctttcatccagccactgcccaaagccatcttcctgcctactggatgcttacagtgactgtggatacgggggttccctttccccattcagtgacatgtcctctctgcttggtgtaaaccattcttgggaggacacttttgccaatgaactctttccccagctgattagtgtctaaggaatgatccaatactgttgcccttttccttgactattacactgcctggaggatagcagagaagcctgtctgtacttcattcaaaaagccaaaatagagagtatacagtcctagagaattcctctatttgttcagatctcatagatgacccccaggtattgtcttttgacatccagcagtccaaggtattgagacatattactggaagtaagaaatattactataattgagaactacagcttttaagattgtacttttatcttaaaagggtggtagttttccctaaaatacttattatgtaagggtcattagacaaatgtcttgaagtagacatggaatttatgaatggttctttatcatttctcttccccctttttggcatcctggcttgcctccagttttaggtcctttagtttgcttctgtaagcaacgggaacacctgctgagggggctctttccctcatgtatacttcaagtaagatcaagaatcttttgtgaaattatagaaatttactatgtaaatgcttgatggaattttttcctgctagtgtagcttctgaaaggtgctttctccatttatttaaaactacccatgcaattaaaaggtacaatgcagcatc

SEQ ID NO: 200406 - DNA, 1131 bp, Homo sapiens
  Payload ID: 19537
  Gene Name: X-box binding protein 1
  Uniprot ID: P17861
  ENST ID: ENST00000344347
  CDS Start-End: 1-1131
atggtggtggtggcagccgcgccgaacccggccgacgggacccctaaagttctgcttctgtcggggcagcccgcctccgccgccggagccccggccggccaggccctgccgctcatggtgccagcccagagaggggccagcccggaggcagcgagcggggggctgccccaggcgcgcaagcgacagcgcctcacgcacctgagccccgaggagaaggcgctgaggaggaaactgaaaaacagagtagcagctcagactgccagagatcgaaagaaggctcgaatgagtgagctggaacagcaagtggtagatttagaagaagagaaccaaaaacttttgctagaaaatcagcttttacgagagaaaactcatggccttgtagttgagaaccaggagttaagacagcgcttggggatggatgccctggttgctgaagaggaggcggaagccaaggggaatgaagtgaggccagtggccgggtctgctgagtccgcagcaggtgcaggcccagttgtcacccctccagaacatctccccatggattctggcggtattgactcttcagattcagagtctgatatcctgttgggcattctggacaacttggacccagtcatgttcttcaaatgcccttccccagagcctgccagcctggaggagctcccagaggtctacccagaaggacccagttccttaccagcctccctttctctgtcagtggggacgtcatcagccaagctggaagccattaatgaactaattcgttttgaccacatatataccaagcccctagtcttagagataccctctgagacagagagccaagctaatgtggtagtgaaaatcgaggaagcacctctcagcccctcagagaatgatcaccctgaattcattgtctcagtgaaggaagaacctgtagaagatgacctcgttccggagctgggtatctcaaatctgctttcatccagccactgcccaaagccatcttcctgcctactggatgcttacagtgactgtggatacgggggttccctttccccattcagtgacatgtcctctctgcttggtgtaaaccattcttgggaggacacttttgccaatgaactctttccccagctgattagtgtctaa

SEQ ID NO: 200407 - DNA, 1690 bp, Homo sapiens
  Payload ID: 19537
  Gene Name: X-box binding protein 1
  ENST ID: ENST00000405219
  CDS Start-End: 98-733
ccggactgaccggatccgccacgctgggaacctagggcggcccagggctcttttctgtactttttaactctctcgttagagatgaccagagctggggatgcgggcacctgtcttccaggccctcttgctgtgtggccgcagactggtggttcagcctcttaactcggacatgaggaaactgaaaaacagagtagcagctcagactgccagagatcgaaagaaggctcgaatgagtgagctggaacagcaagtggtagatttagaagaagagaaccaaaaacttttgctagaaaatcagcttttacgagagaaaactcatggccttgtagttgagaaccaggagttaagacagcgcttggggatggatgccctggttgctgaagaggaggcggaagccaaggggaatgaagtgaggccagtggccgggtctgctgagtccgcagcactcagactacgtgcacctctgcagcaggtgcaggcccagttgtcacccctccagaacatctccccatggattctggcggtattgactcttcagattcagagtctgatatcctgttgggcattctggacaacttggacccagtcatgttcttcaaatgcccttccccagagcctgccagcctggaggagctcccagaggtctacccagaaggacccagttccttaccagcctccctttctctgtcagtggggacgtcatcagccaagctggaagccattaatgaactaattcgttttgaccacatatataccaagcccctagtcttagagataccctctgagacagagagccaagctaatgtggtagtgaaaatcgaggaagcacctctcagcccctcagagaatgatcaccctgaattcattgtctcagtgaaggaagaacctgtagaagatgacctcgttccggagctgggtatctcaaatctgctttcatccagccactgcccaaagccatcttcctgcctactggatgcttacagtgactgtggatacgggggttccctttccccattcagtgacatgtcctctctgcttggtgtaaaccattcttgggaggacacttttgccaatgaactctttccccagctgattagtgtctaaggaatgatccaatactgttgcccttttccttgactattacactgcctggaggatagcagagaagcctgtctgtacttcattcaaaaagccaaaatagagagtatacagtcctagagaattcctctatttgttcagatctcatagatgacccccaggtattgtcttttgacatccagcagtccaaggtattgagacatattactggaagtaagaaatattactataattgagaactacagcttttaagattgtacttttatcttaaaagggtggtagttttccctaaaatacttattatgtaagggtcattagacaaatgtcttgaagtagacatggaatttatgaatggttctttatcatttctcttccccctttttggcatcctggcttgcctccagttttaggtcctttagtttgcttctgtaagcaacgggaacacctgctgagggggctctttccctcatgtatacttcaagtaagatcaagaatcttttgtgaaattatagaaatttactatgtaaatgcttgatggaattttttcctgctagtgtagcttctgaaaggtgctttctccatttatttaaaa

SEQ ID NO: 200408 - DNA, 1824 bp, Homo sapiens
  Payload ID: 19537
  Gene Name: X-box binding protein 1
  ENST ID: ENST00000403532
  CDS Start-End: 35-835
gcggcgcgcggtgcgcggtgcgtagtctggagctatggtggtggtggcagccgcgccgaacccggccgacgggacccctaaagttctgcttctgtcggggcagcccgcctccgccgccggagccccggccggccaggccctgccgctcatggtgccagcccagagaggggccagcccggaggcagcgagcggggggctgccccaggcgcgcaagcgacagcgcctcacgcacctgagccccgaggagaaggcgctgaggaggaaactgaaaaacagagtagcagctcagactgccagagatcgaaagaaggctcgaatgagtgagctggaacagcaagtggtagatttagaagaagaggtaaaactacttaagaaccaaaaacttttgctagaaaatcagcttttacgagagaaaactcatggccttgtagttgagaaccaggagttaagacagcgcttggggatggatgccctggttgctgaagaggaggcggaagccaaggggaatgaagtgaggccagtggccgggtctgctgagtccgcagcactcagactacgtgcacctctgcagcaggtgcaggcccagttgtcacccctccagaacatctccccatggattctggcggtattgactcttcagattcagagtctgatatcctgttgggcattctggacaacttggacccagtcatgttcttcaaatgcccttccccagagcctgccagcctggaggagctcccagaggtctacccagaaggacccagttccttaccagcctccctttctctgtcagtggggacgtcatcagccaagctggaagccattaatgaactaattcgttttgaccacatatataccaagcccctagtcttagagataccctctgagacagagagccaagctaatgtggtagtgaaaatcgaggaagcacctctcagcccctcagagaatgatcaccctgaattcattgtctcagtgaaggaagaacctgtagaagatgacctcgttccggagctgggtatctcaaatctgctttcatccagccactgcccaaagccatcttcctgcctactggatgcttacagtgactgtggatacgggggttccctttccccattcagtgacatgtcctctctgcttggtgtaaaccattcttgggaggacacttttgccaatgaactctttccccagctgattagtgtctaaggaatgatccaatactgttgcccttttccttgactattacactgcctggaggatagcagagaagcctgtctgtacttcattcaaaaagccaaaatagagagtatacagtcctagagaattcctctatttgttcagatctcatagatgacccccaggtattgtcttttgacatccagcagtccaaggtattgagacatattactggaagtaagaaatattactataattgagaactacagcttttaagattgtacttttatcttaaaagggtggtagttttccctaaaatacttattatgtaagggtcattagacaaatgtcttgaagtagacatggaatttatgaatggttctttatcatttctcttccccctttttggcatcctggcttgcctccagttttaggtcctttagtttgcttctgtaagcaacgggaacacctgctgagggggctctttccctcatgtatacttcaagtaagatcaagaatcttttgtgaaattatagaaatttactatgtaaatgcttgatggaattttttcctgctagtgtagcttctgaaaggtgctttctccatttatttaaaactacccatgcaattaaaaggtacaatgcagca

SEQ ID NO: 200409 - DNA, 1794 bp, Homo sapiens
  Payload ID: 19537
  Gene Name: X-box binding protein 1
  Uniprot ID: P17861
  ENST ID: ENST00000611155
  CDS Start-End: 49-1179
ggcgctgggcggctgcggcgcgcggtgcgcggtgcgtagtctggagctatggtggtggtggcagccgcgccgaacccggccgacgggacccctaaagttctgcttctgtcggggcagcccgcctccgccgccggagccccggccggccaggccctgccgctcatggtgccagcccagagaggggccagcccggaggcagcgagcggggggctgccccaggcgcgcaagcgacagcgcctcacgcacctgagccccgaggagaaggcgctgaggaggaaactgaaaaacagagtagcagctcagactgccagagatcgaaagaaggctcgaatgagtgagctggaacagcaagtggtagatttagaagaagagaaccaaaaacttttgctagaaaatcagcttttacgagagaaaactcatggccttgtagttgagaaccaggagttaagacagcgcttggggatggatgccctggttgctgaagaggaggcggaagccaaggggaatgaagtgaggccagtggccgggtctgctgagtccgcagcaggtgcaggcccagttgtcacccctccagaacatctccccatggattctggcggtattgactcttcagattcagagtctgatatcctgttgggcattctggacaacttggacccagtcatgttcttcaaatgcccttccccagagcctgccagcctggaggagctcccagaggtctacccagaaggacccagttccttaccagcctccctttctctgtcagtggggacgtcatcagccaagctggaagccattaatgaactaattcgttttgaccacatatataccaagcccctagtcttagagataccctctgagacagagagccaagctaatgtggtagtgaaaatcgaggaagcacctctcagcccctcagagaatgatcaccctgaattcattgtctcagtgaaggaagaacctgtagaagatgacctcgttccggagctgggtatctcaaatctgctttcatccagccactgcccaaagccatcttcctgcctactggatgcttacagtgactgtggatacgggggttccctttccccattcagtgacatgtcctctctgcttggtgtaaaccattcttgggaggacacttttgccaatgaactctttccccagctgattagtgtctaaggaatgatccaatactgttgcccttttccttgactattacactgcctggaggatagcagagaagcctgtctgtacttcattcaaaaagccaaaatagagagtatacagtcctagagaattcctctatttgttcagatctcatagatgacccccaggtattgtcttttgacatccagcagtccaaggtattgagacatattactggaagtaagaaatattactataattgagaactacagcttttaagattgtacttttatcttaaaagggtggtagttttccctaaaatacttattatgtaagggtcattagacaaatgtcttgaagtagacatggaatttatgaatggttctttatcatttctcttccccctttttggcatcctggcttgcctccagttttaggtcctttagtttgcttctgtaagcaacgggaacacctgctgagggggctctttccctcatgtatacttcaagtaagatcaagaatcttttgtgaaattatagaaatttactatgtaaatgcttgatggaattttttcctgctagtgtagcttctgaaaggtgctttctccatttatttaaaactacccatgcaattaaaaggtacaatgca

SEQ ID NO: 200410 - DNA, 4126 bp, Homo sapiens
  Payload ID: 19538
  Gene Name: xenotropic and polytropic retrovirus receptor 1
  Uniprot ID: Q9UBH6
  ENST ID: ENST00000367589
  CDS Start-End: 171-2066
ggaggaagatggcgggcgggctgctctgaagagacctcggcggcggcggaggaggagagaagcgcagcgccgcgccgcgccggggcccatgtggggaggagtcggagtcgctgttgccgccgccgcctgtagctgctggacccgagtgggagtgagggggaaacggcaggatgaagttcgccgagcacctctccgcgcacatcactcccgagtggaggaagcaatacatccagtatgaggctttcaaggatatgctgtattcagctcaggaccaggcaccttctgtggaagttacagatgaggacacagtaaagaggtattttgccaagtttgaagagaagtttttccaaacctgtgaaaaagaacttgccaaaatcaacacattttattcagagaagctcgcagaggctcagcgcaggtttgctacacttcagaatgagcttcagtcatcactggatgcacagaaagaaagcactggtgttactacgctgcgacaacgcagaaagccagtcttccacttgtcccatgaggaacgtgtccaacatagaaatattaaagaccttaaactggccttcagtgagttctacctcagtctaatcctgctgcagaactatcagaatctgaattttacagggtttcgaaaaatcctgaaaaagcatgacaagatcctggaaacatctcgtggagcagattggcgagtggctcacgtagaggtggccccattttatacatgcaagaaaatcaaccagcttatctctgaaactgaggctgtagtgaccaatgaacttgaagatggtgacagacaaaaggctatgaagcgtttacgtgtcccccctttgggagctgctcagcctgcaccagcatggactacttttagagttggcctattttgtggaatattcattgtactgaatattacccttgtgcttgccgctgtatttaaacttgaaacagatagaagtatatggcccttgataagaatctatcggggtggctttcttctgattgaattcctttttctactgggcatcaacacgtatggttggagacaggctggagtaaaccatgtactcatctttgaacttaatccgagaagcaatttgtctcatcaacatctctttgagattgctggattcctcgggatattgtggtgcctgagccttctggcatgcttctttgctccaattagtgtcatccccacatatgtgtatccacttgccctttatggatttatggttttcttccttatcaaccccaccaaaactttctactataaatcccggttttggctgcttaaactgctgtttcgagtatttacagcccccttccataaggtaggctttgctgatttctggctggcggatcagctgaacagcctgtcagtgatactgatggacctggaatatatgatctgcttctacagtttggagctcaaatgggatgaaagtaagggcctgttgccaaataattcagaagaacgaggtcactcggacactatggtgttcttttacctgtggattgtcttttatatcatcagttcctgctataccctcatctgggatctcaagatggactggggtctcttcgataagaatgctggagagaacactttcctccgggaagagattgtatacccccaaaaagcctactactactgtgccataatagaggatgtgattctgcgctttgcttggactatccaaatctcgattacctctacaactttgttgcctcattctggggacatcattgctactgtctttgccccacttgaggttttccggcgatttgtgtggaacttcttccgcctggagaatgaacatctgaataactgtggtgaattccgtgctgtgcgggacatctctgtggcccccctgaacgcagatgatcagactctcctagaacagatgatggaccaggatgatggggtacgaaaccgccagaagaatcggtcatggaagtacaaccagagcatatccctgcgccggcctcgcctcgcttctcaatccaaggctcgtgacactaaggtattgatagaagacacagatgatgaagctaacacttgaattttctgaagtctagcttaacatctttggttttcctactctacaatcctttcctcgaccaacgcaacctctagtacctttccagccgaaaacaggagaaaacacataacacattttccgagctcttccggatcggatcctatggactccaaacaagctcactgtgtttcttttcttttcttctggtttaattttaattttctattttcaaaacaaatatttacttcatttgccaatcagaggatgttttaagaaacaaaacatagtatcttatggattgtttacaatcacaaggacatagatacctatcaggatgaagaacaggcattgcaaggaccctctgatgggacggtactgagatatctcggcttccgctcagcccggttttgactggttgaaaccggacattggtttttaaattttttgtcagtttatgtggagaatttttttctttccttcatacccagcgcaaaggcactggccgcacttgcaggaaaagtgcaacttaaagcagtaccttcattcatgaagctactttttaatttgatgtaacttttcttattttgggaagggttgctgggtgggtgggaaatatgatgtatttgttacacatagttttctcattatttatgaaacttaaccatacagaatgatataactcctgtgcaatgaaggtgataacagtaaaagaaggcaggggaaacttacgttggatgacatttatgagggtcagtcccacatacctctttcaggagacaacttgcaccagtttgaccttttcttttctttgtttttattttaagccaaagtttcattgctaacttcttaagttgctgctgctttagagtcctgagcatatctctcataacaaggaatcccacacttcacaccaccggctgaatttcatggaagaggttctgataatttttttaactttttaaggaacagatgtggaatacactggcccatatttcaaccttaacagctgaagctatgccttattatgcatccacatgtatggtccctgtagcgtgacctttactagctctgaatcagaagacagagctatttcagaggctctgtgtgccctcactagatagtttttcttctgggttcaaccactttagccagaatttgatcaaattaaaagtctgtcatggggaaactatatttttgagcacatggaacaaattatacttcctcattcatattatgttgatacaaaagaccttggcagccatttctcccagcagttttaaaggatgaacattggatttcatgccatcccatagaaaacctgttttaaaattttagggatctttacttggtcatacatgaaaagtacactgcttagaaattatagactattatgatctgtccacagtgcccattgtcacttctttgtctcatttcttccctttgttccttagtcatccaaataagcctgaaaaccataagagatattactttattgaatatggttggcattaaatttagcatttcattatctaacaaaattaatataaattccaggacatggtaaaatgtgttttaataacccccagacccaaatgaaaatttcaaagtcaataccagcagattcatgaaagtaaatttagtcctataattttcagcttaattataaacaaaggaacaaataagtggaagggcagctattaccattcgcttagtcaaaacattcggttactgccctttaatacactcctatcatcagcacttccaccatgtattacaagtcttgacccatccctgtcgtaactccagtaaaagttactgttactagaaaatttttatcaattaactgacaaatagtttctttttaaagtagtttcttccatctttattctgactagcttccaaaatgtgttccctttttgaatcgaggtttttttgttttgttttgttttctgaaaaaatcatacaactttgtgcttctattgcttttttgtgttttgttaagcatgtcccttggcccaaatggaagaggaaatgtttaattaatgctttttagtttaaataaattgaatcatttataataa

SEQ ID NO: 200411 - DNA, 8474 bp, Homo sapiens
  Payload ID: 19538
  Gene Name: xenotropic and polytropic retrovirus receptor 1
  Uniprot ID: Q9UBH6
  ENST ID: ENST00000367590
  CDS Start-End: 199-2289
gcggggaggggcggggctatggagaggaggaggaagatggcgggcgggctgctctgaagagacctcggcggcggcggaggaggagagaagcgcagcgccgcgccgcgccggggcccatgtggggaggagtcggagtcgctgttgccgccgccgcctgtagctgctggacccgagtgggagtgagggggaaacggcaggatgaagttcgccgagcacctctccgcgcacatcactcccgagtggaggaagcaatacatccagtatgaggctttcaaggatatgctgtattcagctcaggaccaggcaccttctgtggaagttacagatgaggacacagtaaagaggtattttgccaagtttgaagagaagtttttccaaacctgtgaaaaagaacttgccaaaatcaacacattttattcagagaagctcgcagaggctcagcgcaggtttgctacacttcagaatgagcttcagtcatcactggatgcacagaaagaaagcactggtgttactacgctgcgacaacgcagaaagccagtcttccacttgtcccatgaggaacgtgtccaacatagaaatattaaagaccttaaactggccttcagtgagttctacctcagtctaatcctgctgcagaactatcagaatctgaattttacagggtttcgaaaaatcctgaaaaagcatgacaagatcctggaaacatctcgtggagcagattggcgagtggctcacgtagaggtggccccattttatacatgcaagaaaatcaaccagcttatctctgaaactgaggctgtagtgaccaatgaacttgaagatggtgacagacaaaaggctatgaagcgtttacgtgtcccccctttgggagctgctcagcctgcaccagcatggactacttttagagttggcctattttgtggaatattcattgtactgaatattacccttgtgcttgccgctgtatttaaacttgaaacagatagaagtatatggcccttgataagaatctatcggggtggctttcttctgattgaattcctttttctactgggcatcaacacgtatggttggagacaggctggagtaaaccatgtactcatctttgaacttaatccgagaagcaatttgtctcatcaacatctctttgagattgctggattcctcgggatattgtggtgcctgagccttctggcatgcttctttgctccaattagtgtcatccccacatatgtgtatccacttgccctttatggatttatggttttcttccttatcaaccccaccaaaactttctactataaatcccggttttggctgcttaaactgctgtttcgagtatttacagcccccttccataaggtaggctttgctgatttctggctggcggatcagctgaacagcctgtcagtgatactgatggacctggaatatatgatctgcttctacagtttggagctcaaatgggatgaaagtaagggcctgttgccaaataattcagaagaatcaggaatttgccacaaatatacatatggtgtgcgggccattgttcagtgcattcctgcttggcttcgcttcatccagtgcctgcgccgatatcgagacacaaaaagggcctttcctcatttagttaatgctggcaaatactccacaactttcttcatggtgacgtttgcagccctttacagcactcacaaagaacgaggtcactcggacactatggtgttcttttacctgtggattgtcttttatatcatcagttcctgctataccctcatctgggatctcaagatggactggggtctcttcgataagaatgctggagagaacactttcctccgggaagagattgtatacccccaaaaagcctactactactgtgccataatagaggatgtgattctgcgctttgcttggactatccaaatctcgattacctctacaactttgttgcctcattctggggacatcattgctactgtctttgccccacttgaggttttccggcgatttgtgtggaacttcttccgcctggagaatgaacatctgaataactgtggtgaattccgtgctgtgcgggacatctctgtggcccccctgaacgcagatgatcagactctcctagaacagatgatggaccaggatgatggggtacgaaaccgccagaagaatcggtcatggaagtacaaccagagcatatccctgcgccggcctcgcctcgcttctcaatccaaggctcgtgacactaaggtattgatagaagacacagatgatgaagctaacacttgaattttctgaagtctagcttaacatctttggttttcctactctacaatcctttcctcgaccaacgcaacctctagtacctttccagccgaaaacaggagaaaacacataacacattttccgagctcttccggatcggatcctatggactccaaacaagctcactgtgtttcttttcttttcttctggtttaattttaattttctattttcaaaacaaatatttacttcatttgccaatcagaggatgttttaagaaacaaaacatagtatcttatggattgtttacaatcacaaggacatagatacctatcaggatgaagaacaggcattgcaaggaccctctgatgggacggtactgagatatctcggcttccgctcagcccggttttgactggttgaaaccggacattggtttttaaattttttgtcagtttatgtggagaatttttttctttccttcatacccagcgcaaaggcactggccgcacttgcaggaaaagtgcaacttaaagcagtaccttcattcatgaagctactttttaatttgatgtaacttttcttattttgggaagggttgctgggtgggtgggaaatatgatgtatttgttacacatagttttctcattatttatgaaacttaaccatacagaatgatataactcctgtgcaatgaaggtgataacagtaaaagaaggcaggggaaacttacgttggatgacatttatgagggtcagtcccacatacctctttcaggagacaacttgcaccagtttgaccttttcttttctttgtttttattttaagccaaagtttcattgctaacttcttaagttgctgctgctttagagtcctgagcatatctctcataacaaggaatcccacacttcacaccaccggctgaatttcatggaagaggttctgataatttttttaactttttaaggaacagatgtggaatacactggcccatatttcaaccttaacagctgaagctatgccttattatgcatccacatgtatggtccctgtagcgtgacctttactagctctgaatcagaagacagagctatttcagaggctctgtgtgccctcactagatagtttttcttctgggttcaaccactttagccagaatttgatcaaattaaaagtctgtcatggggaaactatatttttgagcacatggaacaaattatacttcctcattcatattatgttgatacaaaagaccttggcagccatttctcccagcagttttaaaggatgaacattggatttcatgccatcccatagaaaacctgttttaaaattttagggatctttacttggtcatacatgaaaagtacactgcttagaaattatagactattatgatctgtccacagtgcccattgtcacttctttgtctcatttcttccctttgttccttagtcatccaaataagcctgaaaaccataagagatattactttattgaatatggttggcattaaatttagcatttcattatctaacaaaattaatataaattccaggacatggtaaaatgtgttttaataacccccagacccaaatgaaaatttcaaagtcaataccagcagattcatgaaagtaaatttagtcctataattttcagcttaattataaacaaaggaacaaataagtggaagggcagctattaccattcgcttagtcaaaacattcggttactgccctttaatacactcctatcatcagcacttccaccatgtattacaagtcttgacccatccctgtcgtaactccagtaaaagttactgttactagaaaatttttatcaattaactgacaaatagtttctttttaaagtagtttcttccatctttattctgactagcttccaaaatgtgttccctttttgaatcgaggtttttttgttttgttttgttttctgaaaaaatcatacaactttgtgcttctattgcttttttgtgttttgttaagcatgtcccttggcccaaatggaagaggaaatgtttaattaatgctttttagtttaaataaattgaatcatttataataatcagtgttaacaatttagtgacccttggtaggttaaaggttgcattatttatacttgagatttttttcccctaactattctgttttttgtactttaaaactatgggggaaatatcactggtctgtcaagaaacagcagtaattattactgagttaaattgaaaagtccagtggaccaggcatttcttatataaataaaattggtggtactaatgtgtatccagagacatttgaattattaactttattctttattagtgaatctctatgatggcacacataaaatcttacagttgacttctgctgtttgaattccccagtgtttttacattaatgtatcctatggccagtttagtctttcttcaactgttacagttctaggccctaatcggtcttattctttcacatatgatgcaatgatagatgtaatccttttctgaagtgtttgtcggattggcatagtctattcaaaaataaggcttatgtaactttcagcttgctatgtgacagaagtttaaatgtgtatttaagtacacagctttatgttcctcttaaagctgtaaagagaaaagaggacttttcctcatcaagagagcttgggagacaaagcatacatttaatttttttctttcaaaaaaggcaatgtgcactttcctctcctaaattttatatgccctagcagttgcgaatgttgtgtccaccttacaatttgattggaggctcccatacactgaaactctcaatagaattcttaaaaatgaacatcagctgggcgcagtggctcacgtctgtaatcccagcactttgggaggccaaggtgggcagatcacgagctcaggagttcgagaccagcctgaccaacatggtgaaaccccgtctctactaaaaatacaaaaattagctgggcgtggtggcgcatgcctgtaatcccagctactcaggagactgaggcaggagaattgcttaaacctgggaagcagaggttgcagtgagactagatcatgccactgcactccactgccactgcctgggcaacagagcaagactccatctcaaaaacaaacaaaaaaaatcacagactcattttaaaggagcagcaacctaaccaaatacaaacttcatttgattttaggtttagaaattctagttttattttggagaatcactcagtttttaatatcaattaaaatagtcctcaaaggaatgaagaggaagtctaaataaatgaataaaactcatttttcattttatggtagtatagaaagcattgatgtgtgtagagaaattaaaagacaagagtggtttactgtctatgcacaaatgagtgcctatatttaaggctgcctataccattacagtggcgtaattggtgatttcatagcatacagagaaacaatgaaatcaaagattaaatcattaggttatgatggtcatttgtaagattggaaagtagtcaaaaacccatgtgcaactttttttcagcactctaccattaggctccttaggcaagctgcttaacttccgtcagaagcaaaggtgtgggagaacaccattcacctcagtagtaacttataaaaaccgtttaaagaaggaaaatgggccccagcccctaggatccctgacttcctgatattctaaacatgagagttctgtgactttaactgagctctttaccagaagtaacgtgttgatgtatattatctttccaccatgctttgaccaaagtacattcacagtaactagagaaagcagatcatccatttctggataggtgaactacggcaaggtaagaacagaaaaaagtaaagtagtattgagtcatgcaggtatcagattaacagacattcattgaagataagtgaaataactttggagatagcagagaagagcaagaagatgttggacgttggcagtaagccgcagcaaggcagttaggaaagtacgtgagcctgatgacgcgaaggtgatgcctccatctgtccgcttagtggttattaaattgctgggaaagacctgcctttattttcctatcatcttttccccattactttgcattattcaggaaataattatttattcccaaatgcagttttctaagcagtgaccacaaaaatttcttattctaaggaaaataattaagaaaataaccctatctgtggcattgttttaaaatgtgggatacaaatctggtaagcagatttcaggtcattattgttttcttttaatggtttacatgaaattttcctctcaaaaaacaagtacctcttactgtataacatttgagtttttaaaattgagatagcttctgagagaaaaaaagaaagttgaatttgtagctctctcaactacaaaatcaccacacttttctcaaatctaataggaattcagtgtcattacagatacggtctctagtgaccaggtgaagacaattgaagctttggtagaacttctgcaaaagttaggtaaagaagaataaatccaatttatcagctttgttcatattctttttctgagtgatctaaatttttcttgcttgtgatcattagctaagacaaggagtgttaaaggttttctaaatgcaaacacatacgtttctgcatttcagaagtcagtcttgatagtaaatcctacaaactctcaactttctgcattgtattttaagtctatacaatgttagagcacatggtaatgtgggacagagttgattatatgatagcatgagaaatttgcactggttggtgttacaaaccaatgatctaaccagcatactctccaaatatgaaaaagtaaaaacatctcattaggtttggaagagcctaaggtagtccatacaggaagtttgcctgagaacagagaggagcctgttgattggcatggctcatgatgcctttcttgtatgaattatcaaaactgatactgagttgcccctagaaaacagccttccagaatatgtttgcttatttatggtggaagaggaagtgagaacaagatgagagtttcccttaaagtgaggagaatcattatacaactttgcaactgaagtatgtttccttgtagcaaacctttggtttattttatcgtcaaatcaaagccaccctcagttttttgtatggtgccatcaacctaaggaggacaatcaaataacctattgtttgccttggattcagtatatctactaagtacacagtctcgtataccttcaaaccagttacttgactaaacttccaccatattaccttagttcttcctatgccctttcctctgtgccaccacaaatcagagggaaagactgcagtacttctagaaagttgtggacttctaagaaagagccaggcttccatctcactatcccttgatcattatctctgaagtccctacctgcacttccctgattgccctgtagcaacaccagcatggtgggaattggagggaaagattgtggaaaatccctaaagggtcattgttcatgacgttattttgaattgtaaaattgtgagccactcacatttcaattacaaaaagaacagaactcttaatcacgttgtgaagattaatttcttgccattttctggattagcacagaagcttgtatcaatgaagagtatttaggaggggaatagggggaaaattgtatttttctgttcaaactctctccttctatttgtgtttccttcacccctctccctccaccacactgtgttggtcaaatgatactattctatgaaaccctgagctatagttgtcaaaagtaactatggattgtgattagtcctctgtgggtgcttccttccctcttttttctccctcactctctttctcagtctccactctggtaaatggaaaaggtgatgtcgaagaattgatgcttgcttggactcatgttgtatctgtgactatgctattagctgtctcctttttccttcctatatgggtagaattcttatgacttatgaagttcccttcttgataagtaggttaaatgcacaatgtggtactgttttatagtttctagatggttgtataaagcaaaaagttaatgtggttatgtgtttttaaagaaaataagtgattggtcactaaactctgtccttttttcattattacaatttctctctgttttccaaca

SEQ ID NO: 200412 - DNA, 1417 bp, Homo sapiens
  Payload ID: 19539
  Gene Name: xeroderma pigmentosum, complementation group A
  Uniprot ID: P23025
  ENST ID: ENST00000375128
  CDS Start-End: 66-887
ggctcgcctcggcgtgcagtgcgcgtgcgtggagctgggagctaggtcctcggagtgggccagagatggcggcggccgacggggctttgccggaggcggcggctttagagcaacccgcggagctgcctgcctcggtgcgggcgagtatcgagcggaagcggcagcgggcactgatgctgcgccaggcccggctggctgcccggccctactcggcgacggcggctgcggctactggaggcatggctaatgtaaaagcagccccaaagataattgacacaggaggaggcttcattttagaagaggaagaagaagaagaacagaaaattggaaaagttgttcatcaaccaggacctgttatggaatttgattatgtaatatgcgaagaatgtgggaaagaatttatggattcttatcttatgaaccactttgatttgccaacttgtgataactgcagagatgctgatgataaacacaagcttataaccaaaacagaggcaaaacaagaatatcttctgaaagactgtgatttagaaaaaagagagccacctcttaaatttattgtgaagaagaatccacatcattcacaatggggtgatatgaaactctacttaaagttacagattgtgaagaggtctcttgaagtttggggtagtcaagaagcattagaagaagcaaaggaagtccgacaggaaaaccgagaaaaaatgaaacagaagaaatttgataaaaaagtaaaagaattgcggcgagcagtaagaagcagcgtgtggaaaagggagacgattgttcatcaacatgagtatggaccagaagaaaacctagaagatgacatgtaccgtaagacttgtactatgtgtggccatgaactgacatatgaaaaaatgtgattttttagttcagtgacctgttttatagaattttatatttaaataaaggaaatttagattggtccttttcaaaattcaaaaaaaaaagcaacatcttcatagatgaatgaaacccttgtataagtaatacttcagtaataattatgtatgttatggcttaaaagcaagtttcagtgaaggtcacctggcctggttgtgtgcacaatgtcatgtctgtgattgccttcttacaacagagatgggagctgagtgctagagtaggtgcagaagtggtaggtcagctacaaatttgaggacaagataccaaggcaaaccctagattggggtagagggaaaagggttcaacaaaggctgaactggattcttaaccaagaaacaaataatagcaatggtggtgcaccactgtaccccaggttctagtcatgtgttttttaggacgatttctgtctccacgatggtggaaacagtggggaactactgctggaaaaagccctaatagcagaaataaacattgagttgtacgagtctga

SEQ ID NO: 200413 - DNA, 1584 bp, Homo sapiens
  Payload ID: 19539
  Gene Name: xeroderma pigmentosum, complementation group A
  ENST ID: ENST00000462523
  CDS Start-End: 2-796
gatggcggcggccgacggggctttgccggaggcggcggctttagagcaacccgcggagctgcctgcctcggtgcgggcgagtatcgagcggaagcggcagcgggcactgatgctgcgccaggcccggctggctgcccggccctactcggcgacggcggctgcggctactggaggcatggctaatgtaaaagcagccccaaagataattgacacaggaggaggcttcattttagaagaggaagaagaagaagaacagaaaattggaaaagttgttcatcaaccaggacctgttatggaatttgattatgtaatatgcgaagaatgtgggaaagaatttatggattcttatcttatgaaccactttgatttgccaacttgtgataactgcagagatgctgatgataaacacaagcttataaccaaaacagaggcaaaacaagaatatcttctgaaagactgtgatttagaaaaaagagagccacctcttaaatttattgtgaagaagaatccacatcattcacaatggggtgatatgaaactctacttaaagttacagattgtgaagaggtctcttgaagtttggggtagtcaagaagcattagaagaagcaaaggaagtccgacaggaaaaccgagaaaaaatgaaacagaagaaatttgataaaaaagtaaaagaggttgttcccgccttcctgaataggccacaaagggctgagactggagtagacactgtagagattagacacaaggagcttactgtgcagttttctcagaaggctcagaacagagaggaataaaagcaagtctaaaagtattttagttgaaaagaaattggaacctggttcctcttggtcttctgattttgatccacaaagaagctgacacagtttacttctttatgggaagaattgcggcgagcagtaagaagcagcgtgtggaaaagggagacgattgttcatcaacatgagtatggaccagaagaaaacctagaagatgacatgtaccgtaagacttgtactatgtgtggccatgaactgacatatgaaaaaatgtgattttttagttcagtgacctgttttatagaattttatatttaaataaaggaaatttagattggtccttttcaaaattcaaaaaaaaaagcaacatcttcatagatgaatgaaacccttgtataagtaatacttcagtaataattatgtatgttatggcttaaaagcaagtttcagtgaaggtcacctggcctggttgtgtgcacaatgtcatgtctgtgattgccttcttacaacagagatgggagctgagtgctagagtaggtgcagaagtggtaggtcagctacaaatttgaggacaagataccaaggcaaaccctagattggggtagagggaaaagggttcaacaaaggctgaactggattcttaaccaagaaacaaataatagcaatggtggtgcaccactgtaccccaggttctagtcatgtgttttttaggacgatttctgtctccacgatggtggaaacagtggggaactactgctggaaaaagccctaatagcagaaataaacattgagttgtacgagtctga

SEQ ID NO: 200414 - DNA, 3832 bp, Homo sapiens
  Payload ID: 19540
  Gene Name: xeroderma pigmentosum, complementation group C
  Uniprot ID: Q01831
  ENST ID: ENST00000285021
  CDS Start-End: 216-3038
atacaccggaaatagagagaaacctgttgtgctctttcctgcttcccgcagttttttagtggccacgggtatggggtggagcttcctttaggggcgtgactaggcctccaacgaaggggcgtggccaagcgcaccgcctcggggcggggccggcgttctagcgcatcgcggccgggtgcgtcactcgcgaagtggaatttgcccagacaagcaacatggctcggaaacgcgcggccggcggggagccgcggggacgcgaactgcgcagccagaaatccaaggccaagagcaaggcccggcgtgaggaggaggaggaggatgcctttgaagatgagaaacccccaaagaagagccttctctccaaagtttcacaaggaaagaggaaaagaggctgcagtcatcctgggggttcagcagatggtccagcaaaaaagaaagtggccaaggtgactgttaaatctgaaaacctcaaggttataaaggatgaagccctcagcgatggggatgacctcagggactttccaagtgacctcaagaaggcacaccatctgaagagaggggctaccatgaatgaagacagcaatgaagaagaggaagaaagtgaaaatgattgggaagaggttgaagaacttagtgagcctgtgctgggtgacgtgagagaaagtacagccttctctcgatctcttctgcctgtgaagccagtggagatagagattgaaacgccagagcaggcgaagacaagagaaagaagtgaaaagataaaactggagtttgagacatatcttcggagggcgatgaaacgtttcaataaaggggtccatgaggacacacacaaggttcaccttctctgcctgctagcaaatggcttctatcgaaataacatctgcagccagccagatctgcatgctattggcctgtccatcatcccagcccgctttaccagagtgctgcctcgagatgtggacacctactacctctcaaacctggtgaagtggttcattggaacatttacagttaatgcagaactttcagccagtgaacaagataacctgcagactacattggaaaggagatttgctatttactctgctcgagatgatgaggaattggtccatatattcttactgattctccgggctctgcagctcttgacccggctggtattgtctctacagccaattcctctgaagtcagcaacagcaaagggaaagaaaccttccaaggaaagattgactgcggatccaggaggctcctcagaaacttccagccaagttctagaaaaccacaccaaaccaaagaccagcaaaggaaccaaacaagaggaaacctttgctaagggcacctgcaggccaagtgccaaagggaagaggaacaagggaggcagaaagaaacggagcaagccctcctccagcgaggaagatgagggcccaggagacaagcaggagaaggcaacccagcgacgtccgcatggccgggagcggcgggtggcctccagggtgtcttataaagaggagagtgggagtgatgaggctggcagcggctctgattttgagctctccagtggagaagcctctgatccctctgatgaggattccgaacctggccctccaaagcagaggaaagcccccgctcctcagaggacaaaggctgggtccaagagtgcctccaggacccatcgtgggagccatcgtaaggacccaagcttgccagcggcatcctcaagctcttcaagcagtaaaagaggcaagaaaatgtgcagcgatggtgagaaggcagaaaaaagaagcatagctggtatagaccagtggctagaggtgttctgtgagcaggaggaaaagtgggtatgtgtagactgtgtgcacggtgtggtgggccagcctctgacctgttacaagtacgccaccaagcccatgacctatgtggtgggcattgacagtgacggctgggtccgagatgtcacacagaggtacgacccagtctggatgacagtgacccgcaagtgccgggttgatgctgagtggtgggccgagaccttgagaccataccagagcccatttatggacagggagaagaaagaagacttggagtttcaggctaaacacatggaccagcctttgcccactgccattggcttatataagaaccaccctctgtatgccctgaagcggcatctcctgaaatatgaggccatctatcccgagacagctgccatccttgggtattgtcgtggagaagcggtctactccagggattgtgtgcacactctgcattccagggacacgtggctgaagaaagcaagagtggtgaggcttggagaagtaccctacaagatggtgaaaggcttttctaaccgtgctcggaaagcccgacttgctgagccccagctgcgggaagaaaatgacctgggcctgtttggctactggcagacagaggagtatcagcccccagtggccgtggacgggaaggtgccccggaacgagtttgggaatgtgtacctcttcctgcccagcatgatgcctattggctgtgtccagctgaacctgcccaatctacaccgcgtggcccgcaagctggacatcgactgtgtccaggccatcactggctttgatttccatggcggctactcccatcccgtgactgatggatacatcgtctgcgaggaattcaaagacgtgctcctgactgcctgggaaaatgagcaggcagtcattgaaaggaaggagaaggagaaaaaggagaagcgggctctagggaactggaagttgctggccaaaggtctgctcatcagggagaggctgaagcgtcgctacgggcccaagagtgaggcagcagctccccacacagatgcaggaggtggactctcttctgatgaagaggaggggaccagctctcaagcagaagcggccaggatactggctgcctcctggcctcaaaaccgagaagatgaagaaaagcagaagctgaagggtgggcccaagaagaccaaaagggaaaagaaagcagcagcttcccacctgttcccatttgagcagctgtgagctgagcgcccactagaggggcacccaccagttgctgctgccccactacaggccccacacctgccctgggcatgcccagcccctggtggtgggggcttctctgctgagaaggcaaactgaggcagcatgcacggaggcggggtcaggggagacgaggccaagctgaggaggtgctgcaggtcccgtctggctccagcccttgtcagattcacccagggtgaagccttcaaagctttttgctaccaaagcccactcaccctttgagctacagaacactttgctaggagatactcttctgcctcctagacctgttctttccatctttagaaacatcagtttttgtatggaagccaccgggagatttctggatggtggtgcatccgtgaatgcgctgatcgtttcttccagttagagtcttcatctgtccgacaagttcactcgcctcggttgcggacctaggaccatttctctgcaggccacttaccttcccctgagtcaggcttactaatgctgccctcactgcctctttgcagtaggggagagagcagagaagtacaggtcatctgctgggatctagttttccaagtaacattttgtggtgacagaagcctaaaaaaagctaaaatcaggaaagaaaaggaaaaatacgaattgaaaattaaggaaatgttagtaaaatagatgagtgttaaactagattgtattcattactagataaaatgtataaagctctctgtactaaggagaaatgacttttataacattttgagaaaataataaagcatttatctaaa

SEQ ID NO: 200415 - DNA, 557 bp, Homo sapiens
  Payload ID: 19540
  Gene Name: xeroderma pigmentosum, complementation group C
  ENST ID: ENST00000511155
  CDS Start-End: 54-557
gcatcgcggccgggtgcgtcactcgcgaagtggaatttgcccagacaagcaacatggctcggaaacgcgcggccggcggggagccgcggggacgcgaactgcgcagccagaaatccaaggccaagagcaaggcccggcatgcctttgaagatgagaaacccccaaagaagagccttctctccaaagtttcacaaggaaagaggaaaagaggctgcagtcatcctgggggttcagcagatggtccagcaaaaaagaaagtggccaaggtgactgttaaatctgaaaacctcaaggttataaaggatgaagccctcagcgatggggatgacctcagggactttccaagtgacctcaagaaggcacaccatctgaagagaggggctaccatgaatgaagacagcaatgaagaagaggaagaaagtgaaaatgattgggaagaggttgaagaacttagtgagcctgtgctgggtgacgtgagagaaagtacagccttctctcgatctcttctgcctgtgaagccagtggagatagagattgaaacgccagagcaggcgaag

SEQ ID NO: 200416 - DNA, 2944 bp, Homo sapiens
  Payload ID: 19540
  Gene Name: xeroderma pigmentosum, complementation group C
  Uniprot ID: Q01831
  ENST ID: ENST00000476581
  CDS Start-End: 34-456
actcgcgaagtggaatttgcccagacaagcaacatggctcggaaacgcgcggccggcggggagccgcggggacgcgaactgcgcagccagaaatccaaggccaagagcaaggcccggcgtgaggaggaggaggaggatgcctttgaagatgagaaacccccaaagaagagccttctctccaaagtttcacaaggaaagaggaaaagaggctgcagtcatcctgggggttcagcagatggtccagcaaaaaagaaagtggccaaggtgactgttaaatctgaaaacctcaaggttataaaggatgaagccctcagcgatggggatgacctcagggactttccaagtgacctcaagaaggcacaccatctgaagagaggggctaccatgaatgaagacagcaatgaagaagaggaagaaagtgaaaatgattgggaagaggttgaagtgaaaagataaaactggagtttgagacatatcttcggagggcgatgaaacgtttcaataaaggggtccatgaggacacacacaaggttcaccttctctgcctgctagcaaatggcttctatcgaaataacatctgcagccagccagatctgcatgctattggcctgtccatcatcccagcccgctttaccagagtgctgcctcgagatgtggacacctactacctctcaaacctggtgaagtggttcattggaacatttacagttaatgcagaactttcagccagtgaacaagataacctgcagactacattggaaaggagatttgctatttactctgctcgagatgatgaggaattggtccatatattcttactgattctccgggctctgcagctcttgacccggctggtattgtctctacagccaattcctctgaagtcagcaacagcaaagggaaagaaaccttccaaggaaagattgactgcggatccaggaggctcctcagaaacttccagccaagttctagaaaaccacaccaaaccaaagaccagcaaaggaaccaaacaagaggaaacctttgctaagggcacctgcaggccaagtgccaaagggaagaggaacaagggaggcagaaagaaacggagcaagccctcctccagcgaggaagatgagggcccaggagacaagcaggagaaggcaacccagcgacgtccgcatggccgggagcggcgggtggcctccagggtgtcttataaagaggagagtgggagtgatgaggctggcagcggctctgattttgagctctccagtggagaagcctctgatccctctgatgaggattccgaacctggccctccaaagcagaggaaagcccccgctcctcagaggacaaaggctgggtccaagagtgcctccaggacccatcgtgggagccatcgtaaggacccaagcttgccagcggcatcctcaagctcttcaagcagtaaaagaggcaagaaaatgtgcagcgatggtgagaaggcagaaaaaagaagcatagctggtatagaccagtggctagaggtgttctgtgagcaggaggaaaagtgggtatgtgtagactgtgtgcacggtgtggtgggccagcctctgacctgttacaagtacgccaccaagcccatgacctatgtggtgggcattgacagtgacggctgggtccgagatgtcacacagaggtacgacccagtctggatgacagtgacccgcaagtgccgggttgatgctgagtggtgggccgagaccttgagaccataccagagcccatttatggacagggagaagaaagaagacttggagtttcaggctaaacacatggaccagcctttgcccactgccattggcttatataagaaccaccctctgtatgccctgaagcggcatctcctgaaatatgaggccatctatcccgagacagctgccatccttgggtattgtcgtggagaagcggtctactccagggattgtgtgcacactctgcattccagggacacgtggctgaagaaagcaagagtggtgaggcttggagaagtaccctacaagatggtgaaaggcttttctaaccgtgctcggaaagcccgacttgctgagccccagctgcgggaagaaaatgacctgggcctgtttggctactggcagacagaggagtatcagcccccagtggccgtggacgggaaggtgccccggaacgagtttgggaatgtgtacctcttcctgcccagcatgatgcctattggctgtgtccagctgaacctgcccaatctacaccgcgtggcccgcaagctggacatcgactgtgtccaggccatcactggctttgatttccatggcggctactcccatcccgtgactgatggatacatcgtctgcgaggaattcaaagacgtgctcctgactgcctgggaaaatgagcaggcagtcattgaaaggaaggagaaggagaaaaaggagaagcgggctctagggaactggaagttgctggccaaaggtctgctcatcagggagaggctgaagcgtcgctacgggcccaagagtgaggcagcagctccccacacagatgcaggaggtggactctcttctgatgaagaggaggggaccagctctcaagcagaagcggccaggatactggctgcctcctggcctcaaaaccgagaagatgaagaaaagcagaagctgaagggtgggcccaagaagaccaaaagggaaaagaaagcagcagcttcccacctgttcccatttgagcagctgtgagctgagcgcccactagaggggcacccaccagttgctgctgccccactacaggccccacacctgccctgggcatgcccagcccctggtggtgggggcttctctgctgagaaggcaaactgaggcagcatgcacggaggcggggtcaggggagacgaggccaagctgaggaggtgctgcaggtcccgtctggctccagcccttgtcagattcac

SEQ ID NO: 200417 - DNA, 2315 bp, Homo sapiens
  Payload ID: 19541
  Gene Name: Xg blood group
  Uniprot ID: P55808
  ENST ID: ENST00000381174
  CDS Start-End: 226-768
gtgtgcctacactggtcccacaggttttcagctgtggagtttgggatctgagcttggagcccatttgtttctggcagttccgctcatattttccacttgaagacatcgcctcccttccttccaagctgggagaccagaagtcaacaacaggagggtggagaggccgggtctcacaatccgcttggctggggagtccactgaggttcttgcatcctgaagcaaaccatggagagctggtggggacttccctgtcttgcgttcctgtgttttctaatgcacgcccgaggtcaaagagactttgatttggcagatgcccttgatgaccctgaacccaccaagaagccaaactcagatatctacccaaagccaaaaccaccttactacccacagcccgagaatcccgacagcggtggaaatatctacccaaggccaaagccacgccctcaaccccagcctggcaattccggcaacagtggaggttacttcaatgatgtggaccgtgatgacggacgctacccgcccaggcccaggccacggccgcctgcaggaggtggcggcggtggctactccagttatggcaactccgacaacacgcacggtggagatcaccattcaacgtatggcaatccagaaggcaatatggtagcaaaaatcgtgtctcccatcgtatccgtggtggtggtgacactgctgggagcagcagccagttatttcaaactaaacaataggagaaattgtttcaggacccatgaaccagaaaatgtctgaagatgttaagatcccctgattactttgagaaaaacaactaaaacaagaaccgtgtttatcactgttgtggagatttccttttattcttgacacaatttgatgacctaaagtgtgttttcttctgtgtaaagtacatgagctgcctcactaagcattcccaactcattgaatgtgatgtggttataaagataagttaggcagctagaccctgcgttctaaaaaaggattgcttgcaatgttggtttggctattcatttgcacaaagagactgtggctctctgttgtgagatcttcagctacctcatggtgcaataacacacacacgcttaaccatgttgatggcacaaagcggtgagcagtagggaggtagaatatcttggtggggaggggatgttatcagcttctgggagatgaagaatattgttgaggttccaaagatgctggacctgtgctaaattcttcagtgatatgaaaaaatcattgagcattcattattgcgaatgaagtggggatgcattatttctgacacccacaagcagggtttgatcatcctttcagctttgagatatctgcacataaaattattattacctgaagaaaataaggctgcattttgaaatgttaagtgcaaaatgactgatgttaaaaccatctgggggaaatcttgggatgctttttcctaggaaatcatatggttgtgatatgttttggcgcataggagacagaaatagtgattatcaggcgttgagcctttttgtagtatttttagtctttgatactctgtaagtgctagttcctaaggcaccaacattgcattccttggtttatactttttctattcatcagggtaggaagtcttaaatccttaggcatccaagaagtatactagctttttgcttctcttttagaaatacttgtggggagagaaaaaaggatggtttgggcatattggtatagtttgagtaaactaaggttaatgttcatataacatttagactttgccataaatatcagaaccaaagatcaagacattcatgtacagtctggaatgtatatatggggcccataaaaattcccagtatgcatgttttatgctcaccattatgaattggggtcttcaaagagagaaggttgaaagtggaaagcacttgaaagggctccccggtttgtaaaatatctttaatcattcacattaggtacctcggagttgcgggtctcaaatgtggattcatgcatcatttgtgcagtttgaagatagtccatatttcctatttcagtattaggtcctgcaacacttttcaattcttgtagaaggtttttttcaggagtggtgatgtctgatgctcaattactattttccctataagagtttcagcatgagcttaattaaattcttgtgaaaaaacctgtgtttttagttacacacacacacacacacacacctacttaaatggaatctaaacatttttagcctttaatccattccattttctaaaactgtcataaactatttttaatcattttaaataaatgtaaaagaaaaataa

SEQ ID NO: 200418 - DNA, 979 bp, Homo sapiens
  Payload ID: 19541
  Gene Name: Xg blood group
  Uniprot ID: P55808
  ENST ID: ENST00000419513
  CDS Start-End: 224-811
gtgcctacactggtcccacaggttttcagctgtggagtttgggatctgagcttggagcccatttgtttctggcagttccgctcatattttccacttgaagacatcgcctcccttccttccaagctgggagaccagaagtcaacaacaggagggtggagaggccgggtctcacaatccgcttggctggggagtccactgaggttcttgcatcctgaagcaaaccatggagagctggtggggacttccctgtcttgcgttcctgtgttttctaatgcacgcccgaggtcaaagagactttgatttggcagatgcccttgatgaccctgaacccaccaagaagccaaactcagatatctacccaaagccaaaaccaccttactacccacagcccgagaatcccgacagcggtggaaatatctacccaaggccaaagccacgccctcaaccccagcctggcaattccggcaacagtggaggttacttcaatgatgtggaccgtgatgacggacgctacccgcccaggcccaggccacggccgcctgcaggaggtggcggcggtggctactccagttatggcaactccgacaacacgcacggaagagggggctatagactcaactctcgttatggaaatacttatggtggagatcaccattcaacgtatggcaatccagaaggcaatatggtagcaaaaatcgtgtctcccatcgtatccgtggtggtggtgacactgctgggagcagcagccagttatttcaaactaaacaataggagaaattgtttcaggacccatgaaccagaaaatgtctgaagatgttaagatcccctgattactttgagaaaaacaactaaaacaagaaccgtgtttatcactgttgtggagatttccttttattcttgacacaatttgatgacctaaagtgtgttttcttctgtgtaaagtacatgagctgcctcactaagcattcccaactcattg

SEQ ID NO: 200419 - DNA, 574 bp, Homo sapiens
  Payload ID: 19541
  Gene Name: Xg blood group
  ENST ID: ENST00000509484
  CDS Start-End: 131-574
cttgaagacatcgcctcccttccttccaagctgggagaccagaagtcaacaacaggagggtggagaggccgggtctcacaatccgcttggctggggagtccactgaggttcttgcatcctgaagcaaaccatggagagctggtggggacttccctgtcttgcgttcctgtgttttctaatgcacgcccgagatatctacccaaagccaaaaccaccttactacccacagcccgagaatcccgacagcggtggaaatatctacccaaggccaaagccacgccctcaaccccagcctggcaattccggcaacagtggaggttacttcaatgatgtggaccgtgatgacggacgctacccgcccaggcccaggccacggccgcctgcaggaggtggcggcggtggctactccagttatggcaactccgacaacacgcacggtggagatcaccattcaacgtatggcaatccagaaggcaatatggtagcaaaaatcgtgtctcccatcgtatccgtggtggtggtgacactgctgggagcagcagccagttatttcaaactaaacaataggagaaat

SEQ ID NO: 200420 - DNA, 1584 bp, Homo sapiens
  Payload ID: 19542
  Gene Name: XIAP associated factor 1
  Uniprot ID: Q6GPH4
  ENST ID: ENST00000346752
  CDS Start-End: 242-1090
gtagatgcggctgtgacagcagcaaagaatgacggccaagggcgacagcaggggctggccatgctgtaaaggggcttcttgggagggtccagcctcaggaatcaaggggaactcctgagccgagaattctgaagatctcctccctccctgaagctgtgggctgggccatcggaaaactttcagttttgtttccttgcctgcaagaaacgaaactcaaccgaaagcctgcagagagcagaacatggaaggagacttctcggtgtgcaggaactgtaaaagacatgtagtctctgccaacttcaccctccatgaggcttactgcctgcggttcctggtcctgtgtccggagtgtgaggagcctgtccccaaggaaaccatggaggagcactgcaagcttgagcaccagcaggccaatgagtgccaggagcgccctgttgagtgtaagttctgcaaactggacatgcagctcagcaagctggagctccacgagtcctactgtggcagccggacagagctctgccaaggctgtggccagttcatcatgcaccgcatgctcgcccagcacagagatgtctgtcgcagtgaacaggcccagctcgggaaaggggaaagaatttcagctcctgaaagggaaatctactgtcattattgcaaccaaatgattccagaaaataagtatttccaccatatgggtaaatgttgtccagactcagagtttaagaaacactttcctgttggaaatccagaaattcttccttcatctcttccaagtcaagctgctgaaaatcaaacttccacgatggagaaagatgttcgtccaaagacaagaagtataaacagatttcctcttcattctgaaagttcatcaaagaaagcaccaagaagcaaaaacaaaaccttggatccacttttgatgtcagagcccaagcccaggaccagctcccctagaggagataaagcagcctatgacattctgaggagatgttctcagtgtggcatcctgcttcccctgccgatcctaaatcaacatcaggagaaatgccggtggttagcttcatcaaaaggaaaacaagtgagaaatttcagctagatttggaaaaggaaaggtactacaaattcaaaagatttcacttttaacactggcattcctgcctacttgctgtggtggtcttgtgaaaggtgatgggttttattcgttgggctttaaaagaaaaggtttggcagaactaaaaacaaaactcacgtatcatctcaatagatacagaaaaggcttttgataaaattcaacttgacttcatgttaaaaaccctcaacaaaccaggcgtcgaaggaacatacctcaaaataataagagccatctatgacaaaaccacagccaacatcatactgaatgagcaaaagctggagcattactcttgagaagtagaacaaggcacttcagtcctattcaacatagtactggaagtcctcgccacagcaatcaggcaagagaaagaaataaaaggcaaccaaaaagaaaggaagtcgaagtatctctgtttgcagacgatatgattctatatctagaaaaccccatgatcttgg

SEQ ID NO: 200421 - DNA, 3623 bp, Homo sapiens
  Payload ID: 19542
  Gene Name: XIAP associated factor 1
  Uniprot ID: Q6GPH4
  ENST ID: ENST00000361842
  CDS Start-End: 240-1145
agatgcggctgtgacagcagcaaagaatgacggccaagggcgacagcaggggctggccatgctgtaaaggggcttcttgggagggtccagcctcaggaatcaaggggaactcctgagccgagaattctgaagatctcctccctccctgaagctgtgggctgggccatcggaaaactttcagttttgtttccttgcctgcaagaaacgaaactcaaccgaaagcctgcagagagcagaacatggaaggagacttctcggtgtgcaggaactgtaaaagacatgtagtctctgccaacttcaccctccatgaggcttactgcctgcggttcctggtcctgtgtccggagtgtgaggagcctgtccccaaggaaaccatggaggagcactgcaagcttgagcaccagcaggttgggtgtacgatgtgtcagcagagcatgcagaagtcctcgctggagtttcataaggccaatgagtgccaggagcgccctgttgagtgtaagttctgcaaactggacatgcagctcagcaagctggagctccacgagtcctactgtggcagccggacagagctctgccaaggctgtggccagttcatcatgcaccgcatgctcgcccagcacagagatgtctgtcgcagtgaacaggcccagctcgggaaaggggaaagaatttcagctcctgaaagggaaatctactgtcattattgcaaccaaatgattccagaaaataagtatttccaccatatgggtaaatgttgtccagactcagagtttaagaaacactttcctgttggaaatccagaaattcttccttcatctcttccaagtcaagctgctgaaaatcaaacttccacgatggagaaagatgttcgtccaaagacaagaagtataaacagatttcctcttcattctgaaagttcatcaaagaaagcaccaagaagcaaaaacaaaaccttggatccacttttgatgtcagagcccaagcccaggaccagctcccctagaggagataaagcagcctatgacattctgaggagatgttctcagtgtggcatcctgcttcccctgccgatcctaaatcaacatcaggagaaatgccggtggttagcttcatcaaaaggaaaacaagtgagaaatttcagctagatttggaaaaggaaaggtactacaaattcaaaagatttcacttttaacactggcattcctgcctacttgctgtggtggtcttgtgaaaggtgatgggttttattcgttgggctttaaaagaaaaggtttggcagaactaaaaacaaaactcacgtatcatctcaatagatacagaaaaggcttttgataaaattcaacttgacttcatgttaaaaaccctcaacaaaccaggcgtcgaaggaacatacctcaaaataataagagccatctatgacaaaaccacagccaacatcatactgaatgagcaaaagctggagcattactcttgagaagtagaacaaggcacttcagtcctattcaacatagtactggaagtcctcgccacagcaatcaggcaagagaaagaaataaaaggcaaccaaaaagaaaggaagtcgaagtatctctgtttgcagacgatatgattctatatctagaaaaccccatgatcttggcccaaaagctcctagatctgataaacaacttcagctaactttcaggagacaaaatcaatatacaaaatatggtagcatttttatacaccaacgacatccaagctgagagccaaatcaagaatgcaatcctattcacaattgccacaaaaagaataaaatacctaggaatacagctaaccagggagatgaaagatctctacaacaaaaattacaaaacactgctgaaagaaatcagagatgacacaaatggaaaaacattccatacttatggataggaagaatcaatattgttaaaatggccatactacccaaagcaatttatagattcaatgctattcctatcaaactaccaataacattcttcacagaatcagaaaaaaaaagcattaaaatttatttgaaaccaaaaaagagcccaaaaagccaaagcaatcctaagcaaaaagaacaaagctggaggcatcgcattacccaacttcaaactatactacagggctacagtaaccaaaactgcatgatactggtacaaaagcatggtgctggtacaaaagcagacacatagatcaatggaacagaatagagggcccagaaataaagctacacacctacaaccatctaatctttgacaaagttgacaaaaatacgcaatggggaaagaattccccattcagtaagtggtactgggataactagctagccatatgcagaggattgaaactgaaccacttccttacaccatatgcaaaaatcaactcaagatggattaaagacttaaatgtaaaaccccaaactataaaaactctggaagataacctaggcaataccattctggacataggaacggaaaaagatttcatgacaaagatcccaaaaataattgtaacgaaagcaaaaattgacaaatgggacatgattaaacagaattaccatttgactcagcaatcccattattggttatatacccaaaggaatctaaatcattctgtcataaagacatatatacacaaatgttcacggcagcactatacacaatcgcaaagtcagggaatcaaactaaatgtccatcagtggtagaaaggataaagaaaatgtggtggcagggagtggtggctcatgtctgtaatcccagcactttgggaggctgaggcgggtggttcacctgaggtcaggagtttgagaccagcctggccaacatggagaaactccgtctccgctaaaaatacgaaaattagccaggcgtggtggcgagcacctgtcatcccagctacttgggaggcctaggcgtgagaatcgcttgaacctggaaggtggtggttgcagtgagccgagatcctgccactgcactccagcctgggcaaccaagcgagactctgccttaaaaaaaaaaaaaagaaaatgtggcacatatacaccatggaatactatgcagccataaaaaagaatgggatcatgtcctgtgcagcaacgtggatggagctggaagccattatcctaaatgaactcactcagaaacagaaaaccaaataccacatgttctcacttataagtagaagctaaacattgagtacacatggatacaaagaagggaaccgcagacactggggcctacctgaggtcggagcatggaaggagggtgaggatcaaaaaactacctatctggtactatgctttttatctggatgatgaaataatctgtacaacaaaccctggtgacatgcaatttacctatatagcaagcctacacatgtgcccctgaacctaaaaaaaaagttaaaagaaaaacgtttggattattttccctctttcgaacaaagacattggtttgcccaaggactacaaataaaccaacgggaaaaaagaaaggttccagttttgtctgaaaattctgattaagcctctgggccctacagcctggagaacctggagaatcctacacccacagaacccggctttgtccccaaagaataaaaacacctctctaaaa

SEQ ID NO: 200422 - DNA, 820 bp, Homo sapiens
  Payload ID: 19542
  Gene Name: XIAP associated factor 1
  Uniprot ID: Q6GPH4
  ENST ID: ENST00000574962
  CDS Start-End: 1-426
atggaaggagacttctcggtgtgcaggaactgtaaaagacatgtagtctctgccaacttcaccctccatgaggcttactgcctgcggttcctggtcctgtgtccggagtgtgaggagcctgtccccaaggaaaccatggaggagcactgcaagcttgagcaccagcaggttgggtgtacgatgtgtcagcagagcatgcagaagtcctcgctggagtttcataaggccaatgagtgccaggagcgccctgttgagtgtaagttctgcaaactggacatgcagctcagcaagctggagctccacgagtcctactgtggcagccggacagagctctgccaaggctgtggccagttcatcatgcaccgcatgctcgcccagcacagagatgtctgtcgcagtgaacaggcccagctcgggaaagggtaaatgttgtccagactcagagtttaagaaacactttcctgttggaaatccagaaattcttccttcatctcttccaagtcaagctgctgaaaatcaaacttccacgatggagaaagatgttcgtccaaagacaagaagtataaacagatttcctcttcattctgaaagttcatcaaagaaagcaccaagaagcaaaaacaaaaccttggatccacttttgatgtcagagcccaagcccaggaccagctcccctagaggagataaagcagcctatgacattctgaggagatgttctcagtgtggcatcctgcttcccctgccgatcctaaatcaacatcaggagaaatgccggtggttagcttcatcaaaaggaaaacaagtgagaaatttcagctag

SEQ ID NO: 200423 - DNA, 1010 bp, Homo sapiens
  Payload ID: 19542
  Gene Name: XIAP associated factor 1
  ENST ID: ENST00000576724
  CDS Start-End: 25-519
ccgaaagcctgcagagagcagaacatggaaggagacttctcggtgtgcaggaactgtaaaagacatgtagtctctgccaacttcaccctccatgaggcttactgcctgcggttcctggtcctgtgtccggagtgtgaggagcctgtccccaaggaaaccatggaggagcactgcaagcttgagcaccagcaggttgggtgtacgatgtgtcagcagagcatgcagaagtcctcgctggagtttcataaggccaatgagtgccaggagcgccctgttgagtgtaagttctgcaaactggacatgcagctcagcaagctggagctccacgagtcctactgtggcagccggacagagctctgccaaggctgtggccagttcatcatgcaccgcatgctcgcccagcacagagatgtctgtcgcagtgaacaggcccagctcgggaaagaaaccagtcctgatccaggaaaatgtctctccattacggttgctgctgccctgagtgcacatctgtggccataaaggaaatgatgtgggtgattcggccaagagttgcctgtgtggtcaaggatgccggcagcgcaggaaagtcaagaccaggggaaagaatttcagctcctgaaagggaaatctactgtcattattgcaaccaaatgattccagaaaataagtatttccaccatatgggtaaatgttgtccagactcagagtttaagaaacactttcctgttggaaatccagaaattcttccttcatctcttccaagtcaagctgctgaaaatcaaacttccacgatggagaaagatgttcgtccaaagacaagaagtataaacagatttcctcttcattctgaaagttcatcaaagaaagcaccaagaagcaaaaacaaaaccttggatccacttttgatgtcagagcccaagcccaggaccagctcccctagaggagataaagcagcctatgacattctgaggagatgttctcagtgtggcatcctgcttcccctgccgatc

SEQ ID NO: 200424 - DNA, 1609 bp, Homo sapiens
  Payload ID: 19542
  Gene Name: XIAP associated factor 1
  ENST ID: ENST00000571217
  CDS Start-End: 18-242
cctgcagagagcagaacatggaaggagacttctcggtgtgcaggaactgtaaaagacatgtagtctctgccaacttcaccctccatgaggcttactgcctgcggttcctggtcctgtgtccggagtgtgaggagcctgtccccaaggaaaccatggaggagcactgcaagcttgagcaccagcaggggaaagaatttcagctcctgaaagggaaatctactgtcattattgcaaccaaatgattccagaaaataagtatttccaccatatgggtaaatgttgtccagactcagagtttaagaaacactttcctgttggaaatccagaaattcttccttcatctcttccaagtcaagctgctgaaaatcaaacttccacgatggagaaagatgttcgtccaaagacaagaagtataaacagatttcctcttcattctgaaagttcatcaaagaaagcaccaagaagcaaaaacaaaaccttggatccacttttgatgtcagagcccaagcccaggaccagctcccctagaggagataaagcagcctatgacattctgaggagatgttctcagtgtggcatcctgcttcccctgccgatcctaaatcaacatcaggagaaatgccggtggttagcttcatcaaaaggaaaacaagtgagaaatttcagctagatttggaaaaggaaaggtactacaaattcaaaagatttcacttttaacactggcattcctgcctacttgctgtggtggtcttgtgaaaggtgatgggttttattcgttgggctttaaaagaaaaggtttggcagaactaaaaacaaaactcacgtatcatctcaatagatacagaaaaggcttttgataaaattcaacttgacttcatgttaaaaaccctcaacaaaccaggcgtcgaaggaacatacctcaaaataataagagccatctatgacaaaaccacagccaacatcatactgaatgagcaaaagctggagcattactcttgagaagtagaacaaggcacttcagtcctattcaacatagtactggaagtcctcgccacagcaatcaggcaagagaaagaaataaaaggcaaccaaaaagaaaggaagtcgaagtatctctgtttgcagacgatatgattctatatctagaaaaccccatgatcttggcccaaaagctcctagatctgataaacaacttcagctaactttcaggagacaaaatcaatatacaaaatatggtagcatttttatacaccaacgacatccaagctgagagccaaatcaagaatgcaatcctattcacaattgccacaaaaagaataaaatacctaggaatacagctaaccagggagatgaaagatctctacaacaaaaattacaaaacactgctgaaagaaatcagagatgacacaaatggaaaaacattccatacttatggataggaagaatcaatattgttaaaatggccatactacccaaagcaatttatagattcaatgctattcctatcaaactaccaataacattcttcacagaatcagaaaaaaaaagcattaaaatttatttgaaaccaaaaaagagcccaaaaagccaaagcaatcctaagcaaaaa

SEQ ID NO: 200425 - DNA, 583 bp, Homo sapiens
  Payload ID: 19542
  Gene Name: XIAP associated factor 1
  ENST ID: ENST00000574907
  CDS Start-End: 13-583
agagagcagaacatggaaggagacttctcggtgtgcaggaactgtaaaagacatgtagtctctgccaacttcaccctccatgaggcttactgcctgcggttcctggtcctgtgtccggagtgtgaggagcctgtccccaaggaaaccatggaggagcactgcaagcttgagcaccagcaggagagatgggatctgggagtcacagagtgggtccagtcctccctgcaggagagatggggtctgagagttgggggacgagggtccagtcctccctgcaggttgggtgtacgatgtgtcagcagagcatgcagaagtcctcgctggagtttcataaggccaatgagtgccaggagcgccctgttgagtgtaagttctgcaaactggacatgcagctcagcaagctggagctccacgagtcctactgtggcagccggacagagctctgccaaggctgtggccagttcatcatgcaccgcatgctcgcccagcacagagatgtctgtcgcagtgaacaggcccagctcgggaaaggggaaagaatttcagctcctgaaagggaaatctactgtcattattgcaacca

SEQ ID NO: 200426 - DNA, 576 bp, Homo sapiens
  Payload ID: 19542
  Gene Name: XIAP associated factor 1
  ENST ID: ENST00000574394
  CDS Start-End: 176-576
agagcctccctggacgctgtttgcaaggtcctcaccgcctggaagtccaggagccatttttagggaacagcattcaagctcaacatgctgtgggctgggccatcggaaaactttcagttttgtttccttgcctgcaagaaacgaaactcaaccgaaagcctgcagagagcagaacatggaaggagacttctcggtgtgcaggaactgtaaaagacatgtagtctctgccaacttcaccctccatgaggcttactgcctgcggttcctggtcctgtgtccggagtgtgaggagcctgtccccaaggaaaccatggaggagcactgcaagcttgagcaccagcaggttgggtgtacgatgtgtcagcagagcatgcagaagtcctcgctggagtttcataaggccaatgagtgccaggagcgccctgttgagtgtaagttctgcaaactggacatgcagctcagcaagctggagctccacgagtcctactgtggcagccggacagagctctgccaaggctgtggccagttcatcatgcaccgcatgctcgcccagcacagagatgtctgtcgcagtga

SEQ ID NO: 200427 - DNA, 557 bp, Homo sapiens
  Payload ID: 19542
  Gene Name: XIAP associated factor 1
  ENST ID: ENST00000575147
  CDS Start-End: 13-204
agagagcagaacatggaaggagacttctcggtgtgcaggaactgtaaaagacatgtagtctctgccaacttcaccctccatgaggcttactgcctgcggttcctggtcctgtgtccggagtgtgaggagcctgtccccaaggaaaccatggaggagcactgcaagcttgagcaccagcaggcttggagagcagtggagaactagcccaccgcataacacaggccaatgagtgccaggagcgccctgttgagtgtaagttctgcaaactggacatgcagctcagcaagctggagctccacgagtcctactgtggcagccggacagagctctgccaaggctgtggccagttcatcatgcaccgcatgctcgcccagcacagagatgtctgtcgcagtgaacaggcccagctcgggaaagaaaccagtcctgatccaggaaaatgtctctccattacggttgctgctgccctgagtgcacatctgtggccataaaggaaatgatgtgggtgattcggccaagagttgcctgtgtggtcaaggatgccggcagcgcaggaa

SEQ ID NO: 200428 - DNA, 763 bp, Homo sapiens
  Payload ID: 19542
  Gene Name: XIAP associated factor 1
  Uniprot ID: Q6GPH4
  ENST ID: ENST00000571673
  CDS Start-End: 1-369
atggaaggagacttctcggtgtgcaggaactgtaaaagacatgtagtctctgccaacttcaccctccatgaggcttactgcctgcggttcctggtcctgtgtccggagtgtgaggagcctgtccccaaggaaaccatggaggagcactgcaagcttgagcaccagcaggccaatgagtgccaggagcgccctgttgagtgtaagttctgcaaactggacatgcagctcagcaagctggagctccacgagtcctactgtggcagccggacagagctctgccaaggctgtggccagttcatcatgcaccgcatgctcgcccagcacagagatgtctgtcgcagtgaacaggcccagctcgggaaagggtaaatgttgtccagactcagagtttaagaaacactttcctgttggaaatccagaaattcttccttcatctcttccaagtcaagctgctgaaaatcaaacttccacgatggagaaagatgttcgtccaaagacaagaagtataaacagatttcctcttcattctgaaagttcatcaaagaaagcaccaagaagcaaaaacaaaaccttggatccacttttgatgtcagagcccaagcccaggaccagctcccctagaggagataaagcagcctatgacattctgaggagatgttctcagtgtggcatcctgcttcccctgccgatcctaaatcaacatcaggagaaatgccggtggttagcttcatcaaaaggaaaacaagtgagaaatttcagctag

SEQ ID NO: 200429 - DNA, 565 bp, Homo sapiens
  Payload ID: 19542
  Gene Name: XIAP associated factor 1
  ENST ID: ENST00000571135
  CDS Start-End: 3-389
acatggaaggagacttctcggtgtgcaggaactgtaaaagacatgtagtctctgccaacttcaccctccatgaggcttactgcctgcggttcctggtcctgtgtccggagtgtgaggagcctgtccccaaggaaaccatggaggagcactgcaagcttgagcaccagcaggcttatggatctggcataggcaagaggttctggtttcaggaaagactggctgttctcttgagatctgtaaagagaggatgtgaaaaaggaaggtcctggaaggcagtcagatggagccctgtttcccgcctttccatgtccattcctcctggggcccctgatctgtctctctggagatactcaagctcaggcagccgttgccaactcagactggtctgacaaacacttcttgaacactgggcggggtgctagagagacactgaggttgggtgtacgatgtgtcagcagagcatgcagaagtcctcgctggagtttcataaggccaatgagtgccaggagcgccctgttgagtgtaagttctgcaaactggacatgcagctcagcaagctggagct

SEQ ID NO: 200430 - DNA, 588 bp, Homo sapiens
  Payload ID: 19542
  Gene Name: XIAP associated factor 1
  ENST ID: ENST00000572546
  CDS Start-End: 34-471
gaaactcaaccgaaagcctgcagagagcagaacatggaaggagacttctcggtgtgcaggaactgtaaaagacatgtagtctctgccaacttcaccctccatgaggcttactgcctgcggttcctggtcctgtgtccggagtgtgaggagcctgtccccaaggaaaccatggaggagcactgcaagcttgagcaccagcaggccaatgagtgccaggagcgccctgttgagtgtaagttctgcaaactggacatgcagctcagcaagctggagctccacgagtcctactgtggcagccggacagagctctgccaaggctgtggccagttcatcatgcaccgcatgctcgcccagcacagagatgtctgtcgcagtgaacaggcccagctcgggaaagaaaccagtcctgatccaggaaaatgtctctccattacggttgctgctgccctgagtgcacatctgtggccataaaggaaatgatgtgggtgattcggccaagagttgcctgtgtggtcaaggatgccggcagcgcaggaaagtcaagaccaggggaaagaatttcagctcctgaaagggaaatctactgtc

SEQ ID NO: 200431 - DNA, 2830 bp, Homo sapiens
  Payload ID: 19542
  Gene Name: XIAP associated factor 1
  ENST ID: ENST00000575369
  CDS Start-End: 632-1018
gatgttgtttagagttcttctgttagcacagctgtttctagggtctggaaaaactctaaggacccccaggaggatacacaccagattgggtctgggctcacaccaccctgcatccccagagcctccctggacgctgtttgcaaggtcctcaccgcctggaagtccaggagccatttttagggaacagcattcaagctcaacatggcaagttccctctttcctgcaggggaggaccagaagggagccggagatgggggagaagggtgggaggtggatggtttggaaaagggatggagacccagacggagagaagccagccagccagggtgagggaacaagctgctgtgctgcccaggagaggcctggcctcaggctgccagcctcagggaggtagatgcggctgtgacagcagcaaagaatgacggccaagggcgacagcaggggctggccatgctgtaaaggggcttcttgggagggtccagcctcaggaatcaaggggaactcctgagccgagaattctgaagatctcctccctccctgaagctgtgggctgggccatcggaaaactttcagttttgtttccttgcctgcaagaaacgaaactcaaccgaaagcctgcagagagcagaacatggaaggagacttctcggtgtgcaggaactgtaaaagacatgtagtctctgccaacttcaccctccatgaggcttactgcctgcggttcctggtcctgtgtccggagtgtgaggagcctgtccccaaggaaaccatggaggagcactgcaagcttgagcaccagcaggcttatggatctggcataggcaagaggttctggtttcaggaaagactggctgttctcttgagatctgtaaagagaggatgtgaaaaaggaaggtcctggaaggcagtcagatggagccctgtttcccgcctttccatgtccattcctcctggggcccctgatctgtctctctggagatactcaagctcaggcagccgttgccaactcagactggtctgacaaacacttcttgaacactgggcggggtgctagagagacactgaggtagccacatcggatccctgccctctgggagttcacagacccaaacccggaacactgtgagccaaagtggatgtggggcaggccctgggtgctgggtggacccacatctggtgtgtgtgtgtgtgtgtgtgtgtgtgtttaggttgggtgtacgatgtgtcagcagagcatgcagaagtcctcgctggagtttcataaggccaatgagtgccaggagcgccctgttgagtgtaagttctgcaaactggacatgcagctcagcaagctggagctccacgagtcctactgtggcagccggacagagctctgccaaggctgtggccagttcatcatgcaccgcatgctcgcccagcacagagatgtctgtcgcagtgaacaggcccagctcgggaaaggggaaagaatttcagctcctgaaagggaaatctactgtcattattgcaaccaaatgattccagaaaataagtatttccaccatatgggtaaatgttgtccagactcagagtttaagaaacactttcctgttggaaatccagaaattcttccttcatctcttccaagtcaagctgctgaaaatcaaacttccacgatggagaaagatgttcgtccaaagacaagaagtataaacagatttcctcttcattctgaaagttcatcaaagaaagcaccaagaagcaaaaacaaaaccttggatccacttttgatgtcagagcccaagcccaggaccagctcccctagaggagataaagcagcctatgacattctgaggagatgttctcagtgtggcatcctgcttcccctgccgatcctaaatcaacatcaggtactcagcctctgttctctgcttacctttctgggaaccatccgcacagtgtcttaaaaaaatccaagacctgaaagatgttcacaaatgttgtggctgaaaaggccgttttctctgactcccacttctctgggtgcccaaatgcactatctcgtagcacttaccacctggtttatttgcatcacctccgagagactgagtcacctttgactcaagccaggtctttgaaggtagagccaggtccctcttctctgtgtctccagcttctaggccagggattgatttggagcaactgcttcaaaactgttgagtaaatgaatgaatcagaggatacccagtctatctctctcatggtgtagatatggcactgaggcccagagatgagatgtcttggtcaagatcctaagccagttggtggtggcttacctccagcagatcaaggtttgcttcaagaagatcagggtttgtaggcatctccctgaatatcatgatttttatgtcctaggttattttctagtaataataataactggcattagaggttgttaaccattgtgtgccagttacaatacagagctctttataatcttcatcataaacaataggcatgcattttatctccattttacagataaggtgaagtagctttccaaggagtatacaattagaaggtggcaggatccagcctgagtccacatgtatatagctccaaagtttatgctcttaagctccagattaaatgccttacttaaaaaatttattttttttcaaaatacataagtactagattttgttggagctagttgatataatatcatataaagaagtataaaagcaaagctaaccctaattccccaaccccataccctgagataccactttggacagtcttatgggcatcttttcaaagctctacctttgcatatacaagcctaaacaagcat

SEQ ID NO: 200432 - DNA, 6460 bp, Homo sapiens
  Payload ID: 19543
  Gene Name: xin actin binding repeat containing 1
  Uniprot ID: Q702N8
  ENST ID: ENST00000340369
  CDS Start-End: 230-5761
cagagacctggagccagggcagcaagaaggtgtctgttggagccagcagaacagaaccaatttgaacaagaacctccagaggaacgacgaaccctgagaccacagctgctacagaccacaaacaccccatcagccaagagagacccttgcatccagcctctaccctgctgaacatctagatctaaggctcccaatcccatcctcatctctgccccttcttctcagaaggatggccgacacccagacacaggtggcccccacaccaaccatgaggatggcaactgcagaggacctgcccctccctccacccccagccctggaggacctgccactgccgccacccaaggaatccttctccaagttccatcagcagcggcaagctagtgagctccgccgcctctacaggcacatccaccctgagctccgcaagaatctggctgaggctgtggccgaggatctggctgaggtcctgggctctgaggaacccaccgagggtgacgttcagtgcatgcgctggatctttgagaactggagactggatgccattggagaacacgagaggccagctgccaaggagcccgtgctgtgtggtgacgtccaggccacctcccgcaagtttgaggaaggctcctttgccaacagcacagaccaggagccaaccaggccccagccaggtggaggagacgttcgtgcagcccgctggctatttgagacaaagccactggacgagctgacagggcaagccaaggaactggaggccactgtgagggagcctgcagccagcggagatgtgcagggtaccaggatgctctttgagacgcggccgctggaccgcctgggctcccgcccctccctgcaggagcagagccccttggaactgcgctcagagatccaggagctgaagggtgatgtgaaaaagacagtgaagctcttccaaacggagcccctgtgtgccatccaggatgcagagggcgccatccatgaggtcaaggccgcatgccgggaggagatccaaagcaacgcggtgaggtctgcccgctggctctttgagacccggcctctggacgccatcaaccaggaccccagccaggtgcgggtgatccgggggatttccctggaggagggggcccggcccgacgtcagtgcaactcgctggatctttgagacacagcccctggatgccatccgggagatcttggtagatgagaaggacttccagccatccccagaccttatcccacctggtccagatgttcagcagcagcagcatctgtttgagacccgagcgctggacactctgaagggggacgaagaggctggagcagaggccccacccaaggaggaagtggtccctggtgatgtccgctccaccctgtggctatttgaaacaaagcccctggatgctttcagagacaaggtccaagtgggtcacctacagcgagtggatccccaggacggtgaggggcatctatccagtgacagctcctcagcactgcccttctctcagagtgccccccagagggatgagctaaagggggatgtgaagacttttaagaacctttttgagacccttcccttggacagcattggacagggtgaggttctggcccatgggagtccaagcagagaagaaggaactgattctgctgggcaggcccagggcatagggtccccagtgtatgccatgcaggacagcaagggccgcctccatgccctgacctctgttagcagagagcagatagtcggaggtgatgtgcagggctacaggtggatgtttgagacacagcccctagaccagctcggccgaagccccagtaccatcgacgtggtgcggggcatcacccggcaggaagtggtggctggggacgttggcacagctcggtggctttttgagacccagcccctggagatgatccaccaacgggagcagcaggaacgacagaaagaagaagggaagagtcagggagacccccagcctgaggcacccccaaagggcgatgtgcagaccatccggtggttgttcgagacttgcccaatgagtgagttggccgaaaagcaggggtcagaggtcacagatcccacagccaaggctgaggcacagtcctgcacctggatgttcaagccccaacctgtggacaggccagtgggctccagggagcagcacctgcaggttagccaggtcccggctggggaaagacagacagacagacacgtctttgagaccgagcctcttcaggcctcaggccgtccctgtggaagacggcctgtgagatactgcagccgcgtggagatcccttcagggcaggtgtctcgtcagaaagaggtttttcaggccctggaggcaggcaagaaggaagaacaggagccccgggtaatcgctgggtccatccccgcgggttctgtccacaagttcacttggctttttgagaattgtcccatgggctccctggcagctgagagcatccaagggggcaacctcctggaagagcagcccatgagcccctcaggcaacaggatgcaagagagccaggagactgcagctgaggggaccctgcggactctgcatgccacacctggcatcctgcaccatggaggcatcctcatggaggcccgagggccaggggagctctgtcttgccaagtatgtgctctcgggcacagggcaggggcacccttatatacgaaaggaggagctggtgtcaggtgaacttcccaggatcatctgccaagtcctgcgccggccagatgtggaccagcaggggctgctggtgcaggaagacccaactggccagctccaactcaagccgctgaggctgccaactccaggcagcagtgggaatattgaagacatggaccctgagctccagcagctgctggcttgcggtcttgggacctccgtggcaaggactgggctggtgatgcaggagacagagcagggcctggtcgcactgactgcctactctctgcagccccggctaactagcaaggcctctgagaggagcagcgtgcagctgttggccagctgcatagataaaggagacctgagtggcctgcacagtctgcggtgggagcccccggctgacccgagtccagtgccagccagcgagggggcccagagcctgcacccaactgagagcatcatccatgttcccccactggaccccagcatggggatggggcatctgagagcctcaggggccaccccttgccctcctcaggccattggaaaggcagtccctctggctggggaagctgcagcaccagcccaattgcaaaacacagaaaagcaggaagacagtcactctggacagaaagggatggcagtcttgggaaagtcagaaggagccacgactacccctccggggcctggggccccagacctcctggccgccatgcagagtctgcggatggcaacagctgaagcccagagcctgcaccagcaagttctgaacaagcacaagcagggccccaccccaacagccacttccaaccccatccaggacggtcttcggaaagctggggctacccaaagcaacataaggcctgggggtggaagtgatccccggatcccagcagcccccagaaaggtcagtagggaagagcaagcactacccagagggctgcctggggggtgggtgacaattcaggatggcatctacaccgctcatcccgtgaggacctttgacccacctgggggtgtccagctttctcagagggaaccccagtcaaggcacagggagactgccctctcagtccaggctccccgcccactccagggaggcccaggtcagagtactgggccagggcgggaggagcctgggggctgcacacagatggcctgggggccaccagggaaggcgatggcagaagtctgcccagggggcctccaagctgcagagaccaccctgaagactgcccctctaggccgccacattctggcctctgggccccaagctgcaggtgccagcccgcacccccataatgcctttgttcctcctcctcctactctcccagctgctgtgacaggacctgactttccagctggagcccaccgtgctgaggactccatccagcaagcctctgagcccctgaaggacccccttcttcactcccacagcagccctgctggccagagaacccctggagggtcacagacaaagaccccaaaactggaccccaccatgcccccaaagaagaagccgcagctgccccctaaacctgcacacctaacccagagccaccctcctcagaggctgcccaagcccttgcctctatctcccagcttttcctcggaggtggggcaaagagaacaccaacgaggtgagagagatacagccatccctcagccagccaaggttcccactactgtagaccagggccacatacctctggccagatgtcccagtggacatagccagcccagcttacaacatggcctcagcaccacggcccccaggcccaccaagaatcaggctacaggcagcaatgcccagagctctgagccccccaagctcaatgccctcaaccatgatcccacctcaccacagtggggccccggcccctcaggagagcagcccatggaaggttcccaccaaggggcccctgagagccctgacagtctgcaaagaaaccagaaagagctccagggcctcctgaaccaggtgcaagccctggagaaggaggccgcaagcagtgtggacgtgcaggccctgcggaggctctttgaggccgtgccccagctgggaggggctgctcctcaggctcctgctgcccaccaaaagcccgaggcctcagtggagcaggcctttggggagctgacacgggtcagcacggaagttgctcaactgaaggaacagaccttggcaaggctgctggacattgaagaggctgtgcacaaggcactcagctccatgtctagcctccagcctgaggccagtgccagaggccatttccagggacctccaaaagaccacagtgcccacaagatcagtgtcacagtcagcagtagcgccaggcccagtggctcaggccaggaggtcggaggtcaaactgcagtcaagaaccaagccaaggttgaatgccacactgaggcccagagtcaagtcaagatcagaaatcacacagaggccagaggtcacacagcctcaactgccccttccaccaggaggcaggagacatcaagagagtatttgtgccctcctcgggttttaccttccagccgagattctccctcctccccaacatttatctccatccagtcggccacaaggaagcctctagagactcccagctttaagggcaaccctgatgtctcagtgaaaagcacacaactggctcaggacataggccaggccctgctccaccagaaaggtgtccaagacaaaactgggaagaaggacatcacccagtgctctgtgcaacctgaacctgcccctccctcagccagtcccctgcccagagggtggcaaaagagtgttctggagctacagacggggccagggagctcacaacactatggagccatgagaaccgtgactgaacagtatgaggaggtggaccagtttgggaacacagtcctcatgtcttccaccacagtcaccgagcaggcagagccacccaggaacccaggctcccacctcgggctccacgcctcccccttgctgaggcagttcctgcacagcccagctgggttcagcagtgacctgacagaagctgagacggtgcaggtgtcctgcagctactcccagccagctgcccagtgaggcccaccgcctcccaccacacctgccacctgttcctggcctccactgccccaggactgaagtgggtacctgcctcctgtacactggagcaaggaccaagaggaaatggcatcttcagaggattactgtgggccatttccctttcgcagttctttcaataggcccagttcttccaaatggaaaaagaaaggtctggaagaggcccacagagttgcacaggcgtgggggtaggatgggggctcccagctgcttgtggaggatgtaatatatacagacacacacatgtttttcacacaggcctggcccacgcatcgacatgtgtgaatttgcacaccactgcctgaattggagccccccagagtgtccctctacccagagtttttatttctttaattagtctgagtgttcccagccatctgctccttaatccctggagaggaacagagccaactggacacagcgttggtctctgtttggaatcactgtgaggtctccagaaggacctggccgccagccccttcatcaccatctccatcattcagctggtcatctggtggcccaaaggtcacccaaagagtcagcaatcagcatgtccctagaagccaaatgcactgcctttctctgtccccatgactgtcccccactctgcaccccaaatgggaagcatacggtctgaataaatccaagttttattctcta

SEQ ID NO: 200433 - DNA, 6040 bp, Homo sapiens
  Payload ID: 19543
  Gene Name: xin actin binding repeat containing 1
  Uniprot ID: Q702N8
  ENST ID: ENST00000396251
  CDS Start-End: 232-3597
gacagagacctggagccagggcagcaagaaggtgtctgttggagccagcagaacagaaccaatttgaacaagaacctccagaggaacgacgaaccctgagaccacagctgctacagaccacaaacaccccatcagccaagagagacccttgcatccagcctctaccctgctgaacatctagatctaaggctcccaatcccatcctcatctctgccccttcttctcagaaggatggccgacacccagacacaggtggcccccacaccaaccatgaggatggcaactgcagaggacctgcccctccctccacccccagccctggaggacctgccactgccgccacccaaggaatccttctccaagttccatcagcagcggcaagctagtgagctccgccgcctctacaggcacatccaccctgagctccgcaagaatctggctgaggctgtggccgaggatctggctgaggtcctgggctctgaggaacccaccgagggtgacgttcagtgcatgcgctggatctttgagaactggagactggatgccattggagaacacgagaggccagctgccaaggagcccgtgctgtgtggtgacgtccaggccacctcccgcaagtttgaggaaggctcctttgccaacagcacagaccaggagccaaccaggccccagccaggtggaggagacgttcgtgcagcccgctggctatttgagacaaagccactggacgagctgacagggcaagccaaggaactggaggccactgtgagggagcctgcagccagcggagatgtgcagggtaccaggatgctctttgagacgcggccgctggaccgcctgggctcccgcccctccctgcaggagcagagccccttggaactgcgctcagagatccaggagctgaagggtgatgtgaaaaagacagtgaagctcttccaaacggagcccctgtgtgccatccaggatgcagagggcgccatccatgaggtcaaggccgcatgccgggaggagatccaaagcaacgcggtgaggtctgcccgctggctctttgagacccggcctctggacgccatcaaccaggaccccagccaggtgcgggtgatccgggggatttccctggaggagggggcccggcccgacgtcagtgcaactcgctggatctttgagacacagcccctggatgccatccgggagatcttggtagatgagaaggacttccagccatccccagaccttatcccacctggtccagatgttcagcagcagcagcatctgtttgagacccgagcgctggacactctgaagggggacgaagaggctggagcagaggccccacccaaggaggaagtggtccctggtgatgtccgctccaccctgtggctatttgaaacaaagcccctggatgctttcagagacaaggtccaagtgggtcacctacagcgagtggatccccaggacggtgaggggcatctatccagtgacagctcctcagcactgcccttctctcagagtgccccccagagggatgagctaaagggggatgtgaagacttttaagaacctttttgagacccttcccttggacagcattggacagggtgaggttctggcccatgggagtccaagcagagaagaaggaactgattctgctgggcaggcccagggcatagggtccccagtgtatgccatgcaggacagcaagggccgcctccatgccctgacctctgttagcagagagcagatagtcggaggtgatgtgcagggctacaggtggatgtttgagacacagcccctagaccagctcggccgaagccccagtaccatcgacgtggtgcggggcatcacccggcaggaagtggtggctggggacgttggcacagctcggtggctttttgagacccagcccctggagatgatccaccaacgggagcagcaggaacgacagaaagaagaagggaagagtcagggagacccccagcctgaggcacccccaaagggcgatgtgcagaccatccggtggttgttcgagacttgcccaatgagtgagttggccgaaaagcaggggtcagaggtcacagatcccacagccaaggctgaggcacagtcctgcacctggatgttcaagccccaacctgtggacaggccagtgggctccagggagcagcacctgcaggttagccaggtcccggctggggaaagacagacagacagacacgtctttgagaccgagcctcttcaggcctcaggccgtccctgtggaagacggcctgtgagatactgcagccgcgtggagatcccttcagggcaggtgtctcgtcagaaagaggtttttcaggccctggaggcaggcaagaaggaagaacaggagccccgggtaatcgctgggtccatccccgcgggttctgtccacaagttcacttggctttttgagaattgtcccatgggctccctggcagctgagagcatccaagggggcaacctcctggaagagcagcccatgagcccctcaggcaacaggatgcaagagagccaggagactgcagctgaggggaccctgcggactctgcatgccacacctggcatcctgcaccatggaggcatcctcatggaggcccgagggccaggggagctctgtcttgccaagtatgtgctctcgggcacagggcaggggcacccttatatacgaaaggaggagctggtgtcaggtgaacttcccaggatcatctgccaagtcctgcgccggccagatgtggaccagcaggggctgctggtgcaggaagacccaactggccagctccaactcaagccgctgaggctgccaactccaggcagcagtgggaatattgaagacatggaccctgagctccagcagctgctggcttgcggtcttgggacctccgtggcaaggactgggctggtgatgcaggagacagagcagggcctggtcgcactgactgcctactctctgcagccccggctaactagcaaggcctctgagaggagcagcgtgcagctgttggccagctgcatagataaaggagacctgagtggcctgcacagtctgcggtgggagcccccggctgacccgagtccagtgccagccagcgagggggcccagagcctgcacccaactgagagcatcatccatgttcccccactggaccccagcatggggatggggcatctgagagcctcaggggccaccccttgccctcctcaggccattggaaaggcagtccctctggctggggaagctgcagcaccagcccaattgcaaaacacagaaaagcaggaagacagtcactctggacagaaagggatggcagtcttgggaaagtcagaaggagccacgactacccctccggggcctggggccccagacctcctggccgccatgcagagtctgcggatggcaacagctgaagcccagagcctgcaccagcaagttctgaacaagcacaagcagggccccaccccaacagccacttccaaccccatccaggacggtcttcggaaagctggggctacccaaagcaacataaggcctgggggtggaagtgatccccggatcccagcagcccccagaaagctgctgtgacaggacctgactttccagctggagcccaccgtgctgaggactccatccagcaagcctctgagcccctgaaggacccccttcttcactcccacagcagccctgctggccagagaacccctggagggtcacagacaaagaccccaaaactggaccccaccatgcccccaaagaagaagccgcagctgccccctaaacctgcacacctaacccagagccaccctcctcagaggctgcccaagcccttgcctctatctcccagcttttcctcggaggtggggcaaagagaacaccaacgaggtgagagagatacagccatccctcagccagccaaggttcccactactgtagaccagggccacatacctctggccagatgtcccagtggacatagccagcccagcttacaacatggcctcagcaccacggcccccaggcccaccaagaatcaggctacaggcagcaatgcccagagctctgagccccccaagctcaatgccctcaaccatgatcccacctcaccacagtggggccccggcccctcaggagagcagcccatggaaggttcccaccaaggggcccctgagagccctgacagtctgcaaagaaaccagaaagagctccagggcctcctgaaccaggtgcaagccctggagaaggaggccgcaagcagtgtggacgtgcaggccctgcggaggctctttgaggccgtgccccagctgggaggggctgctcctcaggctcctgctgcccaccaaaagcccgaggcctcagtggagcaggcctttggggagctgacacgggtcagcacggaagttgctcaactgaaggaacagaccttggcaaggctgctggacattgaagaggctgtgcacaaggcactcagctccatgtctagcctccagcctgaggccagtgccagaggccatttccagggacctccaaaagaccacagtgcccacaagatcagtgtcacagtcagcagtagcgccaggcccagtggctcaggccaggaggtcggaggtcaaactgcagtcaagaaccaagccaaggttgaatgccacactgaggcccagagtcaagtcaagatcagaaatcacacagaggccagaggtcacacagcctcaactgccccttccaccaggaggcaggagacatcaagagagtatttgtgccctcctcgggttttaccttccagccgagattctccctcctccccaacatttatctccatccagtcggccacaaggaagcctctagagactcccagctttaagggcaaccctgatgtctcagtgaaaagcacacaactggctcaggacataggccaggccctgctccaccagaaaggtgtccaagacaaaactgggaagaaggacatcacccagtgctctgtgcaacctgaacctgcccctccctcagccagtcccctgcccagagggtggcaaaagagtgttctggagctacagacggggccagggagctcacaacactatggagccatgagaaccgtgactgaacagtatgaggaggtggaccagtttgggaacacagtcctcatgtcttccaccacagtcaccgagcaggcagagccacccaggaacccaggctcccacctcgggctccacgcctcccccttgctgaggcagttcctgcacagcccagctgggttcagcagtgacctgacagaagctgagacggtgcaggtgtcctgcagctactcccagccagctgcccagtgaggcccaccgcctcccaccacacctgccacctgttcctggcctccactgccccaggactgaagtgggtacctgcctcctgtacactggagcaaggaccaagaggaaatggcatcttcagaggattactgtgggccatttccctttcgcagttctttcaataggcccagttcttccaaatggaaaaagaaaggtctggaagaggcccacagagttgcacaggcgtgggggtaggatgggggctcccagctgcttgtggaggatgtaatatatacagacacacacatgtttttcacacaggcctggcccacgcatcgacatgtgtgaatttgcacaccactgcctgaattggagccccccagagtgtccctctacccagagtttttatttctttaattagtctgagtgttcccagccatctgctccttaatccctggagaggaacagagccaactggacacagcgttggtctctgtttggaatcactgtgaggtctccagaaggacctggccgccagccccttcatcaccatctccatcattcagctggtcatctggtggcccaaaggtcacccaaagagtcagcaatcagcatgtccctagaagccaaatgcactgcctttctctgtccccatgactgtcccccactctgcaccccaaatgggaagcatacggtctgaataaatccaagttttattctctactctg

SEQ ID NO: 200434 - DNA, 2596 bp, Homo sapiens
  Payload ID: 19543
  Gene Name: xin actin binding repeat containing 1
  Uniprot ID: Q702N8
  ENST ID: ENST00000421646
  CDS Start-End: 318-1898
acagagacctggagccagggcagcaagaaggtgtctgttggagccagcagaacagaaccaatttgaacaagaacctccagaggaacgacgaaccctgagaccacagctgctacagaccacaaacaccccatcagccaagagagacccttgctgctgtgacaggacctgactttccagctggagcccaccgtgctgaggactccatccagcaagcctctgagcccctgaaggacccccttcttcactcccacagcagccctgctggccagagaacccctggagggtcacagacaaagaccccaaaactggaccccaccatgcccccaaagaagaagccgcagctgccccctaaacctgcacacctaacccagagccaccctcctcagaggctgcccaagcccttgcctctatctcccagcttttcctcggaggtggggcaaagagaacaccaacgaggtgagagagatacagccatccctcagccagccaaggttcccactactgtagaccagggccacatacctctggccagatgtcccagtggacatagccagcccagcttacaacatggcctcagcaccacggcccccaggcccaccaagaatcaggctacaggcagcaatgcccagagctctgagccccccaagctcaatgccctcaaccatgatcccacctcaccacagtggggccccggcccctcaggagagcagcccatggaaggttcccaccaaggggcccctgagagccctgacagtctgcaaagaaaccagaaagagctccagggcctcctgaaccaggtgcaagccctggagaaggaggccgcaagcagtgtggacgtgcaggccctgcggaggctctttgaggccgtgccccagctgggaggggctgctcctcaggctcctgctgcccaccaaaagcccgaggcctcagtggagcaggcctttggggagctgacacgggtcagcacggaagttgctcaactgaaggaacagaccttggcaaggctgctggacattgaagaggctgtgcacaaggcactcagctccatgtctagcctccagcctgaggccagtgccagaggccatttccagggacctccaaaagaccacagtgcccacaagatcagtgtcacagtcagcagtagcgccaggcccagtggctcaggccaggaggtcggaggtcaaactgcagtcaagaaccaagccaaggttgaatgccacactgaggcccagagtcaagtcaagatcagaaatcacacagaggccagaggtcacacagcctcaactgccccttccaccaggaggcaggagacatcaagagagtatttgtgccctcctcgggttttaccttccagccgagattctccctcctccccaacatttatctccatccagtcggccacaaggaagcctctagagactcccagctttaagggcaaccctgatgtctcagtgaaaagcacacaactggctcaggacataggccaggccctgctccaccagaaaggtgtccaagacaaaactgggaagaaggacatcacccagtgctctgtgcaacctgaacctgcccctccctcagccagtcccctgcccagagggtggcaaaagagtgttctggagctacagacggggccagggagctcacaacactatggagccatgagaaccgtgactgaacagtatgaggaggtggaccagtttgggaacacagtcctcatgtcttccaccacagtcaccgagcaggcagagccacccaggaacccaggctcccacctcgggctccacgcctcccccttgctgaggcagttcctgcacagcccagctgggttcagcagtgacctgacagaagctgagacggtgcaggtgtcctgcagctactcccagccagctgcccagtgaggcccaccgcctcccaccacacctgccacctgttcctggcctccactgccccaggactgaagtgggtacctgcctcctgtacactggagcaaggaccaagaggaaatggcatcttcagaggattactgtgggccatttccctttcgcagttctttcaataggcccagttcttccaaatggaaaaagaaaggtctggaagaggcccacagagttgcacaggcgtgggggtaggatgggggctcccagctgcttgtggaggatgtaatatatacagacacacacatgtttttcacacaggcctggcccacgcatcgacatgtgtgaatttgcacaccactgcctgaattggagccccccagagtgtccctctacccagagtttttatttctttaattagtctgagtgttcccagccatctgctccttaatccctggagaggaacagagccaactggacacagcgttggtctctgtttggaatcactgtgaggtctccagaaggacctggccgccagccccttcatcaccatctccatcattcagctggtcatctggtggcccaaaggtcacccaaagagtcagcaatcagcatgtccctagaagccaaatgcactgcctttctctgtccccatgactgtcccccactctgcaccccaaatgggaagcatacggtctgaataaatccaagttttattctct

SEQ ID NO: 200435 - DNA, 5246 bp, Homo sapiens
  Payload ID: 19544
  Gene Name: xin actin binding repeat containing 2
  ENST ID: ENST00000295237
  CDS Start-End: 423-3314
caagcatataaaagataataagaacgatttttcccccaaagttgaactggcaacctccctgtcagatatggaatgtaaaattactacctcaaaggatcagaaaaaagtaatggtgatgaccagcagtgaacacacggagacaaagcagaacgttattagtaagagtcttgatgaaagaaaacaattatctattgactctgcaaactgtctctcacacacagttccaggaacttcagcacccaggaaaaaacagattgcgcctcttataaaatctcattcatttccagagagttcaggacaacaaaatccaaaaccttatatgagaaaatttaagacacctttaatgattgctgaagaaaaatatagacaacaatgttaaaactcaaagccaaaatcaacacataacagaggtggaaaaggaaatgccattacaaaaaaccaatgaggaggtttccctatctggaattgattcagaatgcactgtggttcaacccagcccaggctctcaaagtaatgctcggatactaggagtgtgttctgataaccaactctccacaacatcgccagaaacagtcgctgccaagaggctccaccatgttttagcagcttcagaagacaaagataagatgaaaaaggaagttttacaaagctcaagggacattatgcaatccaaatcagcttgcgaaattaaacaaagtcaccaagaatgtagtacccaacaaacacaacagaagaagtatttggagcagttgcacttgccccaaagcaaaccaatttccccaaatttcaaagttaaaaccatcaaacttccaactctagatcatacattaaatgaaacagaccacagctatgaaagtcataaacagcaatctgagattgatgttcaaacctttaccaaaaaacaatatctgaaaaccaagaaaactgaagcaagcactgaatgtagtcataagcaatctctggctgaaagacattatcagttacctaagaaggagaaaagagtgacagtacaattgcctacagaatccatacagaagaaccaggaagataagctcaagatggttcccaggaagcaaagagaatttagcggatctgacagagggaaacttccaggaagtgaagaaaaaaatcagggaccatcaatgattggtcgaaaagaagagagattaataactgaaagaaaacacgaacatctgaagaataaatcagcaccaaaggtcgtcaagcaaaaggttatcgatgcacatcttgattcacagactcagaattttcagcaaacacaaatacagaccgctgaaagtaaagctgaacataaaaaattgccccagccatataatagtctgcaggaagaaaaatgtctcgaagtcaagggcatacaagagaaacaagtcttctctaatactaaagattcaaagcaagagattacacagaacaaatctttcttttcctctgtgaaagaatcccagcgggatgatggaaaaggtgccttaaatatagtggaattcttgagaaaacgtgaagaactgcaacagattttgtcgagagtgaaacagtttgaagcagagccaaataaaagtggccttaaaacatttcagacactattaaatactatcccaggatggctgataagtgaagataagagagaatatgcagttcacattgccatggagaataatttagaaaaagtaaaagaagaaataacacatattaaaactcaagcggaagatatgcttgtgtcctatgaaaatataattcagacagccatgatgtcctccaaaacaggaaaaccgggaaataaacccactagtcttgatgaaacatcatccaaagtatctaatgttcatgtcagcaataataaaaatagtgaacagaaagaaaataaaattgccaaagagaaaacagtacagcaccaagtagcagctcatcatgaagcaactgttcgtagtcacgtgaaaacccatcaggaaattaaacttgatgatagcaacattcctcctccctctttaaaaacacgcccaccgtcaccaacttttatcacaatagaatctactgcccgacgaacagaaaaccctactaagaacgagctttctcagtcccctaaaaaggacagttatgttgaacccccaccaagaaggcccatgtcgcaaaaatctgaaattcacagagcaaacacttccccttctccacccaggagtcgctctgaacaacttgtcagactcaaagacaccactgcaaagttatccaaaggggccatcccatgtccagcagcaaccccggttccaattgtagagaagaggtctgaaatcatcatgtctcctgcaacacttcgtcgtcaaattaagatagaaactcgtggtagggactctccacctacaatcacaataccagtaaatataaatcatgctgctagtggttccttcagagaatctgtggacgctcaagaggaaatcaggaaagtggagaagagagctacttatgttcataaagatggactaaattccactgatcacatggtgcccgacactgaaagttatgatgcagttgaaatcatccgcaaggttgcagtgcctcctcgcctgtcagagcacacacagagatatgaagcggccaaccgaactgttcaaatggctgaaaatttcgtgaatgaccctgaaaatgaaataaacagatggttcagggaatttgagcatggcccagtttctgaagcaaagtcaaatagaagagtttatgcaaagggagaaacaaaccataacatacaacaagaaagtcgtacattttgtaaggaggaatttggattaacatctttaggaaacacgagttttacagacttttcttgcaaacatcctagagaactgcgagaaaagattcctgttaagcagcccaggatctgctctgaaaccaggtctctaagtgaacatttctcaggcatggatgcatttgagagtcaaattgttgagtcgaagatgaaaacctcttcatcacatagctcagaagctggcaaatctggctgtgacttcaagcatgccccaccaacctatgaggatgtcattgctggacatattttagatatctctgattcacctaaagaagtaagaaaaaattttcaaaagacgtggcaagagagtggaagagtttttaaaggcctgggatatgcaaccgcagatgcttctgcaactgagatgagaaccaccttccaagaggaatctgcatttataagtgaagctgctgctccaagacaaggaaatatgtatactttgtcaaaagacagtttatccaatggagtgcctagtggcagacaagcagaattttcataagtcctgcttccgatgccaccattgcaacagtaaactaagtttgggaaattatgcatcacttcatggacaaatatactgtaaacctcactttaaacaacttttcaaatccaaaggaaattatgatgaaggttttggacataagcagcataaagatagatggaactgcaaaaaccaaagcagatcagtggactttattcctaatgaagaaccaaatatgtgtaaaaatattgcagaaaacacccttgtacctggagatcgtaatgaacatttagatgctggtaacagtgaagggcaaaggaatgatttgagaaaattaggggaaaggggaaaattaaaagtcatttggcctccttccaaggagatccctaagaaaaccttaccctttgaggaagagctcaaaatgagtaaacctaagtggccacctgaaatgacaaccctgctatcccctgaatttaaaagtgaatctctgctagaagatgttagaactccagaaaataaaggacaaagacaagatcactttccatttttgcagccttatctacagtccacccatgtttgtcagaaagaggatgttataggaatcaaagaaatgaaaatgcctgaaggaagaaaagatgaaaagaaggaaggaaggaagaatgtgcaagataggccgagtgaagctgaagacacaaagagtaacaggaaaagtgctatggatcttaatgacaacaataatgtgattgtgcagagtgctgaaaaggagaaaaatgaaaaaactaaccaaactaatggtgcagaagttttacaggttactaacactgatgatgagatgatgccagaaaatcataaagaaaatttgaataagaataataataacaattatgtagcagtctcatatctgaataattgcaggcagaagacatctattttagaatttcttgatctattacccttgtcgagtgaagcaaatgacactgcaaatgaatatgaaattgagaagttagaaaatacatctagaatctcagagttacttggtatatttgaatctgaaaagacttattcgaggaatgtactagcaatggctctgaagaaacagactgacagagcagctgctggcagtcctgtgcagcctgctccaaaaccaagcctcagcagaggccttatggtaaaggggggaagttcaatcatctctcctgatacaaatctcttaaacattaaaggaagccattcaaagagcaaaaatttacactttttcttttctaacaccgtgaaaatcactgcattttccaagaaaaatgagaacattttcaattgtgatttaatagattctgtagatcaaattaaaaatatgccatgcttggatttaagggaatttggaaaggatgttaaaccttggcatgttgaaacaacagaagctgcccgcaataatgaaaacacaggttttgatgctctgagccatgaatgtacagctaagcctttgtttcccagagtggaggtgcagtcagaacaactcacggtggaagagcagattaaaagaaacaggtgctacagtgacactgagtaaaatatctatggccactgacagtccacacttaggcactgagagatattgatgttctgaaataagattttatgaatttggatacccttttgaggaacttgatgtaaacatggtgttcagaaatctcgtgtctatctcaatgggatatttcttgtattacaccttgtcatttttttcacaatttatttacatctacttttgtttgaactggaatgaagagatgaaacactatggatatgttttccattcaaatggcactttagcatattgttctgttttcctgtaaaacatcatgggtgtgatttttatactgctgctgcttgtcacaattattataacttctctgtaatttcctctgaaataaaattgaatcacctgaggtgcaaacc

SEQ ID NO: 200436 - DNA, 3292 bp, Homo sapiens
  Payload ID: 19544
  Gene Name: xin actin binding repeat containing 2
  Uniprot ID: A4UGR9
  ENST ID: ENST00000409043
  CDS Start-End: 90-2906
ggagaaatctggcaggtctctaggcagacaaaagggaacatctggtagggactgggacatgtagaaaaaaggacaacctggacccatccatgttcccaatgcagaagggctccctcaacctcctgaggcagaaatgggaatcttgtgattatcagagaagtgagtgtcatcccagggacagccattgtacaattttccagcctcaggaaagcaaattgcttgcgcctgaaggagaggtagtatcagcacctcaatctttggatcccacaagtctgccctacagtacaggggaagagatgtggagttcgaagccggaagagaaggattctgtggacaagagtaacaacaccagggaatatggtcggccagaagtgctgaaggaggattccctgagcagtcggcgcaggattgaacgcttttccattgcccttgatgagctgaggagtgtgtttgaggctcctaagagtggaaacaaaccagctgagtacggtggaaaggaagtggaaattgagcgaagtttgtgctcgccagcttttaagagtcaccctgggagccagctggaggattctgtgaaagattcagacaagaaaggcaaggaaacatcttttgacaagatgtcacctgaaagtggtcacagccgcatctttgaagcgactgctggccctaataagcctgagagtggatttgcagaagacagtgctgctcggggcgagggtgtgtcagacctccacgaagtggtctccctgaaggagcggatggcgaggtaccaggcagctgtttccaggggtgactgccgcagcttctctgctaatatgatggaagaatcagaaatgtgcgcagtgcctggtggtttggccaaggtgaagaaacaatttgaggacgaaattacttcttcccgtaatacctttgctcaataccaatatcaacatcagaacagatctgagcaggaggcaattcatagcagccaggttggcacttcaagaagcagccaggaaatggcaagaaatgaacaagaagggtccaaagtacagaaaattgatgttcatggaacagaaatggtctctcatcttgaaaagcacaccgaggaagtaaaccaagcatctcagtttcatcaatatgttcaagaaactgtcattgatacacctgaggatgaagagattccaaaggtttcgactaagttgttaaaagagcagtttgaaaagtctgcccaggaaaagatcctttattctgacaaagagatgacaaccccagccaagcagattaagaagctgctgctccaagacaaggaaatatgtatactttgtcaaaagacagtttatccaatggagtgcctagtggcagacaagcagaattttcataagtcctgcttccgatgccaccattgcaacagtaaactaagtttgggaaattatgcatcacttcatggacaaatatactgtaaacctcactttaaacaacttttcaaatccaaaggaaattatgatgaaggttttggacataagcagcataaagatagatggaactgcaaaaaccaaagcagatcagtggactttattcctaatgaagaaccaaatatgtgtaaaaatattgcagaaaacacccttgtacctggagatcgtaatgaacatttagatgctggtaacagtgaagggcaaaggaatgatttgagaaaattaggggaaaggggaaaattaaaagtcatttggcctccttccaaggagatccctaagaaaaccttaccctttgaggaagagctcaaaatgagtaaacctaagtggccacctgaaatgacaaccctgctatcccctgaatttaaaagtgaatctctgctagaagatgttagaactccagaaaataaaggacaaagacaagatcactttccatttttgcagccttatctacagtccacccatgtttgtcagaaagaggatgttataggaatcaaagaaatgaaaatgcctgaaggaagaaaagatgaaaagaaggaaggaaggaagaatgtgcaagataggccgagtgaagctgaagacacaaagagtaacaggaaaagtgctatggatcttaatgacaacaataatgtgattgtgcagagtgctgaaaaggagaaaaatgaaaaaactaaccaaactaatggtgcagaagttttacaggttactaacactgatgatgagatgatgccagaaaatcataaagaaaatttgaataagaataataataacaattatgtagcagtctcatatctgaataattgcaggcagaagacatctattttagaatttcttgatctattacccttgtcgagtgaagcaaatgacactgcaaatgaatatgaaattgagaagttagaaaatacatctagaatctcagagttacttggtatatttgaatctgaaaagacttattcgaggaatgtactagcaatggctctgaagaaacagactgacagagcagctgctggcagtcctgtgcagcctgctccaaaaccaagcctcagcagaggccttatggtaaaggggggaagttcaatcatctctcctgatacaaatctcttaaacattaaaggaagccattcaaagagcaaaaatttacactttttcttttctaacaccgtgaaaatcactgcattttccaagaaaaatgagaacattttcaattgtgatttaatagattctgtagatcaaattaaaaatatgccatgcttggatttaagggaatttggaaaggatgttaaaccttggcatgttgaaacaacagaagctgcccgcaataatgaaaacacaggttttgatgctctgagccatgaatgtacagctaagcctttgtttcccagagtggaggtgcagtcagaacaactcacggtggaagagcagattaaaagaaacaggtgctacagtgacactgagtaaaatatctatggccactgacagtccacacttaggcactgagagatattgatgttctgaaataagattttatgaatttggatacccttttgaggaacttgatgtaaacatggtgttcagaaatctcgtgtctatctcaatgggatatttcttgtattacaccttgtcatttttttcacaatttatttacatctacttttgtttgaactggaatgaagagatgaaacactatggatatgttttccattcaaatggcactttagcatattgttctgttttcctgtaaaacatcatgggtgtgatttttatactgctgctgcttgtcacaattattataacttctctgtaatttcctctgaaataaaattgaatcacctgaggtgcaaacc

SEQ ID NO: 200437 - DNA, 3391 bp, Homo sapiens
  Payload ID: 19544
  Gene Name: xin actin binding repeat containing 2
  Uniprot ID: A4UGR9
  ENST ID: ENST00000409728
  CDS Start-End: 90-3005
ggagaaatctggcaggtctctaggcagacaaaagggaacatctggtagggactgggacatgtagaaaaaaggacaacctggacccatccatgttcccaatgcagaagggctccctcaacctcctgaggcagaaatgggaatcttgtgattatcagagaagtgagtgtcatcccagggacagccattgtacaattttccagcctcaggaaagcaaattgcttgcgcctgaaggagaggtagtatcagcacctcaatctttggatcccacaagtctgccctacagtacaggggaagagatgtggagttcgaagccggaagagaaggattctgtggacaagagtaacaacaccagggaatatggtcggccagaagtgctgaaggaggattccctgagcagtcggcgcaggattgaacgcttttccattgcccttgatgagctgaggagtgtgtttgaggctcctaagagtggaaacaaaccagctgagtacggtggaaaggaagtggaaattgagcgaagtttgtgctcgccagcttttaagagtcaccctgggagccagctggaggattctgtgaaagattcagacaagaaaggcaaggaaacatcttttgacaagatgtcacctgaaagtggtcacagccgcatctttgaagcagtgttctccacggaccaagcccagattctcaggctccacctgcatccaaaattgacaaagacccccaagaacagcctcaaatcctcaacttatatttcgactgctggccctaataagcctgagagtggatttgcagaagacagtgctgctcggggcgagggtgtgtcagacctccacgaagtggtctccctgaaggagcggatggcgaggtaccaggcagctgtttccaggggtgactgccgcagcttctctgctaatatgatggaagaatcagaaatgtgcgcagtgcctggtggtttggccaaggtgaagaaacaatttgaggacgaaattacttcttcccgtaatacctttgctcaataccaatatcaacatcagaacagatctgagcaggaggcaattcatagcagccaggttggcacttcaagaagcagccaggaaatggcaagaaatgaacaagaagggtccaaagtacagaaaattgatgttcatggaacagaaatggtctctcatcttgaaaagcacaccgaggaagtaaaccaagcatctcagtttcatcaatatgttcaagaaactgtcattgatacacctgaggatgaagagattccaaaggtttcgactaagttgttaaaagagcagtttgaaaagtctgcccaggaaaagatcctttattctgacaaagagatgacaaccccagccaagcagattaagaagctgctgctccaagacaaggaaatatgtatactttgtcaaaagacagtttatccaatggagtgcctagtggcagacaagcagaattttcataagtcctgcttccgatgccaccattgcaacagtaaactaagtttgggaaattatgcatcacttcatggacaaatatactgtaaacctcactttaaacaacttttcaaatccaaaggaaattatgatgaaggttttggacataagcagcataaagatagatggaactgcaaaaaccaaagcagatcagtggactttattcctaatgaagaaccaaatatgtgtaaaaatattgcagaaaacacccttgtacctggagatcgtaatgaacatttagatgctggtaacagtgaagggcaaaggaatgatttgagaaaattaggggaaaggggaaaattaaaagtcatttggcctccttccaaggagatccctaagaaaaccttaccctttgaggaagagctcaaaatgagtaaacctaagtggccacctgaaatgacaaccctgctatcccctgaatttaaaagtgaatctctgctagaagatgttagaactccagaaaataaaggacaaagacaagatcactttccatttttgcagccttatctacagtccacccatgtttgtcagaaagaggatgttataggaatcaaagaaatgaaaatgcctgaaggaagaaaagatgaaaagaaggaaggaaggaagaatgtgcaagataggccgagtgaagctgaagacacaaagagtaacaggaaaagtgctatggatcttaatgacaacaataatgtgattgtgcagagtgctgaaaaggagaaaaatgaaaaaactaaccaaactaatggtgcagaagttttacaggttactaacactgatgatgagatgatgccagaaaatcataaagaaaatttgaataagaataataataacaattatgtagcagtctcatatctgaataattgcaggcagaagacatctattttagaatttcttgatctattacccttgtcgagtgaagcaaatgacactgcaaatgaatatgaaattgagaagttagaaaatacatctagaatctcagagttacttggtatatttgaatctgaaaagacttattcgaggaatgtactagcaatggctctgaagaaacagactgacagagcagctgctggcagtcctgtgcagcctgctccaaaaccaagcctcagcagaggccttatggtaaaggggggaagttcaatcatctctcctgatacaaatctcttaaacattaaaggaagccattcaaagagcaaaaatttacactttttcttttctaacaccgtgaaaatcactgcattttccaagaaaaatgagaacattttcaattgtgatttaatagattctgtagatcaaattaaaaatatgccatgcttggatttaagggaatttggaaaggatgttaaaccttggcatgttgaaacaacagaagctgcccgcaataatgaaaacacaggttttgatgctctgagccatgaatgtacagctaagcctttgtttcccagagtggaggtgcagtcagaacaactcacggtggaagagcagattaaaagaaacaggtgctacagtgacactgagtaaaatatctatggccactgacagtccacacttaggcactgagagatattgatgttctgaaataagattttatgaatttggatacccttttgaggaacttgatgtaaacatggtgttcagaaatctcgtgtctatctcaatgggatatttcttgtattacaccttgtcatttttttcacaatttatttacatctacttttgtttgaactggaatgaagagatgaaacactatggatatgttttccattcaaatggcactttagcatattgttctgttttcctgtaaaacatcatgggtgtgatttttatactgctgctgcttgtcacaattattataacttctctgtaatttcctctgaaataaaattgaatcacctgaggtgcaaacc

SEQ ID NO: 200438 - DNA, 12675 bp, Homo sapiens
  Payload ID: 19544
  Gene Name: xin actin binding repeat containing 2
  Uniprot ID: A4UGR9
  ENST ID: ENST00000409195
  CDS Start-End: 90-10739
ggagaaatctggcaggtctctaggcagacaaaagggaacatctggtagggactgggacatgtagaaaaaaggacaacctggacccatccatgttcccaatgcagaagggctccctcaacctcctgaggcagaaatgggaatcttgtgattatcagagaagtgagtgtcatcccagggacagccattgtacaattttccagcctcaggaaagcaaattgcttgcgcctgaaggagaggtagtatcagcacctcaatctttggatcccacaagtctgccctacagtacaggggaagagatgtggagttcgaagccggaagagaaggattctgtggacaagagtaacaacaccagggaatatggtcggccagaagtgctgaaggaggattccctgagcagtcggcgcaggattgaacgcttttccattgcccttgatgagctgaggagtgtgtttgaggctcctaagagtggaaacaaaccagctgagtacggtggaaaggaagtggaaattgagcgaagtttgtgctcgccagcttttaagagtcaccctgggagccagctggaggattctgtgaaagattcagacaagaaaggcaaggaaacatcttttgacaagatgtcacctgaaagtggtcacagccgcatctttgaagcgactgctggccctaataagcctgagagtggatttgcagaagacagtgctgctcggggcgagggtgtgtcagacctccacgaagtggtctccctgaaggagcggatggcgaggtaccaggcagctgtttccaggggtgactgccgcagcttctctgctaatatgatggaagaatcagaaatgtgcgcagtgcctggtggtttggccaaggtgaagaaacaatttgaggacgaaattacttcttcccgtaatacctttgctcaataccaatatcaacatcagaacagatctgagcaggaggcaattcatagcagccaggttggcacttcaagaagcagccaggaaatggcaagaaatgaacaagaagggtccaaagtacagaaaattgatgttcatggaacagaaatggtctctcatcttgaaaagcacaccgaggaagtaaaccaagcatctcagtttcatcaatatgttcaagaaactgtcattgatacacctgaggatgaagagattccaaaggtttcgactaagttgttaaaagagcagtttgaaaagtctgcccaggaaaagatcctttattctgacaaagagatgacaaccccagccaagcagattaagactgaaagtgaatatgaagagactttcaagccatcatcagttgtgagtacctcttccacttcttgcgtttcaaccagccagaggaaggaaacatcaactacaagatatagtgatcacagtgtcacttcctcaactctggcacaaattaatgctacttcttcaggaatgacagaagaatttcctcctcccccacctgacgtacttcaaacttcagtagatgtgacagcattttcccagtcccctgaactgcccagtcctcctagaagactaccagtccccaaagatgtatattccaagcaaagaaatttgtatgaattaaaccgtttatataaacacatccatcctgagttaagaaaaaacttagaaaaagattatatcagtgaagtttctgagattgtttctagtcaaatgaactcagggagttcagtctcagcagatgtgcaacaagcccggtatgtttttgaaaacacaaatgacagttctcaaaaagatctgaactcagaaagagaatacttggaatgggatgaaattctgaagggagaggtgcagtccattagatggatctttgagaatcaaccattggattccatcaacaatggctctcctgatgaaggtgatatttccaggggcattgctgatcaagaaatcattgctggtggtgatgtgaaatataccacatggatgtttgaaacccaacccatcgacacacttggggcttattcttctgacactgtagaaaatgcagagaaaattcctgagctagccagaggagatgtctgcacagctcggtggatgtttgaaacaaggccattggactcaatgaataaaatgcatcaaagtcaagaagaatcagcggtaactatcagtaaggacataactgggggggatgtcaagactgtgagatacatgtttgaaactcaacatctagatcaacttggacagcttcattcagtggatgaggttcatttactgcagcttaggtctgagctcaaagaaattaagggaaatgttaaaagaagtataaaatgtttcgaaactcaaccattatatgttattagagatggttcgggccaaatgctggaaattaaaactgttcacagagaagacgttgaaaagggagatgtaagaacagcacggtggatgtttgaaacacagccgttggacacaattaacaaagatatcacagaaattaaagttgtccgaggaatatccatggaagaaaatgtcaaaggtggggtgagtaaggcaaagtggttatttgaaacccaacctttggagaaaatcaaagagtcagaagaggtcatcattgaaaaggaaaaaataataggtacagatgtctccagaaagtgttggatgtttgaaacccagccattagacattctaaaagaagttcctgatgcagattctctacaacgtgaggagataataggtggtgatgtacaaactactaagcatctatttgaaacacttccaattgaagcattaaaagacagtcctgatataggaaagcttcaaaaaatcactgcctctgaagaagaaaaaggggatgttaggcatcaaaaatggatttttgaaacccaacctctggaagacattagaaaagataaaaaggagtacacacgaacagtgaaacttgaagaagttgacagaggagatgtgaagaattacacacatatctttgaatcaaacaatttaattaaatttgatgcatcacataaaatagaggtggaaggagttacaagaggtgctgtagagttaaataaatctctcttcgagacaacaccactgtatgccattcaagatccccttggaaaatatcatcaagtaaagacagtccagcaagaagaaatcgtaagaggtgatgtaagaagctgtaggtggctttttgaaacaaggcccattgaccagtttgatgaaagcattcataaatttcaaataattagaggaatatctgctcaagaaatacagactggaaatgtgaaatctgccaaatggttgtttgaaacccaacctcttgattcaattaaatattttagtgatgtggaagaaacagaaagtaaaactgaacaaactagagatattgttaaaggggatgtcaaaacctgtaaatggctttttgagacccagccaatggagtctctttatgaaaaagtttcgttaatgaccagcagtgaagaaattcataagggagatgtcaaaacttgtacttggctctttgaaactcagccacttgataccataaaagatgactctgaaacagcagtcaaattgcaaactgtaaaacaggaggagatccaaggtggggatgttcgtacagcatgttttctttttgagacagaaaatttggacagcatacaaggagaagaagtgaaggaaatcaagcctgttgaaatggatatacaagctggagatgtttccagcatgaggtataaatttgaaaatcagtccttagattctataagttctagttcagaggaagttttgaaaaagatcaaaaccttaaaaactgaagatattcagaaaggcaatgttttaaattgtaggtggctttttgaaaaccaaccaattgataagataaaagaaagccaagaaggtgatgaatgtgttaagacggtgacagacatacaaggtggggatgtaagaaaggggtgctttatttttgagactttttctttagatgagattaaagaagaatctgactatatcagcaccaagaaaacaattactgaagaagtaatacagggtgatgtaaaaagctacagaatgctctttgaaacccagccactctatgcaattcaagaccgagaagggtcctatcatgaagtgaccacagttaaaaaagaagaggtaattcatggagatgtgcgaggaacaaggtggctttttgaaacaaagccattagactctattaataaatcagaaactgtgtatgttattaaatctgtcacacaagaagacattcagaagggagatgttagttctgtcagatacagatttgaaactcagccactggatcagatttctgaagaatcacataatattatgcccagtattgaccatatacaaggtggcaatgtaaagacaagtagacaattctttgagtctgaaaattttgataagaataactatatacgaacagtaagtgtcaatgaaatacaaaagggcaatgttaaaacatctacttggctatttgaaacccacactatggatgaactgagaggagaagggttagaatatgaaaatatcaagacagtcactcaggaagatgtgcagaaaggtgatgttaagcaggctgtgtggctttttgaaaatcgaactttcgattctattatggaagcacataaaggtatcacaaaaatgaccaaggaagaaatccctccttctgatgtcaaaacaaccacatggctctttgaaacaacaccacttcatgaatttaatgaaactagagtagaaaagatagaaattattggcaagagcattaaagaaaccttagaagatctctactctcaaaaagttatccaggctcctggaatcatcattgaagctgatgaaataggggatgttcgaatggcaaaatacaagctaatgaaccaagcatctcctgagatacagaaagaagaaattatcagggctgatctcagaaatataatggtgaacctactttccaaaagggactgtactgaaagagagattttgattagtgaagaagagaagggaaatgttaatttgactaaaactcaattattaaacagatcaactgaatttcatgctgaaaaagaagagatagtgaaaggtgatgtacaacaagcaataaaaaacctgttctctgaggaaagatctgtaaagaaaggcatcttaattcaggaagatgaaaaaggagatattaacatgactatctattgtcttcttcatgaaaatgatggtgacacaattgagcgtgaagaagtaataggtggtgatgtcaaacgtaccattcataatttattgtcttccacatcaaacaataaaatatctgaaagggctaaaattgatgcctctgagagaggaaatgttcagtttttcacaacctgcatagaagctggagctttggattatctgaaacaactccacacagagtcaaatgaaacactgacagctaagaaacaagaaggagagaaagaaatcattggtggtgatgttgaaggtacaaaactgttactgaagaaaaggcagtctctggttgaacgtactgttagtgaaactgacatcatccctggagatgtgcataacacagttaaggtttttatgaccgagcctcagagtacatttggtaagatacccaaagaagagattataaaaggtgatttgacatcaaccctaaattccctcagccaggctgtaaatcagaaaacagtgacgaaaacagaagaaattataaaaggtaacatgctagccacactcaagtcacttaaagaatcaagccatcgatggaaagaatctaaacagcctgatgccatccctggtgatattgaaaaagctattgaatgccttgaaaaagctacaaatacaaagacagaaattctgaaaaaggagcttctcaaagatgacctggaaacatcactaaggtctttgaaagaagcacaaagaagtttcaaagaggtacataaagaaggtgtaataaaaaaagatgctaaagctgtgatggcaggatcctcgggagagcagaaaacagatattcatcaggttgctgtccagaggaacaaaaatagtcttcttcagccaaagccaggtccatttgagccagcggccaagtggcaagggggagcagatactctcagtcaaactatggggaaatcttgccatggcaatttagtagaagaaagaactgaggttaatcttccaaaagcccccaaaggcactgtaaagattgtcatagatcgtgaacaaaacaatgatgctctggagaaaagccttagaagactatctaattcacaccataaatctaatgttttggaatcaggagacaaaacgggtgtctggactgatactacaggagaacagcatcttagagatgaatatatgagcagacaattaacttcaactgtgtcagttaagaataatctaacaactaaagaatcagacagggcagtgagagagctgaagaaggatgatgtctttaattccatccaatctgctggtaaaaccgttggaaagcaacagacatatgaactgagaaatgaccaccagaaaatggagggttttcatataaagagtcctaaaaagaccaaaaatattaaaatattaactgatacacaaagctccaagcccagtcccacccagcatccagtcagcatgccagttggaggaacttacgacctttcaggggactttcagaagcaaactttgttaaagcaagaaacaaaatattctaataaggatataaagaaaaagaatataaaccttcaaccaatgtggcagcttttgcctgtagagcaagacacatccaatgtaacagaaatgaaagtctctgaaaaaagtcacaatacatttaaggcaaccaacaaaaagcgggagactgatgttcacttgaaaagccaggactttctaatgaaaacaaatacttccacaggcttaaaaatggcaatggaaaggtccttgaatccaatcaactttaaccctgagaataatgtaaaagaaagtgagtgcccccttccacctccatctccacctcctccaccaccttctaatgcatcatctgaaattgaatttcctcttcctcctccacctcctttgatgatgtttcctgaaaaaaatgggtttcttccctcactgtccacagagaagataaaggctgaatttgaaagttttccaggcctccctcttcctccacctccagtagatgagaaatctgaaagagaaagttcatcgatgtttctgccgcctcctcctcctccaactccatctcaaaagccagcacatctcctttcctcctctgctccggaaaagcacagtggagacttcatgcaacaatattcccaaaaagaagcctcgaactctcagaattctcaggctaaaatcataacaggaaaaaccggtgtgttgccacctcccacattgcccaaacccaaacttcccaagcatataaaagataataagaacgatttttcccccaaagttgaactggcaacctccctgtcagatatggaatgtaaaattactacctcaaaggatcagaaaaaagtaatggtgatgaccagcagtgaacacacggagacaaagcagaacgttattagtaagagtcttgatgaaagaaaacaattatctattgactctgcaaactgtctctcacacacagttccaggaacttcagcacccaggaaaaaacagattgcgcctcttataaaatctcattcatttccagagagttcaggacaacaaaatccaaaaccttatatgagaaaatttaagacacctttaatgattgctgaagaaaaatatagacaacaaaaagaagaaattgaaaaacagaaacaggagagttcttactacaacattgttaaaactcaaagccaaaatcaacacataacagaggtggaaaaggaaatgccattacaaaaaaccaatgaggaggtttccctatctggaattgattcagaatgcactgtggttcaacccagcccaggctctcaaagtaatgctcggatactaggagtgtgttctgataaccaactctccacaacatcgccagaaacagtcgctgccaagaggctccaccatgttttagcagcttcagaagacaaagataagatgaaaaaggaagttttacaaagctcaagggacattatgcaatccaaatcagcttgcgaaattaaacaaagtcaccaagaatgtagtacccaacaaacacaacagaagaagtatttggagcagttgcacttgccccaaagcaaaccaatttccccaaatttcaaagttaaaaccatcaaacttccaactctagatcatacattaaatgaaacagaccacagctatgaaagtcataaacagcaatctgagattgatgttcaaacctttaccaaaaaacaatatctgaaaaccaagaaaactgaagcaagcactgaatgtagtcataagcaatctctggctgaaagacattatcagttacctaagaaggagaaaagagtgacagtacaattgcctacagaatccatacagaagaaccaggaagataagctcaagatggttcccaggaagcaaagagaatttagcggatctgacagagggaaacttccaggaagtgaagaaaaaaatcagggaccatcaatgattggtcgaaaagaagagagattaataactgaaagaaaacacgaacatctgaagaataaatcagcaccaaaggtcgtcaagcaaaaggttatcgatgcacatcttgattcacagactcagaattttcagcaaacacaaatacagaccgctgaaagtaaagctgaacataaaaaattgccccagccatataatagtctgcaggaagaaaaatgtctcgaagtcaagggcatacaagagaaacaagtcttctctaatactaaagattcaaagcaagagattacacagaacaaatctttcttttcctctgtgaaagaatcccagcgggatgatggaaaaggtgccttaaatatagtggaattcttgagaaaacgtgaagaactgcaacagattttgtcgagagtgaaacagtttgaagcagagccaaataaaagtggccttaaaacatttcagacactattaaatactatcccaggatggctgataagtgaagataagagagaatatgcagttcacattgccatggagaataatttagaaaaagtaaaagaagaaataacacatattaaaactcaagcggaagatatgcttgtgtcctatgaaaatataattcagacagccatgatgtcctccaaaacaggaaaaccgggaaataaacccactagtcttgatgaaacatcatccaaagtatctaatgttcatgtcagcaataataaaaatagtgaacagaaagaaaataaaattgccaaagagaaaacagtacagcaccaagtagcagctcatcatgaagcaactgttcgtagtcacgtgaaaacccatcaggaaattaaacttgatgatagcaacattcctcctccctctttaaaaacacgcccaccgtcaccaacttttatcacaatagaatctactgcccgacgaacagaaaaccctactaagaacgagctttctcagtcccctaaaaaggacagttatgttgaacccccaccaagaaggcccatgtcgcaaaaatctgaaattcacagagcaaacacttccccttctccacccaggagtcgctctgaacaacttgtcagactcaaagacaccactgcaaagttatccaaaggggccatcccatgtccagcagcaaccccggttccaattgtagagaagaggtctgaaatcatcatgtctcctgcaacacttcgtcgtcaaattaagatagaaactcgtggtagggactctccacctacaatcacaataccagtaaatataaatcatgctgctagtggttccttcagagaatctgtggacgctcaagaggaaatcaggaaagtggagaagagagctacttatgttcataaagatggactaaattccactgatcacatggtgcccgacactgaaagttatgatgcagttgaaatcatccgcaaggttgcagtgcctcctcgcctgtcagagcacacacagagatatgaagcggccaaccgaactgttcaaatggctgaaaatttcgtgaatgaccctgaaaatgaaataaacagatggttcagggaatttgagcatggcccagtttctgaagcaaagtcaaatagaagagtttatgcaaagggagaaacaaaccataacatacaacaagaaagtcgtacattttgtaaggaggaatttggattaacatctttaggaaacacgagttttacagacttttcttgcaaacatcctagagaactgcgagaaaagattcctgttaagcagcccaggatctgctctgaaaccaggtctctaagtgaacatttctcaggcatggatgcatttgagagtcaaattgttgagtcgaagatgaaaacctcttcatcacatagctcagaagctggcaaatctggctgtgacttcaagcatgccccaccaacctatgaggatgtcattgctggacatattttagatatctctgattcacctaaagaagtaagaaaaaattttcaaaagacgtggcaagagagtggaagagtttttaaaggcctgggatatgcaaccgcagatgcttctgcaactgagatgagaaccaccttccaagaggaatctgcatttataagtgaagctgctgctccaagacaaggaaatatgtatactttgtcaaaagacagtttatccaatggagtgcctagtggcagacaagcagaattttcataagtcctgcttccgatgccaccattgcaacagtaaactaagtttgggaaattatgcatcacttcatggacaaatatactgtaaacctcactttaaacaacttttcaaatccaaaggaaattatgatgaaggttttggacataagcagcataaagatagatggaactgcaaaaaccaaagcagatcagtggactttattcctaatgaagaaccaaatatgtgtaaaaatattgcagaaaacacccttgtacctggagatcgtaatgaacatttagatgctggtaacagtgaagggcaaaggaatgatttgagaaaattaggggaaaggggaaaattaaaagtcatttggcctccttccaaggagatccctaagaaaaccttaccctttgaggaagagctcaaaatgagtaaacctaagtggccacctgaaatgacaaccctgctatcccctgaatttaaaagtgaatctctgctagaagatgttagaactccagaaaataaaggacaaagacaagatcactttccatttttgcagccttatctacagtccacccatgtttgtcagaaagaggatgttataggaatcaaagaaatgaaaatgcctgaaggaagaaaagatgaaaagaaggaaggaaggaagaatgtgcaagataggccgagtgaagctgaagacacaaagagtaacaggaaaagtgctatggatcttaatgacaacaataatgtgattgtgcagagtgctgaaaaggagaaaaatgaaaaaactaaccaaactaatggtgcagaagttttacaggttactaacactgatgatgagatgatgccagaaaatcataaagaaaatttgaataagaataataataacaattatgtagcagtctcatatctgaataattgcaggcagaagacatctattttagaatttcttgatctattacccttgtcgagtgaagcaaatgacactgcaaatgaatatgaaattgagaagttagaaaatacatctagaatctcagagttacttggtatatttgaatctgaaaagacttattcgaggaatgtactagcaatggctctgaagaaacagactgacagagcagctgctggcagtcctgtgcagcctgctccaaaaccaagcctcagcagaggccttatggtaaaggggggaagttcaatcatctctcctgatacaaatctcttaaacattaaaggaagccattcaaagagcaaaaatttacactttttcttttctaacaccgtgaaaatcactgcattttccaagaaaaatgagaacattttcaattgtgatttaatagattctgtagatcaaattaaaaatatgccatgcttggatttaagggaatttggaaaggatgttaaaccttggcatgttgaaacaacagaagctgcccgcaataatgaaaacacaggttttgatgctctgagccatgaatgtacagctaagcctttgtttcccagagtggaggtgcagtcagaacaactcacggtggaagagcagattaaaagaaacaggtgctacagtgacactgagtaaaatatctatggccactgacagtccacacttaggcactgagagatattgatgttctgaaataagattttatgaatttggatacccttttgaggaacttgatgtaaacatggtgttcagaaatctcgtgtctatctcaatgggatatttcttgtattacaccttgtcatttttttcacaatttatttacatctacttttgtttgaactggaatgaagagatgaaacactatggatatgttttccattcaaatggcactttagcatattgttctgttttcctgtaaaacatcatgggtgtgatttttatactgctgctgcttgtcacaattattataacttctctgtaatttcctctgaaataaaattgaatcacctgaggtgcaaaccaaaa

SEQ ID NO: 200439 - DNA, 2890 bp, Homo sapiens
  Payload ID: 19544
  Gene Name: xin actin binding repeat containing 2
  Uniprot ID: A4UGR9
  ENST ID: ENST00000409605
  CDS Start-End: 354-2504
atacagagctcagttcctaaaaataggtgccaagttgcatcctttagacgctctgctaaaataaattcagccgtcccatctacttgcttgatagacccttcagtggagcgggcctccactgcacccattgctttcaggggactgggaaattggctgtacatgaaacaagggaggaagctagtctgtgaagaactataaagatatatgatatttccacaaacttggggttaaacctaaatatcataaaagcgactgctggccctaataagcctgagagtggatttgcagaagacagtgctgctcggggcgagggtgtgtcagacctccacgaagtggtctccctgaaggagcggatggcgaggtaccaggcagctgtttccaggggtgactgccgcagcttctctgctaatatgatggaagaatcagaaatgtgcgcagtgcctggtggtttggccaaggtgaagaaacaatttgaggacgaaattacttcttcccgtaatacctttgctcaataccaatatcaacatcagaacagatctgagcaggaggcaattcatagcagccaggttggcacttcaagaagcagccaggaaatggcaagaaatgaacaagaagggtccaaagtacagaaaattgatgttcatggaacagaaatggtctctcatcttgaaaagcacaccgaggaagtaaaccaagcatctcagtttcatcaatatgttcaagaaactgtcattgatacacctgaggatgaagagattccaaaggtttcgactaagttgttaaaagagcagtttgaaaagtctgcccaggaaaagatcctttattctgacaaagagatgacaaccccagccaagcagattaagaagctgctgctccaagacaaggaaatatgtatactttgtcaaaagacagtttatccaatggagtgcctagtggcagacaagcagaattttcataagtcctgcttccgatgccaccattgcaacagtaaactaagtttgggaaattatgcatcacttcatggacaaatatactgtaaacctcactttaaacaacttttcaaatccaaaggaaattatgatgaaggttttggacataagcagcataaagatagatggaactgcaaaaaccaaagcagatcagtggactttattcctaatgaagaaccaaatatgtgtaaaaatattgcagaaaacacccttgtacctggagatcgtaatgaacatttagatgctggtaacagtgaagggcaaaggaatgatttgagaaaattaggggaaaggggaaaattaaaagtcatttggcctccttccaaggagatccctaagaaaaccttaccctttgaggaagagctcaaaatgagtaaacctaagtggccacctgaaatgacaaccctgctatcccctgaatttaaaagtgaatctctgctagaagatgttagaactccagaaaataaaggacaaagacaagatcactttccatttttgcagccttatctacagtccacccatgtttgtcagaaagaggatgttataggaatcaaagaaatgaaaatgcctgaaggaagaaaagatgaaaagaaggaaggaaggaagaatgtgcaagataggccgagtgaagctgaagacacaaagagtaacaggaaaagtgctatggatcttaatgacaacaataatgtgattgtgcagagtgctgaaaaggagaaaaatgaaaaaactaaccaaactaatggtgcagaagttttacaggttactaacactgatgatgagatgatgccagaaaatcataaagaaaatttgaataagaataataataacaattatgtagcagtctcatatctgaataattgcaggcagaagacatctattttagaatttcttgatctattacccttgtcgagtgaagcaaatgacactgcaaatgaatatgaaattgagaagttagaaaatacatctagaatctcagagttacttggtatatttgaatctgaaaagacttattcgaggaatgtactagcaatggctctgaagaaacagactgacagagcagctgctggcagtcctgtgcagcctgctccaaaaccaagcctcagcagaggccttatggtaaaggggggaagttcaatcatctctcctgatacaaatctcttaaacattaaaggaagccattcaaagagcaaaaatttacactttttcttttctaacaccgtgaaaatcactgcattttccaagaaaaatgagaacattttcaattgtgatttaatagattctgtagatcaaattaaaaatatgccatgcttggatttaagggaatttggaaaggatgttaaaccttggcatgttgaaacaacagaagctgcccgcaataatgaaaacacaggttttgatgctctgagccatgaatgtacagctaagcctttgtttcccagagtggaggtgcagtcagaacaactcacggtggaagagcagattaaaagaaacaggtgctacagtgacactgagtaaaatatctatggccactgacagtccacacttaggcactgagagatattgatgttctgaaataagattttatgaatttggatacccttttgaggaacttgatgtaaacatggtgttcagaaatctcgtgtctatctcaatgggatatttcttgtattacaccttgtcatttttttcacaatttatttacatctacttttgtttgaactggaatgaagagatgaaacactatggatatgttttccattcaaatggcactttagcatattgttctgttttcctgtaaaacatcatgggtgtgatttttatactgctgctgcttgtcacaattattataacttctctgtaatttcctctgaaataaaattgaatcacctgaggtgcaaacc

SEQ ID NO: 200440 - DNA, 12269 bp, Homo sapiens
  Payload ID: 19544
  Gene Name: xin actin binding repeat containing 2
  Uniprot ID: A4UGR9
  ENST ID: ENST00000409273
  CDS Start-End: 354-10337
atacagagctcagttcctaaaaataggtgccaagttgcatcctttagacgctctgctaaaataaattcagccgtcccatctacttgcttgatagacccttcagtggagcgggcctccactgcacccattgctttcaggggactgggaaattggctgtacatgaaacaagggaggaagctagtctgtgaagaactataaagatatatgatatttccacaaacttggggttaaacctaaatatcataaaagcgactgctggccctaataagcctgagagtggatttgcagaagacagtgctgctcggggcgagggtgtgtcagacctccacgaagtggtctccctgaaggagcggatggcgaggtaccaggcagctgtttccaggggtgactgccgcagcttctctgctaatatgatggaagaatcagaaatgtgcgcagtgcctggtggtttggccaaggtgaagaaacaatttgaggacgaaattacttcttcccgtaatacctttgctcaataccaatatcaacatcagaacagatctgagcaggaggcaattcatagcagccaggttggcacttcaagaagcagccaggaaatggcaagaaatgaacaagaagggtccaaagtacagaaaattgatgttcatggaacagaaatggtctctcatcttgaaaagcacaccgaggaagtaaaccaagcatctcagtttcatcaatatgttcaagaaactgtcattgatacacctgaggatgaagagattccaaaggtttcgactaagttgttaaaagagcagtttgaaaagtctgcccaggaaaagatcctttattctgacaaagagatgacaaccccagccaagcagattaagactgaaagtgaatatgaagagactttcaagccatcatcagttgtgagtacctcttccacttcttgcgtttcaaccagccagaggaaggaaacatcaactacaagatatagtgatcacagtgtcacttcctcaactctggcacaaattaatgctacttcttcaggaatgacagaagaatttcctcctcccccacctgacgtacttcaaacttcagtagatgtgacagcattttcccagtcccctgaactgcccagtcctcctagaagactaccagtccccaaagatgtatattccaagcaaagaaatttgtatgaattaaaccgtttatataaacacatccatcctgagttaagaaaaaacttagaaaaagattatatcagtgaagtttctgagattgtttctagtcaaatgaactcagggagttcagtctcagcagatgtgcaacaagcccggtatgtttttgaaaacacaaatgacagttctcaaaaagatctgaactcagaaagagaatacttggaatgggatgaaattctgaagggagaggtgcagtccattagatggatctttgagaatcaaccattggattccatcaacaatggctctcctgatgaaggtgatatttccaggggcattgctgatcaagaaatcattgctggtggtgatgtgaaatataccacatggatgtttgaaacccaacccatcgacacacttggggcttattcttctgacactgtagaaaatgcagagaaaattcctgagctagccagaggagatgtctgcacagctcggtggatgtttgaaacaaggccattggactcaatgaataaaatgcatcaaagtcaagaagaatcagcggtaactatcagtaaggacataactgggggggatgtcaagactgtgagatacatgtttgaaactcaacatctagatcaacttggacagcttcattcagtggatgaggttcatttactgcagcttaggtctgagctcaaagaaattaagggaaatgttaaaagaagtataaaatgtttcgaaactcaaccattatatgttattagagatggttcgggccaaatgctggaaattaaaactgttcacagagaagacgttgaaaagggagatgtaagaacagcacggtggatgtttgaaacacagccgttggacacaattaacaaagatatcacagaaattaaagttgtccgaggaatatccatggaagaaaatgtcaaaggtggggtgagtaaggcaaagtggttatttgaaacccaacctttggagaaaatcaaagagtcagaagaggtcatcattgaaaaggaaaaaataataggtacagatgtctccagaaagtgttggatgtttgaaacccagccattagacattctaaaagaagttcctgatgcagattctctacaacgtgaggagataataggtggtgatgtacaaactactaagcatctatttgaaacacttccaattgaagcattaaaagacagtcctgatataggaaagcttcaaaaaatcactgcctctgaagaagaaaaaggggatgttaggcatcaaaaatggatttttgaaacccaacctctggaagacattagaaaagataaaaaggagtacacacgaacagtgaaacttgaagaagttgacagaggagatgtgaagaattacacacatatctttgaatcaaacaatttaattaaatttgatgcatcacataaaatagaggtggaaggagttacaagaggtgctgtagagttaaataaatctctcttcgagacaacaccactgtatgccattcaagatccccttggaaaatatcatcaagtaaagacagtccagcaagaagaaatcgtaagaggtgatgtaagaagctgtaggtggctttttgaaacaaggcccattgaccagtttgatgaaagcattcataaatttcaaataattagaggaatatctgctcaagaaatacagactggaaatgtgaaatctgccaaatggttgtttgaaacccaacctcttgattcaattaaatattttagtgatgtggaagaaacagaaagtaaaactgaacaaactagagatattgttaaaggggatgtcaaaacctgtaaatggctttttgagacccagccaatggagtctctttatgaaaaagtttcgttaatgaccagcagtgaagaaattcataagggagatgtcaaaacttgtacttggctctttgaaactcagccacttgataccataaaagatgactctgaaacagcagtcaaattgcaaactgtaaaacaggaggagatccaaggtggggatgttcgtacagcatgttttctttttgagacagaaaatttggacagcatacaaggagaagaagtgaaggaaatcaagcctgttgaaatggatatacaagctggagatgtttccagcatgaggtataaatttgaaaatcagtccttagattctataagttctagttcagaggaagttttgaaaaagatcaaaaccttaaaaactgaagatattcagaaaggcaatgttttaaattgtaggtggctttttgaaaaccaaccaattgataagataaaagaaagccaagaaggtgatgaatgtgttaagacggtgacagacatacaaggtggggatgtaagaaaggggtgctttatttttgagactttttctttagatgagattaaagaagaatctgactatatcagcaccaagaaaacaattactgaagaagtaatacagggtgatgtaaaaagctacagaatgctctttgaaacccagccactctatgcaattcaagaccgagaagggtcctatcatgaagtgaccacagttaaaaaagaagaggtaattcatggagatgtgcgaggaacaaggtggctttttgaaacaaagccattagactctattaataaatcagaaactgtgtatgttattaaatctgtcacacaagaagacattcagaagggagatgttagttctgtcagatacagatttgaaactcagccactggatcagatttctgaagaatcacataatattatgcccagtattgaccatatacaaggtggcaatgtaaagacaagtagacaattctttgagtctgaaaattttgataagaataactatatacgaacagtaagtgtcaatgaaatacaaaagggcaatgttaaaacatctacttggctatttgaaacccacactatggatgaactgagaggagaagggttagaatatgaaaatatcaagacagtcactcaggaagatgtgcagaaaggtgatgttaagcaggctgtgtggctttttgaaaatcgaactttcgattctattatggaagcacataaaggtatcacaaaaatgaccaaggaagaaatccctccttctgatgtcaaaacaaccacatggctctttgaaacaacaccacttcatgaatttaatgaaactagagtagaaaagatagaaattattggcaagagcattaaagaaaccttagaagatctctactctcaaaaagttatccaggctcctggaatcatcattgaagctgatgaaataggggatgttcgaatggcaaaatacaagctaatgaaccaagcatctcctgagatacagaaagaagaaattatcagggctgatctcagaaatataatggtgaacctactttccaaaagggactgtactgaaagagagattttgattagtgaagaagagaagggaaatgttaatttgactaaaactcaattattaaacagatcaactgaatttcatgctgaaaaagaagagatagtgaaaggtgatgtacaacaagcaataaaaaacctgttctctgaggaaagatctgtaaagaaaggcatcttaattcaggaagatgaaaaaggagatattaacatgactatctattgtcttcttcatgaaaatgatggtgacacaattgagcgtgaagaagtaataggtggtgatgtcaaacgtaccattcataatttattgtcttccacatcaaacaataaaatatctgaaagggctaaaattgatgcctctgagagaggaaatgttcagtttttcacaacctgcatagaagctggagctttggattatctgaaacaactccacacagagtcaaatgaaacactgacagctaagaaacaagaaggagagaaagaaatcattggtggtgatgttgaaggtacaaaactgttactgaagaaaaggcagtctctggttgaacgtactgttagtgaaactgacatcatccctggagatgtgcataacacagttaaggtttttatgaccgagcctcagagtacatttggtaagatacccaaagaagagattataaaaggtgatttgacatcaaccctaaattccctcagccaggctgtaaatcagaaaacagtgacgaaaacagaagaaattataaaaggtaacatgctagccacactcaagtcacttaaagaatcaagccatcgatggaaagaatctaaacagcctgatgccatccctggtgatattgaaaaagctattgaatgccttgaaaaagctacaaatacaaagacagaaattctgaaaaaggagcttctcaaagatgacctggaaacatcactaaggtctttgaaagaagcacaaagaagtttcaaagaggtacataaagaaggtgtaataaaaaaagatgctaaagctgtgatggcaggatcctcgggagagcagaaaacagatattcatcaggttgctgtccagaggaacaaaaatagtcttcttcagccaaagccaggtccatttgagccagcggccaagtggcaagggggagcagatactctcagtcaaactatggggaaatcttgccatggcaatttagtagaagaaagaactgaggttaatcttccaaaagcccccaaaggcactgtaaagattgtcatagatcgtgaacaaaacaatgatgctctggagaaaagccttagaagactatctaattcacaccataaatctaatgttttggaatcaggagacaaaacgggtgtctggactgatactacaggagaacagcatcttagagatgaatatatgagcagacaattaacttcaactgtgtcagttaagaataatctaacaactaaagaatcagacagggcagtgagagagctgaagaaggatgatgtctttaattccatccaatctgctggtaaaaccgttggaaagcaacagacatatgaactgagaaatgaccaccagaaaatggagggttttcatataaagagtcctaaaaagaccaaaaatattaaaatattaactgatacacaaagctccaagcccagtcccacccagcatccagtcagcatgccagttggaggaacttacgacctttcaggggactttcagaagcaaactttgttaaagcaagaaacaaaatattctaataaggatataaagaaaaagaatataaaccttcaaccaatgtggcagcttttgcctgtagagcaagacacatccaatgtaacagaaatgaaagtctctgaaaaaagtcacaatacatttaaggcaaccaacaaaaagcgggagactgatgttcacttgaaaagccaggactttctaatgaaaacaaatacttccacaggcttaaaaatggcaatggaaaggtccttgaatccaatcaactttaaccctgagaataatgtaaaagaaagtgagtgcccccttccacctccatctccacctcctccaccaccttctaatgcatcatctgaaattgaatttcctcttcctcctccacctcctttgatgatgtttcctgaaaaaaatgggtttcttccctcactgtccacagagaagataaaggctgaatttgaaagttttccaggcctccctcttcctccacctccagtagatgagaaatctgaaagagaaagttcatcgatgtttctgccgcctcctcctcctccaactccatctcaaaagccagcacatctcctttcctcctctgctccggaaaagcacagtggagacttcatgcaacaatattcccaaaaagaagcctcgaactctcagaattctcaggctaaaatcataacaggaaaaaccggtgtgttgccacctcccacattgcccaaacccaaacttcccaagcatataaaagataataagaacgatttttcccccaaagttgaactggcaacctccctgtcagatatggaatgtaaaattactacctcaaaggatcagaaaaaagtaatggtgatgaccagcagtgaacacacggagacaaagcagaacgttattagtaagagtcttgatgaaagaaaacaattatctattgactctgcaaactgtctctcacacacagttccaggaacttcagcacccaggaaaaaacagattgcgcctcttataaaatctcattcatttccagagagttcaggacaacaaaatccaaaaccttatatgagaaaatttaagacacctttaatgattgctgaagaaaaatatagacaacaaaaagaagaaattgaaaaacagaaacaggagagttcttactacaacattgttaaaactcaaagccaaaatcaacacataacagaggtggaaaaggaaatgccattacaaaaaaccaatgaggaggtttccctatctggaattgattcagaatgcactgtggttcaacccagcccaggctctcaaagtaatgctcggatactaggagtgtgttctgataaccaactctccacaacatcgccagaaacagtcgctgccaagaggctccaccatgttttagcagcttcagaagacaaagataagatgaaaaaggaagttttacaaagctcaagggacattatgcaatccaaatcagcttgcgaaattaaacaaagtcaccaagaatgtagtacccaacaaacacaacagaagaagtatttggagcagttgcacttgccccaaagcaaaccaatttccccaaatttcaaagttaaaaccatcaaacttccaactctagatcatacattaaatgaaacagaccacagctatgaaagtcataaacagcaatctgagattgatgttcaaacctttaccaaaaaacaatatctgaaaaccaagaaaactgaagcaagcactgaatgtagtcataagcaatctctggctgaaagacattatcagttacctaagaaggagaaaagagtgacagtacaattgcctacagaatccatacagaagaaccaggaagataagctcaagatggttcccaggaagcaaagagaatttagcggatctgacagagggaaacttccaggaagtgaagaaaaaaatcagggaccatcaatgattggtcgaaaagaagagagattaataactgaaagaaaacacgaacatctgaagaataaatcagcaccaaaggtcgtcaagcaaaaggttatcgatgcacatcttgattcacagactcagaattttcagcaaacacaaatacagaccgctgaaagtaaagctgaacataaaaaattgccccagccatataatagtctgcaggaagaaaaatgtctcgaagtcaagggcatacaagagaaacaagtcttctctaatactaaagattcaaagcaagagattacacagaacaaatctttcttttcctctgtgaaagaatcccagcgggatgatggaaaaggtgccttaaatatagtggaattcttgagaaaacgtgaagaactgcaacagattttgtcgagagtgaaacagtttgaagcagagccaaataaaagtggccttaaaacatttcagacactattaaatactatcccaggatggctgataagtgaagataagagagaatatgcagttcacattgccatggagaataatttagaaaaagtaaaagaagaaataacacatattaaaactcaagcggaagatatgcttgtgtcctatgaaaatataattcagacagccatgatgtcctccaaaacaggaaaaccgggaaataaacccactagtcttgatgaaacatcatccaaagtatctaatgttcatgtcagcaataataaaaatagtgaacagaaagaaaataaaattgccaaagagaaaacagtacagcaccaagtagcagctcatcatgaagcaactgttcgtagtcacgtgaaaacccatcaggaaattaaacttgatgatagcaacattcctcctccctctttaaaaacacgcccaccgtcaccaacttttatcacaatagaatctactgcccgacgaacagaaaaccctactaagaacgagctttctcagtcccctaaaaaggacagttatgttgaacccccaccaagaaggcccatgtcgcaaaaatctgaaattcacagagcaaacacttccccttctccacccaggagtcgctctgaacaacttgtcagactcaaagacaccactgcaaagttatccaaaggggccatcccatgtccagcagcaaccccggttccaattgtagagaagaggtctgaaatcatcatgtctcctgcaacacttcgtcgtcaaattaagatagaaactcgtggtagggactctccacctacaatcacaataccagtaaatataaatcatgctgctagtggttccttcagagaatctgtggacgctcaagaggaaatcaggaaagtggagaagagagctacttatgttcataaagatggactaaattccactgatcacatggtgcccgacactgaaagttatgatgcagttgaaatcatccgcaaggttgcagtgcctcctcgcctgtcagagcacacacagagatatgaagcggccaaccgaactgttcaaatggctgaaaatttcgtgaatgaccctgaaaatgaaataaacagatggttcagggaatttgagcatggcccagtttctgaagcaaagtcaaatagaagagtttatgcaaagggagaaacaaaccataacatacaacaagaaagtcgtacattttgtaaggaggaatttggattaacatctttaggaaacacgagttttacagacttttcttgcaaacatcctagagaactgcgagaaaagattcctgttaagcagcccaggatctgctctgaaaccaggtctctaagtgaacatttctcaggcatggatgcatttgagagtcaaattgttgagtcgaagatgaaaacctcttcatcacatagctcagaagctggcaaatctggctgtgacttcaagcatgccccaccaacctatgaggatgtcattgctggacatattttagatatctctgattcacctaaagaagtaagaaaaaattttcaaaagacgtggcaagagagtggaagagtttttaaaggcctgggatatgcaaccgcagatgcttctgcaactgagatgagaaccaccttccaagaggaatctgcatttataagtgaagctgctgctccaagacaaggaaatatgtatactttgtcaaaagacagtttatccaatggagtgcctagtggcagacaagcagaattttcataagtcctgcttccgatgccaccattgcaacagtaaactaagtttgggaaattatgcatcacttcatggacaaatatactgtaaacctcactttaaacaacttttcaaatccaaaggaaattatgatgaaggttttggacataagcagcataaagatagatggaactgcaaaaaccaaagcagatcagtggactttattcctaatgaagaaccaaatatgtgtaaaaatattgcagaaaacacccttgtacctggagatcgtaatgaacatttagatgctggtaacagtgaagggcaaaggaatgatttgagaaaattaggggaaaggggaaaattaaaagtcatttggcctccttccaaggagatccctaagaaaaccttaccctttgaggaagagctcaaaatgagtaaacctaagtggccacctgaaatgacaaccctgctatcccctgaatttaaaagtgaatctctgctagaagatgttagaactccagaaaataaaggacaaagacaagatcactttccatttttgcagccttatctacagtccacccatgtttgtcagaaagaggatgttataggaatcaaagaaatgaaaatgcctgaaggaagaaaagatgaaaagaaggaaggaaggaagaatgtgcaagataggccgagtgaagctgaagacacaaagagtaacaggaaaagtgctatggatcttaatgacaacaataatgtgattgtgcagagtgctgaaaaggagaaaaatgaaaaaactaaccaaactaatggtgcagaagttttacaggttactaacactgatgatgagatgatgccagaaaatcataaagaaaatttgaataagaataataataacaattatgtagcagtctcatatctgaataattgcaggcagaagacatctattttagaatttcttgatctattacccttgtcgagtgaagcaaatgacactgcaaatgaatatgaaattgagaagttagaaaatacatctagaatctcagagttacttggtatatttgaatctgaaaagacttattcgaggaatgtactagcaatggctctgaagaaacagactgacagagcagctgctggcagtcctgtgcagcctgctccaaaaccaagcctcagcagaggccttatggtaaaggggggaagttcaatcatctctcctgatacaaatctcttaaacattaaaggaagccattcaaagagcaaaaatttacactttttcttttctaacaccgtgaaaatcactgcattttccaagaaaaatgagaacattttcaattgtgatttaatagattctgtagatcaaattaaaaatatgccatgcttggatttaagggaatttggaaaggatgttaaaccttggcatgttgaaacaacagaagctgcccgcaataatgaaaacacaggttttgatgctctgagccatgaatgtacagctaagcctttgtttcccagagtggaggtgcagtcagaacaactcacggtggaagagcagattaaaagaaacaggtgctacagtgacactgagtaaaatatctatggccactgacagtccacacttaggcactgagagatattgatgttctgaaataagattttatgaatttggatacccttttgaggaacttgatgtaaacatggtgttcagaaatctcgtgtctatctcaatgggatatttcttgtattacaccttgtcatttttttcacaatttatttacatctacttttgtttgaactggaatgaagagatgaaacactatggatatgttttccattcaaatggcactttagcatattgttctgttttcctgtaaaacatcatgggtgtgatttttatactgctgctgcttgtcacaattattataacttctctgtaatttcctctgaaataaaattgaatcacctgaggtgcaaacc

SEQ ID NO: 200441 - DNA, 12182 bp, Homo sapiens
  Payload ID: 19544
  Gene Name: xin actin binding repeat containing 2
  Uniprot ID: A4UGR9
  ENST ID: ENST00000628543
  CDS Start-End: 126-10250
tgtaacaggaagtggaaattgagcgaagtttgtgctcgccagcttttaagagtcaccctgggagccagctggaggattctgtgaaagattcagacaagaaaggcaaggaaacatcttttgacaagatgtcacctgaaagtggtcacagccgcatctttgaagcgactgctggccctaataagcctgagagtggatttgcagaagacagtgctgctcggggcgagggtgtgtcagacctccacgaagtggtctccctgaaggagcggatggcgaggtaccaggcagctgtttccaggggtgactgccgcagcttctctgctaatatgatggaagaatcagaaatgtgcgcagtgcctggtggtttggccaaggtgaagaaacaatttgaggacgaaattacttcttcccgtaatacctttgctcaataccaatatcaacatcagaacagatctgagcaggaggcaattcatagcagccaggttggcacttcaagaagcagccaggaaatggcaagaaatgaacaagaagggtccaaagtacagaaaattgatgttcatggaacagaaatggtctctcatcttgaaaagcacaccgaggaagtaaaccaagcatctcagtttcatcaatatgttcaagaaactgtcattgatacacctgaggatgaagagattccaaaggtttcgactaagttgttaaaagagcagtttgaaaagtctgcccaggaaaagatcctttattctgacaaagagatgacaaccccagccaagcagattaagactgaaagtgaatatgaagagactttcaagccatcatcagttgtgagtacctcttccacttcttgcgtttcaaccagccagaggaaggaaacatcaactacaagatatagtgatcacagtgtcacttcctcaactctggcacaaattaatgctacttcttcaggaatgacagaagaatttcctcctcccccacctgacgtacttcaaacttcagtagatgtgacagcattttcccagtcccctgaactgcccagtcctcctagaagactaccagtccccaaagatgtatattccaagcaaagaaatttgtatgaattaaaccgtttatataaacacatccatcctgagttaagaaaaaacttagaaaaagattatatcagtgaagtttctgagattgtttctagtcaaatgaactcagggagttcagtctcagcagatgtgcaacaagcccggtatgtttttgaaaacacaaatgacagttctcaaaaagatctgaactcagaaagagaatacttggaatgggatgaaattctgaagggagaggtgcagtccattagatggatctttgagaatcaaccattggattccatcaacaatggctctcctgatgaaggtgatatttccaggggcattgctgatcaagaaatcattgctggtggtgatgtgaaatataccacatggatgtttgaaacccaacccatcgacacacttggggcttattcttctgacactgtagaaaatgcagagaaaattcctgagctagccagaggagatgtctgcacagctcggtggatgtttgaaacaaggccattggactcaatgaataaaatgcatcaaagtcaagaagaatcagcggtaactatcagtaaggacataactgggggggatgtcaagactgtgagatacatgtttgaaactcaacatctagatcaacttggacagcttcattcagtggatgaggttcatttactgcagcttaggtctgagctcaaagaaattaagggaaatgttaaaagaagtataaaatgtttcgaaactcaaccattatatgttattagagatggttcgggccaaatgctggaaattaaaactgttcacagagaagacgttgaaaagggagatgtaagaacagcacggtggatgtttgaaacacagccgttggacacaattaacaaagatatcacagaaattaaagttgtccgaggaatatccatggaagaaaatgtcaaaggtggggtgagtaaggcaaagtggttatttgaaacccaacctttggagaaaatcaaagagtcagaagaggtcatcattgaaaaggaaaaaataataggtacagatgtctccagaaagtgttggatgtttgaaacccagccattagacattctaaaagaagttcctgatgcagattctctacaacgtgaggagataataggtggtgatgtacaaactactaagcatctatttgaaacacttccaattgaagcattaaaagacagtcctgatataggaaagcttcaaaaaatcactgcctctgaagaagaaaaaggggatgttaggcatcaaaaatggatttttgaaacccaacctctggaagacattagaaaagataaaaaggagtacacacgaacagtgaaacttgaagaagttgacagaggagatgtgaagaattacacacatatctttgaatcaaacaatttaattaaatttgatgcatcacataaaatagaggtggaaggagttacaagaggtgctgtagagttaaataaatctctcttcgagacaacaccactgtatgccattcaagatccccttggaaaatatcatcaagtaaagacagtccagcaagaagaaatcgtaagaggtgatgtaagaagctgtaggtggctttttgaaacaaggcccattgaccagtttgatgaaagcattcataaatttcaaataattagaggaatatctgctcaagaaatacagactggaaatgtgaaatctgccaaatggttgtttgaaacccaacctcttgattcaattaaatattttagtgatgtggaagaaacagaaagtaaaactgaacaaactagagatattgttaaaggggatgtcaaaacctgtaaatggctttttgagacccagccaatggagtctctttatgaaaaagtttcgttaatgaccagcagtgaagaaattcataagggagatgtcaaaacttgtacttggctctttgaaactcagccacttgataccataaaagatgactctgaaacagcagtcaaattgcaaactgtaaaacaggaggagatccaaggtggggatgttcgtacagcatgttttctttttgagacagaaaatttggacagcatacaaggagaagaagtgaaggaaatcaagcctgttgaaatggatatacaagctggagatgtttccagcatgaggtataaatttgaaaatcagtccttagattctataagttctagttcagaggaagttttgaaaaagatcaaaaccttaaaaactgaagatattcagaaaggcaatgttttaaattgtaggtggctttttgaaaaccaaccaattgataagataaaagaaagccaagaaggtgatgaatgtgttaagacggtgacagacatacaaggtggggatgtaagaaaggggtgctttatttttgagactttttctttagatgagattaaagaagaatctgactatatcagcaccaagaaaacaattactgaagaagtaatacagggtgatgtaaaaagctacagaatgctctttgaaacccagccactctatgcaattcaagaccgagaagggtcctatcatgaagtgaccacagttaaaaaagaagaggtaattcatggagatgtgcgaggaacaaggtggctttttgaaacaaagccattagactctattaataaatcagaaactgtgtatgttattaaatctgtcacacaagaagacattcagaagggagatgttagttctgtcagatacagatttgaaactcagccactggatcagatttctgaagaatcacataatattatgcccagtattgaccatatacaaggtggcaatgtaaagacaagtagacaattctttgagtctgaaaattttgataagaataactatatacgaacagtaagtgtcaatgaaatacaaaagggcaatgttaaaacatctacttggctatttgaaacccacactatggatgaactgagaggagaagggttagaatatgaaaatatcaagacagtcactcaggaagatgtgcagaaaggtgatgttaagcaggctgtgtggctttttgaaaatcgaactttcgattctattatggaagcacataaaggtatcacaaaaatgaccaaggaagaaatccctccttctgatgtcaaaacaaccacatggctctttgaaacaacaccacttcatgaatttaatgaaactagagtagaaaagatagaaattattggcaagagcattaaagaaaccttagaagatctctactctcaaaaagttatccaggctcctggaatcatcattgaagctgatgaaataggggatgttcgaatggcaaaatacaagctaatgaaccaagcatctcctgagatacagaaagaagaaattatcagggctgatctcagaaatataatggtgaacctactttccaaaagggactgtactgaaagagagattttgattagtgaagaagagaagggaaatgttaatttgactaaaactcaattattaaacagatcaactgaatttcatgctgaaaaagaagagatagtgaaaggtgatgtacaacaagcaataaaaaacctgttctctgaggaaagatctgtaaagaaaggcatcttaattcaggaagatgaaaaaggagatattaacatgactatctattgtcttcttcatgaaaatgatggtgacacaattgagcgtgaagaagtaataggtggtgatgtcaaacgtaccattcataatttattgtcttccacatcaaacaataaaatatctgaaagggctaaaattgatgcctctgagagaggaaatgttcagtttttcacaacctgcatagaagctggagctttggattatctgaaacaactccacacagagtcaaatgaaacactgacagctaagaaacaagaaggagagaaagaaatcattggtggtgatgttgaaggtacaaaactgttactgaagaaaaggcagtctctggttgaacgtactgttagtgaaactgacatcatccctggagatgtgcataacacagttaaggtttttatgaccgagcctcagagtacatttggtaagatacccaaagaagagattataaaaggtgatttgacatcaaccctaaattccctcagccaggctgtaaatcagaaaacagtgacgaaaacagaagaaattataaaaggtaacatgctagccacactcaagtcacttaaagaatcaagccatcgatggaaagaatctaaacagcctgatgccatccctggtgatattgaaaaagctattgaatgccttgaaaaagctacaaatacaaagacagaaattctgaaaaaggagcttctcaaagatgacctggaaacatcactaaggtctttgaaagaagcacaaagaagtttcaaagaggtacataaagaaggtgtaataaaaaaagatgctaaagctgtgatggcaggatcctcgggagagcagaaaacagatattcatcaggttgctgtccagaggaacaaaaatagtcttcttcagccaaagccaggtccatttgagccagcggccaagtggcaagggggagcagatactctcagtcaaactatggggaaatcttgccatggcaatttagtagaagaaagaactgaggttaatcttccaaaagcccccaaaggcactgtaaagattgtcatagatcgtgaacaaaacaatgatgctctggagaaaagccttagaagactatctaattcacaccataaatctaatgttttggaatcaggagacaaaacgggtgtctggactgatactacaggagaacagcatcttagagatgaatatatgagcagacaattaacttcaactgtgtcagttaagaataatctaacaactaaagaatcagacagggcagtgagagagctgaagaaggatgatgtctttaattccatccaatctgctggtaaaaccgttggaaagcaacagacatatgaactgagaaatgaccaccagaaaatggagggttttcatataaagagtcctaaaaagaccaaaaatattaaaatattaactgatacacaaagctccaagcccagtcccacccagcatccagtcagcatgccagttggaggaacttacgacctttcaggggactttcagaagcaaactttgttaaagcaagaaacaaaatattctaataaggatataaagaaaaagaatataaaccttcaaccaatgtggcagcttttgcctgtagagcaagacacatccaatgtaacagaaatgaaagtctctgaaaaaagtcacaatacatttaaggcaaccaacaaaaagcgggagactgatgttcacttgaaaagccaggactttctaatgaaaacaaatacttccacaggcttaaaaatggcaatggaaaggtccttgaatccaatcaactttaaccctgagaataatgtaaaagaaagtgagtgcccccttccacctccatctccacctcctccaccaccttctaatgcatcatctgaaattgaatttcctcttcctcctccacctcctttgatgatgtttcctgaaaaaaatgggtttcttccctcactgtccacagagaagataaaggctgaatttgaaagttttccaggcctccctcttcctccacctccagtagatgagaaatctgaaagagaaagttcatcgatgtttctgccgcctcctcctcctccaactccatctcaaaagccagcacatctcctttcctcctctgctccggaaaagcacagtggagacttcatgcaacaatattcccaaaaagaagcctcgaactctcagaattctcaggctaaaatcataacaggaaaaaccggtgtgttgccacctcccacattgcccaaacccaaacttcccaagcatataaaagataataagaacgatttttcccccaaagttgaactggcaacctccctgtcagatatggaatgtaaaattactacctcaaaggatcagaaaaaagtaatggtgatgaccagcagtgaacacacggagacaaagcagaacgttattagtaagagtcttgatgaaagaaaacaattatctattgactctgcaaactgtctctcacacacagttccaggaacttcagcacccaggaaaaaacagattgcgcctcttataaaatctcattcatttccagagagttcaggacaacaaaatccaaaaccttatatgagaaaatttaagacacctttaatgattgctgaagaaaaatatagacaacaaaaagaagaaattgaaaaacagaaacaggagagttcttactacaacattgttaaaactcaaagccaaaatcaacacataacagaggtggaaaaggaaatgccattacaaaaaaccaatgaggaggtttccctatctggaattgattcagaatgcactgtggttcaacccagcccaggctctcaaagtaatgctcggatactaggagtgtgttctgataaccaactctccacaacatcgccagaaacagtcgctgccaagaggctccaccatgttttagcagcttcagaagacaaagataagatgaaaaaggaagttttacaaagctcaagggacattatgcaatccaaatcagcttgcgaaattaaacaaagtcaccaagaatgtagtacccaacaaacacaacagaagaagtatttggagcagttgcacttgccccaaagcaaaccaatttccccaaatttcaaagttaaaaccatcaaacttccaactctagatcatacattaaatgaaacagaccacagctatgaaagtcataaacagcaatctgagattgatgttcaaacctttaccaaaaaacaatatctgaaaaccaagaaaactgaagcaagcactgaatgtagtcataagcaatctctggctgaaagacattatcagttacctaagaaggagaaaagagtgacagtacaattgcctacagaatccatacagaagaaccaggaagataagctcaagatggttcccaggaagcaaagagaatttagcggatctgacagagggaaacttccaggaagtgaagaaaaaaatcagggaccatcaatgattggtcgaaaagaagagagattaataactgaaagaaaacacgaacatctgaagaataaatcagcaccaaaggtcgtcaagcaaaaggttatcgatgcacatcttgattcacagactcagaattttcagcaaacacaaatacagaccgctgaaagtaaagctgaacataaaaaattgccccagccatataatagtctgcaggaagaaaaatgtctcgaagtcaagggcatacaagagaaacaagtcttctctaatactaaagattcaaagcaagagattacacagaacaaatctttcttttcctctgtgaaagaatcccagcgggatgatggaaaaggtgccttaaatatagtggaattcttgagaaaacgtgaagaactgcaacagattttgtcgagagtgaaacagtttgaagcagagccaaataaaagtggccttaaaacatttcagacactattaaatactatcccaggatggctgataagtgaagataagagagaatatgcagttcacattgccatggagaataatttagaaaaagtaaaagaagaaataacacatattaaaactcaagcggaagatatgcttgtgtcctatgaaaatataattcagacagccatgatgtcctccaaaacaggaaaaccgggaaataaacccactagtcttgatgaaacatcatccaaagtatctaatgttcatgtcagcaataataaaaatagtgaacagaaagaaaataaaattgccaaagagaaaacagtacagcaccaagtagcagctcatcatgaagcaactgttcgtagtcacgtgaaaacccatcaggaaattaaacttgatgatagcaacattcctcctccctctttaaaaacacgcccaccgtcaccaacttttatcacaatagaatctactgcccgacgaacagaaaaccctactaagaacgagctttctcagtcccctaaaaaggacagttatgttgaacccccaccaagaaggcccatgtcgcaaaaatctgaaattcacagagcaaacacttccccttctccacccaggagtcgctctgaacaacttgtcagactcaaagacaccactgcaaagttatccaaaggggccatcccatgtccagcagcaaccccggttccaattgtagagaagaggtctgaaatcatcatgtctcctgcaacacttcgtcgtcaaattaagatagaaactcgtggtagggactctccacctacaatcacaataccagtaaatataaatcatgctgctagtggttccttcagagaatctgtggacgctcaagaggaaatcaggaaagtggagaagagagctacttatgttcataaagatggactaaattccactgatcacatggtgcccgacactgaaagttatgatgcagttgaaatcatccgcaaggttgcagtgcctcctcgcctgtcagagcacacacagagatatgaagcggccaaccgaactgttcaaatggctgaaaatttcgtgaatgaccctgaaaatgaaataaacagatggttcagggaatttgagcatggcccagtttctgaagcaaagtcaaatagaagagtttatgcaaagggagaaacaaaccataacatacaacaagaaagtcgtacattttgtaaggaggaatttggattaacatctttaggaaacacgagttttacagacttttcttgcaaacatcctagagaactgcgagaaaagattcctgttaagcagcccaggatctgctctgaaaccaggtctctaagtgaacatttctcaggcatggatgcatttgagagtcaaattgttgagtcgaagatgaaaacctcttcatcacatagctcagaagctggcaaatctggctgtgacttcaagcatgccccaccaacctatgaggatgtcattgctggacatattttagatatctctgattcacctaaagaagtaagaaaaaattttcaaaagacgtggcaagagagtggaagagtttttaaaggcctgggatatgcaaccgcagatgcttctgcaactgagatgagaaccaccttccaagaggaatctgcatttataagtgaagctgctgctccaagacaaggaaatatgtatactttgtcaaaagacagtttatccaatggagtgcctagtggcagacaagcagaattttcataagtcctgcttccgatgccaccattgcaacagtaaactaagtttgggaaattatgcatcacttcatggacaaatatactgtaaacctcactttaaacaacttttcaaatccaaaggaaattatgatgaaggttttggacataagcagcataaagatagatggaactgcaaaaaccaaagcagatcagtggactttattcctaatgaagaaccaaatatgtgtaaaaatattgcagaaaacacccttgtacctggagatcgtaatgaacatttagatgctggtaacagtgaagggcaaaggaatgatttgagaaaattaggggaaaggggaaaattaaaagtcatttggcctccttccaaggagatccctaagaaaaccttaccctttgaggaagagctcaaaatgagtaaacctaagtggccacctgaaatgacaaccctgctatcccctgaatttaaaagtgaatctctgctagaagatgttagaactccagaaaataaaggacaaagacaagatcactttccatttttgcagccttatctacagtccacccatgtttgtcagaaagaggatgttataggaatcaaagaaatgaaaatgcctgaaggaagaaaagatgaaaagaaggaaggaaggaagaatgtgcaagataggccgagtgaagctgaagacacaaagagtaacaggaaaagtgctatggatcttaatgacaacaataatgtgattgtgcagagtgctgaaaaggagaaaaatgaaaaaactaaccaaactaatggtgcagaagttttacaggttactaacactgatgatgagatgatgccagaaaatcataaagaaaatttgaataagaataataataacaattatgtagcagtctcatatctgaataattgcaggcagaagacatctattttagaatttcttgatctattacccttgtcgagtgaagcaaatgacactgcaaatgaatatgaaattgagaagttagaaaatacatctagaatctcagagttacttggtatatttgaatctgaaaagacttattcgaggaatgtactagcaatggctctgaagaaacagactgacagagcagctgctggcagtcctgtgcagcctgctccaaaaccaagcctcagcagaggccttatggtaaaggggggaagttcaatcatctctcctgatacaaatctcttaaacattaaaggaagccattcaaagagcaaaaatttacactttttcttttctaacaccgtgaaaatcactgcattttccaagaaaaatgagaacattttcaattgtgatttaatagattctgtagatcaaattaaaaatatgccatgcttggatttaagggaatttggaaaggatgttaaaccttggcatgttgaaacaacagaagctgcccgcaataatgaaaacacaggttttgatgctctgagccatgaatgtacagctaagcctttgtttcccagagtggaggtgcagtcagaacaactcacggtggaagagcagattaaaagaaacaggtgctacagtgacactgagtaaaatatctatggccactgacagtccacacttaggcactgagagatattgatgttctgaaataagattttatgaatttggatacccttttgaggaacttgatgtaaacatggtgttcagaaatctcgtgtctatctcaatgggatatttcttgtattacaccttgtcatttttttcacaatttatttacatctacttttgtttgaactggaatgaagagatgaaacactatggatatgttttccattcaaatggcactttagcatattgttctgttttcctgtaaaacatcatgggtgtgatttttatactgctgctgcttgtcacaattattataacttctctgtaatttcctctgaaataaaattgaatcacctgaggtgcaaacc

SEQ ID NO: 200442 - DNA, 1690 bp, Homo sapiens
  Payload ID: 19545
  Gene Name: XK, Kell blood group complex subunit-related family, member 3
  Uniprot ID: Q5GH77
  ENST ID: ENST00000331428
  CDS Start-End: 104-1483
cttttgaaattctaaattctgatgcagaacgtatcagtgaaactccctcccactgtctcttgtattagcatcaaggaagcgagaaaaaataagcaccctgagaatggagacagtgtttgaagagatggatgaagaaagcacaggaggagtttcatcttcgaaagaagaaatagtccttggccagagactccatctaagctttccttttagcattatcttctcaactgttctctactgtggtgaggttgcctttggtttatacatgtttgaaatttatcgaaaagctaatgacacattctggatgtcatttaccatcagctttattattgtgggggcaattttggatcaaattatcctgatgtttttcaacaaagacttgaggagaaataaggctgcattacttttttggcacattcttcttttaggacctattgtgaggtgtttgcacaccattagaaattaccacaaatggttgaaaaatcttaaacaggagaaggaagagactcaagttagcatcacaaagagaaacacgatgctggaaagggagattgcattctcaatccgggataatttcatgcagcagaaggctttcaagtacatgtcagtgattcaggcttttctcggttctgttccacaattaattttgcagatgtatatcagtctcactatacgagaatggcctttgaatagagcattgctgatgacattttccctgttatcagttacttatggggccattcgctgcaatatactggccatccagatcagcaatgatgatactaccattaagctaccgccgatagaattcttctgtgtcgtgatgtggcgttttttggaggttatctcacgtgtagtgactctggcatttttcattgcatctctgaaactgaagagcctacccgttttgttaatcatatattttgtatcattgttggcaccgtggctggagttttggaaaagtggagctcatcttcctggcaacaaagaaaataattccaatatggtgggtacagtactgatgcttttcttgatcacactgctatatgctgccatcaacttctcctgctggtcagcagtgaaactgcagttgtcagatgacaaaataattgacgggagacagaggtggggccatagaatcctacactacagctttcagtttttagaaaatgtgataatgatattggtatttaggttctttggagggaaaactttgctgaattgttgtgactcattaattgccgtgcagctcatcataagctacctattggccactggctttatgctcctcttctatcagtatttgtacccatggcagtcaggcaaagtgttgccaggacgtactgaaaatcagccagaagcaccgtactattatgtaaacatcgagaaaactgaaaagaataaaaataagcagctgaggaattactgtcactcctgcaatagggttggatatttttcaatcagaaaaagtatgacatgttcataaaatatacatatatactttcacagaacaatgagtaaagatgctgaatgtgacttgttaagaggctcttaaatttaaaaaatatacacagcaaaatcttggaagtggtttctaataaaattcatttatgttctcctgtgaacgtgccttagtaatttttgttttcttaactataattatacaattcattaaataaaacaaaataaaaaa

SEQ ID NO: 200443 - DNA, 19880 bp, Homo sapiens
  Payload ID: 19546
  Gene Name: XK, Kell blood group complex subunit-related family, member 4
  Uniprot ID: Q5GH76
  ENST ID: ENST00000327381
  CDS Start-End: 101-2053
ctgggagggaagccggggcgaggcgaggaggtggcgggaggaggagacagcggggaaaggtgtcagataaaggagggctctcctccggtgtggaggcatcatggccgctaaatcagacgggaggctgaaaatgaagaaaagcagcgacgtggcgttcaccccgctgcagaactcggaccactcgggctcggtgcagggattggctccaggcttgccgtcggggtcgggagccgaggacgaggaggcggccgggggcggctgctgcccggacggcggcggctgctcgcgctgctgctgctgctgcgccgggagtggcggctccgcgggctcgggcggctccggcggcgtcgccggcccgggcggcggcggggcgggctcggctgcgctgtgcctgcgcctgggcagggagcagcggcgctactcactgtgggactgcctctggatcctggccgccgtggccgtgtacttcgcggacgtgggcacagacgtctggctcgccgtggactactacctgcgcggccagcgctggtggttcgggctcacgctcttcttcgtggtgctcggctctctgtcggtgcaagtgttcagcttccgctggtttgtgcacgatttcagcaccgaggacagcgccacggccgctgctgcctccagctgcccgcagcctggagccgattgcaagacggtggtcggcggtgggtctgcagccggggaaggcgaggctcgtccttccacgccgcaaaggcaagcatctaacgccagcaagagcaacatcgccgcggccaacagcggcagcaacagcagcggggctacccgggccagtggcaagcacaggtctgcgtcctgctccttctgcatctggctcctgcagtcactcatccacatcttgcagctcgggcaaatctggagatatttccacacaatatacttaggtattcgaagccgacagagtggggagaatgacagatggaggttttactggaaaatggtatatgagtatgcggatgtgagtatgctgcatttgctagccacctttctggaaagtgctccacagctggtcctgcagctctgcattatcgtacagactcatagcttacaggccctccaaggtttcacagcggcagcttccctcgtgtccctggcctgggccttggcctcctaccagaaggccctccgggactctcgagatgacaagaagcccatcagctacatggccgtcatcatccagttctgctggcacttcttcaccatcgccgccagggtcatcacgtttgccctctttgcctcggttttccagctgtactttgggatcttcatcgtccttcactggtgcatcatgaccttctggatcgtccactgtgagacagaattctgtatcaccaaatgggaagagattgtgttcgacatggtggtggggattatctatatcttcagttggttcaatgtcaaggaaggcaggacacgctgcaggctattcatttactattttgtgatccttttggaaaatacagccttgagtgccctctggtacctctacaaggctccccagattgcagacgcatttgccattccagcgctgtgtgtggtgttcagcagctttttaactggcgttgtttttatgctgatgtattatgccttctttcatcccaatggacccagattcgggcagtcaccaagttgtgcttgtgaggacccagccgctgccttcactttgcccccagacgtggccacaagcaccctacggtccatctccaacaaccgcagtgttgtcagcgaccgcgatcagaaattcgcagagcgggatgggtgtgtacctgtctttcaagtgaggcccactgccccatccaccccatcatctcgcccaccacggattgaagaatcagtcattaaaattgacttgttcaggaataggtacccagcatgggagagacatgttttggaccgaagcctccgaaaggctattttagcttttgaatgttccccatctcctccaaggctgcagtacaaagatgatgcccttattcaggagcggttggagtacgaaaccactttataaagcaaaaggagttgcaggacccacaacatccagatgaaggggtgacagcagggctgtggccataatgacacttcatcctagagcagggcagtgagccgtgaagttcctagtgggaccgtcatcaccattatcatttgatcctgtcggctgggggcggctggtctccttccaaagcagctgcacccgagagtctctgactccacctgaaagaatgacgctggcttaataggactctccattgctaccaaactcctcctgcacggtcttgggtgcacccaccagagggtactactattatggaaaaattttgcctccaatcattagggtgtcttgatggcgttaactgatctttccataaaaatagattcagtcatacacacatacacacactaacacacataagttacaccagtcctctgtcaaaaaagcttaggtgacttttcttgatgcaaagctctgattcccacaggaatataaaaacaaagaaagagggaaacatccctcgagaaaaaaaatagtattgcttagaaaagaaaccattttctcatttggaaatccataccatgtgtgaaaatcctatccaacggacagcaaacccaaatgttgtctacacatgtgttagcattgatggagtggttcattttctacacatttcaggatttgttttatattttaaattttcagttgcgaacatcctttttgacagaaatcctatgcagcccatgtacggctttcaacaagaccaaggagctcaataacttcatgatgtaaattaaatagtaatcatgattcagtattcaattgcaaaaatgtaacaggtacacaaagaggaagtggggaaaaaggcaaaatgagagtctgattcccaggcatgtgcagcgcccattgggacataacggcagtgcggcgcgagccagaggaatgggctggaaccggatctgtttccagacgcagaatgagtggctctgtgtgaccataggcagatgctgactctggaagactccgtgccactcctttctagtgccaaacaccatccaaccacaggactgacgtggaagccccaaacaactgagaatgagtggcatgagccccctaaaagcaggcgagagaacgagcaatcaagttctccactgtgtacagacttttcctccccccaatccaaggtcaaagtgatgtgtcttttagaggctttgggacactttttagtaagtatgagcagacaaatgcaatgaatatgctatgaaaaaacccttctgaactgagagagggcttatcactatatccagctaagatttgtatttgaatcatctgtaaagtcgcactcttacaacaagcttctgggttttaaatacctccgtacagcaagtaaacgttccccgctttctgttctcagtgtcctcggtcatggtgcttttcgttgcattaaaagtgccggtcaaactttgatagtatttttttatagttggtgcagagtggaataactcatggattatttcaatatttttgtaataaaaaatatagggtatacacataggcatcatcacattttttatagacctggaatcgtttaaaatactttaagcatcataattacttgggatgtcagaaactggtccacaaattccatcagcctgcctcagcagattgaaaacatttgtctcttgcaagatcaccctactttgcaagttggtgcccccaggaacctggccaggggtgctatcagaatatcaggtgaagagagaatcagcttaaatagaaagggcttgtcaagactggccaatgtttcccaggaaatcaaagatgtaaatgattactttcatccatccattataacaaacctgaccacagtggaagctgtcttaaacttccttccctggttttatattaacccaactgatagattaagtattagtcaaaccactaaaaaagaaaaagaaaaaagtttaacttaattattcggttatttggatctaattcacacaaagtagtccagttctctagccaccacctgtaatgggtgtgtcatccagagactgtgtccccacgatgacatccacaggaagtaacagagggctcaacctaggacttcttttggtacaaagccccaaatcaatttttttaaaaaatagacaatttttataagtagacatacttcctagtactccatgatttgatcctccaagcaagatttccactaaaaaatactaatcttttgttgggatgtggaaagattacctagtcaccagtaaaggcccaggaaaaggctcttcttgtcagcacatggtgaaaacattccatccccactggagaaggaaaaaacgattttggcaaattcttcacttttgtgcagaaccttgagttattagcttcattgtttccaagacaacttttaactgatgatctttggaaattgagtttctcagttgaactgtacctttgattctatgagtaaatcacagattacagtctaatagagtcaatcaatcaacacaaacccaacaggccccatcatgcttcaatcatgtaagttctaagttatttctcaacttgatccctcattcaacatgttaagagtcagaatgaatactatgtcaatgaaaaatgatgtactgtgctttgacttggaggtgagattggcagtcaggagaatgtaaggaggttgaatttttcagtgatttcccaaatactgtaaatactctgttatccgacatatttggagattatgatgttttaattaggcatgaattcttgttaaggaaagaacatatccatgatgtgatgaattacaacctttcaaaagattacaagagcaaaacaagagataaatcatgatttagccttgcttccatgattcaggaagcactacactgccatcagactgttgtggtaataacaacttttacttgttttctagatgcacagataacagagagtttaaagtattcagatttaaagagacatcatcagtgtacaaagaaacaaagtttcatttttgtatttatattttaattctaacatttccttttcaatctgccattaaaccctccgcagacagtaactggagaatcccaaaggaaaaaattggaaatgctgggttccttatctgcaggctcctttctgtgtctgagtccactttgattccatttaagagggagatctgctcttactcactttttgcataggatcaggaaattttctaaaggaacaacattgtaatttgttttacttttaaacttgcatttctaaatatgaaaccatgtttaatgaatatatataatgtgtgtgtgtgtatcttaaccatagtgacactttaagtgtttgtgtgaaagaaaaggaaataatttttccatgtaagtcaaagtttagtctcccaaaatgactatgtcctttaaatcctctttgcttatttacttaactacatactgtctagttcaatagcactgactttgcagacacttagttactactcatttgtgataaacgctgttaacccaacaaatataataaattctcttactgacatggcaagaatatataattcaagtattagcaaaagataatctgaggataaaagtaaaatgaagtattttatggttaatttctaaatgcccaatttattttgctctatgagtaaaggaagtgattgcacagaacaattaaaagtgaatgagaatagttgaaaactcaatggctgttttttaaaaatgatatgtgccttttaagtgtgtttgtgtacatacatatatgtatatatacgtacctatatatgtatgtacacacacacacacacacactttccaactaaagtaacagagatgaaaaggataaagtatatactgcttttgaatgtatataaagtggtatgttatgcatataaattgtacataaactttttagaaaagaagcattttcctgctcctttttcaaaaccaacccaagcttacagtccatctataagaccaacacacttacgaacttcagttggaaatacctaaatataattcagcacttcttagctcgaatgagttttatcacttcttaaggatctcatcttttaaacagctgaataaaatagttctgtgtcacttcaaagtttctttctctgaacagattgaattgagcaaagagaacctcttctgtccttaccaggattgtgtaaggttacacatttgcttttaaatataccaaatgccgttgattggaaacaagttctgacacaatgtttagacaagaatccagagattttttctaatgaaccattttctagactaaatatatgctcccttgcattttccacatatctttgccattagccattgctgtttctatataaagcttggatgagatgcctgcatttttatgtgctaaggagaattccttaaagcctttttaaaaatagctcatactgtcattcagattatagctcagaggatggttgaagcgcatggtgaaaacacaggaggactggggtggtcattcctataatttcagtgacagatgcagatcaacgttcctttgtctcggcaatccaatgtcatttttgaaaacaatcaaaaagatcgcttgtgtcagcttctgactcataacactcctcccacctgatgctccagtgtttcaaaatggccaaggatgggcgattccgctctatcccccatttctgagactcttgtctggacctgtaacaggccgtgaaatgccctgagcattcgagtggcatcccttctcctcacataggcacctgggtggcagcatcagaccactgaagttgttgtgttgacatatgtcttatctagttgctgtcctaaaaatgggcatgtggcaagactctcaatctacagcctcgacagtatcattactcattctaaagtaaaactgcagaatatgggtggaattgtataaaaacataatgagccatttaattttgctaattgaagcaattagtctaacatgcaagcagcctgctctcacagcagagagccacatggaagaagtgccaaatagccatttgcatttatatatatatattgcaggcagtgacctggcccccaaatgtaaagcttttgtcaaccttgaggcctatattctgctaaacaagagatgacttaatgtccttgaaatattttcgtaatatactgacagcctaatgtcagaaacgagctgcctaaatcaagttttgcttttggttatttcacttccccatagactttcttatggttccatctcccacattgagagtagctcaccacgatggatggtttactgcgcacctagtgctggactaagagctgtatctatgtggtttcatttagtcctcactgccatctgtgagttaagcatcatttacagatgacaaaatctgtaaatggcttagagatgtcaagcaatttgcccaaaggtcccacagctaggaaacagtggggctgagggttgagcacagctttcaacaactgcgacttctgggagcccagtgactcttcccacaaaatctagtcctgatttggcaagtcttcagaagaaacagaatcatggtctgatgatcaaatttttccaagaaaattttatttaaaagtcaaagatgtccttcaaaatgaacagttaaaaatgtaaaagtcgatgtaaaatggaagtctctatcacctgtaactaaattttaccttaactctaactcatagtaggcagataaatgctattcttccattccaggcaactgtccccctcctatggctccactatgtattcaattaagtgataaatataaattaacctgatgccatgtctcttgtattttatatgtgtatgctgttttcatccaattaagcagactgaaaaaaaactaaaccccattacttactttggcattttgacaagatagagagagaggaaaagaaagagggagggagagagggagggaaggaagaaggaaggaaggaaggaaggaaggaaggaaggaaggaaggaaggaaggaaggaaggaaggaaggagatttaacaagtctttgaagtgatattttcaaattataaggtaattctgtttcactgccataatttttccctaaattttatttaatatcttgcaggtcacaaactttaatatttaagaggattattaaaccactagcttgaacaatcatataagtctaggaaccttattttagtgttagatgccaataatactgcaagtgtcaaccaaatatttgttgaattgaattataaaataattgatgtgttctttcccttctcactttagatatagcatgtctgaaggtctgcaagatgacagagttgtaacccattcaatgatattgttgcctagtaagctgtgtgtgtgttgtttgaactgatactaaaaaggtagctgataataaaccaaaaattttctcaaccctggtgtttatttttaaaaaatcttcaatgatcaatatgaatgtagtgtattaaaatacaagtaactatcttcctactttgatttaagagatctttatgaatttatataaaattagaagtcactgatttttataggaaatagcatgtaaaataaatctaagtattgctttatcactttattttatagatgagacaactgagatccaaaaagaacaggtaatttttgtgatcaggattacacaatacacttttttttttccctgagtcatttattcaacaagtttgacctctacaactcatttggctaggcaatgcacagtcaagcacaaaaggaaagttgcactggaatagctcatagtctggctattagcagcacaatcatagttttctgacgccagctcttactcttttctactctaccacactgtttcttctcttctcaatatctatatttaattccatattgaagcaagaaagaaacacagcttttctaagactatgcagtcatgtgtcacttaaggatggggatatgttctgagatatgcatcgtcaggcaattttgtcattgtgtgatggagtgtgcttacacaagcttagatggtagagcctaccatgctcctaggctatatggtagagcctattgtccctaggctacaaacctgtacagcatgctactgtaccgaatactgtaggcaactgtaacaccatggtaagtacttgtgtatttaaatatagaaaagttaacagtaaaaaatatagtattattgtcttatgggatcgctgtcatatgtgcagtctattattgaccaaaatgccattgtgtggcatgtgagccttacaatatacaattaacatatgaaataatgatgatgaacataaagtaacaatacaaatacaaaaaaaaaactagatgactgcttataaagagaaaagtaattttataatttgtttatatgactctccaacactagatatttttaaattgatatcacaacacacaaaaaaattgaaatactctcttggtgcatagtatttgattgaaaacaatcatttttggataaactttgaagcgattcttgagaacttatttcaagaaaaggcatgaaattagggagactccaaagtgaagagttttccaataggtgacttctctgatttttcaagaaagcattcttcactaactgtatttctccagcatactggttatttaggaataacaaatttctggacataaacatgagctgtttctctaaagcctttcctccaatgcccagaagagcagcactgtgctgcgtgacaatttcaggagtcaggagtcaggagtcaggacagtcagccccagcttcctggggaaacccacactggctttggacccgattgcattctctcctgagtgattggcttcccacatatataagcagcagattgttaaagatcactattaacttgtataactaattttccttatgtgaaataattctggtcagggaatatataaacccattggccctctaaggagtagaagaaaagagagaagaaagtatattaacttttatgagtacagaataattcaagttccttagcgagtcacattatgcattaataaaagagttgacctaataaatgttacaaggtaccatgatctctaggttcatgccaccattaccacattccttactacaattattgctattttagtcattggaccagacaaaatgaagcatataattactgatataatatttgctaagcaaaaatcttgtttaacgaaaaaaatcaataccaaaactaattaatcaaaatattaagcaaatattaccagcacagtactgacacaaaattttctcttgtgctagtaattgaagtatgtcatctaccctgttattagaatttcagaaaataggccgggcgcagtggctcacgcctgtaatcccaacactttgggaggctgaggcgggcggatcacaaggtcaggagatcgagaccatcctggctaacacagtgaaacccccatctctactaaaactacaaaaaaattagccaggcatggtggcgggcgcctgtggtcccagctactcgggaggctgaggcaggagaatggcatgaacccaggaggcagagcttgcagtgagccaagatcgtgccactgcactccagcctgggtgacagagcaagactccgtctcaaaaaaaaaaaaaaaaaaaaaaaagaatttcagaaaatataaagttttatgtttttattatatttccatctaccaaattgttgaccttctcctcctctccattgcttaatttatattaaaacagatttaatcaaattattacttaagtactacaaatgttatcagatggagatgtggttaagctaatttaatttacctattctagtggcattctggtatggagctgtatcaaatcaacacttttaattatttcacattaattcatcaagaagttccaaaacactactaaatgtgttgaaaatatagtttgagtttctatgattgtaatcaaaattcctattttgatcgcacaccagtagaacgcatcttaacaccagcattgccattgtgagtctagaaaatgagcactttgtgtgttgagcgctgttgcattcacttagcaattaacctttgacctgtggttttctgctgagccccttgtgattttttttattctattcaaattgggagcaataacacaccttaacataaccaaaaaaaggagacctgtcagctagtgaaagaattgtcattttatatcattctttcaaaaaattaaaatattcaacttcccttattaacctttctaatgcattgtacataaaagaggaaatggatttctgaaatatattttgaaagcctggggtgaaacattttccacggtctgaatcggaagcttggggctctgtggaaagatgtaaatccctcctgctgtaagaggagggaaggcagcagtgagctgtcactcagaaatacagtcaccactgtcacaaagctgcctattgctgatgctatcgattcccttctttttctacagaaacatcttggagcttgtcaagctttactggaggtgatttgcagttaattaattcaacagacactttaatcttgcaaattcttgacttgtaatattgtaaccaagctcctgcaagggaacattaatcagttagtgaaaaaggagcacttccgttcagccgtagtaccatgacgtgcacaggcctgaagagaaatacctctgtgaagtggagcgctagtgaattcctgctacctgcttcttatggctcacgctatgaatattcacctgcttcatttgttttttccagtaaacgctgttttgaaaaaaaagaaaaatattcccgggggcttgcatagctcagagaacggagtactgggtcgtggagacttgctttaaatggattcaaatccacatgtttggaaatgaaaataatgcactgtcatctgttgaataattgatctgtctgagtacagttgctgcttttatttcatttcttgagactaccattgtcagcattgtaataaccaatttataaaaattgagtttttattcagtttcagaggtaaaatctgcatgggtgcagctactgaataatttgattcctgccttcttaggtggtgacattagcagttccaaaccgagatccatttctatgtggaattggctatcctgttgcttctcaggccctgcaaaaccttggttacgagctcaaagatcacgaatctgatattcttttttttttttttttttttttttttttgagacagagtctcgctctgtcgcaggggctggagtgcagtggcacaatctcggctcactgcaagctctgcctcccaggttcacaccatccttctgcctcagccttctgagtaggtgggactacaggcgcctgtcaccacgcccggctaatttttttgtattttttagtagagatggggtttcaccgtgttagccagaatggtctcgatctcctgacctcgtgatctgccctccttggcctcccaaagtgctgggattacaggcgtgagccaccacacccggccccgatattcttaatgactaaattttcacatagaggtaaacagatcatctcttaatttaatacatggttctttctcccttgcttctgggttttgttttttttttttcaaagaaagatttgagctacgagataagaatgaagttaccagaagttatcaggtcatagtttcagagtatgcaagagagtcgggccttcatatgttcttgtaaagttttctgtctaatcttttggtataacaattttaggagttcaccctagatgaaagagtggaagtcatcagatttgtcaataagcagtctagaggaaaaatgagaagaggaagaagcagggattctttttcttgtgttttgaagatgtttctcctcccaaagctatcaccttggtagttatcaccaagatgtataatagcaagcactactgaatgatcttcccagttatcagcactagcatcacggcgagtcagttttcagaactagctcttggcgcaagccctgaaataaaatggggacaaaaagtggtctaccaccatgtgacttattttctttttttttttaattttattattattatactttaagttttagggtacatgtgcacaacgtgcaggtttgttacatatgtatacatgtgccatgttggtgtgctgtacctattaactcgtcatttagcatcaggtatatctcctaatgctatccctcccccctccccccaccccacaacactccccggtgtgtgatgttccccttcctgtgcacgtgacttattttcaattgcccagcaatgaaaactaacaagttaaagaaaatgttcattttctgaaccccagagcccacataggtacaaagatactctgtaatgtacaatgaggtggccaatcgtgggaatataggagcaataaatagtcctcttaagcaaggttcatgggtaagagttactctagcaggattgggtgttgggtcagagggtatctattaatgtagaggcccaagtatggtgatgaagagaaaacctgtcagtggctcatccatagtatttgccttttcacagagcagagaagttcaaaatagtcacagccagtccataactataacaacagacatgtccactttggaaaggctagggcctgacgaaagtgggaaaacagagatgtcagtggtgtcatgtctaagagtgactctgtcattaggggaacccaccccctgtgatagttctccttgaccactggtccctatgggctctgcaggagagcttctcgtgggttctaagataaggtattccaaggtattgtaagttacccttgtttgtagaacatgaaccacttaaccatccctccttttaacagcaatgagattcagggttaccatggccttactcatcttcccattgtaaatatatcacaatgtcacaagagcctctgtgtccaaacacactaaactgggtttacaagcattagaatctttcactcatattgtgaatctcaattctgccagtcacctagtctgtgtatctgttcccaaactggaaaaaataattcttgagagaataattttcagaataatggaggtggaaagaaatgaacagttaagcaatttttcaacatagacaaaaccactggaccattgatagccctcaagctctgattcttcctcctgactaagtttcttttctttggggggctttcaacatctgaattttccagatgattgcggaaccatcgtcactaaaccaaagtagacaaggagttattaaaaaataaagactgtccacatgactgcaaatatcctgatgaaaagtggccaagtagatcactcaagtggtaaatttggtcttcatgatatcaaacatacggatatttggaaaagtcgagatgtttgaatcatacagttttccgtctgggtgtctggtgtttctggatagacagactgctccggtgttgtaagtaatggaattgaactttcttgcgccgtaagcaattgctggtcatattctgctgctaaaagtctctttgttgtgccaagagaaataatgcagaacaaatgttatttaatttttatttactttcagcaaacacatgaatgaaagaggtcaggtaggctgtcctgggcattctgggcctggctgcggcacaccctccttcacttggcccctgccaggcaagaaactttctattcagtctttgctatctttcataaattgtatcattgctcttctgctgttcatatcatcttagttattcacaaagtctacttgataaaatggctcaagggaaatacaagtttcttaagtttttattcttcaaatagaagttttaattttaagcattccttatgatattttttaagcctaaaaaccattcaaattgcttgacaaaattatttcatggtgaattttataaggttgatagaagtaaaagctatttttcccaaaacaaacaaaataccatacatagttttttgggtttggtttgttgatgtcatgccaatttccaagcaccaactggttaccacaaacatgggaatatttagtgatatctttgtagtcatcgttaaaattcctgggaaaaaaagaaaaagtttacgtcaaaggaaaattcacctcccacaaggaaagtctgagatgttcatcctgacatttgcgttcctgattatttgtggacatttcttcattgtgactgtaggaagctgagcttgtttctcctaatttgacactgggttggtgagcattgtctcaaattttgtgcttgcctcatttatggtcctgaagcttagcagaaaaacagacaagctattcagaccagttttctttaagagcacttatgttgcagaacatgatacaaatgattcaccgtgagcaggcacacagagtacggaaaggtattcaactatgcaaagatattgaggggatttccagagaaaacttaaatgttttgaagatttgtaggtagggttttgattgtgtcacattctacactcagtgccaagttagaatgtctttatggggaaggcaataaagttacttgttgggtccttccttcccttacaaacagaatgtttttatgaaatcaaatggatcctccactttgtgtagtaaggaccccccaggccccacaacatcatcactgtgagtcctatcgcagatgtgtgtaccagcccaattcagttttgcttttctttttccctaagatttttacttcaccaaatcccatttcaaatctttttaccttcatgttaccaacaggatgtttagttgaatcagcaacaaagacgtgacaacctattgtcctccacaaaagcatgagtcattttattcagtgatctttggtagtacgataatcaatggaatttatggtgtcgtagaaaaccaaaaatccatgttgaatatagtgactgtcttaaatatacttaaatatgttattctacaaaacaatatccttttacactatgggatggattcctttctggatgcagggatgggagggtctatgggtcagtgactgggacaaaggaactgggaatctctgcacaactgagccctaatccctggtccatctctccagcctcagaaactcaccctcagcctcattttccccatatgcaaaagagagatatttatttacctacctcataggggtgttgtggagattagctagatttgctaaagtgcttgtaggttagaaagtgctgtcattcctgagaactggcattaacagaagagagctgtgtgcagcacggaggaagtggagtctgaggaatacaacagcaacaactcaccaagcagagaatacaatggttcttcatcactatataaaactaacacttttccttcaaaggtctatgtataattttcttcaatgattagctttttaatgagacaactcctttcatccagacattcagatgctttatataagttggcaattttcctgttaaccaaactgaattttattaaatgtttattaaaatgcacccagaaaacttgtctcctcctgatgcctgaggggtttgcatgcctgatcccaagctgcattttttcagaatgcgtgcatgatgccccagttctgtactcatgatcaccaggtggcgttctgaaatccactactggggaaagatttttaacagatattagtgagattagagttggtgtcatttccattgagtatcctcttcacccctaagatgacacatctttacaacacaataaaagaacgtaaagccttatttccacctgtaactcctgaattgattcattttcacgttataactacatttcaaatatttcggagaagtttttacacagggcttcagctatatactgatatacatatgcttacatgtgcttaggtgggaattctactaaaggataaaggacacagtgtgaaaacaacatcagagaatatcctgtacaacttccccaaaagtgacaagttttcttgtacttaaaaatttaatcctgataagaactaatgtgaaataacatcattttggtttataaatatttgtaatttttgagacatagaggcaatatcatgatataggaatacattcataaaactagactagcaaagcagataatgttttcatgatatggcttcatgaggcaaagttgttgtacatcaatattatcattgtgcccttatttaaggattatattccattgtgaaaaaaatgtgcacactcttaaaaacacaaaatgggtttcagaaagtttaccttgagaagtgggtttgaaatcatcttgtgcttggagctgacataagatacgcactcaatataatctcttctggattctaaaatctaattggcagtgatatttcaaagccttaacatttcaaggtggttaattaatatctaatgcatggtattaaactttctgaagcatgaatttaacctaggcaattatctgattcattttttttaaagtttgtgctgccaaaccagactgaagtattgtttttctggactaatactatgagaatagtaagtgagtcaaaaaataattgggactgtcctttttcccctgcccacttcctagtatcaatactcccccaaccagaaatgcagcagaatatcctttttgctataaaggaaaatactgtgtttttatttgtttttgcagaagaaaactggtgttgcctatttggactagatgtaggggcctggaagaaggaagtggcagattcacaggtggggtgaccaggatgggaggaaaatagtggggcgagtatgtcatggggagattttgccacaaagatacaaaacagaattgaagtgtgttagagctggacaaccctttgaaatgacagagtctagattcttcaccaaacagatgaaaagacaagtagagacaacatgtacttgagatataagctatacatctcatcactggaagaaaggagacttcagcctcttttcaaggctttccagaccacatggaactctccagagccctccttgaaagtttttagaaaaactaccattttcagcaaagattcatgtgattatgctgctgaggaccagtcattctgtaaacatcacatatgtgatgctttgtaaatgtattaattgtggtcaattttcatggatatttcccattaacattgtattccatgaacaagtgatagaaaacatatggaaattctcttttgatcaaaaggagtgtctcccaattagtttacgtgtgttagtattgctgacatattattatcatcacaaaattccttttatatctagatggtatcaaataagaaaaaaatgcatcatttggtcaattgcttattgaagatcccagctgaagcctttctttggtaaagagcgcagaaagagaccatagctattcttggatgagaaccttgcctctactaaatagtttctgcttttcctctctgtagccagacagctcaatagcctagggagagtcgatgaaggatatgcaaattacatttttcccattctcagaacaaagacagcaaccaatgagccagaggtttcttctctctttgaaaccaaatagcacgctgaatttagggctatgacaaaaatgttgttaaagcaagagcaaaatcatccttcctatggattcttttctcagtgtttacttaattctttttgcagtttggattggagtttctagtaatgataattaatgccattttacatgatagcttcaatgcagaaatggtgtgagcctgagttacaaatgacatgactagggatacaaacttcgtctgtactaacatcctaccaagcagattggaaacaaatactactaccactaatattctgatgtaattaataacatctaatagaaaaatagaaacatcgtgcttagcatgaaaccattgcacaatataaacctgctcccaaatggcaaggatttttgctaccaatatttgttcttaattctccagttattttaagtaaataagtttcacatctaactacctcagctactgttgttttatttagaaacatgaaaccatgcactttgtaatcaataagtcttttgtttaacatttcaaaaggatatttggtgcaaagcaattttcaaaaatttgtacatgatatacaccacccaacctcaggaggttgtacttaattttgtttgtttgtttctaaggttggttttgggtaaaatcctcatttccactcaacatcaagataagctgctctatatttgcttaatttgccttaaacattttgtgctcctttccctgttcaatttttttgttttgttttaaatctatctctgaaaaaaaaatggaacaggtggcaggtgaacagcaaatggaagagaatggaccagtaatttctcagtcccctgttgtcaactatctgcatgacattctgattgtgcaaaaatgccattcctgtgcttccccctccattacagaataaggtccgagagaccccacgagtgtgcgtagggaacggtgtagacatttcccccagtatgagcacagtgcctggacctgaatgatcatcttggcagttcttgtgcttttactttgtaaacattgtacaaatgtatttggaattttatttgaaatggagacttaaactagttattaaatttgtttccttcctgtaaatatatatattcaaattccatgtatccaaacatccctttagcgttcagattgtaagtgtgtctttattcgcgggaggccactgtcagcaggcagtgacccccagtgccctagtttgaagcacagtgtgtggagtatttgatgtactacagtaccatagttattttggtctgttaagtaagttgcaatttgtgatgaaatgaagtggaaagtagtacttcataatgaacaaatttccttggttacatggtttttcttgtaaaacttaaagaaaaaaaaagaaaacttgaaatttta

SEQ ID NO: 200444 - DNA, 3907 bp, Homo sapiens
  Payload ID: 19546
  Gene Name: XK, Kell blood group complex subunit-related family, member 4
  Uniprot ID: Q5GH76
  ENST ID: ENST00000622811
  CDS Start-End: 33-1985
aaaggagggctctcctccggtgtggaggcatcatggccgctaaatcagacgggaggctgaaaatgaagaaaagcagcgacgtggcgttcaccccgctgcagaactcggaccactcgggctcggtgcagggattggctccaggcttgccgtcggggtcgggagccgaggacgaggaggcggccgggggcggctgctgcccggacggcggcggctgctcgcgctgctgctgctgctgcgccgggagtggcggctccgcgggctcgggcggctccggcggcgtcgccggcccgggcggcggcggggcgggctcggctgcgctgtgcctgcgcctgggcagggagcagcggcgctactcactgtgggactgcctctggatcctggccgccgtggccgtgtacttcgcggacgtgggcacagacgtctggctcgccgtggactactacctgcgcggccagcgctggtggttcgggctcacgctcttcttcgtggtgctcggctctctgtcggtgcaagtgttcagcttccgctggtttgtgcacgatttcagcaccgaggacagcgccacggccgctgctgcctccagctgcccgcagcctggagccgattgcaagacggtggtcggcggtgggtctgcagccggggaaggcgaggctcgtccttccacgccgcaaaggcaagcatctaacgccagcaagagcaacatcgccgcggccaacagcggcagcaacagcagcggggctacccgggccagtggcaagcacaggtctgcgtcctgctccttctgcatctggctcctgcagtcactcatccacatcttgcagctcgggcaaatctggagatatttccacacaatatacttaggtattcgaagccgacagagtggggagaatgacagatggaggttttactggaaaatggtatatgagtatgcggatgtgagtatgctgcatttgctagccacctttctggaaagtgctccacagctggtcctgcagctctgcattatcgtacagactcatagcttacaggccctccaaggtttcacagcggcagcttccctcgtgtccctggcctgggccttggcctcctaccagaaggccctccgggactctcgagatgacaagaagcccatcagctacatggccgtcatcatccagttctgctggcacttcttcaccatcgccgccagggtcatcacgtttgccctctttgcctcggttttccagctgtactttgggatcttcatcgtccttcactggtgcatcatgaccttctggatcgtccactgtgagacagaattctgtatcaccaaatgggaagagattgtgttcgacatggtggtggggattatctatatcttcagttggttcaatgtcaaggaaggcaggacacgctgcaggctattcatttactattttgtgatccttttggaaaatacagccttgagtgccctctggtacctctacaaggctccccagattgcagacgcatttgccattccagcgctgtgtgtggtgttcagcagctttttaactggcgttgtttttatgctgatgtattatgccttctttcatcccaatggacccagattcgggcagtcaccaagttgtgcttgtgaggacccagccgctgccttcactttgcccccagacgtggccacaagcaccctacggtccatctccaacaaccgcagtgttgtcagcgaccgcgatcagaaattcgcagagcgggatgggtgtgtacctgtctttcaagtgaggcccactgccccatccaccccatcatctcgcccaccacggattgaagaatcagtcattaaaattgacttgttcaggaataggtacccagcatgggagagacatgttttggaccgaagcctccgaaaggctattttagcttttgaatgttccccatctcctccaaggctgcagtacaaagatgatgcccttattcaggagcggttggagtacgaaaccactttataaagcaaaaggagttgcaggacccacaacatccagatgaaggggtgacagcagggctgtggccataatgacacttcatcctagagcagggcagtgagccgtgaagttcctagtgggaccgtcatcaccattatcatttgatcctgtcggctgggggcggctggtctccttccaaagcagctgcacccgagagtctctgactccacctgaaagaatgacgctggcttaataggactctccattgctaccaaactcctcctgcacggtcttgggtgcacccaccagagggtactactattatggaaaaattttgcctccaatcattagggtgtcttgatggcgttaactgatctttccataaaaatagattcagtcatacacacatacacacactaacacacataagttacaccagtcctctgtcaaaaaagcttaggtgacttttcttgatgcaaagctctgattcccacaggaatataaaaacaaagaaagagggaaacatccctcgagaaaaaaaatagtattgcttagaaaagaaaccattttctcatttggaaatccataccatgtgtgaaaatcctatccaacggacagcaaacccaaatgttgtctacacatgtgttagcattgatggagtggttcattttctacacatttcaggatttgttttatattttaaattttcagttgcgaacatcctttttgacagaaatcctatgcagcccatgtacggctttcaacaagaccaaggagctcaataacttcatgatgtaaattaaatagtaatcatgattcagtattcaattgcaaaaatgtaacaggtacacaaagaggaagtggggaaaaaggcaaaatgagagtctgattcccaggcatgtgcagcgcccattgggacataacggcagtgcggcgcgagccagaggaatgggctggaaccggatctgtttccagacgcagaatgagtggctctgtgtgaccataggcagatgctgactctggaagactccgtgccactcctttctagtgccaaacaccatccaaccacaggactgacgtggaagccccaaacaactgagaatgagtggcatgagccccctaaaagcaggcgagagaacgagcaatcaagttctccactgtgtacagacttttcctccccccaatccaaggtcaaagtgatgtgtcttttagaggctttgggacactttttagtaagtatgagcagacaaatgcaatgaatatgctatgaaaaaacccttctgaactgagagagggcttatcactatatccagctaagatttgtatttgaatcatctgtaaagtcgcactcttacaacaagcttctgggttttaaatacctccgtacagcaagtaaacgttccccgctttctgttctcagtgtcctcggtcatggtgcttttcgttgcattaaaagtgccggtcaaactttgatagtatttttttatagttggtgcagagtggaataactcatggattatttcaatatttttgtaataaaaaatatagggtatacacataggcatcatcacattttttatagacctggaatcgtttaaaatactttaagcatcataattacttgggatgtcagaaactggtccacaaattccatcagcctgcctcagcagattgaaaacatttgtctcttgcaagatcaccctactttgcaagttggtgcccccaggaacctggccaggggtgctatcagaatatcaggtgaagagagaatcagcttaaatagaaagggcttgtcaagactggccaatgtttcccaggaaatcaaagatgtaaatgattactttcatccatccattataacaaacctgaccacagtggaagctgtcttaaacttccttccctggttttatattaacccaactgatagattaagtattagtcaaaccact

SEQ ID NO: 200445 - DNA, 4893 bp, Homo sapiens
  Payload ID: 19547
  Gene Name: XK, Kell blood group complex subunit-related family, member 5
  ENST ID: ENST00000618742
  CDS Start-End: 152-2212
tggccactacgaataaaccagacatacaattcgcgcctaacggcttagccagaaatgccacccgcagtcgggccccgggccggaaacctccccgacgcggggccgcgtgcaggggaaggggcgggcgcaggctgcggggtcggcacggaagatgcacgcgaggctcctggggctctcggccctgctgcaggcggccgagcagagcgcgcgcctttacaccgtggcttactacttcaccacaggacggcttctgtgggggtggctggcccttgctgtcctcctgcccgggttcttggtccaggccctgagctacctgtggttccgagcagacgggcatccagggcattgctccttgatgatgctgcacctcctacagcttggtgtttggaagcggcactgggacgctgcactgaccagtctgcagaaggaactggaggctccccaccgaggctggctgcagctgcaggaggccgacctgtcggcccttcgactcttggaggccctgctgcagactgggccccacctgctgcttcagacatatgtttttctagcctcagacttcacagatattgtgccaggggtgagcaccctgttttcctggtcctcactctcctgggcactggtgtcctacactcgcttcatgggcttcatgaagccaggccacctggccatgccatgggccgccctcttctgccagcagctctggaggatgggcatgttgggaacccgcgtgctgagtctggttctgttctacaaagcctaccacttttgggtttttgtggttgcaggtgcccactggctggtgatgacattctggcttgtcgcccagcagagtgacatcatcgacagcacctgccactggaggctgttcaacctgctcgtgggggccgtgtacatcctctgctacctcagcttctgggacagcccttctagaaataggatggtcacgttctacatggtcatgctgttggagaacatcatcctgttgctgttggccaccgactttctccagggggcatcgtggaccagcctgcagaccatagctggggtcctgtctggatttctgattggcagtgtctcactggtaatttattacagcctgctgcatccaaaatccacagacatctggcagggctgcctaaggaagtcctgtggcattgcaggaggtgataaaacagagagaagagattctccccgggccacagatctagctgggaagagaaccgagagctcaggctcatgccaaggggcaagttatgaaccaaccattttagggaagccccctacccctgagcaggtccccccagaggctgggctggggacccaggttgctgtggaggactctttcctcagtcatcaccactggctgtgggtgaaacttgccctaaaaacaggaaatgtgtctaagatcaatgccgcctttggagataacagtcctgcctattgtccacctgcatgggggttgagtcaacaggactacctgcagagaaaggccttgtctgcccagcaagagctcccatcctcatcccgtgacccctcaaccttagagaacagctctgcgtttgaaggtgtccctaaagcagaggccgacccattggaaacctcaagttacgtatcttttgccagcgatcagcaggatgaagcacctacccagaacccagcagccacgcagggggagggcaccccaaaggaaggagctgacgctgtttctgggacacaggggaaggggacaggtgggcagcagagaggaggggaaggacagcagagttccacgttgtacttcagcgccactgcagaagtggccacatcctcacaacaagaaggcagcccagctactctgcaaacggcccactctggaaggaggctgggaaagagcagccctgcccagcctgcatcgccccacccagtgggcttggcgcccttccccgacaccatggccgacattagccccatcctaggcacaggcccatgtagaggcttctgccccagtgcaggcttccctggaagaaccctcagtatctcagagctagaggagccgctggagcccaaaagggagctaagtcaccatgcagctgttggtgtgtgggtgtcattgccacagctgaggactgcccatgagccctgcctcacgtccacccctaagtctgagtctatccaaacggactgcagctgcagggaacagatgaagcaagagccgagttttttcatctgaccacagtcatggtgggataagacaacaggctgacaaaccaagctggccatttggtaccgtgagaaaggaaatcccacttctgacacctgtgtccttgggcacatcactgtcacctctgaatctccatctgcatccctgaaaaatgaagaaacagggctggatgattttgcaggtccaatgcaaacatcacagaccccacccatgcataggagagactctaacatactttagaggaggagaaagagattccagtcaaaattgtctgctaccttttatgagctgtaggttcccttattttatctttttgctgtggcttctaggaaacacaaaggtaaaacccagattcctattttatttgaggttcttgttacaattagctttgcctcacatttagcggttatgaatctcattttaatatattctaactgtattatgttatgaaatctcttggtaagataatttgcatgctttctgggagtaggtaaggcctgtgtgcttgtaataactaacataactgaaagtgcaaatgtcattctaagattcccatatcttttggttaggggacaatattagagcttttaaaaaggaagggtagactcacttagctcagcctcacccatgctaagggcacatgcacacattttctgcaattcactctcagaccatcagcatcctcctggccagctgcataaatgtatttttctgtgaaatgtgctgctcccctttgtgcaggctggccagccaagagttcccttccagctcccactgctgctttccaccccatctcctttatgtccaagctttgttcccacttccattcaatgtgagacactatccatgatttaagcccatccaaaaagaagggaggaaacgtccattcctctcgcactctccttctctctgactcctccactctaaagtgttctttgtggctaggtatttccataatttctttaagccttcctttgtagctgattaaggaagtctagtcataaactatcaaagagaaaggcacacagagagctggatgctatttagggatgggtatttttgttttgttttgtttcatttcatttgtttatttgttgagacagggcctctctgtcacccaggctggagtgcagtggcatgatcatggctcactgcagcctcaacctccagggcttaagcaatcctctcacctcagcctctcgagtagctgggactactggcaggtgggcaccatgcctggctacttttttgtattttttgtagagacaggttcttgccaggtggctcaggctggtctccaactcctgagctcaagcgatctgcccatctcggcctcccaaagtgctgggattacaggcgtgagccaccgtgcccagccagaatgggtagtttttattctctccaaacacttttggattagggtacaatattagagctctaaaaaggaatagtagaataacttagctcagcctgacacatactaagggcacctgcagacactttctgcaataagctctcagaccatcagcatcctcctggccagccacataagccaatcggggatgcagacaagtggctacaaactttccatacaacaggtgaagataacgagactttgggtcggatgcaggggctcacaccggtaatcccagcactttgagaggctgaggcgggaagatcacttgaggccagaagttcgagaccagcctgggcaatgtagtgagaccccatcactactaaaaatacataaattatcctggtgtggtggcacacacctgtagtcccagctgctcgagaggctgaggcacgagaatcagttgaactgggaggcagaggttgcagtgagctgagatcgtaccatggcactccagcctgggcgacagagcaagactctatctaaaaaaaaagcttgttaatagaacaaaatcattcatagttccattcactgtgctatcccagcatctcagtccttcctccatgcagtctctcgcccagccaggtgagagcatgagcacttccctgagtcctcaccagccctccccatttgtcctccaagactccactcaaacatctcctcttggtgccttcctgggccctccccagctccagctctcccagacctaccctctgtccccaggttgtattccactgccctttgccctctggtgacctcttcctaaacttgaagccctgcctccctgaaggctaattaagggttgcagtcctccttctgggctaactccaaggtccagcagagtgtccagcaaaagtaggcgttagagcattcaacagcatgaattcactaacgagcggggctgtgggcatgaatttcagcttgagtgcatatcctggatcaacggcatttgtgttatggggtaaaagtaagggtgggatatggggaatttgctcattcttttcaaactttctagcccttgaatagcctggaaagctagaaatactcttcattcattcattcatttaaggaatattagttgagtatgacaggcactgagtatgcagaaatcaaggcatgtacttgctgttcgaggccctgtggaccaacatcggcttctcagatggcttcctcacttcatgcctccagaaagcatattgcccggtgatgaaaaggatcagaaaatatacactatatttattagagaagactaataaatggacacttaattcaaaaa

SEQ ID NO: 200446 - DNA, 4885 bp, Homo sapiens
  Payload ID: 19547
  Gene Name: XK, Kell blood group complex subunit-related family, member 5
  ENST ID: ENST00000618990
  CDS Start-End: 6-266
ggaagatgcacgcgaggctcctggggctctcggccctgctgcaggcggccgagcagagcgcgcgcctttacaccgtggcttactacttcaccacaggacggcttctgtgggggtggctggcccttgctgtcctcctgcccgggttcttggtccaggccctgagctacctgtggttccgagcagacgggcatccagggcattgctccttgatgatgctgcacctcctacagcttggtgtttggaagcgcccacaaatccacttgtaaatgcagcatgagatgacagaagaaggcctatctcatccttagcatgcaccttggtttagcaatttttctttagtgaaagttcaaggttgtcaaaaggaaagttaaggtaaactctaaaggcactgggacgctgcactgaccagtctgcagaaggaactggaggctccccaccgaggctggctgcagctgcaggaggccgacctgtcggcccttcgactcttggaggccctgctgcagactgggccccacctgctgcttcagacatatgtttttctagcctcagacttcacagatattgtgccaggggtgagcaccctgttttcctggtcctcactctcctgggcactggtgtcctacactcgcttcatgggcttcatgaagccaggccacctggccatgccatgggccgccctcttctgccagcagctctggaggatgggcatgttgggaacccgcgtgctgagtctggttctgttctacaaagcctaccacttttgggtttttgtggttgcaggtgcccactggctggtgatgacattctggcttgtcgcccagcagagtgacatcatcgacagcacctgccactggaggctgttcaacctgctcgtgggggccgtgtacatcctctgctacctcagcttctgggacagcccttctagaaataggatggtcacgttctacatggtcatgctgttggagaacatcatcctgttgctgttggccaccgactttctccagggggcatcgtggaccagcctgcagaccatagctggggtcctgtctggatttctgattggcagtgtctcactggtaatttattacagcctgctgcatccaaaatccacagacatctggcagggctgcctaaggaagtcctgtggcattgcaggaggtgataaaacagagagaagagattctccccgggccacagatctagctgggaagagaaccgagagctcaggctcatgccaaggggcaagttatgaaccaaccattttagggaagccccctacccctgagcaggtccccccagaggctgggctggggacccaggttgctgtggaggactctttcctcagtcatcaccactggctgtgggtgaaacttgccctaaaaacaggaaatgtgtctaagatcaatgccgcctttggagataacagtcctgcctattgtccacctgcatgggggttgagtcaacaggactacctgcagagaaaggccttgtctgcccagcaagagctcccatcctcatcccgtgacccctcaaccttagagaacagctctgcgtttgaaggtgtccctaaagcagaggccgacccattggaaacctcaagttacgtatcttttgccagcgatcagcaggatgaagcacctacccagaacccagcagccacgcagggggagggcaccccaaaggaaggagctgacgctgtttctgggacacaggggaaggggacaggtgggcagcagagaggaggggaaggacagcagagttccacgttgtacttcagcgccactgcagaagtggccacatcctcacaacaagaaggcagcccagctactctgcaaacggcccactctggaaggaggctgggaaagagcagccctgcccagcctgcatcgccccacccagtgggcttggcgcccttccccgacaccatggccgacattagccccatcctaggcacaggcccatgtagaggcttctgccccagtgcaggcttccctggaagaaccctcagtatctcagagctagaggagccgctggagcccaaaagggagctaagtcaccatgcagctgttggtgtgtgggtgtcattgccacagctgaggactgcccatgagccctgcctcacgtccacccctaagtctgagtctatccaaacggactgcagctgcagggaacagatgaagcaagagccgagttttttcatctgaccacagtcatggtgggataagacaacaggctgacaaaccaagctggccatttggtaccgtgagaaaggaaatcccacttctgacacctgtgtccttgggcacatcactgtcacctctgaatctccatctgcatccctgaaaaatgaagaaacagggctggatgattttgcaggtccaatgcaaacatcacagaccccacccatgcataggagagactctaacatactttagaggaggagaaagagattccagtcaaaattgtctgctaccttttatgagctgtaggttcccttattttatctttttgctgtggcttctaggaaacacaaaggtaaaacccagattcctattttatttgaggttcttgttacaattagctttgcctcacatttagcggttatgaatctcattttaatatattctaactgtattatgttatgaaatctcttggtaagataatttgcatgctttctgggagtaggtaaggcctgtgtgcttgtaataactaacataactgaaagtgcaaatgtcattctaagattcccatatcttttggttaggggacaatattagagcttttaaaaaggaagggtagactcacttagctcagcctcacccatgctaagggcacatgcacacattttctgcaattcactctcagaccatcagcatcctcctggccagctgcataaatgtatttttctgtgaaatgtgctgctcccctttgtgcaggctggccagccaagagttcccttccagctcccactgctgctttccaccccatctcctttatgtccaagctttgttcccacttccattcaatgtgagacactatccatgatttaagcccatccaaaaagaagggaggaaacgtccattcctctcgcactctccttctctctgactcctccactctaaagtgttctttgtggctaggtatttccataatttctttaagccttcctttgtagctgattaaggaagtctagtcataaactatcaaagagaaaggcacacagagagctggatgctatttagggatgggtatttttgttttgttttgtttcatttcatttgtttatttgttgagacagggcctctctgtcacccaggctggagtgcagtggcatgatcatggctcactgcagcctcaacctccagggcttaagcaatcctctcacctcagcctctcgagtagctgggactactggcaggtgggcaccatgcctggctacttttttgtattttttgtagagacaggttcttgccaggtggctcaggctggtctccaactcctgagctcaagcgatctgcccatctcggcctcccaaagtgctgggattacaggcgtgagccaccgtgcccagccagaatgggtagtttttattctctccaaacacttttggattagggtacaatattagagctctaaaaaggaatagtagaataacttagctcagcctgacacatactaagggcacctgcagacactttctgcaataagctctcagaccatcagcatcctcctggccagccacataagccaatcggggatgcagacaagtggctacaaactttccatacaacaggtgaagataacgagactttgggtcggatgcaggggctcacaccggtaatcccagcactttgagaggctgaggcgggaagatcacttgaggccagaagttcgagaccagcctgggcaatgtagtgagaccccatcactactaaaaatacataaattatcctggtgtggtggcacacacctgtagtcccagctgctcgagaggctgaggcacgagaatcagttgaactgggaggcagaggttgcagtgagctgagatcgtaccatggcactccagcctgggcgacagagcaagactctatctaaaaaaaaagcttgttaatagaacaaaatcattcatagttccattcactgtgctatcccagcatctcagtccttcctccatgcagtctctcgcccagccaggtgagagcatgagcacttccctgagtcctcaccagccctccccatttgtcctccaagactccactcaaacatctcctcttggtgccttcctgggccctccccagctccagctctcccagacctaccctctgtccccaggttgtattccactgccctttgccctctggtgacctcttcctaaacttgaagccctgcctccctgaaggctaattaagggttgcagtcctccttctgggctaactccaaggtccagcagagtgtccagcaaaagtaggcgttagagcattcaacagcatgaattcactaacgagcggggctgtgggcatgaatttcagcttgagtgcatatcctggatcaacggcatttgtgttatggggtaaaagtaagggtgggatatggggaatttgctcattcttttcaaactttctagcccttgaatagcctggaaagctagaaatactcttcattcattcattcatttaaggaatattagttgagtatgacaggcactgagtatgcagaaatcaaggcatgtacttgctgttcgaggccctgtggaccaacatcggcttctcagatggcttcctcacttcatgcctccagaaagcatattgcccggtgatgaaaaggatcagaaaatatacactatatttattagagaagactaataaatggacacttaattcaaaaa

SEQ ID NO: 200447 - DNA, 1550 bp, Homo sapiens
  Payload ID: 19548
  Gene Name: XK, Kell blood group complex subunit-related family, member 6
  ENST ID: ENST00000297303
  CDS Start-End: 1-864
atggcggcgaaatccgatggcggtggcgtgggggtgggcttcgctcagctgcacaacctggacgaggcggtgggcagcggcggcgaggaggacggggagcccgggggaggcggctgcggcggcggcggcgacggcagcgagcccggcgagagcagctcgatgcacatctgccactgctgcaacacctcctcgtgctactggggctgccgctccgcctgcctgcgctccctcctgggcaggaagccgcgccgcagcgccgccgccgacgggggggaccagccgctgcagcctcccgcggcccccggcgccggccgccaacccccgacgccctcggccgcgcggccggagccgccgccgccgcaggtggagcggccgtggctcgactgcctgtggatcgtgctggcgctgctggtgttcttcggggacgtgggcaccgacctgtggctggccctcgactactaccgcaagggggactacgtctacttcgggctgaccctcttcttcgtgctggtgccgtcgctgctggtgcagagcctgagcttccgctggttcgtgcaggactacacgggcggcgggctgggcgccgtggaggggctcaccagccggggcccccccatgatgggggccggctacgtccacggcgcggcccgcggtggcccaggcgtgagggtctcccccacgccgggggcgcagcgcctgtgtcgcctctccgtgtggatctggcagtcggtcatccacctgctgcagatggggcaggtgtggagtgggcaagaccctttggtaccatcaaggaaaagaaggagcagatttaaccacatgaagttgcctcacctggtttcttcccttctccctcctcccatctgaaaaatccagaaatacttgcttagctgtgagggtaagtgggttaaattgagacagagatacttcctccaggagaatgaataagaagagaacatctctaaagatttatttcttgtttttgagtgaacagtaaccctaaaaacttgacatttatggtaaattttcaagggaaggggatgaaaaaatggcatgctttggagcgaaattgcaactggggatgcagcatagtatttccagaaggatccagaaacaaagtgtcaaaatctgtattgtaagaaggctggtgctcctgaaatctagcaggcaggtgcttactagaagtcacaagttgttcatttctgtcttcaacatcatttgatactatagacttattcataaggtcaattgcctagtcaggcttatgcagtgcagtggatagattctgtaatgttggaaagattctgtgggatggaaagattctgtgggatgcaaaaagaaactgtgtctctgatgttgccattttcaccccaggatgatttgctttacaacgtgctgtctgcaaataagtttgtggttaaaattttagtttactccccatgatgtgctattcatctagtttcttctcatcaggaattctggatttcttatttgcctcttaaaaagtaaaacttttaaaaaatttatgaaaatataacctcatttaacaagtt

SEQ ID NO: 200448 - DNA, 3163 bp, Homo sapiens
  Payload ID: 19548
  Gene Name: XK, Kell blood group complex subunit-related family, member 6
  ENST ID: ENST00000382461
  CDS Start-End: 1-1256
gtctttttctcctgccttctcctggagatgaagagaactgcaaacactgtgtactgctgcacgcgggcctcccccaggccaacagaactgctgggtatatccgcaccatgtacctggggattcagagccagcggcggaaggaacaccagcgacgcttctactgggctatgatgtatgaatatgcagacgtcaacatgctgcgcctcctggagaccttcctggagagcgcgccccaactggtgctacagctctacatcatgctccagaagaacagcgccgagaccctgccctgtgtctcctctgtgacttccctgatgtccctggcttgggtgctagcctcctatcacaagctgctgcgggactccagggacgacaagaagagcatgagctacagaggggccatcatccaggtcttctggcgcctcttcaccatctcatcccgagtgatctcttttgccctctttgcttccatcttccagctctattttgggatcttcgtggtggttcactggtgcgccatggccttctggatcatccatggcggaacagacttctgcatgtccaagtgggaggagatcctcttcaacatggtggtagggatcgtgtacattttctgctggtttaacgtcaaggaagggcggactcgatatcgaatgtttgcatattatacgatagtcttgaccgagaatgctgccttgacgttcctttggtatttttacagagacccggagaccactgactcctatgcggtgccagcactgtgttgtgtctttattagctttgtggctgggatcgcaatgatgctcttatactatggcgtgctgcatcccacaggaccacgagctaagatccttgccagctcctgttgtgccgagctgctctggggcatccctttgccccccgatgttgagcccatggcgcctgagatccctgggtaccgggggacccaggttacgcccaccagagccgtaacggaacaacaggaggatctcacggctgacacttgcttgcctgttttccaagtgagacccatggggccccctaccccgttggggcgtccttacctcccagaagggcccctcattaagattgacatgccaagaaagcgatacccagcttgggatgctcattttgtagacaggaggctgagaaggactattaacattctacaatatgtcacccccaccgcagtaggcattcgatatcgagacggaccactcctctatgagttgctacagtatgagtcttcactctaagagcatcttgaccaagttgagaaggggaccttaagtttggtttgcggcaaacagcacttgcaagaaatataaccctcccttcccccaatacacagaaccaccgccaccaccaccaacaccgccacaccaacaccaccactacaaaaaaaaaagaattaataagtcacaaccccttcaaataagctttctttccagtcgctgtatgtatacaaagatattctctatgttttgtaagtaaaaacaaaaagaaaacctttcttttgttttttacacataagaaacagtattgaaaaatcccacgctatggttcatagggtggagaaggaggagttatctccactccaaaagaaaaaaaaaaagttttttaccttacaccaagtgtagatcatttatgggattggtgctgattgaaagaacaaaacaaaacaaaacaaacacaaacaaacaaaaaaccttcaactgccttatgcccttaggtgctgagtttcattaagtactgtcacgttttctcatgcaaaactctctggtgatttttgcaccagaagagggaaaattaaacaattaaatgaaacaaatctaaaagtgaaacaaaaaccaaccaacaaatacaacacaaagcaattattcttcctatctgattatttgtattgaagaaaacaaatttaccaaaagcaaaagcataaacccctccctcttttcagtttctccccctcctctcctgaccttctccccactttgcagagccttctaggagctcaagggctgtttgaaactcaaatggctggagaagctacttgaaggctgattatgtgccattttagcatttgcctagcaagaatcacattcgtttcccagtgaaaagcaaaccagaacaaaacaaaaagccaccgcaataattcggtaaggacaggatattctaaagcaaattaaaggagatttctgtacacatagtcagtaataataaaactcagcatagtagcaaaaagaacgacatcagtttaaaggcacaatacttaatcagtgactggcaacaacgattagttccatcattttaaggctgtgaatggtagacatttatcacatgtgatattgtgtaaagcctcttctgtttccatttggtgggaagccttaaattgatctggaaagaattcttcatttttcatttgtgcttttttaaaaaaaaaaataacacaaagaggaaaactagaatatatatatatatatacatatatataaaaagtcaaaattgtaataactgacccatttcaaagactgtttggtgcttctgtctttcaccattgtggttggctgaaaatcattcagctcacctggtgcatctgggttgaatgggaaattttgtgtgtgtagtatgtgtgtgtttgtgtgtgtatgtgtgtgtgtgcccatagcacacgtatatatgtgtgtgtccctgctgcaaagtcttgccagagatatacaaaactgatgtaagacgaacttggatcacggcttggttcagcagagcatgggggcgggggctctggagtggtggggaagtgatgctgcctgcccacgagccctggtttgggtggcaagactcacaccagcagcggactgcaggccttagaggccatgccatttgggtgaggatttgattccactgtttattttctcattgtatcaagttgaatttctgcaggtgttgcaagtatgttcaacgatttaaatttttttttatttttcaaagtattgttcctttaaagaatatttctgttctagggcatcgtttcaatcgcatcgtatctctacttgggcacaaaaaaaaaggaaaagaaaaaaaatcacaaaaaagatatataataagtatatatatatatatatatataaacacacacaatatttttaagtaaatactgttagtcttt

SEQ ID NO: 200449 - DNA, 3382 bp, Homo sapiens
  Payload ID: 19548
  Gene Name: XK, Kell blood group complex subunit-related family, member 6
  Uniprot ID: Q5GH73
  ENST ID: ENST00000416569
  CDS Start-End: 28-1953
acctccggagctgggaagagagtcaagatggcggcgaaatccgatggcggtggcgtgggggtgggcttcgctcagctgcacaacctggacgaggcggtgggcagcggcggcgaggaggacggggagcccgggggaggcggctgcggcggcggcggcgacggcagcgagcccggcgagagcagctcgatgcacatctgccactgctgcaacacctcctcgtgctactggggctgccgctccgcctgcctgcgctccctcctgggcaggaagccgcgccgcagcgccgccgccgacgggggggaccagccgctgcagcctcccgcggcccccggcgccggccgccaacccccgacgccctcggccgcgcggccggagccgccgccgccgcaggtggagcggccgtggctcgactgcctgtggatcgtgctggcgctgctggtgttcttcggggacgtgggcaccgacctgtggctggccctcgactactaccgcaagggggactacgtctacttcgggctgaccctcttcttcgtgctggtgccgtcgctgctggtgcagagcctgagcttccgctggttcgtgcaggactacacgggcggcgggctgggcgccgtggaggggctcaccagccggggcccccccatgatgggggccggctacgtccacggcgcggcccgcggtggcccaggcgtgagggtctcccccacgccgggggcgcagcgcctgtgtcgcctctccgtgtggatctggcagtcggtcatccacctgctgcagatggggcaggtgtggaggtatatccgcaccatgtacctggggattcagagccagcggcggaaggaacaccagcgacgcttctactgggctatgatgtatgaatatgcagacgtcaacatgctgcgcctcctggagaccttcctggagagcgcgccccaactggtgctacagctctacatcatgctccagaagaacagcgccgagaccctgccctgtgtctcctctgtgacttccctgatgtccctggcttgggtgctagcctcctatcacaagctgctgcgggactccagggacgacaagaagagcatgagctacagaggggccatcatccaggtcttctggcgcctcttcaccatctcatcccgagtgatctcttttgccctctttgcttccatcttccagctctattttgggatcttcgtggtggttcactggtgcgccatggccttctggatcatccatggcggaacagacttctgcatgtccaagtgggaggagatcctcttcaacatggtggtagggatcgtgtacattttctgctggtttaacgtcaaggaagggcggactcgatatcgaatgtttgcatattatacgatagtcttgaccgagaatgctgccttgacgttcctttggtatttttacagagacccggagaccactgactcctatgcggtgccagcactgtgttgtgtctttattagctttgtggctgggatcgcaatgatgctcttatactatggcgtgctgcatcccacaggaccacgagctaagatccttgccagctcctgttgtgccgagctgctctggggcatccctttgccccccgatgttgagcccatggcgcctgagatccctgggtaccgggggacccaggttacgcccaccagagccgtaacggaacaacaggaggatctcacggctgacacttgcttgcctgttttccaagtgagacccatggggccccctaccccgttggggcgtccttacctcccagaagggcccctcattaagattgacatgccaagaaagcgatacccagcttgggatgctcattttgtagacaggaggctgagaaggactattaacattctacaatatgtcacccccaccgcagtaggcattcgatatcgagacggaccactcctctatgagttgctacagtatgagtcttcactctaagagcatcttgaccaagttgagaaggggaccttaagtttggtttgcggcaaacagcacttgcaagaaatataaccctcccttcccccaatacacagaaccaccgccaccaccaccaacaccgccacaccaacaccaccactacaaaaaaaaaagaattaataagtcacaaccccttcaaataagctttctttccagtcgctgtatgtatacaaagatattctctatgttttgtaagtaaaaacaaaaagaaaacctttcttttgttttttacacataagaaacagtattgaaaaatcccacgctatggttcatagggtggagaaggaggagttatctccactccaaaagaaaaaaaaaaagttttttaccttacaccaagtgtagatcatttatgggattggtgctgattgaaagaacaaaacaaaacaaaacaaacacaaacaaacaaaaaaccttcaactgccttatgcccttaggtgctgagtttcattaagtactgtcacgttttctcatgcaaaactctctggtgatttttgcaccagaagagggaaaattaaacaattaaatgaaacaaatctaaaagtgaaacaaaaaccaaccaacaaatacaacacaaagcaattattcttcctatctgattatttgtattgaagaaaacaaatttaccaaaagcaaaagcataaacccctccctcttttcagtttctccccctcctctcctgaccttctccccactttgcagagccttctaggagctcaagggctgtttgaaactcaaatggctggagaagctacttgaaggctgattatgtgccattttagcatttgcctagcaagaatcacattcgtttcccagtgaaaagcaaaccagaacaaaacaaaaagccaccgcaataattcggtaaggacaggatattctaaagcaaattaaaggagatttctgtacacatagtcagtaataataaaactcagcatagtagcaaaaagaacgacatcagtttaaaggcacaatacttaatcagtgactggcaacaacgattagttccatcattttaaggctgtgaatggtagacatttatcacatgtgatattgtgtaaagcctcttctgtttccatttggtgggaagccttaaattgatctggaaagaattcttcatttttcatttgtgcttttttaaaaaaaaaaataacacaaagaggaaaactagaatatatatatatatatacatatatataaaaagtcaaaattgtaataactgacccatttcaaagactgtttggtgcttctgtctttcaccattgtggttggctgaaaatcattcagctcacctggtgcatctgggttgaatgggaaattttgtgtgtgtagtatgtgtgtgtttgtgtgtgtatgtgtgtgtgtgcccatagcacacgtatatatgtgtgtg

SEQ ID NO: 200450 - DNA, 728 bp, Homo sapiens
  Payload ID: 19548
  Gene Name: XK, Kell blood group complex subunit-related family, member 6
  ENST ID: ENST00000529336
  CDS Start-End: 1-278
tgctggtgccgtcgctgctggtgcagagcctgagcttccgctggttcgtgcaggactacacgggcggcgggctgggcgccgtggaggggctcaccagccggggcccccccatgatgggggccggctacgtccacggcgcggcccgcggtggcccaggcgtgagggtctcccccacgccgggggcgcagcgcctgtgtcgcctctccgtgtggatctggcagtcggtcatccacctgctgcagatggggcaggtgtggagctctaagcgaaagacatgaggcctcagcctgaaatgaggttgttttgaggtcatctgatttctgactagaaggtgagcgatcgcctcgtcctgaaaccacttcagcccgcatggtaaatggcaaagccagcgagagggaggccttcatgtgtttccgtgtctgtgctgccccagttccttcctcttcaagattaaaaacattttaaagttgtaaaccaaaggtttgcaattttttttggtgatggcatgttcagaatcttggatccctaagttcaatatattggacatatttaggaactctggaaattatgttgttttcacatatctagtaacttactagatgaatcagtagatttcattaaagtatatctaataacagataattatgatgtacttctgggttgacatgcatgtctctcattatcagctatcagtattagtgtcatgctttggagacagttatcttttg

SEQ ID NO: 200451 - DNA, 7844 bp, Homo sapiens
  Payload ID: 19549
  Gene Name: XK, Kell blood group complex subunit-related family, member 7
  Uniprot ID: Q5GH72
  ENST ID: ENST00000562532
  CDS Start-End: 175-1914
agctcaggcgggtgggggcggggcggggcggcgccgaggagaatgaataattgaagtggaggggaggaggaagaagaggagaaggaggaagaggagccgcccgcgcagggtcctccccacgccgcacccccctccgccgcccggaagtcgctccccgcctccctctccgccaacatggccgcgaagtcggatggagcggcggcctcggccagcccggacccggagggggctgccggtggagcccggggcagtgccggcgggcgcggggaggcggcggcggcggccgggcccccgggggtcgtcggggcgggcggcccggggccgcgctacgagctgcgggactgctgctgggtgctgtgcgcgctgctcgtgttcttctccgacggtgccacggacctgtggctggcggcctcctactacctgcagaatcaacacacctacttcagcctcaccttgctgttcgtgctcctgccctcgctggtcgtgcagttactgagcttccgctggttcgtctacgactactcggagcccgcagggtccccgggacccgccgtcagcaccaaggacagcgtagccggcggagccgccatcagcaccaaggacagcgccggcgccttccggaccaaagaaggcagccccgagccgggtccccagcctgcgccctcctcggccagcgcctaccgccgccgctgctgccgcctctgcatctggctgctgcagaccctcgtccacctcctgcagctcggccaggtctggaggtacctgcgcgccctgtacctggggctgcagagccgctggcgcggggagcggctgcggcgccacttctactggcagatgctgttcgagagcgccgacgtgagcatgctgcgcttgctggagaccttcctgcgcagcgcgccgcagctagtgctgcagctcagcctgctggtgcaccgcggtggcgcgcccgacctgctgccggccctctccacctccgcctccctcgtgtctctggcctggacgctggcctcctaccagaaggtgctgcgggactcgcgggacgacaagcggccgctgtcctacaagggcgccgtggcacaggtgctgtggcacctgttcagcattgccgcccgcggcctggccttcgcgctcttcgccagcgtctacaagctctattttggcatcttcatcgtggcccactggtgcgtcatgaccttctgggtcatccaaggggagacggacttctgcatgtccaagtgggaggagatcatctacaacatggtcgtgggcatcatctacatcttctgctggttcaacgtcaaggagggccgcagccgccgccgcatgaccctctaccactgcatcgtcctgctggagaacgccgcgctcaccggcttctggtactccagccgcaacttctcaaccgacttctactcgctcatcatggtctgcgtagtggcctccagctttgcgctgggcatattcttcatgtgtgtctactactgtctcctgcaccccaatgggcccatgctgggtccccaggcacctggttgcatcttccgtaaggcctcagagccctgtggcccacccgctgacgccatcacgagtccccccaggtccctgccaaggactacaggtgctgagcgggatggggcctcggcgggagagcgtgcagggacccccaccccacctgtcttccaggtgcggcctggcttgcctcccacaccagtggcccgcaccttgcggacagaggggcctgtcatccggattgacttgcctcgcaagaagtacccggcctgggatgctcattttattgaccgccggctccggaagaccatcctggcactggagtactcctcacctgccacgccccggttgcagtaccggagtgtggggacttcccaggagctgctggagtatgagaccacagtgtaggctacagtgtcccagcacaaaagggacaggcttggctgatcccacatccgccgcagtgttgtgccccgaatttcagggccaccaggctaagggggagtggatctgttggtccaagggtagagtggccccactcttgggttctttcaggggagggggcagccttgcggaggccccagccctgggccccgttttcagccttgtggcccattccctaaattcccctgacccagggcctggggaatcatctggtgctacacttttcgagctgccctgctttcatggggcctccacacctctcccctgcctggcgttgcccatgtgttgcccctgctggacttgccagagaaagggcactgtctggggtccatgacctagaccctgtgctcctcaggggttgtggagagtgggctgcctctatggtgggaaaagatctctgagaaggatggaggtggccgtggaagggatggggtgaggttggagcattgtgtggacagggatggcgtggctcctgtagcatctgaggcctggagccagggcaagagggagctgaagaagggagttggggtggggcagggtgttggggtggggggctggcagtgctggagatggataggagaaagaactggggggggggtctaggctggcagaagcatggaggggtggaagacttgggggaggggaacctgcaatccagagcatagcgaacaagaatgaactccttaggagacgtctcttgttgtgttgtgggctctgtgaaggatgaagttccacacacctcaggtgaaatgtttgaaggagccattttttgttctagatgtgcacctggaacgtggcttctagatacaggtcttcaacacagcagataagatgtctggaaagatctctgggctcaagtgcaggtgaggttttagcacagttatcagaggaactgatccagaagcaggcttagttctagattgagttctagagtgctaggctgataaaatgtcccagggagccactctgatctgtgtattctgttgtgaggaggaggacactggaggcctgctgctctgctgtgggggattctagcacctgtcacagtggtgggggagaagaggttctagagcccagcgtgaatggaattttctaggaatgggtgctctcattctagacttctggggctcatgggagctctaggcccctgttaccttggtccatagccatctttctaaaaggaaattgtcctcagaacccctgagacatttcagctgccaactggttcccagctggaaaaaaaaatagctctggggacgtgacatgaatcctggctctcagccactctgcaaatggggctccctggagcggcatctgggaaactgacttgttttgccttagatctgatgactccccaggacctgtggtctattcccatggcctgaacatcctggagtgcccaggggactcacccagggcccctcctcccacctaggacagccagtgctggattgagggggcgtatgggagaggggaagtaggcagttccatggggtgaggagacagagcctctagcagagctgggaacccaacccaccccccacccccccacacacacactcccacagcaacttaggtgtgattggtgggagaggacagcagcggatgttaaggacagatgccaacctgatcctggagtgaggtgggccatgagaatcctagactatgcaaattagagggatgcttagccctccctggttcagcctctcttgggttacagatgggaaactgaggcccagagtggcagccactctctcaaggtcccagactctgggctgcccatcaaaaggtgatgggtaatgatgaattgctggggatgcagggtaaccccaaaggcagggagggccagactgcccacatacacacaagcacaagcacaaccatgatacgggtcaccctccccaccagcacacaggccgagatggtgtacgcatcatccctcctgccaacacagcaagagtgcttttccttctttctgctgctaagcaccctcaggaacgaggcctcgagggtgacgggaggtgggagaagcccaaggctgacccaggcccactctgttgggttcatccatcctccaaatccatctttggaggctgaattcacacacaaagccgttgtgagatgggagctctgaagatgcggacccagacccagaaacagactgtttctccagggccaactttgtgccaggaattttcaccccatgtcgtttcacttacactctcctctggtcacgacgtccctgcaagagaggtattatcaacccatcttacagacgaggaaactgaggcccagagatgtagcatgagggtcacccttggcaagttattctcctccccagtatcccagaatggcccatctggctgctgccttctagaggaaaagtcctagctggggtcctttacactccaggagactcccaaggggcagggatgtgctggcagggcttggcatggtctgaggctcgcagggaagccatggctacatttttggattttactccacccccactccccacctcttctcaaccccacacacccttccctcagggcttctgcctgcagggacatctgggcacaggaatggccacagtcaaagggcccagggagagggctgcaggcacctcctcctgcttctcaccctcagaagagtctcagcccttaaaggactctccacccaggagctcgggaccaggcctgaggccccctgctccactggcttgtcccttcatttcactgggatagaggagtcagatgagggaggggtccatccccttggagctgttttgtttttctttctgtgacacaatctacctcagccagtctctcccctagcagaactgacccccctggtcctctgcctcctgtcccctgacccccaccccagtctggatgttcagtccttccctgtccttcccaccctgccagggtccttgcagcccagagggtccctgagggttccttaagccacctgccctccacatccattagacaggagaaagtgagacccagagaggaccaaggactcaccaaaggccacacaggaagtcagtggcagttaggatttccctggggatgagaggtagttgggtgtgtcttaattttgccaggaacagaagagaacaggatgctttgggtaccaaatatggcaggccctgccctcagttacctctaaccccaggagaccagtgtccccatctccagggcagacttctgtctacctgttttcttagaactgacccccacgctgttgactgtgttccccaaacctctgcaggcaccacacacacccacatcacggcgcctcctggcactgatgtgccatgtgccttgtaactgtcaccccagctgaacagcacagacctccccactcccccacacagggctccccaatgagggagccttgcttgatcccctcctgtcatctgcctcattcttgtgtctcccccaaatctgccttacccccagccagctccctgctacacctgtgtcccacagaggcatgtcacccatgagagtcgggaaagacagagggcagggaaggtgaggcctggggaaagtccaggcctctggataagggctgagggagctgggaatatccagggaaggtctcgcttgcagtcaacaccctcctaagtactcgagttctgcaggttcttcccttggaattaatctggacctggagtccacagaagcctcagacaatagggagaaggttttctgggacgaaggctgcatgggatgcaaactcaaatgcctcgagataatgaaactaagagtaatggagacaatagggagtgttggggactctggcagacaggagagtgagtgtgtgccctgcctgtaggtactaaaattcaaatgtttgggaaactgctggccactcatatttggcccacgtgccaccagtttgagacttacggttcaaaatgttgagaaggttctggagtgtcctgccaagtggaaacccctcagcggaagtcagggacagaggctgtggctccctctgagactttgctagtccaaccctaaatccccatcacctggctatctgagaactgagcccactgccctctcagctgaaaagggaaatctggggggtccacagggtccctggtttgggaatcatctgataagggctacaggcccctccagtgcctcatggggttagaggctgctggagtcttctccagcttgggggcccctggttaggaggaatctacattgggttgcaggggagtccaggtgcaggatgtggactgaaagccaggacccaagagtcccattctgtgctggcccctgccacctttggcacctgtctccctcccagttcaagctgtggtggggcctgcagtagaggttggtagggggagctgtagtttctatattaaagtgctttgcagtgtctcaatggaagggaacaagtgggtgtcaagccgcatgggcagtagtagggttggggtttgagcccccttcccaaccatagaggcttctgagacctggggctggggaggaaaggagcttcaatgtgccattctggttggggagaggataggacatttctgggtccttggctgctgccggtagaggtatggggaggaaaaactctagagtgggagatgtggaagtggaaaaggaaggccctgtccaggcctggcctggtttctggagacagaaaactccccaggggacagagaggttacccccttgtgcttagcttctgccacccttcccttctctggaggagaaggctgccctctcctcagcaaccctggcctttattctatgcataaccactgcaagggcacccctggccaggctgaatgggtgggggtcccagggcacctgcaataatctcagaatggagggtatcctgggacaaagagggggtacagaaggtgccaggggggaaaaggtgattcctccatctctctctcacccaaatccccccagatcgaatctgacccttttccctggtctccattgtgctaaaccaccgaacttggaggagcctcatataaacatagcccccagccccactggctttccgaacccatcatgaaatagctggaaggtatctgaaccgttcccatagctccctcattattttcttccctgaggatcctgtggtttaggagatttttctcccaaaccagcctcatttcttgaagaagaattcattttcccatattaaattaactcaagctgagcttctgattgcagataaatgtttctaaggcctcaagtcaacttctagggcttgaaggtgggggaatatatgtattttattgagttgcttaatacaaaattctcaaaagcacttgtgggcactcattcctgccttcacaggccctcagggtctgggaccccacgttgggaatcaatggtttagacatccagcatcctattttactgaaggggcaagcccagagatgggagatggccagcccaaggtcacacagcaagttggtggcagggtgagaccagaacccggttcttttgagggtcccaccagaatatccccagccctgatcctcccctccatgcccctggaactctaggaatcactagccatgcctgaggggctaatctccctctgtcagcacaattccgagtgattcttcccctccctgtcgtctcttcctccctaacgggccctcacccctgtcctcttctgtttccttttcctggtcccacctcctggtatttactacatctgtgccatccctcatccccctgacccccattcaccctccgagcttcccccaggagggggagggggagggggccccgagctggggcctctttactgagactcttttgtacaccacaaactttttgtatatttttaattttgctgcgacatgagatattaaaagtcatttcagtacgtgc

SEQ ID NO: 200452 - DNA, 2692 bp, Homo sapiens
  Payload ID: 19550
  Gene Name: XK, Kell blood group complex subunit-related family, member 8
  Uniprot ID: Q9H6D3
  ENST ID: ENST00000373884
  CDS Start-End: 609-1796
attcccttccgtatggaaatgaggttaactcatttgcaggaacctaacgcccgccctcccccgactcggatcgctggcgtgaacccagcggccccgtgctctccgggtatccctggatcgaggcgcacgcgttgttgcaaagtctcgcacttagggattagaatgtgcctttgcgtttcgttttgttttgcaacaatacaggtgtgagggatcgcagccctggtccaggctctagtctccccgccctctcgctttcttgggcctccgggcgcctcaaaggtaaaactaggccatttgaagcctgcgaagcgaagggcagtcggtcttcaggcctagcgggcttggctgggctgggtcggtggacccctgggctggcggcgggagcagagcatcgagcggcttttagctggggttcgggcggaggacctgggacaaccgcgggcctcgctcctccccggacggggcgggacggggaagtcccgcccaccaggcccaggccccgggccgccccgagggctgcgcccacctccttcctgcctcggcaaccccgggccctgagggcaggccccaaccgcggaggagcaggagagggcggaggccggcgggccatgccctggtcgtcccgcggcgccctccttcgggacctggtcctgggcgtgctgggcaccgccgccttcctgctcgacctgggcaccgacctgtgggccgccgtccagtatgcgctcggcggccgctacctgtgggcggcgctggtgctggcgctgctgggcctggcctccgtggcgctgcagctcttcagctggctctggctgcgcgctgaccctgccggcctgcacgggtcgcagcccccgcgccgctgcctggcgctgctgcatctcctgcagctgggttacctgtacaggtgcgtgcaggagctgcggcaggggctgctggtgtggcagcaggaggagccctctgagtttgacttggcctacgccgacttcctcgccctggacatcagcatgctgcggctcttcgagaccttcttggagacggcaccacagctcacgctggtgctggccatcatgctgcagagtggccgggctgagtactaccagtgggttggcatctgcacatccttcctgggcatctcgtgggcactgctcgactaccaccgggccttgcgcacctgcctcccctccaagccgctcctgggcctgggctcctccgtgatctacttcctgtggaacctgctgctgctgtggccccgagtcctggctgtggccctgttctcagccctcttccccagctatgtggccctgcacttcctgggcctgtggctggtactgctgctctgggtctggcttcagggcacagacttcatgccggaccccagctccgagtggctgtaccgggtgacggtggccaccatcctctatttctcctggttcaacgtggctgagggccgcacccgaggccgggccatcatccacttcgccttcctcctgagtgacagcattctcctggtggccacctgggtgactcatagctcctggctgcccagcgggattccactgcagctgtggctgcctgtgggatgcggctgcttctttctgggcctggctctgcggcttgtgtactaccactggctgcaccctagctgctgctggaagcccgaccctgaccaggtagacggggcccggagtctgctttctccagaggggtatcagctgcctcagaacaggcgcatgacccatttagcacagaagtttttccccaaggctaaggatgaggctgcttcgccagtgaagggataggtgaacggcgtcctttgaagcaggatcagacccagccagcagagatggagagtgactctgttggcagaaggcaggcgaggataagctaacgatgctgctgtggcctctatgcactcagcaagagcgggacgcctgtgctgggccgggcaccagggatggtgctgagtcgggcagaggcctcctttcaaggagttcacagtgaacaagatgagaagggctgggccctggagggtcaagagccccaattatgtacaagacactttgggaggaaagaagactaccttttccccctgccattggtatagctggtgccccaaaacttccacctccctccctggctacctctaaaatgactggtataggtgctgccccaccccttagctcccctatcctgggctaggaggccacaggggctgtcctctagaattcttccttccctcccccacaccattcattcaattcatgaaacaaatctttgccaagagcagtttatgtgccaggaacatcattctgtccttgcaacctggaacaagaccagctaccagcctagcttcatccgctacttgcaccaaccagtcccgggttagatcccaaatgctagaagccagggatgcccaactctgggtggccccagtcagaacctctgggatctcagtgaagctggcctggcctctgctcctgctctcaaggggctgcttttcaaccaagagccttgtgagcctggtctgagccttgcacagccactgagtattttttttgccttagccagtgtacctcctacctcagtctatgtgagaggaagagaatgtgtgtgcctgtgggtctctacaagtgacagatgtgttgttttcaacagtattattaggttatgaataaagcctcatgaaatcctccaa

SEQ ID NO: 200453 - DNA, 3174 bp, Homo sapiens
  Payload ID: 19551
  Gene Name: XK, Kell blood group complex subunit-related family, member 9
  Uniprot ID: Q5GH70
  ENST ID: ENST00000408926
  CDS Start-End: 535-1656
gcgcgggcagtggtgggaaggctggcgcgaggcgtgaggtggcgtgaggcgaagctggaatctgcctctgtcacgggggctggtgcctcacgggtttgtgtcctagacaggcgagtggatccaagtgggcgagagacattttaatctggaagagtcttgtgatttgggagacagtgaagaagaagtaaaatattcacaagatgaagatttttccagaagggactttgagtcaaagatggctttttatatttgacaagtcttgtcatctgtaatgaagatcattgtgaaacagaagattgattaaagccttgtaacattggacctagattagagatttagaaaagaaagtcaaaattagtcactttagtgttagtgttcccatttcataatatttattctttcttctaaatagatttagggagtagaaattaaaattcaatgctataccaaagggtatactaatatttgtttggctttttttccctttttgtgagggagaaaaaagtagataacgaaaagctatagtcattcgtaatgaaatatactaaacagaattttatgatgtcagttcttggcattataatctacgtaactgatttaattgtggacatatgggtatctgtcagatttttccatgaaggacagtatgtttttagtgctttagcgttaagctttatgctttttggaacacttgtggctcagtgttttagttattcttggttcaaggctgatttaaagaaagcaggccaagaaagtcagcattgttttcttctacttcattgcttgcaaggaggagtttttacaaggtattggtttgccttaaaaaggggttaccatgcagcttttaaatatgacagcaatactagtaacttcgtggaagaacaaattgatctacataaagaagttatagatagagtgactgatttgagcatgctcagactatttgagacctacctggaaggctgcccacaacttattcttcaactctacattcttctggagcatggacaagcgaatttcagtcagtatgcggccatcatggtctcttgctgtgctatttcttggtcaactgttgattatcaagtagctttaagaaaatccttgcctgacaaaaagcttcttaatggattatgtcccaaaatcacatatctcttttacaagttgtttacattattatcgtggatgctgagtgttgtacttctactattcttaaatgttaagattgctttatttctgttgttatttctttggttgttaggtataatatgggcatttaaaaacaacacccagttttgtacttgtataagtatggaattcttatataggattgttgttggattcattcttatctttacattttttaatattaagggacagaataccaagtgtccaatgtcttgttattatattgttagggtactgggcactttggggatattgactgtattctgggtttgccccctcactatttttaatccagactattttatacctatcagtataactatagttcttactcttcttcttggaattctttttcttattgtttattatgggagttttcacccaaacagaagtgcagaaacaaaatgtgatgaaattgatggaaaaccagttctaagagaatgtagaatgagatatttcctaatggaataagctattcatttatgatatatattttcttatattttgtttcattggttagtaaagaaaatgtgtgttatgtgggtgtgttgtctcttatttttgccacctttaatttgaaattagttcagtgaaataggagatacatagtagtattttatttttaaaattaatttctcatttggttttgaagatcttgagtactcagatatctttctactgcctggtagagctgccatcttgagcctgaaatataagaaatggtctggttttcataatgagaaggctggaattgagcttccctcccattttccttgttcctgaactaatactactgtacctgttatggaggactgcaaagggaagagaaaagcagaacactgtattattttttcctttattgtcttcagtgcatatatttgcagttggggacaggttgagtagaggaaaagggaaagaagggaaagcagaaaacaaatttttagcatctgctgtgctttcatccatgaaatctccaattcagtaagtgcaaaagagaattggtgtgcatctgagaggtctgacatttcattatttacttatttcctagcttttctgaattaatgcactcttaacatataattatattaatcctatttgtgctagaatagttgtatctaaatcatattttaaaattatttttatttttaaaaaattatggtaaaaacatataaaatttaccatcttaatcactttgagtgtacagttcatcagtgttaactgtattcaccttgtgcaacagatctcaaggactttttcaccttgtaaaactaagattctctatttattgaacaaatccccatttcctccttccccaagtctctctcaactgaaattataattttttgtttctatgagtttgaatactttagataccttgttgccatggtttgaatgtgccccccagatttcatgtgtgtgaaacttaatctccaaatttgtatgttgatggcatttggaagtggtggggactttgtttatttatttatttttaattttttaattttatattattattattattattatactttaaggtttagggtacatgtgcacaatgtgcaggttagttacatatgtatacatgtgccatgctggtgtgctgcacccattaactcgtcatttatcattaggtatatctcctaaagctatccctcccccctccccccaccccacaacagtccccagagtgtgatgatccccttcctgtgtccatgtgttctcattgttcagttcccacctatgagtgagaatatgcagtgtttggttttttgttcttgcgatagtttactgagaatgatgatttccagcttcatccatgtccctacaaaggacatgaactcatcattttttatggctgcatagtattccatggtgtatatgtgccacattttcttaatccagtctattgttgttggacatttgggttggttccaagtctttgctattgtgaatagtgctgcaataaacatacgtgtgcatgtgtcttta

SEQ ID NO: 200454 - DNA, 716 bp, Homo sapiens
  Payload ID: 19551
  Gene Name: XK, Kell blood group complex subunit-related family, member 9
  ENST ID: ENST00000519350
  CDS Start-End: 450-716
agatatttctgatgaagaaaacgatctgctcttacctattttatgaatcagcagcatagtgtatcagagtggctaatgacatctgcttttgaagaagaagtaaaatattcacaagatgaagatttttccagaagggactttgagtcaaagatggctttttatatttgacaagtcttgtcatctgtaatgaagatcattgtgaaacagaagattgattaaagccttgtaacattggacctagattagagatttagaaaagaaagtcaaaattagtcactttagtgttagtgttcccatttcataatatttattctttcttctaaatagatttagggagtagaaattaaaattcaatgctataccaaagggtatactaatatttgtttggctttttttccctttttgtgagggagaaaaaagtagataacgaaaagctatagtcattcgtaatgaaatatactaaacagaattttatgatgtcagttcttggcattataatctacgtaactgatttaattgtggacatatgggtatctgtcagatttttccatgaaggacagtatgtttttagtgctttagcgttaagctttatgctttttggaacacttgtggctcagtgttttagttattcttggttcaaggctgatttaaagaaagcaggccaagaaagtcagcattgttttcttctacttcattgcttgcaaggaggagttttt

SEQ ID NO: 200455 - DNA, 1841 bp, Homo sapiens
  Payload ID: 19551
  Gene Name: XK, Kell blood group complex subunit-related family, member 9
  ENST ID: ENST00000520092
  CDS Start-End: 535-912
gcgcgggcagtggtgggaaggctggcgcgaggcgtgaggtggcgtgaggcgaagctggaatctgcctctgtcacgggggctggtgcctcacgggtttgtgtcctagacaggcgagtggatccaagtgggcgagagacattttaatctggaagagtcttgtgatttgggagacagtgaagaagaagtaaaatattcacaagatgaagatttttccagaagggactttgagtcaaagatggctttttatatttgacaagtcttgtcatctgtaatgaagatcattgtgaaacagaagattgattaaagccttgtaacattggacctagattagagatttagaaaagaaagtcaaaattagtcactttagtgttagtgttcccatttcataatatttattctttcttctaaatagatttagggagtagaaattaaaattcaatgctataccaaagggtatactaatatttgtttggctttttttccctttttgtgagggagaaaaaagtagataacgaaaagctatagtcattcgtaatgaaatatactaaacagaattttatgatgtcagttcttggcattataatctacgtaactgatttaattgtggacatatgggtatctgtcagatttttccatgaaggacagtatgtttttagtgctttagcgttaagctttatgctttttggaacacttgtggctcagtgttttagttattcttggttcaaggctgatttaaagaaagcaggccaagaaagtcagcattgttttcttctacttcattgcttgcaaggaggagtttttacaagggccttgctctgtcacccaggctggcctgcagtggcgccttcccagctcattgcagcctccacctccttggttcaagagattctcctgcatcagcttcctgagtagctgggattacaggtattggtttgccttaaaaaggggttaccatgcagcttttaaatatgacagcaatactagtaacttcgtggaagaacaaattgatctacataaagaagttatagatagagtgactgatttgagcatgctcagactatttgagacctacctggaaggctgcccacaacttattcttcaactctacattcttctggagcatggacaagcgaatttcagtcagtatgcggccatcatggtctcttgctgtgctatttcttggtcaactgttgattatcaagtagctttaagaaaatccttgcctgacaaaaagcttcttaatggattatgtcccaaaatcacatatctcttttacaagttgtttacattattatcgtggatgctgagtgttgtacttctactattcttaaatgttaagattgctttatttctgttgttatttctttggttgttaggtataatatgggcatttaaaaacaacacccagttttgtacttgtataagtatggaattcttatataggattgttgttggattcattcttatctttacattttttaatattaagggacagaataccaagtgtccaatgtcttgttattatattgttagggtactgggcactttggggatattgactgtattctgggtttgccccctcactatttttaatccagactattttatacctatcagtataactatagttcttactcttcttcttggaattctttttcttattgtttattatgggagttttcacccaaacagaagtgcagaaacaaaatgtgatgaaattgatggaaaaccagttctaagagaatgtagaatgagatatttcctaatggaataagctattcatttatgatatatattttcttatattttgtttcattggttagtaaagaaaatgtgtgtta

SEQ ID NO: 200456 - DNA, 1799 bp, Homo sapiens
  Payload ID: 19551
  Gene Name: XK, Kell blood group complex subunit-related family, member 9
  Uniprot ID: Q5GH70
  ENST ID: ENST00000520030
  CDS Start-End: 612-1733
gtgaggtggcgtgaggcgaagctggaatctgcctctgtcacgggggctggtgcctcacgggtttgtgtcctagacaggcgagtggatccaagtgggcgagagacattttaatctggaagagtcttgtgatttgggagacagtgaagaagaagtaaaatattcacaagatgaagatttttccagaagggactttgagtcaaagatggctttttatatttgacaagattcaaaatctagtgcattagacttttgaactagctgttccttcaagctggaaggcttttccatctctatgcacatggccaatttcactactcaaatgccaccttctcagtcttgtcatctgtaatgaagatcattgtgaaacagaagattgattaaagccttgtaacattggacctagattagagatttagaaaagaaagtcaaaattagtcactttagtgttagtgttcccatttcataatatttattctttcttctaaatagatttagggagtagaaattaaaattcaatgctataccaaagggtatactaatatttgtttggctttttttccctttttgtgagggagaaaaaagtagataacgaaaagctatagtcattcgtaatgaaatatactaaacagaattttatgatgtcagttcttggcattataatctacgtaactgatttaattgtggacatatgggtatctgtcagatttttccatgaaggacagtatgtttttagtgctttagcgttaagctttatgctttttggaacacttgtggctcagtgttttagttattcttggttcaaggctgatttaaagaaagcaggccaagaaagtcagcattgttttcttctacttcattgcttgcaaggaggagtttttacaaggtattggtttgccttaaaaaggggttaccatgcagcttttaaatatgacagcaatactagtaacttcgtggaagaacaaattgatctacataaagaagttatagatagagtgactgatttgagcatgctcagactatttgagacctacctggaaggctgcccacaacttattcttcaactctacattcttctggagcatggacaagcgaatttcagtcagtatgcggccatcatggtctcttgctgtgctatttcttggtcaactgttgattatcaagtagctttaagaaaatccttgcctgacaaaaagcttcttaatggattatgtcccaaaatcacatatctcttttacaagttgtttacattattatcgtggatgctgagtgttgtacttctactattcttaaatgttaagattgctttatttctgttgttatttctttggttgttaggtataatatgggcatttaaaaacaacacccagttttgtacttgtataagtatggaattcttatataggattgttgttggattcattcttatctttacattttttaatattaagggacagaataccaagtgtccaatgtcttgttattatattgttagggtactgggcactttggggatattgactgtattctgggtttgccccctcactatttttaatccagactattttatacctatcagtataactatagttcttactcttcttcttggaattctttttcttattgtttattatgggagttttcacccaaacagaagtgcagaaacaaaatgtgatgaaattgatggaaaaccagttctaagagaatgtagaatgagatatttcctaatggaataagctattcatttatgatatatattttcttatattttgtttcattggttagtaaagaaaatgtgtgtt

SEQ ID NO: 200457 - DNA, 2848 bp, Homo sapiens
  Payload ID: 19552
  Gene Name: XK, Kell blood group complex subunit-related, X-linked
  Uniprot ID: Q6PP77
  ENST ID: ENST00000372956
  CDS Start-End: 606-1955
ctgagagcgcgcaggtgagcgggccagctgatagctacagcctagcaatagctaggatacctaggcactgaactgaatcccctcttctgccctccttcttctgcgcccgctcttctgccctggctcagctctccgctgacttgagaggacacactggtcaggactctttgtgaggagctgctgagtgtcggtgcccccgacagatcggctacaccctgcctgaggggctgcgaaaggagccgccacggaagccgctgttctcatgactcttcacgtccctggagttggactctggatggggcgctgggatgcttgcttttgtcttgttcaagtttcacagcaagtatgttgacgattggaatcggggccaatcaagagtcaagttcaaagtggtactcctgggctttccatcccagactccaagtcgaatctgagtctagaagagagcggtttcttgctctaactagtgaatctctgttcccaaactggacttgacagagctctcctcacctatacttggactgtagcggccatagggttctcttggggatgggtgggagggtgctatgaacacaagaccacaacattcagaaagaacctcgacaatggacagagtttatgaaattcctgaggagccaaatgtggatccggtttcatctctggaggaagatgtcatccgtggagccaacccccgatttacttttccatttagcatccttttctccacctttttgtactgtggggaggctgcatctgctttgtacatggttagaatctatcgaaagaatagtgaaacttactggatgacatacaccttttctttctttatgttttcatccattatggtccagttgaccctcatttttgtccacagagatctagccaaagataaaccgctatcattatttatgcatctaatcctcttgggacctgttatcagatgtttggaggccatgattaagtacctcacactgtggaagaaagaggagcaggaggagccctatgtcagcctcacccgaaagaagatgctaatagatggcgaggaggtgctgatagaatgggaggtgggccactccatccggaccctggctatgcaccgcaatgcctacaaacgtatgtcacagatccaagccttcctgggctcagtgccccagctgacctatcagctctatgtgagcctgatctctgcagaggttcccctgggtagagttgtgctaatggtattttccctggtatctgtcacctatggggccaccctttgcaatatgttggctatccagatcaagtacgatgactacaagattcgccttgggccactagaagtcctctgcatcaccatctggcggacattggagatcacttcccgcctcctgattctggtgctcttctcagccactttgaaattgaaggctgtgcccttcctagtgctcaacttcctgatcatcctctttgagccctggattaagttctggagaagtggtgcccagatgcccaataacattgagaaaaacttcagccgggtcggcactctggtggtcctgatttcagtcaccatcctctatgctggcatcaacttctcttgctggtcagctttgcagttgaggttggcagacagagatctcgtcgacaaagggcagaactggggacatatgggcctgcactatagtgtgaggttggtagagaatgtgatcatggtcttggtttttaagttctttggagtgaaagtgttactgaattactgtcattccttgattgccttgcagctcattattgcttatctgatttccattggcttcatgctccttttcttccagtacttgcatccattgcgctcactcttcacccataatgtagtagactacctccattgtgtctgctgtcaccagcaccctcggaccagggttgagaactcagagccaccctttgagactgaagcaaggcaaagtgttgtctgattctattttctgggtattttaggaagagttgggagttgccaagagtaaccatgaaattgaacgaaaggatgaggttcatgggtgagatacccatcagtacattttcttgacttttctgttaagcctatcagaagaaagagcaactcccaaataggttttattttcttaagagttaccactatgtttggaaacagggggtatcgactatatagttgaaagggtcagaaataccattcacacccttcttacccaagtcaattggaataacttgtcttcaaacactttaggctctctaaagtgaccttctagctctgctcatttgcttgatgcatttctgagctttcctgggctgagctgaaggcccagaatcccgctagaatatatcctgactgatcagaggatatgacagcttaccagctaagagtacctcccaggaaacagtctgactaatgtggaacctgcaactgtcagtgtggctggggtctttttaattccagtgagaagctctggctgagaagaaaatcaccactattaaaaaagctgctccccaagcagattagctctctgttaggattttactagtggccattcagcaaggacctctctttacagtggcacttcataggcacactctaaggagaaagtgcagagtagaattccttcagggcataagccaaaatgactctttttctcagggacctgcatgggcctccagcttgtctattggaattgttaagtgaagcctctcacttagtgcctcattagcagagatttcctccaacccagcttttctgtgctcttggtattttactacttgatgtggacctcagagaagctgaactgtaattgaaaatgtttccgatgtgtggaagaaatgaagactgctttgtgtc

SEQ ID NO: 200458 - DNA, 2249 bp, Homo sapiens
  Payload ID: 19552
  Gene Name: XK, Kell blood group complex subunit-related, X-linked
  ENST ID: ENST00000468904
  CDS Start-End: 1130-1549
aaagctgtggctcctgcctgggtctggaggtggtggtcagaagtgcttctgaagagcggcccaagcccctttttgtcccgccactccacaacgagcatccctcggctggccgcctgcccgggaactctccggctggttttgtttggccgcagccgtcccgcccatctcgcccgcccccgccgtcccggtgccttagtttttgaagctgccgacctctcgcagctggaatcgcagaccaggcaggaccctggcagcagacggcgtccaagagtttggcgacctccgtccagccaggttggcgccccgcacatcgtgcctctcactagcaaagtttctccgaggagaagcagcccctccagccttttcttcatcctgtagagcgagcgcgctctgcttctgtccctcaacactgcattcggagacagggtggtgacaatactccactcccgggccaggcggtcttgggggcggggcttgggggaatccgaggagctatcctgagaaccctggactcggcaaaggtcctgagagcgcgcaggtgagcgggccagctgatagctacagcctagcaatagctaggatacctaggcactgaactgaatcccctcttctgccctccttcttctgcgcccgctcttctgccctggctcagctctccgctgacttgagaggacacactggtcaggactctttgtgaggagctgctgagtgtcggtgcccccgacagatcggctacaccctgcctgaggggctgcgaaaggagccgccacggaagccgctgttctcatgactcttcacgtccctggagttggactctggatggggcgctgggatgcttgcttttgtcttgttcaagtttcacagcaagtatgttgacgattggaatcggggccaatcaagagtcaagttcaaagtggtactcctgggctttccatcccagactccaagtcgaatctgagtctagaagagagcggtttcttgctctaactagtgaatctctgttcccaaactggacttgacagagctctcctcacctatacttggactgtagcggccatagggttctcttggggatgggtgggagggtgctatgaacacaagaccacaacattcagaaagaacctcgacaatggacagagtttatgaaattcctgaggagccaaatgtggatccggtttcatctctggaggaagatgtcatccgtggagccaacccccgatttacttttccatttagcatccttttctccacctttttgtactgtggggaggctgcatctgctttgtacatggttagaatctatcgaaagaatagtgaaacttactggatgacatacaccttttctttctttatgttttcatccattatggtccagttgaccctcatttttgtccacagagatctagccaaagataaaccgctatcattatttatgcatctaatcctcttgggacctgttatcagttgtgctaatggtattttccctggtatctgtcacctatggggccaccctttgcaatatgttggctatccagatcaagtacgatgactacaagattcgccttgggccactagaagtcctctgcatcaccatctggcggacattggagatcacttcccgcctcctgattctggtgctcttctcagccactttgaaattgaaggctgtgcccttcctagtgctcaacttcctgatcatcctctttgagccctggattaagttctggagaagtggtgcccagatgcccaataacattgagaaaaacttcagccgggtcggcactctggtggtcctgatttcagtcaccatcctctatgctggcatcaacttctcttgctggtcagctttgcagttgaggttggcagacagagatctcgtcgacaaagggcagaactggggacatatgggcctgcactatagtgtgaggttggtagagaatgtgatcatggtcttggtttttaagttctttggagtgaaagtgttactgaattactgtcattccttgattgccttgcagctcattattgcttatctgatttccattggcttcatgctccttttcttccagtacttgcatccattgcgctcactcttcacccataatgtagtagactacctccattgtgtctgctgtcaccagcaccctcggaccagggttgagaactcagagccaccctttgagactgaagcaaggcaaagtgttgtctgattctattttctgggtattttaggaagagttgggagttgc

SEQ ID NO: 200459 - DNA, 8584 bp, Homo sapiens
  Payload ID: 19553
  Gene Name: X-linked inhibitor of apoptosis, E3 ubiquitin protein ligase
  Uniprot ID: P98170
  ENST ID: ENST00000355640
  CDS Start-End: 307-1800
tcgggccggctgtcctggcgcggtgggtacagcttgtgtaggctttcccctcccccgctttccctccttcccctctcctccctcccctcttcttttcccctccacttccctcgggccggcgctgctggggagggcgggaaggccgcgccagcccatcaggggtggcccggccccggctgcttgcccgggttcctcggactgccgacggcaggcgtgggtgggtgggtgacttcaggcctgcaggattgccttcctaaaccctgtgacacctaagaaaaggtggacaagtcctattttcaagagaagatgacttttaacagttttgaaggatctaaaacttgtgtacctgcagacatcaataaggaagaagaatttgtagaagagtttaatagattaaaaacttttgctaattttccaagtggtagtcctgtttcagcatcaacactggcacgagcagggtttctttatactggtgaaggagataccgtgcggtgctttagttgtcatgcagctgtagatagatggcaatatggagactcagcagttggaagacacaggaaagtatccccaaattgcagatttatcaacggcttttatcttgaaaatagtgccacgcagtctacaaattctggtatccagaatggtcagtacaaagttgaaaactatctgggaagcagagatcattttgccttagacaggccatctgagacacatgcagactatcttttgagaactgggcaggttgtagatatatcagacaccatatacccgaggaaccctgccatgtatagtgaagaagctagattaaagtcctttcagaactggccagactatgctcacctaaccccaagagagttagcaagtgctggactctactacacaggtattggtgaccaagtgcagtgcttttgttgtggtggaaaactgaaaaattgggaaccttgtgatcgtgcctggtcagaacacaggcgacactttcctaattgcttctttgttttgggccggaatcttaatattcgaagtgaatctgatgctgtgagttctgataggaatttcccaaattcaacaaatcttccaagaaatccatccatggcagattatgaagcacggatctttacttttgggacatggatatactcagttaacaaggagcagcttgcaagagctggattttatgctttaggtgaaggtgataaagtaaagtgctttcactgtggaggagggctaactgattggaagcccagtgaagacccttgggaacaacatgctaaatggtatccagggtgcaaatatctgttagaacagaagggacaagaatatataaacaatattcatttaactcattcacttgaggagtgtctggtaagaactactgagaaaacaccatcactaactagaagaattgatgataccatcttccaaaatcctatggtacaagaagctatacgaatggggttcagtttcaaggacattaagaaaataatggaggaaaaaattcagatatctgggagcaactataaatcacttgaggttctggttgcagatctagtgaatgctcagaaagacagtatgcaagatgagtcaagtcagacttcattacagaaagagattagtactgaagagcagctaaggcgcctgcaagaggagaagctttgcaaaatctgtatggatagaaatattgctatcgtttttgttccttgtggacatctagtcacttgtaaacaatgtgctgaagcagttgacaagtgtcccatgtgctacacagtcattactttcaagcaaaaaatttttatgtcttaatctaactctatagtaggcatgttatgttgttcttattaccctgattgaatgtgtgatgtgaactgactttaagtaatcaggattgaattccattagcatttgctaccaagtaggaaaaaaaatgtacatggcagtgttttagttggcaatataatctttgaatttcttgatttttcagggtattagctgtattatccattttttttactgttatttaattgaaaccatagactaagaataagaagcatcatactataactgaacacaatgtgtattcatagtatactgatttaatttctaagtgtaagtgaattaatcatctggattttttattcttttcagataggcttaacaaatggagctttctgtatataaatgtggagattagagttaatctccccaatcacataatttgttttgtgtgaaaaaggaataaattgttccatgctggtggaaagatagagattgtttttagaggttggttgttgtgttttaggattctgtccattttcttttaaagttataaacacgtacttgtgcgaattatttttttaaagtgatttgccatttttgaaagcgtatttaatgatagaatactatcgagccaacatgtactgacatggaaagatgtcaaagatatgttaagtgtaaaatgcaagtggcaaaacactatgtatagtctgagccagatcaaagtatgtatgtttttaatatgcatagaacaaaagatttggaaagatatacaccaaactgttaaatgtggtttctcttcggggagggggggattgggggaggggccccagaggggttttataggggccttttcactttctacttttttcattttgttctgttcgaattttttataagtatgtattacttttgtaatcagaatttttagaaagtattttgctgatttaaaggcttaggcatgttcaaacgcctgcaaaactacttatcactcagctttagtttttctaatccaagaaggcagggcagttaacctttttggtgccaatgtgaaatgtaaatgattttatgtttttcctgctttgtggatgaaaaatatttctgagtggtagttttttgacaggtagaccatgtcttatcttgtttcaaaataagtatttctgattttgtaaaatgaaatataaaatatgtctcagatcttccaattaattagtaaggattcatccttaatccttgctagtttaagcctgcctaagtcactttactaaaagatctttgttaactcagtattttaaacatctgtcagcttatgtaggtaaaagtagaagcatgtttgtacactgcttgtagttatagtgacagctttccatgttgagattctcatatcatcttgtatcttaaagtttcatgtgagtttttaccgttaggatgattaagatgtatataggacaaaatgttaagtctttcctctacctacatttgttttcttggctagtaatagtagtagatacttctgaaataaatgttctctcaagatccttaaaacctcttggaaattataaaaatattggcaagaaaagaagaatagttgtttaaatattttttaaaaaacacttgaataagaatcagtagggtataaactagaagtttaaaaatgcttcatagaacgtccagggtttacattacaagattctcacaacaaacctattgtagaggtgagtaaggcatgttactacagaggaaagtttgagagtaaaactgtaaaaaattatatttttgttgtactttctaagagaaagagtattgttatgttctcctaacttctgttgattactactttaagtgatattcatttaaaacattgcaaatttattttatttatttaattttctttttgagatggagtcttgcttgtcacccaggctggagtgcagtggagtgatctctgctcactgcaacctccgccttctgggttcaagcgattctcgtgcctcagcttcctgagtagctggaattacaggcaggtgccaccatgcccgactaatttttttttatttttagtagagacggggtttcaccatgttggccaggctggtatcaaactcctgacctcaagagatccactcgccttgccctcccaaagtgctgggattacaggcttgagccaccacgcccggctaaaacattgcaaatttaaatgagagttttaaaaattaaataatgactgccctgtttctgttttagtatgtaaatcctcagttcttcacctttgcactgtctgccacttagtttggttatatagtcattaacttgaatttggtctgtatagtctagactttaaatttaaagttttctacaaggggagaaaagtgttaaaatttttaaaatatgttttccaggacacttcacttccaagtcaggtaggtagttcaatctagttgttagccaaggactcaaggactgaattgttttaacataaggcttttcctgttctgggagccgcacttcattaaaattcttctaaaacttgtatgtttagagttaagcaagactttttttcttcctctccatgagttgtgaaatttaatgcacaacgctgatgtggctaacaagtttattttaagaattgtttagaaatgctgttgcttcaggttcttaaaatcactcagcactccaacttctaatcaaatttttggagacttaacagcatttgtctgtgtttgaactataaaaagcaccggatcttttccatctaattccgcaaaaattgatcatttgcaaagtcaaaactatagccatatccaaatcttttccccctcccaagagttctcagtgtctacatgtagactattccttttctgtataaagttcactctaggatttcaagtcaccacttattttacattttagtcatgcaaagattcaagtagttttgcaataagtacttatctttatttgtaataatttagtctgctgatcaaaagcattgtcttaatttttgagaactggttttagcatttacaaactaaattccagttaattaattaatagctttatattgcctttcctgctacatttggttttttcccctgtccctttgattacgggctaaggtagggtagagtgggtgtagtgagtgtatataatgtgatttggccctgtgtattatgatattttgttatttttgttgttatattatttacatttcagtagttgttttttgtgtttccattttagtggataaaatttgtattttgaactatgaatggagactaccgccccagcattagtttcacatgatataccctttaaacccgaatcattgttttatttcctgattacacaggtgttgaatggggaaaggggctagtatatcagtaggatatactatgggatgtatatatatcattgctgttagagaaatgaaataaaatggggctgggctcagtggctcacgcctgtaatcccagcactttgggaggctgaggcaggtggatcacgaggtcaggagatcgagaccatcctggctaacacggtgaaaccccgtctctactaaaaaacagaaaattagccgggcgtggtggcgggcgcctgtagtcccagctactcgggaggctgaggcaggagaatggtgtgaacccgggaggcagagcttgcagtgagccgagatctcgccactgcactccagcctgggcaacagagcaagactctgtctcaaaaaaaaaaaaaaaagaaataagaaaatgggaagcaatatttgacatagttctttttagtcaaatctacttgttaaaaaaagggtagcagtttattcatctgtgaaaggaaaataatacttatcttacaaggttgcaagagctcaaggagaccatgtatgtaaagttcctgctgtaaatatgaactcccatcctaatacccttttacctctctgtgggtttgtcttgacctggaaatttgggctaaaacttagaaaaaattcttacatgataactcagtgatgcttactcatagtttttggtgtttctcatagataagatataaatcagctgggcgcggtggctcatgcctgtaatcccagcactttgggaggccgaggcgggcagatcacctgaggtcgggaggtcgagaccagcctgaccaacatggagaaaccccgtctctactaaaaatacaaaattagctgggcgtggtggctcatgcctgtaatcccagctacttgggaggctgaggcaggagaatcgcttgaacccaggaggcggaggttgtggtgagcgaagatcgtgccattgcactccagcctgggcaacaagagcaaaactctgtctcaaaaaaaaaaaaagatataaatcacaataaataaataggtcaatacaaatgttagccaggcgtggtggcacatgcccatagtcgcagctactctggaggcagaggcaggaggatcacttgagcccatgaatttgaggcagcagtgagctatgattgtgccactgtactccagtctgggtgacagagtgagaccccatctctaaataaataggtcaaacccttaaaaatatttaaattcttaaaaaattgaaaagattattcttctcaaatttagttgagctttctaagagaagcaattggctttttcccacttcaataatcattttcagtttgactcatacagttaacacaatgtgaatttcttcctcagcataacagagttatagaatgacagggctggaagtgaccttagagagtatccagttctttcattttacaggtgaggcaactgagactcaaaggtgatgtaatttgtgcaaagattatagctaattagtagcagagccctgactgggacatagtttgaaggtgaaaaacttcaccaagctacctttcttgaaaggtccaaatgtttatgttttcaactactctttccactgtaccataactttcactacatattaaatgacactttataactaatataataggacaatcatcaatgcatatatagccagcccttcatatctgtgggttttgcatccatggattcaaccaaggaggaattgaaaacactgagaaaaaaaaaaaagaccacacaataaaaaaaaaaaatacaaaataatacaaagaaaaagccaaaattgtcatactgttgttaagcaacagtataacaactatttacatagcattaaggttggtgcaaaaatgcaaaaaaaaaaaaagcaattatttttaaaccaacctaatatattgtattaggtattaaagtcatctggacatgaattaaagtatatgatgccagcctggacaaaaggcaaaaccctgtctctacaaaaaatacaaaaattagctgggcatggtggtgtgtgcctgtagtcctggctactccggagcctgaggtgggaggatcgcttgagtctgggaggcagaggctgcattgagctatgatcatggcactgcattccagcctgggtgacagtgcaagaccttgtctcagaataaataaagtatgtgatgaagatgtgcatacattatatgcaaatactgttttttttttttttaatttaaacagtctcactgtgttgcccaggatggagtgcaatggcacaatcttggctcatggcaaactctgcctcgcaagcagctgggactacaggcatgctccacggtgcccagttaattttttttgtattcttagtagagacagggtttcaccatgttggccaggctagtcttgaatttctgacctcaagtgattcatctcccaaagtgctgggattacaggcgtgagccaccacggccggctaatttttgtattttttagtagtgactggtttcgcggtgttgaccaggctggtctcgaactcctgatctcaggtgatctgcctgcctcggcctcacaaagtgctgggattacaggtgtgaaccactgctcccggccttgtgtgattttatctaagggacttaagcgtcctcaggtcctagggggtcgtgaaaccaaaaccccagggatagcaagggacaattgtatcttcaaagtagacaaatggcgccgggcacggtggctcacgcctgtaatcccagcagtttccgaggctgaggcaggcggctcacctgaggtcaggagttggagaccagcctggccaacatgctgaaaccctgtctgtacaaaaatacaaaaatagctgggcatggtggcgcatgcctgtagtcccagctactagagcgactgaggcaggagaattgcttgaacctgggaggcggaggttgcagggagccaagatggcgccaccgcactccagcctaggtgatagagtgagactccctctcaaaaacaaaacaaaacaaaaaaattagacaaatgctacattaatgtttgggtggtcagattctactttgaatctgaagtttgcagatatgcctatagatttttggagtttaccactttcttattctgtatcattaatgtaatattttaaattactatatatgttaccatttttctggatttagtaagaaatttgcagttttggtttgatgtaacaagggttttaatgtaatttatgttagattttgcatttttttcattactgttatattttaacctgactgactgatctaattgtattagtattgtgaataatcatgtgaaatgttttgagacagagtactatatttgtgaatataattttatggtttttttcacttagaacctttctgtgtggaaaactaagaaaattgctttctgctgtataatctggcattcattgtagattaaagcttatttttctgtgaataaaacgtattcaataaaatactattcttt

SEQ ID NO: 200460 - DNA, 8591 bp, Homo sapiens
  Payload ID: 19553
  Gene Name: X-linked inhibitor of apoptosis, E3 ubiquitin protein ligase
  Uniprot ID: P98170
  ENST ID: ENST00000371199
  CDS Start-End: 300-1793
tgacggaccgcgcccggtgtctctttgaggccctgacgtggacacacttcgggtttcacgactccgggtttctccaggggatgggccggccggtagaggcgcgtgagggagacgaagggacttccgtttccttcacctaggctggggccaagccgcagagcggagttggcatttccagattggggctcgggccgcgcctcctccgggaccctccccttggaccgagccgatcgccgcggggcagttcgggccggctgtcctggcgcgaaaaggtggacaagtcctattttcaagagaagatgacttttaacagttttgaaggatctaaaacttgtgtacctgcagacatcaataaggaagaagaatttgtagaagagtttaatagattaaaaacttttgctaattttccaagtggtagtcctgtttcagcatcaacactggcacgagcagggtttctttatactggtgaaggagataccgtgcggtgctttagttgtcatgcagctgtagatagatggcaatatggagactcagcagttggaagacacaggaaagtatccccaaattgcagatttatcaacggcttttatcttgaaaatagtgccacgcagtctacaaattctggtatccagaatggtcagtacaaagttgaaaactatctgggaagcagagatcattttgccttagacaggccatctgagacacatgcagactatcttttgagaactgggcaggttgtagatatatcagacaccatatacccgaggaaccctgccatgtatagtgaagaagctagattaaagtcctttcagaactggccagactatgctcacctaaccccaagagagttagcaagtgctggactctactacacaggtattggtgaccaagtgcagtgcttttgttgtggtggaaaactgaaaaattgggaaccttgtgatcgtgcctggtcagaacacaggcgacactttcctaattgcttctttgttttgggccggaatcttaatattcgaagtgaatctgatgctgtgagttctgataggaatttcccaaattcaacaaatcttccaagaaatccatccatggcagattatgaagcacggatctttacttttgggacatggatatactcagttaacaaggagcagcttgcaagagctggattttatgctttaggtgaaggtgataaagtaaagtgctttcactgtggaggagggctaactgattggaagcccagtgaagacccttgggaacaacatgctaaatggtatccagggtgcaaatatctgttagaacagaagggacaagaatatataaacaatattcatttaactcattcacttgaggagtgtctggtaagaactactgagaaaacaccatcactaactagaagaattgatgataccatcttccaaaatcctatggtacaagaagctatacgaatggggttcagtttcaaggacattaagaaaataatggaggaaaaaattcagatatctgggagcaactataaatcacttgaggttctggttgcagatctagtgaatgctcagaaagacagtatgcaagatgagtcaagtcagacttcattacagaaagagattagtactgaagagcagctaaggcgcctgcaagaggagaagctttgcaaaatctgtatggatagaaatattgctatcgtttttgttccttgtggacatctagtcacttgtaaacaatgtgctgaagcagttgacaagtgtcccatgtgctacacagtcattactttcaagcaaaaaatttttatgtcttaatctaactctatagtaggcatgttatgttgttcttattaccctgattgaatgtgtgatgtgaactgactttaagtaatcaggattgaattccattagcatttgctaccaagtaggaaaaaaaatgtacatggcagtgttttagttggcaatataatctttgaatttcttgatttttcagggtattagctgtattatccattttttttactgttatttaattgaaaccatagactaagaataagaagcatcatactataactgaacacaatgtgtattcatagtatactgatttaatttctaagtgtaagtgaattaatcatctggattttttattcttttcagataggcttaacaaatggagctttctgtatataaatgtggagattagagttaatctccccaatcacataatttgttttgtgtgaaaaaggaataaattgttccatgctggtggaaagatagagattgtttttagaggttggttgttgtgttttaggattctgtccattttcttttaaagttataaacacgtacttgtgcgaattatttttttaaagtgatttgccatttttgaaagcgtatttaatgatagaatactatcgagccaacatgtactgacatggaaagatgtcaaagatatgttaagtgtaaaatgcaagtggcaaaacactatgtatagtctgagccagatcaaagtatgtatgtttttaatatgcatagaacaaaagatttggaaagatatacaccaaactgttaaatgtggtttctcttcggggagggggggattgggggaggggccccagaggggttttataggggccttttcactttctacttttttcattttgttctgttcgaattttttataagtatgtattacttttgtaatcagaatttttagaaagtattttgctgatttaaaggcttaggcatgttcaaacgcctgcaaaactacttatcactcagctttagtttttctaatccaagaaggcagggcagttaacctttttggtgccaatgtgaaatgtaaatgattttatgtttttcctgctttgtggatgaaaaatatttctgagtggtagttttttgacaggtagaccatgtcttatcttgtttcaaaataagtatttctgattttgtaaaatgaaatataaaatatgtctcagatcttccaattaattagtaaggattcatccttaatccttgctagtttaagcctgcctaagtcactttactaaaagatctttgttaactcagtattttaaacatctgtcagcttatgtaggtaaaagtagaagcatgtttgtacactgcttgtagttatagtgacagctttccatgttgagattctcatatcatcttgtatcttaaagtttcatgtgagtttttaccgttaggatgattaagatgtatataggacaaaatgttaagtctttcctctacctacatttgttttcttggctagtaatagtagtagatacttctgaaataaatgttctctcaagatccttaaaacctcttggaaattataaaaatattggcaagaaaagaagaatagttgtttaaatattttttaaaaaacacttgaataagaatcagtagggtataaactagaagtttaaaaatgcttcatagaacgtccagggtttacattacaagattctcacaacaaacctattgtagaggtgagtaaggcatgttactacagaggaaagtttgagagtaaaactgtaaaaaattatatttttgttgtactttctaagagaaagagtattgttatgttctcctaacttctgttgattactactttaagtgatattcatttaaaacattgcaaatttattttatttatttaattttctttttgagatggagtcttgcttgtcacccaggctggagtgcagtggagtgatctctgctcactgcaacctccgccttctgggttcaagcgattctcgtgcctcagcttcctgagtagctggaattacaggcaggtgccaccatgcccgactaatttttttttatttttagtagagacggggtttcaccatgttggccaggctggtatcaaactcctgacctcaagagatccactcgccttgccctcccaaagtgctgggattacaggcttgagccaccacgcccggctaaaacattgcaaatttaaatgagagttttaaaaattaaataatgactgccctgtttctgttttagtatgtaaatcctcagttcttcacctttgcactgtctgccacttagtttggttatatagtcattaacttgaatttggtctgtatagtctagactttaaatttaaagttttctacaaggggagaaaagtgttaaaatttttaaaatatgttttccaggacacttcacttccaagtcaggtaggtagttcaatctagttgttagccaaggactcaaggactgaattgttttaacataaggcttttcctgttctgggagccgcacttcattaaaattcttctaaaacttgtatgtttagagttaagcaagactttttttcttcctctccatgagttgtgaaatttaatgcacaacgctgatgtggctaacaagtttattttaagaattgtttagaaatgctgttgcttcaggttcttaaaatcactcagcactccaacttctaatcaaatttttggagacttaacagcatttgtctgtgtttgaactataaaaagcaccggatcttttccatctaattccgcaaaaattgatcatttgcaaagtcaaaactatagccatatccaaatcttttccccctcccaagagttctcagtgtctacatgtagactattccttttctgtataaagttcactctaggatttcaagtcaccacttattttacattttagtcatgcaaagattcaagtagttttgcaataagtacttatctttatttgtaataatttagtctgctgatcaaaagcattgtcttaatttttgagaactggttttagcatttacaaactaaattccagttaattaattaatagctttatattgcctttcctgctacatttggttttttcccctgtccctttgattacgggctaaggtagggtagagtgggtgtagtgagtgtatataatgtgatttggccctgtgtattatgatattttgttatttttgttgttatattatttacatttcagtagttgttttttgtgtttccattttagtggataaaatttgtattttgaactatgaatggagactaccgccccagcattagtttcacatgatataccctttaaacccgaatcattgttttatttcctgattacacaggtgttgaatggggaaaggggctagtatatcagtaggatatactatgggatgtatatatatcattgctgttagagaaatgaaataaaatggggctgggctcagtggctcacgcctgtaatcccagcactttgggaggctgaggcaggtggatcacgaggtcaggagatcgagaccatcctggctaacacggtgaaaccccgtctctactaaaaaacagaaaattagccgggcgtggtggcgggcgcctgtagtcccagctactcgggaggctgaggcaggagaatggtgtgaacccgggaggcagagcttgcagtgagccgagatctcgccactgcactccagcctgggcaacagagcaagactctgtctcaaaaaaaaaaaaaaaagaaataagaaaatgggaagcaatatttgacatagttctttttagtcaaatctacttgttaaaaaaagggtagcagtttattcatctgtgaaaggaaaataatacttatcttacaaggttgcaagagctcaaggagaccatgtatgtaaagttcctgctgtaaatatgaactcccatcctaatacccttttacctctctgtgggtttgtcttgacctggaaatttgggctaaaacttagaaaaaattcttacatgataactcagtgatgcttactcatagtttttggtgtttctcatagataagatataaatcagctgggcgcggtggctcatgcctgtaatcccagcactttgggaggccgaggcgggcagatcacctgaggtcgggaggtcgagaccagcctgaccaacatggagaaaccccgtctctactaaaaatacaaaattagctgggcgtggtggctcatgcctgtaatcccagctacttgggaggctgaggcaggagaatcgcttgaacccaggaggcggaggttgtggtgagcgaagatcgtgccattgcactccagcctgggcaacaagagcaaaactctgtctcaaaaaaaaaaaaagatataaatcacaataaataaataggtcaatacaaatgttagccaggcgtggtggcacatgcccatagtcgcagctactctggaggcagaggcaggaggatcacttgagcccatgaatttgaggcagcagtgagctatgattgtgccactgtactccagtctgggtgacagagtgagaccccatctctaaataaataggtcaaacccttaaaaatatttaaattcttaaaaaattgaaaagattattcttctcaaatttagttgagctttctaagagaagcaattggctttttcccacttcaataatcattttcagtttgactcatacagttaacacaatgtgaatttcttcctcagcataacagagttatagaatgacagggctggaagtgaccttagagagtatccagttctttcattttacaggtgaggcaactgagactcaaaggtgatgtaatttgtgcaaagattatagctaattagtagcagagccctgactgggacatagtttgaaggtgaaaaacttcaccaagctacctttcttgaaaggtccaaatgtttatgttttcaactactctttccactgtaccataactttcactacatattaaatgacactttataactaatataataggacaatcatcaatgcatatatagccagcccttcatatctgtgggttttgcatccatggattcaaccaaggaggaattgaaaacactgagaaaaaaaaaaaagaccacacaataaaaaaaaaaaatacaaaataatacaaagaaaaagccaaaattgtcatactgttgttaagcaacagtataacaactatttacatagcattaaggttggtgcaaaaatgcaaaaaaaaaaaaagcaattatttttaaaccaacctaatatattgtattaggtattaaagtcatctggacatgaattaaagtatatgatgccagcctggacaaaaggcaaaaccctgtctctacaaaaaatacaaaaattagctgggcatggtggtgtgtgcctgtagtcctggctactccggagcctgaggtgggaggatcgcttgagtctgggaggcagaggctgcattgagctatgatcatggcactgcattccagcctgggtgacagtgcaagaccttgtctcagaataaataaagtatgtgatgaagatgtgcatacattatatgcaaatactgttttttttttttttaatttaaacagtctcactgtgttgcccaggatggagtgcaatggcacaatcttggctcatggcaaactctgcctcgcaagcagctgggactacaggcatgctccacggtgcccagttaattttttttgtattcttagtagagacagggtttcaccatgttggccaggctagtcttgaatttctgacctcaagtgattcatctcccaaagtgctgggattacaggcgtgagccaccacggccggctaatttttgtattttttagtagtgactggtttcgcggtgttgaccaggctggtctcgaactcctgatctcaggtgatctgcctgcctcggcctcacaaagtgctgggattacaggtgtgaaccactgctcccggccttgtgtgattttatctaagggacttaagcgtcctcaggtcctagggggtcgtgaaaccaaaaccccagggatagcaagggacaattgtatcttcaaagtagacaaatggcgccgggcacggtggctcacgcctgtaatcccagcagtttccgaggctgaggcaggcggctcacctgaggtcaggagttggagaccagcctggccaacatgctgaaaccctgtctgtacaaaaatacaaaaatagctgggcatggtggcgcatgcctgtagtcccagctactagagcgactgaggcaggagaattgcttgaacctgggaggcggaggttgcagggagccaagatggcgccaccgcactccagcctaggtgatagagtgagactccctctcaaaaacaaaacaaaacaaaaaaattagacaaatgctacattaatgtttgggtggtcagattctactttgaatctgaagtttgcagatatgcctatagatttttggagtttaccactttcttattctgtatcattaatgtaatattttaaattactatatatgttaccatttttctggatttagtaagaaatttgcagttttggtttgatgtaacaagggttttaatgtaatttatgttagattttgcatttttttcattactgttatattttaacctgactgactgatctaattgtattagtattgtgaataatcatgtgaaatgttttgagacagagtactatatttgtgaatataattttatggtttttttcacttagaacctttctgtgtggaaaactaagaaaattgctttctgctgtataatctggcattcattgtagattaaagcttatttttctgtgaataaaacgtattcaataaaatactattctttaaaattatatcata

SEQ ID NO: 200461 - DNA, 8415 bp, Homo sapiens
  Payload ID: 19553
  Gene Name: X-linked inhibitor of apoptosis, E3 ubiquitin protein ligase
  Uniprot ID: P98170
  ENST ID: ENST00000434753
  CDS Start-End: 127-1620
ttcttactgcccccatccggttcggggaggtggcgggaccttggcggcgcccggagccggcgtggcgctcatcgagggacgcccggcccaagtgaaaaggtggacaagtcctattttcaagagaagatgacttttaacagttttgaaggatctaaaacttgtgtacctgcagacatcaataaggaagaagaatttgtagaagagtttaatagattaaaaacttttgctaattttccaagtggtagtcctgtttcagcatcaacactggcacgagcagggtttctttatactggtgaaggagataccgtgcggtgctttagttgtcatgcagctgtagatagatggcaatatggagactcagcagttggaagacacaggaaagtatccccaaattgcagatttatcaacggcttttatcttgaaaatagtgccacgcagtctacaaattctggtatccagaatggtcagtacaaagttgaaaactatctgggaagcagagatcattttgccttagacaggccatctgagacacatgcagactatcttttgagaactgggcaggttgtagatatatcagacaccatatacccgaggaaccctgccatgtatagtgaagaagctagattaaagtcctttcagaactggccagactatgctcacctaaccccaagagagttagcaagtgctggactctactacacaggtattggtgaccaagtgcagtgcttttgttgtggtggaaaactgaaaaattgggaaccttgtgatcgtgcctggtcagaacacaggcgacactttcctaattgcttctttgttttgggccggaatcttaatattcgaagtgaatctgatgctgtgagttctgataggaatttcccaaattcaacaaatcttccaagaaatccatccatggcagattatgaagcacggatctttacttttgggacatggatatactcagttaacaaggagcagcttgcaagagctggattttatgctttaggtgaaggtgataaagtaaagtgctttcactgtggaggagggctaactgattggaagcccagtgaagacccttgggaacaacatgctaaatggtatccagggtgcaaatatctgttagaacagaagggacaagaatatataaacaatattcatttaactcattcacttgaggagtgtctggtaagaactactgagaaaacaccatcactaactagaagaattgatgataccatcttccaaaatcctatggtacaagaagctatacgaatggggttcagtttcaaggacattaagaaaataatggaggaaaaaattcagatatctgggagcaactataaatcacttgaggttctggttgcagatctagtgaatgctcagaaagacagtatgcaagatgagtcaagtcagacttcattacagaaagagattagtactgaagagcagctaaggcgcctgcaagaggagaagctttgcaaaatctgtatggatagaaatattgctatcgtttttgttccttgtggacatctagtcacttgtaaacaatgtgctgaagcagttgacaagtgtcccatgtgctacacagtcattactttcaagcaaaaaatttttatgtcttaatctaactctatagtaggcatgttatgttgttcttattaccctgattgaatgtgtgatgtgaactgactttaagtaatcaggattgaattccattagcatttgctaccaagtaggaaaaaaaatgtacatggcagtgttttagttggcaatataatctttgaatttcttgatttttcagggtattagctgtattatccattttttttactgttatttaattgaaaccatagactaagaataagaagcatcatactataactgaacacaatgtgtattcatagtatactgatttaatttctaagtgtaagtgaattaatcatctggattttttattcttttcagataggcttaacaaatggagctttctgtatataaatgtggagattagagttaatctccccaatcacataatttgttttgtgtgaaaaaggaataaattgttccatgctggtggaaagatagagattgtttttagaggttggttgttgtgttttaggattctgtccattttcttttaaagttataaacacgtacttgtgcgaattatttttttaaagtgatttgccatttttgaaagcgtatttaatgatagaatactatcgagccaacatgtactgacatggaaagatgtcaaagatatgttaagtgtaaaatgcaagtggcaaaacactatgtatagtctgagccagatcaaagtatgtatgtttttaatatgcatagaacaaaagatttggaaagatatacaccaaactgttaaatgtggtttctcttcggggagggggggattgggggaggggccccagaggggttttataggggccttttcactttctacttttttcattttgttctgttcgaattttttataagtatgtattacttttgtaatcagaatttttagaaagtattttgctgatttaaaggcttaggcatgttcaaacgcctgcaaaactacttatcactcagctttagtttttctaatccaagaaggcagggcagttaacctttttggtgccaatgtgaaatgtaaatgattttatgtttttcctgctttgtggatgaaaaatatttctgagtggtagttttttgacaggtagaccatgtcttatcttgtttcaaaataagtatttctgattttgtaaaatgaaatataaaatatgtctcagatcttccaattaattagtaaggattcatccttaatccttgctagtttaagcctgcctaagtcactttactaaaagatctttgttaactcagtattttaaacatctgtcagcttatgtaggtaaaagtagaagcatgtttgtacactgcttgtagttatagtgacagctttccatgttgagattctcatatcatcttgtatcttaaagtttcatgtgagtttttaccgttaggatgattaagatgtatataggacaaaatgttaagtctttcctctacctacatttgttttcttggctagtaatagtagtagatacttctgaaataaatgttctctcaagatccttaaaacctcttggaaattataaaaatattggcaagaaaagaagaatagttgtttaaatattttttaaaaaacacttgaataagaatcagtagggtataaactagaagtttaaaaatgcttcatagaacgtccagggtttacattacaagattctcacaacaaacctattgtagaggtgagtaaggcatgttactacagaggaaagtttgagagtaaaactgtaaaaaattatatttttgttgtactttctaagagaaagagtattgttatgttctcctaacttctgttgattactactttaagtgatattcatttaaaacattgcaaatttattttatttatttaattttctttttgagatggagtcttgcttgtcacccaggctggagtgcagtggagtgatctctgctcactgcaacctccgccttctgggttcaagcgattctcgtgcctcagcttcctgagtagctggaattacaggcaggtgccaccatgcccgactaatttttttttatttttagtagagacggggtttcaccatgttggccaggctggtatcaaactcctgacctcaagagatccactcgccttgccctcccaaagtgctgggattacaggcttgagccaccacgcccggctaaaacattgcaaatttaaatgagagttttaaaaattaaataatgactgccctgtttctgttttagtatgtaaatcctcagttcttcacctttgcactgtctgccacttagtttggttatatagtcattaacttgaatttggtctgtatagtctagactttaaatttaaagttttctacaaggggagaaaagtgttaaaatttttaaaatatgttttccaggacacttcacttccaagtcaggtaggtagttcaatctagttgttagccaaggactcaaggactgaattgttttaacataaggcttttcctgttctgggagccgcacttcattaaaattcttctaaaacttgtatgtttagagttaagcaagactttttttcttcctctccatgagttgtgaaatttaatgcacaacgctgatgtggctaacaagtttattttaagaattgtttagaaatgctgttgcttcaggttcttaaaatcactcagcactccaacttctaatcaaatttttggagacttaacagcatttgtctgtgtttgaactataaaaagcaccggatcttttccatctaattccgcaaaaattgatcatttgcaaagtcaaaactatagccatatccaaatcttttccccctcccaagagttctcagtgtctacatgtagactattccttttctgtataaagttcactctaggatttcaagtcaccacttattttacattttagtcatgcaaagattcaagtagttttgcaataagtacttatctttatttgtaataatttagtctgctgatcaaaagcattgtcttaatttttgagaactggttttagcatttacaaactaaattccagttaattaattaatagctttatattgcctttcctgctacatttggttttttcccctgtccctttgattacgggctaaggtagggtagagtgggtgtagtgagtgtatataatgtgatttggccctgtgtattatgatattttgttatttttgttgttatattatttacatttcagtagttgttttttgtgtttccattttagtggataaaatttgtattttgaactatgaatggagactaccgccccagcattagtttcacatgatataccctttaaacccgaatcattgttttatttcctgattacacaggtgttgaatggggaaaggggctagtatatcagtaggatatactatgggatgtatatatatcattgctgttagagaaatgaaataaaatggggctgggctcagtggctcacgcctgtaatcccagcactttgggaggctgaggcaggtggatcacgaggtcaggagatcgagaccatcctggctaacacggtgaaaccccgtctctactaaaaaacagaaaattagccgggcgtggtggcgggcgcctgtagtcccagctactcgggaggctgaggcaggagaatggtgtgaacccgggaggcagagcttgcagtgagccgagatctcgccactgcactccagcctgggcaacagagcaagactctgtctcaaaaaaaaaaaaaaaagaaataagaaaatgggaagcaatatttgacatagttctttttagtcaaatctacttgttaaaaaaagggtagcagtttattcatctgtgaaaggaaaataatacttatcttacaaggttgcaagagctcaaggagaccatgtatgtaaagttcctgctgtaaatatgaactcccatcctaatacccttttacctctctgtgggtttgtcttgacctggaaatttgggctaaaacttagaaaaaattcttacatgataactcagtgatgcttactcatagtttttggtgtttctcatagataagatataaatcagctgggcgcggtggctcatgcctgtaatcccagcactttgggaggccgaggcgggcagatcacctgaggtcgggaggtcgagaccagcctgaccaacatggagaaaccccgtctctactaaaaatacaaaattagctgggcgtggtggctcatgcctgtaatcccagctacttgggaggctgaggcaggagaatcgcttgaacccaggaggcggaggttgtggtgagcgaagatcgtgccattgcactccagcctgggcaacaagagcaaaactctgtctcaaaaaaaaaaaaagatataaatcacaataaataaataggtcaatacaaatgttagccaggcgtggtggcacatgcccatagtcgcagctactctggaggcagaggcaggaggatcacttgagcccatgaatttgaggcagcagtgagctatgattgtgccactgtactccagtctgggtgacagagtgagaccccatctctaaataaataggtcaaacccttaaaaatatttaaattcttaaaaaattgaaaagattattcttctcaaatttagttgagctttctaagagaagcaattggctttttcccacttcaataatcattttcagtttgactcatacagttaacacaatgtgaatttcttcctcagcataacagagttatagaatgacagggctggaagtgaccttagagagtatccagttctttcattttacaggtgaggcaactgagactcaaaggtgatgtaatttgtgcaaagattatagctaattagtagcagagccctgactgggacatagtttgaaggtgaaaaacttcaccaagctacctttcttgaaaggtccaaatgtttatgttttcaactactctttccactgtaccataactttcactacatattaaatgacactttataactaatataataggacaatcatcaatgcatatatagccagcccttcatatctgtgggttttgcatccatggattcaaccaaggaggaattgaaaacactgagaaaaaaaaaaaagaccacacaataaaaaaaaaaaatacaaaataatacaaagaaaaagccaaaattgtcatactgttgttaagcaacagtataacaactatttacatagcattaaggttggtgcaaaaatgcaaaaaaaaaaaaagcaattatttttaaaccaacctaatatattgtattaggtattaaagtcatctggacatgaattaaagtatatgatgccagcctggacaaaaggcaaaaccctgtctctacaaaaaatacaaaaattagctgggcatggtggtgtgtgcctgtagtcctggctactccggagcctgaggtgggaggatcgcttgagtctgggaggcagaggctgcattgagctatgatcatggcactgcattccagcctgggtgacagtgcaagaccttgtctcagaataaataaagtatgtgatgaagatgtgcatacattatatgcaaatactgttttttttttttttaatttaaacagtctcactgtgttgcccaggatggagtgcaatggcacaatcttggctcatggcaaactctgcctcgcaagcagctgggactacaggcatgctccacggtgcccagttaattttttttgtattcttagtagagacagggtttcaccatgttggccaggctagtcttgaatttctgacctcaagtgattcatctcccaaagtgctgggattacaggcgtgagccaccacggccggctaatttttgtattttttagtagtgactggtttcgcggtgttgaccaggctggtctcgaactcctgatctcaggtgatctgcctgcctcggcctcacaaagtgctgggattacaggtgtgaaccactgctcccggccttgtgtgattttatctaagggacttaagcgtcctcaggtcctagggggtcgtgaaaccaaaaccccagggatagcaagggacaattgtatcttcaaagtagacaaatggcgccgggcacggtggctcacgcctgtaatcccagcagtttccgaggctgaggcaggcggctcacctgaggtcaggagttggagaccagcctggccaacatgctgaaaccctgtctgtacaaaaatacaaaaatagctgggcatggtggcgcatgcctgtagtcccagctactagagcgactgaggcaggagaattgcttgaacctgggaggcggaggttgcagggagccaagatggcgccaccgcactccagcctaggtgatagagtgagactccctctcaaaaacaaaacaaaacaaaaaaattagacaaatgctacattaatgtttgggtggtcagattctactttgaatctgaagtttgcagatatgcctatagatttttggagtttaccactttcttattctgtatcattaatgtaatattttaaattactatatatgttaccatttttctggatttagtaagaaatttgcagttttggtttgatgtaacaagggttttaatgtaatttatgttagattttgcatttttttcattactgttatattttaacctgactgactgatctaattgtattagtattgtgaataatcatgtgaaatgttttgagacagagtactatatttgtgaatataattttatggtttttttcacttagaacctttctgtgtggaaaactaagaaaattgctttctgctgtataatctggcattcattgtagattaaagcttatttttctgtgaataaaacgtattcaataaaatactattctttaaaattatatc

SEQ ID NO: 200462 - DNA, 528 bp, Homo sapiens
  Payload ID: 19553
  Gene Name: X-linked inhibitor of apoptosis, E3 ubiquitin protein ligase
  ENST ID: ENST00000430625
  CDS Start-End: 61-528
gctcatcgagggacgcccggcccaagtgaaaaggtggacaagtcctattttcaagagaagatgacttttaacagttttgaaggatctaaaacttgtgtacctgcagacatcaataaggaagaagaatttgtagaagagtttaatagattaaaaacttttgctaattttccaagtggtagtcctgtttcagcatcaacactggcacgagcagggtttctttatactggtgaaggagataccgtgcggtgctttagttgtcatgcagctgtagatagatggcaatatggagactcagcagttggaagacacaggaaagtatccccaaattgcagatttatcaacggcttttatcttgaaaatagtgccacgcagtctacaaattctggtatccagaatggtcagtacaaagttgaaaactatctgggaagcagagatcattttgccttagacaggccatctgagacacatgcagactatcttttgagaactgggcaggttgtagatatatcagacaccatatacccgagg

SEQ ID NO: 200463 - DNA, 390 bp, Homo sapiens
  Payload ID: 19553
  Gene Name: X-linked inhibitor of apoptosis, E3 ubiquitin protein ligase
  ENST ID: ENST00000422098
  CDS Start-End: 342-390
atgtgcgcgcgctaggtcagcttctcggttccagccgggcgggggggtcgggtgggggtgggggtaggggttgcaagggcctcattttttcttactgcccccatccggttcggggaggtggcgggaccttggcggcgcccggagccggcgtggcgctcatcgagggacgcccggcccaagtggctggggccaagccgcagagcggagttggcatttccagattggggctcgggccgcgcctcctccgggaccctccccttggaccgagccgatcgccgcggggcagttcgggccggctgtcctggcgcgaaaaggtggacaagtcctattttcaagagaagatgacttttaacagttttgaaggatctaaaacttgtgtacctgcagaca

SEQ ID NO: 200464 - DNA, 5206 bp, Homo sapiens
  Payload ID: 19554
  Gene Name: X-linked Kx blood group
  Uniprot ID: P51811
  ENST ID: ENST00000378616
  CDS Start-End: 204-1538
ccaggtcggccgcccccaccaggtccagttccagagcccaggccggtcggccgggcccgcgtgccctcggcgggctgcgcagagcgcgggagcggtttggggctgggcatgctgggagcccctcgggcaacggccgccgccgccacagccacacagccgccgccactgcgtccgtccccggtgagcgccgctgacgcgcggagatgaaattcccggcctcggtgctggcgtccgtgttcctgttcgtggccgagacaacggcggcgctcagcctgagcagcacctaccgctcgggcggggaccgcatgtggcaggcgctgacgttgcttttctcgctactgccttgcgcgctcgtgcagctcacgcttctcttcgtacaccgcgacctcagccgcgaccgcccgctcgtactgctgctgcacctgctgcaacttgggccccttttcaggtgttttgaagtcttctgcatctactttcagtcaggcaacaatgaagagccttatgtcagtatcaccaagaagaggcaaatgccaaaaaatggcctctcagaggagattgagaaggaggtgggccaggcagaaggcaaactaatcacccaccgatcagcgttcagccgggcgtcggtgatccaggctttcttgggctcagccccccagctgaccctacagctgtacataagtgtcatgcagcaggacgtcactgttggaagaagtctcctcatgaccatatccctgttgtccattgtgtatggagccttgcgctgcaacatcctagccatcaaaatcaagtacgatgagtatgaagtcaaagtgaagcctctggcctatgtctgtatcttcctgtggaggagctttgagattgccactcgagttgtagtcctggtcctctttacctccgtcctgaagacctgggtggtggttataatactcatcaacttcttcagtttcttcttgtacccctggatcctcttctggtgcagtggttccccattccctgagaacatagagaaggccctcagtagagtgggcaccaccattgtactatgctttctaactttactctatactggtatcaacatgttctgctggtctgctgtacagctgaaaattgacagccctgacctcatcagcaagtcccataattggtaccagctactggtgtattacatgataagattcatcgagaatgccatcctcctcctcctgtggtatcttttcaagactgacatctatatgtatgtgtgcgcacctctgttggtcctgcagctgctcattgggtactgcacagccattctcttcatgcttgtattctatcagttcttccacccttgcaaaaagctcttttcttccagtgtttctgaaggctttcagaggtggctcaggtgtttttgctgggcctgcaggcagcaaaaaccctgtgagccgataggaaaggaagatctacagtcatccagagatagagatgagacaccttctagcagtaaaacaagtcctgagcctggtcagttcttgaatgctgaagatctctgctctgcttaatgggacccaaggtctcagagcacaggcatattattttctgggtttgatactcgttattcatacaaataatgagccctacacagggaacaaggcaggaagttagctgttaactccttgtgagctgcttctctttatagagctcttgggtatgtagaactgtatgggaagaagccaggaaaacctctgagtgttgaaggggcaacccaaggcatcacagttcacaggtaaccatgttgtgttcttctaggcattactggccttttcactgacaagttacccctgaaatctgagttgtactggttagattcattaggttgaatgaggagaggggcttacctgttctctagttttccagactgctggtttgggtaacctgaagttttatgatccctgaacatagttttcacccaagagctgtcctggtgaccaaaaaagattactagggttttgccatcagcaacatcattcctgtcagagctttcagggagggctgttcaagtttggtttttgaatagacagaggtttcattttcatctcattagggcttttttgtacatagccaactgtagccaccctggcatgctgtctctaattgattcaagggcctagatttggagactttgttccttagcatccatggatgcagaaatgagtgataaatttggccatgaaagccctggaattttaggaaagttgtgattctttgatatgttgatgaaattctggatcaggaggggtgttaaaacatcaaaatgatggcgacttgtataagtagaattcttaccatcttactcctgcctccccattccttgcctgtcaggaccattttagaagagttaccttggttaacttaagggttttttagaaaaccccacagaaatctctcacccagttcaggtgtatagggaattttcattttcattatttcaaggaatagagttttcctcactaccacttgtaattagagattgacttcagaaactttttctaaattataaagacggaatgaccagaaaatttttgtctttcatggaatgcaatttgacttggcataattgtgagttaatttgataaagatctccagttgtatcctctgacaccctttaatgttctatataatttttcctttaatcggagaccctatttgtttcattaaagaggattgggtagcatatcctcaattatcttggaaaaatgcgtagatctagtgccattatttctaccattaaaatcttgaaagcgaaatacttgaaaagaggtgaccataaagatcacaccaatttagaatgaatattaaagtctgagaaatttacaaaagggactctatggactcgattttaccatatggaatagggatccacttctctgttaacctacaaaacgtatttatctggccattgcacttcggataattttcatttttaattcctcttggtgtcaaatttttaagtaatttcatgcacacaggagaaaatgcaatttgataatcagtttccactacattcggaggtcaagaaagcagtatatattctttcacaaggcatccatactgtttaatatttatagagttcatagaaatacatcaataagctcctaaattatagagcctcaattttggtttttctcatttgaaatgtttttgatttatcaatatttgtggtttaactttgtgggggtgtccaggcagtagatcattttttgtctatttttaaccaaataagaataacactcaagactatgttctccatcccaacacatcacttaccacttgcactattcttaataggcctaaaatagtgagcatatataatcaaaataatacttcatacaacatatacttccatgcactcttcatgtaatcacatatgtgcatagatacacaatcgtattacataaaacacccttgaaaatatatgactttgaataaaataaagctaccatgttaatacatcattttttgtttcttcctaattaacaaaagggctctataatgattaggagagctgtaaggccattctttagtcattccaagtgtatatttgtatcacaccagttacttgtgttcattgacaccaaatattttcaagctttttgtgagaaagagattcttgccttgaggctctgcagtggcaaatggtaggggcaatagcgctcccttttcacctgaaatgccttcagctcaggccttgggagtgaggtgtgggagtagccaccagcctcccactgactaggcatgttaggaattagacaaggatggagagactggttttttccagccttggtttggaagcttgtctcaaaaaccattacaaaatcttaaccttcaaatacattctaaatcactttaatttagaagataggtgagcaacttgagtgatcccaaaccaaactaacagtgctggtttgtccgacacccaaagcccacttcacacatttataaggacagagatttggtaactcatttgggtattttgtcagttttaacccttaatatacaggtatcccagctttgggcacatgtatgtccattcactttcaggaaggggtgtcagtactttctttctgtgtggtgaaaacataagccatggtgaactgataatttttgtttttaaattatttatattactgaattggcaaaattacagttcacactgcagagctaggttgtcctattggcataaaacaaaccagcaacttttctcatgtgtttggagttaaaatgtgtttttcagttataatttcaatttttaaatttcttggtgctttgtctaattaattacatcccataacttgtcaggatagttgctccaactgaattgctatcatttggctggatgggggtgaagtatgtcttcaaaatatattgaagtaagttcatcaaacatgtttagacttcctctcattgctggagacagcccagtgtagagattggcacttccctgtccagcactacaacttaattgctctatgcctcagtttccccataatacccttttccaacctacctcacaaggttatcagaaagatcaaattaaataatagatgtgaaaatgctttgaaaatgtttttaagtgctatgcatatttatagagttattatagttattcaaatccataagcaggttatttttatttttttactgtttgaaaagaaataagtagtgtcattcatatgagttcctgagtggatatgcgaatctttggtcttctcgacaggtgccctttctcttaccactagttgcttacaaaaatagcacccaaacacatggcacttggaagaaaaagacccactgaatctgagaaagtactttctggtggcaaatgaatttatcattttagtatagttttcgataaaggatatagcaacatcttttgataattgtgctttacaacttgaatgctgattcaaggcattatttggatgtgagtttaatcttttcagccttgtaaatgggaaaatatatattaaaattgattgtcaaatacagcatttctttggaaaccaccttaaaacattagtgctatggttatgagtgtatgtgccagtacttaccagtcaatgcattgtggatatgagctttcgttgactgcttctctgcagtcgttgatgctaataaatattgtcctgtttcttcatataataaattaatttttcaatttctccttgta

SEQ ID NO: 200465 - DNA, 2667 bp, Homo sapiens
  Payload ID: 19555
  Gene Name: XPA binding protein 2
  Uniprot ID: Q9HCS7
  ENST ID: ENST00000358368
  CDS Start-End: 39-2606
agcgcgcgactctctcctgtacctgggcatccagaaaaatggtggtgatggcgcgactctcgcggcccgagcggccggaccttgtcttcgaggaagaggacctcccctatgaggaggaaatcatgcggaaccaattctctgtcaaatgctggcttcgctacatcgagttcaaacagggcgccccgaagcccaggctcaatcagctatacgagcgggcactcaagctgctgccctgcagctacaaactctggtaccgatacctgaaggcgcgtcgggcacaggtgaagcatcgctgtgtgaccgaccctgcctatgaagatgtcaacaactgtcatgagagggcctttgtgttcatgcacaagatgcctcgtctgtggctagattactgccagttcctcatggaccaggggcgcgtcacacacacccgccgcaccttcgaccgtgccctccgggcactgcccatcacgcagcactctcgaatttggcccctgtatctgcgcttcctgcgctcacacccactgcctgagacagctgtgcgaggctatcggcgcttcctcaagctgagtcctgagagtgcagaggagtacattgagtacctcaagtcaagtgaccggctggatgaggccgcccagcgcctggccaccgtggtgaacgacgagcgtttcgtgtctaaggccggcaagtccaactaccagctgtggcacgagctgtgcgacctcatctcccagaatccggacaaggtacagtccctcaatgtggacgccatcatccgcgggggcctcacccgcttcaccgaccagctgggcaagctctggtgttctctcgccgactactacatccgcagcggccatttcgagaaggctcgggacgtgtacgaggaggccatccggacagtgatgaccgtgcgggacttcacacaggtgtttgacagctacgcccagttcgaggagagcatgatcgctgcaaagatggagaccgcctcggagctggggcgcgaggaggaggatgatgtggacctggagctgcgcctggcccgcttcgagcagctcatcagccggcggcccctgctcctcaacagcgtcttgctgcgccaaaacccacaccacgtgcacgagtggcacaagcgtgtcgccctgcaccagggccgcccccgggagatcatcaacacctacacagaggctgtgcagacggtggaccccttcaaggccacaggcaagccccacactctgtgggtggcgtttgccaagttttatgaggacaacggacagctggacgatgcccgtgtcatcctggagaaggccaccaaggtgaacttcaagcaggtggatgacctggcaagcgtgtggtgtcagtgcggagagctggagctccgacacgagaactacgatgaggccttgcggctgctgcgaaaggccacggcgctgcctgcccgccgggccgagtactttgatggttcagagcccgtgcagaaccgcgtgtacaagtcactgaaggtctggtccatgctcgccgacctggaggagagcctcggcaccttccagtccaccaaggccgtgtacgaccgcatcctggacctgcgtatcgcaacaccccagatcgtcatcaactatgccatgttcctggaggagcacaagtacttcgaggagagcttcaaggcgtacgagcgcggcatctcgctgttcaagtggcccaacgtgtccgacatctggagcacctacctgaccaaattcattgcccgctatgggggccgcaagctggagcgggcacgggacctgtttgaacaggctctggacggctgccccccaaaatatgccaagaccttgtacctgctgtacgcacagctggaggaggagtggggcctggcccggcatgccatggccgtgtacgagcgtgccaccagggccgtggagcccgcccagcagtatgacatgttcaacatctacatcaagcgggcggccgagatctatggggtcacccacacccgcggcatctaccagaaggccattgaggtgctgtcggacgagcacgcgcgtgagatgtgcctgcggtttgcagacatggagtgcaagctcggggagattgaccgcgcccgggccatctacagcttctgctcccagatctgtgacccccggacgaccggcgcgttctggcagacgtggaaggactttgaggtccggcatggcaatgaggacaccatcaaggaaatgctgcgtatccggcgcagcgtgcaggccacgtacaacacgcaggtcaacttcatggcctcgcagatgctcaaggtctcgggcagtgccacgggcaccgtgtctgacctggcccctgggcagagtggcatggacgacatgaagctgctggaacagcgggcagagcagctggcggctgaggcggagcgtgaccagcccttgcgcgcccagagcaagatcctgttcgtgaggagtgacgcctcccgggaggagctggcagagctggcacagcaggtcaaccccgaggagatccagctgggcgaggacgaggacgaggacgagatggacctggagcccaacgaggttcggctggagcagcagagcgtgccagccgcagtgtttgggagcctgaaggaagactgacccgtccctcccccatcccccctccccaccccctccccaatacagctacgtttgtacatca

SEQ ID NO: 200466 - DNA, 2467 bp, Homo sapiens
  Payload ID: 19556
  Gene Name: X-prolyl aminopeptidase (aminopeptidase P) 1, soluble
  Uniprot ID: Q9NQW7
  ENST ID: ENST00000322238
  CDS Start-End: 121-2049
gacccggcgctagcccgcccgcccgcccgccggctctcgcgcctccttcgcgccggcccttccgcgggtgatcagctggtctgcgctcccctgacgtgggctggggcacgtcaccgccgaatggcagcctccagaaagccaccgcgagtaagggtgaatcaccaggattttcaactgagaaatttaagaataattgaacctaacgaggtgacacactcaggagacacaggtgtggaaacagacggcagaatgcctccaaaggtgacttcagagctgcttcggcagctgagacaagccatgaggaactctgagtatgtgaccgaaccgatccaggcctacatcatcccatcgggagatgctcatcagagtgagtatattgctccatgtgactgtcggcgggcttttgtctctggattcgatggctctgcgggcacagccatcatcacagaagagcatgcagccatgtggactgacgggcgctactttctccaggctgccaagcaaatggacagcaactggacacttatgaagatgggtctgaaggacacaccaactcaggaagactggctggtgagtgtgcttcctgaaggatccagggttggtgtggaccccttgatcattcctacagattattggaagaaaatggccaaagttctgagaagtgccggccatcacctcattcctgtcaaggagaacctcgttgacaaaatctggacagaccgtcctgagcgcccttgcaagcctctcctcacactgggcctggattacacaggcatctcctggaaggacaaggttgcagaccttcggttgaaaatggctgagaggaacgtcatgtggtttgtggtcactgccttggatgagattgcgtggctatttaatctccgaggatcagatgtggagcacaatccagtatttttctcctacgcaatcataggactagagacgatcatgctcttcattgatggtgaccgcatagacgcccccagtgtgaaggagcacctgcttcttgacttgggtctggaagccgaatacaggatccaggtgcatccctacaagtccatcctgagcgagctcaaggccctgtgtgctgacctctccccaagggagaaggtgtgggtcagtgacaaggccagctatgctgtgagcgagaccatccccaaggaccaccgctgctgtatgccttacacccccatctgcatcgccaaagctgtgaagaattcagctgagtcagaaggcatgaggcgggctcacattaaagatgctgttgctctctgtgaactctttaactggctggagaaagaggttcccaaaggtggtgtgacagagatctcagctgctgacaaagctgaggagtttcgcaggcaacaggcagactttgtggacctgagcttcccaacaatttccagtacgggacccaacggcgccatcattcactacgcggatggcaccacagatgtgacgcggacaatgcattttgggacccctacagcctacgagaaggaatgcttcacatatgtcctcaagggccacatagctgtgagtgcagccgttttcccgactggaaccaaaggtcaccttcttgactcctttgcccgttcagctttatgggattcaggcctagattacttgcacgggactggacatggtgttgggtcttttttgaatgtccatgagggtccttgcggcatcagttacaaaacattctctgatgagcccttggaggcaggcatgattgtcactgatgagcccgggtactatgaagatggggcttttggaattcgcattgagaatgttgtccttgtggttcctgtgaagaccaagtataattttaataaccggggaagcctgacctttgaacctctaacattggttccaattcagaccaaaatgatagatgtggattctcttacagacaaagagtgcgactggctcaacaattaccacctgacctgcagggatgtgattgggaaggaattgcagaaacagggccgccaggaagctctcgagtggctcatcagagagacgcaacccatctccaaacagcattaataaatacctccccggttttgtttttgtaaaatgctctggaggaaggaagaaacgtggcagatccctgacatctttcccctttcctttccttcttccctacctcccctttttactttagactttaagaagaacagaaaatcttcttatcctctttgatattttattgcaaacactcagtcttttatgattttttaattgttgagaacaagccaagaataaaattgctgcaccagaaggagggtccctccaaagttgaacacttggtgaaaggaagatgccccgacttctttggccagtgatggggaatcagtgagtgctccatgatggtcatgttccaggtgctagtacatcattcatgatcaccttaatgctcatgagactatatttatgatcagtgaataaaaatgtcagaactgtg

SEQ ID NO: 200467 - DNA, 2344 bp, Homo sapiens
  Payload ID: 19556
  Gene Name: X-prolyl aminopeptidase (aminopeptidase P) 1, soluble
  ENST ID: ENST00000369683
  CDS Start-End: 268-1926
ctccttcgcgccggcccttccgcgggtgatcagctggtctgcgctcccctgacgtgggctggggcacgtcaccgccgaatggcagcctccagaaagccaccgcgagtaagacggcagaatgcctccaaaggtgacttcagagctgcttcggcagctgagacaagccatgaggaactctgagtatgtgaccgaaccgatccaggcctacatcatcccatcgggagatgctcatcaggcacagccatcatcacagaagagcatgcagccatgtggactgacgggcgctactttctccaggctgccaagcaaatggacagcaactggacacttatgaagatgggtctgaaggacacaccaactcaggaagactggctggtgagtgtgcttcctgaaggatccagggttggtgtggaccccttgatcattcctacagattattggaagaaaatggccaaagttctgagaagtgccggccatcacctcattcctgtcaaggagaacctcgttgacaaaatctggacagaccgtcctgagcgcccttgcaagcctctcctcacactgggcctggattacacaggcatctcctggaaggacaaggttgcagaccttcggttgaaaatggctgagaggaacgtcatgtggtttgtggtcactgccttggatgagattgcgtggctatttaatctccgaggatcagatgtggagcacaatccagtatttttctcctacgcaatcataggactagagacgatcatgctcttcattgatggtgaccgcatagacgcccccagtgtgaaggagcacctgcttcttgacttgggtctggaagccgaatacaggatccaggtgcatccctacaagtccatcctgagcgagctcaaggccctgtgtgctgacctctccccaagggagaaggtgtgggtcagtgacaaggccagctatgctgtgagcgagaccatccccaaggaccaccgctgctgtatgccttacacccccatctgcatcgccaaagctgtgaagaattcagctgagtcagaaggcatgaggcgggctcacattaaagatgctgttgctctctgtgaactctttaactggctggagaaagaggttcccaaaggtggtgtgacagagatctcagctgctgacaaagctgaggagtttcgcaggcaacaggcagactttgtggacctgagcttcccaacaatttccagtacgggacccaacggcgccatcattcactacgcgccagtccctgagacgaataggaccttgtccctggatgaggtgtaccttattgactcgggtgctcaatacaaggatggcaccacagatgtgacgcggacaatgcattttgggacccctacagcctacgagaaggaatgcttcacatatgtcctcaagggccacatagctgtgagtgcagccgttttcccgactggaaccaaaggtcaccttcttgactcctttgcccgttcagctttatgggattcaggcctagattacttgcacgggactggacatggtgttgggtcttttttgaatgtccatgagggtccttgcggcatcagttacaaaacattctctgatgagcccttggaggcaggcatgattgtcactgatgagcccgggtactatgaagatggggcttttggaattcgcattgagaatgttgtccttgtggttcctgtgaagaccaagtataattttaataaccggggaagcctgacctttgaacctctaacattggttccaattcagaccaaaatgatagatgtggattctcttacagacaaagagtgcgactggctcaacaattaccacctgacctgcagggatgtgattgggaaggaattgcagaaacagggccgccaggaagctctcgagtggctcatcagagagacgcaacccatctccaaacagcattaataaatacctccccggttttgtttttgtaaaatgctctggaggaaggaagaaacgtggcagatccctgacatctttcccctttcctttccttcttccctacctcccctttttactttagactttaagaagaacagaaaatcttcttatcctctttgatattttattgcaaacactcagtcttttatgattttttaattgttgagaacaagccaagaataaaattgctgcaccagaaggagggtccctccaaagttgaacacttggtgaaaggaagatgccccgacttctttggccagtgatggggaatcagtgagtgctccatgatggtcatgttccaggtgctagtacatcattcatgatcaccttaatgctcatgagactatatttatgatcagtgaataaaaatgtcagaactgtg

SEQ ID NO: 200468 - DNA, 1006 bp, Homo sapiens
  Payload ID: 19556
  Gene Name: X-prolyl aminopeptidase (aminopeptidase P) 1, soluble
  ENST ID: ENST00000403138
  CDS Start-End: 98-1006
gcgggtgatcagctggtctgcgctcccctgacgtgggctggggcacgtcaccgccgaatggcagcctccagaaagccaccgcgagtaagacggcagaatgcctccaaaggtgacttcagagctgcttcggcagctgagacaagccatgaggaactctgagtatgtgaccgaaccgatccaggcctacatcatcccatcgggagatgctcatcagagtgagtatattgctccatgtgactgtcggcgggcttttgtctctggattcgatggctctgcgggcacagccatcatcacagaagagcatgcagccatgtggactgacgggcgctactttctccaggctgccaagcaaatggacagcaactggacacttatgaagatgggtctgaaggacacaccaactcaggaagactggctggtgagtgtgcttcctgaaggatccagggttggtgtggaccccttgatcattcctacagattattggaagaaaatggccaaagttctgagaagtgccggccatcacctcattcctgtcaaggagaacctcgttgacaaaatctggacagaccgtcctgagcgcccttgcaagcctctcctcacactgggcctggattacacaggcatctcctggaaggacaaggttgcagaccttcggttgaaaatggctgagaggaacgtcatgtggtttgtggtcactgccttggatgagattgcgtggctatttaatctccgaggatcagatgtggagcacaatccagtatttttctcctacgcaatcataggactagagacgatcatgctcttcattgatggtgaccgcatagacgcccccagtgtgaaggagcacctgcttcttgacttgggtctggaagccgaatacaggatccaggtgcatccctacaagtccatcctgagcgagctcaaggccctgtgtgctgacctctccccaagggagaaggtgtgggtcagtgacaaggccagctatgctgtgagcgagaccatcccc

SEQ ID NO: 200469 - DNA, 712 bp, Homo sapiens
  Payload ID: 19556
  Gene Name: X-prolyl aminopeptidase (aminopeptidase P) 1, soluble
  ENST ID: ENST00000423625
  CDS Start-End: 13-712
gcagacggcagaatgcctccaaaggtgacttcagagctgcttcggcagctgagacaagccatgaggaactctgagtatgtgaccgaaccgatccaggcctacatcatcccatcgggagatgctcatcagagtgagtatattgctccatgtgactgtcggcgggcttttgtctctggattcgatggctctgcgggcacagccatcatcacagaagagcatgcagccatgtggactgacgggcgctactttctccaggctgccaagcaaatggacagcaactggacacttatgaagatgggtctgaaggacacaccaactcaggaagactggctggtgagtgtgcttcctgaaggatccagggttggtgtggaccccttgatcattcctacagattattggaagaaaatggccaaagttctgagaagtgccggccatcacctcattcctgtcaaggagaacctcgttgacaaaatctggacagaccgtcctgagcgcccttgcaagcctctcctcacactgggcctggattacacagggctatttaatctccgaggatcagatgtggagcacaatccagtatttttctcctacgcaatcataggactagagacgatcatgctcttcattgatggtgaccgcatagacgcccccagtgtgaaggagcacctgcttcttgacttgggtctggaagccgaatacaggatccaggtgc

SEQ ID NO: 200470 - DNA, 2539 bp, Homo sapiens
  Payload ID: 19556
  Gene Name: X-prolyl aminopeptidase (aminopeptidase P) 1, soluble
  Uniprot ID: Q9NQW7
  ENST ID: ENST00000502935
  CDS Start-End: 121-2121
gacccggcgctagcccgcccgcccgcccgccggctctcgcgcctccttcgcgccggcccttccgcgggtgatcagctggtctgcgctcccctgacgtgggctggggcacgtcaccgccgaatggcagcctccagaaagccaccgcgagtaagggtgaatcaccaggattttcaactgagaaatttaagaataattgaacctaacgaggtgacacactcaggagacacaggtgtggaaacagacggcagaatgcctccaaaggtgacttcagagctgcttcggcagctgagacaagccatgaggaactctgagtatgtgaccgaaccgatccaggcctacatcatcccatcgggagatgctcatcagagtgagtatattgctccatgtgactgtcggcgggcttttgtctctggattcgatggctctgcgggcacagccatcatcacagaagagcatgcagccatgtggactgacgggcgctactttctccaggctgccaagcaaatggacagcaactggacacttatgaagatgggtctgaaggacacaccaactcaggaagactggctggtgagtgtgcttcctgaaggatccagggttggtgtggaccccttgatcattcctacagattattggaagaaaatggccaaagttctgagaagtgccggccatcacctcattcctgtcaaggagaacctcgttgacaaaatctggacagaccgtcctgagcgcccttgcaagcctctcctcacactgggcctggattacacaggcatctcctggaaggacaaggttgcagaccttcggttgaaaatggctgagaggaacgtcatgtggtttgtggtcactgccttggatgagattgcgtggctatttaatctccgaggatcagatgtggagcacaatccagtatttttctcctacgcaatcataggactagagacgatcatgctcttcattgatggtgaccgcatagacgcccccagtgtgaaggagcacctgcttcttgacttgggtctggaagccgaatacaggatccaggtgcatccctacaagtccatcctgagcgagctcaaggccctgtgtgctgacctctccccaagggagaaggtgtgggtcagtgacaaggccagctatgctgtgagcgagaccatccccaaggaccaccgctgctgtatgccttacacccccatctgcatcgccaaagctgtgaagaattcagctgagtcagaaggcatgaggcgggctcacattaaagatgctgttgctctctgtgaactctttaactggctggagaaagaggttcccaaaggtggtgtgacagagatctcagctgctgacaaagctgaggagtttcgcaggcaacaggcagactttgtggacctgagcttcccaacaatttccagtacgggacccaacggcgccatcattcactacgcgccagtccctgagacgaataggaccttgtccctggatgaggtgtaccttattgactcgggtgctcaatacaaggatggcaccacagatgtgacgcggacaatgcattttgggacccctacagcctacgagaaggaatgcttcacatatgtcctcaagggccacatagctgtgagtgcagccgttttcccgactggaaccaaaggtcaccttcttgactcctttgcccgttcagctttatgggattcaggcctagattacttgcacgggactggacatggtgttgggtcttttttgaatgtccatgagggtccttgcggcatcagttacaaaacattctctgatgagcccttggaggcaggcatgattgtcactgatgagcccgggtactatgaagatggggcttttggaattcgcattgagaatgttgtccttgtggttcctgtgaagaccaagtataattttaataaccggggaagcctgacctttgaacctctaacattggttccaattcagaccaaaatgatagatgtggattctcttacagacaaagagtgcgactggctcaacaattaccacctgacctgcagggatgtgattgggaaggaattgcagaaacagggccgccaggaagctctcgagtggctcatcagagagacgcaacccatctccaaacagcattaataaatacctccccggttttgtttttgtaaaatgctctggaggaaggaagaaacgtggcagatccctgacatctttcccctttcctttccttcttccctacctcccctttttactttagactttaagaagaacagaaaatcttcttatcctctttgatattttattgcaaacactcagtcttttatgattttttaattgttgagaacaagccaagaataaaattgctgcaccagaaggagggtccctccaaagttgaacacttggtgaaaggaagatgccccgacttctttggccagtgatggggaatcagtgagtgctccatgatggtcatgttccaggtgctagtacatcattcatgatcaccttaatgctcatgagactatatttatgatcagtgaataaaaatgtcagaactgtg

SEQ ID NO: 200471 - DNA, 912 bp, Homo sapiens
  Payload ID: 19557
  Gene Name: X-prolyl aminopeptidase (aminopeptidase P) 2, membrane-bound
  ENST ID: ENST00000371105
  CDS Start-End: 241-792
cttgcacagtccgcctcgggcagcccaaagctcctctgcccaccctggctcccagagccctccaaaacaaaagaccagagaagcactctccacccagcagccagacgcctccttcttgacgccagcccccaccctctgtctgctcgagcccaggaaaggcctgaaggaagaggccggggaaagagccctccctctctcccttgtccctccatccacccagcgccggcatctggagaccctatggcccgggctcactggggctgctgcccctggctggtcctcctctgtgcttgtgcctggggccacacaaagccagtggaccttggagggcaggatgtgagaaactgttccaccaaccccccttaccttccagttactgtggtcaataccacaatgtcactcacagccctccgccagcagatgcagacccagaatctctcagcctacatcatcccaggcacagatgctcacatgaacgagtacatcggccaacatgacgagaggcgtgcgtggattacaggctttacagggtctgcaggaactgcagtggtgactatgaagaaagcagctgtctggaccgacagtcgctactggactcaggctgagcggcagatggactgcaactgggagctccataaggaagttggcaccactcctattgtcacctggctcctcaccgagattcctgctggagggcgtgtgggttttgaccccttcctcttgtccattggtatgctcttccttcagtccctgaatttgtccatgctaacgagggtgactcagcttccctaggatataaagaaatggaccttggtagaaggaggggcggtgggactataaagatagagcatttgaaattgtagttgcagaatgttttgcaatgaggatgtattcatggattgtgtaattaaa

SEQ ID NO: 200472 - DNA, 3270 bp, Homo sapiens
  Payload ID: 19557
  Gene Name: X-prolyl aminopeptidase (aminopeptidase P) 2, membrane-bound
  Uniprot ID: O43895
  ENST ID: ENST00000371106
  CDS Start-End: 193-2217
ctcccagagccctccaaaacaaaagaccagagaagcactctccacccagcagccagacgcctccttcttgacgccagcccccaccctctgtctgctcgagcccaggaaaggcctgaaggaagaggccggggaaagagccctccctctctcccttgtccctccatccacccagcgccggcatctggagaccctatggcccgggctcactggggctgctgcccctggctggtcctcctctgtgcttgtgcctggggccacacaaagccagtggaccttggagggcaggatgtgagaaactgttccaccaaccccccttaccttccagttactgtggtcaataccacaatgtcactcacagccctccgccagcagatgcagacccagaatctctcagcctacatcatcccaggcacagatgctcacatgaacgagtacatcggccaacatgacgagaggcgtgcgtggattacaggctttacagggtctgcaggaactgcagtggtgactatgaagaaagcagctgtctggaccgacagtcgctactggactcaggctgagcggcagatggactgcaactgggagctccataaggaagttggcaccactcctattgtcacctggctcctcaccgagattcctgctggagggcgtgtgggttttgaccccttcctcttgtccattgacacctgggagagttatgatctggccctccaaggctctaacagacagctggtgtccatcacaaccaatcttgtggacctggtatggggatcagagaggccaccggttccaaatcaacccatttatgccctgcaggaggcattcacagggagcacttggcaggagaaagtatctggcgtccgaagccagatgcagaagcatcaaaaggtcccgactgccgtccttctgtcggcgcttgaggagacggcctggctcttcaaccttcgagccagtgacatcccctataaccccttcttctattcctacacgctgctcacagactcttctattaggttgtttgcaaacaagagtcgctttagctccgaaaccttgagctatctgaactccagttgcacaggccccatgtgtgtgcaaatcgaggattacagccaagttcgtgacagcatccaggcctactcattgggagatgtgaggatctggattgggaccagctataccatgtatgggatctatgaaatgatacccaaggagaaactcgtgacagacacctactccccagtgatgatgaccaaggcagtgaagaacagcaaggagcaggccctcctcaaggccagccacgtgcgggacgctgtggctgtgatccggtacttggtctggctggagaagaacgtgcccaaaggcacagtggatgagttctcgggggcagagatcgtggacaagttccgaggagaagaacagttctcctccggacccagttttgaaaccatctctgctagtggtctgaatgctgccctggcccactacagcccgaccaaggagctgaaccgcaagctgtcctcagatgagatgtacctgctggactctggggggcagtactgggacgggaccacagacatcaccagaacagtccactggggcaccccctctgccttccagaaggaggcatacacccgtgtgctgataggaaatattgacctgtccaggctcatctttcccgctgctacatcagggcgaatggtggaggcctttgcccgcagagccttgtgggatgctggtctcaattatggtcatgggacaggccacggcattggcaacttcctgtgtgtgcatgagtggccagtgggattccagtccaacaacatcgctatggccaagggcatgttcacttccattgaacctggttactataaggatggagaatttgggatccgtctcgaagatgtggctctcgtggtagaagcaaagaccaagtacccagggagctacctgacctttgaagtggtatcatttgtgccctatgaccggaacctcatcgatgtcagcctgctgtctcccgagcatctccagtacctgaatcgctactaccagaccatccgggagaaggtgggtccagagctgcagaggcgccagctactagaggagttcgagtggcttcaacagcacacagagcccctggccgccagggccccagacaccgcctcctgggcctctgtgttagtggtctccacccttgccatccttggctggagtgtctagaggctccagactctcctgttaaccctccatctagatggggggctcccttgcttagctcccctcaccctgcactgaacataccccaagagcccctgctggcccattgcctagaaacctttgcattcatcctccttctccaagacctatggagaaggtcccaggccccaggaacacagggcttcttggccccagatggcacctccctgcaccccggggttgtataccacaccctgggcccctaatcccaggccccgagataggaaagccagctagtctcttctcttctgtgatctcagtaggcctaacctataacctagcacagactgctacagctgctcccctcccgccaaacaaaaccccaagagagcaatgcccctaccacccaagggtgccatggtcccgggagagcccaaacctatcaccacctgttgggcatagccagagctgttcccacccagccagggcatgaaacatcaaccccccacatgtgaacccatcattcctaaaccctgggtaggctccatgccaagtaacagcagagggagttaagccataggaatttggctgtggagtaagagggaatgcggtgaggcactctggaatatgaccctaccagaggttggagaacaaacttgggcagccggaacccgtcactattctagacttccctggcattcgaggagccctttgaactttccaaagtgcagccacagctacaatgctgttaaatcctcccacattcttggatgccccttcaccttgtgtggacagtgtctggtttctccattttacagacaggaaaactgagcttcagacagggggtgggctttgcctaaggacacacaaatttggttgggagttgatggggccagatgagccagcattccagctctttcacccttcagcaacatgcagagtccctgagcccacctcccagccctctcctcattctctgaacccactgtggtgagaagaatttgctccggccaaattggccgttagccacctgggtccacatcctgctaagacgtttaaaacagcctaacaaagaca

SEQ ID NO: 200473 - DNA, 7988 bp, Homo sapiens
  Payload ID: 19558
  Gene Name: X-prolyl aminopeptidase 3, mitochondrial
  Uniprot ID: Q9NQH7
  ENST ID: ENST00000357137
  CDS Start-End: 85-1608
ggtttcctggcgacgcggccctgcaggcggttgcgttccccgtcgttaccctctttctcttcccgacgcgtgagttaggccgtaatgccttggctgctctcagcccccaagctggttcccgctgtagcaaacgtccgcggcctctcaggatgtatgttgtgttcacagcgaaggtactcccttcagcctgtcccagaaaggaggattccaaaccgatacttaggccagcccagcccctttacacacccacacctcctcagaccaggggaggtaactccaggactatctcaggtggaatatgcacttcgcagacacaaactaatgtctctgatccagaaggaagctcaagggcagagtgggacagaccagacagtggttgtgctctccaaccctacatactacatgagcaacgatattccctatactttccaccaagacaacaatttcctgtacctatgtggattccaagagcctgatagcattcttgtccttcagagcctccctggcaaacaattaccatcacacaaagccatactttttgtgcctcggcgagatcccagtcgagaactttgggatggtccgcgatctggcactgatggagcaatagctctaactggagtagacgaagcctatacgctagaagaatttcaacatcttctaccaaaaatgaaagctgagacgaacatggtttggtatgactggatgaggccctcacatgcacagcttcactctgactatatgcagcccctgactgaggccaaagccaagagcaagaacaaggttcggggtgttcagcagctgatacagcgcctccggctgatcaagtctcctgcagaaattgaacgaatgcagattgctgggaagctgacatcacaggctttcatagaaaccatgttcaccagtaaagcccctgtggaagaagcctttctttatgctaagtttgaatttgaatgccgggctcgtggcgcagacattttagcctatccacctgtggtggctggtggtaatcggtcaaacactttgcactatgtgaaaaataatcaactcatcaaggatggggaaatggtgcttctggatggaggttgtgagtcttcctgctatgtgagtgacatcacacgtacgtggccagtcaatggcaggttcaccgcacctcaggcagaactctatgaagccgttctagagatccaaagagattgtttggccctctgcttccctgggacaagcttggagaacatctacagcatgatgctgaccctgataggacagaagcttaaagacttggggatcatgaagaacattaaggaaaataatgccttcaaggctgctcgaaaatactgtcctcatcatgttggccactacctcgggatggatgtccatgacactccagacatgccccgttccctccctctgcagcctgggatggtaatcacaattgagcccggcatttatattccagaggatgacaaagatgccccagagaagtttcggggtcttggtgtacgaattgaggatgatgtagtggtgactcaggactcacctctcatcctttctgcagactgtcccaaagagatgaatgacattgaacagatatgcagccaggcttcttgaccttcactgcggcccacatgcacctcaggttcaaaatgggtgtcttctggcagccctgcacgtgtgctttctgagtgtctctgtgtgtgcattaatatatgcattccatttgggagcatagcagctgtgtgaatgtatgtaattgtgtgtggggggttttttgttttaagtagttagaagtctgggaaaatgaatttttgaatagtatgttactgcagctttggtaacattaattctatagaattaatgatcagagcaagtttaatttttaaacataaaggtcttggttacacatgtccatgcattccagttaacacatttaaacatatagaaaattcacttcttctttcaagtccttccctttctatacttttgctgagatcaacccaatatcataagaagtttgtgtgatgcctgtatttttagctaattaccaaggtctctgcctatgcaaaaattcatctttcggtgattgtgggcggccaatacataccttctgtaactcctccctacctattctagatcctgcatatctactggagccatatgagccctcaggggcactggtgtcctgcagtcttactagtcagccacagtccaggttccagcaacactagctacctaccaaacaaaacacttctgagcttttcttgccatttggttgcctgggacctggaaagtgtttagattcttgataaagatggaaatggaagagaaagaaaattatatatgtatatactaaagatccagacatcagggctgggcacagcggttccgcctgtaatcccagcactttgggaggtccaggcaggtggatctcttgagaccaggaggtcaagaccagcctggccaacgtggtgaaacactgtctctactaaaaatacaaaaatgagctgggtgtgatgatacatgcctgtaatcctggctacttgggaggctgaggcatgagaattgcttgaacctgggaggtggaggttgcagtgagctgagctcatgcgactgcactccagcctgggtgactgagcaagactctgcctcaaaaaaacaaataaataaataaaatcctgacatcctgccatcttttctcttcaatttaaagttgatttcttaatgatgacttcaaaaattaataaaaagaaaagaaaaaaatgatttctggccgggcgtggtggctcaagcctgtaatcccagcactttgggaggccgaggtgggcggatcacgaggtcaggagattgagacctcctggctaacacggtgaaaccccgtctttactaaaaatacaaaaaaaattagctgggcgtggtggcggatgcctgtagtcccagctactcaggaggctgaggcaggagaatggcgtgaacccagaaggcagagcttgcagtgagccaagatcgcgccactgcactccagcctgggtgacagagcgagactccgtctcaaaaaaaaaaaaaaaaaagaaaaaaaaaagaaagatttctttcgcagatatccctgctccctctatagattcttaatgcactgaccctcacaggttacccttttagctgttgtgctgcgcaggagcagatcctctacttacgtaccctgtcagagtcacagtagtagcgcccagttttcagagaagtacccctgttatcattctgtgatttcctctagtgctaatagaaacaaaatatggaatctaccaagtacccgtaaatatcctatgattcttatctttctttgatactagcactgggagtgcagtggtaaagagtcatacttcttttttttttttttttttggagacagagtctcgctctgtcgcctgggctggatggagtgcagtggcgtaatctcagctcactacaacctccaccacctgggttcaggcaattctcctgcctcagcctcccaagtaactgggactacaggtgcacgctgccatgcccagctaattttttgtattttagtagagacagggtttcaccctgttgcccaggccggtctcaaactcctgagctccggcaatccgcccacctcagcctcccaaagtgctaggattacaggcatgagccactgcgcccggtgtaagagtcatatttttttaaacacaaacattggatacaattatacagcaactcagtttgcaagatgaacagggctagattaccacagatagcttatttaggagcgtctgtgatagagggaagctttaagaaccagtgtgttcacctcctttaaacctggatatgaggtcaagatgtataaaacatgccaattgttagaacacaaatttgagggtttcttaaaaaaacaatttgtattagggaagcacaagctaggggattaacaatctctgtaatgctggaagtttgcctatcttatcagggaaacccagggtacagagtgaaaagcagacaggcagtgacttcctcaagagacagataatgtgaaaacaaaagtgatacaaatcatatcctgacagtgctagcctaggaatgcctggctttgcgcaccttatctaagcagctctcagaatggaggctgcacagctggagtctccatcccccatacccaccttcccacctccctccaatttctcaatccagagctttttaaaaaaaggggagggaaataactccacagctctggctgctcacttcccaggctctgtgcccccaacagccctttccttggattgtgtttcctttgttcatttgtaatccaggaataaggaatttccttttcttcttgtatcattttcttttcttttctttttttttttttttttgagacggagtctcacactgtcaccggggctggtgtgcaatagcgagacctcagctccctgcaacctccatctcccaggttcaagcgattctcctgcctcagcctcccgaatagctaggaatacaggcgcctgccaccacacccggctatttttttgtattttaaatagagacgaggtttcactgtgttggccaggctggtctcgaactcctgacctcatgatctgcccgcctcggcctccctaagtgctgcgattacagacgtgagccaccgcacctcctgtatcattttctatggtctaaacttttctagctaaaagcctaggtagcttgtatgtatagcagcatacttggacatgaaacacacttctggttagattccagtcaagttctataggtgttattggtaggcagaaaggctgttgtagaattcttctggtgattttcagtccctgacccaggtatattgtcctttgagtcccagattaactaactatagcagctaagcatttgaatcagacttctcatagcaatgttatgggctgtctgatatattcaggatttgttgagcagataagctgtgtgtgatcttactcattctcagccatgccgcagacatacccatttccctttagtaattttttaatacagagaatgctattaactgttactggatatcaaataattttatttttctaatagtattttccaaatatttcttaaaattcttaaaatttaggttaaagtttgctggtctcttacatttaataaagctgggacttgaagacttaccatagttttcaactgcctttgcaagttcataaacttctaagggtaaaaagtgaataagataaattcagagttttaaggtaaaggctttatattagctttttttttttttaaaggttttttgtggggtttttttgttttttttttttttgagatggagtctcgctctgtcacccaggctggagtgcagtggcacgatcttggctcactgcaacctccatctcccgggttcaggcaattcttctgcctcagcctcctgagtagctgggactacaggcgcgtgccaccatgcccggctagtttattgtatttttagtagagatggggttttactgtgttagccaggatggtctcaatctcctgacctcataatctgcccacctcagcctcccaaagtgctgggattacaggcgtgagccactgcacccagcctttttaaagtttttaattgacatataattgtacgtatttacagggtaaataatgatgttttgatacatatataatgatcagatcagaacaattagcatatccatcacattgaacatttatcatttatttgtgttgagcctttagttcttttttttttttgagatagagtctcactctgtcacccaggctggagtacagtggtgtgatcttggctcactgcaacctccacccaccggcttcaaccaattctcctgcctcagcctccctagtaactgggattacaggcacctgccaccacacccaatttttgtatttttagtagagacggggtttcaccatcttggccaggccaggctggtcttgatctcctgaccttgtgatccacccacctcagcttcccaaactgctgggattacaggcatgagccacggcccccagccagagacagtcttgctttgtcgccaggctggagtgtagtggcgccatcttggctcactgcaacctccaactccctggttcaagcagttctcctgcctcagcctcccaagtagctgggattacaggcacgcaccaccatgcccagctaatttttgtatttttagtagagacagggtttcaccatgttggccaggatggtcttgatctcctgacctcgtgatctgcccactttggcctcccaaagtgctgggattacaggtgtgagccaccgtgcccagccgagcctttagttctaagtataataaataatatatataccaggcattcctattaaaaatcttaacttaaaaaaaattactcaaatgttactactggaatttttctccctgaattgaagatacatggttagatcattaacaataccacctaaatgaaggaaacatatctggatatccagtgtcacatacttttatgtatttatttcaggaattactattttgtcaccataattaggaaacagactgtgttctttatttgaaacacaacagtataaatactatagtaaagttgggtgcagtggatcacagctataatcccagcactttgggagaccaaggagggatggtcacttgagcccaggagtttgagaccagcctaggcaacatagagagaccttgtctcaacaaaaaaatttaaagttagccaggtgtggtggtttgcacctatagtcccagctactcaggaggctgaggtgggaggatcgcttgagcttaggaggtcaaggctgcagtgagccatgattgtgccacttcaccctgggcaacagagaaagaccctgtctcaataaaaaagaagagaaaaactggagtgagaactctcctcctctcataatcatagtatccacgttaggaaaatgcttctgagagtaacttaaagtactgtgtgtgcatcttccttcaaaaccttgcttttttctccgtttttgtaaggtgagaaagggaaaaaccttcaccgtagaaatactgtcttgagattaagatacaaataaaacatgttaaacctccatctaaagacattgcaacttattaaaacagaaaaatgtacctttgttatgtctttccaaatatccacacccacaccctgttcagctttgttaataatacagagatcagaaatgtgaagcacaaatgctgcttctccccctcctgttcccatgtcagagatggagaagaaagcacagtgagctgttcaccagtccagcggtgacctcggagtcctttgtaacagtgtttccaataacttctgccaataaaacagaatttgagttagaacctatctgctgtccctcaactagtgtctgatagctgagaatgtaattcgtttgtgtgtctattagaaaattaggcaggcaccacagacagtagcaacataaaggaacctgcttagaagaggtttttatggtgtgattgtgtttttttttttttaatttttgtttcctgaagtagaatccatagctcaaaacaagttttaagcctgagaaaatataatttgaggtgttttttatgctcctaatgaaaagatgaatgaatgcatcattaaaccttaacagtagagcagaatttcactgttacaaaccacatgggttctcctggttgtgctgctgttctctacctgtgtgtcactgagtttgagcatcattattgtttgaatcagaggacccactggaatcaaggcttcttggaattgcgcaagaatctgagaaaacttcaatctttaccagcatttcttaatgctttccatgacttttgtgcaattatataagttcagtttagacaaaatgctgttactttttaaggcattactaataactgaaaatagttacgtcattgcccatcaagggaaaagcacttgtaactgtcatttaaaaaaaataaaactataaaacaata

SEQ ID NO: 200474 - DNA, 2737 bp, Homo sapiens
  Payload ID: 19558
  Gene Name: X-prolyl aminopeptidase 3, mitochondrial
  ENST ID: ENST00000428799
  CDS Start-End: 52-261
cgttccccgtcgttaccctctttctcttcccgacgcgtgagttaggccgtaatgccttggctgctctcagcccccaagctggttcccgctgtagcaaacgtccgcggcctctcaggatgtatgttgtgttcacagcgaaggtactcccttcagcctgtcccagaaaggaggattccaaaccgatacttaggccagcccagcccctttacacacccacacctcctcagaccagactcgaattcctgctgggaagtcggctgaaactaaggaaatgcagctcaccactgaaacccacaagaaatcagagtttttcaaagctgtaaggggaggtaactccaggactatctcaggtggaatatgcacttcgcagacacaaactaatgtctctgatccagaaggaagctcaagggcagagtgggacagaccagacagtggttgtgctctccaaccctacatactacatgagcaacgatattccctatactttccaccaagacaacaatttcctgtacctatgtggattccaagagcctgatagcattcttgtccttcagagcctccctggcaaacaattaccatcacacaaagccatactttttgtgcctcggcgagatcccagtcgagaactttgggatggtccgcgatctggcactgatggagcaatagctctaactggagtagacgaagcctatacgctagaagaatttcaacatcttctaccaaaaatgaaagctgagacgaacatggtttggtatgactggatgaggccctcacatgcacagcttcactctgactatatgcagcccctgactgaggccaaagccaagagcaagaacaaggttcggggtgttcagcagctgatacagcgcctccggctgatcaagtctcctgcagaaattgaacgaatgcagattgctgggaagctgacatcacaggctttcatagaaaccatgttcaccagtaaagcccctgtggaagaagcctttctttatgctaagtttgaatttgaatgccgggctcgtggcgcagacattttagcctatccacctgtggtggctggtggtaatcggtcaaacactttgcactatgtgaaaaataatcaactcatcaaggatggggaaatggtgcttctggatggaggttgtgagtcttcctgctatgtgagtgacatcacacgtacgtggccagtcaatggcaggttcaccgcacctcaggcagaactctatgaagccgttctagagatccaaagagattgtttggccctctgcttccctgggacaagcttggagaacatctacagcatgatgctgaccctgataggacagaagcttaaagacttggggatcatgaagaacattaaggaaaataatgccttcaaggctgctcgaaaatactgtcctcatcatgttggccactacctcgggatggatgtccatgacactccagacatgccccgttccctccctctgcagcctgggatggtaatcacaattgagcccggcatttatattccagaggatgacaaagatgccccagagaagtttcggggtcttggtgtacgaattgaggatgatgtagtggtgactcaggactcacctctcatcctttctgcagactgtcccaaagagatgaatgacattgaacagatatgcagccaggcttcttgaccttcactgcggcccacatgcacctcaggttcaaaatgggtgtcttctggcagccctgcacgtgtgctttctgagtgtctctgtgtgtgcattaatatatgcattccatttgggagcatagcagctgtgtgaatgtatgtaattgtgtgtggggggttttttgttttaagtagttagaagtctgggaaaatgaatttttgaatagtatgttactgcagctttggtaacattaattctatagaattaatgatcagagcaagtttaatttttaaacataaaggtcttggttacacatgtccatgcattccagttaacacatttaaacatatagaaaattcacttcttctttcaagtccttccctttctatacttttgctgagatcaacccaatatcataagaagtttgtgtgatgcctgtatttttagctaattaccaaggtctctgcctatgcaaaaattcatctttcggtgattgtgggcggccaatacataccttctgtaactcctccctacctattctagatcctgcatatctactggagccatatgagccctcaggggcactggtgtcctgcagtcttactagtcagccacagtccaggttccagcaacactagctacctaccaaacaaaacacttctgagcttttcttgccatttggttgcctgggacctggaaagtgtttagattcttgataaagatggaaatggaagagaaagaaaattatatatgtatatactaaagatccagacatcagggctgggcacagcggttccgcctgtaatcccagcactttgggaggtccaggcaggtggatctcttgagaccaggaggtcaagaccagcctggccaacgtggtgaaacactgtctctactaaaaatacaaaaatgagctgggtgtgatgatacatgcctgtaatcctggctacttgggaggctgaggcatgagaattgcttgaacctgggaggtggaggttgcagtgagctgagctcatgcgactgcactccagcctgggtgactgagcaagactctgcctcaaaaaaacaaataaataaataaaatcctgaca

SEQ ID NO: 200475 - DNA, 230 bp, Homo sapiens
  Payload ID: 19558
  Gene Name: X-prolyl aminopeptidase 3, mitochondrial
  ENST ID: ENST00000614001
  CDS Start-End: 63-230
gcaggcggttgcgttccccgtcgttaccctctttctcttcccgacgcgtgagttaggccgtaatgccttggctgctctcagcccccaagctggttcccgctgtagcaaacgtccgcggcctctcagggtcttactttgtcacccaagctggagtgcagtggcgtgatcccattacactgcaacctatgtcttccaggctcaagcagtctttctaccagcttcccgagtag

SEQ ID NO: 200476 - DNA, 4695 bp, Homo sapiens
  Payload ID: 19559
  Gene Name: X-ray radiation resistance associated 1
  Uniprot ID: Q6P2D8
  ENST ID: ENST00000321448
  CDS Start-End: 852-2405
ggccgcggggcttgctgggacttgaggttagacgtcccggccgtcggttgccgcctacactgtctgccgtcgcgtcgcagttactaaggcgtggggaagatagcggcaggcaccgcagtggagcggctccgagatccccggggggctcgcaggcgcgcatccctcctgactgggacgtcgcctccgcagacccctcggaggctgaagcgacgccggaggcaggccaaggacactggttagtggttcagaaaggtaacctcaagaagaagcccaagggtttggttggagcacaagctgaacgtcgggaaagcctgaaggcgacttcttttgagttcaaggggaagaaagagtctcggcgggaaaatcaggtggaccttcctggacatatcctggaccaggcttttctgctgaagcaccactgtgtgaggaagccatcagatctgtgcaccattaatgtgagtggcctgaagttctccaaggccaaggaaaatgacttcaagcattttcattctgtgatttatatcaatgcctcagaaaacctgctgcctctagaggcatttcacacgtttccagccctaaaggaactggatctcgcatttaatggcatcaaaactatctacgtgaaatatggagactttaagttattagaattcttggacctttccttcaacagcctgactgtggaggccatctgtgatttggggattctgccacacctccgtgtcctgctcctcacaggcaatggccttacctccctgccgcccaatttggccgtcgcagaacaggaggcatctgtaacatcgctgacaagcaagaggtacatcctgaggttcccagcgctggagacactgatgctggatgacaacagactctccaaccccagttgctttgccagcctggctgggctcaggagactgaagaagttaagcttggatgaaaacaggattatcaggatcccatacctacagcaagttcagctctatgacgagtcagtagactggaatggaggcaggggaagtccccataaagagccccaattcatgctgcagtccaagccaaggatgcttgaggactcagatgagcaactggattatactgtactgcccatgaaaaaggatgttgaccggacagaggttgtgttttcatcttaccctggattttcaacctcagagatcgcaaaagaggatgctgtcctaccagtagctctcttcccatctctctgcgagttcgtctttcataacaaccctctggtggcccatacacgaggggtccctccactgctgaagagcttcctccaggagcgactgggaatccacttaattcgaaggaagatagtaaagcctaagcatcatgttttgatgtctcggaaggaatcatggaaggtgaaaagcgaaatcccaaaggtgccgaagcagcctctggtgctccatcacccgcgcatgacgacaaccaagtctccctcaaaggatatgctagagccagaggcagagctggctgaagatctgcccactaccaaaagcacttctgtggagtcagagatgcccactgagaacctggaaggccattccccgtcttgccggaccttcgtgccactgcctcccatctgctccaactccactgtgcatagtgaagagaccctgtcccacctgagtgacacaactgtccgcctcagcccagagcgcccatcagatgaggactccaagagcacagagtccatcttcctgacccaggtgagtgaactgccttcctccgtcatccataaggatgatttagagttaaaggagaaagaccaaaagaaaccaccaacggcacccagagaggtgaaagggactcggaggaaactcccaactgccttccttcccagcaagtaccacggctatgaagaactgctgacagccaagcctgatccagccttcattgagccaaagggaatccagaagaatgcacaagccctgcaacaaatgctgaagcacccactcctgtgccactcctccaagcccaagctggacactcttcagaaaccctatgttcacaaagagaaacgggcccagagaatcccgattccacccccaaagaagactagagcccaacttctggatgacatcttcattcgcttgcgggatccccggaacattacagaggctccactaggtgctgtcctgcaccagtggacagaacggcggctggtgaaccacaagcagtacctggaggccaagaggctgttgaaggagttccaggcacgttaccggcagctggtgagtggctctctgcgcacagtgttcgggactaccccgctccccatggcctgcccagcgctgagtgagagccagcccaagttcggccacttcctcgagttcatggatgagttctgccaggagcccacagccagtgactcacaaggctagagctgtgcatgggggctgtgtgcaccacccggcctgtgccccagctctccccgagggctctgtgccctggaccgcacctcaaggttgaccagccggccacaggcctcagagctcagctgggccccacttgctggccacaaggtggcatccccttgtcaggatctcccctccttggcccaggcatgacctggtgcctggcccagcggcaataaagagtgggtgcacagggcaatagactgggtgccacatgcattctttcttggaacccaggccacagcagcattgtcacacttccctctaaaaatggttttccagttcagatgcaacagggatacatttgttctctgttgtatgagaaactgacaccaaggggatcttaacaaattcctgaacaatggctccaaaaaagggtatttttaaaaaccagatcttgtgagtacagccctaatgtgcagggacagtgtcatcctgtatattcgttctttactcagactctttcttggttccttcattaggagcatgaatggttgaatgtgaacatgacagtaaattggagcaaactgtaaactggacataacttatgccaaaagacgtagttgtacaccatggaaaccccatccctgctcctaatctctactgccattctgaatgccaaagcaagacatccaacatggggcatctcccagagcacatacagcaccaaaaatccacacacagcctaagcttaacccatgtttttgtctgagattgttcaccagagacaagactctgactataaacagaacatccactttcatgagtttcctttactgtattctcaacttgggccttgcttcaagcaggcaaacatacattgaagaatgcactttggtactgtttaaataacaacacatcagcccacttgattccatgccatgtccttgctgacagaaacatccccaacagggcatgccctggtccaagtcctctgtctttgtcaaaatgctcttctgatgagttggagaggaggcagccagcagtggcagtccacaaggatccaggtaccttctccaatcctaaagcagacagcaggttgaataaaaccaatacacaacctattttctaggcaggaggggaaaaggcccttaggacaataatatttgtacaaagagttgagagtaaacaaacagtgtatcaggttcaaaaaaaaaaaaactattcgttggcatttaaatttttttcccttgcatagtatctattctctcactaggacttttaagtgctctgctggaggctcagcgttggtaataccatgtttgatgcaaacttgaacccaatgctctcattggtggcacagctttggagggtggtggccccaagaaggggcaatctgcctgctgctatattaatctggaaccagggccaacagctactcttgaactatggtatttgaagagcgagttcattgcctgttttaccttaaatgacaggaaaggaagatgaacaaaccttgctttgccttggcttcaaactagttcttgatttaagacaccagaaagggagagagggagtctgcttagagtttgaggttgcctctcacaagatgacagttaaaagttgccaccttacttaaaaggcattaaggaggcatttactcacaaaggagagagagtaaatttttttcttaagaggaaaaaaatactgataatacatagaacaatctgcacatccagtcttggcactttttccaatttgactgatctctaaactggtgacccttgcatatatcttagtctcttttctacaatcttcttcagaaagctacagcagctaacaatcatgtataaagatgcatttcctagatcatcttcagaagaaaatctcttcagcactttccctagaatctgtctcctgaccaccccgccccagacctgctttctcttttgagaattcataaccaggtatgtttagataccagttcaaaagaccactctatgggttgatgaggaaaaggctgcctgaggacaatttaagaccataatgagtttccaatttttaaagaaaatttggctagctggcttttaattcttaattaaaatcattaaatttaattaaaattattccaatcaaaatatatcactttccaagattccacattcatattacttacttatactatggagactttctctacctgagcatgtattcaggggctataggtacatttaactctaactaactgaaaaaaatcaggaagaaaaaactattaaaataaaataacctcctaaatcatttgggggtatccccatca

SEQ ID NO: 200477 - DNA, 5681 bp, Homo sapiens
  Payload ID: 19559
  Gene Name: X-ray radiation resistance associated 1
  Uniprot ID: Q6P2D8
  ENST ID: ENST00000340360
  CDS Start-End: 333-2711
agtttgggtcttgctggcgcgaggtagtcagaggacgtggccgcggggcttgctgggacttgaggttagacgtcccggccgtcggttgccgcctacactgtctgccgtcgcgtcgcagttactaaggcgtggggaagatagcggcaggcaccgcagtggagcggctccgagatccccggggggctcgcaggcgcgcatccctcctgactgggacgtcgcctccgcagacccctcggaggctgaagcgacgccggaggcaggcaaagaaacaagtgaagaaacaaaaaaaaaaggaagttaaggggccattcccaaagtcaaagatcaaggagatggccttctcaggaatctacaagctggatgatgggaagccttacctgaacaactgcttcccagccagaaatctgcttcgcgtgccggaggaaggccaaggacactggttagtggttcagaaaggtaacctcaagaagaagcccaagggtttggttggagcacaagctgaacgtcgggaaagcctgaaggcgacttcttttgagttcaaggggaagaaagagtctcggcgggaaaatcaggtggaccttcctggacatatcctggaccaggcttttctgctgaagcaccactgtgtgaggaagccatcagatctgtgcaccattaatgccaaggaaaatgacttcaagcattttcattctgtgatttatatcaatgcctcagaaaacctgctgcctctagaggcatttcacacgtttccagccctaaaggaactggatctcgcatttaatggcatcaaaactatctacgtgaaatatggagactttaagttattagaattcttggacctttccttcaacagcctgactgtggaggccatctgtgatttggggattctgccacacctccgtgtcctgctcctcacaggcaatggccttacctccctgccgcccaatttggccgtcgcagaacaggaggcatctgtaacatcgctgacaagcaagaggtacatcctgaggttcccagcgctggagacactgatgctggatgacaacagactctccaaccccagttgctttgccagcctggctgggctcaggagactgaagaagttaagcttggatgaaaacaggattatcaggatcccatacctacagcaagttcagctctatgacgagtcagtagactggaatggaggcaggggaagtccccataaagagccccaattcatgctgcagtccaagccaaggatgcttgaggactcagatgagcaactggattatactgtactgcccatgaaaaaggatgttgaccggacagaggttgtgttttcatcttaccctggattttcaacctcagagacaaccaagatatgttcacttcctcccatattcgagatccttcctgtgaagtcactgaaggccaggaaccagacgctggccccacccttcccagagctgagataccttagcctggcctacaacaagatcgcaaaagaggatgctgtcctaccagtagctctcttcccatctctctgcgagttcgtctttcataacaaccctctggtggcccatacacgaggggtccctccactgctgaagagcttcctccaggagcgactgggaatccacttaattcgaaggaagatagtaaagcctaagcatcatgttttgatgtctcggaaggaatcatggaaggtgaaaagcgaaatcccaaaggtgccgaagcagcctctggtgctccatcacccgcgcatgacgacaaccaagtctccctcaaaggatatgctagagccagaggcagagctggctgaagatctgcccactaccaaaagcacttctgtggagtcagagatgcccactgagaacctggaaggccattccccgtcttgccggaccttcgtgccactgcctcccatctgctccaactccactgtgcatagtgaagagaccctgtcccacctgagtgacacaactgtccgcctcagcccagagcgcccatcagatgaggactccaagagcacagagtccatcttcctgacccaggtgagtgaactgccttcctccgtcatccataaggatgatttagagttaaaggagaaagaccaaaagaaaccaccaacggcacccagagaggtgaaagggactcggaggaaactcccaactgccttccttcccagcaagtaccacggctatgaagaactgctgacagccaagcctgatccagccttcattgagccaaagggaatccagaagaatgcacaagccctgcaacaaatgctgaagcacccactcctgtgccactcctccaagcccaagctggacactcttcagaaaccctatgttcacaaagagaaacgggcccagagaatcccgattccacccccaaagaagactagagcccaacttctggatgacatcttcattcgcttgcgggatccccggaacattacagaggctccactaggtgctgtcctgcaccagtggacagaacggcggctggtgaaccacaagcagtacctggaggccaagaggctgttgaaggagttccaggcacgttaccggcagctggtgagtggctctctgcgcacagtgttcgggactaccccgctccccatggcctgcccagcgctgagtgagagccagcccaagttcggccacttcctcgagttcatggatgagttctgccaggagcccacagccagtgactcacaaggctagagctgtgcatgggggctgtgtgcaccacccggcctgtgccccagctctccccgagggctctgtgccctggaccgcacctcaaggttgaccagccggccacaggcctcagagctcagctgggccccacttgctggccacaaggtggcatccccttgtcaggatctcccctccttggcccaggcatgacctggtgcctggcccagcggcaataaagagtgggtgcacagggcaatagactgggtgccacatgcattctttcttggaacccaggccacagcagcattgtcacacttccctctaaaaatggttttccagttcagatgcaacagggatacatttgttctctgttgtatgagaaactgacaccaaggggatcttaacaaattcctgaacaatggctccaaaaaagggtatttttaaaaaccagatcttgtgagtacagccctaatgtgcagggacagtgtcatcctgtatattcgttctttactcagactctttcttggttccttcattaggagcatgaatggttgaatgtgaacatgacagtaaattggagcaaactgtaaactggacataacttatgccaaaagacgtagttgtacaccatggaaaccccatccctgctcctaatctctactgccattctgaatgccaaagcaagacatccaacatggggcatctcccagagcacatacagcaccaaaaatccacacacagcctaagcttaacccatgtttttgtctgagattgttcaccagagacaagactctgactataaacagaacatccactttcatgagtttcctttactgtattctcaacttgggccttgcttcaagcaggcaaacatacattgaagaatgcactttggtactgtttaaataacaacacatcagcccacttgattccatgccatgtccttgctgacagaaacatccccaacagggcatgccctggtccaagtcctctgtctttgtcaaaatgctcttctgatgagttggagaggaggcagccagcagtggcagtccacaaggatccaggtaccttctccaatcctaaagcagacagcaggttgaataaaaccaatacacaacctattttctaggcaggaggggaaaaggcccttaggacaataatatttgtacaaagagttgagagtaaacaaacagtgtatcaggttcaaaaaaaaaaaaactattcgttggcatttaaatttttttcccttgcatagtatctattctctcactaggacttttaagtgctctgctggaggctcagcgttggtaataccatgtttgatgcaaacttgaacccaatgctctcattggtggcacagctttggagggtggtggccccaagaaggggcaatctgcctgctgctatattaatctggaaccagggccaacagctactcttgaactatggtatttgaagagcgagttcattgcctgttttaccttaaatgacaggaaaggaagatgaacaaaccttgctttgccttggcttcaaactagttcttgatttaagacaccagaaagggagagagggagtctgcttagagtttgaggttgcctctcacaagatgacagttaaaagttgccaccttacttaaaaggcattaaggaggcatttactcacaaaggagagagagtaaatttttttcttaagaggaaaaaaatactgataatacatagaacaatctgcacatccagtcttggcactttttccaatttgactgatctctaaactggtgacccttgcatatatcttagtctcttttctacaatcttcttcagaaagctacagcagctaacaatcatgtataaagatgcatttcctagatcatcttcagaagaaaatctcttcagcactttccctagaatctgtctcctgaccaccccgccccagacctgctttctcttttgagaattcataaccaggtatgtttagataccagttcaaaagaccactctatgggttgatgaggaaaaggctgcctgaggacaatttaagaccataatgagtttccaatttttaaagaaaatttggctagctggcttttaattcttaattaaaatcattaaatttaattaaaattattccaatcaaaatatatcactttccaagattccacattcatattacttacttatactatggagactttctctacctgagcatgtattcaggggctataggtacatttaactctaactaactgaaaaaaatcaggaagaaaaaactattaaaataaaataacctcctaaatcatttgggggtatccccatcattggtgcgtgtgtctgcgtgtgtcaaactttaatgattatttattcagaccctggaaaaccacactataaaatagggcactggatcacaagttcgtttggttaaaaaaaaaaaaaaaaaaaagtgggggcggggggcagagaagaagtttaacttggatgatttccatgcccattccagctgtaacattctatgactgtgacccagcctttgttctcttttctcactctcctactagacatttcaatgaaaagttaggcaggaaaaaggaaaggaatcccaagttgctgccagctctgatgagagatcaggttgggggagagattaggtggttactgaattgaggtgtgggcctcccctgaccatgtcagtgatccacaacccacctcacttcttggggcttaagctaaaagcagcttctgaagagatgttaatgtcctgtaatcactagaggagaaaattcattctccttccataacattacttagtaaaggaaaagcggtggtgcaatcaaattcacaaataccaatggggtctctaaaatgtagaatgcagcttgctgggtgctggtcagttttctaaatgggaccagaaatggctttcctaagaccataaatgaactctccagccacacatacattcaaatgcattccattagacattgagctcctcaagagcagg

SEQ ID NO: 200478 - DNA, 1588 bp, Homo sapiens
  Payload ID: 19559
  Gene Name: X-ray radiation resistance associated 1
  ENST ID: ENST00000531449
  CDS Start-End: 1-191
gcaggggaagtccccataaagagccccaattcatgctgcagtccaagccaaggatgcttgaggactcagatgagcaactggattatactgtactgcccatgaaaaaggatgttgaccggacagatcgcaaaagaggatgctgtcctaccagtagctctcttcccatctctctgcgagttcgtctttcataacaaccctctggtggcccatacacgaggggtccctccactgctgaagagcttcctccaggagcgactgggaatccacttaattcgaaggaagatagtaaagcctaagcatcatgttttgatgtctcggaaggaatcatggaaggtgaaaagcgaaatcccaaaggtgccgaagcagcctctggtgctccatcacccgcgcatgacgacaaccaagtctccctcaaaggatatgctagagccagaggcagagctggctgaagatctgcccactaccaaaagcacttctgtggagtcagagatgcccactgagaacctggaaggccattccccgtcttgccggaccttcgtgccactgcctcccatctgctccaactccactgtgcatagtgaagagaccctgtcccacctgagtgacacaactgtccgcctcagcccagagcgcccatcagatgaggactccaagagcacagagtccatcttcctgacccaggtgagtgaactgccttcctccgtcatccataaggatgatttagagttaaaggagaaagaccaaaagaaaccaccaacggcacccagagaggtgaaagggactcggaggaaactcccaactgccttccttcccagcaagtaccacggctatgaagaactgctgacagccaagcctgatccagccttcattgagccaaagggaatccagaagaatgcacaagccctgcaacaaatgctgaagcacccactcctgtgccactcctccaagcccaagctggacactcttcagaaaccctatgttcacaaagagaaacgggcccagagaatcccgattccacccccaaagaagactagagcccaacttctggatgacatcttcattcgcttgcgggatccccggaacattacagaggctccactaggtgctgtcctgcaccagtggacagaacggcggctggtgaaccacaagcagtacctggaggccaagaggctgttgaaggagttccaggcacgttaccggcagctggtgagtggctctctgcgcacagtgttcgggactaccccgctccccatggcctgcccagcgctgagtgagagccagcccaagttcggccacttcctcgagttcatggatgagttctgccaggagcccacagccagtgactcacaaggctagagctgtgcatgggggctgtgtgcaccacccggcctgtgccccagctctccccgagggctctgtgccctggaccgcacctcaaggttgaccagccggccacaggcctcagagctcagctgggccccacttgctggccacaaggtggcatccccttgtcaggatctcccctccttggcccaggcatgacctggtgcctggcccagcggcaataaagagtgggtgcacagggcaa

SEQ ID NO: 200479 - DNA, 5084 bp, Homo sapiens
  Payload ID: 19559
  Gene Name: X-ray radiation resistance associated 1
  ENST ID: ENST00000531849
  CDS Start-End: 903-1250
aatcgggatccgtagtttgggtcttgctggcgcgaggtagtcagaggacgtggccgcggggcttgctgggacttgaggttagacgtcccggccgtcggttgccgcctacactgtctgccgtcgcgtcgcagttactaaggcgtggggaagatagcggcaggcaccgcagtggagcggctccgagatccccggggggctcgcaggcgcgcatccctcctgactgggacgtcgcctccgcagacccctcggaggctgaagcgacgccggaggcaggccaaggacactggttagtggttcagaaaggtaacctcaagaagaagcccaagggtttggttggagcacaagctgaacgtcgggaaagcctgaaggcgacttcttttgagttcaaggggaagaaagagtctcggcgggaaaatcaggtggaccttcctggacatatcctggaccaggcttttctgctgaagcaccactgtgtgaggaagccatcagatctgtgcaccattaatgtgagtggcctgaagttctccaaggccaaggaaaatgacttcaagcattttcattctgtgatttatatcaatgcctcagaaaacctgctgcctctagaggcatttcacacgtttccagccctaaaggaactggatctcgcatttaatggcatcaaaactatctacgtgaaatatggagactttaagttattagaattcttggacctttccttcaacagcctgactgtggaggccatctgtgatttggggattctgccacacctccgtgtcctgctcctcacaggcaatggccttacctccctgccgcccaatttggccgtcgcagaacaggaggcatctgtaacatcgctgacaagcaagaggtacatcctgaggttcccagcgctggagacactgatgctggatgacaacagactctccaaccccagttgctttgccagcctggctgggctcaggagactgaagaagttaagcttggatgaaaacaggattatcaggatcccatacctacagcaagttcagctctatgacgagtcagtagactggaatggaggcaggggaagtccccataaagagccccaattcatgctgcagtccaagccaaggatgcttgaggactcagatgagcaactggattatactgtactgcccatgaaaaaggatgttgaccggacagatcgcaaaagaggatgctgtcctaccagtagctctcttcccatctctctgcgagttcgtctttcataacaaccctctggtggcccatacacgaggggtccctccactgctgaagagcttcctccaggagcgactgggaatccacttaattcgaaggaagatagtaaagcctaagcatcatgttttgatgtctcggaaggaatcatggaaggtgaaaagcgaaatcccaaaggtgccgaagcagcctctggtgctccatcacccgcgcatgacgacaaccaagtctccctcaaaggatatgctagagccagaggcagagctggctgaagatctgcccactaccaaaagcacttctgtggagtcagagatgcccactgagaacctggaaggccattccccgtcttgccggaccttcgtgccactgcctcccatctgctccaactccactgtgcatagtgaagagaccctgtcccacctgagtgacacaactgtccgcctcagcccagagcgcccatcagatgaggactccaagagcacagagtccatcttcctgacccaggtgagtgaactgccttcctccgtcatccataaggatgatttagagttaaaggagaaagaccaaaagaaaccaccaacggcacccagagaggtgaaagggactcggaggaaactcccaactgccttccttcccagcaagtaccacggctatgaagaactgctgacagccaagcctgatccagccttcattgagccaaagggaatccagaagaatgcacaagccctgcaacaaatgctgaagcacccactcctgtgccactcctccaagcccaagctggacactcttcagaaaccctatgttcacaaagagaaacgggcccagagaatcccgattccacccccaaagaagactagagcccaacttctggatgacatcttcattcgcttgcgggatccccggaacattacagaggctccactaggtacggctctgccacagctgccaggatcccagatccagttcacgcctgctggctaaaggcaaagaaagggcttgtgtcagtgcaggaaaggcccttagagagcaactgcctacatcagtctctacatgtagatggacaaaaggagagccagcgtgaggcagggagttgcctaaaatcacacagcatgttaaggtcctgaaccagggcttaagatagagtcaatgcataggggcagtaggaagtcagtgacttcccaagctggaaaggccatttttagccccttagcatcctcctgccacaccatcccattttccaagggtctctggacccaatcctcttgcttctggctaggtgagaaccaggatgagcttggtgcctctcctggcttcttttcctgcaggtgctgtcctgcaccagtggacagaacggcggctggtgaaccacaagcagtacctggaggccaagaggctgttgaaggagttccaggcacgttaccggcagctggtgagtggctctctgcgcacagtgttcgggactaccccgctccccatggcctgcccagcgctgagtgagagccagcccaagttcggccacttcctcgagttcatggatgagttctgccaggagcccacagccagtgactcacaaggctagagctgtgcatgggggctgtgtgcaccacccggcctgtgccccagctctccccgagggctctgtgccctggaccgcacctcaaggttgaccagccggccacaggcctcagagctcagctgggccccacttgctggccacaaggtggcatccccttgtcaggatctcccctccttggcccaggcatgacctggtgcctggcccagcggcaataaagagtgggtgcacagggcaatagactgggtgccacatgcattctttcttggaacccaggccacagcagcattgtcacacttccctctaaaaatggttttccagttcagatgcaacagggatacatttgttctctgttgtatgagaaactgacaccaaggggatcttaacaaattcctgaacaatggctccaaaaaagggtatttttaaaaaccagatcttgtgagtacagccctaatgtgcagggacagtgtcatcctgtatattcgttctttactcagactctttcttggttccttcattaggagcatgaatggttgaatgtgaacatgacagtaaattggagcaaactgtaaactggacataacttatgccaaaagacgtagttgtacaccatggaaaccccatccctgctcctaatctctactgccattctgaatgccaaagcaagacatccaacatggggcatctcccagagcacatacagcaccaaaaatccacacacagcctaagcttaacccatgtttttgtctgagattgttcaccagagacaagactctgactataaacagaacatccactttcatgagtttcctttactgtattctcaacttgggccttgcttcaagcaggcaaacatacattgaagaatgcactttggtactgtttaaataacaacacatcagcccacttgattccatgccatgtccttgctgacagaaacatccccaacagggcatgccctggtccaagtcctctgtctttgtcaaaatgctcttctgatgagttggagaggaggcagccagcagtggcagtccacaaggatccaggtaccttctccaatcctaaagcagacagcaggttgaataaaaccaatacacaacctattttctaggcaggaggggaaaaggcccttaggacaataatatttgtacaaagagttgagagtaaacaaacagtgtatcaggttcaaaaaaaaaaaaactattcgttggcatttaaatttttttcccttgcatagtatctattctctcactaggacttttaagtgctctgctggaggctcagcgttggtaataccatgtttgatgcaaacttgaacccaatgctctcattggtggcacagctttggagggtggtggccccaagaaggggcaatctgcctgctgctatattaatctggaaccagggccaacagctactcttgaactatggtatttgaagagcgagttcattgcctgttttaccttaaatgacaggaaaggaagatgaacaaaccttgctttgccttggcttcaaactagttcttgatttaagacaccagaaagggagagagggagtctgcttagagtttgaggttgcctctcacaagatgacagttaaaagttgccaccttacttaaaaggcattaaggaggcatttactcacaaaggagagagagtaaatttttttcttaagaggaaaaaaatactgataatacatagaacaatctgcacatccagtcttggcactttttccaatttgactgatctctaaactggtgacccttgcatatatcttagtctcttttctacaatcttcttcagaaagctacagcagctaacaatcatgtataaagatgcatttcctagatcatcttcagaagaaaatctcttcagcactttccctagaatctgtctcctgaccaccccgccccagacctgctttctcttttgagaattcataaccaggtatgtttagataccagttcaaaagaccactctatgggttgatgaggaaaaggctgcctgaggacaatttaagaccataatgagtttccaatttttaaagaaaatttggctagctggcttttaattcttaattaaaatcattaaatttaattaaaattattccaatcaaaatatatcactttccaagattccacattcatattacttacttatactatggagactttctctacctgagcatgtattcaggggctataggtacatttaactctaactaactgaaaaaaatcaggaagaaaaaactattaaaataaaataacctcctaaat

SEQ ID NO: 200480 - DNA, 690 bp, Homo sapiens
  Payload ID: 19559
  Gene Name: X-ray radiation resistance associated 1
  ENST ID: ENST00000531852
  CDS Start-End: 632-690
ggttgccgcctacactgtctgccgtcgcgtcgcagttactaaggcgtggggaagatagcggcaggcaccgcagtggagcggctccgagatccccggggggctcgcaggcgcgcatccctcctgactgggacgtcgcctccgcagacccctcggaggctgaagcgacgccggaggcaggcaaagaaacaagtgaagaaacaaaaaaaaaaggaagttaaggggccattcccaaagtcaaagatcaagccaaggacactggttagtggttcagaaaggtaacctcaagaagaagcccaagggtttggttggagcacaagctgaacgtcgggaaagcctgaaggcgacttcttttgagttcaaggggaagaaagagtctcggcgggaaaatcaggtggaccttcctggacatatcctggaccaggcttttctgttcttggacctttccttcaacagcctgactgtggaggccatctgtgatttggggattctgccacacctccgtgtcctgctcctcacaggcaatggccttacctccctgccgcccaatttggccgtcgcagaacaggaggcatctgtaacatcgctgacaagcaagaggtacatcctgaggttcccagcgctggagacactgatgctggatgacaacagactctccaaccccagttgctttgccagcctggctgggctcag

SEQ ID NO: 200481 - DNA, 1016 bp, Homo sapiens
  Payload ID: 19559
  Gene Name: X-ray radiation resistance associated 1
  ENST ID: ENST00000528219
  CDS Start-End: 851-1016
tcgcgtcgcagttactaaggcgtggggaagatagcggcaggcaccgcagtggagcggctccgagatccccggggggctcgcaggcgcgcatccctcctgactgggacgtcgcctccgcagacccctcggaggctgaagcgacgccggaggcaggcaaagaaacaagtgaagaaacaaaaaaaaaaggaagttaaggggccattcccaaagtcaaagatcaagccaaggacactggttagtggttcagaaaggtaacctcaagaagaagcccaagggtttggttggagcacaagctgaacgtcgggaaagcctgaaggcgacttcttttgagttcaaggggaagaaagagtctcggcgggaaaatcaggtggaccttcctggacatatcctggaccaggcttttctgctgaagcaccactgtgtgaggaagccatcagatctgtgcaccattaatgtgagtggcctgaagttctccaaggccaaggaaaatgacttcaagcattttcattctgtgatttatatcaatgcctcagaaaacctgctgcctctagaggcatttcacacgtttccagccctaaaggaactggatctcgcatttaatggcatcaaaactatctacgtgaaatatggagactttaagttattagaattcttggacctttccttcaacagcctgactgtggaggccatctgtgatttggggattctgccacacctccgtgtcctgctcctcacaggcaatggccttacctccctgccgcccaatttggccgtcgcagaacaggaggcatctgtaacatcgctgacaagcaagaggtacatcctgaggttcccagcgctggagacactgatgctggatgacaacagactctccaaccccagttgctttgccagcctggctgggctcaggagactgaagaagttaagcttggatgaaaacaggattatcaggatcccatacctacagcaagttcagctctatgacgagtcagtagactggaatggaggcaggggaa
